United States Patent 9,587,003 (MODIFIED POLYNUCLEOTIDES FOR THE PRODUCTION OF ONCOLOGY-RELATED PROTEINS AND PEPTIDES) - sequence listing, part 11

SEQ ID NO: 17512 - DNA, 1929 bp, Artificial Sequence
  Description of Artificial Sequence: Synthetic coding sequence
atggccttacgccagcgcgaggaattgcgcgaaaagttggccgctgctaaggaaaagaggcttttgaaccagaaacttggtaagatcaagacactaggtgaggacgacccctggcttgacgacaccgcggcctggatagaacgatctaggcagctgcagaaagagaaggacctggcggagaagagggcaaagttacttgaagagatggaccaggagtttggtgtatccaccttggttgaagaagagttcggtcagagaagacaggatctatactccgctcgcgaccttcagggactgactgtcgagcacgccattgatagttttcgggagggtgaaactatgatcctgactctaaaagataaaggtgtgcttcaggaggaggaagatgtcctggttaacgttaacctcgtcgacaaggaacgtgccgaaaagaacgtggagttacggaaaaagaagcctgactacttgccatacgcggaggatgagagcgtggacgacctggctcaacagaagcccaggagcatcctcagcaaatacgatgaagaactggagggagagcggccacattcttttagactggagcagggcggaacagccgatggtctaagagaaagggaattggaagaaatcagggccaagctgcgtctgcaggcacagagcctgtcaactgtaggcccaagactagccagtgagtacctaacaccagaggagatggtcacttttaagaagacaaagaggcgagtcaagaaaatccgcaagaaagagaaagaggtggtggtgagagccgacgatctcctgcccctgggcgatcagacacaggacggggacttcggttccagactccgcgggcgcggacgtaggcgcgtttcggaagtggaggaggaaaaagagccagtgcctcagccactgccaagcgatgacactagggttgagaatatggacatttctgacgaggaagagggaggcgctccccctccaggcagccctcaggtccttgaagaggacgaggcggagcttgaactgcagaaacagctcgagaaaggacgccggctgcgccaattgcagcagctccagcaactgcgcgactccggagagaaggtggtcgaaatcgtgaaaaagctcgaatcaaggcagagggggtgggaggaagacgaggatccggaaagaaaaggagccatcgtgtttaacgcaacgtccgagttttgtaggaccctgggggagataccgacctacggattggccgggaaccgcgaggagcaagaagagctgatggacttcgagagggacgaggaaagatccgccaacggcggctcggagagtgacggagaggagaacatagggtggagcacagtcaaccttgacgaggagaagcagcagcaggatttcagcgccagctcaacgacaatcctggacgaagagccaatcgttaacagaggactggctgccgctctcttactgtgccagaacaaagggctcctcgagaccactgtgcagaaagttgcaagggtcaaggcaccaaataagtctctgccttcagctgtgtactgtattgaggacaaaatggccatcgatgacaagtactcaagaagggaagagtacagaggattcacacaggatttcaaggaaaaggatggttataaaccagatgtcaagatcgagtacgtagacgagacaggaagaaaattgaccccaaaagaggcttttagacaattatcccataggttccatggtaagggctccggaaagatgaagactgaacgccggatgaaaaaactagacgaggaggccctgctgaagaagatgagcagttcagatacacctctggggaccgtggccttgttgcaggaaaagcaaaaagcccaaaaaaccccatatattgtgttgagtggctcagggaagagcatgaacgcaaatactatcacgaaatag

SEQ ID NO: 17513 - DNA, 4392 bp, Artificial Sequence
  Description of Artificial Sequence: Synthetic coding sequence
atgaagaagaaaacggtgtgcacattgaatatgggggacaagaaatatgaggacatggagggggaggagaacggagacaatacaatttccactggccttctctactctgaagctgacagatgccctatctgccttaattgccttctcgagaaagaagtcggctttcccgaaagttgtaaccacgtgttttgtatgacttgcatcctgaagtgggccgaaaccttggcctcatgccctattgatcgtaagccattccaggccgtttttaagttcagtgcactggagggttatgtgaaagtacaagtgaaaaagcagctgagagaaacgaaagacaaaaagaacgagaattccttcgagaaacaggtgagctgccacgagaattcaaagtcctgcattaggagaaaagcaatcgtccgagaagatctcttatctgccaaggtatgtgatttgaagtggatccatagaaactccctgtatagcgagacgggagggaagaaaaacgctgccataaagataaacaagccacagcgtagcaactggtccactaaccagtgtttccggaatttcttcagcaacatgttctcctccgtaagccacagtggtgaatccagttttacctatcgagcctactgcactgagttcattgaagcctcagagattagtgccttaatccgacagaaacggcatgaactggaactgtcttggttccctgacaccttgcctggaattggccgaattggattcattccttggaacgtggaaaccgaggtgctccccttgataagtagcgtgttgccaaggactatctttcccacatccacaatctcttttgaacatttcggcacatcgtgcaaaggctatgcactcgctcatactcaggaaggtgaagaaaagaaacaaacatctggcacgagcaataccagaggcagccgacggaagcccgcaatgactacccctacccgtcgctcaacgaggaacacaagagcagaaaccgcctcacagtcccagagatcccctatttcagataacagcggttgtgatgcacccggcaattctaacccgtctttaagtgttccttcctccgctgagtcagagaagcaaacacgccaagcccctaagcgaaaatccgttcgcagaggcaggaagccccccctgctgaagaaaaagctcaggtcatcagtagccgctcccgagaagtcttcctcaaatgactcagtcgatgaagagactgccgagtctgacacctcccctgtactagaaaaagaacatcaaccagatgtggattccagcaatatttgcaccgtgcagacccacgtggagaaccagtcagcaaattgcctgaagtcttgcaatgagcagattgaggaatctgaaaagcatactgccaattacgacacggaggagcgggttggaagctctagctctgaatcttgtgcacaggacctgccagtgttagtgggggaggaaggggaggtgaagaaactggagaatacgggcattgaggccaacgtcctatgtctggagtcagagattagcgaaaatattctggagaagggaggcgatcccctggagaagcaggaccagatctccggtctgagccagagcgaagtcaaaaccgacgtgtgcacagttcatctacctaatgatttcccgacatgtcttactagtgaaagtaaagtttaccagcctgtgtcctgccccttgtctgacttatctgagaacgttgagtcagtggtgaatgaggaaaaaattaccgagagcagtctggtggaaattactgagcacaaagactttaccctgaaaactgaggagctgattgagtcccccaagctcgaaagctcagagggtgagattattcagactgtggaccggcagagcgtaaagagccccgaggtgcagctgctggggcacgtggagaccgaagacgtagagattatagctacctgcgacacgtttggaaacgaagatttcaacaatatacaggactctgagaataatctgttaaaaaacaacttactcaatacgaaactagagaagtctttggaagagaagaatgagagtttaaccgaacatcccaggtcaaccgagctcccgaagacccacatcgagcagatccaaaaacacttttccgaggacaacaacgagatgatccccatggaatgtgattctttctgctccgaccagaatgaaagtgaagtcgaacccagtgtgaatgccgatctgaaacagatgaatgaaaatagcgttacccactgttccgagaataacatgccgtcctctgacctggccgacgaaaaggtcgagacagtgagccagccgtccgaaagcccaaaggacactatagataagaccaagaagccccggacacgacgtagtcgtttccacagtccttcaaccacctggtcacccaataaggatacccctcaagagaagaagcgccctcaatctcctagtcctcgtcgtgagactggcaaggaaagcaggaaaagccaatcgcctagccccaaaaacgaaagcgcaaggggcagaaagaagtctcggagtcagtcccccaaaaaggatatagccagggagcggcggcaatcccagagccggtctccaaagagagacacaaccagggagagcagacggagtgaatcactgtcccctcgacgcgaaacttcccgggagaacaaaagatcccagccacgggtcaaggacagtagtcctggggaaaaatcacgctctcagtctcgggaacgcgagagcgatcgcgacgggcagcgacgcgaacgggagcggcgcacccgcaagtggagccgctcccggagccattcaagatctccgagtagatgcaggactaaatcaaagtcttcatcatttggaaggattgatagagatagctattccccacgctggaaaggtagatgggcaaacgacggctggcgctgcccaagaggaaatgatcggtaccggaagaacgacccagagaagcaaaatgaaaacacccgcaaggagaagaatgacattcatctcgacgcagacgatcctaacagcgcagataagcatagaaacgactgtcctaattggattacagagaagatcaacagcggtccagatccacgcacgcgcaaccccgaaaagctgaaagagtcgcactgggaggaaaaccgtaatgagaacagcgggaattcgtggaataaaaacttcggatcaggttgggtgagcaaccgcggtaggggccgaggcaaccgcgggagagggacctaccgatcctcttttgcctacaaggaccagaatgaaaatcgctggcagaatagaaagcctctgagcggaaacagtaacagcagcgggtccgaaagctttaagtttgttgagcaacagagctacaagagaaagtcagaacaggagttttcttttgatacacccgccgatcgttctggctggacgagcgccagttcatgggcagtgagaaagactcttcctgccgatgtgcagaattactattcacggaggggcagaaattcaagcgggccccagtccggctggatgaagcaggaagaagaaacttcgggccaggattcaagcctgaaagaccagaccaaccaacaggttgatgggtctcagcttcctatcaacatgatgcagccacagatgaatgtcatgcaacaacaaatgaatgctcaacaccaacccatgaacatcttcccctatccagtgggtgttcatgctcctctgatgaatatacaaagaaatccgttcaatatacacccacagctgccattgcaccttcacaccggcgtgcctctcatgcaagtggccacaccaacatcggtgtcgcagggcctgcccccccccccaccaccccctccccctagccagcaggtaaattacattgcgtcccaacctgacggtaagcaacttcagggcattccttccagctctcacgtttcgaataacatgtcgacgcccgttctgccggcaccaaccgctgccccagggaacaccgggatggtgcagggcccctcctctgggaacacatcaagtagctcacatagcaaagccagtaatgctgctgtcaaactggccgaaagcaaggtgtccgtcgcagtcgaagctagtgccgactcaagtaagaccgacaaaaaacttcagatccaggaaaaggccgcccaggaggtcaagctcgctattaagcccttctaccagaacaaagacattacaaaggaggaatacaaagaaatagtaagaaaggcagtcgataaggtctgtcacagcaagagcggcgaggtgaacagtacgaaagtcgcaaacctggtgaaagcgtatgttgataagtataagtattccagaaagggatcccaaaagaagacactggaggagccggtgagtaccgagaagaatattggctag

SEQ ID NO: 17514 - DNA, 4392 bp, Artificial Sequence
  Description of Artificial Sequence: Synthetic coding sequence
atgaagaagaagacagtgtgcacgctaaacatgggcgacaaaaaatacgaagatatggaaggggaggaaaacggggacaatacaatttcaactgggttactgtactcagaggcagacagatgccccatttgcctcaattgccttctggaaaaagaggtgggattcccagaatcttgtaatcacgttttctgcatgacctgcattctaaaatgggctgagacgctcgcatcttgtcctattgatagaaagcctttccaggcagtgtttaagttttcagcactggaagggtacgtcaaggtgcaggtgaagaaacagctgcgggaaacaaaggataagaagaacgagaattcctttgagaaacaggtttcatgccacgaaaattctaagtcatgcattagaagaaaggctattgtgagagaagacctcctgagcgccaaagtgtgcgatctcaaatggattcacaggaatagcctgtacagcgagacagggggtaagaaaaacgctgctataaaaattaataagccacaacggtcaaactggtccaccaatcagtgctttcgcaactttttttccaacatgttctcctcggtaagtcatagtggggaatcctcttttacatacagggcatactgcacagagttcatagaagccagcgagatcagtgccttaattcgccagaaaagacatgaactggagctgtcttggttccctgatacactgcccggtattggcaggattggttttatcccttggaatgtggagacagaggttcttcctctgatctcttctgtgctgccccgcacgatttttccaacatccacgataagttttgaacactttgggacgtcatgtaagggctacgctctggctcatacacaggagggcgaggagaaaaagcagacctctggcacaagcaacactaggggctcgcggcgcaagcccgcaatgaccacgcccacccgacggtccacccggaacactcgcgccgaaacagcttcacagagtcagcggtcacctatctcagataactctggatgcgacgcccccggcaactcaaatccatccttatcagtgcccagctcagcggaatctgagaagcagactagacaggcaccaaagcgcaaatctgtgcgtcgcgggaggaagccaccactgctgaaaaaaaagctgaggagttcagtggctgcgcccgagaagagttctagtaacgactccgttgacgaagaaaccgccgagagcgacacgtctccagtgttagagaaggaacaccagccagatgtggatagtagcaatatctgtaccgtgcagacacacgttgagaatcagtcagcaaattgcctgaaatcctgcaacgagcaaattgaagagtccgagaaacacacggccaactacgacaccgaagagcgagtgggttcttcatctagtgaaagctgtgcccaggacctgcctgtgcttgtgggggaagagggagaggtgaagaagttggaaaataccggaatcgaagccaacgtcctctgcctggagagcgagatctccgaaaacatccttgaaaagggaggggacccgctagagaaacaggaccaaatttctgggctctcccaatcagaggttaaaactgatgtttgtacagttcatctgccgaatgattttccaacttgcctaacttcagagagcaaagtctatcagcctgtctcatgccctttaagtgaccttagcgaaaacgtagagagtgtggtcaacgaggagaaaatcacagaaagctcactggttgagattacagaacataaagattttacactcaagacggaggagttgatcgagagcccgaagctggaaagctccgagggcgagataattcagacagtggaccgtcaaagcgtgaaatcacctgaagtgcaattgcttggtcacgtggaaacagaagatgttgagattattgctacgtgtgatacattcggaaacgaggattttaataatatccaggatagcgagaacaatcttctgaagaataatttgttaaacaccaaactggaaaagtcactcgaggagaagaacgagtccttaaccgagcacccccgatctactgaactgcccaagacccacattgagcagattcagaaacatttcagcgaagataacaatgaaatgatccccatggaatgtgactcattctgcagtgatcaaaatgaatcagaagtcgaaccttccgtaaacgccgatcttaaacagatgaatgagaacagcgtgacccattgttccgagaataatatgccctcctcagatctggcagatgaaaaagttgagacagtttctcagccgtccgagtctcccaaggatacaatagataagactaagaagcctaggacccgtcggtccagattccatagtccaagcactacatggtcccccaacaaggacacaccccaggaaaaaaaacgtccacagtctccatcacctcggagagagaccggcaaagaatcaaggaaatcccagtccccctctccgaaaaacgagtccgccaggggtagaaaaaagtctcggagtcaatctccaaagaaggacatcgcgagggaaaggaggcagtcacagtcacgctccccgaaacgcgacaccactcgggagtcccgcagatccgaaagtctgagccctagacgggagacatccagagaaaacaaaagatcccagccaagagtaaaggatagctctcccggagagaaaagcagatcccaatcaagagaacgagagtcagaccgcgatggccaaagacgcgagcgcgagcggaggacaagaaagtggagtaggtccagatcgcattcaaggagtccatcaaggtgccgcacaaagtccaagtcaagctccttcgggaggattgaccgagattcctattccccccgttggaagggtagatgggcgaatgatggctggcgctgtccccgcgggaatgacaggtaccgcaagaacgacccggagaagcagaacgaaaatacaagaaaagaaaaaaacgatattcatctcgacgccgacgatcctaacagcgccgacaagcatcgtaatgattgtcccaactggattacggaaaaaataaattcaggtcctgaccctcgaaccaggaatcccgaaaagctcaaggaatcacattgggaggagaatcggaacgaaaacagcggcaatagttggaacaagaactttgggagcgggtgggtgtccaaccgcggacgagggcgtgggaacagggggagaggcacttatcggagttctttcgcctacaaggaccagaacgaaaatagatggcagaaccgaaagcccctgagtggcaattccaattctagcggctctgagtcattcaagtttgttgagcaacagtcctacaaaagaaagtccgagcaggaattctccttcgacactcccgccgataggagcggttggacctcggcaagctcctgggcggttcggaaaacgttgcccgccgatgtgcagaactattattccagacggggacgtaactcctccggccctcagtccgggtggatgaaacaggaggaagaaaccagcgggcaagactcgagccttaaagaccaaactaatcagcaggtcgacggatcacagctccctattaacatgatgcagcctcagatgaatgtaatgcagcagcagatgaacgcacagcaccagcccatgaacatctttccatatcccgtgggcgtgcatgctccactcatgaacatccagaggaacccgttcaatatccatccacagcttccccttcatctgcacacgggagtgccactgatgcaagttgccacccctacttctgtgtcccagggtctccccccacccccccccccacctccgccctctcagcaggtcaattacatcgcttcacagcccgacggcaaacagttacagggcattccaagtagctcacacgtctccaacaacatgtccacaccggttcttccggcccctaccgctgcccccggaaatactgggatggtgcaggggccctcatccggtaatacatcttcctcctcccactctaaggccagtaatgccgctgtcaaactggccgagagcaaagtgtcagtggccgtggaggcctctgccgacagtagcaagactgacaagaagctccagatccaggaaaaagccgctcaggaggtgaagctagccattaagcccttctatcaaaataaagatattactaaggaagaatataaggagattgttagaaaggcagtggataaagtgtgtcacagcaaaagcggagaagtcaacagcaccaaagtcgctaacctagttaaggcttacgtcgataagtacaaatactctcgtaagggatcccagaagaagactctggaggagcccgtttccaccgaaaaaaacattgggtag

SEQ ID NO: 17515 - DNA, 3447 bp, Artificial Sequence
  Description of Artificial Sequence: Synthetic coding sequence
atgaccacaccaaccaggaggtccacaaggaataccagagcagaaacagcgtcacaaagccagcggagcccgatatccgacaactcaggctgcgacgccccaggcaactctaatccaagcttgtctgtgccgtcaagcgcggagagtgaaaagcagacaagacaagctccaaaaaggaagagcgtgaggaggggccggaaaccaccactgcttaaaaagaagctgaggtccagcgttgcagcaccggagaaatcatcctcaaacgactccgttgacgaggaaacggccgaaagcgacactagccctgtgctagagaaggagcaccagccagatgtcgactcatccaatatttgtaccgtgcagacccacgtggaaaaccagtcggctaactgtctgaagagctgcaatgagcagatagaggagagcgaaaaacacaccgcgaactacgacactgaagagcgggtagggagtagctcgtcagaatcctgcgcccaagaccttccagttctagttggggaggagggagaagttaaaaaactagagaacacaggaattgaagccaacgttctgtgtctagagagcgaaatatctgaaaacatcctggagaaaggcggggaccccttggagaagcaggatcagatcagcggtctctcacagtcggaggtgaaaaccgatgtatgtacagtgcacttacctaatgatttcccaacgtgtttgactagcgagtccaaagtgtatcagcctgtgtcgtgcccccttagcgatttgagcgagaatgtggagagcgtagtgaacgaggaaaaaattactgaaagcagtctcgtggagatcactgaacataaagacttcaccttgaaaactgaggagctgatcgaatcaccaaaacttgagtctagcgaaggtgaaattatccagacagtggaccggcagtccgtgaagtcacccgaggtacagctactcggtcacgttgagactgaggatgtcgaaataatcgccacttgcgatacatttggtaatgaggattttaataatattcaggactccgagaacaacctgcttaagaacaaccttctgaatactaaactagagaaatccctggaagagaaaaacgaaagtctcacggagcacccacggagtacagagctccctaaaacccacatcgaacagatccagaagcatttcagcgaggataacaacgagatgatacccatggagtgcgattcattctgctctgaccaaaacgaatccgaggtagagccttcagtcaatgcagatcttaagcagatgaatgagaattcagtaacccattgtagcgaaaacaacatgccttcaagcgatttggccgatgagaaagtggaaaccgtctcacagccgagtgaatcgccaaaggacaccatcgacaagaccaaaaaaccaagaaccagacggtctaggttccactcccctagcactacatggagccccaacaaagacacaccacaggaaaaaaaaaggccacaaagcccgagtcctagaagagagaccggtaaagagtcgcgtaaaagccaaagcccttcaccaaaaaacgagagtgccagggggcgtaagaagagtcgcagtcagtcgccaaagaaagacattgcccgggaaaggcggcagtcgcagtccaggagcccaaaaagggatacgactagggaaagtcgccgctctgaatccctgagcccaaggcgcgagacaagccgggagaacaagcggagccagccaagagtgaaagacagcagccccggggaaaagtccaggagccaatcgagagagcgtgaatccgacagggacggccagagacgcgaaagggagcgccgcacacgcaagtggagcaggagtcggagtcactctcgtagtccatcccgatgtcgtacaaagagcaaaagcagtagcttcggccgtatagaccgggactcatacagtcctcgctggaagggccggtgggctaacgacgggtggcgttgtcccagagggaacgacagatatagaaaaaacgatcccgaaaagcaaaatgagaacacaagaaaggaaaagaacgacattcacctcgatgccgatgaccccaactccgccgataaacaccgcaatgactgccctaactggatcactgagaaaataaactccggccctgaccctagaacaagaaaccctgaaaagttgaaagagtcacactgggaggagaatagaaacgagaattcaggcaattcctggaataagaactttgggtctggatgggtaagcaaccggggacgtgggagagggaaccgtggcagagggacatatcgctcgtcctttgcgtataaggatcagaacgaaaataggtggcagaatcggaagcccctaagtggcaactcaaatagttccggcagtgaaagcttcaaatttgtggagcagcaatcctataagcgcaaaagtgagcaggaattctcattcgacacgcccgctgataggagcggctggacctctgcaagctcttgggcagttcggaaaacgttgcccgccgatgtgcagaattattactccagacgtggaaggaatagtagcggtcctcagtcaggatggatgaagcaggaagaggaaacatccgggcaagacagttcacttaaagaccagactaatcagcaggtggacgggtcccagctgccaatcaacatgatgcagccccagatgaacgtcatgcagcagcagatgaatgcacaacatcagcctatgaacatattcccgtatccagtgggcgtgcacgcccccctcatgaacatccaaaggaatccttttaacatacaccctcagctccccctgcacctgcataccggagtgccactgatgcaggtggcaacccccacgtcagtgagccagggcctgcccccgccaccgccaccccccccgccatcccagcaggtgaattacattgcctctcaaccagacggtaagcaattgcagggcattccttcttccagccacgtcagtaataacatgagtactcccgtattgccggcccccaccgcagcgcctggcaacaccggcatggttcaggggccaagcagcggtaacacatcatccagttcacactctaaagcgtcaaacgccgcagtcaagctggccgaatccaaggttagcgttgccgtcgaagcctcggcagacagctccaaaaccgacaaaaaattacaaatccaggagaaagccgctcaagaggtgaagctggcaatcaaaccattctatcagaataaggacataactaaagaggaatacaaggagatcgtgaggaaggcagtggacaaggtctgccacagcaagtcaggcgaggttaattccacgaaagttgccaatttggtcaaggcttatgtggataaatataagtacagtcgaaagggctctcagaagaagacgttagaagaacctgtgtcaacagaaaagaacatcgggtag

SEQ ID NO: 17516 - DNA, 1401 bp, Artificial Sequence
  Description of Artificial Sequence: Synthetic coding sequence
atggcggaggaacaggacttgtcagaggttgaacttagtcctgtgggcagcgaagagccacggtgcctttcacccggctctgctccgagcctcgggcccgacgggggagggggtggaagcggccttcgggcctccccagggcctggtgagctgggcaaagtcaagaaagaacagcaggacggtgaagccgatgacgataaatttcccgtgtgcattcgggaggcagtctctcaggtcctgtccggttacgactggactctggtaccgatgcccgtccgagtgaacggagcctctaagagcaagcctcacgtaaagagacctatgaatgctttcatggtctgggcgcaggctgctagacggaagcttgcagaccagtacccccacctgcataacgccgaactatctaaaacccttggaaagctgtggcgattgcttaatgaatctgataaaaggccattcatagaagaggccgaacggctgcgaatgcagcataagaaagatcaccccgactataaataccagcctcggcgacgcaagaacggcaaggccgcacagggcgaggccgagtgccccggaggggaggccgagcaaggcgggactgcagcaattcaagcacattacaaatccgcacacctcgatcacagacatcctggtgaagggtccccaatgtcggacgggaaccccgagcacccgtcagggcagtcccacgggcctccaacaccccctacgactcccaagactgaactccaaagtggtaaggcagaccctaagcgcgatggccgctccatgggcgaagggggaaagcctcacatcgattttggaaacgtcgacattggagaaattagccatgaagttatgtctaatatggaaactttcgatgtggcggagttggatcaataccttccgcccaacggtcatccaggtcacgtgtctagctattctgccgccgggtatggactaggatcggctctcgccgtcgcctctggtcactctgcctggatctctaagcctccaggagtggctttgcctaccgtgtccccgccaggtgtggatgcgaaagcacaggttaaaaccgagactgcgggaccccaagggcctcctcattatacagaccaaccaagcaccagtcagatcgcttacacatccctgagcctcccccactatggctcagcatttccgagcatcagtcggcctcagttcgactactcggaccaccagccatccggaccatactacgggcattctggacaggcctcagggctgtactcagctttctcctacatggggcctagccagagacccctgtacacagcaatatctgaccccagcccaagcggaccccagtcccacagtcccactcattgggaacaaccggtgtacaccactctgtctaggccatag

SEQ ID NO: 17517 - DNA, 1401 bp, Artificial Sequence
  Description of Artificial Sequence: Synthetic coding sequence
atggccgaagagcaagatctgtccgaggtagagctctctcccgtgggttccgaggagcctcggtgcctgtcacctggatctgcaccctcacttggcccagatgggggcggagggggctctggcttgagagccagtcccgggccgggagaactcggcaaggtgaaaaaggagcaacaagacggagaggctgatgacgacaaattccctgtgtgcatccgtgaggccgtatctcaggtgctgtcaggttacgactggacattagtcccaatgcctgtacgagtgaatggtgcatccaaaagtaagccccatgtcaaaagaccaatgaatgcatttatggtgtgggcacaagcagcccgaagaaaactagccgaccaatatccccatctacataatgccgaactgagcaaaactctgggtaagttgtggaggcttcttaacgagtcagacaagcgaccgtttatagaagaagctgaacgactccggatgcagcacaaaaaggaccacccagattacaagtatcagcctagaagacggaaaaatgggaaagcggcacagggagaagctgaatgccccggaggggaagccgagcagggagggactgctgctatccaggcacactataagagcgctcacctcgaccacagacaccccggggaggggagcccaatgtctgatggaaaccccgagcacccctcgggacagagccacggtccacctaccccccctactactccaaaaactgaactgcaaagtggtaaggctgacccaaagcgcgacgggcgttccatgggtgaaggaggaaaaccacacatcgatttcggaaacgtcgacattggagagataagccatgaagtcatgagtaatatggagaccttcgatgtggccgagctcgaccagtacctaccacctaatggtcatcccggccacgtctccagctactcagcggctggatacggcctcggaagtgccctggccgtcgcaagcgggcacagtgcctggatttcaaagccaccaggcgtcgctctacccacagtctcccccccaggggtagatgcaaaggctcaagtaaaaacggagactgccggtccacagggaccaccccattataccgaccagcctagcacatctcagattgcatataccagcctgagtctaccccactatggctccgcatttcctagcattagtaggccacaatttgattacagcgaccaccaaccgtccggcccgtactatggccacagcggacaggcatcggggctctatagcgccttttcatatatgggaccctctcaacggcctctatacaccgcaatctctgacccaagccctagcggaccgcaaagtcactctcccactcattgggaacagcctgtctataccacgctgtcacgcccttag

SEQ ID NO: 17518 - DNA, 861 bp, Artificial Sequence
  Description of Artificial Sequence: Synthetic coding sequence
atggccgaagagcaggacttgtctgaggtcgagctcagcccagtgggatcggaagaacctaggtgcctttcaccaggatctgcacctagcctggggcccgacggcggcggcgggggaagcggactgagagccagtcccggcccgggtgaactcgggaaagtgaaaaaggagcagcaggatggagaagccgacgatgataaatttcctgtgtgtatcagagaggccgtatcacaggtgctctcagggtacgattggacactcgtacccatgcccgtgcgcgtgaacggggcaagtaagtccaagccccacgtgaagcgacctatgaatgcatttatggtttgggcgcaagctgcccgtcgcaagctcgctgaccagtacccccatctacataatgcagagctatcaaagaccctaggcaagctctggcggctgctgaacgaatccgacaaacgccccttcatagaagaggcggagcggctacggatgcaacataagaaagaccacccagactataagtatcaaccgcgccgccggaaaaatggtaaggcagcacaaggcgaagccgaatgtccaggcggggaggctgagcaagggggtactgcagccatccaggcacactataaatctgcccacctcgatcatagacaccccggggagggaagccccatgtcagacggtaacccagagcacccgtcaggccagtcgcacggaccgccgaccccccctactactccaaaaactgaactacagagcgggaaagctgaccccaagcgtgacggtagaccttcaccttccggcccccagtcgcactcgcccactcactgggagcagcctgtctataccaccctcagtcggccctag

SEQ ID NO: 17519 - DNA, 642 bp, Artificial Sequence
  Description of Artificial Sequence: Synthetic coding sequence
atggccgaagaacaggatctaagcgaagttgagttaagccccgttggatctgaggaaccgcgttgtctctcgcccggatccgcgccatcactcggtccagatggtggcggcggggggtccggtttgcgtgcctctccaggccctggagagctgggtaaggtgaaaaaagagcaacaagatggcgaagcagacgacgacaagttccctgtttgcataagagaagctgtctcgcaggtgctctctggatatgattggaccctggtcccgatgcccgtccgagtcaatggggcctcaaagtctaagccacatgtcaaaagacccatgaacgcattcatggtgtgggcccaagcggcacgtaggaagctcgccgatcagtacccacaccttcataacgcagagctcagtaagactctgggaaagctttggcggttacttaatgaatccgataagagaccttttatcgaggaggccgagcggctccgcatgcagcataagaaggaccatccggactacaagtatcaaccccgaaggcgaaagaacggtaaagcagctcagggggaggctgaatgtccaggaggtgaggccgagcaaggaggaaccgccgcaattcaagctcattacaaatcggcgcatcttgactag

SEQ ID NO: 17520 - DNA, 1425 bp, Artificial Sequence
  Description of Artificial Sequence: Synthetic coding sequence
atggtgcagcagacaaataatgccgagaataccgaggccctcctggccggagagagctctgacagcggggctgggctcgagcttggcatagcctccagtcccacgccgggcagtaccgcctcgacggggggtaaggcggacgatcctagctggtgcaaaaccccatctggacatataaaaaggcctatgaatgctttcatggtttggtcacaaattgagagacgcaaaattatggagcagagccctgacatgcacaatgccgagatttccaagagactgggtaaacgctggaagctcctaaaagacagtgataaaattccattcatcagagaagcggagagactgcgactcaaacacatggcggattaccccgactacaaatacagaccacgcaagaaagtaaagagcggcaacgctaactcttctagttctgccgcagctagcagtaagcctggagagaaaggagacaaggtcggaggctccggtggtgggggacacggcggaggaggaggcggaggcagctcaaacgccggggggggaggaggtggcgccagtggcgggggggctaacagcaaacctgcacagaagaagtcatgtggctctaaagtggctggcggggccgggggtggtgtgtccaagccccatgccaagctgatcctcgctggaggcgggggcggcggaaaagccgccgcagccgcggcagcgtcttttgccgccgagcaagcaggagccgcagcccttctcccattaggtgccgcagcggaccatcattcactttataaggcaaggacaccttcggccagcgctagcgcttcctctgctgctagcgcctctgccgccctagctgcccccggaaagcacctggcagaaaaaaaggtaaagcgcgtgtatctatttggcggcctgggcacctccagtagcccagttggtggggtgggggccggggcagacccttccgacccattgggcctgtacgaggaggaaggcgccggatgttctcccgacgccccctccttatctggtaggtcatccgctgccagctctcctgctgcgggcagatcacccgccgaccaccgaggatacgcaagcctgcgcgctgcctctcccgcccctagttcagctccatcacacgccagtagctctgcatcctcccattctagctcaagctcctcgtctggtagtagctcaagcgatgacgaatttgaagacgatttactggacctcaacccctcttcaaactttgagtcaatgagccttgggtccttcagttcttctagcgccctggacagggatctcgattttaactttgaacccgggtcggggtcccacttcgagttcccagactattgtaccccggaagtcagcgaaatgatctcaggagattggctggagagctctatcagcaatcttgtgttcacttattag

SEQ ID NO: 17521 - DNA, 1425 bp, Artificial Sequence
  Description of Artificial Sequence: Synthetic coding sequence
atggttcagcagacgaataacgcagagaataccgaggcgttattagcaggcgaaagctccgatagcggagctggcctggagctcgggatcgcgagctcccctacgcccgggtcgactgcgagcacgggcggcaaagcggacgatcctagttggtgtaaaactccttcaggccacatcaagaggccaatgaacgcgttcatggtgtggtctcagatagaacgccgtaagatcatggagcaatctccagatatgcacaacgccgagatctctaagagattgggcaaaaggtggaaactgctcaaggatagcgacaagatccccttcatccgtgaggccgagaggcttaggctgaagcatatggctgactaccccgactacaagtataggcctcgcaaaaaagtgaaatctggaaacgctaacagctcctctagtgccgctgcttcaagtaaaccgggggaaaagggagacaaagtgggcggatcgggaggcggcggtcacgggggtggcgggggcggtggatcctcaaatgccggcggggggggcggtggagcgtccgggggtggggcaaactcaaagcctgcgcagaagaaatcttgcgggtctaaagtggccgggggagccggaggaggggtgtccaaaccacacgccaagctaattttggccggaggcggtgggggcggcaaagccgccgccgccgccgcagcttcctttgccgcggagcaggctggagcagcggctcttctgcctctgggcgccgccgcagaccaccattctctgtacaaggcgcgaaccccgtctgcatctgccagcgcttcttcagccgcctcggcgtccgccgctctggcagcccccggtaaacatttggccgaaaagaaggtcaagcgtgtctatctgttcgggggcctgggtacctcgtcctcacctgtggggggcgtgggcgctggcgcagacccaagcgatcccctcggtctctatgaggaggaaggagctggctgctcccccgatgctcctagtctgtctggccgctccagtgcagcatcttcaccagccgctggtagatcccctgcggatcatagaggatacgcttctttgcgggcggcaagccctgcaccgtcttcagccccctctcacgcctcttcctctgcatcctcgcattcatctagttcttcttccagtgggtcctctagcagtgacgacgaatttgaggacgacttgttggaccttaacccttcatcaaatttcgagagcatgtccctagggagtttttcctcatccagcgcactggatcgagacctcgactttaactttgaaccaggctcgggcagtcactttgaattcccggactactgcacacccgaggttagcgaaatgatttctggtgactggttggagtccagtatctctaatttggttttcacttattag

SEQ ID NO: 17522 - DNA, 3318 bp, Artificial Sequence
  Description of Artificial Sequence: Synthetic coding sequence
atgcttgaacctagttccgtgttacacgccaatgtcaaccaagcccctctctggtgtctggtgctcaggtggtgccgtgagtgtaaggataccgtgtgcggcgggaagcagaagtctcgggtgaaccacacatttcagcgccgcgagattgaagcaaaagaagcctgcgattggctcagggctgctggttttcctcaatacgctcagctctatgaagacagccagtttcccatcaacatcgtagccgtgaaaaacgatcatgactttctggagaaagacctggtggaaccactgtgtcggcggctaaatactctaaataagtgtgcttccatgaaactggacgttaacttccagcgcaagaagggcgacgattccgacgaagaggatctgtgtatttccaataaatggacattccagcgaacctctagacgctggagccgtgtggacgacttatatactctgctgcctcggggcgatcggaacggaagccccggcggcacagggatgcgcaataccacctctagtgagagcgtgttaacggacttgagcgaaccagaagtctgctcgatccacagcgagagctctggtggaagtgattctcgctcacagcctggtcagtgctgcacagataaccctgtgatgttggatgcacctctggtctccagctcactgccacaacctccaagagacgtgctaaaccacccatttcacccgaagaatgaaaaaccgacacgtgcccgcgctaaaagctttctcaagagaatggaaacactgagagggaaaggtgcccacgggagacataagggaagcggacggacagggggactcgtgatctccggccccatgctgcagcaggagccggaatctttcaaagcaatgcagtgcattcagatccctaacggagaccttcagaattctccgcccccagcctgtcgcaaaggcttaccctgcagcggtaagtctagcggcgaaagttcgccctcagagcatagcagtagtggtgtgtcgacgccctgtctgaaggagcgtaaatgccatgaagccaacaaacgaggtgggatgtacctcgaggacttggacgtgctggctggaaccgccctccctgacgccggagaccagagtcgcatgcatgaatttcacagccaggaaaacctggtggtacacatccccaaggatcacaagcctggcaccttccctaaagccttgtctatcgaaagcctaagcccaaccgattcaagcaatggtgtcaactggcgcaccggctctattagtctgggacgggaacaggtccctggagcacgagagccccggctcatggcgagctgtcaccgggcttctcgagtgagcatttatgacaacgtccccggcagtcacctctacgcctctactggtgaccttctggacctggaaaaggacgacctgttcccacacctggacgatattcttcagcacgtcaacgggctccaggaagtggtggacgattggtccaaggatgtactgcccgaattgcaaacccacgatacactggtcggagagccaggtctgtctacatttccctcacccaatcagataacacttgatttcgagggaaactccgtctctgaagggcgaaccacacccagtgatgtggagcgcgacgtaacttctctgaacgagtcagaacccccgggcgtgcgtgaccggcgggatagcggcgtgggagccagcttaacgagaccaaaccggagactcaggtggaatagctttcagctgtcacaccagcctcgccccgcaccagcttccccccacattagctcccagacggcttctcagctatctctgctgcagcggttttccttgctccgattaaccgcaattatggagaagcactccatgtccaataagcatggttggacctggtcagtcccaaaattcatgaagcgtatgaaggtacccgactataaagacaaagctgtttttggagtcccactgattgtgcacgtccaacgcacaggacaacccctgccgcaaagcatacagcaggccctgagatatctgaggagtaattgtctagaccaggttggactgtttcggaaatctggagtaaagtctaggattcacgctcttcgacaaatgaatgagaactttcccgaaaatgtgaattacgaagatcagtctgcgtacgatgtcgccgacatggttaagcagtttttccgcgacctgccggagcctttgtttaccaataaactgagcgagactttcctacacatataccagtacgtctctaaggagcagcgtctccaggcagtgcaagcagccatactgctactagctgatgagaatagggaggtacttcagacactcctatgctttttaaatgatgtagtcaacctggtggaagagaatcagatgacaccaatgaatctggcggtttgtcttgctcctagcttgtttcacctgaacctgcttaagaaagagagtagtccacgggtgattcagaagaagtacgccaccggcaaacccgaccaaaaagacctgaatgaaaatcttgcagcagcccagggattggcgcatatgatcatggagtgtgacaggttattcgaggtaccccatgaactcgtggcccagagcaggaacagctacgtggaagccgaaatccacgttccaacgctggaggagcttggtacacagctcgaagaaagcggagcgacttttcatacatatttgaatcaccttattcaaggcctgcagaaggaagcgaaagagaagtttaaagggtgggtaacatgttcctcaaccgacaacactgatctagctttcaaaaaagtcggagacggtaaccccctaaaattgtggaaagctagtgtggaagtagaggcgcccccgagcgttgtacttaacagagtgctgcgggagcgtcatctatgggacgaggattttgtgcaatggaaggtcgtggaaactctggatcgacagactgaaatctaccagtacgtgcttaacagcatggccccgcacccaagtagggatttcgtggtgctgagaacctggaaaactgatctcccaaagggaatgtgcaccttggtgtccttgagcgtggagcatgaagaagcccaattattgggtggcgttcgcgctgtcgtgatggactctcagtaccttatcgaaccttgtgggtccggaaagagtcggctcactcacatatgtcgcattgacctgaagggccactctcccgagtggtatagcaagggatttggccatctgtgcgcagccgaagttgctcgtatcagaaactccttccagccgcttatcgctgaaggacccgagactaaaatatag

SEQ ID NO: 17523 - DNA, 3342 bp, Artificial Sequence
  Description of Artificial Sequence: Synthetic coding sequence
atgttcagtcaagtgccacgaactccggcttcgggttgctattacctgaattcaatgacacccgaggggcaggagatgtaccttcgtttcgatcagactactcgccgttctccataccgcatgtcccgtatcctggcccgtcatcagttggtcaccaagatacaacaggaaatcgaggcgaaagaggcctgtgactggttaagggctgctggcttccctcagtatgcacagctctatgaagactcccagttccccataaatatcgttgcagtgaaaaatgatcatgactttttggaaaaggacctggttgagcccttgtgtcggagactcaacactctgaataaatgcgcctccatgaaactagacgtcaactttcagagaaaaaagggcgacgacagcgatgaggaggatctttgcatcagcaacaaatggacctttcagaggaccagtcgaagatggagtcgtgtggacgatctctacacactcctcccgagaggcgatagaaacgggagcccaggtggcacagggatgcgcaacacaacttcttctgagagtgttctgaccgacctcagcgaaccagaagtctgtagtattcactccgagagttctggcgggtcagactctaggtcacagccagggcaatgttgtacagacaacccggtgatgctcgatgcacccctcgttagtagctctttgcctcagccaccgagggatgtgcttaaccacccattccatccgaagaacgagaagcctacaagagcgagagcgaagtcttttttgaaaagaatggaaaccttacgtggcaagggggcacacgggcgtcacaaagggagcggacgcacaggtggcctggtgatcagtgggcccatgctccagcaggagcctgaatcctttaaggccatgcagtgcatccagattcctaatggggacctgcagaactcccctcctcccgcctgccggaagggactgccctgttctggcaagtcttccggtgaatctagtccctctgaacacagttctagtggcgtatccactccatgtctgaaagaaagaaaatgtcacgaagcaaacaaacgcggcggcatgtatctggaagatctggacgtgctcgccggcacagctctgcccgatgcaggggatcagtcccggatgcatgagttccacagccaggaaaacctggtagtacacatcccaaaggatcataagcctgggactttccccaaggcactatccattgaatccctgagccctacagacagctccaacggtgttaattggcggactggcagcatctctctggggagggaacaagttcctggcgcacgggagccgcgcctaatggcatcatgtcaccgagcgtccagggtcagtatctatgacaacgtgcccgggtcccacttgtatgcctcaacgggcgacctcctcgacttagaaaaggatgatctgtttccacatctggacgacatcctgcagcacgtgaacgggttgcaggaggtagtagacgactggtccaaagacgtactaccggagctacagactcacgacacgttggtaggagaacctggattatccacatttccctctccaaatcagatcacgctagatttcgaggggaattccgtttcagagggtaggacaaccccctccgacgtagagcgggacgtaacctccctgaatgagagtgaaccacccggcgtgcgggacagacgggacagcggcgtgggagcctccttaacaagacccaacagacgcctgcgttggaacagcttccagctttctcaccagccaaggccggcacctgcttccccccacatttcttctcagactgctagtcaactgagtctactgcagcggttctccctcctgcgcctgacagccattatggagaaacactcaatgtcaaataagcacggttggacctggagcgttcccaagtttatgaagcggatgaaagtgcccgactataaggataaggcagtgtttggcgttcctctcattgtgcatgtccaaaggaccggccagcccctcccccaatccattcagcaagccttgcggtatttgcgcagcaattgcctggatcaagttgggctcttccggaaatctggcgtgaagtcccgcatccacgcgctccggcagatgaacgaaaattttccagagaacgtcaactatgaggatcagtctgcatatgatgtggctgatatggtcaagcagtttttcagagatctgcccgaacctttgtttaccaataagctgtcagaaaccttcctgcacatttatcaatacgtgtctaaggaacagagactgcaggcagttcaggctgccatacttctcctggctgacgaaaatcgggaagtgctacagacattgctctgctttctgaacgacgttgtcaacctcgtggaggagaatcagatgaccccaatgaatctcgccgtgtgcttggcccctagtcttttccacctgaacctcttgaaaaaggagagtagcccgcgtgtaatccagaaaaagtacgccacgggcaagccagaccaaaaggatctcaacgagaacctggcagctgcacaagggctagcccatatgatcatggagtgcgacagattgttcgaggtgccccatgagcttgtggcgcaatcaagaaacagctacgtagaggccgaaatccatgtcccaaccttggaagagctgggaacccagctggaagaatcaggcgcgacctttcacacataccttaaccatttaattcaaggattgcagaaagaggcgaaggagaagttcaaaggctgggtaacatgttccagtaccgataacaccgatcttgcattcaagaaagtcggtgatgggaaccccctgaaactgtggaaagccagcgtggaggtagaggcacctcctagtgtggtgctcaatcgggtgttaagagaaaggcatttatgggacgaggactttgtccagtggaaagtggtcgagaccctggatcggcagaccgagatctaccaatatgtgctgaacagtatggctccccacccctccagggattttgtggtcctgcgcacttggaagacagacctaccaaaaggtatgtgtaccctggtgtccctttcagttgagcatgaggaagcccaactgctgggtggggtgagagccgtcgtgatggattcacagtatttaattgagccctgtgggtcaggcaagagtcgactgactcacatctgtagaatcgatctgaaaggccattcccctgagtggtacagcaaagggtttgggcacctctgcgccgctgaggtagcccgcattcgcaatagcttccaacccctgattgctgaaggtccagagacaaaaatctag

SEQ ID NO: 17524 - DNA, 2064 bp, Artificial Sequence
  Description of Artificial Sequence: Synthetic coding sequence
atgctggagccttcaagcgttcttcatgccaatgttaaccaggcccctctctggtgtctcgtgctccgatggtgccgcgaatgcaaggacactgtgtgcggaggcaaacagaagtcccgtgtcaatcatacctttcaacggagagagatcgaggccaaggaggcctgtgactggttgagagccgccggcttcccccaatacgctcagctctatgaggactcccagttcccgattaatattgtggctgtgaagaacgaccacgattttctagagaaggacctggtggagccgctctgccgacgtctgaatactctaaacaagtgtgcctccatgaagttagatgtgaactttcaacgcaagaagggagacgactccgacgaagaggacctatgtatcagtaacaagtggacatttcaaaggacgtcaagacggtggtctagggtggacgacctgtatactttattgccaagaggggatcggaatggctcgccggggggcacaggcatgcgaaacacaaccagcagcgagagtgtactgactgatctgtctgaacctgaagtgtgttccattcatagcgagtccagtgggggttcggattctcggagccagccaggccagtgctgcactgataatcctgtaatgttagatgcaccgctggtgtcctccagcttgcctcaaccgcctagggacgtcctgaatcatccattccaccctaagaacgagaaacctacgagggctcgggctaaaagcttcctcaaacgcatggagacactgagagggaaaggggcccacggcaggcacaaaggcagcgggagaactggagggttggtcatttcgggaccaatgttgcagcaggagccagagtcattcaaggctatgcagtgtatacaaatcccgaacggcgacctccaaaacagtccaccgcccgcatgccgaaaagggttaccctgcagcggcaagtcctcgggagagtctagtccgtccgaacactccagctccggcgtttccactccttgcctgaaggagcgaaagtgtcacgaagccaacaaaagaggcggcatgtacctcgaggacctggacgtgctggcaggcacagctttgccagacgcaggagaccaaagtcgaatgcatgagttccattcgcaggaaaacttggtggtccacatccctaaggatcacaaacctggcacattccccaaggccttgtctatcgaaagcctctcccctacggactcgtcaaacggggtgaactggaggacagggagtatctctcttggccgagagcaggtacccggggcgagagagccgcggctcatggccagctgccatcgcgccagcagggtttctatctacgacaacgtgcccggaagtcatctatatgcctcaaccggtgatctactggatttggagaaagacgatttattccctcacctggacgatatcttgcagcacgtgaacggtctgcaggaggtggtggatgactggtctaaggatgttctgcccgagctgcaaactcatgatacgctggtgggcgagcccggattgtctacatttccctcgccaaaccagatcacgctcgattttgagggaaacagtgttagcgaaggtcggacaacacccagtgacgtggaaagggatgtaacttcccttaacgaatccgagcccccgggcgtgcgggataggagagactcgggcgttggggcaagcctcacaagaccgaaccggagactgcggtggaactcgttccagctgagccaccaaccgcgtcctgctcctgcctcacctcacatctcatcccagaccgcctcccagctctccctgctccagcgtttctccctgctgagactgacagcgattatggaaaagcacagtatgagcaataagcatgggtggacctggtctgtcccgaaattcatgaaacgaatgaaggtcccagactacaaggataaagctgtttttggtgtgcccttgatagttcacgtccaacgcaccggtcagccactgccccagtccatccaacaggcactgagatatctccgcagcaattgcctggatcaggaatag

SEQ ID NO: 17525 - DNA, 2988 bp, Artificial Sequence
  Description of Artificial Sequence: Synthetic coding sequence
atgaaactggacgtaaactttcagagaaaaaagggcgacgactctgacgaagaggatctttgcatctccaacaagtggacgtttcagagaacatcccgcaggtggtcacgtgtggatgatctctatacgctgctgccccgtggcgaccggaacggaagccctggaggcactggtatgcgcaatacaacaagcagcgaatcagtgctgactgacctctcggagcccgaggtctgttccatacacagtgagtcgtccgggggatctgattcaagaagtcagccagggcagtgctgtactgacaatccagtcatgctcgatgcgcctctcgtcagcagttccctaccccagccccccagagacgtgctgaatcacccctttcatcccaaaaacgagaagccgacccgtgcgcgggctaagtcttttctcaaacgtatggagaccctacgcgggaaaggagctcacgggcgacataaagggagcgggcggaccggcgggctggtgatttccggtccgatgcttcagcaggaaccagagagttttaaggctatgcagtgtattcagatccctaacggggacctacagaactcgcccccacccgcatgccgcaaaggactgccttgcagtggcaagagctctggggagagttctcctagtgagcatagttctagcggtgtctccacgccctgtctgaaggagaggaagtgtcatgaggccaacaaaagggggggaatgtatctggaggatctggatgtgcttgctggcactgccctgccagacgccggtgatcaatcccggatgcatgaatttcattcacaggagaatctcgtggtgcatattcccaaggatcacaaacctggcaccttcccaaaggcattgtccatcgaaagcctgtctccaaccgatagctcaaatggcgtgaactggcgtaccggatccatatctctgggaagagagcaggtacctggcgcgcgcgagccccggttgatggcttcatgtcaccgggcttcacgtgtgagtatatatgacaacgtcccaggctctcacctctatgcgtccactggtgatctactcgacctggagaaggatgatttgtttcctcacctggacgacatacttcagcacgtgaacggcctccaggaagtggtcgatgactggtctaaggatgtgcttccagagctgcagacccacgatacactggttggggagccgggcctgtccacatttccatcacctaatcaaataacattagacttcgagggtaacagcgtgtctgagggacggaccaccccttcagatgtcgaaagagacgtgacctcactcaacgaatcagaacctcctggggtgagggatcgccgtgactccggcgtcggcgcctctctgactaggcctaaccggcggcttcggtggaactcctttcagctttctcaccagccccgaccagcacccgcctcgccccacatctcctctcagacagcttctcagctgtcactgctgcaacgctttagtctcctccggctgactgccattatggagaaacatagtatgtcaaataaacacgggtggacctggtcagtacctaagtttatgaaaagaatgaaggttccagattataaggacaaggcggttttcggagtgcccttgatagtgcacgtgcagcgcacaggtcagccattaccacagagcatacagcaggcattgcggtatttgaggtctaactgcttggaccaggtgggccttttccgcaaatctggagtcaaaagcaggatccacgctctaagacagatgaatgagaatttccctgagaacgtgaactatgaagatcagtccgcctatgatgtggcagacatggttaaacagttctttagagacctgcctgagcctcttttcacaaataaactgtctgagaccttcttgcatatctaccagtacgtctcaaaggagcagagactgcaggccgtacaggctgccattctcctgctggctgatgaaaatagggaagtgctgcagaccctgttatgctttctaaacgatgtggtcaatttggtggaggaaaaccagatgacgccgatgaatcttgccgtgtgcctggcaccctctttgtttcacctgaatcttctgaagaaagagtcctctccccgggttatccagaagaagtacgccacaggaaagcccgatcagaaggacctgaatgaaaatctggctgctgctcaagggctcgcccacatgattatggagtgtgaccgcttgttcgaggtacctcatgagctcgtggcacaaagcaggaactcttacgtggaggcagagatacacgtgccaaccctagaagagcttggcactcagctggaggaatcaggcgccacctttcatacatacctcaatcatctgattcaaggcctgcagaaggaggcgaaggagaagttcaaaggctgggttacatgcagctcaaccgacaatactgacctggcatttaagaaggtgggggacggtaaccccctgaaactgtggaaagccagcgttgaggtggaggcccctccgagtgtcgtccttaatagagtcctgagggaacgccatctctgggacgaagacttcgtgcagtggaaggtggtggaaaccttggaccgccagacagaaatctaccagtatgtactgaactccatggccccacatcctagccgggactttgtagtgcttagaacgtggaaaacagaccttccaaaggggatgtgcacacttgtgagccttagcgtcgagcatgaggaagctcaactgttgggtggcgtgcgggccgtggttatggacagccaatacttgatcgaaccatgtggttcaggcaagagtcgtctgacccatatctgtcgcattgaccttaagggacacagcccggagtggtatagtaaaggcttcggacatctgtgcgccgctgaggtggcaagaattcgtaacagttttcaacccctcatcgctgaaggaccagagacaaagatctag

SEQ ID NO: 17526 - DNA, 450 bp, Artificial Sequence
  Description of Artificial Sequence: Synthetic coding sequence
atggcgtccagcgacatccaagtgaaggagctggaaaagcgcgccagcggccaggccttcgagttgatcctcagtcctaggtcgaaagaatcggtacctgagttccccctgagcccgccgaagaaaaaagacctgtctctggaagaaattcagaagaagctcgaagccgccgaggaacgccgcaagagtcatgaagccgaagtgctgaagcagctggcggaaaaaagggagcacgagaaggaggtgctccaaaaggcgatcgaagagaacaataacttcagcaagatggccgaggagaagctgacccacaaaatggaggcgaacaaagagaaccgggaagctcaaatggcggcaaagttagaacgcctcagagaaaaagacaagcacatcgaggaggttcgcaaaaacaaggagtccaaggatcctgctgatgagacagaggccgactag

SEQ ID NO: 17527 - DNA, 450 bp, Artificial Sequence
  Description of Artificial Sequence: Synthetic coding sequence
atggcttcttcggacatccaggtgaaagagctggagaaacgggcgtccggccaggccttcgaactgattctgtctccgagatcgaaagagtcggtgcccgaatttccactttcaccgccaaagaagaaggacttgtctttagaagagatccagaaaaagctggaagcggcggaagagcgacggaaatctcacgaggctgaagtcttaaaacagctggccgaaaaaagggagcacgagaaggaagtgctccagaaagccattgaagagaacaataacttttctaagatggctgaagagaaattaacacataaaatggaagcgaataaggagaatagagaggcacagatggccgccaaattggaacgcctaagggaaaaggacaaacatattgaagaggttaggaagaataaggaatccaaggaccccgccgacgagaccgaggcagactag

SEQ ID NO: 17528 - DNA, 450 bp, Artificial Sequence
  Description of Artificial Sequence: Synthetic coding sequence
atggcaagcagtgacatccaggtgaaggagttggagaaaagggccagcggccaggcattcgaactgattctgtctccgcgtagcaaggaatctgtgcctgaatttcctctgagcccccctaagaagaaggacttgagcctagaagagatccaaaaaaagctggaggccgcggaggagcgtcgcaaatcacacgaggcagaggtgttgaaacagcttgccgaaaagcgagagcacgagaaggaggttctccagaaagccatcgaggagaataacaatttctctaaaatggccgaagaaaagcttacacacaagatggaggccaataaagagaaccgtgaggcgcagatggcagcaaagcttgaacggctgcgagagaaggataagcacatcgaagaagtgcgcaagaataaagaaagtaaggatcctgcagatgaaaccgaggctgattag

SEQ ID NO: 17529 - DNA, 525 bp, Artificial Sequence
  Description of Artificial Sequence: Synthetic coding sequence
atggcctctagcgatattcaggtgaaggaactggagaagcgggcatctggtcaggcgttcgagctgatcctgtccccccgcagcaaagaaagtgtgcccgagttcccactgagccctcccaagaagaaggacctgtctctggaggagatacagaagaaactggaggccgcggaagagcggcgcaagtctcacgaagctgaagtgttgaagcagctggccgaaaagagagagcacgagaaagaagtcttgcagaaggctatcgaggaaaacaacaatttctcgaaaatggccgaagaaaaattgacccacaagatggaagcaaacaaagaaaaccgcgaagcccagatggctgccaaactcgagcgcctgcgagagaagatgtacttttggacacatgggcccggggcacacccagctcagatttccgccgagcagtcttgtctccacagcgtccctgctctgtgtcccgcccttggccttcagtccgctctgatcacatggtccgacctatcccaccatcattag

SEQ ID NO: 17530 - DNA, 261 bp, Artificial Sequence
  Description of Artificial Sequence: Synthetic coding sequence
atggcatcatcagatattcaggtaaaagagttagaaaagagagccagtggacaggcttttgagctgatcctcagcccccggtccaaagaatccgtccctgagttccctctgtctccgccaaagaagaaggatttgtcactcgaagagatccaaaaaaagctggaggcagctgaggaacggaggaagagccatgaggcagaagtccttaaacaattggccgaaaaacgagagcacgagaaagaggttctccagaaggcttag

SEQ ID NO: 17531 - DNA, 450 bp, Artificial Sequence
  Description of Artificial Sequence: Synthetic coding sequence
atggcgtcctcagatatacaggttaaggagttggagaagagagcttccggtcaggctttcgaacttatactgtctcccagatctaaagaatccgtgccagagttcccgttgtctccccccaagaaaaaggacctgagcctggaagaaattcagaaaaagttggaggctgccgaggaacggcggaagtcccatgaggccgaggtgcttaaacagctcgcggagaaaagggagcacgagaaggaagttctccagaaagccatagaagaaaataacaatttctccaaaatggccgaggagaagcttacacataagatggaagctaacaaggagaacagagaggcacagatggccgccaaacttgagagacttcgggaaaaggacaagcacatcgaagaagtcaggaaaaataaggagagcaaggatccagccgatgagacagaagcagactag

SEQ ID NO: 17532 - DNA, 3615 bp, Artificial Sequence
  Description of Artificial Sequence: Synthetic coding sequence
atgtcatttttcaacttccggaagatatttaaattggggtcagaaaaaaagaaaaagcaatacgaacatgtgaaacgggacctgaaccctgaagatttttgggagatcattggagaactaggggacggggcttttggcaaggtgtacaaggcacagaacaaggagacctccgtcctggccgccgctaaagtgattgacaccaagtccgaggaagagctcgaggattatatggtggaaattgatatcctggcgagctgtgatcacccaaatatcgtcaaactcctggacgccttctactacgaaaataacctgtggattttgatcgagttctgtgccggcggggccgttgacgccgtgatgctggaactggaacgccctctcacagagagccaaatccaggtcgtatgcaaacaaacccttgacgcacttaattatctgcacgacaacaaaattattcacagagacctcaaggccgggaacatcttgtttactctagacggcgatatcaaattggctgactttggcgtctctgccaaaaacactaggaccattcagagaagggacagttttatcgggaccccctattggatggcccctgaagttgtgatgtgcgagacttcgaaagatcggccgtacgactacaaggctgacgtgtggtcccttggcattactttgatcgagatggcagaaatcgagcccccacatcacgagctgaatcccatgagggtactcttaaaaatagcaaagtccgagccccctacacttgctcagccctcgcgatggagttctaatttcaaagacttcctgaagaagtgcctggaaaagaatgtggatgcgcgctggacaacttcccagctgctccaacaccctttcgttaccgttgatagcaacaagcctattcgagagctcattgccgaggctaaggcagaagttaccgaggaggttgaagacggcaaggaggaggatgaggaagaggagacagagaattctctccccatccccgcaagcaaaagagcctcgtctgatctgtccatcgcaagctcagaggaggacaaattatctcaaaacgcctgtattctcgaatccgtatcggaaaaaacagaaaggtcaaattccgaggacaaacttaactccaaaattcttaatgaaaagcccaccactgacgagcccgagaaagccgtcgaagacattaatgaacacattacagatgcccagcttgaggctatgaccgaactgcatgataggacagcagttattaaagagaacgaacgggaaaaacggcccaaattggagaacctaccagacacagaggatcaagaaaccgtggatatcaactctgtgtccgaaggcaaagaaaataatatcatgattaccctggagaccaacattgaacataatctgaagtcggaggaagagaaggatcaggagaagcagcagatgttcgagaacaagcttatcaaatctgaggagataaaggatactattcttcagactgtagacctggtaagtcaggaaactggagagaaggaagcaaacatccaagccgtagactctgaggtcggccttactaaagaggacacacaggagaagctgggggaagatgacaagactcagaaggacgtgatctctaacacatccgacgtgataggaacatgcgaggcagccgatgtagctcagaaggtagacgaagacagcgcagaagacacgcagagcaatgatggcaaagaggtggtcgaagttggacagaagttaattaacaagcccatggtgggtcctgaggccggcggcacaaaggaggtccctatcaaggagattgttgagatgaacgaaattgaggaaggcaagaacaaggagcaagccataaacagttcagagaacatcatggacattaacgaggaacccggcactaccgagggcgaggagatcactgagagttcgtctactgaggaaatggaggtgaggagcgtcgtggctgacaccgatcagaaagctctcgggtctgaagtacaggatgcaagcaaagtgacgacacagattgacaaagagaagaaagaaattccggtgtctatcaaaaaagaacctgaagtgacagtcgtgtctcagcccaccgaacctcagcccgtgctcatcccttcgatcaatataaattccgattcaggcgaaaacaaagaggaaattggtagtttatcaaagacggaaacgatcctccctcctgagtcagagaatccgaaggagaatgacaatgactccggaaccgggagcaccgcagacacctcctcaatcgatcttaacctgagcatcagttcgtttctctccaaaactaaagactcaggatccatctccctgcaggagacccggcgacagaaaaagacactgaaaaaaactcgaaaattcattgtggatggcgtggaagtgagcgtcacaacatctaaaattgtgactgactccgactcaaagacggaggaacttagatttctcaggagacaagaactgagggagcttagatttcttcagaaagaagagcagcgcgcccagcagcagctgaattccaagcttcagcagcagagggagcagatctttagacgcttcgaacaagaaatgatgtcgaaaaagaggcagtatgatcaggagatcgaaaacttggagaagcagcaaaagcaaacgatagaaagactggagcaggagcacacgaataggttaagggacgaagctaagcgcataaaaggcgagcaggaaaaggagttatccaaattccagaatatgctgaagaacagaaaaaaggaggagcaggagttcgtgcagaagcagcagcaggagctggacggaagtctaaagaaaattattcagcagcagaaagcagaactagcaaatattgaaagagagtgtcttaacaataagcagcagcttatgcgcgctagagaagctgcaatctgggagctggaggagcgacacctccaagagaaacaccagctcttaaagcagcaactaaaggaccagtatttcatgcaacgccatcagctgttgaaaaggcacgagaaggagacggagcaaatgcagaggtataatcagcgtctgattgaggaattgaagaaccgtcagacgcaggaacgggcacgtcttccaaagatccagcggagcgaggcgaaaacacggatggctatgtttaaaaaaagcctaaggattaacagcaccgccacccctgaccaggatagagacaagataaagcagtttgcagcacaagaggaaaaacgccaaaaaaacgagagaatggcccagcaccagaaacacgagaatcagatgagggacctccaactgcaatgcgaagcaaatgtgcgcgagctccatcaattgcagaacgagaagtgccacctcctcgtggagcacgagactcagaaactgaaggagcttgatgaagagcacagtcaagagttgaaagagtggcgcgaaaaactgcggcccaggaagaaaaccctggaggaggaattcgcccgaaaacttcaggagcaggaggttttctttaaaatgactggagagtctgagtgccttaatccgtccactcagagcagaatttccaaattttacccaatccccagcctgcattccacgggctcctag

SEQ ID NO: 17533 - DNA, 3708 bp, Artificial Sequence
  Description of Artificial Sequence: Synthetic coding sequence
atgtctttctttaatttcagaaaaatcttcaagctgggctccgagaagaagaagaagcaatatgaacatgtcaagagagatcttaaccctgaggacttttgggagataatcggcgaactgggcgatggggcctttggcaaagtttataaggcgcagaataaggagacatccgtgcttgctgccgccaaggtaatagacactaagtccgaggaggagttggaggactatatggttgagatcgatatccttgcctcttgtgatcatccaaatatagtgaagctgctggacgcattctattatgaaaataatctttggatcctgattgagttttgcgctggcggagctgtcgacgcggtcatgctcgaacttgagcgcccgctgacagaatcacaaattcaggtggtctgcaaacagacgctcgacgcgctgaattacctgcatgacaataaaattattcaccgcgacctgaaagccgggaacatactgtttaccctcgacggcgacatcaagctcgccgacttcggcgtgtctgctaagaatactagaaccattcagcgtagggattctttcattgggaccccctactggatggcccccgaggtcgtcatgtgtgagacttccaaggatcggccttatgattacaaagcggatgtttggtcgctggggattaccctgattgagatggccgagatcgagcctccccaccacgagttgaatcccatgcgcgtcctgctcaaaatcgcaaagagtgagcctccaacactcgcccaacccagccggtggtcgagtaacttcaaggactttcttaagaagtgtttggagaaaaatgtggatgcccgctggacaacaagtcaattgttacagcatccctttgttactgtggattctaacaagcctataagagaactcattgcagaggccaaagctgaggtgaccgaggaagtggaggacggtaaggaggaagacgaggaggaagaaacagaaaactctctgcccattcctgcctctaagagagcatccagtgatttatctatcgccagttctgaggaagacaaactgtcccaaaacgcctgcatcttggagagtgtctccgagaagactgagcgctctaactccgaggacaagttgaattctaaaatcctcaatgaaaaaccaactactgatgagcccgagaaggcagtcgaagacatcaatgagcatataacggatgcccagttggaggccatgactgaactgcatgatcggaccgccgtaataaaagagaatgaaagagagaagcgcccaaaattggagaacctccccgacactgaagaccaggaaacagtggacatcaatagcgtgtctgagggaaaggagaataacattatgataaccctggaaactaatatcgaacacaatctgaagagtgaagaagaaaaagaccaggagaaacagcagatgtttgagaacaagctgataaaatccgaagagatcaaggataccatcctgcagaccgtggatctggtctctcaggagaccggagaaaaggaggcaaacattcaggccgtggactccgaggtagggttgacgaaggaagacactcaggagaagctgggcgaagacgataagacccaaaaagatgtgatttccaatacaagtgacgtgatagggacatgtgaggcggcggacgtcgcccaaaaagtggacgaggattctgccgaggacacccagtccaatgacggcaaggaggtggtggaagtcgggcagaagctgataaataaacccatggtcgggccagaggctggaggcacaaaggaagtgccgatcaaagagatcgtagagatgaacgagatagaggaaggcaaaaacaaagagcaggccattaacagcagcgagaacatcatggacatcaacgaggaaccggggacaacagaaggtgaagagatcactgagagctcgtctacagaggagatggaagtccgaagcgtcgtagcggacacagatcagaaggcactcgggtcagaggtgcaggatgcatccaaggtgactactcagatagataaagaaaagaaggagattccagtgagcataaagaaggaaccggaagttacagtggtgtcacagcccaccgagccccagccggtgctaattccatcgatcaatattaactctgacagcggggaaaataaagaggagatcgggtccttgagcaagaccgagactattctaccacccgagtccgagaatcccaaagaaaatgataacgactctggtactggctcaaccgctgacacctcatctatcgatctaaacttaagtatctcatccttcctaagcaaaacaaaagattcaggtagcattagtctccaggagacgcgtaggcagaagaagaccctaaaaaagacccgaaagttcattgtcgacggcgtcgaagtttcggtaacaaccagtaaaatcgtaaccgactctgattccaaaacagaagagctaaggtttcttagacggcaagaacttagggagctgcggttccttcagaaggaggagcaacgcgcccagcagcagcttaattctaagttacagcagcagcgggaacagatcttccggcgttttgaacaggagatgatgtcaaagaagagacagtacgaccaggagatcgaaaatctggaaaagcagcagaagcaaaccatcgagcggctggagcaggagcacaccaatagattgcgcgacgaggccaaaaggatcaagggagagcaggagaaagaactgagtaaatttcaaaatatgctcaaaaaccgcaaaaaggaggtaattaatgaggtggagaaggcgcccaaggagcttaggaaagagttaatgaaacggcgaaaagaagaactggcccagagccagcacgctcaagagcaggagtttgttcagaagcagcagcaggaacttgatggaagcctgaagaaaatcatacaacaacagaaggccgagttagctaatatagagagagaatgtcttaataacaaacagcaactcatgagggcacgggaagctgctatctgggagctcgaagagaggcatttgcaggaaaaacatcagcttctgaagcagcaactgaaggaccagtacttcatgcaaaggcaccaattgctgaagcgccatgaaaaagagacagaacagatgcagaggtacaatcaacgactcatcgaagagttgaagaatcgccagacgcaagaacgggctcggttgcccaaaatccagcgatctgaggctaaaactcgcatggccatgttcaagaaaagcctcaggataaactccaccgcaaccccggaccaggacagagacaagatcaagcagttcgcggcccaggaagaaaagcggcagaaaaatgaacggatggcacagcaccagaagcacgagaaccaaatgcgggatctgcaattacagtgcgaggctaacgtgcgggagcttcaccaattacaaaatgaaaaatgccatctgctcgtcgagcatgagacccagaagcttaaggaattggatgaggagcactcgcaggaacttaaggaatggagagagaaactccgtccccggaagaagacgctcgaggaagagttcgccaggaaactgcaggagcaagaggttttctttaaaatgacaggagagtccgagtgcctgaacccctccacgcaatcccgaatctcgaagttttatccaatcccctcactccactccaccggatcctag

SEQ ID NO: 17534 - DNA, 3444 bp, Artificial Sequence
  Description of Artificial Sequence: Synthetic coding sequence
atggacgaacccccgttttccgaggctgctctagaacaggcactgggcgaaccatgcgacctggatgccgcgctcctcacagacattgaggacatgctgcaactgatcaataatcaggactcagacttcccgggcctgtttgatccgccatatgcggggagcggagcaggcggaaccgatccggcctctcctgatacttcgtcccccggatccctgtccccccccccagcaaccctgagctcctccctggaagccttcctttcaggacctcaggccgccccaagccccctgagcccccctcagccggcacctaccccactgaagatgtacccctccatgcctgccttctcccccgggccgggaatcaaagaagaatcagtaccattgtctatattacagacacccactcctcagcctttgccaggcgctttactccctcagtccttccctgccccagccccaccgcagttttctagcactcccgtgcttgggtacccctctccacccgggggcttttctaccgggtcccctcccggaaatacacagcagccgctcccaggcctccctctcgccagtccccctggagtcccccctgtgagcctgcacacgcaggtgcagagcgtcgtcccccagcagcttctcaccgtgacagccgctcctaccgccgccccggtgacaacgaccgtgaccagtcagattcagcaggtaccagttctgttgcagccccactttataaaggccgactcccttcttctcaccgccatgaagaccgatggcgccacagttaaagcagcaggcctcagtccactggtatcagggactactgtacaaacagggcccttgccaactctcgtaagcggcgggaccattttggcgacagttcctctcgtggttgacgccgagaaactgcccatcaatcggttagcagccggttcaaaggcccctgcatcagcacagagtcgcggagaaaagaggaccgcacacaatgctattgagaaaagatataggagctcaatcaacgataaaattattgaactgaaggatttagtggtgggcaccgaggcaaagctgaataagtccgccgtgttgaggaaggccattgattacatcagatttttacagcattcaaaccagaaactgaagcaggaaaacctttctttgaggacagccgtgcataagagcaagagcctgaaagacctagtcagtgcctgcggtagcggcggaaacacagacgtcctgatggaaggagttaagacggaggtagaagacacgctgacacctccaccctcagatgcggggtcgcctttccagtcctccccactatccctggggtcaagaggctccggcagtggaggctctgggagcgatagcgaaccagattcccccgtgttcgaggattccaaagctaagcctgagcagcggccttcactccactcccggggaatgctggaccgcagcaggctagctctctgtacacttgtttttctgtgtttatcttgcaatccattggcgtcccttctcggagcacgtggtcttccctcgcctagcgacactacatccgtttatcactcccccggacgaaatgtgcttggtacagaatcccgcgatggtcccgggtgggcccagtggctcttgcctcccgtcgtttggctgcttaacgggcttctggttctcgtgagcctcgtgctgttgttcgtatatggtgaaccagtcacacggccgcacagcggccctgccgtttacttctggcgccatcgcaagcaggccgatttggacctggcaaggggggatttcgcacaggccgcacagcagctctggctcgctttaagagctttgggacgccctctgccgaccagtcatctggacctggcttgtagtctgttatggaacctgataaggcacttgctccagaggctgtgggttggacgctggctggccgggagagctggtggcctgcagcaggactgcgccctgagagtggatgccagcgcctctgcccgcgacgctgctttggtgtaccacaagttgcaccagctccacactatggggaagcacactggcgggcacctgactgctacgaatctagcactctccgccctgaatctcgctgaatgtgcgggagatgctgtttccgtcgccactctggcggagatctatgtcgccgccgccctccgagtgaaaacttccctgcccagggcacttcactttctcacacgcttttttctctccagtgcgagacaggcttgtctagctcagtcaggaagtgtcccaccagcaatgcagtggctgtgtcatcccgtgggtcaccgattctttgtggatggggattggtctgtcctaagcacaccgtgggaatccctgtattccttggctggaaaccctgtggaccctttggcccaggtgacccagctcttcagggaacacctgcttgagagagcattgaactgcgtgacacagcctaatccctccccaggatctgccgatggagacaaagaattcagcgatgcactgggttatcttcagctgctgaattcttgcagcgacgcggctggggcaccagcatacagtttcagcatttccagctcaatggcaaccactaccggggtggatcctgtcgccaagtggtgggcttctttgacagcggttgtgattcattggctgcggagagatgaagaggcagcagaaagactctgtccccttgtggagcacctacccagagtcctgcaagagtcagagcggcccctccctcgggccgcgctgcacagcttcaaagccgcccgcgccttactgggatgtgccaaggcagagtcggggcctgcctcactgaccatatgcgagaaagctagtggatatctccaggattcactggccactactcccgcgtcatccagtatcgacaaagccgttcagctgtttctttgcgatctgctcctggttgtccgcactagcctgtggaggcagcagcagccccctgcgcctgcccccgcagctcagggcacctctagtcgaccacaggcctctgccctcgaactcagaggattccagcgggacttgagcagcctccggcgattagcacagtcatttaggcctgccatgcggcgggtcttcctccacgaagccaccgccaggcttatggctggcgcttctcccacaaggacacaccagttgttagaccgaagtcttcgtcggagagcaggtccaggcggtaaaggaggggccgttgcagagctagaaccacggcccacacgtcgcgagcacgctgaggctctactgttggcttcatgctatctgccccctgggttcctaagcgcccctggacagagagttgggatgctcgcagaggccgcgagaaccctggaaaagcttggtgatcggagactgcttcacgattgtcagcaaatgctcatgagactgggcggagggaccacagtaacttcatcctag

SEQ ID NO: 17535 - DNA, 3216 bp, Artificial Sequence
  Description of Artificial Sequence: Synthetic coding sequence
atggacgagccccccttttcagaagccgccttggaacaggccctgggagaaccgtgtgacctggacgccgccctgctgactgacattgaggacatgctccagctgataaacaatcaagattccgactttccgggtctctttgaccctccatatgcggggagcggagcaggcggcaccgatcctgcttcgccggatacgagctctcctggatccttgagtccacctcccgccacactgtcatcctccctcgaggcctttctaagtggaccccaggctgcccccagtcctctctcccccccccagcccgccccaacgccattaaaaatgtacccctctatgccagcttttagcccaggacccgggattaaagaggagtccgtaccactcagcatcctccagacacctacaccacagccattgcctggcgcactcctcccgcagtcgtttccggcccctgcccccccacaattttcttcaacaccagtcctgggctatccctcgccaccaggaggattctctacaggatccccacctggtaacacacagcagcccctaccagggctgcctcttgcttcgccgccgggggtgccacccgtatccttacacacccaggtccagagcgttgtccctcagcagctgctgactgtcacagccgctcctacagccgctcccgtgactacaacagtgactagtcagatccagcaggttcctgtactgctgcagcctcacttcattaaggctgactcgctgctgttgacagcgatgaagacagatggagcaaccgtgaaagctgctggcctgagcccacttgtttcagggacaactgtgcaaaccgggcccctccccacactggtcagtgggggcacaatactggccaccgtgcccttagtggtggacgccgagaaattgcccattaacagactggctgccgggagtaaggcccctgcatcagcgcaaagccggggcgagaagcggactgctcataacgccattgaaaaaagatatagaagctctatcaatgataaaattatcgagctgaaagacctggtggtcggaaccgaggccaagctgaataaaagcgccgtgctgaggaaggctattgattacattcgcttcttacagcattctaatcaaaaactaaaacaggagaacctttccttacgtacagccgtccacaagtcaaagtccctgaaagacctggtgtccgcctgcggcagtggaggaaatacagacgtacttatggagggagtgaaaacagaggtggaagataccctaactccgcccccctcggatgccggttcaccctttcagtcgagccccctaagccttggaagccggggtagtggttccggaggaagcggatccgatagtgaaccggattctcctgtgtttgaggattcgaaggcaaaacctgagcagcggccgtcgctgcattcacgaggcatgctcgacagatctagactggcactgtgtaccctggtcttcctatgcctaagctgtaacccattggctagcctgcttggtgctcgagggctgccaagtccctcagacaccaccagcgtgtatcattccccaggtcggaatgtactggggaccgagtccagagacggccctggctgggctcagtggctactgccacccgtcgtgtggctcctgaatggattgcttgtgctcgtttccctagtcctgctttttgtctatggtgaaccggtaacccgacctcactccggaccagccgtgtacttctggagacataggaagcaggccgacttagatctcgcccgcggtgattttgctcaagcggcccagcagttgtggctggctctacgggccctcgggcgaccccttcccactagccacctggatctggcgtgttccttactgtggaatctgattcgccacctccttcagaggttgtgggttggaagatggctcgctggcagagccggcggcctccaacaggattgtgctctgcgggtggatgctagcgcatctgccagggatgcagctctggtgtaccataagttacaccagctgcataccatgggcaaacacaccggtgggcacctcacagcaactaaccttgcgttgtccgctctcaatcttgctgaatgcgcgggagatgcggtctccgtagctactctggcagagatctacgttgcggctgcactcagggtgaagaccagtctgccccgggcactgcatttcctcacccggttcttcctctcctcagctaggcaggcatgtctggcccagtctggaagcgttccacccgctatgcagtggctctgtcatccagtaggccacaggttctttgtcgacggtgactggtcagtgctctcaacaccatgggagtcgctgtattctctcgcaggtaaccccgtggacccgctggcacaagtgacccagctattcagagagcatcttctcgagagagccttaaactgcgtgactcagcccaacccaagccccggctcagcagatggtgacaaggagttcagcgacgcacttggatatctgcagcttctcaacagttgttccgatgctgccggagcccctgcctactccttctctatttccagctccatggccaccaccaccggtgttgacccagtagctaaatggtgggcgagcctgacagccgttgtgattcattggcttcgcagagatgaagaggctgctgaaaggctgtgtcccctcgttgagcatttacctcgggttcttcaagagagtgagagaccactgccccgcgcagctctgcacagctttaaagcagctcgagccctcctgggctgtgcgaaggcagaaagcgggcccgcttcactgaccatatgcgaaaaggcaagtggttatctgcaggattcgctggctaccacacccgcttctagcagtattgacaaggccgttcaactgttcctatgtgacctcctcctggtcgtgcgtacgagtttatggagacaacagcagcctcccgccccagcgcccgcagctcagggaacaagtagcagaccacaggcgtctgctctagaactgaggggctttcaacgcgatctgagctccctgcgtcgcctcgcccagagcttcaggcccgccatgagacggctcatggacgttctgacaagtgagtcagcgtgggccctgccacaacacctcgggaaggggtttccatccccctctggccacaaggtgccgggctggcatggccgaatggattag

SEQ ID NO: 17536 - DNA, 3534 bp, Artificial Sequence
  Description of Artificial Sequence: Synthetic coding sequence
atggacgaaccccccttctctgaggcagctctcgaacaggcactgggtgaaccatgtgacctggatgcggcccttctcactgacatcgagggcgaagtgggagctggcagaggccgtgccaatggactggacgcaccgcgggccggcgccgataggggtgcaatggattgcactttcgaggacatgctgcaactgattaataaccaggattccgattttcccggcctctttgaccccccctacgcgggttctggtgctgggggcacagacccggcttcacccgacacctccagcccaggatctctgtctccaccccccgccacgctctcctcctctctagaagcctttctaagcggacctcaggcggcgccaagcccactctctcctcctcagcccgcccctacacctctgaaaatgtaccccagcatgcccgccttctcccctggcccaggcattaaggaggagtccgtgccacttagtattcttcagacgcccaccccccagccattgccaggagctctgctccctcagagctttcctgcgcccgcgccaccccagttttcgtcaaccccggtgcttggctacccttccccacctggtggttttagtacgggtagccctccagggaacacacagcagccactgcccggtttgcccctcgcctcacctccgggcgtcccccctgtcagcctgcacacccaggttcaatctgtggtgccgcagcagcttctcaccgttaccgctgcaccgacggctgctccggtgacaaccacagtcacgtcccagatccaacaagtgcctgtcttattgcaaccccatttcatcaaggctgattccctcctgctgactgcgatgaagactgatggtgccacagtgaaggctgctggactgtcacccctagtatccggtacaacggtgcagacaggcccactgccaacattggtgtccggaggcacaatcttggccaccgttcccctggtcgtcgacgccgagaagttacccataaatcgtttagcggctggatctaaggccccagcgtccgcccaaagtagaggtgagaaaaggacagcccacaatgcaatagaaaaacgctacaggagctcaattaacgacaagatcatcgaactcaaggacctcgtcgtggggaccgaggccaagctgaacaagtccgccgtactaagaaaggccatcgactacatccgcttcttacagcatagcaaccaaaaattaaaacaggaaaacctttcattacgtacggccgtgcacaagtctaagtctctgaaggatctcgtgagcgcctgcgggtcgggaggcaacaccgacgtgctgatggagggcgtgaagactgaggttgaggacacactcacacctcccccttcggatgcgggcagcccatttcagagctcccctctctccctaggaagtcgtgggtctgggagtggggggtctggctctgactctgagccagattcaccagtgtttgaggattccaaagccaaacccgagcagaggccctccctgcactctagaggtatgttagaccggtctcggttggcactctgcacactagtgtttctgtgtttaagctgtaatcccttagccagcctactcggcgcacgcggactgccaagtccatccgacactaccagcgtgtatcactctcccggccgcaacgtacttggaactgagtcaagagacggtccagggtgggctcagtggcttttgccaccagtggtgtggctccttaatggccttctagtgctagtatcactcgttctgcttttcgtctatggcgagcccgtcacacgccctcatagcggccctgctgtatatttttggcgccacagaaagcaggcggatctagacctggcccgcggtgactttgcacaggctgctcaacaattgtggcttgctctgcgggccttggggagacctctaccaacgagccacctcgatttggcatgctctctgctgtggaatttgattcgtcatttgctccagcggttatgggtcgggaggtggctggccggccgcgctggagggctgcaacaggattgcgcactaagggtcgacgcatccgccagcgcacgcgacgctgcattagtgtaccataaactgcaccagctgcacaccatggggaaacataccgggggtcatctgactgctactaacttagctctttcagccctgaacctggccgagtgcgccggagacgccgtctccgtggccaccctggcggagatctacgtcgccgccgctctgagggttaagacttcactccctcgtgctctgcactttctgactcggtttttcctgtcttcggcacggcaggcttgcctcgctcagtcgggttctgttcctccagcaatgcaatggttgtgccacccagtggggcatcgcttcttcgtcgatggagattggtcagtactgagcaccccatgggaaagtctgtattctctggcgggcaacccagttgatccactggcccaggtcacccagttattccgggagcatctcctggagcgcgcactgaactgtgtcactcagcctaacccaagccctggttccgccgatggcgataaagaattttctgatgccttgggctacctccagctgcttaatagttgctcagacgctgctggagccccagcgtactctttttcaatttcctcttccatggcaacaacaactggtgttgacccagtggccaagtggtgggcatcgctaacggccgtggtcatacattggcttaggagagacgaagaggccgccgaaaggttgtgccccctcgtggagcacttgcctcgggtgctgcaggaaagtgaaagaccgctgcccagagctgcacttcactcattcaaggccgcaagggccctcctgggatgcgccaaggcggagtcaggtcctgcctcattaactatctgcgaaaaagcctctggttatctgcaggactcactggccacgactcctgcctctagctcaatcgacaaagcagtgcagctgtttctatgcgacctgcttttagtggtaagaacctctctgtggcgccagcagcagccgccagcacccgcccccgccgcccaggggacctctagccgcccccaggcctcagccttagagttgcgcggtttccaaagggatctgtcttccctgcgaagactagcacagtcgttccgtcctgcaatgagacgggtatttctgcatgaagcaacggctcggctgatggccggggcctctccgactcgtactcatcagctgctggatcgatccttacgtcgaagagccggtcctggaggcaaagggggtgccgtggccgagctggagccaaggcccaccaggagggaacacgccgaggccctcctgctggccagctgctacctcccgcccggattcctttctgctcccggtcagcgtgtgggtatgcttgcagaggcagccagaactcttgaaaaactcggcgaccggcgtctcctccatgattgccaacagatgcttatgcggttaggtggagggaccaccgtcacatctagctag

SEQ ID NO: 17537 - DNA, 3468 bp, Artificial Sequence
  Description of Artificial Sequence: Synthetic coding sequence
tgaaagatacgaagggcactcacaggggaagtgggagcaggccgtggacgggccaatggtctagatgctccaagggcgggtgccgataggggcgctatggactgcacgtttgaggatatgctgcagctcatcaataaccaggacagcgactttcctggacttttcgatcccccctacgcaggctccggggccggggggacggatccggctagtcctgacacttcgtcccctggttcattaagccctccacccgcaacactaagttcatcactggaggcctttctgtctggaccccaggccgccccctccccactgtctcctccacagccagctccaacccccctgaaaatgtacccatctatgccggcgttttcaccaggtccggggatcaaagaggagagcgtgccactttcaatcctgcagactcctaccccccagcctttgcctggcgctctcctgccccagagcttccccgctcctgcgccaccccaattcagttcaactcccgttttaggatatcccagtccccccggaggcttctctacagggtccccccctggtaacactcagcagccactgccaggcctgccccttgcatccccacccggggttcctcccgtttcactccatacccaggtccagagcgtcgtgcctcagcagctgctgaccgtgacagccgcaccgacagccgcacccgtgaccactactgtgacaagtcaaattcagcaggtcccagtgctgctgcagccgcacttcattaaggcagactctctgttactcactgccatgaagaccgacggcgcaacggtcaaagctgctggtctgtcaccccttgtctcaggcacaacggttcaaaccggccctctgcccaccctggtatcaggcgggacaatcctagcgacagtgccgcttgtggtcgatgcagaaaaattacccatcaaccgactggcggccggctccaaagcccccgctagtgcacagagtagaggggaaaagcggactgcgcacaacgcaatcgagaaaagataccggagtagcattaacgacaaaatcattgagctgaaggacctcgtggtgggcactgaggctaaactgaataaatctgctgtgctgaggaaggccatcgactacattcgcttcctgcagcatagcaaccagaagctcaagcaggagaatctatccttgcggacggcagtccacaaatccaaatccctgaaagacctggtgagcgcttgtggatccggaggcaacactgacgttctaatggagggagtcaaaacagaagtggaagatactcttaccccccctcccagcgacgcgggctctcccttccagagttcaccgttgagtctgggctcccggggctcagggtctggcgggtctggaagtgatagcgaacctgactcccccgttttcgaggactccaaggctaaacccgaacagcgcccatccctgcacagcaggggaatgcttgatagaagccgcctggccctgtgtactctcgtcttcctgtgtctctcgtgtaatcctctggcaagcctgctgggagcacgaggcctgccttcaccgtccgacacaacgagtgtttaccactcgcctggccgaaacgtgctggggacggagtcaagggacggtcccggatgggcacaatggttgctgcctcctgtcgtatggctgctcaatggcttgctggtgctcgtgagcctggtgctgctttttgtgtacggagagcccgtgacacggccacattctgggccagcagtgtatttttggaggcacaggaagcaggccgacctcgaccttgcacgcggagattttgcccaagccgcgcaacagctctggttggctttgagggctcttggaagacctctgccaacttcgcacctggatctagcctgctccctcctgtggaatctgatcaggcacttgttgcagcggctttgggtcggaaggtggctcgctggcagagccggcggactgcaacaggattgtgcgttgagagtcgatgcgtcagcttctgctagagatgccgcactggtgtatcacaagctacatcagttgcacacaatggggaagcacacaggggggcacctgactgccacaaacttggccttatcagcactcaatttagccgagtgcgctggggacgcagtctcagtagccacactggccgagatttacgtcgctgcagcgctgagggtgaaaacaagcctgcccagagcattacactttctgacacgattcttcctgtcctccgcacgtcaggcctgcctcgctcaatcaggcagcgttcctcccgccatgcaatggctctgccaccctgtcggacacaggttttttgtggacggagactggtcagttttatcgacaccctgggaatcactgtactccctggctggtaatccagtggaccctctcgctcaggtgactcagctcttccgggagcacttgcttgagagagcactcaattgcgttactcagcccaacccatcaccaggatcggctgacggcgataaagagttctccgatgccctgggatacctgcaactgttgaactcctgctctgatgccgctggcgcgcctgcctacagcttctccatcagttcatctatggccaccactacgggcgtcgatccagttgcaaagtggtgggctagcttaactgcagtcgtgatccactggttgcggcgagatgaggaggccgcggagagattatgtcccctggtcgagcatctgcctcgtgttctgcaggagtccgaaagacctttgcccagagccgccctgcactcctttaaggctgcccgggccctgctcggttgcgccaaagctgagtcaggcccggctagtctgacaatatgcgaaaaggcgagcggttacctccaggattcactggcgacaacaccagctagctcttctatcgataaggctgtgcagctgtttctgtgcgacttgttgctggtcgtcaggacgagcctttggaggcagcagcagcccccggcgcccgctcctgccgcacagggaacttcctcacggcctcaggccagcgctttggaactgcggggattccagcgggacctgtcatcactgcgcagactcgctcagagtttccggcccgcgatgagaagggtgttcctacatgaagccaccgcccgcttgatggccggggcatctccaacacgaacacatcagttacttgataggagcctgcgccgcagggccggccccggagggaagggtggcgcagtcgccgaactcgagccccgccccactcgccgcgagcatgccgaggctctgctgctggcatcttgctatcttccccctggatttctatctgctcctggccagcgtgtgggaatgctagccgaggctgcacgcacactcgaaaagctgggcgaccgtcgcctgctccacgattgtcagcagatgttgatgcgtctcgggggagggaccacagtgacctccagctag

SEQ ID NO: 17538 - DNA, 2301 bp, Artificial Sequence
  Description of Artificial Sequence: Synthetic coding sequence
atgttggcccatctgtcgcgtgctgccccctgcccgttggcggccggagctgtcgcggccgtggccgtggccgtgactaggtcactcacagcccagtccctacgaacggcacgactcggccctgcaacagtccccccctctcctctgccagcaatctcctctgaacctcatgatagagctggcaagacactgaccgatcccacaagtcatttcatagacaggatcaccgaagcatggtcacatgttgggtcgcattcaaaagcaaagcctgaacaaaggccaagtctgcattcaaggggaatgctggatcggagtcggcttgcattatgcaccctggtttttctgtgcctgtcctgcaatcctcttgccagtctgttaggagcccgcggacttccttccccttctgacaccacatctgtgtatcactctcccggtcggaatgtcctgggaaccgaaagtagagatggccctggttgggcccagtggctgcttcccccagtggtctggcttttgaatggcctcctcgtgttggtttctttggtcttactttttgtttacggggagcctgtgacacgcccgcacagtggccccgcagtttatttctggcgccatagaaagcaggcagacctcgacttagccaggggcgattttgcccaggctgcgcaacagctttggctggctctgagagcactggggagacctctgccaactagtcacctggatctggcttgctccctcctttggaacctcatccggcaccttttgcagcgcctgtgggtcggtcgatggctggctggccgcgctggtggactgcagcaagattgcgcgctccgggtcgatgcctcagctagcgcccgcgacgctgctctcgtctaccataagctccatcagctgcacacaatggggaagcacaccgggggccacctgacagctacaaacttggcacttagcgctttaaatctggctgaatgcgccggagacgctgtaagcgtagcgaccctggctgaaatctatgtggcagctgcgttacgagtgaagacatcactgccccgtgcacttcatttccttactagattttttctctcctccgctcgtcaagcttgtttagcccaatccgggagcgtgcccccagcaatgcagtggctctgccaccctgtgggccatcgattcttcgtggacggggactggtctgttctaagcacaccatgggaatcactgtatagcttggctggtaaccccgtggatcccctggctcaagtgacccagctcttccgggagcatttattggaaagagctctcaactgcgttacccagcccaatccgtcccctggctccgcagacggggacaaagaatttagtgatgccctggggtacctgcaactactcaacagctgctctgatgctgccggagctcccgcctatagcttctccatttctagctccatggccacaactacgggtgtggatccggttgctaaatggtgggcttcactgacggccgtggtgatccactggcttcgccgcgacgaggaagccgcagagcgtctgtgtcccctggttgaacacctgccgagggtcctccaggagtctgagcggccccttcccagggcagcactccacagtttcaaggctgccagggccctactggggtgtgcaaaggcagaatctgggccagcgagcctgaccatctgtgaaaaagcgtctggctatctccaagacagtcttgctaccaccccggcctcatcttctattgacaaagccgtccagttattcctgtgtgacctgctgctggttgtgagaacaagcttgtggcggcaacaacagccgcctgccccggctccggccgcacagggcacatcgagcaggccacaggcctcggctcttgagttaagaggttttcagagggacctttcaagtcttagaaggctcgctcagagtttccgaccggctatgaggagagtctttttgcatgaggctacagccagacttatggctggcgccagccctactcgcacacatcagctgctggatcgatctctccggcgaagagccgggccaggcggcaagggaggagccgtcgccgagctagagccccgacccacacgacgggagcatgccgaggcactgctattggctagttgctacttgcctcccggatttctttcagcccccggtcaacgtgttggtatgctcgccgaagccgcccgaaccctagagaagttgggggatcgacggctcctgcacgactgtcagcagatgctgatgagactgggagggggaactaccgtgacttcatcctag

SEQ ID NO: 17539 - DNA, 2682 bp, Artificial Sequence
  Description of Artificial Sequence: Synthetic coding sequence
atgaaaacagatggagccacagtcaaggccgcgggcttatcacctctagtttccgggaccacagttcagactggacccctccctactttggtgagcggagggactatcctggctacagtccccttagtggtggacgcggagaagttaccaatcaataggctcgcagcaggaagtaaagctcctgcctccgctcagagccgaggcgaaaaaaggacagcacacaacgcaatcgagaagcggtatcggtcttctatcaatgacaagatcatcgagcttaaagatttggtggtgggtacagaagccaaactcaataaatcggcggtgctccgaaaagctatagattacattcggttcctccagcacagcaatcagaaactcaagcaagaaaatctgtccctgagaacagctgttcataagagcaaatccttaaaggatctggtgtcggcgtgtggttctgggggtaataccgatgtgttaatggagggagtgaagacagaggtcgaggacacacttaccccgccaccatctgacgccggatctcccttccaatcctctcccttgtcacttggctcccgggggagcggtagtggagggagcggctctgactcagagcccgactcccccgtttttgaagacagtaaggctaaacctgagcagagacctagtcttcattcgcgtggtatgttggaccgcagccgcttagcgctctgtactttagtttttctctgcctttcttgcaatccgctggcctctctcctgggtgccaggggcctgcccagcccatccgatacgacttccgtctaccactctccaggaagaaatgtgttaggcactgagagtagagacggcccagggtgggctcagtggctgcttcccccagttgtctggctgctaaatggcttgcttgtcctcgtctccctggtgctcctctttgtctacggcgaacctgtcactcgtcctcattccgggccggctgtttacttctggcggcaccgtaagcaagctgaccttgacctagctcggggtgacttcgcccaggctgcccagcagttgtggctggcccttcgcgccctaggacgacctctcccgacatcccacttggacttagcgtgttcactgctgtggaatcttatccgtcatctgcttcagcgcttatgggtgggccgctggctggctggccgagcgggcggcctgcaacaggattgcgcccttagagttgacgcctcggccagtgcccgagatgccgccctggtctaccacaagctgcatcaattgcacacaatgggtaagcacacaggtggacatctgacggccacgaatctggctctctctgcactgaacctcgccgagtgcgcaggagatgccgtttctgtggccacactcgccgagatctatgttgcagccgccctgagagtaaagaccagcctgccacgcgccctgcactttctgacccggttctttctgagtagtgctagacaggcatgtctggctcagagcggatcagtaccaccggcaatgcagtggttatgtcaccccgtggggcatcgctttttcgtcgacggcgattggagcgtgctcagcacgccctgggaaagcttatatagcctggcgggaaaccccgtggatcctctggcacaggtgacccagctctttagagagcacctgctggaaagagcgttaaattgtgtgactcagcctaacccatcccctggatcagctgacggcgataaggagtttagcgatgcactcggatacctgcagcttctgaattcatgctccgatgctgccggggcccccgcctacagcttctctatctcttcctctatggctacaactaccggcgtggaccccgtcgctaaatggtgggcctcacttacagccgtcgttatacattggctcagacgggatgaggaagccgctgagaggttatgtccactggtggagcatctgccccgagtgctccaggagtcagagagaccactgccaagagccgctctgcactctttcaaggcggcaagggccctcctgggatgtgctaaagctgaatccggtccagcgagtctgaccatttgtgaaaaggcttctggttatctacaggactcactagctaccacacctgcttcttcatctattgacaaggcagtgcaattgtttctatgtgacttgctgctggtggtcagaacaagtctttggcgccagcaacagccccctgcccccgctccagctgcccaggggacaagtagccggccacaagctagtgcactggagctgagaggctttcagagggacctgtcttccctgcggaggctcgcacagtcctttcgacccgccatgcgtagagtgttcctccacgaggctactgcccgcctcatggccggcgcaagcccaacacgcacccaccagctgctagacagaagtttacggcgccgcgccgggcccggaggcaagggaggggcggtggcagaacttgagcccaggcctacccgccgggagcatgctgaagccctcctgctagccagttgctatcttcctcctgggttcctgtcagcccccggccagcgcgtgggaatgttggctgaggcagcgcgtactcttgagaagctgggggaccgcagactgctgcacgactgtcagcagatgcttatgcgtctgggaggaggtaccacggtgacttcctcttag

SEQ ID NO: 17540 - DNA, 2955 bp, Artificial Sequence
  Description of Artificial Sequence: Synthetic coding sequence
atggattgtacgtttgaagacatgctgcagctgataaataaccaagatagcgattttcccggtttattcgatcccccctacgctggaagtggagcaggtgggacagacccggctagcccagatacttcttctcccgggtctctgtcgcccccgccggccactctgagctcaagcctcgaggctttcttgtctggcccacaggccgcaccctcccccttatcccctccacagcccgcccccactcccttgaaaatgtacccatccatgccagcgttctctcctggtcccggaattaaagaagaaagtgttcctcttagtattctgcagacaccaaccccccagcctctgccagtgcctactctggtgtctggcgggactattctggctactgttcccctggtcgtggacgcagaaaaactgcctattaataggctggctgccgggtccaaagcacccgcctcagctcagtctagaggtgaaaaacgaaccgctcacaacgccatagaaaagcgctatcgcagcagcatcaatgacaagattatcgaattgaaagatctggtggtgggcactgaagccaaattgaacaagtcagctgttctacgcaaggccatcgactatatcaggttcctgcaacactccaaccagaaactgaagcaagaaaatctttctctgcgcacagctgtccataaaagcaaatctctgaaagatttagttagcgcctgtggcagtgggggcaacaccgacgtactgatggagggggtcaaaactgaggtcgaggacaccttaacccctcccccgagcgacgctggttcaccgtttcagtcctctccgctctctcttgggtccaggggaagcggatctggagggagcggatcagattcagagcctgatagtcccgtgtttgaagacagcaaagccaagcccgaacagaggccgtcgctacactcaagggggatgctggacagatctaggctcgcgttatgcacactggtgttcctctgcttgtcgtgtaatccccttgcctcgctcttgggagcaaggggtctcccttcgccctccgatacaacaagcgtttaccactctccagggcggaacgtgcttggcactgaatctagggacgggccaggttgggcccagtggttactccctccagtggtatggttattgaatggcctgctcgtcctggtgagccttgttctgctgttcgtgtacggcgagcctgtcacccgccctcacagtgggccggcagtgtacttctggagacacagaaaacaggcagacttggatctggcacgaggtgatttcgcacaggccgctcaacagctgtggttggcactgcgcgcactcggaagacccctgcccacaagccatttggacctggcctgttccctgctctggaatctgatccgacatcttctgcagaggctatgggtcggacgttggctagctggcagagcaggagggttgcagcaagattgcgcgttgagggtggatgcctctgcaagtgcacgggacgccgccctagtgtatcataaattgcatcaactgcacacgatgggcaaacacacgggagggcatctaacagcaactaacctggctttatccgcgttgaacctcgctgagtgtgccggagatgccgtgagtgtggctaccctcgcggagatttacgtggccgcagccctgcgagtgaagacttccctacctcgggcgctgcatttcctgactcgcttcttcctcagttcagcccggcaggcctgcctggctcagtctgggagcgttcccccagcaatgcagtggctgtgccacccggtgggacacagattcttcgtcgacggggactggtctgtactgtctaccccatgggagagcctctacagtttagctggaaatcctgtggatccactggcacaagtcacccaactctttagggagcatttactcgaacgggccctgaattgtgtgacacagcccaacccatcgcctggctctgcggacggagacaaggaattttctgacgcgctcggatatctacagttattgaacagttgttctgatgccgcaggcgccccagcctatagttttagcatctcctccagcatggcaaccacgactggtgtggatccggttgccaagtggtgggcctctctaaccgccgttgtgatccattggttaaggcgggatgaggaggcagccgaaagactttgcccattggtcgagcatctcccccgtgtcttacaggagtccgagaggccactgccgagagctgccctgcacagcttcaaggccgctagggctttgcttggctgcgccaaggccgaaagcgggcctgcatctctgaccatttgtgagaaagcatcagggtacctccaggactcgcttgcaaccaccccagcttcctcatcaattgacaaggccgtgcagctcttcttatgcgacctgctgctggtggtgcggacgagcctgtggcgtcaacagcagccacctgcccccgcccccgcagcccagggcacatctagccggccccaggcaagcgctttggagctgcggggcttccagcgggatcttagcagcctccggcggcttgcccagagcttcagaccagccatgcgaagagtgtttctgcatgaagccaccgctaggctgatggccggggcgtctcctactcgaactcaccagctgctggatcgatctctgcggcgtagggcaggacctgggggcaaaggtggcgcagtggccgaactggagcctcggccaacacgccgcgagcacgccgaggctctgttgctcgcctcctgttatctgccgcccggtttcctgagtgcccccggccagagagtgggcatgttggccgaggcagccaggaccctcgagaaactgggcgaccggaggctactgcatgactgccaacaaatgctgatgaggttgggagggggaaccactgtcacttcctcctag

SEQ ID NO: 17541 - DNA, 3222 bp, Artificial Sequence
  Description of Artificial Sequence: Synthetic coding sequence
atggactgcactttcgaagatatgcttcagcttattaacaaccaggatagcgacttcccaggcctttttgatccgccacagcctgctccaacacccttgaagatgtacccctcgatgccagccttctctcctgggcctggcatcaaggaagagtccgtgcccctgagcatactccagactcctacaccccagcccctgcccggggccctcctgccccaaagcttccctgcaccagcaccacctcaatttagtagtacccccgtgctggggtatccatcaccgcctggaggtttcagcacaggttccccccccggtaacactcagcaacctctacccgggctgccacttgcttcccctcccggggttcctcctgtgtcacttcatactcaggtgcagtcagtggtgccgcaacagttgctgacagtcaccgcagcgccgacggctgctcccgtgacgaccaccgtgaccagtcaaatccagcaggttcccgttctcctgcagccccacttcattaaagccgattccctcctactgactgctatgaaaacagacggggccaccgtaaaagctgccgggttgagtccactggtcagcgggactaccgtgcagactgggcccctgccgacacttgtctcggggggaactatcttggctacagtccctttggtggttgatgctgaaaagctgccaattaatagactcgccgccggatctaaggccccagccagcgcacaaagccgcggagaaaaacggacggctcacaacgccatcgagaaacggtacaggtcttccatcaacgataagatcattgagctaaaggatcttgtggttggcactgaagccaaacttaataagagtgctgtgcttcgtaaggctattgactatatccggtttctgcaacactcaaatcagaagctgaagcaggaaaacctgagtctaaggaccgcggtgcataagtccaaatccctgaaagatctggtgtcggcgtgcggttctggaggcaataccgacgtgctcatggagggggtgaagacagaggtcgaagatacgctgacacctccaccaagcgacgcaggatcgccctttcagtctagcccgctttctctgggctccaggggctctggcagcgggggttccggaagcgactccgagccagatagtccagtctttgaggattccaaggcaaaacccgagcagcgcccgtctctacattcacggggtatgctcgaccgttcacgacttgccttatgcaccctagtgttcctgtgcctgagttgtaatcctctagcgtcactcctcggggcacgtggcctgccatctccaagtgacaccacctctgtctatcattcgcctgggcgcaatgttctcggcacagagagccgggatgggcccggatgggcacagtggctgttacccccggttgtttggttgctaaacggattattagtcctggtgtctctggtcctcctatttgtgtatggagaacccgttacaaggccccattccgggcccgctgtctacttttggcggcataggaagcaagccgacctcgacctggcccggggtgattttgcacaggctgcgcaacagctgtggctggcactgcgggcgctaggccgccctcttccaacaagccatttggacctggcatgctccctcctgtggaacctgatcagacacttattacagaggctctgggtgggaaggtggctggctgggagggccggaggtctgcagcaagactgcgccctgcgggtggacgcgtccgcatccgctcgggacgctgcattggtctaccataagctgcaccagcttcacactatgggaaagcacaccggcggccacctgacagctactaacctagccctgtcagccctgaacctggccgagtgtgcaggagatgccgttagtgtggcaacgctcgcagaaatatacgtggcagcagccctgcgtgtgaaaacttcccttccaagggcgctgcacttcctgactagatttttcctttcatccgcgaggcaggcctgtcttgcacagagcggctccgttcctcctgcaatgcagtggttgtgtcatccagtgggccataggtttttcgtggatggggactggagcgtgctgagcacaccctgggagagcctgtattctctggccggcaatccagtcgacccactggctcaagtgacgcagctatttcgggagcaccttctggagcgggcactgaattgtgtcacgcaaccgaatccaagtccaggatccgcggatggcgataaagagttttcggatgccttaggctacctacagctcctaaacagctgctctgatgcagccggtgctcctgcttacagcttctccatctcttcttccatggcaacgaccaccggagtggatccggtcgctaaatggtgggcctcactgaccgccgtagtgatccattggcttagaagggatgaggaggccgctgaacgtctgtgcccccttgtggagcacctgccccgcgtgctgcaggagagcgagagacctcttccaagagccgcattgcattctttcaaggccgctagagccctgcttggatgcgccaaagccgaatctgggcccgctagcctgacaatctgcgagaaggcatccgggtacctgcaagactccctagcaaccaccccggccagttcatccattgacaaggctgtccagctcttcctctgtgacctcctgctggttgtgagaacatccctatggaggcaacagcaaccacctgccccagcccccgctgcacaggggacctcatcccggccacaggcgtcagcgcttgagctgcgcggttttcagagggacctgtcctctctgcgccggcttgcacagtcctttagacctgcgatgagaagggtgttcctgcacgaagccacagcaagactgatggccggtgcctccccaacacggacccaccagttgttagatcgcagtctgcggagaagggccggacccggaggaaaaggcggcgcagtggctgagcttgagccgagacctacacggcgcgaacatgctgaggctttgcttctcgctagctgttatctaccccctggcttcctgtcagcccccgggcagagagtgggcatgctggccgaagcggccagaaccctggaaaaactcggcgaccgcaggctcctccacgactgtcagcagatgctgatgcggttaggcggggggaccacagttaccagctcctag

SEQ ID NO: 17542 - DNA, 1413 bp, Artificial Sequence
  Description of Artificial Sequence: Synthetic coding sequence
atggatgagccccctttctctgaggccgccctggagcaagccctgggagaaccatgtgacctagatgcagccctcctgactgatatcgaggacatgctccaattaatcaataatcaggacagcgactttccaggtcttttcgatccgccttacgccggctcaggcgcaggaggtaccgaccccgcctcgcccgacactagctcacccggatcactgagtccacctccagccactctgagctcctcgctggaagcttttttatccggcccccaagctgctccatccccattgagccccccacagccagccccaacccctttgaaaatgtatcctagcatgccagctttttcaccaggcccagggatcaaggaggagtctgtcccgttgtccatccttcaaaccccgacaccacagccactccctggtgctctgctgccgcagtctttccccgcaccggcccccccccagttctcttcaactccagtgttgggatacccatccccacctggagggttctctaccggtagccctccaggaaacacacagcagcctcttccggggctcccccttgcgtccccacccggcgtgccaccagtgtctctccatacccaggtacagtctgtggtgccgcagcaactgctaacggtcactgccgctcccaccgctgctccagtgaccacaaccgtcacaagccagatccagcaggtgccagtgctcctgcaacctcatttcattaaggcagactccttgcttctgacagcgatgaaaaccgacggcgcaactgttaaggcagctggactgagccctttagtttctgggacaactgtgcagactggccccctgcctactttggtctccggtggcacgattttggctacggtacccctcgtggtcgatgcagaaaagctgccaattaatcggttggccgccggatcaaaagcgcctgcctcagcacaaagcagaggcgaaaagagaaccgcccacaacgcaattgagaagcggtaccggagtagcattaacgataaaattattgaactgaaggacctcgtggtgggcaccgaggcaaagcttaataaaagcgcagtcctgcggaaggccattgactatatcaggttcctgcagcattcaaatcaaaagcttaaacaagagaaccttagcctccgaaccgctgtgcataagtcgaagagtctgaaagacctggtctccgcctgcggcagcgggggcaacacagatgtactaatggaaggtgtcaagaccgaggtcgaggacacgctaacaccccccccttccgacgctggtagcccattccagtcatcaccgctgtcgctgggaagtagggggtctggatccggaggcagtggatcagattctgaaccagacagccccgtgttcgaagacagtaaaacggagtag

SEQ ID NO: 17543 - DNA, 645 bp, Artificial Sequence
  Description of Artificial Sequence: Synthetic coding sequence
ctcatgcccgcctgccttccaggcaagcatactggaggacatcttaccgcgacgaatctcgccttatccgcactcaatcttgctgaatgcgctggagatgctgtatccgttgctacccttgccgagatttacgtagctgcagcgctgcgtgtgaagaccagcctaccgcgtgcccttcattttctgacccgtttcttcctgtcatctgctcgtcaagcctgtctcgcccagagtggttccgtgcctcccgccatgcagtggctgtgccatccagtaggacaccggttcttcgtggacggggattggtccgtgctgtctactccctgggaaagtctctactccctagcgggaaatcctgttgacccactggcacaggttacgcagctcttccgcgaacacctgctggagagagctttaaattgcgtgacccaacctaaccccagtcctggatcagctgatggggacaaggagtttagcgacgccctggggtatctgcagttgctcaacagctgttccgacgccgcaggggctcctgcgtactccttttcgataagctcgtccatggcaactaccacgggcgatccctgtcccggtcagctgtgtactccttccagactccctggcccttgctgggctgttccttag

SEQ ID NO: 17544 - DNA, 747 bp, Artificial Sequence
  Description of Artificial Sequence: Synthetic coding sequence
atggaaagggcttccctgattcagaaggccaagcttgcggagcaggctgaaaggtatgaagatatggcagcctttatgaagggggctgtcgagaagggcgaggagctttcatgcgaggagagaaatctcctctcagttgcttataaaaacgtagtggggggtcagcgagctgcctggcgagtgctgtccagcattgagcagaaaagcaacgaggaagggagtgaagaaaaagggccagaggtaagagaatacagggagaaggtggagacagagctccagggggtgtgtgacaccgtcctcggactcttagactcccacctaatcaaggaggctggggacgcagagtcaagagtgttctatctcaagatgaagggagattactaccgatacctagctgaagttgcaacgggcgacgacaaaaaaaggatcatcgattcagctagatccgcttaccaagaagctatggatatcagtaagaaagagatgccacccaccaacccaatcaggctgggtttggccttaaacttctccgtgtttcattatgagatcgcaaactctcccgaggaagctatatccctagctaaaacaacatttgatgaagcgatggctgatctgcacacgctatcagaggattcctacaaggactctaccctcattatgcagctcctgcgcgacaacttaacactgtggacggctgacaacgccggcgaggaagggggcgaagccccccaggagcctcagagctag

SEQ ID NO: 17545 - DNA, 651 bp, Artificial Sequence
  Description of Artificial Sequence: Synthetic coding sequence
atggaacgggccagtctgattcagaaggctaagctggcggagcaggcagagaggtatgaggacatggccgcttttatgaagggcgccgttgagaagggagaagaactgtcttgtgaggagcgaaacttgctttctgtggcttataagaacgtggtcggcggacaacgcgccgcttggagagtgcttagctctatcgagcaaaaatcgaatgaagagggctctgaggagaaaggacccgaagttcgcgagtaccgcgtcttttatctcaaaatgaaaggtgattattaccggtatttggccgaggtggcaactggggatgacaaaaagcgcattatcgatagtgcccgctccgcctatcaggaggcaatggatatcagcaaaaaggagatgccaccaaccaatccgattagactgggtttggcattgaacttttccgtcttccactacgaaattgctaatagcccagaggaggcgatctctttagccaaaacaactttcgatgaagcgatggccgaccttcacaccctgagcgaggatagctataaagacagcactctcatcatgcagctgctgcgagataacctgaccctgtggacagccgacaatgctggggaggaaggcggcgaggccccccaggagccccaatcctag

SEQ ID NO: 17546 - DNA, 3702 bp, Artificial Sequence
  Description of Artificial Sequence: Synthetic coding sequence
atgggatttctcaaactgattgaaattgagaacttcaagagctacaaggggcgtcagatcatcggacccttccagcgctttactgccattatcggaccaaacggatcaggaaaaagcaacctgatggatgctattagctttgtgctcggtgagaagacttctaaccttcgggtaaagacactaagagatcttatacacggtgcccctgtggggaaacctgccgccaaccgggcatttgtgagtatggtctacagcgaagaaggcgccgaggacaggacattcgcacgcgtaatcgtggggggctcctcagagtacaagatcaataacaaagtcgtgcaactgcacgaatattcagaagagctcgaaaagctgggcatactgataaaggcacggaattttcttgtgttccagggcgccgttgaaagcattgccatgaaaaatccaaaggagaggactgcactttttgaagaaatatcacgatccggggaattggcacaagagtatgataagcgcaagaaggaaatggtgaaagctgaggaggatacccaattcaattaccacagaaagaaaaatatcgctgccgagaggaaagaggccaaacaggaaaaggaggaggccgatcgttatcagcgcctaaaggacgaagtcgtccgagcgcaggtccaactgcagctcttcaagctctatcacaacgaagtagaaattgaaaagctgaacaaggagctggcatctaagaacaaagaaatcgaaaaggataaaaagcggatggataaggtggaggatgaactcaaggagaagaagaaggaactaggcaaaatgatgagagaacagcagcagatcgaaaaagaaattaaggagaaggatagcgaactcaatcagaaacgaccacagtacataaaggccaaagagaacacgtctcataaaattaaaaagctcgaggctgccaagaagtcactccagaacgctcagaaacattacaagaagcggaagggggacatggacgagctagaaaaggaaatgctaagtgtggagaaggcacgacaagagttcgaggaacgaatggaggaagagtctcagtctcaggggcgtgatctgacgttggaggaaaaccaggttaaaaagtatcaccggttgaaggaggaagctagtaagcgcgctgccacactcgctcaggaactggagaagttcaaccgcgaccagaaggccgatcaggatcgcttggatctggaagagcgcaagaaggtcgagacagaagccaagatcaaacagaaattgcgggaaattgaggagaaccagaaacgcatcgagaaacttgaagagtacatcactacatccaagcagagtttggaggaacaaaagaagttagaaggggaattgacagaggaagtagagatggctaagagacgcattgatgagatcaataaagaacttaatcaggtcatggaacagcttggcgacgctcgtattgatcgccaggagtcctctcggcagcagcggaaggccgaaattatggagtctattaaacgactctatcctgggtcagtgtacgggaggttaattgacctctgtcagcctacacagaagaaataccaaatcgcagtcacgaaagttctgggtaagaacatggatgccatcatagtggattccgaaaaaacaggaagagattgtatccaatacatcaaagaacagcgcggagagcccgagacctttttgcctcttgattacttagaagtgaagcccaccgatgagaaactccgggaattaaagggggccaaactagtgattgacgtgattcggtacgaacctccacacattaaaaaggccttgcaatacgcctgcggaaacgcactcgtttgtgataacgtggaggacgcgaggaggatcgccttcggggggcaccagcggcacaagactgtagctttggacggtaccctattccagaagtcaggggtcatcagcggcggcgcctctgacctgaaagctaaggctcggcggtgggatgaaaaggcggtggacaaactgaaagaaaaaaaggaacgtctaactgaggagctcaaagaacagatgaaagccaagcggaaagaagccgaattgcggcaagtgcagtctcaggcacatggactgcagatgcggcttaagtatagccaatcagatctggaacaaactaagacgagacacctcgctttgaaccttcaggagaaatctaagctagaaagcgagctggccaattttggcccacgtatcaacgacatcaagaggattatccaatcccgcgagcgggaaatgaaagatttgaaagagaaaatgaatcaggtggaggacgaagtattcgaggagttctgtagagaaattggtgtcaggaatatccgtgaattcgaagaagagaaggtgaagcgtcagaatgagatcgccaaaaagcgcttagagtttgaaaatcagaagactcgcctggggatccagctcgatttcgagaagaaccagctgaaagaagaccaggataaagtccacatgtgggagcagacggtcaagaaggatgagaatgagattgaaaagctaaaaaaggaagagcagcggcacatgaaaattatagatgaaaccatggcccagttacaggacttgaaaaatcagcacctggcaaaaaagagtgaagtgaacgacaagaatcacgaaatggaggagataaggaagaagctgggaggagctaataaagagatgactcacctgcaaaaggaggtcacagcaattgagaccaagctcgagcagaaacggtctgaccgacataatctgctccaggcttgtaagatgcaagatataaaacttcctctgagcaaaggtacgatggatgacatcagtcaggaagaggggtcgagccagggcgaggacagcgtgagtggatcacagagaatttcgtcgatctatgccagagaagctctgattgagatcgattatggagacttgtgtgaggatctgaaggacgcccaggcagaggaagagattaaacaagagatgaataccctccagcagaagcttaatgaacaacagtccgtgcttcagaggattgctgcacccaacatgaaggccatggaaaagctggagtctgtgagagacaagttccaggagacatcagacgaattcgaagccgctcggaaaagagccaagaaagctaagcaggcctttgaacagattaaaaaggaacggtttgaccgcttcaacgcttgcttcgagtccgtagctacgaatattgacgagatctataaggccctgagtcggaatagctctgcacaggcctttctgggtcccgagaatccggaagagccatatctcgacgggatcaattataactgcgttgcgccgggtaagcgcttcagacccatggataatctatctggcggcgagaagaccgtcgctgcactcgccttgctgtttgccatacattcttacaagcccgcgccattttttgtgctcgacgaaattgacgcagcactcgataataccaatatcggtaaagtcgctaattacataaaggaacagtctacttgcaatttccaggccatcgttatcagtctgaaagaagagttctatactaaagcggagtctctgatcggggtgtaccctgagcagggcgactgtgttatttccaaggtgctgacatttgacttgacgaagtacccggacgctaaccccaatcccaatgaacaatag

SEQ ID NO: 17547 - DNA, 612 bp, Artificial Sequence
  Description of Artificial Sequence: Synthetic coding sequence
atgggattcttaaaacttatcgaaattgaaaactttaagagttataaaggccgccagatcatcggacccttccagaggttcaccgcaattatcggtccgaatggctctggaaaaagcaatcttatggatgccatatcctttgtcttaggagagaagacctccaacctaagggtaaaaacactgcgcgatttgatacacggtgctccagtcggcaaacccgccgcgaaccgtgctttcgtgtcaatggtctacagcgaagagggtgcagaggaccgaacctttgctagagtgatagttggagggagttcagaatataaaatcaacaataaggtggtgcagctccacgagtactccgaagagttagaaaaattgggaattcttataaaagcgaggaatttcctcgtcttccaaggctgctgcggcatttattgccatgagacgccaaaacgtgggcaactttacttaaagatctcgagatcgggcgagctggcccaggagtacgacaaacggaaaaaagagatggtcaaggctgaggaggatacgcaatttaactatcacagaaagaaaaacattgccgcagagcggaaagaggccaaacaggagaaggagtag

SEQ ID NO: 17548 - DNA, 1551 bp, Artificial Sequence
  Description of Artificial Sequence: Synthetic coding sequence
atgggctttctcaagttaatcgagatcgaaaactttaaaagttataagggaaggcagatcattggaccattccaaaggttcactgcaatcatcggcccgaacggatccggtaagtctaacctgatggatgctatctcatttgtattgggagagaagacaagcaatctcagagtgaaaacactgcgcgacttaattcatggagctcccgtgggtaagcctgcagctaatagagccttcgttagtatggtttactccgaggaaggtgctgaggacagaacctttgcaagagtcatcgtgggaggatcaagcgaatacaaaatcaataataaggtcgttcagctgcacgaatacagtgaagaactagagaaattgggcattcttatcaaagcaagaaatttcctggttttccaggtgaagaagtaccacaggctaaaggaagaagcctcaaaacgcgcagccacactggctcaggagcttgaaaagtttaacagggatcagaaagctgaccaggatcgtctggatctggaagaacgaaaaaaagtcgaaacggaggcaaagatcaaacagaaactccgggaaatcgaggagaaccagaagagaatcgaaaaattggaggagtacatcacaacgtctaagcagtctctcgaagagcagaagaaactcgaaggcgagttgacagaagaggtggagatggctaagcgaagaatcgacgagatcaacaaggaattaaatcaggtgatggagcagcttggagacgcaaggatcgatagacaagaatcaagtcgccaacaacgtaaagctgagattatggaatcaatcaagaggctgtatccagggtcagtatacggcaggctgattgacctgtgtcagcctacccaaaagaagtaccagatcgcagttaccaaagtactggggaagaatatggatgcaataatcgtggacagtgaaaagacgggtcgagattgtattcaatatattaaagagcaacgaggagagcctgaaacttttttacctttggattaccttgaggtgaagccgaccgacgagaagttgagggaactcaagggcgcaaagttagtcattgacgtgattcggtacgagcctcctcatattaaaaaagctttacagtatgcgtgtggaaacgccctggtctgcgataatgtggaggacgcccggcgaattgcatttggtggacatcagcgccataagaccgtcgcactggacggaacactttttcaaaagtccggggttatttcagggggcgccagcgatctcaaagccaaagccaggcgatgggacgagaaggccgtagataaactcaaggaaaaaaaagaaaggttaactgaagaactaaaagaacagatgaaagccaaaaggaaagaggccgagctccgccaggtccaatctcaggctcatggattgcagatgcgacttaagtacagtcagtcagatctggagcagaccaaaacgcgccatctcgcactcaacttgcaggtgggcccaggactgcagccatgttcccccaaagccatacacaccttcctggcgtag

SEQ ID NO: 17549 - DNA, 870 bp, Artificial Sequence
  Description of Artificial Sequence: Synthetic coding sequence
tagtggtacacccccacgcccttttacagtagcctggaggctgcactgttgaacttcagaccaagcgcacccgtctttcggatgctcgaagtaagcattcctactccccatcgctacgtcagaggaaaaagtaatttgatggatgctatcagttttgtgctcggcgagaagacatctaatcttagggtgaaaacactgcgtgatctgatccacggggccccagtcggcaaacccgccgctaatagggcttttgtctccatggtatactccgaggagggcgctgaggatcggaccttcgccagggtcattgtggggggaagctctgagtacaagataaataacaaggtagtgcagctgcatgaatacagcgaggagctcgagaaactgggaattctgattaaggcgcgcaacttcctggtgttccagggcgctgtggaaagtatcgccatgaagaaccctaaggagaggaccgccctgttcgaggagatatcacggtccggtgagctcgctcaagaatatgataaaagaaagaaagaaatggttaaagctgaggaagacacccagttcaattaccatagaaaaaaaaatatcgcagccgaaagaaaggaggccaaacaggaaaaggaagaagctgatcgctatcaacgattgaaggacgaagttgtccgggcccaggttcagttacagctttttaaactgtaccacaatgaagtcgaaattgagaagttaaataaggagttagcgagcaaaaataaggagattgaaaaagataagaagcggatggacaaggtggaggatgaacttaaggagaagaaaaaggaactgggaaagatgatgcgtgaacagcagcaaatagagaaggaaatctag

SEQ ID NO: 17550 - DNA, 1995 bp, Artificial Sequence
  Description of Artificial Sequence: Synthetic coding sequence
atgagcggggtgcgcggcctgagtcgtttactgtcggcccgacggctggccctggcaaaagcgtggccaacagtgttgcagactggcacccgaggtttccatttcacagtggatggcaacaaacgtgctagcgccaaagtgtccgattctataagcgctcaataccctgtggtcgaccacgaatttgacgcagtcgtagtcggggccggcggagccgggctgagggccgcatttgggctgtccgaggctgggtttaacactgcctgcgtgacgaagctcttcccaaccaggtctcacacggttgcagcccaaggaggaatcaacgctgccctgggcaacatggaggaggacaattggcggtggcacttctacgacacggtgaaagggtcagattggttaggagaccaggacgctatccactatatgaccgagcaggcaccagctgccgtagtagaactggagaattatggaatgcccttctctaggactgaggacggtaaaatctaccagcgagcttttggggggcaaagtctgaagtttggtaagggaggccaggcccaccgttgctgctgtgtggccgaccggaccggacactccttgctgcacaccttatatgggagatctcttcgctacgacacaagctacttcgtcgagtatttcgccctggacctgcttatggagaatggagagtgccgcggagtgattgcactgtgtattgaggatggctctatccacaggattagagcgaagaacacggtggtagccactggggggtacggccggacatactttagctgcacatccgcccacactagcaccggggacggtaccgcgatgatcacccgggccgggctcccgtgccaggatctggagtttgttcagtttcacccaaccggaatttatggcgcgggctgcctcatcactgagggctgtcggggggaagggggtatcctgattaactcccagggcgaacggttcatggaacgttacgccccagtggctaaagatctggcatcacgcgatgttgttagtcgcagcatgacactggaaatcagggaagggcgaggttgcggtcccgaaaaggatcatgtgtaccttcagctgcaccatcttccacctgaacagctggccaccagattgcccgggatttccgaaaccgccatgatttttgccggagtcgatgtgaccaaggagcctatccctgtgctgcccaccgtgcattataacatgggaggcatacccactaactacaaggggcaggtactacgacacgtgaacgggcaggatcaaatcgtgccggggctatacgcctgtggggaggcggcttgcgcctcagtgcacggtgctaaccgactgggagctaactcactgctcgacttggtcgttttcggtagagcttgcgcacttagcattgaggagtcatgccgcccaggcgataaggtgcctcctatcaagccaaacgcaggcgaggaatcagtcatgaatctagataagctgcgtttcgccgacggctccatccgcacttcagagctgagactgtccatgcagaagtcgatgcaaaaccacgccgctgtcttcagagttggctcagttctgcaggagggctgtggcaaaatttccaaactgtacggggacctcaaacatttgaagacctttgatagggggatggtttggaataccgacttggtcgaaacgcttgagctgcagaacttgatgctgtgcgctttgcagacaatttatggagcagaggctagaaaagaatcgcggggcgcacacgcccgagaggactacaaagtgcgcattgacgagtatgactacagcaagccaatccagggccagcaaaagaagccgttcgaggagcattggcggaaacacacgctttcatatgtcgatgtgggcaccgggaaggtcactctggaatatcgacctgtgatagataaaacattgaatgaggctgactgtgccacagttcctccagccatccgaagctactag

SEQ ID NO: 17551 - DNA, 1560 bp, Artificial Sequence
  Description of Artificial Sequence: Synthetic coding sequence
atgtccggcgtaagaggcctgagccgcctgttgagcgcacgaaggctcgcgctggcgaaagcatggccgacggtgctacaaactggtacaagagggtttcactttacagtagacggaaacaaaagggcatctgccaaggtctccgacagtatctctgcccagtaccccgttgtcgatcatgagtttgacgccgtggttgttggcgccggaggtgctggcctgcgcgccgcctttgggctgagcgaagccgggttcaataccgcctgtgtgacgaagctttttcccaccagatctcacacggtggctgcccagggagggattaatgccgccctgggcaatatggaggaggacaactggcgctggcacttttatgatacgtcaaccggcgacggtacagctatgattactagggccggcctaccctgtcaggatctcgaattcgtgcagttccaccctaccggcatctatggggcgggctgtctgattacagagggatgtcggggagaaggcggaattctcatcaattcacagggggaacgattcatggaacgttacgcaccggtcgccaaggacctcgcatctagggatgtggtgtcccgcagcatgacactggagattagagaagggagaggatgcggcccagaaaaggaccacgtgtatctgcagctccaccatctccctcccgaacagctggccacacggctacctggcatctctgagaccgccatgatatttgctggcgtcgacgttaccaaagagcccatccccgtcctccctacggtgcactataatatgggggggatccccacaaattataagggccaggtactgcggcatgtgaatggtcaggatcagattgtccccgggctctatgcctgcggcgaggctgcctgcgctagcgtgcacggtgctaacaggcttggagcaaattcattgttggatctggtcgttttcgggagagcgtgtgcattatccattgaagaatcctgtcggcctggagacaaggtgccacctataaaacccaatgcaggagaggagtctgtgatgaatctggacaagctcaggtttgccgatgggagcatcaggacctcagaactccggctgtctatgcagaaatccatgcagaaccacgccgcggtcttccgcgtcggcagcgtcctgcaggagggctgcggtaagatttctaaactctatggagatttgaagcacctgaaaacgtttgacagaggtatggtttggaacacggacttggttgaaacactcgaactacagaacctcatgctttgtgctctccagaccatatatggggcagaggctcggaaggagtccagaggtgcccacgctcgcgaagattataaagtgcggatcgacgaatacgactatagtaaacctatacaaggccagcagaagaaacccttcgaagaacactggcgcaagcacaccctgtcttacgtggacgttggaacggggaaagttacactagaatatagacccgtaatagataaaactctgaacgaggctgactgcgcaactgtgccgcctgctatccgttcctactag

SEQ ID NO: 17552 - DNA, 6645 bp, Artificial Sequence
  Description of Artificial Sequence: Synthetic coding sequence
atgaaacgcaaggaacgaatcgctcgcagattggaaggcattgagaacgatactcagcctatactactgcagagttgcaccgggctggtcacacatagactcctggaagaggacactccgcgctatatgcgagccagcgacccagcttcacctcatattggcaggtccaacgaggaagaagagactagcgactcttccttggagaaacaaacacggagcaagtattgcactgagacttcgggcgtgcatggggattccccctacggcagtgggacgatggacacccactcccttgagtcgaaagctgagaggatcgcacgttataaggctgaacggcgaagacagctcgctgagaagtacggacttacactggaccccgaagcagattccgagtacctgagcaggtacactaagagcaggaaggagcctgacgccgttgaaaagcgcggagggaagagtgataagcaggaagaatcgagcagggatgcaagctcattgtacccgggcactgagactatggggcttcggacctgcgcgggggaatccaaggactatgcattacacgtaggcgacgggagcagcgatcctgaagtcctgctgaacatagagaatcagagacgaggccaggagctgagtgctacccgccaggcccatgatctgtcacccgctgccgaatcttcatcgaccttcagctttagtggcagggattctagcttcacagaggttccccggtcgcccaaacatgcacatagttcctccttgcagcaggcagctagcagatcgcctagcttcggcgatccgcagctctcaccggaggccaggccctctactggcaagcctaaacatgagtggttcttacagaaggattcagaaggggatactccctccctcattaattggcccagcagggtgaaggtccgtgaaaaacttgtaaaagaagaatccgcgagaaactcgcctgaactcgcctccgagtctgtaacacaacgccgacatcaaccagcacccgtccattacgtctcttttcagagtgaacacagcgctttcgacagagtcccttccaaagctgccggatccacacgccaaccaattcgcggatacgtgcaaccagccgacacaggccacacggcaaaattggtgactcccgagactccagagaacgcttcagagtgttcttgggttgcaagcgccacacagaacgtcccaaagccaccaagcttaaccgtgctggagggcgatggaagggatagccctgtgctgcacgtatgtgagtcaaaggccgaggaggaggagggggaaggagagggcgaggaaaaagaggaggatgtgtgttttactgaggccctcgagcagagcaaaaagacgttactagccttggagggagacggactcgttcgatctcccgaagatccttctaggaacgaggacttcggaaagcctgccgtgtccaccgtgactctcgagcaccaaaaagaacttgaaaatgtggcccaaccccctcaggcacctcaccagcccacagagagaactggcaggagcgagatggtgctgtacatccaaagcgaacccgtcagtcaggatgccaagccgacggggcacaacagggaagccagtaagaaaagaaaagtccgcaccaggtccctaagcgacttcactggcccccctcagcttcaggccctgaaatacaaggatccagctagccgccgtgagctggagctcccatcctctaaaaccgaggggccctacggtgagataagtatgctcgacacaaaggtgtcagtggcacaattaaggagcgcatttctggccagcgccaatgcctgtcggcgacctgagctgaaatcccgggtggaaaggtctgccgaaggacccggtttgcctacaggcgtcgagcgcgagcgcgggtcccgcaaaccccggcggtatttttctcccggcgaaagccggaaaacttccgaacgattccggacccagcccatcacatccgccgagcggaaagagagcgatagatgtacatcccactccgaaacccctacagttgacgacgaggagaaggtagacgagagagcgaaactcagtgtcgcggccaaacggcttctgttccgagagatggaaaagtcgttcgacgagcagaacgtccccaaacggagaagccgcaatacggccgttgaacagagactccgacgacttcaagatcgctctctgactcagcccatcacgacagaagaagtggtgattgcggccaccgagccgatccccgcaagctgctccggcggtacccatcccgttatggcccgcctcccctcgccaacagtggccagatcagcagtgcagcccgcaagactccaggcaagcgcgcaccagaaagccctggctaaggaccagaccaatgaaggcaaggaactcgctgagcaaggggagccagactccagcacactcagcctcgctgaaaagctggcattgttcaacaagctgagccagcccgtgagtaaggcaatctccacaaggaatcggatcgacacacgacaacgaaggatgaatgctcggtaccaaacgcagccggtcactctgggcgaggtcgagcaggtgcagagcgggaagttgattcccttcagccctgctgtgaacactagcgtgtctaccgtggcaagtacggtcgcccctatgtacgcgggcgacctgaggacaaagccacctctggaccacaatgcctctgccacagattataagttttccagttcaatagaaaactccgattcacctgtgcggtcaatcctcaaaagtcaggcctggcagccgctcgtggagggatcagagaacaagggcatgcttagagaatacggcgaaaccgaaagcaagagagccttaaccgggcgggattccggcatggagaaatacggttcatttgaggaggctgaggccagctaccctattctgaatcgagccagagagggtgattcccataaagagtcgaagtacgccgtgcccaggagaggtagcctggagcgcgctaaccccccaattacacaccttggcgacgaaccaaaggaattctccatggcaaagatgaacgctcaggggaaccttgatctacgggaccgcctaccctttgaagagaaggtagaagtcgaaaatgtcatgaagcggaagttcagtctccgggccgccgagttcggagagcctactagtgaacagactggaactgcagctgggaaaaccatcgcacagactacagcacccgtctcctggaagcctcaggatagtagtgaacaaccccaggagaaattatgtaaaaacccttgcgcgatgttcgccgctggcgaaatcaaaacacccaccggcgaaggactccttgattccccaagcaagaccatgtctatcaaggaacggctagcccttctcaaaaaatccggcgaagaggattggcgcaaccgcctctctaggcggcaggaggggggcaaggcccctgcctcctcactccatacgcaagaggccggaaggagcctgattaaaaaacgtgtcaccgagtctagggaatcccaaatgactatcgaagagcgcaagcaactgataacagtgcgagaggaagcatggaaaacacgaggccgcggggctgctaatgactctacacagtttaccgtggcgggcagaatggtgaagaaggggctggcatctccaacagcaatcacccctgtggcctcccctatctgcgggaaaacccgtggaactacccccgtatcaaagcctttggaagatatagaagcccgtcccgacatgcagctggagagcgacttaaagcttgaccgcctggagacatttctgagacgattaaacaataaagttggcggcatgcatgaaaccgtgctgaccgtgacaggaaagtcagtgaaagaggtaatgaagccagatgacgatgagactttcgccaagttctaccgctccgtagattataacatgcccaggagcccggtggagatggacgaggacttcgacgtcatttttgatccgtatgcccccaagttgacaagcagcgtggctgaacacaagcgggccgtacgtccgaaacgacgggttcaggccagtaagaatcctctgaagatgttggccgcccgcgaggatcttctccaggaatatacagagcagcgccttaacgtggccttcatggagagcaagcgtatgaaagtcgaaaaaatgtcatccaactctaatttcagcgaagtcacactggctggactggctagcaaggagaacttcagtaacgttagccttcgcagcgtaaacctgacggagcaaaattcgaacaactcggccgtaccctacaaacgcctgatgcttttgcagataaaaggtagacgccatgtgcaaacaaggctcgtggaaccccgggcttctgccctcaattctggggactgctttttgctactgtcgccacattgctgttttctctgggtgggcgaattcgccaatgtaatcgaaaaggccaaagcaagtgagctggcgaccctgatacagactaagcgagagctcgggtgcagagctacatacattcagacgatcgaagaaggaatcaacacacacacacacgccgctaaggatttttggaaacttcttggtgggcagacttcctatcagtcagccggcgatcctaaggaagacgagttgtacgaagctgccatcatagagaccaattgtatttatcggctgatggacgataagctggtgcccgatgacgattactggggcaagattcctaagtgttctctcctgcagcctaaggaggtgctcgtttttgacttcggaagtgaagtgtacgtctggcacggtaaagaagtaaccctggcgcaacggaaaattgccttccagttagccaaacatctgtggaacggaaccttcgattacgaaaattgcgacatcaatcctttggacccaggcgagtgtaaccccctgattccacgcaaaggtcagggaaggccagattgggcgattttcggccgactgacagagcataacgagactattctattcaaggaaaagttcctggattggaccgaattaaagaggagcaatgaaaagaatccaggcgaacttgcccagcataaagaagatcctagaaccgacgttaaggcctatgatgttacccggatggtgagcatgccccagactactgcagggaccatccttgatggggttaatgttgggagaggatacgggttggtcgagggccacgataggaggcagttcgagataacatctgttagtgtcgacgtttggcatatcttggagttcgactattccaggctgcccaagcagtcaatcggacaatttcatgaaggcgatgcctacgtcgtcaaatggaagtttatggtgagtacggcagtgggctctcggcagaagggggagcacagtgtgcgggctgcgggtaaggaaaagtgtgtttatttcttttggcaggggagacactctacggtgtccgagaaaggcaccagcgcccttatgacagttgaacttgatgaggagaggggggcacaggttcaggttctgcagggaaaagagcctccgtgtttcctgcagtgtttccaaggtggcatggtggtgcacagcgggcggagggaagaggaagaggaaaatgtgcaatcagagtggagactctattgtgttagaggggaggtgcctgtcgagggtaacctgttagaagtcgcatgccattgcagctcactccgcagccggacctccatggttgtgctaaacgttaacaaggctcttatctacctttggcacggatgtaaagctcaggctcatactaaggaagtgggcagaaccgccgcaaataagataaaagagcagtgccccctcgaggccgggctgcactcctcatcgaaagtgacgatccacgagtgtgatgaaggatctgagccattaggattctgggatgcactcggcaggcgggatagaaaagcctacgattgcatgctccaggacccgggcagctttaatttcgctcctcggttattcattttgtctagcagctcaggggactttgcagccaccgaatttgtataccccgcccgtgcccctagcgtggtgagcagtatgcccttcttacaggaggatctgtatagtgccccacagcccgcgctgtttttagtggataatcatcacgaagtatatttatggcagggttggtggcctatagagaataagatcaccggttctgccagaattcggtgggcttccgatcgtaaatccgcaatggaaactgtcctccagtactgtaaggggaagaatctcaagaaaccagctcccaagagctacctgatccatgctggcctcgaacctctgactttcacaaatatgtttccctcgtgggaacatcgggaggatatcgccgaaatcaccgaaatggacacagaagtgtcgaaccaaataaccttggtggaggacgtgctcgccaaactctgcaagacgatctaccctttagctgatctactggctcggcctctgcccgagggagtggatccgctgaagcttgagatctacttaaccgatgaggattttgagtttgctctggacatgacaagggatgagtacaacgcacttccggcatggaagcaggtgaacctcaaaaaggcaaagggactcttctag

SEQ ID NO: 17553 - DNA, 6645 bp, Artificial Sequence
  Description of Artificial Sequence: Synthetic coding sequence
atgaagcgcaaggagcggatcgcaaggcggctggaggggatcgagaacgacacgcagcctatccttctgcagagctgcaccgggttagtaacacaccggctgctggaggaggacacgccaagatacatgagagctagcgatcctgcgagcccccacattggccggagcaatgaggaggaggaaacctcggattccagtttggaaaagcagacccgatccaaatactgtactgaaacatcaggcgtgcatggcgacagcccatacggttctggtactatggatactcatagcttagagtccaaagcggagagaattgccaggtacaaagctgaaagacggcggcagctagcagagaaatacggtctcaccctcgaccccgaggccgactcggagtatcttagtcgctacacaaagtcccgtaaagaaccagatgccgtggaaaaacgggggggcaaatcagacaagcaggaagaatcatcccgcgacgcctcttcattgtatcctgggacagaaacaatgggcctgcggacgtgtgctggggagagcaaagactatgcactccacgtcggagatggatcttcagatccggaggtcctgctaaacatcgagaaccagaggcgaggccaagaactatcagccacaagacaggcccacgacttaagccctgcggctgaatcaagcagcacgttctcgttttctgggagagacagctctttcaccgaggttccacggtcaccaaaacacgcacatagttcctctcttcagcaggcggcatccagatccccatcgttcggggacccccagctgagccctgaggctcggccatccacaggaaagccaaagcacgaatggtttctccaaaaggattcagaaggagataccccgtctctcattaattggcctagccgcgttaaggtgcgggagaagctggtcaaagaggaatccgcccgcaactcccctgaattggcatcagagtcggtgacccagcgccgtcaccagccggctccagtccactacgtgtccttccagtccgagcacagcgcctttgatcgggtacctagcaaggctgccggctctactcggcagcctatccgcggatatgtacaaccagccgacactggacacaccgcaaaactggttacccctgagacccctgagaatgccagcgaatgctcctgggtggctagcgcaactcagaacgttcctaaacctccaagtctgactgttctggaaggagatggtcgggactctcccgtattacatgtatgcgagtccaaggcggaagaggaagagggtgaaggtgagggcgaggagaaggaagaggatgtctgttttactgaggccttggagcaatcaaagaagaccctgttggccctcgagggtgacgggctagtgaggtcccctgaggatccatctcggaacgaggacttcggcaagcccgccgtctccaccgtcacactcgagcatcagaaggagttggagaatgtggcccagcccccacaggccccccaccagcctaccgaacggacaggacgttccgaaatggtcctctacatccagtccgaacccgtctcccaggacgctaaaccaactgggcacaatcgcgaagccagcaaaaaacggaaagtgcgcacacgctccctatcagacttcacaggcccacctcaacttcaggctctgaagtacaaggacccagcatctcggcgcgaactcgagctgccttcaagcaaaaccgaagggccatatggggagataagtatgctggatacaaaggtcagcgtggcgcagctgcgatccgcttttttagcctctgcgaacgcctgtaggagaccagagctgaaatcccgggtggagcggtccgcggagggccctgggctacccaccggtgttgaacgtgagaggggctcaagaaagccaagacggtatttctctccaggagagtcccggaaaaccagcgagcggtttcgcacacaacctattacgtccgccgagcgcaaagaatccgaccggtgcacatcccactctgagacaccaacagtcgacgatgaagaaaaggtggacgagcgggctaaactctctgtggccgcaaaacgcttgctgtttcgagaaatggagaaaagctttgatgaacaaaacgtccccaagcggcgctcaaggaataccgccgtcgaacagcgcctgcggagactgcaggatcgcagcctgacgcagcctatcacaaccgaagaggtggtcattgccgcgactgagcctatacccgcaagctgcagcggcgggacccatcctgttatggctaggctgccctctcctacagttgctcgttccgcagttcagcccgcaagactgcaagcctctgcgcaccaaaaggccctagctaaagaccaaacaaacgagggcaaggagctcgctgaacagggagagcccgactccagcacactttcactggccgagaagcttgccctgtttaacaaattgtctcaacccgtttccaaagccatatccacccggaacagaatcgatacgagacagagaagaatgaatgctcgctatcagacacagcccgttaccttgggggaagttgagcaagtccaaagcggcaaattaatacccttcagcccagctgtcaacacgagtgtctctaccgtggcttccacagtggccccgatgtacgctggtgatcttcggacaaagcctccacttgatcacaatgcaagcgctactgattacaaattctccagcagtatcgagaacagcgattctcctgtgagaagcatcctgaagagccaggcatggcaaccgctcgtggaaggttccgaaaataaggggatgttgcgcgagtacggggagacagagagcaagcgagcactgactgggcgcgatagcggaatggaaaagtatggctcttttgaagaagccgaagctagctacccaattctgaaccgggctcgggaaggtgacagtcacaaggagagtaaatacgctgtacctcgccgaggaagcttggaaagggccaatcctcccatcacacacctgggcgacgagcccaaagagttttccatggcgaagatgaacgcccagggtaacctcgacctgcgggatagattaccatttgaagaaaaggtagaagttgaaaatgtgatgaagcgcaaattttctctgagagccgccgagttcggagaacccacatcggaacagactggcactgccgccggcaagactatcgcacagactaccgcgcctgtttcatggaaaccccaggactctagtgagcagcctcaagaaaaattatgcaaaaatccttgcgcgatgtttgctgctggggaaatcaagacacccaccggcgaaggacttcttgactccccaagtaaaaccatgtccataaaggaaagactcgccctcctgaaaaagtcaggtgaggaagattggcggaatagactcagcagacgtcaggaggggggtaaggcacccgcctctagtctgcatacccaggaagctggccgctcactgatcaaaaaacgcgtgacggaaagtcgggagagtcagatgaccatcgaagagagaaagcagctgatcacagttcgggaagaggcctggaagactcggggacgcggcgcagccaacgattcaacgcaattcacagtggccggcaggatggtcaaaaaaggcctggccagtcctactgctattacccctgtggcctcacctatctgcgggaagactcgtggaacaacccctgtgtcgaagcctctggaagatatcgaggcccgcccagatatgcagctggaaagtgacttgaagctggacagattggagacattcctccgtaggctgaacaataaggtgggtggtatgcatgagacagtactgactgtcacagggaagtccgtcaaggaagtaatgaagcccgacgacgatgaaactttcgccaaattctatcgcagcgtcgattacaatatgccacgcagcccagttgagatggatgaagactttgatgtgatatttgatccctacgcccctaaactgacttcgagtgtggctgagcacaaacgagccgtgagacctaagcggagagtgcaggcatccaagaatcctttaaagatgctggccgcgcgtgaagatctcctgcaggaatataccgaacagcgtttgaacgttgcttttatggaatcaaagcggatgaaggtcgagaaaatgtcaagcaactcaaatttttctgaagtaaccctagcaggcctggcttccaaggaaaatttctccaatgtatctttgcgctcagtgaatctaactgaacagaattctaacaactctgccgttccttataagagactgatgctgctccaaatcaaagggaggcgccatgtccagactagacttgtggagccaagggccagcgccctgaatagcggtgattgcttcctgctcctaagcccacactgttgctttttgtgggtgggtgagtttgcgaacgtgattgagaaggcgaaggccagtgaattggcaacattgattcagaccaaacgtgaacttggttgtagggccacctacattcagactattgaggaaggcatcaacacccacacccatgcagctaaggatttctggaaactgctaggggggcagacgtcctatcagtccgccggcgacccaaaagaggatgagctttacgaggccgctataatcgagaccaattgcatttaccgcctgatggatgataagttagtgcccgatgacgactactggggcaagattccgaaatgttcactgctccagccgaaagaggtgctggtcttcgattttggatcagaggtctacgtgtggcacggcaaggaagtgactctggcgcagaggaagatcgcattccagcttgctaagcatctgtggaacgggactttcgattacgagaattgtgatattaacccgctggaccccggggagtgtaaccctctgatccccaggaaagggcaagggaggccagactgggcaatcttcgggaggctgaccgagcataatgaaactattctgtttaaagaaaaattcttggactggacagagctgaaaaggtcaaatgagaagaatcctggggagctggcacaacacaaggaagatccgcgtactgatgttaaagcatatgatgtgactcgtatggtgagcatgccccaaaccacagctggtacgatcttagatggtgttaatgtggggcggggatacggactggtcgagggccatgataggcgccagtttgagatcacatcagtgtcggtggatgtgtggcacatcctcgagttcgactatagccggctgcccaaacagtctatagggcagttccatgaaggcgatgcatacgtggtcaaatggaaatttatggtaagcacggccgtcggaagcagacagaagggggagcatagtgttcgggccgctggtaaggaaaaatgcgtctatttcttttggcaaggtaggcacagcaccgtgtcggagaagggcacatcggctcttatgacggtcgagctggacgaggaacgcggcgctcaggtgcaggtgctgcaagggaaagagcctccttgctttcttcagtgtttccagggagggatggtggtacatagtgggaggcgtgaggaggaagaggaaaacgtgcaatccgaatggaggctgtactgcgtgaggggagaagtgccagtcgaaggcaacctgttagaagtagcctgccactgttcgagtttacgttctagaacctcgatggttgttcttaatgtgaataaggctctcatttatttgtggcacggatgtaaagcacaagcgcataccaaagaagtcggacggaccgcggccaacaagatcaaagagcagtgcccattggaagcggggttgcactctagctccaaggtgacgattcacgagtgtgacgaggggtcagaacctcttggtttttgggacgcattagggaggcgggataggaaagcctatgactgcatgctccaggacccaggctccttcaattttgcaccgcgcctgtttattctatcctcctcatctggagacttcgcagcaaccgaattcgtttaccccgctcgtgccccttcagtcgtctcttctatgcccttcctgcaggaggatttgtatagtgctcctcaacctgccttgtttttagtcgacaaccaccatgaggtttacctgtggcaaggctggtggcccatcgaaaacaagatcactggatctgctcggattagatgggcttctgacagaaaatccgccatggaaaccgtgctgcagtactgcaagggtaagaacctgaagaagcctgcacctaagagctatctcatccacgccggtctggaacccctcactttcaccaatatgttccctagctgggagcacagggaggacattgcagagattaccgagatggacacggaggtatcaaatcagattacactggtggaggatgtgcttgcaaaattatgcaagacgatctacccgttagctgacctcctggccaggcccctccccgagggcgttgaccccctgaagctggaaatctacctgactgatgaagatttcgagtttgccctggatatgacacgggatgagtataatgcgctgccagcctggaagcaggtcaatctgaaaaaggccaaaggactgttctag

SEQ ID NO: 17554 - DNA, 5367 bp, Artificial Sequence
  Description of Artificial Sequence: Synthetic coding sequence
atgaaacgaaaagaaagaatcgctcggcgactggaaggtattgagaacgacacccaacccattctgctgcaatcatgcacagggctagtcactcataggctcttagaggaggacactccacggtatatgagggcctccgatcctgctagcccgcatataggaagatcaaacgaggaggaagagacctcagatagtagcctggagaaacaaacacgtagcaagtactgtaccgaaactagcggtgtccacggggacagcccctacgggtcagggaccatggacacccactctttggaatccaaagctgagaggatcgcacgatacaaagcagagaggaggcgacagctcgcagaaaagtacgggctgaccttggatccggaagctgattctgagtacttatcccggtataccaagagccggaaggaacccgacgccgtcgagaagcggggtggcaaatctgacaaacaggaggaaagtagcagggacgcttccagcctctacccgggaaccgagacgatggggctgcgtacatgtgcaggagaatcaaaagactacgcgcttcacgtgggggacggatcaagtgacccagaggtcctgctgaatatcgagaatcagcgtcgcggccaagagctctccgccacgagacaggcccacgacctgtcaccagccgcggaatcttcctctacattctctttcagcgggcgggactccagtttcactgaagtgccaaggagtcctaagcacgctcatagtagttctctgcaacaggccgccagtcgctctccgagcttcggagacccccagttgagcccggaagcaaggccaaggtgtaccagccacagtgagaccccaaccgtggatgatgaggagaaagtcgacgagagggcaaaactgtcagtggccgctaagcgactactgtttagggaaatggagaagagcttcgatgagcagaacgtccctaaaaggcgctctcgaaataccgctgtcgaacaaagactgcggcggttacaggatcggagtctgactcagcccatcacaactgaagaggtggttatcgcagctaccctgcaggcatccgctcaccagaaagcacttgctaaggaccagaccaacgagggtaaagaactggctgagcagggcgagccagattccagcaccctaagcctggcagaaaagctggccctgttcaacaaactctctcagcctgtgtcgaaagcgatctccactcgaaatcgcatagatacgagacagagacgcatgaatgctaggtaccaaactcagcccgtcaccttgggcgaggtcgaacaggtgcagtcaggtaaactaatccccttctcacccgccgtgaacacgtccgtttccacagtggcatcaactgtggctcccatgtacgcgggggacttgagaacgaaacctccattagatcacaacgcttcagccacagattacaaattctcctcctccattgagaactctgacagtccagtgaggagtatcctgaagtctcaagcatggcagcccctagtggaaggcagtgagaacaaggggatgctccgggaatacggagagactgagagcaaacgcgccttgaccggacgtgactccggcatggagaagtatgggagcttcgaagaggccgaagcttcataccctattttaaatcgcgcaagggaaggcgattcccacaaggagtcaaagtacgccgtgccacggaggggaagtctagaacgtgctaaccctcccattacccacctgggcgacgagcccaaagagttcagtatggcgaaaatgaatgcacaaggcaacctcgacctgagggaccggctgccatttgaggagaaggtcgaagtggagaacgtgatgaagagaaagttctctctgcgagcggctgaattcggagagcccacctcagaacagactggaacagccgctgggaagactattgcccagactaccgcacccgttagttggaagccccaggactcatctgagcagccgcaagaaaagctgtgtaaaaacccttgcgccatgttcgcagctggagagattaagaccccaactggcgagggcttactcgattctccatctaagaccatgtccattaaagagcggctggccctccttaaaaaaagtggtgaagaagactggagaaatcgcttatcacgcaggcaggagggcggaaaagcaccagcaagcagcctccacacgcaagaggctggacggtccctgatcaagaaacgtgtgacggaatctcgggaatcgcagatgaccattgaggagagaaaacaactgattactgtcagagaggaggcatggaagacacgcgggaggggggccgccaacgatagtacacaattcactgtggccggaaggatggttaaaaagggcctggcaagccctaccgctataacgcctgtggcctcccccatctgcggcaaaactagaggcactacgccagtgagtaagcctctggaagatatagaagcccggccagatatgcaactagagagtgacctcaagttagatcggctagagacatttctgaggcgattaaataataaagtaggtgggatgcacgagactgtgctcactgtcaccggcaagtccgtcaaagaggttatgaaacctgatgacgatgagacctttgcgaagttctacaggagcgtggactacaacatgcctcgatcaccggttgaaatggacgaagatttcgatgttattttcgacccgtacgctccgaaactcactagttccgtggccgaacacaagagagctgtgaggccaaaaagacgggttcaggcttccaaaaacccactgaagatgctcgccgcacgagaggatctgttgcaagagtatactgaacagcgcctgaacgtcgcattcatggaaagtaagcgcatgaaggtcgagaagatgagctcaaactctaacttcagtgaagttacgctggcgggactggcctcaaaagaaaacttttcgaacgtgtctctacggagtgtgaatcttacagagcagaactccaataatagtgctgtgccttacaagcgtctcatgttgttgcaaatcaagggccgccggcacgttcagaccagactggtcgaaccccgtgctagtgctctgaatagtggagattgcttcctgctcctgagtccacactgctgctttttatgggtcggcgagtttgcaaacgtgattgaaaaagctaaagccagcgaactagccacactcatacaaacgaaacgcgagctcggatgcagggccacctacatacaaaccattgaggagggcataaatacacatacacatgcagcgaaagatttctggaagttattgggtggacagacctcttaccagagtgccggcgatcctaaggaagacgaactttacgaagcagctatcatagagaccaactgcatctatcgtcttatggacgacaaactggtccctgacgacgactattgggggaagattcccaagtgcagcttgcttcaaccaaaggaagtgctcgtgttcgactttggatctgaggtctacgtgtggcatgggaaggaggtgacactcgcccagcgtaagatcgccttccagctggccaaacatctgtggaacggcaccttcgactacgagaattgtgatatcaaccccctggaccccggagagtgcaacccactgataccaagaaagggacagggacgtcccgattgggctatctttggacggcttaccgaacataatgagactatcctattcaaagagaaatttcttgactggacggaactaaaacgctctaacgaaaaaaatcctggcgaactagcacagcacaaggaggacccacggaccgacgtgaaggcatacgacgttactcgcatggtatccatgccccagacaacggctggtaccatcctggacggcgttaacgtgggccgtggctacggcttggtggagggccatgaccgtaggcaatttgaaatcacttctgtatctgtcgacgtttggcacattctggagtttgattactcacgcttgccaaagcagagcattggacaattccacgaaggggatgcctacgtggtgaaatggaaattcatggtctctaccgcagtgggatcaaggcaaaagggggaacactctgttagggcagcaggcaaggaaaagtgtgtctacttcttttggcaaggcagacattcgaccgtgagtgaaaaaggcacttctgccttaatgacggtggaactggatgaggagcggggggctcaggtccaggtgttacaggggaaagaacccccatgcttccttcagtgttttcagggtgggatggtggtacacagcggtagacgtgaggaagaagaggagaacgtccagagtgagtggcgactgtattgtgtgaggggagaggtgcccgtcgagggaaacctcctggaagtggcttgccactgctctagcctgagatcacgtacttccatggtcgttcttaacgtgaataaggcgctgatttacctgtggcacggatgcaaagcgcaggcacacacaaaggaggtaggccgcacagcagccaataagatcaaggagcagtgccctcttgaggccggactgcacagtagtagtaaagtgactatccacgagtgtgacgaaggcagcgagcccctcgggttctgggacgccctgggcagacgggacagaaaagcctatgactgtatgctacaggatcccgggagcttcaatttcgccccccggttattcatcctgagctcttccagtggagacttcgcagcaaccgaattcgtatacccagcaagagcaccctctgtcgtatcttctatgccgtttctgcaggaggatttgtacagcgcgcctcaaccagcgcttttcttggtggacaaccaccacgaagtctacttatggcaaggatggtggcctatagaaaacaagatcacgggatccgctcggattagatgggcatcagatcgaaagtctgctatggagacggtgctacaatactgcaaaggcaagaatttgaagaagccggcccctaaaagctacttgatacatgcaggcctggagccccttaccttcaccaatatgtttccatcatgggagcatagagaggacatcgctgaaatcactgaaatggacacagaagtttccaaccagattacactggtggaggacgttttagcaaagctctgcaagaccatataccctctggccgatttgctggctcgcccactgcccgaaggagtggatcctctgaagctggagatctacctgactgatgaagatttcgagtttgcgttggatatgacgagagacgagtacaacgcgttgccagcctggaagcaggtgaacctcaagaaagctaagggtcttttttag

SEQ ID NO: 17555 - DNA, 3387 bp, Artificial Sequence
  Description of Artificial Sequence: Synthetic coding sequence
atgtttgctgccggggaaataaagactcctacaggagaagggctcctggatagtccgtcaaagactatgagcatcaaggagagattggcactgctgaaaaaaagtggggaagaagattggcggaaccggctgagtcggcgacaggagggaggtaaagcgcccgcatccagtctgcacacacaagaagccgggaggtctcttataaagaaggaggagggcggagttgcggatgattcagctatttctaacctcttgtggcgcgtaaccgagtccagagaaagccagatgaccattgaggagcgtaaacagctcattacagtaagggaggaagcttggaaaaccagaggccggggagcagcaaatgactctacccaattcactgtggctggaaggatggtgaaaaagggactcgcttctcctacagccattactcctgtcgcttcacccatttgtggaaagaccagagggacaaccccggtttccaagccgttggaggatattgaagctagacccgatatgcagctggagtctgacctgaagctggatcgactggagactttcctgaggagactcaataacaaagtcgggggtatgcatgaaaccgtgctgactgtgaccggcaaaagtgttaaggaagtgatgaagcctgatgatgatgaaacattcgctaagttctaccgctctgtagactataatatgccgcgctcccccgtcgagatggacgaggattttgatgtgatctttgacccttacgcccccaaactcacttcatctgtagcagagcacaagcgggccgtgcggcccaagagacgtgtccaggcgtccaaaaacccccttaaaatgctggctgcccgcgaggatttactgcaggagtacacagagcagaggctgaacgtagccttcatggagagtaagaggatgaaagtggagaaaatgagttcaaattcgaatttctcggaggtcacactggcaggactggcatcaaaagagaacttttcgaacgtaagcttgcgatcggtcaatcttactgagcaaaattccaacaactcagctgtcccctacaaacgtctgatgcttctccagatcaaggggagacgacacgtacagacaaggctagttgagccacgagcctcagccttgaattctggtgactgtttcctgctgctctctcctcactgttgctttctgtgggttggtgagtttgctaacgtgatcgaaaaggcaaaagcaagcgagttggctacactgatccagaccaagcgcgaattaggatgtcgggctacttacatccagaccatagaagagggaatcaacacccacacgcatgccgcaaaggacttttggaagctgctcggtggacaaacatcctaccaatcagccggagatcctaaggaggatgaactgtacgaggccgctatcatcgaaacaaattgtatatatcgtttaatggatgacaaactggtacccgatgatgattattggggaaagattccaaagtgttcccttctccagcctaaggaagtcctggttttcgattttgggtctgaggtctacgtctggcacggcaaggaggtaactttagcccaaagaaagatcgctttccaattggctaagcacttgtggaacggcacattcgattacgagaattgtgacatcaaccctctagacccgggcgaatgcaatcctttaattccacggaaagggcaagggcgacctgactgggccatctttgggcgcctcacagagcacaatgaaaccatcctctttaaagagaaattcctggactggaccgagctgaagagaagcaatgagaaaaaccccggcgagctagcccagcacaaggaggatccccgcacagatgtgaaagcgtacgatgtgaccagaatggtgtccatgccgcagactacagcagggaccattctcgatggtgtgaatgtgggcagggggtacggtcttgtggagggccacgacagacgccagtttgaaataacgtccgtgagcgttgacgtgtggcacatacttgagtttgactattcccgcctcccaaagcaaagtatcggtcagtttcatgagggagatgcttatgtagtcaagtggaaatttatggtgagtactgccgtaggctctagacaaaaaggtgagcattctgtcagagctgctggcaaggaaaaatgcgtgtacttcttttggcagggcagacattccacagtgagtgaaaaagggacaagtgccctgatgacagtcgagctagatgaggagcgcggcgcacaggtccaggtccttcaggggaaggagccgccttgtttcttgcagtgcttccaaggcggtatggttgtacatagcggccgcagagaagaagaagaagagaacgtccagtctgagtggcgcctatattgcgtgagaggtgaagtgcctgtagagggtaacctgctggaagtggcatgtcattgtagcagtttacggagtagaacctccatggtggtgctgaacgtcaataaagccctaatttatctctggcacgggtgtaaggctcaggcccacactaaggaggtgggtcggaccgcagcaaacaagataaaggagcagtgcccactcgaggccggccttcacagctcaagtaaggttaccatacatgaatgtgatgaaggctctgagccattaggcttctgggatgctctgggacgcagggatcgcaaggcctacgactgcatgctccaggacccaggcagcttcaattttgctccacggctttttatattgagctcttcatctggcgatttcgcagcaactgagtttgtgtaccccgcccgcgcaccttctgttgtctcttctatgcccttcctgcaggaggatctgtattcagccccgcagccggcgctgtttctggtcgacaaccatcacgaggtgtacctgtggcaaggatggtggccaattgaaaacaagattacagggtccgcgcgaattaggtgggccagtgacagaaagtctgccatggaaacagtgctccagtactgtaagggtaaaaatctgaaaaagccggcaccgaagtcctacttgatacatgcgggccttgagccgttgacctttaccaacatgttcccttcatgggagcaccgtgaggacatcgctgaaattacagaaatggacactgaagtgtcaaaccaaatcacactggtggaagacgtgttggcgaagttgtgcaaaacaatctatccactcgcagatttgctcgccaggccacttcctgagggagtcgacccactgaagctggagatttacctcactgacgaggattttgaatttgcattggacatgacaagagatgaatataacgcactcccagcatggaaacaagttaacttaaaaaaagcgaaaggactgttttag

SEQ ID NO: 17556 - DNA, 2301 bp, Artificial Sequence
  Description of Artificial Sequence: Synthetic coding sequence
atgaagcgcaagtttagccttagagccgccgagttcggagaacccacctcggaacaaacagggaccgctgcgggcaaaacgatcgcacagacgactgcccccgtgagctggaaacctcaggacagctcggaacagccacaggagaaactgtgcaagaatccctgcgcgatgtttgcagccggcgagatcaagacgccgacaggagagggtctcctcgattccccgtccaagacaatgtcgattaaagaacggctggcgcttctcaaaaaatccggcgaagaagattggaggaatcgtctctcacgccgacaggagggggggaaggcacccgcatcctctctgcacacgcaggaggccggcagatcactaattaaaaaacgggtcacagagagccgtgaaagtcagatgactatcgaggagaggaaacaattaattacagtgagagaagaagcctggaagactcgggggcggggagcagccaatgacagcacacaatttacggtcgccggcagaatggtgaagaagggactggcttcgcctacagccatcacccccgtggcgtccccaatatgcggcaaaacccggggaaccactccagtgagcaaacctctggaagacatcgaagctcgcccagatatgcaattagagtccgatctgaagctggataggctggagacattcctccgcagacttaacaacaaagtgggcggcatgcatgagacggtgctcacagtcacagggaaatccgttaaagaggtcatgaagcccgacgacgatgagacattcgccaaattctaccgctctgtggactataacatgccacggagcccagtggaaatggacgaagattttgatgtaatctttgacccctacgcacccaaacttacaagcagtgtggcagaacacaagcgggccgtgaggcccaaaaggcgtgtccaggccagcaaaaaccccctcaagatgctggctgcccgcgaggatctgcttcaagaatacacagaacagcgactgaatgtggctttcatggaaagcaagcggatgaaggtagagaaaatgtcgtccaatagcaatttctctgaggtgacgctagccggcttggcatccaaggaaaacttttccaatgtgtcactccgcagtgtgaacctcaccgagcagaacagtaacaacagtgccgtgccttacaagcgtctgatgctgctgcagataaagggaaggagacacgtacaaaccagactcgtggaacctcgcgcatcagcacttaactcaggtgactgctttctgctgttgtcaccgcactgctgtttcttgtgggtgggagagttcgcgaacgtgattgagaaagcaaaggccagtgaactggctacactgatccaaactaagcgggaattggggtgccgagcgacttacatccaaactattgaggagggtattaatacacatacacacgcagccaaagatttctggaaacttctgggcgggcagacttcttaccagagcgcgggcgaccccaaagaagacgagctgtatgaggcagcaatcatagagaccaattgtatttacagactgatggacgacaaactggttcctgacgacgactactggggaaagatccccaaatgctcccttctccaaccaaaagaggtcctggtttttgactttggatcagaggtttacgtttggcatggtaaggaagttacgctagcccagcgaaaaatagcctttcagctggctaagcacctgtggaatggtacgtttgattatgaaaactgcgacattaatccactggaccccggagaatgcaatcctctgattcccagaaagggacagggtaggcctgactgggcaatctttggcagactgactgagcacaacgaaacaatattgtttaaagaaaagttccttgactggaccgagctgaaacgttcaaacgaaaaaaatccgggcgagttggctcagcacaaggaagacccaaggaccgatgttaaggcctatgacgttacgcgaatggtgtcaatgccccaaactacagctggaaccatactggacggcgtgaacgtggggcggggatatggattggtcgaaggtcatgaccgaaggcaattcgagatcacgtccgtaagcgtggatgtgtggcatattctggagttcgactacagtaggctgccaaaacagtccattggtcaattccacgaaggcgacgcctatgtggtgaagtggaaatttatggtttcaacggctgtattaagagcctggaggggcgcccgagggcgagagtttgccggatccggtcttagtttatag

SEQ ID NO: 17557 - DNA, 1758 bp, Artificial Sequence
  Description of Artificial Sequence: Synthetic coding sequence
atgaatagttccgacgtctcttcgcttaaacatcccagctctcttgcatcccccaccgccatcacccccgtagcctcacccatttgcgggaagacacgaggcacaacgccagttagtaaaccccttgaggacatagaggcccgccccgatatgcaactggagagcgatctcaagctggacaggctagaaacattcctgcgacgcttgaacaacaaagtgggcgggatgcatgaaactgtcctgactgtcactggtaagagtgtgaaagaagttatgaaaccagatgacgatgaaacttttgcaaagttttacaggagtgtagactataatatgcctcgaagccctgttgaaatggatgaggacttcgatgtaattttcgacccttacgcccccaagctcacgagcagtgtggctgagcacaaacgtgctgtacggccaaagcgtcgtgtccaggcctctaaaaacccactgaaaatgctggccgccagagaggatctactgcaagagtacaccgagcagcgccttaacgttgcgtttatggaaagcaagcgcatgaaagtggagaaaatgagctcaaacagtaacttctctgaagtcacactggctggtctggccagtaaggaaaactttagcaacgtgtcgctgaggtccgtgaatctgactgagcagaattccaacaactctgccgtcccatacaagcgcctgatgttacttcaaatcaagggccggaggcacgtacaaacgagattggtcgagccaagggcaagtgccctcaacagcggcgattgtttcctactccttagcccacattgttgcttcttatgggtcggagagttcgcaaatgtcatagaaaaagctaaagccagcgaactggccaccctaatccagaccaaaagggagttgggctgccgtgccacgtatatccaaaccatagaagaaggaattaatactcacacccacgcagccaaggacttttggaagctgctgggagggcaaacaagctaccagagcgccggcgaccccaaggaagacgagttatatgaggccgccatcatcgaaacaaactgtatctatcgactgatggacgacaaactcgtgcctgacgatgattattggggcaaaatccccaagtgcagcctgctgcaacctaaggaggtactggtgttcgattttggaagcgaagtctatgtctggcacggaaaagaggtaacactcgctcagcggaaaatcgctttccaacttgcgaaacatttgtggaatggcacattcgattatgagaattgtgacattaatccgctcgatcctggcgaatgtaaccctctcatcccacggaaagggcaaggccggcctgactgggcgatcttcgggcgccttacagagcataacgagactatattgtttaaagagaagtttctggattggaccgagctgaagcgatctaacgagaaaaatcccggggagttggcccaacacaaagaggacccacgcaccgacgtgaaggcatacgatgttacccgcatggtctccatgccccagactaccgccggcaccatattagacggagtcaacgtggggcggggctatggccttgttgaagggcacgataggaggcagtttgaaatcacttccgtctctgttgatgtttggcacattctcgagttcgattattcaagactgcccaagcagtccatcggtcagtttcacgagggtgacgcttatgtggtcaagtggaaatttatggtgtccaccgcagggtag

SEQ ID NO: 17558 - DNA, 636 bp, Artificial Sequence
  Description of Artificial Sequence: Synthetic coding sequence
atggtcgcgcataaccaagtggccgctgacaacgcagtgtcaaccgcggccgagcccagacgtcggcccgaaccctcctcaagtagttccagtagcccagcggctcccgcccgcccccgtccctgcccggccgtgccggccccagcgcccggggatactcactttagaacattcaggagtcatgctgactacagacgcatcactagggccagcgctctgctggatgcatgtggattttactggggtccattgagtgtgcatggcgcccatgaacgccttagggccgagcccgttgggacctttctggtaagagacagtcgacaaaggaattgctttttcgccctcagcgtgaaaatggcctcaggtcctacttccattcgcgtacactttcaggctggcaggttccaccttgatggatcgagagagtcattcgattgtcttttcgagctgcttgagcactatgtggcagctccacggaggatgctgggcgctcctcttagacagcggagagtgcgacctttacaggagctgtgcaggcaaagaatcgtcgccacagtgggcagagagaatctggccagaatcccattgaatcccgtgctgagggattatctgagcagtttcccattccagatttag

SEQ ID NO: 17559 - DNA, 678 bp, Artificial Sequence
  Description of Artificial Sequence: Synthetic coding sequence
atggtcacacactcaaagtttccagccgcagggatgtcacggcctctagacaccagcttacgactgaaaaccttcagctcaaagtcggagtatcagttagtggtaaatgctgtgcgtaaactccaggagtctgggttctactggtcagcagtgacaggtggtgaagcgaacctcttgctatctgcagagcccgcaggaacgttcttgatccgagacagctcggatcaacgtcatttcttcaccctgtcggtgaagactcagtctggcacaaaaaatttaaggattcagtgcgaaggtggtagcttcagcctgcagtccgaccctagatcgacccagcctgtacccagattcgactgtgtcctgaagctcgtccatcactatatgcccccccccggcgcacccagctttccctctccaccaaccgaaccttctagcgaggtccccgagcagcccagcgcccaaccgctgccagggtcaccaccgcgccgtgcatactacatctattccggcggcgagaaaatacctctagtcctgagtcgcccactctcaagtaacgtcgctacgttacagcacctctgtagaaaaaccgtcaatggtcaccttgacagttatgagaaggttactcagttacccggtccaattcgcgaattcctggaccagtacgatgcgcccctgtag

SEQ ID NO: 17560 - DNA, 1302 bp, Artificial Sequence
  Description of Artificial Sequence: Synthetic coding sequence
atggccgaactccggccctctggtgctcccggtccgaccgcgcctcccgcccctggcccaacagcccctccagccttcgcctcacttttcccacctggtttgcacgcgatctatggggagtgccgaaggctttatcctgaccagcccaacccattacaagtcactgccattgtcaaatactggcttgggggtcccgacccacttgattacgtatccatgtatcgcaacgtggggagtccaagtgcgaacattcctgaacattggcattacatctctttcgggctgagcgacctctacggcgataatcgggtgcatgagtttaccggaacagacgggccttctgggttcggatttgaactgacattccgcctaaagagggagaccggagagtcagcgccccctacctggccagccgaattgatgcaaggcctggctagatacgtgttccagagtgaaaacacattttgctcaggcgatcatgttagctggcactcacccctcgacaacagtgaatcacgcatccagcacatgctgcttaccgaggacccgcagatgcagcccgttcagactccattcggtgtggtcacatttttgcagatagttggggtctgtacagaggagttgcacagcgctcagcagtggaatgggcagggaatactagagcttctgcgaacggtaccaatcgctggcggcccctggctgattactgacatgcggcggggagaaactatctttgaaattgacccacatctgcaagagagagtggataaaggtatcgagaccgatggctctaacctaagtggcgtatctgctaagtgcgcttgggacgacctcagcagacctcctgaagacgatgaggactctcgcagtatctgtatcggcacgcagccacggcgtctctccggaaaggatacggaacagattcgggagacgctgaggaggggtttagagatcaacagtaaaccggtgctgccccctatcaaccctcaaagacagaatggactcgcacacgatagggcaccctcgagaaaggactcactggaatccgacagctccactgcgattatccctcacgaacttatacgcaccagacagcttgaatccgtgcatctcaaattcaatcaggagagcggcgccctgattccactttgtctacgtggacgtctgctacacggccgccactttacatacaagtccattactggagatatggcaataactttcgtctccactggcgttgaaggtgcctttgccacagaggagcacccgtacgccgcacacggcccttggctccagttatag

SEQ ID NO: 17561 - DNA, 1455 bp, Artificial Sequence
  Description of Artificial Sequence: Synthetic coding sequence
atggccgagctccgaccctctggagccccaggacccacagcacccccagcccctggacccaccgccccccccgcctttgcgagtctgtttccacccggattgcacgccatttatggtgaatgtagacgtttgtacccagatcagcctaatcccctgcaagtgaccgcaatcgttaaatactggctcggtgggccggacccccttgactacgtctcaatgtatcgcaatgttgggtctccgtccgccaacatccccgagcactggcattatatttccttcgggctttccgatctctatggggacaaccgggtgcatgagtttaccggcacagacggaccgtccggttttggattcgagctcaccttcaggcttaagcgggagaccggagaaagcgccccacctacctggccggcggaactgatgcaaggcctagcaaggtacgtgtttcagtctgagaacacattttgttccggcgaccacgtctcctggcactcacccttagacaactccgagtcacggatccagcatatgcttttaacagaggacccacaaatgcagcccgtgcagactcccttcggcgtcgtgacattcctgcagatagtaggtgtttgcactgaggagcttcattcggctcagcagtggaacggccaggggatcctggagttactccgcactgtgccaatcgccggcgggccgtggctcataactgacatgcgtcgcggtgagactatatttgaaatcgatccgcatctgcaggagcgagtggataagggaattgagacagatggatctaatctgtctggggtcagcgctaagtgcgcttgggatgatctctcaagacccccagaagacgatgaggactctcggtctatttgcatagggactcagcccagaaggctgtcaggcaaagacactgagcagatcagggagaccctgcggaggggcctcgaaattaacagcaagccagtccttcctcccatcaatccacaacgacaaaatggactggcacacgatcgggctcccagtagaaaagacagtctcgaaagcgactcgtccaccgccatcataccccacgagctaatccgcacacgccagctggagagcgtgcacctaaagttcaaccaggagtctggagcattaatacctctgtgtctcagaggtagacttctgcatggacggcatttcacctacaaaagcataacaggcgatatggctatcaccttcgtctctaccggcgtcgagggcgcattcgcaacggaggaacatccgtacgcagcccacggaccttggctgcagattttgttgactgaggagttcgtggagaagatgctggaggatctggaggatctgacaagcccggaagaattcaaacttcctaaggagtatagctggcctgaaaagaaactcaaagtgagcattcttcctgacgtcgtgtttgattccccactgcactag

SEQ ID NO: 17562 - DNA, 240 bp, Artificial Sequence
  Description of Artificial Sequence: Synthetic coding sequence
atggcaaggagccggctgaccgcaacttccgtatcacaagtgcaggagaacgggttcgttaaaaagctcgagcccaaatccgggtggatgacgttcttggaggtgaccggcaagatctgtgagatgctcttttgccctgaagcaattctattgacacgcaaagacactccgtattgtgagactgggttgatttttcttacacttaccaaaacaatcgccaacacatatttctatttttag

SEQ ID NO: 17563 - DNA, 240 bp, Artificial Sequence
  Description of Artificial Sequence: Synthetic coding sequence
atggcgcgatccaggctgacagcgacttccgtcagccaggtgcaggaaaatggctttgtcaaaaagttagaacccaaatctggatggatgacatttcttgaagttacgggaaaaatatgcgagatgctcttttgtcctgaggccattcttctgactagaaaggatacaccctactgcgaaactggcctgatcttcctaaccctgaccaaaaccatcgctaatacgtacttctatttctag

SEQ ID NO: 17564 - DNA, 1245 bp, Artificial Sequence
  Description of Artificial Sequence: Synthetic coding sequence
atgaatttgcagcgatactggggagaaatccccattagctcctcccaaactaatcgctccagctttgatctcctccctagagagtttaggctcgttgaagtgcacgacccccctctccatcagccgagtgcaaacaagcctaaacctccaaccatgctggatatacctagtgagccttgttcgctgacgatacatacgatacaactaatccaacataaccgacggctgaggaaccttattgctactgctcaggcgcagaaccagcagcagaccgagggcgtgaagacagaggagtctgaaccgctccccagctgtcctggatctccaccgctacctgacgatctgctgcctttagactgtaaaaaccccaacgcacccttccaaatccgtcatagtgaccctgagtcagatttttatagaggcaaaggtgaaccagttaccgagctaagttggcattcatgcagacagttgttatatcaggccgtggccaccatcctggctcacgctgggttcgactgtgcgaatgaaagtgtcctggagacattgacagatgtagcgcacgaatactgccttaagttcactaaacttctccgctttgcagtagatcgtgaggccaggcttgggcagaccccttttcctgacgtgatggaacaggtgtttcacgaagtaggaatcggatcagtcctttcactacaaaaattctggcagcatcgtattaaagactatcactcttacatgttgcaaattagcaaacaactttcggaagaatatgagcggattgtgaaccccgaaaaggcaaccgaagatgcaaagcccgtgaaaatcaaggaggagcccgtctcagatattacatttcccgtgtctgaggagctcgaggccgacttggccagtggggatcaatctttacccatgggcgttctcggagcgcaatccgagcgctttcctagcaacctcgaagtcgaagcttcccctcaggccagcagcgccgaagtgaatgccagtccgttgtggaaccttgcccatgtgaagatggagccccaggagagcgaggagggaaatgtaagcgggcatggtgtactagggtctgacgtgtttgaggaacccatgtctggcatgtcagaagcgggtatacctcaaagtcctgatgattccgactcgtcttatggttctcattcaaccgattcattgatgggttcatctccagtgtttaaccagagatgcaagaaacgcatgagaaagatctag

SEQ ID NO: 17565 - DNA, 840 bp, Artificial Sequence
  Description of Artificial Sequence: Synthetic coding sequence
atgaacttgcaatcagggaaaggggagcccgtgactgagctctcatggcactcctgccgccagcttctgtaccaggccgtcgccactattctcgcccatgccggattcgactgcgcaaacgagtctgtgctggagaccttaactgacgtagcacacgaatattgcctgaagtttacgaagctgctgaggtttgcagtggatagggaagccaggcttgggcagaccccgtttccagacgtgatggaacaggtgttccacgaagtgggaattggcagcgtgctcagccttcaaaaattttggcagcatcgtataaaggactatcacagctacatgttacaaattagtaaacagctgtcagaagagtacgagagaatcgtgaaccctgaaaaagccaccgaggacgcaaagccagtcaaaatcaaagaagaacctgtatccgatatcacattccctgtgagtgaggagctggaggcagatcttgccagtggcgatcagtctctgcccatgggagtccttggagctcagagtgaacggttcccttccaaccttgaagtggaagcaagcccccaggcctcctcagccgaggtaaatgcatcccctctctggaacctggcacacgtgaagatggaaccgcaggaatctgaagagggcaacgtgtcaggccatggggtattggggtcagatgtcttcgaggagccgatgagcgggatgtctgaagcaggaattcctcagagcccagatgactctgattcttcatacggttctcattccaccgacagtttaatgggctcaagtcccgtgttcaaccaacgatgcaagaaacggatgcgcaagatctag

SEQ ID NO: 17566 - DNA, 1239 bp, Artificial Sequence
  Description of Artificial Sequence: Synthetic coding sequence
atgctacggtattggggggagatcccaatttcttcctcccaaaccaacagatccagctttgatttgctgccgcgggagtttcgtctggtggaggtgcacgaccctcccttacaccaaccgtcagcaaacaagcctaaaccacctaccatgctggatatccccagcgagccttgtagcttgactatacacactatacagctcatccagcataatagacgtctgcggaacttgattgccaccgcccaagcccaaaatcagcagcaaacagaaggcgttaagaccgaagagtccgaacccctgccttcatgccctggctctcctcccctccctgatgacctgttgcctcttgattgcaagaatccaaatgcaccctttcaaatccggcattcagatcctgaatccgatttctaccgtgggaaaggagagcctgtgacagagcttagctggcacagttgtaggcagttgctctatcaagcagttgcaaccattctggcgcatgccgggttcgattgcgctaacgaatccgtgcttgaaaccctcaccgacgttgcacatgagtattgcctcaaattcaccaaacttttgcgatttgctgtcgaccgagaggctcggctaggccagacaccatttcccgatgtgatggagcaagtcttccacgaagtggggataggtagtgttctgagcttgcagaagttctggcagcatcgcattaaagactatcattcatatatgttacagatttccaagcaactgagcgaagaatacgagcgcatcgttaatccagagaaagccacagaggatgcaaagcctgtcaaaattaaggaagagcctgtgtccgacatcacattccccgtatctgaagagctggaagctgatcttgcctctggcgaccaatctctgccaatgggggtactcggcgctcagagcgagaggttcccctctaatttggaggtcgaggcatctccccaagcaagttccgctgaggtaaacgcatcaccactgtggaacctcgcgcacgtgaaaatggagccccaggagtccgaggagggcaacgtgagcgggcatggagtcttggggagtgatgtattcgaggaacccatgagcggtatgtctgaggccggcataccccagagcccggatgatagtgatagcagctacggcagccatagtactgattctcttatggggagcagtcctgtcttcaatcagagatgtaaaaagcgcatgagaaagatctag

SEQ ID NO: 17567 - DNA, 1239 bp, Artificial Sequence
  Description of Artificial Sequence: Synthetic coding sequence
atgctgagatactggggggaaatccccatcagctcctcccaaacaaatagatcctcttttgacttgttgccgcgagaattcagactcgtagaggttcatgacccacccctgcatcagcctagtgctaataagccgaagccacccaccatgcttgatataccctccgaaccttgctccctgaccattcataccatacaactaatccagcataacagacgactccgtaacctgatcgctaccgcccaagctcagaaccagcagcagactgagggcgtgaagaccgaggagtcagagccgctaccatcttgtcctggctcacccccgttgccggacgacctgctgccattggactgcaagaaccccaacgcacctttccagatccgccattccgatccggaatccgacttttatcgaggcaagggtgagcccgtgaccgagctcagttggcacagctgtcggcagctgctctaccaggccgtggccacaatcctggcccacgcaggcttcgattgtgctaatgagtcggtgctggagaccctgacagacgtagcgcacgagtactgtttaaagtttaccaaactccttaggtttgctgtggacagggaggcccggctcggccagaccccattccctgatgtcatggaacaggtcttccatgaagtcgggattggcagtgtcctgtcgctccagaaattctggcagcaccgcataaaggactatcatagctacatgcttcagatatccaaacagctctctgaagagtatgagcgtattgtgaatcccgaaaaagccaccgaggatgccaaaccagtgaaaattaaggaagaaccggtgtccgatataacctttccggttagtgaggaactggaagccgacctggccagtggagatcaatcactgcctatgggagtcctcggcgcacaatcagagcgttttccatccaacctcgaggttgaggcaagtccccaggcttctagcgctgaggtgaacgcctcgccactgtggaacttagcacatgttaaaatggagccacaagaaagcgaggaggggaatgtaagtggacatggagtgttggggagcgatgtcttcgaggaacctatgagtggcatgagcgaggcagggatcccacagtcgcctgacgactccgactcctcttacggctctcattcaacagatagtcttatgggcagttcccctgtgtttaatcagcgatgtaaaaagcgaatgagaaaaatttag

SEQ ID NO: 17568 - DNA, 1239 bp, Artificial Sequence
  Description of Artificial Sequence: Synthetic coding sequence
atgttaaggtattggggcgaaatcccaatcagctcaagtcagaccaatcggtcctcattcgatctactccccagggagttccgactggtcgaggtccacgacccaccactgcatcagcctagcgccaataagccgaaacctcctactatgctcgatatccctagtgagccttgtagcttgacaattcacacaatccaacttatccagcataaccgcagactgagaaacctgatcgcgaccgcccaggcacagaaccaacagcaaaccgagggcgtgaagacagaagaatctgagcctctaccatcctgcccaggatctcccccattgccggacgatctgttgccattagactgcaagaatccaaacgccccatttcagatacgccatagtgatcccgagtccgacttctaccggggaaagggcgaaccagtgactgagctgtcttggcacagttgcagacagttactctaccaggccgtggccactatcctagcacacgctggattcgattgtgcaaacgaatcggttcttgaaacactgactgacgtcgcccatgaatactgtttaaagtttactaaactcctgaggttcgccgtcgacagagaggcccgtctgggccaaacacctttcccggacgtgatggagcaggtgtttcatgaagtgggaattggctccgtcctttcccttcagaagttctggcaacatcggataaaggactaccactcctatatgctccagattagtaagcagctgtccgaggaatatgagagaatcgttaaccccgaaaaggccactgaggatgctaaacccgtcaaaattaaggaggagcccgtctccgacatcacattcccagttagcgaggagctcgaggcggatctcgcgtccggcgatcagtcgctgcccatgggggtgctaggagcgcagtctgagcggttcccctctaacctggaagtcgaggcatctccgcaggccagcagcgcagaagtgaatgcatcccctctgtggaatctcgcgcatgtcaaaatggagcctcaggagtcagaagagggaaatgtgagcggccatggcgtcctgggctcggacgtttttgaggagcccatgtccggcatgtccgaggccgggattccacagagccccgatgacagtgactcatcatacggcagccacagtaccgactcactaatgggatcgagcccagtcttcaaccagagatgtaaaaagcggatgaggaaaatttag

SEQ ID NO: 17569 - DNA, 1272 bp, Artificial Sequence
  Description of Artificial Sequence: Synthetic coding sequence
atggtgggaatgtccaggttacgcaatgacagactcgctgaccccctgacaggctgctcagtttgttgtaagtccagttggaatcagctccaggacctctgtcgattggccaagcttagctgccccgccctaggaatttcaaagcgaaacctgtatgattttgaagttgagtacctctgcgattacaaaaaaataagggagcaggagtattacctcgtgaaatggcggggataccctgattccgagagtacctgggagcctcgacagaatttgaagtgcgtgcgaatcctgaagcagttccacaaagacttagagcgcgaactcctgagacggcaccaccgaagcaaaacaccgaggcacctagatccatcccttgccaactatctggtccagaaggcaaagcaacggagggccctcagacgctgggagcaggaattgaacgccaaacgctctcatctgggccgtattactgtggagaacgaggtggatctggacggtccaccgcgtgctttcgtgtacattaatgagtacagagtcggcgaaggtattacacttaaccaggtggctgtgggctgtgaatgccaagattgcctttgggcgcccactggcgggtgctgccccggcgccagtctccataagttcgcttacaacgaccagggacaggttaggttgagggccggcctccctatctatgagtgtaacagtcgctgcagatgtgggtacgactgcccgaaccgtgtcgttcagaagggcatacggtatgatctctgtatcttccgcaccgatgatgggcgcggatggggcgttcgcaccctggaaaagattagaaaaaacagcttcgtgatggagtatgttggagaaataattacctccgaggaagcagaacggcgtgggcaaatctatgatagacagggcgcaacctacttgtttgatctcgactacgtcgaggatgtctacactgtagacgcagcatattatgggaatatttctcacttcgtcaaccacagctgtgatccaaatctgcaagtttacaacgtgtttattgacaatctggacgagaggcttcctagaattgcattctttgctactcggactattagggcaggcgaggagctgaccttcgattacaatatgcaggttgatcctgtcgacatggagtctactagaatggacagcaacttcggactggccggactacctggcagtcctaagaaacgcgtgcgtatagaatgcaagtgcggaacagagtcctgtcgcaagtaccttttttag

SEQ ID NO: 17570 - DNA, 1239 bp, Artificial Sequence
  Description of Artificial Sequence: Synthetic coding sequence
atggcagagaacttgaagggttgctccgtatgctgtaagtcctcttggaaccagctccaggacctttgtagattggcgaagctgtcatgccctgccctgggaatatctaagagaaatctttacgatttcgaggttgagtatctgtgtgactacaagaagattagggaacaggagtattatttagttaaatggcggggttatcccgatagcgagtccacttgggaaccgagacagaatcttaagtgcgtgcgcatccttaaacagtttcataaggacctggaacgcgaactactgaggcgccaccacaggtcaaaaactcccagacatctggacccttctctcgccaactacctggttcagaaggctaagcagagacgtgccttgagaagatgggagcaggaattgaatgcgaagcggtcccacctgggccgtataacagtcgagaatgaagtcgacttggatggacccccgagagcatttgtgtatattaatgagtacagggtcggtgaaggtatcactcttaaccaggtcgctgtaggttgtgagtgtcaggactgcctgtgggcacctactggcggatgctgccctggagcgagccttcacaaatttgcatataacgatcagggccaggtcagactgagggccggactcccgatttacgaatgtaattcacgttgccgctgcggttacgactgtcctaaccgtgttgtgcagaaaggaatccggtatgacttgtgcatcttccgcaccgatgatggtagagggtggggagttagaactctggagaagatcagaaaaaattcatttgtgatggagtacgtgggggagattatcaccagcgaagaggccgagaggcggggccagatttacgacagacagggggcgacatacctcttcgatttagattatgtcgaggacgtctatactgtagatgccgcttattacggcaacatatctcattttgttaatcactcatgcgacccaaacctgcaggtgtataacgtctttattgataatctggacgagcggcttcccagaattgctttctttgcaacgcgcaccataagagcaggcgaagaattgaccttcgattacaatatgcaggtcgatcccgtcgatatggaaagtacacgaatggatagcaattttggcctggctggcctccctgggagcccaaagaagcgcgtccgcattgaatgtaaatgtggaacggagtcatgcaggaaatacctcttttag

SEQ ID NO: 17571 - DNA, 648 bp, Artificial Sequence
  Description of Artificial Sequence: Synthetic coding sequence
atggcctggatctcccgacttcgcgaacatctggatggaccacctagagcgttcgtatacatcaatgagtatcgcgttggggaaggcatcactttgaaccaggtggccgtgggctgcgagtgtcaggactgcctgtgggcccccacaggtgggtgctgcccaggggccagtctccacaaatttgcttataacgaccagggtcaagtgcgcctgcgcgcaggcctgccaatctacgaatgtaactccaggtgccgctgtgggtatgactgtcctaatagagttgtgcagaagggcattcggtacgatctatgcatcttcaggaccgacgacggaaggggttggggtgtacgtacacttgaaaagatcagaaagaatagctttgtcatggatcccgccctgctgaccgtgtgtttaaaattgcccgccttccccatggggaaagcttgggaaacagacctctccgtgacaggcacgctgggacgtgggtgtggcaggggagaggaccgcttgcaggagagtcccttcccagttcctgcacccagcgtcggttgcacctataagccaccgccaacctttaggaactcattttctacgtctcggctcagtgttgtcgggattcacggcctgctgcgaaggagtaaggggtag

SEQ ID NO: 17572 - DNA, 1230 bp, Artificial Sequence
  Description of Artificial Sequence: Synthetic coding sequence
atggccgagaaccttaagggatgcagtgtgtgctgtaaaagttcttggaatcagctacaggatttgtgccgtttggctaagctcagctgcccagcactaggtatctctaaaagaaacttatatgatttcgaagtagagtacgtgagattgcaagaggaccctaggactggcatactccccggggaaatggcttggattagtcggttacgcgaacacctgggagcaaccgctgaaagtcaagtgtgtgcatatcctcaagccgtcccgcaaggattgaggaagggagccgcaccggcagcccctccggtcaaggatccacccgctcccgggcccaaacttggacagctgcctggagccgagggtcaagctgaggccggagccccctcccttggagcgggagcccagtgtcaggcgcacctaggacgaatcaccgtggaaaatgaggtcgacctcgacggccccccgcgagccttcgtgtatattaacgaatatcgcgttggcgaggggatcacccttaatcaggtcgccgtcgggtgtgagtgccaggattgcctttgggcacccaccgggggctgttgcccccggcactgtactagcctgcccactatgacccgggccaggtgcggctttgagcccggatgcccatccacaagtgctacccctgccgccgcagctgctatgactgcgcaaatagtatggtatcggagggttagcgatatgacgagtgcctcgagtgcacgtatgatgggcgtcgcaggtgcctccgcaccctggcgccggttcgcgagaactgcttcttcgtggagtacctgggaaaggtccctgccacaacgaagacaatccgggggccaaatatacgatagacagggagcgacctacctgttcgacctggactacgttgaagatgtttatactgtggatgcagcctattatgggaatatctcccacttcgtaaatcatagctgcgatccgaatctgcaggtctataacgtgtttatagacaacctggacgagcgcctaccttctctgtccctgccccaggagcctagtggacaggctcggagcagccctctgataacgacttgtaaatggacgccatggacttggcgtgcgcctgcatggacccccacactcgcatggttgggctctctggctcccctgcgcagcggttccgttctgaatgcatcggtaggactatcccccgctgctaacacatcaagcagtccctag

SEQ ID NO: 17573 - DNA, 555 bp, Artificial Sequence
  Description of Artificial Sequence: Synthetic coding sequence
atggcttggatcagcaggttacgcgaacatctcggggcgactgccgaatcccaggtgtgcgcgtatccacaagccgtgcctcaaggacttcggaaaggagccgcccccgcagcccccccagttaaagatccacccgcaccggggcccaagctgggccaacttcctggggctgagggccaagcggagccagggtgcccttcaacttcagccacccccgccgccgctgccgccatgactgcgcaaattgtgtggtaccgaagggtctcggacatgaccagcgcttcctcagctcggatgatgggagttgccggagcctcggccccctggcggaggttcgcccgaacagcctcatcatggtcaacctgggaaaggagcctccctcaaaggcggcagtccggtggagcacgatccactacagtccgcgctccacccacttcgctgacttggacaacttggaggacgtgcaccccctggatgccccctacaatggccacttcccccaccctgtccacaaccgttgtgacaccaacgtgccgctgtaccacaagttcttag

SEQ ID NO: 17574 - DNA, 285 bp, Artificial Sequence
  Description of Artificial Sequence: Synthetic coding sequence
atgcgagcaggtttctccgattttcagcttatcagggaccaggtcctgttcctccaagatcaggctcaaagactaactgagtggctacagctctctggcttcgaaaatccagtaagcgaatccaccaccctctgtttgagagagcgagaaaagcgcataccaacgtgcgtcgctgtctgtgttccatctcctggaacagtgcacactgccctgctgcatcccacaacattgtctcaaagccgcagttcgagcgaggctaagatgctgataatacacacagcctag

SEQ ID NO: 17575 - DNA, 594 bp, Artificial Sequence
  Description of Artificial Sequence: Synthetic coding sequence
atggacgtgggctccaaggaggtcctcatggaatcgcctcccgactactctgctgcccctagggggaggttcggaattccatgctgccctgtacaccttaagagactactcatcgtcgtagtggtcgtcgtgttgattgtggttgtgatcgtcggggccctcttgatgggcttgcatatgtcacagaagcatacagagatggtccttgagatgagcattggcgcacccgaggcccaacagcggttggcactgtcagagcatttagtgactaccgcaacctttagcatcggtagcacaggactagtcgtatacgattatcaacaattgctgattgcatataagccagcaccaggaacctgttgctacatcatgaagatagcaccagagagtattcctagtctggaagctttgactcggaaggtacacaacttccaaatggaatgttcactgcaggcgaaacctgcagttcccacatctaagctgggccaggccgaaggcagagatgcaggcagcgcaccctctggaggggaccctgctttcctgggaatggccgtgtcgacattgtgcggcgaagtgccgctgtattatatttag

SEQ ID NO: 17576 - DNA, 576 bp, Artificial Sequence
  Description of Artificial Sequence: Synthetic coding sequence
atggatgttggctctaaggaagtgctgatggagtcccccccagactattctgctgcccctagggggcggttcggaattccttgctgtccggtgcacctgaagcgattgctcattgtggttgtggtcgtagtcttgatcgttgtggtgatagtgggcgctctgttgatgggacttcatatgagccagaagcacactgaaatggttttagaaatgtccattggggcccccgaagcacagcagaggctcgcgcttagcgagcaccttgtaacaacagccaccttctcaataggctctactggactggtggtctatgactatcagcagctgctgatagcgtataagccggcaccagggacttgctgttacatcatgaaaatcgctcctgaatctattccatctctggaggctttgacgaggaaggttcacaatttccaagcaaagccagctgtacccacgtccaagctgggccaggctgagggacgcgacgcgggaagtgcaccctccggaggggaccccgcctttctaggtatggccgtcagtacgctctgcggcgaagttcccctttactatatttag

SEQ ID NO: 17577 - DNA, 1158 bp, Artificial Sequence
  Description of Artificial Sequence: Synthetic coding sequence
atgatgatgatggccctgtcaaagacctttggtcaaaagccagtgaagtttcagctggaggacgacggagaattctatatgataggatcagaggtgggcaattacctcagaatgtttcgggggagcttatacaagcggtacccatccctatggaggcgactggctacagtcgaggaacgcaagaaaatcgtggcttcctcccatggcaaaaagactaagccaaacactaaagatcacgggtatacaaccctggccacctcggtcacactattgaaagcatctgaagtggaggaaattctggatggcaatgacgaaaaatacaaggccgtgagtatttcaacagaacctcccacatatctgagagaacagaaggccaaacgtaattcgcagtgggtgcccactttgcccaatagctcccaccacctggatgctgtgccgtgcagcaccactatcaacaggaatcggatgggtagagacaagaaacggacttttccgctttgtttcgacgaccatgacccagcagtcattcatgagaacgcttcacagcccgaggtcctcgtacctatacgactcgacatggagatagatggccagaaactccgtgatgcctttacctggaacatgaatgagaagttgatgacgccggaaatgttttccgagatcctatgcgacgaccttgacctcaatcccctcacctttgtccccgcaattgccagtgccattcgtcaacaaattgaatcatatccgaccgatagcatactcgaggatcaatcagatcagcgcgtgattatcaagcttaacatccatgttgggaacataagtttagttgatcaatttgagtgggatatgtccgagaaagaaaactcccccgaaaagttcgccctaaagttgtgctccgaattaggtcttgggggcgagttcgtgacaactattgcctattccatccggggacagctcagctggcaccaaaagacttacgcttttagtgagaaccctttgccgactgtcgagatcgctatcagaaatacgggtgacgctgatcagtggtgcccacttcttgaaacattgaccgacgcagaaatggagaaaaaaatcagagatcaggatcgaaatacaagacggatgcggcggctcgctaacacagcgcccgcctggtag

SEQ ID NO: 17578 - DNA, 1131 bp, Artificial Sequence
  Description of Artificial Sequence: Synthetic coding sequence
atgatgatgatggctctgagcaaaactttcgggcaaaaacctgtgaaatttcagctggaggatgacggggagttctatatgatcggaagtgaggtgggaaattatctgaggatgttcaggggctcactgtacaaaaggtatccctcactctggcggaggcttgcaacagtggaagaacgcaagaaaattgttgcctcatctcatgaccacggctacaccactctggcaacaagtgtgacattgctcaaggcgagcgaggtcgaagaaatcctcgatggcaatgacgagaagtataaggccgtgtccatttctaccgagccccccacataccttcgagagcagaaggccaagaggaattcacagtgggtcccaacactgcccaactccagtcatcatctggacgccgtgccttgtagcacaacgatcaacaggaacagaatggggagggacaaaaagaggacctttccgctctgttttgatgatcacgatcccgccgtcattcacgaaaatgcctcccaaccagaagtcctggtcccgatcaggctggatatggagatcgacggacagaagctgcgggacgcatttacctggaacatgaatgagaaattgatgactccagagatgttcagtgagatcctttgcgacgacttggatctgaacccactgactttcgttccagccatcgcttcagcaatccgccagcagattgagtcataccccacggattccatactggaggatcaatcagaccagagagtaatcatcaagttaaacattcacgtcggaaatattagtctggtggatcagttcgagtgggatatgtctgagaaggaaaatagccctgagaagttcgccctaaaactttgtagcgagcttggacttgggggagaattcgtcacgacaatcgcctactcgatcaggggccagctgtcatggcaccagaagacatacgctttcagcgagaaccctctccctaccgtggagattgcgatcaggaatacaggtgatgctgaccagtggtgtccactgctggaaaccctcacagatgcggagatggaaaagaagatcagagaccaggatagaaacacaagacggatgagacggctagctaataccgcgcccgcatggtag

SEQ ID NO: 17579 - DNA, 81 bp, Artificial Sequence
  Description of Artificial Sequence: Synthetic coding sequence
tggaggagactggcgaccgtggaggaacgtaaaaaaattgttgcaagcagccatgccctgatgacaatgactcagctgtag

SEQ ID NO: 17580 - DNA, 7626 bp, Artificial Sequence
  Description of Artificial Sequence: Synthetic coding sequence
atggtggctcttagtttaaagatcagcatcgggaacgttgtcaagactatgcagtttgaaccttctaccatggtgtacgatgcctgtcgcatcatccgggaaagaattccagaggcccctgccggcccaccttcggatttcgggttatttctctctgatgatgatccgaaaaagggcatctggctggaggccggcaaagccctcgattactacatgttgaggaatggcgacaccatggagtatcgaaaaaagcagaggccccttaagattcgaatgctagacggcactgtcaaaactatcatggtggacgattcaaagaccgtaacagatatgctcatgaccatctgcgccagaatcgggattaccaatcacgacgagtactctctggtgagggaactgatggaagaaaaaaaagaggaaatcaccggaacccttagaaaagacaagaccttactgagggatgagaaaaaaatggagaagctgaaacagaaactccataccgatgacgagctgaattggctggatcacggcagaacgctgcgggaacagggggtggaagagcacgaaaccctgcttctacggcgtaagtttttttattctgaccaaaacgtggacagccgagatccagtgcagttgaatctgttatatgtgcaggcgcgcgatgatatcttaaatggaagccaccccgtcagctttgataaggcttgcgagtttgccggttttcaatgtcagattcagttcggacctcataacgagcagaagcacaaggcagggtttttggacctgaaggacttcctcccaaaagagtacgtcaagcagaaaggtgagcggaaaatcttccaggctcacaagaactgcgggcagatgtccgaaattgaggccaaagtccgatacgtaaagctggctcgatccctcaagacttatggggtcagcttctttttggtaaaggagaagatgaagggaaaaaataaactcgtgcctagactgcttggcatcaccaaagagtgtgtcatgcgggtggatgagaagacaaaagaagttatccaggagtggaacctcaccaacatcaagagatgggccgcgtcacccaagagcttcaccctcgactttggtgactaccaggacgggtactattccgtccagacgactgaaggggagcagattgctcaacttattgcaggttatatcgatattatcctgaaaaagaaaaagtccaaggaccatttcggtctagagggcgatgaggagtctaccatgctggaagattccgtgtcgccgaaaaagagtacagttctccagcagcagtacaatcgggtaggcaaagttgaacacggtagtgtcgctctgcctgccatcatgcgctctggcgcctccggacctgagaactttcaggtaggaagcatgcctcctgctcagcagcagatcacaagcgggcaaatgcacaggggtcacatgccaccgctcacatcagctcagcaagcccttaccgggactataaattcctctatgcaggccgtgcaggccgcacaggctactcttgatgatttcgacaccctaccgcccctcggccaggatgcggcgagcaaggcctggagaaaaaataaaatggacgagagcaagcacgagatccacagccaggtcgatgctatcacggccggcacggcttccgtagtgaatctgactgccggggaccccgctgaaacagattacacagcagtggggtgcgccgtgaccaccatttctagtaatttaactgaaatgtcgcgcggcgtgaagctgctggcagccctgttagaagacgaggggggctccggtcgcccgttgctccaggccgccaagggtctggccggtgccgtatccgagctgttacgatccgcacagcccgctagcgcggagcccaggcagaacctcctccaggccgccggcaatgtggggcaagcctccggcgaactgttgcagcagatcggcgagagtgacacagatcctcacttccaggacgccctgatgcaactggccaaggccgtggcgagcgctgccgcggcactggtgctcaaggccaaaagcgtggcccagagaacagaggattcaggcctgcagacacaggtgatcgcagctgctactcaatgtgcactctctacatctcagctcgtcgcctgcactaaggtcgtggcaccgacaatctcttcgccagtgtgccaagagcaactggtcgaggctggaagactcgtggcgaaggcagtcgaaggctgcgtttccgcttcacaggcagccactgaggacggtcaacttctaaggggcgtgggcgccgctgctaccgctgtgactcaggcattaaatgagcttctccagcacgtcaaggcacacgccaccggtgccggaccagccggacggtatgatcaggcgactgacaccattctgacagtgacagagaacatcttctcatccatgggggatgctggagaaatggtgcgacaggcaaggatactagctcaggctaccagtgacctggtaaatgcgatcaaagcggatgccgaaggggaaagcgatctggaaaatagcaggaaactgttgtctgctgctaaaatcctggcggacgccaccgcgaaaatggtcgaggccgctaagggcgccgctgcacaccctgattcggaagaacaacaacagcgtttgagggaagccgcggagggtctgcggatggcaactaatgctgcagcacagaacgcgatcaaaaagaaactggtgcaaagactggagcacgccgcaaagcaggcagctgcctccgctactcagaccatcgctgccgcgcagcacgctgcctccactccaaaggcctcagccggcccccagcccctcctagtgcaaagctgcaaggccgtggcagaacagatcccgctgcttgtgcagggcgttcgcggctctcaggctcagccagacagcccctcagcccaattagccctcattgctgcttcacagtcctttctgcagcccggaggcaagatggtggcagcggctaaggcaagtgtcccaacaattcaggaccaggccagtgccatgcagctctctcagtgtgctaagaacctcggaactgctctcgcagagttacgtaccgctgcccagaaagcccaagaagcgtgtggacctctcgagatggactccgcactgagcgtcgtgcagaacctcgagaaggacctgcaggaggtcaaggcggccgctagagacggaaagcttaaacccctcccgggagaaactatggagaagtgtacgcaggatctgggcaactcaacaaaggcggttagcagcgcgatcgcccaactactgggagaagtagctcaggggaatgagaactacgccggaatcgcagctagagacgtggccggaggattgcgctctctggcccaggccgcccgaggcgtggctgccctcaccagcgacccagccgttcaggccatcgtcctcgacaccgcttccgacgtcctggacaaagcttcaagcctgatcgaagaggctaaaaaagcggccggccaccccggcgatcccgagagtcagcagcgactggctcaagtggctaaagccgtcacacaggccttgaacagatgcgtctcttgcctcccaggccaacgggatgtagacaatgcgctgagagcggtcggagacgctagcaagagattactcagcgattcattacctcctagcactggtaccttccaggaggctcaaagcagactgaacgaggccgccgccggcctcaaccaagccgccactgaacttgtccaggcttcaagagggacaccacaagacctcgctcgcgcatccggtcgcttcgggcaggactttagcacatttttggaggctggagtggagatggctggtcaggctccctcccaggaggatagagcccaagtcgtgtccaatcttaaggggatctccatgtccagcagcaagctgctgcttgctgcaaaggcgctatccaccgaccccgcggcaccaaatctcaaatcccagcttgccgctgccgctcgcgcagtgacggatagcattaaccaactcattactatgtgcactcagcaggccccgggccaaaaagaatgtgataatgcactgcgcgagcttgagacagtcagagagctgctggaaaaccccgtacaacccattaatgatatgtcttattttggttgtttggactccgtcatggaaaacagcaaagtgctgggggaggcaatgaccggaatcagccaaaacgcaaaaaacggcaatcttccagaatttggtgacgccatctcaaccgcctcaaaggccctatgcggattcaccgaggcagccgcacaggcagcttacctggttggggtaagtgatcctaactcccaggcagggcagcagggactcgtagagccaacacagttcgctcgcgcaaatcaggcgatccaaatggcatgtcaatctctgggtgagcctgggtgcactcaggcccaggtgctatccgctgccacgattgttgctaagcacacttccgccctttgtaacagctgcagactcgcgtctgcaagaacaacgaacccgaccgccaagcggcagttcgtgcagagcgccaaagaggtggcaaattccactgccaatctcgtcaagacgattaaggccctggacggggcctttactgaagagaatagagcacagtgcagagccgccacagcaccattgttggaggcggttgataacctgtctgctttcgcaagcaatcctgaatttagttccatacctgctcagatttctccagagggcagggcagcaatggagcccatagtcatcagcgccaagacgatgctggaaagtgccggaggtttgattcagacggcaagagcactggctgttaacccacgcgaccccccttcatggtccgtgctagccggtcactccaggaccgtgagcgacagcattaaaaagcttataacctctatgcgggacaaggcacccggccagctggaatgcgagacagccatagccgctttgaacagctgtctcagagaccttgatcaagcgtccctagccgccgtgagccaacagttggcccctcgcgaagggatctctcaggaggccctccatacacagatgctcacagctgttcaagagataagccacctgatcgagcccctggctaacgcagctagagccgaagcctcccaactgggccacaaagtgagccagatggcgcagtatttcgaacccctcacactggctgcggtcggagctgccagcaaaaccttgtcccaccctcaacagatggcccttctggaccagaccaaaacactggcagagagtgccttgcagctgctctataccgccaaggaagcaggcggaaatcccaagcaggcagctcacactcaggaggcccttgaggaagccgtccagatgatgactgaagcagttgaagacctgacaaccacactcaatgaggcggctagtgctgcaggcgtcgtcggcggcatggttgactccattacacaggccataaatcagttggacgagggacccatgggggagcctgaaggcagtttcgtggattaccaaaccactatggtcagaaccgccaaggctatcgcggtgacggtgcaggaaatggtgacaaaatctaatacctctcctgaggagctcggccccctggctaatcagctgacttccgattacggaagactcgcatcagaggccaaacccgctgctgttgcagctgaaaacgaggagattggctcccacatcaagcaccgcgtgcaggagttagggcatgggtgcgctgctcttgtgactaaagcaggcgccctccagtgcagcccgtctgacgcttatacgaagaaggagctgattgagtgtgctcgtcgagtgtccgagaaggtgtctcatgtgctagccgccctccaagcaggaaatcgcggtactcaggcctgcatcacagcggctagtgccgtgagtgggattatcgctgacctggacactaccataatgttcgccaccgctgggaccctcaaccgtgaggggaccgaaacatttgccgaccatcgagagggaattctgaaaactgctaaggtgttggttgaggatacaaaagtgctggttcagaacgcggcaggctcccaggagaaactcgctcaagcagcacagagctctgtcgctacaattacccgattagcagatgtagttaaattgggcgctgcaagtctaggtgccgaggaccccgagacgcaggttgtgctcataaatgcagtaaaagatgtggccaaagccctgggggacctgatatctgcaaccaaggcagcggctggcaaagttggcgacgatccggctgtttggcaactcaaaaacagtgcaaaggtgatggtgacaaacgtaactagtcttctgaagaccgtgaaagcagtcgaggatgaagccactaaaggcacaagagccctggaggctaccacagaacacatcaggcaggagctggccgtcttctgttcccctgagccaccagccaagaccagcacgcccgaggacttcattaggatgaccaaaggcattaccatggccacagccaaggctgtcgctgcgggcaactcctgtcgccaagaggacgtaattgccacggctaacctgtcacgacgggctattgccgatatgctccgagcctgtaaagaagcagcgtaccaccctgaagtcgccccagacgtgaggctgcgcgcacttcactacggtcgagagtgcgccaacggctacctggaactgctcgatcatgtgctccttactctgcagaaacccagcccagaactcaaacaacagctgacaggccacagcaagagggtggcaggttcggtgaccgagctgatccaggctgcggaagccatgaaagggaccgaatgggtggatcctgaggaccccacagtgattgccgaaaatgagctcctgggagccgcagccgccatcgaggctgctgctaagaaactcgagcaactcaaaccacgggccaaacctaaagaagcagatgaaagcttgaacttcgaggagcagattctagaggctgctaagagcattgcagcggccaccagcgccctggtgaaggccgcaagcgcagcccagagggaattggttgcacagggaaaggtgggggccattccggccaatgcacttgacgacggccagtggtcacaggggctaatctctgcagctaggatggtggctgctgcgaccaataatctgtgcgaagccgccaatgcagcagtgcaaggccacgcctctcaggagaagctgatttcttccgccaaacaggtggcagctagtacggcacagttgctggtggcatgcaaggtcaaagccgaccaggacagcgaagcaatgaagcgactgcaggctgcaggcaatgccgtaaaacgggcaagcgacaacctggtgaaggcggcccagaaagctgcagcgttcgaggagcaagaaaatgaaacagtagttgtgaaagagaagatggtgggaggcattgcccagattattgccgcgcaagaagagatgctgcggaaggaacgcgagttggaagaggcacgaaagaaactggcccagataagacagcaacagtacaaatttttgccttccgaattaagggatgagcactag

SEQ ID NO: 17581 - DNA, 7290 bp, Artificial Sequence
  Description of Artificial Sequence: Synthetic coding sequence
atggtcgctctgtccctcaagatcagcatcggaaacgtggtaaagactatgcagttcgaacctagcacaatggtctatgatgcgtgcaggatcatcagagagaggatcccagaggctccagccggtcctccctctgattttggactttttctctcagacgatgacccgaagaagggaatatggctggaagctggcaaggccctagattattatatgttgagaaacggcgatacaatggagtacaggaagaagcagaggccccttaagatacggatgctggacggaacagtgaagactattatggtggacgacagtaagacggtgacagacatgctgatgacaatttgtgcccggattggtattacaaaccacgacgagtactccctcgtccgagagctgatggaagagaagaaagaggagataaccggcaccctgaggaaagacaagaccctgcttcgggatgagaaaaaaatggaaaaacttaaacagaagctccacaccgatgatgagttgaactggctggatcacggcagaacgctacgggaacagggagtggaggagcatgaaaccctcctgctccgcaggaaattcttctattcagaccaaaacgtggactccagggatcctgtgcagttgaatctcctgtacgtgcaggcaagggatgacattcttaatggttcccaccccgtgtcctttgataaggcctgcgaatttgcagggttccagtgtcagattcagtttgggcctcacaacgagcagaaacacaaggccgggttcctcgaccttaaggacttcctgcctaaagaatacgttaaacagaaaggcgagcgaaagattttccaagcacacaagaactgcggtcagatgtcagaaatagaggctaaggtccggtacgtgaaattagctcgctctcttaagacatatggcgtgagcttctttctggtgaaagaaaagatgaaagggaagaacaagctcgtgccaaggctgctgggcatcaccaaagagtgcgtcatgcgggtcgatgagaagaccaaggaggtgattcaggaatggaacctgaccaacattaaaaggtgggcagcaagcccaaaatcctttaccctcgattttggagattaccaagacggatattattctgttcagactacagagggcgaacagatagcccagctgattgctgggtacatagacatcatcttgaaaaagaagaagtccaaggaccattttggcctcgagggggacgaagaaagcacaatgctcgaggacagcgtgtccccgaaaaagagtaccgttctccaacaacagtacaatagagtgggaaaggtagagcacgggtccgtggcactccctgcgatcatgagatctggagccagcggaccagagaacttccaggtgggtagcatgcctcctgcccagcagcaaatcacatctgggcagatgcataggggacacatgccacccctgacatccgctcagcaggctctgaccggaacaatcaactcaagcatgcaagctgtgcaggcagctcaggctacattggacgacttcgacaccctgccacctctcggtcaggacgcagcctccaaggcctggcgaaagaataagatggacgagtcaaaacacgagatccactcacaggtggatgccattaccgcgggaactgccagcgtggtgaatctgaccgccggagatcccgccgaaactgattataccgccgtggggtgtgcagtgaccacgatctccagcaacctcaccgagatgagccgcggtgtgaagttgcttgcggcgctgcttgaggacgaaggaggatctggtcggccattgttgcaggctgcaaagggtcttgcaggggccgtgtcagaacttctgcgctctgcccagcccgcctcagccgagccgcgtcagaacctgctacaagcggcgggcaacgtaggacaagccagcggcgagctgttgcagcagatcggggaaagcgacacggatccacacttccaagatgcactaatgcagttagcaaaggcagtcgcctcggcagcggctgctctggtactaaaggcaaagtcggtggcgcagcgcaccgaggattcgggtttgcagacacaggtcatcgccgctgcaacccagtgcgctctgtctaccagccagctggtggcctgtaccaaagtggtcgcccctacgatctcatccccggtgtgccaagagcagttggtcgaggccggccggctggtcgctaaagcggtggaagggtgcgtcagcgcaagccaggccgctaccgaagatgggcagttgctccgcggggtgggtgcagccgctaccgctgtgacccaggccctgaacgaactgctgcaacacgttaaggcccacgctacaggggcaggtccagctggtcgatacgaccaagctaccgatacaatcctgaccgttacagaaaacattttttcctctatgggcgacgcgggagaaatggtgagacaggccaggatactcgcccaggcaacctctgacttagttaatgccatcaaagctgatgccgagggggaaagtgacctggaaaattctcgaaagctgttaagcgccgccaagattctggccgatgctactgctaaaatggtcgaggctgctaagggtgctgcggcccaccccgacagcgaagagcagcagcagagacttagagaggccgccgaaggcttgcgcatggccactaacgccgcagctcagaacgctataaagaagaagctcgtgcagcggctggagcatgctgctaagcaggccgcagcgagtgcaacccagactattgccgcagcacagcatgctgccagcacaccaaaggcctctgcgggccctcagcccctcctggtgcagtcttgtaaagcggttgcagagcagattcccctgttggtccagggagtccgtgggtcacaggctcaaccagacagcccctctgcacaattagctctgatcgctgcatcccagagttttctccagccagggggcaaaatggttgccgccgcaaaagcttccgtcccaactattcaagaccaggcgtcagcgatgcagctcagtcaatgcgccaagaacctcggtactgccctcgctgaattacggactgctgcccagaaagctcaggaggcatgtggccccttggagatggattctgcactatcggtggtgcagaatttggagaaggacttacaagaggtaaaggcagccgcacgggacgggaaactaaagccactgcccggcgaaaccatggaaaagtgtacccaggatctcggcaacagcacaaaagccgtcagctctgccattgcgcagttactgggagaagttgcacaagggaacgagaattacgcaggcatagccgccagagacgtggctgggggactgcgctccctcgctcaggctgctaggggagtggccgccctgacctctgatcccgctgtacaggccatcgtacttgacacagcctcagatgtgctcgacaaggctagttccctgatcgaagaggccaaaaaagctgcaggccatcccggggaccctgagtctcagcagcgacttgcccaggtcgccaaagcagtgacccaggctctgaaccgctgcgtatcttgtctccccggacagagggatgtggacaatgcattacgtgcagtaggtgatgcctctaaaagactgcttagtgacagccttcctccttccacgggaacatttcaggaggcccagagcagattgaacgaggccgcagccggactcaatcaggccgctacagagctggtgcaggcatcaagagggacgcctcaggaccttgccagagcatccgggagatttgggcaggacttcagtacctttctcgaggctggtgtcgagatggcaggccaggcccccagccaggaagaccgggcacaggtcgtgtctaatctcaaggggatttcaatgagcagcagtaagctgttactggccgccaaggcactgagcactgaccccgctgcacccaacttaaagagtcaactggccgccgcagccagggcggtgaccgacagtataaatcagctcatcacgatgtgtacacagcaggctccaggtcagaaagaatgtgacaatgcgctccgcgagctagaaacggtacgcgaactactagagaatccagtccaacctataaacgatatgtcatactttggatgcctggatagcgtaatggaaaacagcaaggtcctgggggaagcaatgacaggcatatcccagaatgcaaagaacggcaatttaccagagttcggagacgccatttctactgcttcaaaggccctatgtgggtttaccgaggcagcagcccaggctgcctacctggtgggcgtgtccgaccctaattctcaggccggacagcagggcctggtggaaccaactcaatttgcccgcgctaatcaagcaatccaaatggcctgtcagagtctgggggagccgggatgcactcaggcccaggtgctctccgctgcaaccattgtggctaaacacacatccgccctgtgcaactcatgtcgactggcttccgcacgaaccactaatcccactgcaaaaagacagttcgtgcagagtgcgaaggaagtggctaactccaccgccaacctggtaaaaacaataaaagccttggacggggcttttactgaggaaaatagggcacagtgccgggcagccacggcccccctgctggaagcagtagataacctttcagcttttgcctcaaaccccgagttctcctcaatccccgcacagatcagccctgaaggcagagccgccatggagcctatcgttatatccgccaagaccatgcttgaaagcgccggtggcctcatccaaacggcgcgggctctggcagtgaacccaagggacccacctagctggagtgtgctggcaggacactcacgaactgtgtctgatagcataaagaaactgataacatcgatgcgcgacaaagctccaggccagctggagtgcgagacagcaatcgccgctttaaacagctgtcttcgagatctggaccaggccagcctggctgcagtttcccagcagttggcccccctgcaagaaatctcccaccttatcgaaccactggccaacgctgctcgagccgaagcgtcccagctgggccacaaggtttctcagatggctcagtattttgagcctctgacgctggcggccgttggtgcagctagtaagaccttaagccacccccaacaaatggctttgctggaccagacaaagacactggctgaaagtgctcttcagctgctgtacactgccaaggaggccggcggtaaccccaaattggatgaaggcccaatgggcgagcctgaggggagcttcgtggactaccagaccactatggtgagaaccgctaaggccatcgccgttaccgttcaggaaatgataggctcccacatcaagcatagggtccaggagcttggtcatggctgcgccgctctggttacgaaggctggggccctgcagtgttctcccagtgacgcttacacaaaaaaagagctgattgaatgcgctaggcgggtctctgaaaaggtgagccatgtgcttgcagccctgcaggctggcaatcggggcactcaggcctgcattacggccgcatcggccgtgtccggtattatcgctgatctggatacaaccattatgttcgcgactgctgggaccttaaaccgggagggaacagaaaccttcgctgatcatcgggaggggatcctaaagacggcaaaagtgctagtggaggacacgaaggtgctggtgcagaacgcggctggaagccaggaaaagctcgcccaggccgcgcagagcagtgtggctaccataactcgcctagctgatgtcgtcaagctcggggcagcttcactgggagccgaggatccggagacccaggtggtgctgattaatgccgtgaaggacgtggcaaaagccctgggagacctcataagcgctacaaaggctgcagctggcaaagtaggcgatgatcctgcagtctggcagttgaagaactccgcgaaagtgatggtgacaaacgtgacctctctgctaaagaccgtgaaagccgtggaagatgaggctaccaagggcactcgcgcccttgaagccacaaccgagcacatccgccaagaacttgccccccctgcaaagacttcaactccagaagattttattcggatgaccaagggcatcacaatggctactgccaaagctgtggccgccgggaactcctgccggcaggaagatgtcatcgccaccgcaaacctgagccggcgcgcaattgccgacatgctgcgcgcgtgtaaggaagcggcttatcaccctgaggtggctccggacgtgcgcctgagagcacttcactatggtcgagagtgcgctaatgggtacctggagttattagatcatgtgctgttgacgctgcagaagcctagcccggagttgaaacagcagttgaccggacactccaagagagtcgccggaagcgtcactgagctgatccaggctgccgaagcaatgaaagggaccgaatgggtcgatcccgaggacccaacagtgatcgctgaaaatgagctgctgggtgctgcggccgctatcgaagccgccgcaaaaaaactcgagcaattgaagccccgggcaaagccaaaggaagcagacgaaagcctcaacttcgaggagcagatactggaggccgccaagagcatagcggcagcaacctctgctttggtcaaggccgctagcgcggcccagcgggagttggttgcccagggcaaggtaggggctatccctgcgaatgcactggacgatggccagtggagtcagggtctgataagtgcagcacggatggtggcagctgctaccaacaacctctgcgaggccgccaacgccgcggtgcagggacacgcaagccaggaaaagctgatatcttcggcaaagcaggttgctgccagcactgcccagttgctcgttgcctgtaaggtgaaggccgaccaggattctgaagctatgaagcgccttcaggccgctggaaatgccgtgaagcgagcatctgacaacctcgtcaaagcagcccagaaagccgccgcattcgaggagcaggagaacgagacagttgttgtgaaggaaaaaatggtcggaggaatcgcgcaaatcatcgccgcgcaggaggaaatgctgcgaaaggagagagagctggaggaagctaggaagaagctcgcacagattagacagcagcagtacaagttcctcccatccgagttgagagacgaacactag

SEQ ID NO: 17582 - DNA, 3984 bp, Artificial Sequence
  Description of Artificial Sequence: Synthetic coding sequence
atggcggcctctagacggtcccagcatcaccatcaccaccatcagcagcagctccaacctgcccccggcgcttccgccccgccgccccctccaccaccgcccctctctcctggcctcgcccctggcaccacccccgcaagtccaacagcaagcggccttgcacccttcgcaagcccgcgccacggcctggctctaccagaaggcgatggaagccgcgacccacctgataggcccaggtcaccagatccggtggatggtacatcttgttgttctactacttcaacaatttgcacagtggccgccgctccagtggtacctgctgtctctacatcttcggcggccggggtggcgcctaaccccgccgggtccgggtccaataactcccctagcagctcatcatcaccgacatcttcatcttcaagtagccccagttccccgggctctagtctggccgagtctcccgaggccgcgggtgttagctctacggcccctctgggcccgggcgccgcagggcccggcacgggggttcccgcagtctcaggagccctacgggagcttttggaggcttgtaggaatggcgatgtgtcccgggtcaagcggctggttgatgccgccaatgtcaatgcgaaggatatggctgggcgcaaaagttcccccttgcacttcgcggctggttttggaagaaaggacgtggtggaacatctcctacagatgggggccaatgtgcacgccagggacgacggggggctcataccccttcacaatgcgtgcagctttgggcacgctgaggtcgtttccctgcttctgtgccaaggtgctgacccgaatgcccgagacaactggaattatacacccctccacgaagcggccattaaagggaaaatcgacgtgtgcatcgttttgctgcagcatggtgcggacccaaatattcggaatactgatggaaaatccgcactggatcttgcggatccatctgccaaggctgtgctgaccggcgagtataaaaaagatgaacttcttgaggccgcgaggagcgggaatgaggaaaagctgatggcactgcttacccctctcaatgtcaattgccacgcatccgacggccggaagagtacgcctcttcacctagccgctgggtataatcgggtccgtatcgtgcagctgcttctgcagcatggtgcggacgtgcacgccaaggacaaagggggcctcgtaccactgcataacgcttgtagctatggccattatgaggtgaccgagctcctgctgaaacatggtgcctgtgtcaatgcgatggacctctggcagtttaccccccttcacgaggctgcatctaagaatagggtggaggtttgttctcttcttctgagtcacggagcagacccaactctggtgaactgtcacggtaaatctgcagtcgatatggcccccacccctgaactgcgggaaagactaacttatgagtttaagggtcactcccttctccaagcagctcgggaggcggatctcgcgaaagtgaaaaagacactcgcgctagagattatcaatttcaaacaacctcaatcacatgaaacagctctgcattgcgcggtcgccagcctacatccaaaacgcaagcaggtgaccgaactcctgctgcgcaaaggagctaacgtcaatgaaaagaataaggacttcatgacacctcttcatgtggcggctgagagggcacataacgacgttatggaggtgttgcacaaacacggagccaagatgaacgctctagacaccctggggcagaccgctctgcaccgcgccgcactggcgggccaccttcagacatgccggctcctcctgagctacggctcagatccatcaatcatttcattgcaaggctttacagctgctcaaatggggaatgaggcagtacagcagatcctctccgaatcaacacccattagaacttctgacgtggattatagactcctcgaggcaagcaaagcgggtgacctggaaacagtgaaacaattgtgctctagtcagaatgtgaactgtagggatttggagggtcggcacagcacccctttacacttcgccgctggctacaatcgcgtgtctgtggtcgaatatctgctgcaccatggggccgacgtgcatgccaaggacaagggaggcctcgtccccttacacaatgcctgtagttacggccattacgaggttgcagagcttttagtgcgtcacggcgcctctgtcaacgttgcagatctgtggaaatttacccccttacatgaagctgccgcgaaggggaaatacgagatctgtaagctcttactcaagcacggagccgaccctactaaaaagaacagagacggtaataccccgctcgatctcgtcaaagagggtgatactgatatccaggacctgctgcgcggggacgcggcattgttggatgctgccaagaagggatgcctcgcacgcgtacagaaactatgcactcctgaaaatatcaactgcagagatacccagggccgcaattcaacgcccctccacttggccgcaggatacaacaaccttgaggtggcggaatacctccttgaacatggagccgacgtgaacgcacaagataaagggggactcatacctctacataacgcggcaagttatggtcatgtggatattgcggctctgctgataaaatataacacatgtgtgaatgccactgacaaatgggctttcaccccacttcacgaagccgcccagaagggaagaactcagctttgcgcgctgctgttggcccacggtgcagaccctacgatgaagaaccaggagggacaaaccccactcgacttggccacagccgatgacatccgagcacttctgatagacgccatgccgcctgaagcactgcctacctgcttcaaacctcaagcaaccgtggtgtcagcgtccctgatctcaccggctagtactccttcctgtctgagcgctgcttcctccatcgataatcttactggccctctggccgagctcgccgtcgggggagcgagcaacgcaggtgatggagccgcagggacagaaagaaaggaaggagaggtggccggtctcgatatgaacatctctcagtttctcaaatcattagggctggaacacctgcgtgatatatttgaaactgaacagattacactcgacgttctggctgacatgggtcatgaagagctgaaggaaatcgggataaatgcatatggacaccgccacaagctaatcaagggcgtcgaaagactgctcgggggccagcagggaacaaatccatacctgaccttccattgtgtgaaccaagggaccatacttctggatctggcccccgaggacaaggagtatcagtccgttgaggaggagatgcagtccacaattcgagagcatagggacggaggcaacgccgggggtatatttaatcgctacaacgtaatccgcatccaaaaggtagtgaacaagaagcttcgtgagcgtttttgtcatcggcagaaggaggttagtgaggaaaaccataaccaccataatgagcgcatgctattccacggaagtcccttcatcaacgccattatacacaaaggttttgatgagagacacgcttacattgggggcatgttcggggccggtatatattttgcagaaaactcatccaaaagtaaccagtacgtgtatggcatcgggggtggcacagggtgccctactcacaaggaccgcagctgttatatctgccatcggcagatgcttttttgtagggtgacactggggaaaagtttcctgcagtttagcaccatgaaaatggcccatgcccctcctggccaccacagtgtcatcggcaggcctagtgtgaatggtcttgcctatgctgagtatgtgatctacaggggagagcaggcctatcccgaatatctgatcacataccagatcatgaagccggaggcaccatcacaaactgcaacggcagccgagcagaaaacgtag

SEQ ID NO: 17583 - DNA, 3501 bp, Artificial Sequence
  Description of Artificial Sequence: Synthetic coding sequence
atgagtgggcgtaggtgcgctggaggaggcgcagcctgcgctagcgcagccgccgaagcagtggaaccggccgcccgggaattatttgaggcatgcagaaatggtgacgtggagcgggtgaaacgcctggttacaccagagaaagtcaactcgagggacacagcaggtcgaaaatcaacccctctgcacttcgcggctggctttgggagaaaagacgtagtcgaatacctgctccagaacggcgccaacgtacaggccagagacgatggcggcttaataccattacacaacgcttgcagcttcggccacgcggaggtcgtcaaccttttgcttcggcatggcgcggacccaaacgctagagacaactggaactacacacctctccacgaagctgcaatcaagggcaagatagacgtctgcatagtgctgcttcaacacggcgccgaacctacaataagaaacactgacggccgcactgccctagaccttgcagacccctcagccaaggctgttcttaccggggagtataaaaaagatgaactgctggagagtgcccggagcggcaatgaggaaaaaatgatggcactactgactcccctgaacgtcaattgccacgcctctgatgggcgcaagtccacgccactgcacctcgccgccggatataatcgcgtcaagatcgttcagctcctactgcaacacggggctgacgttcatgccaaagataagggcgatcttgtgccacttcacaacgcttgtagttatggacactatgaggttactgaactgctcgttaagcatggcgcatgtgtaaacgctatggatctctggcagttcacgccactccacgaagccgcttccaagaatagggtggaagtgtgctctctcctgttaagttacggcgccgacccgactttgctgaattgtcacaataagtcagccatagacctggccccaactccacagctgaaggaacgtctcgcttatgaattcaaaggtcattctctgcttcaggccgctcgagaagctgacgtcacacgcattaaaaagcacttgtcactcgagatggttaatttcaagcaccctcagacacacgagacggctttgcattgtgccgccgcctccccataccctaagcgtaagcagatatgcgaattacttctgcggaaaggggccaacatcaacgagaagacaaaggagtttctgactcctttgcatgtagcatccgagaaagcccacaacgatgtcgtcgaggtcgtcgttaagcacgaagcaaaagtgaatgctctggacaacctgggtcagacgagcctgcaccgggccgcgtactgcggccatttgcagacctgcagactactcctctcatatggatgcgaccccaacatcatcagcctacaaggcttcacagccctacaaatgggaaatgagaacgtgcagcaactgctgcaagaggggattagtttaggaaattcagaagctgatcgtcagctgctcgaagctgctaaagctggcgacgtcgagacagtgaagaaattatgtacggtgcagtcggtgaattgccgtgacatcgagggccgtcagagtactcctcttcacttcgctgctggatacaatcgggtgtctgtggtggaatacttgctccagcacggggccgatgtccatgccaaggacaaaggcggactggtgccactgcacaacgcttgctcttacggacattatgaggtggcggagttgttggtaaagcacggagccgtggtgaatgtggccgatctgtggaagttcactcccctgcacgaagctgccgcaaaaggcaagtacgagatttgtaaactgcttttgcaacatggcgccgatccaacgaaaaaaaaccgcgacggtaacaccccactcgaccttgtgaaagatggggatactgatatccaggacctgctgcggggggacgccgcattgcttgatgctgccaaaaagggttgcttagctagagtaaagaaattaagtagtccggataatgtgaattgccgggacacacaaggccgacacagtactcccctgcacctagccgctgggtataacaaccttgaagtggctgaatatctcttacagcacggcgccgatgttaacgcccaggacaaaggggggttaattcccttgcataacgcagcaagttacggccatgtggacgtagcagccctgttgatcaagtacaacgcctgtgtgaacgcaacagataagtgggccttcactcctctccatgaggccgcacaaaagggaaggacacaactgtgcgccctgttgcttgcacacggcgctgatccgactttaaaaaaccaggagggccagacccctctagacctagtcagcgctgatgacgtctctgcactcctgaccgccgcaatgcctcctagcgcactcccctcctgctataaacctcaagtcctgaatggagtgagaagcccaggggctaccgccgatgctctaagctccggaccatcgtccccttcctccctgtcagctgcaagttccttagacaacttatctggcagcttttccgagcttagcagtgtggtgtcctcctccgggaccgagggggctagttccttagagaaaaaagaggtgcccggcgtggactttagcattactcaattcgttagaaacttgggcctggagcatctgatggacatcttcgaaagggaacagatcacgttggacgttctcgttgagatgggccataaggaattgaaggagattggcatcaatgcctacggccacagacacaaacttatcaaaggcgtggaacgcctgatttcaggtcaacagggtctcaatccttacctgacccttaatacttctgggtcaggaaccattttgattgacctctcacccgacgacaaggaattccagagcgtggaagaagagatgcaatctaccgtgcgcgaacatagagatggaggacacgccggaggcattttcaacaggtacaatattcttaaaatccagaaggtgtgtaacaaaaagctctgggagcgctacactcacaggaggaaggaggtgtccgaagaaaatcacaatcatgctaatgaacgaatgctcttccacggttccccttttgttaacgccatcatccataagggctttgatgaaaggcacgcctacatcgggggcatgtttggcgcaggtatatatttcgcagagaattcttcaaaatccaaccagtacgtgtacggcattggcggcgggactggctgccccgttcacaaagatagatcatgttacatctgccataggcagcttttgttttgcagggttactctgggaaagtcgttcctgcagttcagcgcgatgaagatggctcacagccctccaggccaccatagtgtgaccggacgtcccagcgtgaacgggctggccctggctgaatatgtgatctatcggggcgaacaagcctaccccgaatacctcattacataccagatcatgaggcctgaaggcatggttgacggctag

SEQ ID NO: 17584 - DNA, 2139 bp, Artificial Sequence
  Description of Artificial Sequence: Synthetic coding sequence
atgcgagaacccgcccttgccgcctctgctatggcataccacccattccacgctccgcggccagccgactttcctatgagcgcctttctggcagcagcccagccatcattcttccccgccctggcactgccacctggggctctggcaaagcctttgcctgatccggggctggccggagctgccgctgctgccgccgccgcagccgctgccgccgaggccgggctccacgtttcagcactgggcccacatcctcccgcagcacacctgaggagtctgaaaagtttggagccggaagacgaagtggaggatgatcccaaagtgacactggaagctaaggagctgtgggatcaatttcacaagctgggaacagaaatggtgattacaaaatctggaagacggatgttccccccattcaaagttagagtttcaggactagacaagaaagcaaagtatatcctgctaatggacatcgttgcagccgatgactgtcgctataaattccataactctcggtggatggtcgccggtaaggccgatcccgaaatgccgaaacgcatgtatattcaccctgatagtccggctacaggagagcagtggatggccaagcccgtggctttccacaaactgaaactcaccaataacatctccgacaaacatggatttaccatccttaattccatgcacaagtatcagcctagattccatattgtgcgggctaacgacatcctgaagttaccctatagcactttccggacatacgtgtttcctgagactgacttcatcgcagttaccgcctaccaaaacgacaagattacccagctgaagatcgacaataatccatttgctaagggcttccgggacactggcaacgggcgccgcgaaaaacgtaaacagcttacactgccttccttaaggctttatgaagaacattgcaagcctgagcgggacggggccgaatcagatgccagcagttgcgatccaccgcccgctcgggagccacccacatccccaggcgccgcgcccagtccactgagattacaccgcgctagagccgaagaaaagtcttgcgcagcggatagtgatcccgagcccgagcgactctcagaagagagggccggagcacccctggggaggtctcctgcccccgactcagcctcgcctacacggctgacagaaccagaaagagcgagagagaggcgttcaccagaaaggggaaaggagccagccgaatccggcggtgacggacccttcgggcttcggagcctggagaaggaacgagcagaagctcgccgaaaagacgaaggtcggaaagaagctgccgaggggaaagagcaaggattggcacctctggtcgtgcagacggacagcgcctcacctttgggagccggtcacttgcccggactcgctttctcaagccacttgcacggccagcaatttttcgggccgttgggggcaggtcagcccctgttcctgcatcccggtcagttcacaatgggaccgggcgccttctcagccatgggaatggggcacctgttagccagcgtggctggcggagggaacggagggggcggaggaccaggaactgccgctggactcgacgctggaggcctggggccagcggccagcgccgcatccacagctgcccccttcccatttcacctcagtcagcacatgctggctagtcaggggatccctatgccaacttttggtggactgtttccctatccttatacatatatggccgcagctgcagctgccgcctccgcactgccagccaccagcgcagcagctgctgcggctgcagcggctggatccctctcccgcagcccgtttttaggctcagctcgcccccgccttcggtttagcccatatcagatcccggtgactattcctcctagcaccagtttgttgaccacaggtctcgccagtgagggtagtaaagctgctggaggcaacagccgggagccctcccctctgccagaactggctctgagaaaagtgggggcaccgtctaggggggctcttagcccatcaggcagtgcaaaggaggccgccaacgagctgcagtccatccagagattagtgagtggcttagagagccaacgagccctgtcgcccggcagagaatcgccaaagtag

SEQ ID NO: 17585 - DNA, 981 bp, Artificial Sequence
  Description of Artificial Sequence: Synthetic coding sequence
atgagcgcttttttagcagccgcccaaccatcattttttccggctcttgctctgccccctggggctctggcaaagccattaccagaccctggtctggccggtgccgcagctgctgcggcagcggccgccgcagccgcggaggctggtctccacgtctccgccctcggaccacacccacccgccgctcacctccggagccttaaatcacttgaacctgaggatgaagtggaggacgaccctaaggttacactagaagccaaagagctctgggaccaatttcacaagttgggcactgagatggtcatcacaaaatctggtcggcgcatgttccccccctttaaggtgagggtgagcggactcgacaaaaaagctaaatatatcctgctgatggacatcgttgcggcagatgattgccgttacaaattccataactcccgctggatggtggcgggtaaggccgatcccgagatgcccaaacggatgtacatacacccagattcgccggctacaggagagcaatggatggccaaacctgtggccttccacaaacttaaactgactaacaacatctccgacaagcacgggtttacaattctgaactccatgcataagtaccagccccgctttcacattgtgcgggccaacgatatcctcaaactgccatactcaaccttcagaacttacgtctttccagagactgacttcattgctgtgacagcctatcagaatgacaagattacccagctgaagattgacaacaatccttttgccaagggctttagggacaccgggaacggaaggcgggagaagagaaagcaactgacactgccttcacttagactgtatgaagaacattgcaagcccgagagggacggcgcagagagcgatgcctcctcttgcgaccctccccccgctagggagccacctacctctccaggtgccgctccaagtccactgcgactccaccgcgccagaggttag

SEQ ID NO: 17586 - DNA, 996 bp, Artificial Sequence
  Description of Artificial Sequence: Synthetic coding sequence
atgactgagagaccccctagcgaggccgcgaggagcgacccgcagttggagggcagagatgctgcagaggctagcatggccccaccgcacctcgtcctactgaacggtgtggccaaggagaccagtcgcgcggccgccgccgagccacccgtgatagaactgggcgcaagaggaggccctggcggcggccctgctgggggtggcggcgcagcacgcgatcttaaaggacgggacgctgctaccgcagaagctaggcatagagttcccactaccgaactctgtcgccccccaggtcctgctcctgcacctgcccctgcttccgttacggccgaactgcctggagatggcagaatggtgcagctgtctccccccgccttggccgccccggccgctcccgggagagcattactctattcactgtcccagcctttggcctccttgggctcgggtttttttggtgagcccgacgccttccccatgttcactacaaacaacagggtgaagcgaaggcctagcccttacgagatggaaattaccgacgggccccacacaaaggttgtgaggcgtatatttaccaacagcagggagagatggcgacagcagaatgtgaacggtgccttcgctgagctgaggaagctcatacctacccatcctcccgataaaaaactcagcaaaaacgaaatactaaggcttgccatgaaatatatcaacttcctagcaaagttactgaacgatcaagaggaggaggggacccagcgcgcaaagaccggcaaagaccccgtcgttggggcaggtggagggggtggaggcggcggaggaggcgctccgcccgacgacctcctgcaggacgtcctaagtcccaactcctcttgtggcagtagcctggacggcgcggcgagccccgatagttacaccgaggaacctgcccctaaacacaccgcccggtccttgcaccctgctatgctgccggccgccgacggcgctggaccacggtag

SEQ ID NO: 17587 - DNA, 1002 bp, Artificial Sequence
  Description of Artificial Sequence: Synthetic coding sequence
atgaccgagcgcccgccttcggaggcggccaggagtgatccacagttggagggccgcgatgctgctgaggcaagcatggcccctccacatctggtgctgcttaatggtgtggccaaggagactagccgggccgccgctgccgagccgccagttatagagttgggcgcacgaggggggcctggaggtgggccagctggcgggggaggtgctgcccgcgacctgaagggccgagacgcagctaccgccgaggcaagacacagagtgcctacgactgagctttgcagaccacccggcccagcacctgcccccgcacccgcttcagtgacggctgagttacctggcgatggacgaatggtgcagctgtcaccacccgcacttgctgcccccgctgcgcccggacgtgcactgctatactccctctctcagccgttagcttccttgggatcccattctggcttttttggcgagcctgacgcgttcccaatgttcactacgaataaccgtgtgaagcggagacccagtccctacgagatggaaatcacggacggcccacacaccaaggtagtgcgccggatcttcaccaactcaagagagaggtggaggcagcagaacgtaaacggggcattcgccgaacttcgcaaactgattcctacccacccgcctgacaagaagctgagcaagaatgagattctgcggctggctatgaaatatattaactttctcgcaaaactcttgaacgaccaggaggaggaagggactcaaagggcaaagacagggaaggaccccgtcgttggcgccggaggaggtggaggcggaggtgggggcggggctcctcctgacgacctgcttcaggacgtccttagtccgaattcatcctgcggctccagcttggacggtgccgcaagccctgacagctacaccgaggaaccagcacctaagcatactgcccgaagcctgcacccggccatgctgccggccgctgatggggccgggcccagatag

SEQ ID NO: 17588 - DNA, 996 bp, Artificial Sequence
  Description of Artificial Sequence: Synthetic coding sequence
atgactgagcggcccccctcagaggcggcacgaagtgatccccagctagagggccgggatgcagcagaggcttcgatggccccgcctcatctagttctgctcaatggggtggctaaagaaacaagtcgagcggccgctgccgaacctccagtgattgaactcggagcgcgcggcggacctggagggggcccagctggaggaggtggcgccgctagggacctgaagggaagagatgccgccactgcggaggccagacaccgcgttccaaccacggagttgtgtcgcccgcccggccccgcccctgcgcccgccccagcgtcagtcacggccgagcttccaggtgacggaaggatggtgcagctgtcccctcctgccttagccgcacccgctgcccccggaagagccttgctgtacagtctcagtcagcccctggcttccctggggtccgggttctttggcgagcccgacgctttccccatgttcacaaccaacaatagggtaaaaagaagaccgtctccatatgagatggaaatcactgacggcccccatacaaaggttgtcaggcgcatattcaccaattcacgcgaaagatggaggcagcaaaacgtgaacggtgcttttgccgagttaaggaagttaattcctacacacccccccgacaaaaagctctctaagaacgaaattctgcgtttggctatgaagtatatcaacttcttagccaaactgctgaatgatcaggaggaggagggtacccagcgcgctaaaactggtaaggaccctgtggtgggcgcaggaggaggcggaggagggggaggcgggggggccccacctgacgaccttttacaggatgttctttcccccaatagttcgtgtggttccagcctggatggagccgcttcaccagactcatacactgaagaacctgctccgaaacataccgcccgctcactgcatccagccatgctcccagcagcagacggagcaggaccccgatag

SEQ ID NO: 17589 - DNA, 993 bp, Artificial Sequence
  Description of Artificial Sequence: Synthetic coding sequence
atggagcacttagggcctcatcacctgcaccccggccatgccgagcccatttcatttgggatcgaccagattcttaactctccagatcagggaggttgcatggggcccgcttcccgcttgcaggatggggaatacggcctcgggtgtctcgtcggaggcgcatatacttacggcgggggcggatcggctgccgcgaccggtgccggcggcgctggagcatatggtactggtgggcctgggggtcctgggggtcccgcaggcggtggcggtgcgtgctccatgggtccccttacggggtcttacaatgtcaatatggcactggctggtggccccggtcccggtgggggcggcggctcaagcggcggcgccggcgcactgagtgccgccggcgtgatccgggtgcctgcccaccggcctctcgccggggccgtggcacacccacagcccctggcaaccggcttgcctactgtccctagtgtgcctgccatgcctggcgtgaataatctcactggcctgactttcccttggatggagagcaatcgtcggtacacgaaggatcggttcacgggtcacccctatcagaacagaacacctccaaagaagaagaaaccacggaccagtttcacaaggttacagatctgtgaactggaaaagcgtttccacaggcagaagtacctggcaagcgccgaaagagctgccctcgccaaggccttaaaaatgaccgatgctcaggtcaaaacctggtttcagaatagacgcactaagtggagacgacaaaccgccgaagaaagggaagccgagaggcaacaagcaaaccgaatattgttacagttgcagcaggaggcgttccagaagtctctggcccagccactcccagccgatccactgtgcgtgcacaattcttctctgtttgccttgcaaaatttgcagccatggagtgatgattccaccaagatcacctctgtgacgagtgtcgcctcggcatgtgagtag

SEQ ID NO: 17590 - DNA, 774 bp, Artificial Sequence
  Description of Artificial Sequence: Synthetic coding sequence
atggagcacctgggcccccaccacctccacccaggacatgcagaacccatttcttttggcatcgatcagatcttgaattctcctgaccagggcggctgcatgggtccagctagtcgtctccaagacggcgagtacggactggggtgcctcgtcgggggagcatacacatacggaggaggcggctccgccgccgcaaccggtgcaggaggtgcgggggcttacggtacaggggggccagggggcccaggagggccagcgggcggtggcggggcctgctctatgggtcctctgaccggcagttacaacgttaacatggcgctagctggcgggccgggccctggcgggggcggaggaagcagtggaggagcgggcgccctctctgccgccggcgtcattcgggttccagcccaccggcccttggcaggggccgtggctcatccacagcctctcgcaaccggactgccgactgtgccttccgtgcctgcgatgccaggggtaaataatttgacgggcttgacttttccttggatggagtctaacagaaggtatacgaaggacaggtttaccggccatccataccaaaacagaaccccccccaaaaagaagaagcccagaacaagttttactcggctccagatctgtgaactggagaaacggttccacagacagaagtacctggcttctgccgaaagagccgctctggccaaggcgctgaagatgaccgatgctcaggtgaaaacctggttccaaaaccggcggacaaagtggaggtag

SEQ ID NO: 17591 - DNA, 345 bp, Artificial Sequence
  Description of Artificial Sequence: Synthetic coding sequence
atggcggaatgtccgacactgggggaggccgtgaccgatcacccggaccggctgtgggcgtgggagaagttcgtgtacctggacgagaagcaacacgcttggctgccactgacaatagaaattaaagacaggcttcagctcagagttctgttgcgtagggaggacgtggtcttggggagacccatgactcccacgcagatagggccatcgttactgccgatcatgtggcaactctatccggacggtaggtacaggtcctcagattcctcattttggcgcttggtataccacattaaaatagatggtgttgaggacatgcttctcgaacttctaccagacgattag

SEQ ID NO: 17592 - DNA, 345 bp, Artificial Sequence
  Description of Artificial Sequence: Synthetic coding sequence
atggcagagtgccctactctgggagaggctgtaactgatcacccggacagactgtgggcatgggagaagtttgtctatttagacgagaaacaacacgcctggctacctctaacaatcgaaatcaaagaccgactgcagttgagggtactgctgaggagagaggacgttgtgctgggacgccctatgactcctacacagatcggcccatccctcctgccgattatgtggcaattataccccgacggacgctacaggtctagcgacagtagcttctggcggctggtgtaccatattaagatcgatggcgttgaagacatgctgctggaattattgccagacgactag

SEQ ID NO: 17593 - DNA, 345 bp, Artificial Sequence
  Description of Artificial Sequence: Synthetic coding sequence
atggccgagtgtccgactctgggcgaagctgtgacagatcatcctgatcggctgtgggcttgggagaaatttgtgtacctcgatgagaagcagcacgcatggttgcctctcacgatcgaaattaaagacaggttgcagctacgggtgttgctgcggcgagaggatgtagtcttaggtcgcccgatgactcctacacagatcggtccctcactgctgccaataatgtggcagttgtatcctgacggcaggtatcgcagcagcgactcctcattctggcggctggtttaccacattaaaattgatggagttgaggacatgcttctggaattactacccgacgattag

SEQ ID NO: 17594 - DNA, 345 bp, Artificial Sequence
  Description of Artificial Sequence: Synthetic coding sequence
atggctgaatgcccaacactgggtgaggcggtcacagaccatcctgatcggctgtgggcctgggagaaatttgtctatcttgatgaaaagcaacatgcgtggctgcctctgaccatcgaaataaaggacagactgcagctgagggtcttgctgcgaagggaagatgtcgtgttgggacggcctatgaccccaacacagatcgggcccagcctgctgcctattatgtggcagctgtatccagacggccggtacaggagtagcgacagtagcttctggcggctggtgtaccacatcaagatagatggagttgaagatatgttactggagttgctgccagacgactag

SEQ ID NO: 17595 - DNA, 1407 bp, Artificial Sequence
  Description of Artificial Sequence: Synthetic coding sequence
atggattctctggcgagtttggtgctatgtggcgtgagtcttctgctgagtgggacggttgagggcgcaatggacctcatcctcataaatagcttgcctttggtctccgatgcagagacatccctgacttgcatcgcgagcgggtggcgtccacatgaaccaataacaattggcagagactttgaggccctgatgaaccagcaccaggaccctctcgaggtgacacaggacgtcactcgcgaatgggctaaaaaggtggtctggaagcgagaaaaagcttccaagataaatggcgcatatttttgcgaggggagagtccgaggagaggcaattaggattagaaccatgaagatgaggcagcaagcttcgttcctgcctgcaaccctgacaatgactgtggataaaggagataacgtgaatatatcattcaagaaggtgctgataaaggaggaagacgccgtgatttacaagaatggctcctttatccatagcgtcccccggcacgaagtgcccgacatcctagaggtgcacctgcctcatgctcagcctcaggacgctggcgtgtactccgctcgatatatcggaggaaacctgtttacgtcagcgttcacacgtcttatagtgcgcaggtgcgaagcacagaaatgggggccagaatgcaatcacctctgcactgcctgcatgaataacggagtctgccacgaggataccggcgagtgtatctgtcccccaggcttcatggggcgcacctgtgagaaagcttgcgagctccatactttcgggcggacttgcaaagagcgttgtagcggccaggagggctgtaaatcctatgtcttctgcctaccggacccctatgggtgttcttgtgctacaggttggaaaggtctgcagtgcaacgagggaattcagagaatgactccgaagattgtagacctgcctgaccatatcgaagttaacagcggtaaatttaaccctatatgcaaggcatctgggtggcccttgcccacgaacgaagagatgacactggttaaaccagacgggaccgtattacatcccaaggattttaaccacacggaccactttagtgtcgcaatttttacgattcacaggatcctgcctcccgatagtggagtctgggtttgctccgtgaatactgtggctggaatggtcgagaagccctttaatattagcgtgaaagtgctgcctaaaccacttaacgctcctaacgtgatcgatacgggccataactttgccgtgattaatatttccagtgagccctactttggggacgggccgataaaatccaaaaaactgctgtacaaacctgttaaccactacgaagcatggcagcatatccaggtgtccatggaaaaacagcgtctgactaaagcaaactccgatatttag

SEQ ID NO: 17596 - DNA, 3375 bp, Artificial Sequence
  Description of Artificial Sequence: Synthetic coding sequence
atggactcactcgcctccctcgtgctgtgcggcgtttctctcctcctgtctggtacggtcgaaggggcaatggaccttattcttatcaactccttgccgctcgtgagtgatgccgaaaccagcctcacctgtatcgcatcagggtggagaccccatgaacctatcactataggcagggattttgaggccttgatgaatcagcaccaggaccctttggaggtgactcaggacgtcactcgagaatgggcgaagaaagtcgtgtggaaacgcgagaaagccagtaaaatcaacggggcatatttctgcgagggtagagtgcgtggcgaggcaatccggatacggacgatgaaaatgcggcaacaagcatcttttctccccgctacgttgacaatgacagttgataagggcgataacgtaaacatttccttcaaaaaggtgttgattaaagaagaggacgcggtgatttataagaatgggtcattcattcactctgtacctagacatgaggtccctgacatcctggaagtgcacttaccccatgcacaacctcaggacgcaggggtgtattccgcaaggtatataggagggaatctgttcacgtctgcgttcaccagacttatcgtgcgcagatgcgaagcccagaaatggggcccggaatgcaaccacctgtgtaccgcttgtatgaacaacggtgtgtgccacgaagatactggcgagtgtatctgcccccccggctttatggggcgtacatgcgagaaggcctgtgaattgcacacctttggtcggacttgtaaggaacgatgctcaggtcaggaggggtgcaaatcgtatgttttttgcttacctgatccatacggttgctcatgcgcgacaggctggaaaggcctgcaatgcaacgaggcctgccatcccggtttttatggccctgattgcaaactgagatgttcttgtaacaatggagagatgtgtgaccgctttcaggggtgcctgtgcagccccggatggcagggattgcagtgtgagcgggaaggcattcagagaatgacaccaaaaattgtggacctgccagatcacatcgaggtaaattctggcaaatttaatcctatatgcaaagctagtggttggccgctacccacaaacgaggagatgacactggtgaaacccgacggaaccgtgctgcatcccaaggactttaaccacaccgaccacttctccgttgctattttcacaatccaccgtattctgcctcctgatagtggagtttgggtatgctccgtcaacacagtcgctggaatggtggagaagccattcaacatcagtgtgaaggtactccctaaacctctgaatgccccaaacgtgattgacacagggcacaacttcgcagtaataaacatatccagcgagccctactttggggacggcccgattaagagcaagaaactactttacaagcctgtgaaccactacgaggcctggcaacacatccaggtgacaaacgagatcgtgaccctgaattacctagagccgagaacggaatatgagctgtgcgtgcagctcgtccgcaggggggagggtggtgagggacacccagggccagtgagaagatttacgactgcctctattggacttccccctccgagaggccttaacttgctcccaaaaagtcagacgaccttaaatctgacatggcagcctattttccccagttctgaagacgatttttatgtggaggtggaacgccgcagcgtgcagaaatccgatcaacaaaacatcaaagtgccaggcaacctgacgtcggtgctgctgaacaatctccacccgcgggagcaatatgttgtcagagcgagagtcaatacaaaggcgcaaggcgaatggtccgaggatcttactgcgtggacgctgtccgatatcttgccgccccaaccagagaatattaagatctccaacataacccattcaagcgctgtcatctcttggacaattttggatgggtatagcatatcttctattacaatacgatacaaagtacagggcaagaatgaagatcagcacgtagatgtgaagatcaaaaacgcgacaattactcagtatcagctcaaaggactggagccggagacagcctaccaggtcgacattttcgcggagaataatatcgggtcctctaacccggcattcagtcacgagctcgtgacgctgcctgaatctcaagcaccagctgacttgggcgggggcaaaatgctgcttatagcgatcttgggtagcgctggtatgacttgtctgaccgtcctcctagcctttctaattatcctacaactaaaaagggctaacgtgcaaagacgtatggcgcaggccttccagaatgttagagaggaaccggccgtgcaatttaactcggggaccctggctctgaatcgaaaggtcaagaataatccagaccctacaatctatccagttctggactggaatgatatcaagtttcaagacgtgatcggagaaggaaacttcggccaggtgctcaaagccagaatcaagaaagacgggctgcggatggatgctgccattaaacgaatgaaagaatacgccagtaaagatgatcatagagacttcgcaggagagctcgaagtcctgtgcaagctagggcatcaccccaacattataaacctgctgggcgcctgcgagcataggggctatctatatctcgccatcgagtatgccccacacggcaaccttctggatttcttgcggaaaagtagggttctggaaactgatcctgcttttgccattgctaatagtactgcatcgaccctgagctctcaacaattattacactttgccgccgacgttgctagaggtatggactacctaagtcaaaagcagttcattcaccgtgacctcgctgcccggaacatacttgtaggagagaactacgtggccaagatagctgactttggcctgtcacgtggacaggaggtgtatgtcaagaagaccatggggcgtctgccagtacgatggatggcaatcgagtctctgaactattctgtctatactacgaacagcgatgtttggtcgtacggggtgttgctatgggagatcgttagtctggggggtactccctactgcggtatgacatgcgcggaactgtacgagaaacttccgcagggctacagattggagaagccccttaactgtgacgacgaggtgtacgatcttatgcgccaatgttggcgcgaaaaaccatacgagcggccctcatttgcccagatactcgtcagtcttaaccgcatgctcgaggaacgaaagacctatgttaatacaaccctgtacgaaaagtttacatatgccggcatcgactgctctgccgaagaagcagcctag

SEQ ID NO: 17597 - DNA, 3246 bp, Artificial Sequence
  Description of Artificial Sequence: Synthetic coding sequence
atggatagccttgcttcactggtcctgtgcggagtctcccttctcttaagtgggactgtggaaggcgcgatggatctgatcctgattaactccttgccactcgtgtccgacgccgaaacgagtcttacctgcatcgctagcgggtggcggcctcacgagcctatcaccataggccgtgacttcgaggctctcatgaatcagcaccaggatcccctggaggtaactcaagacgtcaccagggaatgggcaaagaaggtggtttggaaaagagaaaaggcctccaaaattaacggcgcctatttctgtgaggggcgggtgcgcggggaggctattcgaattagaaccatgaagatgagacaacaggcaagctttctgcctgcaaccctgactatgactgtagacaagggcgacaatgtgaacatatcatttaagaaagttctgattaaagaggaggatgccgttatctataaaaatggctctttcatacattccgtgcctcgacatgaggtccccgatattctggaggttcacttgccgcatgctcagccacaggacgctggagtttatagtgcccggtacattggtggcaacctattcacctcagcatttaccagattaattgttcgacgctgtgaggctcagaagtggggaccggagtgcaatcacctgtgtactgcgtgtatgaataatggagtctgccacgaggatacaggcgagtgtatctgtcccccaggcttcatgggcagaacatgcgagaaggcgtgtgaactgcacacatttggccggacctgcaaggagcggtgttcaggacaggaagggtgtaagtcctacgtgttctgcctgccagacccgtacggatgctcctgcgcaacagggtggaagggcctccagtgtaatgaaggaatccagagaatgactcctaaaatcgttgacctgcctgaccacatcgaggtcaattctggaaagttcaaccctatatgcaaggctagcggctggccattgccaacaaacgaagaaatgacactggtcaaacctgatggcaccgtcctgcaccctaaagacttcaatcacactgatcatttctccgttgccatcttcacaattcacaggatcctcccccccgattccggagtttgggtatgtagcgtgaacaccgtggccggcatggttgaaaaaccgttcaacatatctgtcaaagtgttaccaaaacctctgaacgcaccaaacgtgatagatacagggcataattttgctgtgattaacatctcttccgagccgtatttcggggatggacctattaaaagcaaaaagttgctgtacaagccagttaaccattatgaggcttggcagcatatccaggtgactaatgagattgtaacgctgaactacctggaaccaagaacagaatatgagttatgcgtgcaactggtcaggagaggcgaaggcggcgaggggcaccccgggcctgtgcgaagatttaccacagcatctattggtctcccgccaccacgaggattgaacctgctcccgaagtcgcagaccactctaaacttgacctggcaacccattttcccatcttcagaggatgatttttacgtcgaagtcgaacgaagatctgtgcagaaatccgaccagcagaacattaaagtgcctggaaatttaaccagcgtgttacttaacaacttgcaccctagagagcagtacgtggtgcgggcacgcgtgaacactaaggcccagggagagtggagtgaagacttgacagcatggaccctaagcgacatcctgcctcctcagcccgaaaacattaagatctccaatataacacacagttctgccgtgatttcctggactatactggacggatatagtatatccagcatcacaatccggtacaaggtgcagggaaaaaatgaagaccagcacgtggatgttaaaatcaagaacgcgactatcactcagtatcaactgaagggtctggaacccgagacagcttaccaagtcgacatcttcgccgaaaataatataggctccagcaatccggccttcagccatgagctcgtcaccctccccgagtcccaggcccccgcagatttgggtggagggaaaatgctcttgatagccattctgggatccgcgggcatgacctgtctgactgtccttctggcattcctaatcattctgcagttaaagagagcaaatgttcaacgacggatggcacaggccttccagaatgtgagagaagagcccgccgtgcagttcaattccggcacattggcactcaacaggaaggtaaagaataacccggatccaacgatctatcctgtgctggattggaacgacataaaattccaggacgtcatcggcgaaggcaacttcggccaggtgctcaaggcccgtatcaagaaagatgggcttcgcatggacgctgccatcaaaaggatgaaagagtatgctagcaaggatgaccaccgggacttcgctggggaactggaggtgctgtgcaaactgggtcatcacccaaatatcattaacctgctcggcgcttgcgaacatagaggctatctgtacctggccatagagtatgcccctcatggaaatcttctggactttcttcgaaaatctcgggtacttgagacagatcctgcttttgccatcgccaacagtactgcttcaacattgagcagccagcagctgttgcacttcgctgccgatgtggcgcggggtatggattacttgtctcagaaacaatttatccatcgggacttagcagccaggaatatactggtaggcgaaaactacgtggcgaaaattgctgatttcggcttaagtcgcggccaagaagtgtatgtgaaaaagactatgggtcgactaccggttaggtggatggccatcgagtccttaaattatagtgtctacaccactaattcggacgtttggagctacggagttcttctttgggaaattgtgtcactgggagggacgccatattgcggaatgacctgtgccgaactgtatgagaagctaccccagggatacagactggaaaagccactgaactgtgatgatgaggtgtacgacttaatgcgccaatgctggagggaaaaaccctatgagagaccctcattcgcacagattttagtgtctcttaataggatgctggaagaaagaaaaacttacgttaacactactctgtacgaaaagttcacttacgccggaatcgattgtagtgccgaagaggccgcatag

SEQ ID NO: 17598 - DNA, 3375 bp, Artificial Sequence
  Description of Artificial Sequence: Synthetic coding sequence
atggattcacttgctagcttagtactgtgtggtgtgagtctgctgctttctgggaccgtggagggggctatggacttgatccttattaactcactgcctcttgtgtcagacgcagagacctccttgacttgcattgcttccggctggcgccctcatgagcctataactatcgggcgggacttcgaggcattaatgaaccagcaccaggatcctctggaggttacacaggacgtcacacgcgaatgggccaaaaaggtggtttggaaacgcgaaaaggcaagtaaaatcaatggtgcctatttttgtgaaggacgggttagaggagaggccatcagaattcgcacgatgaaaatgcggcagcaggcctcattcctgccggccacactcacaatgacagtggataaaggggacaacgtaaacatttcattcaaaaaggtgctgattaaggaagaggatgcagtgatctataagaacggctccttcatacacagcgtgcctcggcacgaggtgcctgacatcctggaggtccacttgcctcatgcgcaaccccaggatgcaggcgtatactctgctagatacattggcggcaacctgtttacatctgctttcactaggttgattgtgaggagatgtgaagcccagaagtggggccccgaatgcaatcacctgtgtaccgcttgtatgaacaacggcgtgtgccatgaagacacgggcgaatgcatatgtcctcccggcttcatggggcggacgtgcgaaaaagcatgtgagctgcacaccttcgggcgcacttgcaaggaacggtgcagcgggcaggaagggtgcaagagttacgtgttttgcctgcctgatccgtatggatgttcatgcgctacaggatggaaaggcctgcaatgtaacgaggcctgtcaccctgggttttacggtcccgattgcaaactgagatgctcctgtaacaacggggaaatgtgtgatagattccagggttgtctttgctctcccggatggcaggggctgcagtgtgagcgtgagggcatacagcgaatgacgccaaagatcgtcgatttgcctgaccacattgaagtaaactccggaaaatttaatccaatttgtaaggcctcagggtggcccctgcccaccaacgaagaaatgactctggtcaaaccggatggcactgtgctgcaccctaaggactttaatcacactgaccatttttccgtcgctatatttacgatccaccgaattttacctcccgacagcggcgtgtgggtgtgctctgttaacaccgtcgccggaatggtggaaaagccctttaacatttccgtgaaagtgttacccaagcctctcaacgcacctaacgtgattgacaccggccataactttgccgtgatcaacattagtagcgaaccttacttcggagacggtccaattaagtcgaagaagttgctttacaagcctgttaaccattacgaagcttggcaacacatacaggtgactaatgagatcgtcacccttaactacttagagccgagaactgagtatgagctgtgcgtgcaactggttcgacggggtgaaggtggcgaagggcatccaggccctgtccgaaggtttacaacagcctcaattgggcttcccccccctaggggcctgaacctacttccaaaaagccaaaccactctgaacttgacttggcaacccattttcccaagtagtgaagacgatttctacgtcgaggtcgagagacgcagcgtgcaaaaatccgaccaacagaatattaaggtgcccggcaacctcacttctgtactcttgaacaacctgcaccccagagaacagtacgtggtgcgggccagggttaacactaaggcacagggggaatggtctgaggacttgaccgcctggactctgtccgatattctgcccccgcagcctgagaatattaagatttccaatattacacactcttcagcggtgatcagctggaccatactggacggctatagcatctcgtcaataaccatccggtataaggtccaggggaaaaacgaggaccagcacgtcgacgtcaagatcaagaacgcaactattactcagtaccaactgaaagggttggagcccgagacagcgtatcaggtcgatatcttcgctgagaacaacattggctcctcgaaccccgctttttcccatgaactagtcacacttcctgagtctcaggctccagccgatcttggaggcggcaagatgctgctgatagccattctgggttccgcagggatgacttgtctgactgtccttttagcattcttgataatcctgcagctgaagagagctaatgtgcagagacgaatggcacaggcattccaaaacgtcagagaagaacctgccgttcagttcaattccggtaccttggcgcttaaccggaaggtcaaaaataacccagatcctactatctacccggtgttggattggaatgatatcaagttccaggacgtgattggggagggaaatttcggacaagtactcaaagctcgcattaagaaggacgggttgaggatggacgccgctattaaacgaatgaaagaatatgcatctaaggacgaccatcgagatttcgccggagagttggaagtgttgtgcaagctcggtcatcatcctaacatcatcaacctgctgggggcatgtgaacaccggggttacctgtatttggcgattgagtacgcaccacacggaaatctcttggactttttgagaaagtcacgcgtgctcgagacagatccagcctttgctatcgccaacagtaccgcgagcaccttgtcctcgcaacaactgctgcatttcgcagcggatgtcgctcggggtatggattacctatctcaaaaacaatttattcacagagatctggccgctaggaatatcctcgttggggagaattacgttgcaaagattgcggattttggactcagtcgaggtcaggaggtgtatgtgaaaaagaccatgggacgcctgccggtgcgctggatggcaatagagtctctgaactactcggtttacaccacaaactcagatgtgtggagttatggcgttctgctgtgggaaatcgttagcttgggtggaaccccttattgcgggatgacttgcgccgagctctacgaaaaactgccgcaggggtacaggctcgagaaaccactgaactgcgacgatgaggtgtacgatctgatgcgccaatgctggcgcgaaaagccgtatgagcggccctcttttgctcagatactggtgtctcttaacaggatgttagaggagaggaagacctacgttaacacaaccctatatgaaaaattcacatacgcaggaatcgactgctccgctgaggaagccgcttag

SEQ ID NO: 17599 - DNA, 2931 bp, Artificial Sequence
  Description of Artificial Sequence: Synthetic coding sequence
atggattccttagcctccctggtcctatgcggagtgtccctgttgctttctgcatcttttctaccagccacactgactatgactgttgacaagggtgacaacgtcaatataagcttcaaaaaggtgcttatcaaggaagaggatgcagttatctataaaaacggtagcttcattcacagcgtacctaggcacgaagtgcccgacattttagaggtccatctgccccatgcccagcctcaggacgccggggtttactctgctcgatacattggtggcaatctgtttacaagcgcttttaccagactgatcgtgcggcgctgtgaggctcagaagtgggggccagaatgcaaccatctctgcaccgcatgtatgaataacggcgtatgccacgaggatacgggagagtgtatttgcccgcccggctttatgggccggacctgcgaaaaggcctgcgaactgcacacattcggccggacctgcaaggagaggtgcagcggccaggaagggtgtaaatcctatgtcttttgtttgccagacccttatggatgcagttgcgcaacgggctggaaggggctacagtgcaacgagggcatccagaggatgactcccaagatagttgatctgccagaccacatcgaggtaaattctggcaaattcaatcccatttgtaaggcatccgggtggccactgcccactaacgaggagatgaccttggtgaaacccgatggcacggttttacacccaaaggacttcaatcacaccgaccacttcagcgtagctatttttacgatacatcgcatccttcccccggacagcggcgtctgggtgtgctctgtcaatacagtggccggaatggtggaaaaaccctttaacatttctgtcaaagtcttgcccaaacccctgaacgcaccaaacgtgatcgacacaggtcacaatttcgctgtgattaacatctcaagcgaaccatacttcggcgacggacccattaagtccaaaaagcttctgtataagcctgtgaatcactacgaggcatggcagcacattcaggtgacaaatgagattgtgaccctcaattatctggagccccgcacggagtacgagctttgcgtccaactggtccggcgcggcgaaggaggcgagggacatcctggacccgtgaggcgtttcactaccgccagcatcggacttccacctccgcgcggcctgaatttgctgccaaagtcccaaactacccttaatttaacttggcagcccatttttccaagtagtgaagatgatttctacgtggaagtagaacgtcgcagcgttcaaaagtcagaccagcaaaacatcaaagtgcctggaaatttgactagcgtcctgcttaacaacttgcaccctagagagcagtacgtagtgagagctcgggtgaacaccaaggcacagggtgagtggtcggaggatttaacagcgtggactctcagtgatattctgcctccacaaccagaaaatatcaagatttcaaatatcactcactcgtctgcagtgatctcttggaccatccttgacggctattccataagttcaatcactatccgctacaaagtccaggggaaaaatgaagaccagcatgtagatgtgaagattaagaacgccacaatcacccagtaccagctgaagggcctggagccagagaccgcttatcaggtagacatctttgccgagaacaatatcggtagctcaaatccagccttcagtcatgaattggtgacattaccagagagccaagccccagcggatctgggcggcggtaagatgctgctgatcgcaattttgggaagcgccgggatgacctgcttaaccgtgctcttggcctttctgatcatactgcagctcaaaagagcaaatgtccagcggaggatggcacaggctttccagaatcgggaagagcctgcagttcagtttaactcaggcactcttgcgctgaacaggaaggtcaagaacaatcccgacccaaccatttacccagtcttagattggaatgatattaaattccaggacgtcatcggtgaggggaattttggtcaagtcttgaaagccagaatcaaaaaagacgggctcagaatggatgctgctattaaaaggatgaaggaatacgcttccaaggatgatcaccgtgattttgccggcgagttagaagttctctgcaagctggggcatcaccctaatatcattaacctgttgggcgcctgcgagcatcgagggtacttgtacctggccatagagtacgcaccccacggcaatcttctagatttcttgcggaagtcccgcgtgctagagaccgaccctgcattcgccattgccaacagcaccgcctccactttatcctcccagcagctcctacacttcgccgcagatgtcgcacgaggaatggactacctcagccaaaagcaattcattcaccgggatctggccgcccggaatattctggtgggtgaaaactacgtagccaagattgccgacttcggcttgtcacgggggcaggaggtgtatgtaaaaaagactatgggccggctcccagtccgctggatggcaattgagtccctgaattactctgtatacactactaactcagacgtgtggagctacggggtgttactgtgggagatcgtgagcctcggaggtacgccttattgcggcatgacctgcgcagagctttatgagaagttgccgcaagggtaccggcttgaaaagcctctgaactgcgacgacgaggtgtacgatcttatgcgtcagtgttggcgcgagaaaccctacgagcggcccagtttcgcacaaatcttagtatcactgaataggatgctggaggagcggaaaacctatgtgaacaccaccctgtacgagaaattcacctatgctgggatagattgctctgccgaggaagccgcatag

SEQ ID NO: 17600 - DNA, 7884 bp, Artificial Sequence
  Description of Artificial Sequence: Synthetic coding sequence
atggaaaaactccacggtcacgtcagcgcccatcccgatatactgagcctagaaaatcggtgtcttgcaatgctcccagacctccagccccttgagaaactgcaccagcatgtgtctactcactccgacatcctgagtctcaaaaatcaatgcctggccacactgcctgacctcaaaacaatggagaagccgcacggctatgtctccgcccatcctgacatcttatctctggagaaccagtgtctggcaaccttaagtgatttaaagacgatggaaaaacctcatggtcatgtctctgcccaccccgacatcttgagcctagagaacagatgtctcgcaaccctctcttctctcaagagcacagttagcgccagcccattgtttcagtccctccagatttcgcacatgactcaggccgacctctaccgagtgaacaactctaactgtctgttgtcggaacccccaagctggagggcccagcacttctctaagggcctggacttgtccacatgccctatcgccctgaagtctatcagtgccacggaaaccgcccaagaggccaccctgggccgttggttcgatagcgaggagaagaagggggcggagacacagatgcccagctactcccttagcctgggtgaggaggaggaggtagaggatcttgccgtgaagcttacctccggggactctgagagtcacccagagcccacagatcacgtgttacaggaaaagaaaatggctctgctcagtctcctctgcagcaccctggtgtccgaggtcaacatgaataacactagtgaccccactctggcggctatttttgagatttgcagggaactggcccttttggagcccgaattcatcctaaaagcttccctgtatgcaagacagcagctgaacgttaggaatgtggcaaacaatatcctcgccatagctgcgtttctacctgcttgccgccctcacctgagacggtacttctgcgctatagtgcagctcccctccgactggatccaggtggctgaactttatcagtctcttgccgaaggcgataagaataaacttgtaccattgcccgcttgcctccggacagcaatgactgacaagttcgctcagtttgatgagtatcagttggcgaaatataatccaaggaaacatcgggcgaagcggcaccctcggcgcccccctaggagccccggtatggagccaccatttagccaccggtgcttcccgaggtatattggctttctccgtgaggagcaacgtaagttcgaaaaagcgggcgacaccgtctcagagaagaagaatccaccacggtttacactgaagaagctggttcaacggcttcacattcataaacccgcccagcatgtacaggcactcctcgggtatagatacccgagcaatctccagctgttttcgcgctctaggctcccaggcccttgggatagctcacgagcaggtaagcgcatgaagctctcccgccccgaaacttgggagagggagctctccctgcgtggcaacaaggcaagtgtgtgggaggaactgatagagaatgggaagctaccttttatggccatgcttagaaacctctgtaatttactgcgcgtcggtatttcgagtcggcaccacgagctcatactgcagcgactgcaacatgcaaagtctgtcatccactctagacagttccccttcagatttctaaatgcgcatgacgctatcgatgccttggaagctcaactgcgcaaccaggctctcccctttcccagcaacatcacgctgatgcgacgaattctgacacggaacgagaaaaatagaccacgtaggaggtttttgtgtcacctgagtagacaacagctgaggatggccatgcgcatccccgtgctctacgaacagctcaaacgcgagaaactgcgtgtccataaggctcggcagtggaagtatgatggagagatgctgaatagatatagacaagccttggaaaccgccgtgaacctgtccgtgaagcacagcctgcctctgctgcccgggcgaacggtgctggtatacctaacagacgccaacgccgacagactttgcccgaaatccaatcctcagggaccccctctgaactacgcattactgctaataggtatgatgataacacgtgccgagcaggtggacgtggtcctgtgtgggggagacaccctgaagaccgcagtgctcaaagccgaagaaggtatcctcaagaccgccatcaaactgcaggcccaagtgcaggagtttgacgagaatgatggttggtccctgaatacattcgggaagtaccttttaagcctcgctgggcagagggtcccagtggatagggtgatcctgttggggcaatctatggacgacggaatgatcaacgtcgccaaacagctctactggcaaagggtcaattctaagtgtcttttcgtgggtatcctcctcaggcgtgtgcagtacctttcgacagatttaaaccctaacgatgtcacactaagcggttgtacagatgccatcttaaagttcatcgctgaacacggcgcgtctcacctgttggagcatgttggtcagatggacaagatatttaaaattcctccgcctcctgggaaaactggtgtccagagcctacgtcccttggaggaggacacccctagccctttggcccctgtcagccaacagggctggcgttccatccgtctttttatttctagtacatttcgagatatgcacggtgaaagagatctcttactccgctctgtgctgccagcccttcaggctagggctgcccctcaccgtatcagtctgcatggcatcgacctcaggtggggagtgaccgaggaagagactagaaggaacagacagctcgaggtctgcctcggtgaggtcgaaaacgctcaattatttgtcggtatcctgggctcccggtacggatacatcccacccagctacaacctgcctgaccatccacatttccactgggcacaacagtacccttctggccggagtgtcactgagatggaggtcatgcagtttctgaaccggaatcaacgcctgcagcctagcgctcaggctctgatttatttcagagatagttctttcctgtctagcgtgcccgacgcctggaagagcgatttcgtctccgagagcgaggaagctgccagacgaatctctgaattaaagtcatacctatcccggcagaagggcatcacatgtaggcggtacccttgtgaatggggtggggtggccgctgggcgcccttacgtgggaggtctcgaggagtttgggcagcttgtgctgcaggacgtgtggaatatgattcagaagctgtacctgcagcctggcgccttgctggagcagccggtgtctatccctgatgacgatttggtgcaggccacctttcagcaactgcaaaagccgccctctccggcccggccaaggttgcttcaggacactgtgcaaagattgatgctccctcacgggcgtctgtcactagtaactggacagtctgggcagggcaaaaccgccttcttagcgagcttggtcagcgccctgcaggctccggatggggcgaaagttgcgagcttagtgttcttccactttagtggcgcacggcccgatcagggcctagctctgactcttttgcgccgactttgcacctatcttcggggacagttaaaggaaccaggagcactgccctccacatacagaagcctggtatgggagttgcagcagcgactcctgccaaaatcagcggaatccctacatcccgggcagacccaggtcctgatcattgatggggctgatcggctggtcgatcagaacggacagcttatttccgattggatacctaaaaaactgccgcggtgcgtgcacctcgtcctcagtgtgagtagcgatgcaggactgggggagacgctggagcaatcacaaggagcgcacgtgctggcattgggtccgcttgaggccagcgcccgcgctcgcttggtgcgtgaagagctggcactgtacggcaaacggctagaagagtctccctttaataatcaaatgcgccttttgctggttaagagggagagcgggcggcccctctacctgcgtctagtaactgaccatcttcgattatttaccctgtatgaacaggtatcagagcggctgaggaccctgcccgctaccgtgcctctgctgctgcagcacattctgagcactttggaaaaagagcacggccctgacgtactcccacaagctctaacagccctggaggtaactcgcagtgggctgacagtggatcaacttcatggagtgctgtccgtgtggcgcacactaccgaagggtactaaaagctgggaagaagctgtcgcagccggcaacagcggtgacccataccccatgggtcctttcgcctgcctagtgcagagcctgcgctccctgttaggtgaagggcccctagagagacccggcgctagactttgtctgcctgacggacctctcagaacggctgctaagcggtgctatgggaagaggcccggattggaggacaccgcccatattcttattgctgctcagctgtggaaaacttgcgacgcagacgccagcggtacattccgcagctgtcctcccgaagcgttgggagacctgccctatcatcttcttcagtccgggaacagaggcctcctgtctaagtttctgactaacctgcacgtggtggcagcccacctcgagttgggcctggtgtctcggttactggaagctcatgccctatatgcttcctccgttcctaaggaggaacagaagctgcccgaggcagacgtggctgtgtttcgcactttcctgaggcagcaagcttctatcctgtcccagtatccaagattgctgccccagcaagcagcaaatcagcctttggatagccctctttgccaccaggcctcccttctgagccgccggtggcatctccagcacacactcaggtggttgaacaagcctcggactatgaaaaatcagcagtcctccagcttgtccctggccgtgtcctcatctcccactgccgttgcctttagcaccaatggacagagggccgctgtaggcaccgcgaacgggacagtttacctgctcgatttgaggacatggcaagaagaaaaatctgtggtttccggatgcgatggaatttccgcctgtttgttcctcagtgacgatacactgttcctcacagccttcgatgggctgttagaactatgggatctgcagcacgggtgcagagttctccagacgaaggcccatcagtaccagattacaggttgctgtttgagccctgactgccgcttgctcgccaccgtgtgcctcggaggctgtctgaaattgtgggacactgttagaggccaattggcattccagcatacgtatccaaaatcattgaactgtgttgcctttcacccggaaggccaggtaattgcaactggatcatgggctgggagtattagtttctttcaggtagacggccttaaagtgacgaaggaccttggggctcctggagcatctattagaactttggccttcaacgtgcccgggggtgtggtggcagtcggcaggctggacagtatggtagagttgtgggcttggcgcgagggggcccgcttggctgcttttcctgcccatcacggcttcgttgcagccgccctgttcctgcatgctggatgccagctgctgacagccggggaggacggtaaggtgcaggtatggtctggaagcttgggtcgccccagaggacaccttgggtcactgagcctgtcacctgccttgagcgtggcattaagccccgatggtgatagggtggcggttggctaccgggccgacggaattaggatctacaagatctcctcaggaagtcaaggtgcacagggccaagccctcgacgtggcggtgtccgctctcgcttggctcagcccaaaagttctggtatcaggcgccgaggatggttccctccaggggtgggctctgaaagaatgttccttgcaatctctctggctactgtctagattccagaaaccagtcctaggattagctacgtctcaggagctgcttgctagtgccagcgaggatttcacggtccaattgtggccgcgccagcttctgactcggcctcacaaggccgaggactttccatgtggaacggagctgagggggcacgagggtccagtgtcctgctgctccttcagtacagatggaggcagtctagcaaccggaggaagagataggagcctcctgtgttgggacgtcagaacacctaagacccctgtcttgatacatagcttccccgcttgtcatcgggactgggtcacggggtgcgcatggactaaagacaatctgctcatcagctgctcatctgatggttcagtcggtctgtgggacccggagtctgggcaacggctgggccagttcctgggacaccaatccgccgtatccgccgttgctgctgtagaagaacacgtcgttagtgtcagtcgagacggcacactgaaggtttgggatcaccagggagtggagctcaccagcattccagctcactcagggcccataagccattgtgctgctgcgatggagccgagagccgccggacagccaggttcagaattgctggtggtcactgtcggcctggacggggctacgcggttgtggcaccccctcttggtgtgccaaactcacaccttgctgggtcattctggccctgtgcgggcagctgccgtttctgaaacctcaggcttaatgcttacggcatcagaggatggttctgtgaggctatggcaggtcccaaaggaagctgatgacacctgcatcccccggagctcggctgcagtcaccgccgtggcctgggctccagacggatctatggcagtgtccggaaatcaggcaggggaacttatcctatggcaagaagcgaaagcagtggccaccgctcaagcccctggtcacatcggagcactgatctggagtagcgctcatacttttttcgtgctttccgccgacgaaaaaatctctgagtggcaggtgaagctgagaaagggaagcgcaccaggaaacctgtcgctgcatctcaacaggattcttcaggaggatttgggcgtgctcaccagtttagattgggctccagacggtcattttttgatcctggcaaaagccgatcttaagctgctctgcatgaagcccggggacgcccctagcgagatctggtcctcttacacagagaatccaatgattctatctactcataaggagtacggcatttttgtgctccagccaaaggatcccggtgtcctgtccttcctgcggcagaaagagagcggggaatttgaggagcgcttgaacttcgacatcaatcttgagaacccctccaggacattgattagcataactcaggccaaaccggagtctgagtcctctttcctgtgtgccagcagcgacggaatcctgtggaatctcgccaagtgtagccctgagggagaatggacgacaggaaatatgtggcagaaaaaagctaatacgcctgagacacagacacctgggacggacccttcaacatgccgggaatctgacgcctcaatggatagcgacgctagcatggactctgagcctactcctcatttaaagacccgacagaggagaaagatacattccgggtccgtgacagctctccacgtcttacctgaactcctcgtgacagcttcaaaggatcgggacgtcaaattatgggagcggccgagcatgcagctgttggggctgtttcggtgcgaaggtagcgtctcatgtctggaaccttggctcggagccaattctacactgcaactggcagtcggtgacgtccaaggaaacgtgtacttcctgaactgggagtag

SEQ ID NO: 17601 - DNA, 7860 bp, Artificial Sequence
  Description of Artificial Sequence: Synthetic coding sequence
atggagaagctgcacggccacgtgtctgcgcatcctgatattctcagcctcgagaatcgatgtctggctatgcttccggacttacagcccctggaaaaactgcaccagcatgtgagcacccattccgacatactgtcactaaaaaatcagtgcctcgctacactgccagatttaaagactatggagaagcctcacggatatgtctcagctcacccagatatattaagcctggagaaccagtgtctggctactctatccgatctgaagacaatggaaaagccccatggccacgtttctgcacatcctgatatcttatctctggagaatcgctgcctggctactctctcttccctcaaatcaacagttagcgcgtcccccctcttccagtcccttcagattagccacatgacacaagctgacctttaccgtgtgaacaatagtaactgtttattgtctgagccccccagctggagggcacagcatttttcaaaaggtcttgacttgagcacatgtccaatagctcttaaaagtattagtgcaacagagaccgcccaagaggctacactgggaagatggttcgactctgaagaaaagaaaggggccgagacccagatgccaagctatagcttgtcactgggcgaagaagaggaagtggaagaccttgctgtgaaattaacctctggggatagtgaatcacaccctgaacccacagaccatgtgctgcaggaaaagaaaatggcgttattgtcactgctttgctccactcttgttagtgaggtgaatatgaataataccagcgatccgaccttggcagccatctttgagatatgccgggagctcgctctgctcgaacccgagtttatcctgaaggcctcactgtacgcccggcagcagctaaatgttagaaacgtggccaataatatcctggccatagccgccttcctgccagcctgtcggccgcacctgcggcggtacttttgcgcgatcgtccagcttccctccgactggatccaggtggcggaactgtaccaatctttggccgaaggggacaagaacaagctggtgcccctgcccgcctgtctgcgaaccgcaatgacagacaaatttgcccagtttgacgagtatcagctggccaagtacaaccctcgaaagcacagggcaaagcggcatcccaggcgcccgcctcggagccccgggatggagcccccctttagccaccgatgttttccccgatatattggctttctgcgtgaagagcagaggaaatttgagaaggcaggggacacagtgtcagagaaaaagaacccacctcggttcaccctgaaaaaactggtccagagattgcatatccataagccagcgcagcatgtgcaggccctactgggatatcggtaccccagcaacctgcagctgtttagccgcagcagactgcctggcccttgggactctagcagagccggtaaaagaatgaagctttccagacccgaaacttgggaaagagaactgtctttgcgcggcaacaaagccagcgtgtgggaagagctgatcgagaatggcaaactgcctttcatggcaatgctgagaaacctgtgcaacttactccgagttggcatttcctcacgacaccacgagctgattctccagagactgcagcatgccaaatctgtcatccactcccgacagttcccctttcgcttcctgaatgcacacgatgccatagacgcattggaagcacagttaagaaaccaggcgttgcccttcccgtctaacatcaccttaatgaggcgcattttgaccaggaacgagaagaaccgcccaaggagacgcttcttatgtcacctctctcggcagcagctgcggatggccatgcggatccccgttttgtatgagcagctgaaacgcgaaaaacttcgcgttcataaagctcggcagtggaaatatgatggagaaatgctaaataggtacagacaagccctggagacagctgtcaatctgtcagtgaagcactccctccccttgctgcccggtcggactgtgctggtgtacctaacagacgccaacgcagatcggctgtgccccaagtctaatccacagggaccccccctaaattatgctctccttctaattgggatgatgatcaccagggccgagcaggtagacgtcgtgctgtgtggcggcgatactttgaaaactgccgtgctgaaagctgaggaagggatccttaagacagccattaagcttcaggcacaggtccaggaatttgatgagaacgatgggtggtcgcttaacacatttggcaagtacctgctgagcctcgctggacagcgggtgccagttgatcgggtgatccttttggggcaaagcatggatgacggaatgatcaatgttgctaagcagctatactggcaacgtgtgaattcaaaatgtctgtttgtgggcattttgttgcgcagagtccagtatcttagtacagatctgaacccaaatgatgtgaccctgtctggatgtacagatgctatacttaagtttatcgctgagcatggggcttcccacctgctcgaacacgtcggacagatggataagatcttcaagatcccacccccccctggcaaaactggagtgcagtccttgcggcccctagaggaagacacccccagtccccttgccccagtctcgcagcagggatggagatctatcaggctgttcatatcttcaacatttcgcgacatgcacggggagcgggacttgttgctgcgcagtgtcctgcccgctctgcaggcccgagctgcaccacaccgtataagtctacacgggattgacctgcggtggggcgttacagaggaggaaacacgcagaaaccgccagttagaagtttgtctaggagaggtggagaacgcacagctgtttgttggaatcctcggctctcgatatgggtatatccccccttcttacaatcttcctgatcacccgcactttcactgggcccaacaatacccaagtggccggtcagtgaccgagatggaagtgatgcagttcttgaaccgcaaccaaagactgcagcccagcgctcaggccctgatctacttccgggatagtagcttcctcagctccgtgccagatgcttggaagtctgacttcgtgtctgaaagtgaagaagctgcgcgcaggatcagtgaattaaagtcatatctgtcccggcagaagggaattacctgtcgacgctacccttgtgaatggggtggagtcgcagccggacgcccctacgtgggcgggctagaggagtttggacaactcgtgctgcaggatgtatggaatatgatccaaaaattgtacttacagccaggagccctgctggaacagccggtctctattccggatgacgatctggtgcaggcgactttccagcagctccagaagccccccagccccgcccgccctcggcttctacaggataccgtgcagagacttatgctacctcacggcagactttctttggtcacaggtcaatcaggccagggcaaaactgccttccttgcgtcactggtttctgccttgcaagcaccggacggagccaaagtcgcctccctggtgtttttccatttctcaggagctaggcccgatcagggactggccttgacactgcttcggaggctttgcacttacctgaggggccagctaaaagaaccaggcgcacttccttccacgtaccgaagcctggtatgggagcttcaacagcgcctactccctaaaagcgctgaaagtctgcacccagggcagacgcaggtgttaattatcgacggcgccgatcgcctcgtagatcaaaatggccagctcatctccgactggattccaaagaagctgccccggtgtgtgcacctggtgctgtcagtgtcctcagatgctgggttgggagagaccctggaacaaagccagggcgcgcacgtgctggccttaggacctctagaggcatcggcccgggcccgactggttcgagaagagctagccctctatgggaaaagactcgaagagtccccatttaacaatcagatgcgcctgcttctggtcaagagggaaagcgggaggccgctctatctgcgcctggtgactgatcacctgcgcttatttacactgtatgagcaggtgagtgagagactcagaacactcccagctacagttcctctcctgcttcagcatattctgtccacactggaaaaagagcacgggccagatgtgctgcctcaggctctcacagcgctcgaggttactagaagcggtctcacagtcgaccagttgcacggtgtgctgtcagtatggagaacattgcctaaggggaccaagtcatgggaagaagcagtggcagctggaaattccggcgatccatatccaatggggccctttgcctgtttagtgcagtctttgaggagcctactgggggaggggccccttgaaaggccaggcgccagattatgcctgcccgacggaccactgcgcacagctgcaaagaggtgctatggcaagaggcctggcttagaagacaccgcacatatcttgatagccgcgcagctgtggaagacttgtgacgctgatgcgagtggaacttttaggtcatgcccgcctgaagctctcggcgacttgccataccacctgcttcagagcggaaacagggggttactgtcaaaatttttgactaacttacacgtggtcgccgctcatttggagctaggcttggtctcacggcttttagaggcgcatgccctttacgcctcttccgtcccaaaggaggaacagaagttacctgaggccgacgtggccgttttcaggacatttttacgacagcaggcaagcattctgtctcaatatcccagattgctgcctcaacaagctgcgaatcaacccctggactctcctttgtgtcatcaggcatcactcctgtcacggcggtggcatctgcagcacaccctacgctggctaaataagccacgcactatgaagaaccaacagtccagttcactgagtctggcagtgtcgtcgagccccactgccgttgctttctcgacaaatggccagagggcagcggtgggcacagccaacggaacagtttatctgctggacctaaggacttggcaggaggagaagtcagtagtgagcggttgtgatggcatcagcgcttgcctgttcctgtctgacgacacattattcctgactgcctttgacggcctgttggagctgtgggatttacaacacggctgtcgcgtgctgcagaccaaggcacaccagtatcagatcactggctgttgtctctcccctgactgccgcctgcttgccacagtttgtttgggcggatgtcttaagctctgggacacagttaggggacagctggcattccagcacacctaccctaaatcccttaactgcgtggcctttcaccccgaggggcaggtgatcgctaccggatcgtgggctggaagtatctcattctttcaagtcgatggcttgaaggttacaaaagaccttggagccccaggtgccagcatccggacattggcattcaatgtgcccggaggcgtggtcgccgtgggtcgtcttgattctatggtggagctctgggcatggagagagggagctaggctggcggcatttcccgcccaccacggcttcgtagcggccgctttgttcctacacgccggctgtcagctactgacagccggggaagacggcaaggtgcaggtgtggagcggttcactgggccgcccccgagggcatctgggctcattgagtctctcccccgcgctgagtgtcgctctctcaccagacggagatagggttgcagttggttatcgcgctgacggtatccgcatctacaaaatatcaagcggcagccagggtgcccagggacaggctctcgatgtcgctgtctccgccctcgcctggctgtcccccaaagtcctggtgtcgggcgcagaggacggaagcctacaggggtgggcgctcaaggaatgctcacttcagtcactctggctgctgtcacgttttcagaaaccagtgctgggcctagccacttcccaggaattattagcgtcagcatccgaagactttactgttcagctgtggccacgccagctgctgacccgaccccataaggctgaggatttcccctgcggaactgagttgcgtggtcacgagggcccagtttcgtgttgtagcttttcaactgacggagggagtttagccacaggcggcagagatagaagtctcctttgttgggacgtgcggacgcctaaaacccctgttctcatccatagctttccagcatgccaccgagattgggtcaccggttgtgcctggacaaaggataacctgctgatctcttgctcctctgatggaagcgtaggcttgtgggatccagagagcggtcagagactcggacagttcttgggacaccagtctgctgtgtcagctgtggcagccgtggaagagcatgttgtgtcagtgagccgcgacggtaccctcaaggtatgggaccaccagggggtggaactgacttctataccagcccactccggaccaatctcccactgcgccgccgcgatggagccgcgggccgccgggcagcctggcagcgagctgctggttgtgactgtgggcttggatggagccaccaggctgtggcatcctctactggtgtgccaaacccatactctcctgggtcacagtggaccggtgcgtgccgccgcagtcagcgagaccagcggactcatgctcacggcttccgaagatgggtcggtcagactgtggcaggtgcccaaggaagctgacgacacctgcataccgcgcagttccgcggccgtcaccgccgtggcctgggcccctgacggcagtatggcagtgagcggcaaccaggccggagagctgatcctctggcaggaagcaaaagccgtagcaacggcccaagcccctggccacataggagccctgatctggtcctccgctcatacattctttgtcctttccgccgatgagaaaatttccgagtggcaggtgaaacttcgcaagggaagcgctccggggaatctgtctctgcacctgaatcggatactccaggaggatttaggcgtactgacgtcattggattgggcaccagatggacatttcttgatcctggccaaggccgatcttaagttgctgtgcatgaagccaggggatgcaccgagtgaaatctggagcagctatactgagaaccctatgattttgtcgacccataaggaatatggcatattcgtgttacagccgaaggatccgggcgttctcagctttttacggcagaaagagtccggcgagtttgaggagagacttaatttcgacataaatctagaaaatccttcccgtaccttgatttctattacacaggccaagcctgagtcagctctgatgggctcttacggaacctggccgaatgccgcccagaaagagaatggaccacaggtgacctgcgggagaaagaaaaacacacccgagacacagacaccaggcacagacccctctacttgccgtgagtcagacgcgtcaatggactccgatgcatctatggacagtgagccgaccccccatctcaaaacaagacagcggcgcaaaattcatagtggctctgttaccgccttacacgtgttacctgagcttctcgtgacagcctcaaaagaccgggatgtgaagctgtgggagagaccatccatgcagctcctgggtttattccgttgtgagggctccgtctcttgtttggaaccttggctgggggcaaatagcacactccagcttgccgtgggggacgtgcaggggaatgtgtatttccttaattgggaatag

SEQ ID NO: 17602 - DNA, 2031 bp, Artificial Sequence
  Description of Artificial Sequence: Synthetic coding sequence
atgaagaaccagcagtcttcctctctttccctggcggtctcaagctctccaaccgcggtggcatttagcaccaacggccaaagggccgctgtgggtaccgcaaatggcaccgtgtaccttctagatctcagaacatggcaggaagagaagtcagtcgtttccgggtgtgacggcatcagcgcctgcctatttctcagcgatgataccctctttcttaccgccttcgatggcctcctggagttgtgggatctacaacacggctgtagagtactccaaaccaaagctcaccaataccaaatcacaggctgttgtctgtcacctgattgccgtctcctcgctaccgtgtgcctgggagggtgtctgaaactgtgggacactgtccgaggccaactcgcctttcagcacacctaccccaagagcctgaattgcgtggcattccatccagaaggtcaggttatagcaaccggcagttgggctggatccattagcttcttccaagtggacggactcaaggtgacaaaggatctcggcgcacccggtgcatctatacgtacattagctttcaacgtgccagggggggtagtggcagtcggtaggctggattctatggtggagctttgggcttggcgggaaggggctagactggccgccttccctgcccaccacgggttcgtcgccgccgccttattcctgcatgctggctgtcaattgctcaccgctggagaggacgggaaggtacaggtttggtcaggcagtctgggccgaccaagaggacacctgggtagcttgagcctctcacccgctctctctgtcgcccttagtcccgacggcgacagagtggccgtgggatatcgcgcggatggcataagaatctacaaaatttccagtggtagtcagggggcccaggggcaggcactggacgttgcggtgtctgccctggcctggctgtctcctaaggtactggtgtcgggagctgaggatggatcattacagggctgggcactgaaagagtgctctttgcaatcattatggctactttctaggttccaaaaacccgtccttggtctggccaccagccaggagttgctcgctagcgcctccgaggattttaccgtacagttgtggcctcggcaacttttaacacggccccataaagccgaagattttccctgtggtactgagttgagaggccacgagggaccagtgtcctgttgctctttcagtactgatgggggatctctcgcaacaggaggccgggatcggagtctgctgtgctgggacgtgagaacccccaaaacgccagtgctgattcattcattccccgcatgtcaccgcgattgggtgactggttgcgcatggaccaaagataacttgctgatcagttgttcctcagacggatcggttggactctgggacccagagtccgggcagcgcctcggtcagttcctcggacatcagagcgcagtgtctgcagtcgccgccgtggaagaacacgtcgtgagcgtttcccgggatggaaccctgaaggtgtgggaccatcagggcgttgagttgactagtattcccgcacactctgggcctatcagccactgtgccgctgcaatggagccccgcgcggccggccagccgggaagtgagctgctcgtggtaactgtgggcttagacggggcaacccgcctttggcaccctctgttggtttgtcaaacgcatacactcctagggcactccgggccagtccgcgccgctgccgtgtctgaaacatccggattaatgctgaccgcttctgaagacggtagcgtccggctgtggcaagtccctaaggaagctgacgacacctgtatccccagatctagcgcggcagtcaccgcggtggcatgggctccagacggcagcatggccgtttctggtaaccaagccggcgagctcatactctggcaagaagcaaaagccgtcgctacggcccagagttctcccgagcccaattcgacgggaggcttacgcggagctgacaaatccggtctggggtcgtag

SEQ ID NO: 17603 - DNA, 501 bp, Artificial Sequence
  Description of Artificial Sequence: Synthetic coding sequence
atggagaagttacacggacacgtgagtgctcaccctgatattttgagcctggagaacagatgcctcgcaatgcttcctgacctccagcctctggaaaaattacaccagcacgtgagcacccactcggacatccttagcctcaaaaaccagtgcttggccactctgccagatttgaaaactatggaaaaacctcatggatacgtttctgcccacccggacatccttagcctggaaaatcagtgcctggcaaccctctcggacttgaaaactatggagaagcctcacggacatgtttccgctcaccctgatatcctctccctggagaaccggtgtctggccactctgtcatccctcaagtctaccgtgagcgccagccccctgtttcagagcctgcagattagccacatgacacaggcagacctttaccgggtgaataactccaactgtctgctaagcgaaccgccgtcatggagagctcagcacttcagcaaaggtctctag

SEQ ID NO: 17604 - DNA, 1260 bp, Artificial Sequence
  Description of Artificial Sequence: Synthetic coding sequence
atggctgaggatgtgagttcagctgctccgagcccccgcggttgtgccgatggcagggacgccgaccctaccgaagagcagatggccgaaacagagagaaacgatgaagagcagtttgaatgtcaagaattactggaatgtcaggttcaggtgggagcccctgaggaggaagaagaggaggaggaggatgccgggcttgtagctgaagctgaagccgtggccgccggctggatgttggactttctttgtctgagtttatgtcgcgcgttcagggacggcaggtcagaagactttcgccgaacacgtaacagcgcagaagcaatcatccatgggctgagttctctaaccgcttgccaactccgcacgatttatatttgtcaattcctaaccaggattgcggccggaaagaccctggacgcgcagtttgagaacgatgagcgcattacaccacttgagagcgcgctgatgatttggggcagtattgagaaggagcacgacaaactgcatgaggagatccagaacctgattaagattcaggccatcgctgtgtgtatggagaacggcaattttaaagaggcagaagaagtcttcgagagaatctttggcgaccctaacagtcacatgcccttcaagtctaagctcctcatgatcatcagtcaaaaagacacttttcactcttttttccaacatttctcttacaaccacatgatggagaaaataaagagttacgtgaattacgtgctgtccgagaagtccagcaccttcctgatgaaggccgccgcaaaagtagtggaatcgaaaaggacgcgaacaattacatctcaagataagccaagtggcaatgacgttgaaatggaaaccgaagcgaatctcgatacaaggaagagaagccataagaatctctttctcagcaagctgcagcacggtacacagcagcaggatctgaataaaaaggagaggcgagtgggaaccccacagtcgacgaaaaagaaaaaagagtctcgacgggcaacagagtcccggatcccggtgagcaaatctcaaccggtaactccggaaaagcatcgtgctcggaaacggcaagcgtggctctgggaggaagacaaaaaccttagatccggcgttaggaaatacggggagggaaattggtccaagatcctacttcattataagtttaacaatcggacttctgtgatgctgaaagaccgttggaggaccatgaaaaaattgaaactgatcagctcagattccgaagattag

SEQ ID NO: 17605 - DNA, 1320 bp, Artificial Sequence
  Description of Artificial Sequence: Synthetic coding sequence
atggcagaggatgtgtcgagtgcagccccctcgcctcgcggctgcgccgatggacgtgatgccgaccctacagaagagcagatggcggagactgaaagaaatgacgaagaacagttcgaatgtcaggagcttctcgaatgtcaggtgcaggtaggagccccagaggaggaagaagaggaggaagaggatgccgggcttgtcgcagaagcagaggccgtggctgccggttggatgctggattttctatgcttaagtctgtgccgcgctttccgcgacggaaggtctgaggacttccggcgcacccgcaactcggccgaagccatcatccacggcctttcctctcttacggcatgccagctgagaactatatatatttgccagttcctcacacggatagccgccgggaaaactttagatgctcagtttgaaaacgatgaaaggatcacaccgttagagagtgccctgatgatttggggttctatcgagaaggagcacgataagctacacgaggaaatccaaaacctaatcaaaatccaggcaattgctgtgtgcatggagaacgggaacttcaaggaggccgaggaggtgtttgagaggatatttggcgaccctaattctcacatgccttttaaatcaaagctcctcatgattataagtcagaaagacacatttcattctttcttccagcacttcagttacaaccacatgatggagaagataaaatcttatgtgaactacgtgctgagtgaaaagagttcgacctttctaatgaaggccgcggccaaggtcgttgaatctaagcggactaggacaatcacctcccaggacaagccatccgggaacgacgtggagatggagaccgaggctaacctggatacgagaaagtcagtttctgacaagcagtccgccgttaccgagtcctcagagggaacggtttcccttctgagaagtcacaaaaacttgttcctctcgaagctccagcacgggactcagcagcaagacctgaacaagaaagaaagacgtgtgggaaccccgcagtctactaagaagaagaaagagtcaagacgggcaacggaaagccgaatcccagtttcgaagtcacagcccgtcacaccggagaagcatcgtgcccgcaagcggcaggcttggctctgggaggaggataagaatctcaggagtggtgttcggaagtacggagagggcaactggtccaagattctgctgcactataaatttaataatcggacatccgtgatgctaaaagatcgttggcgaaccatgaagaaactgaaattaattagttcggactctgaagattag

SEQ ID NO: 17606 - DNA, 153 bp, Artificial Sequence
  Description of Artificial Sequence: Synthetic coding sequence
atattttctattatacacggactcagctctctgacagcctgtcagttacgcactatctacatttgccaatttctgacccgaatcgcagccggaaaaacgctggacgcccagttcgagaacgacgagcgcatcacccctcttgagagcgcctag

SEQ ID NO: 17607 - DNA, 1503 bp, Artificial Sequence
  Description of Artificial Sequence: Synthetic coding sequence
atggcaggcggtggaggctcctctgacgggtcgggaagagccgccggcaggcgggcatccaggtcttcaggccgcgctcggaggggtcggcatgagcccggattgggcggccccgcggaaaggggagccggagaggctcggcttgaggaggccgtgaaccgctgggtgctgaaattctactttcacgaggccctgagagccttcaggggatctagatacggggatttcaggcaaattcgtgacataatgcaggcactgctggtcagaccattgggcaaggaacacactgtgagtaggctccttagggtcatgcagtgcctgtcgcgaattgaagaaggggagaatctcgattgtagcttcgatatggaggccgagctgaccccgctggaatcagctatcaatgtgttggagatgatcaaaaccgaatttaccctaacggaagcagtggtggagagttcacggaagctggtgaaagaagccgcagtcattatctgtattaaaaataaagaattcgaaaaggccagtaaaatcctcaagaagcacatgtctaaagacccaaccacacagaagctccggaacgacttactaaatatcatacgcgagaagaatctcgctcacccagtcatacagaacttttcatacgaaacatttcagcagaagatgctgcggttcctagagagccatcttgatgatgctgaaccttatctgcttacaatggctaagaaggctctgaagagcgagtcagccgcctcttcaaccgggaaagaagataaacagccagctcccggccctgtggaaaagccgccaagagaaccggctcgacaactgaggaatccgcccacgaccatcggaatgatgactctcaaggccgcattcaagaccctgtctggggcccaggactccgaagcagccttcgctaagctggaccagaaagacctggtattaccaacccaggccctacccgcctctcccgcattgaaaaataagagaccaagaaaagacgagaacgaatcttccgcccccgccgacggcgaaggagggtccgaattacaaccaaaaaataagagaatgacaataagcagattggtactggaagaagattctcagtcaaccgaaccaagcgctggattgaactcttcccaggaggccgcttcagcaccaccttccaaaccaacggtcttgaaccagcctctgcctggggagaagaaccccaaagtgccaaaaggaaagtggaattccagtaacggcgtcgaggagaaagagacttgggttgaggaggacgaacttttccaggtccaggcggcccctgatgaggattcaactactaacataacaaaaaaacagaagtggaccgtggaggaaagtgagtgggtcaaagctggtgtgcagaaatatggcgagggaaactgggctgccatttcaaagaattatccctttgtcaacaggactgctgtcatgatcaaagataggtggcgcaccatgaaacgcctgggaatgaactag

SEQ ID NO: 17608 - DNA, 1200 bp, Artificial Sequence
  Description of Artificial Sequence: Synthetic coding sequence
atggccgaagcaatggatctgggcaaagatccaaacggcccaactcactctagtactctctttgtcagagatgatggctcatctatgtccttctatgtgcgaccttccccagccaaacgccgcctctccaccctgattctgcacggcggcggaactgtgtgcagggtccaggaacctggggctgttctgctggcacagccgggggaggccctggccgaggcctctggcgactttatatcaacccagtacatccttgattgtgtggaaaggaatgaaaggctggagctggaggcttatagactggggccagccagcgctgccgacaccggatccgaggctaagcctggcgcactcgccgagggagccgccgagccggagccccagaggcacgcgggacgaatcgcgtttactgatgctgatgacgtggctattctaacttatgtcaaggagaatgcccggagtccctcaagcgtaactgggaatgctctatggaaagcaatggagaaatcttctttgacacagcactcatggcaaagcctgaaggataggtacctgaaacatctgcgggggcaagaacataagtatcttctcggggatgcacccgtgtccccgtcgagccaaaaattgaagcgcaaggctgaggaagaccctgaagctgcagattcgggcgagccccaaaacaaaagaacccccgacctgcccgaggaggagtacgtgaaggaggaaattcaggaaaatgaggaagcagtgaaaaagatgttggttgaggcaacgagagagttcgaggaagtagtagtggacgaatcccctccggacttcgagatacacatcaccatgtgcgatgacgacccacccacacctgaggaagacagcgaaactcagccagatgaagaagaagaggaggaggaagagaaggtgagtcagccagaggtgggggccgctatcaagatcatacggcagctgatggagaaattcaatctcgatctctccactgtgacccaagcatttttgaagaattctggggagttagaggcaaccagtgcttttctggcctcgggccagcgggctgatgggtacccaatctggtcacggcaggacgacattgatctacagaaggacgatgaagacacccgggaagctctggtcaaaaaatttggcgcccagaacgttgccaggcggattgagttccgaaaaaaatag

SEQ ID NO: 17609 - DNA, 12735 bp, Artificial Sequence
  Description of Artificial Sequence: Synthetic coding sequence
atgatgcctgcccagtatgcactcacttccagtctggtgctattagttttgctcagtactgctagggccggtccattctccagccggtctaacgtaaccctaccggctcccagaccccccccccagccgggaggacacaccgtgggcgccggcgtggggtcccctagctcacagctatacgaacacacggtagaaggtggtgagaagcaggtcgttttcactcacaggatcaacttgccgccaagcacaggatgtggctgtccccctggaacagagcctcctgtgctggcctctgaggtacaggcactccgggtgcgtctcgaaatcttagaggaacttgtgaaagggctgaaagagcagtgcaccggaggttgctgtccggcatcagcccaggctggtaccggacagaccgacgtgaggacactgtgcagcctccatggggttttcgatctctctaggtgcacctgcagttgcgaaccaggatggggcggtcccacttgcagcgaccctacagatgcggagatacctccctcctcccctcctagcgcaagcgggagttgtcccgacgactgcaacgaccagggacgatgtgtgcgcggaagatgcgtgtgttttcctgggtacactggtccttcttgtgggtggcccagttgccctggcgattgccagggaagaggtagatgcgtgcagggtgtttgcgtttgcagagccggcttcagcggcccagactgcagccagcgaagttgccctaggggctgctcacagaggggccgctgcgagggtgggagatgtgtctgcgacccggggtacacaggcgacgattgcggcatgcggtcttgtccacgagggtgctctcagcgaggacgctgtgagaacggccgctgcgtctgcaacccaggttatacaggggaggactgtggcgtgcgtagttgcccacgtggttgctctcagcgtggcagatgtaaggacgggcgatgtgtatgtgaccctggctatactggagaggattgcgggactcgttcatgcccttgggattgtggcgaaggcgggcgctgcgtggacggtcgatgtgtctgttggcccggatacactggggaggactgctccacaagaacctgtcctcgggattgtcgtggtagaggcaggtgtgaggatggtgaatgtatttgcgataccggatatagcggtgatgactgtggggtccgaagctgccccggcgattgcaaccagcgcgggcgctgcgaggacggaagatgcgtgtgttggcccggctataccggtactgattgtggcagcagggcttgcccccgggattgtagagggcgcgggagatgtgagaacggagtttgcgtctgtaatgccggatactcaggagaggactgcggggttcgatcgtgtcctggcgactgcaggggaaggggcaggtgtgaaagtgggagatgtatgtgttggcccggttacaccggacgtgactgtggcacacgcgcttgtcctggcgattgtagagggcggggtcgctgtgttgacggtcgctgcgtgtgcaatcctggcttcacgggggaggactgcgggtctcgtagatgtcctggggattgtcgcggacacggcctctgcgaggacggggtttgcgtatgcgatgccggctactcaggcgaagactgttcgacgagaagttgcccaggcggctgccgcggcaggggccagtgtctggacgggcgctgcgtttgtgaggacgggtactctggggaagactgcggggtacggcagtgcccgaatgactgtagtcagcacggcgtatgccaggacggcgtgtgcatttgctgggagggatacgtctcagaggactgttcaattagaacgtgcccatccaattgccacggtaggggaagatgcgaggaaggacgctgcctgtgtgaccctggttatactggcccaacgtgcgccacgcgcatgtgcccagcagactgcagggggaggggacgctgtgtccagggggtatgtctttgtcacgtggggtatggtggtgaagactgcggccaagaggagcctcccgcatccgcctgccccggcgggtgcggacctagagagctgtgccgggcaggtcaatgcgtgtgtgttgagggtttccgcggaccggattgtgctatccagacttgtccaggagattgccgggggcgtggcgaatgtcacgacggatcatgcgtgtgcaaggatgggtatgccggggaagattgtggtgaagaagtgccaaccatagaagggatgagaatgcacctgctcgaggaaacaactgtgcgcaccgaatggacgccggccccgggacccgtggatgcgtacgagattcagtttatacccacaactgaaggggcttcacctccatttaccgcacgagtgccaagttcagcttctgcctacgatcagcgggggttggccccaggacaggaataccaagttactgtcagagccctgcgcggcacttcctggggactcccagcctccaagacaattacgaccatgatcgatggccctcaggacttgcgagtcgtagctgtgacacctacgacactggaactgggctggctgagacctcaggctgaggtcgacagattcgttgtgtcctacgtgagcgcaggtaaccaacgggtcaggctggaggttccgccagaagccgatggaaccctgcttaccgatctgatgcctggcgtcgagtatgtggtgacagtgaccgccgagcgtggaagagctgtgagctaccccgcgtcggtgcgggccaacaccgggtcatcgcctctcggcctgcttggcactacggacgagcctcctccctccggacctagtactacccagggtgcccaggcgccactcctgcagcagaggccccaggagcttggcgagctgcgcgttctcggcagggacgagaccggacgcctgcgggtggtgtggaccgcccagcctgacacattcgcttactttcagctacggatgagggtgcccgaggggccaggcgcacatgaggaggtcctgccgggggatgtccggcaggctttagtgcccccacccccaccagggacaccttatgaactgtccctgcacggcgtgccaccagggggtaagccatccgatccgattatctatcaggggatcatggataaggacgaggaaaaacctggcaaatcctccggaccaccccgattaggcgaactgacagtgacagaccgaacatcagattcacttttactcaggtggacagtaccggaaggggagtttgactcgtttgtgattcagtacaaggaccgggatggccagcctcaggtagtacccgttgagggaccacagcgatctgctgtgatcacttcattagacccaggccggaagtataagttcgtgctttacggctttgtagggaaaaagagacatggccctctcgtagccgaagccaaaatcctgccacagagtgatccttctcctggaacgccccctcatctgggtaacctttgggtgactgaccccacccccgattctcttcacctctcctggactgttcccgaaggacaattcgatacattcatggtacagtatagggatagagatgggagaccccaggttgtcccagtggaggggcccgaaagatcattcgtggtcagctccctggaccctgatcacaaatacaggttcaccctgttcggcatcgcaaataagaaacgatacggtcctttgaccgccgacgggacgaccgccccggaaaggaaggaagaacctccaaggcccgagttcctagaacaacctctactcggagagctcacagtaactggtgtgacccccgatagcctcaggctctcctggaccgtcgctcaggggccttttgacagctttatggtacagtacaaggacgcccagggccaaccccaggccgtcccggttgctggagacgagaacgaagtgactgtcccgggcctcgaccccgacagaaagtacaaaatgaacttatatgggctacgtggtcgccagagggtgggccccgagagtgtggtggccaagaccgccccccaggaggatgtggacgaaaccccctctcccacggaactcggaactgaggcacctgagtcgccagaggaacctctgctgggcgagttgacagtcaccggcagctctccagacagtctttctctcttttggaccgtgccccagggaagcttcgacagctttaccgtacagtacaaggatagagacgggaggcccagggccgtgagggtggggggaaaggagtccgaagtgactgttggcggtctggaaccaggccataagtataagatgcacctgtacgggctgcatgagggtcagagggtggggcccgtgagcgccgtgggagtcactgcgccgcagcaagaggaaaccccgcccgccacagagagcccactcgaaccacgcttgggcgagctgacagtaacggacgtcacccctaactcagtcggactctcttggacggttcctgagggacagtttgacagttttatcgtgcaatataaagacaaagacgggcagcctcaggtggtgccagtggccgctgatcagagagaggtaaccgtgtacaacttagagcctgagcggaagtacaaaatgaatatgtatggcctgcatgatggccaacggatgggccccctgtcagttgtgatcgtgactgcccctttgccgcctgcgccagcaaccgaagcatcaaaaccccctctcgaaccccggctgggggagctgacagtcacagacataaccccagacagtgtcggcctctcctggaccgtgcccgaaggagagttcgattcctttgtggtacagtataaggatagggatggccaaccacaggtcgttcccgtggccgctgaccagcgtgaggtgacgatcccggacttggaaccatccaggaagtataagttcctgctttttggaattcaggatggaaaacgccgctcacccgtttctgtggaggctaaaacagttgccaggggcgatgcctcgcctggcgctccaccaaggctgggagagctgtgggtaaccgatcccaccccggatagcttgcggctaagctggacggttcccgaaggtcagttcgactcttttgtggtgcagttcaaggataaggacggtccccaggtggtaccggtggagggccacgagcggtctgtgacagtgacgccactcgatgccggaaggaaatatcgattcctgctgtacgggctgctgggtaagaagaggcatggccctctgactgcggatgggacaacagaggcccgatcagcgatggatgatactggaacaaaacgcccacctaagccccgtctcggggaggagcttcaggtgacaaccgttacccaaaatagtgtgggcctttcatggactgtgcctgagggccaatttgacagctttgtggtacagtataaagatagagacggccagccacaggttgtgccagtggaaggtagcctgagagaggtgagcgttccaggactggaccctgcacaccgttataagttgctgctctacgggctgcatcacggcaagagggtcggcccgatatctgcagtcgccatcaccgcgggccgagaggaaacagagaccgaaacaactgccccgacgccgccagcaccagagccgcatctgggcgagctaacagtcgaggaggccacatcgcacaccctccacctgtcttggatggtcactgaaggggagtttgactccttcgagatccaatacaccgaccgtgatggccagctgcagatggtgaggattgggggagaccgaaatgatatcaccctgtccggactggagtctgaccatcggtatctcgttaccctctatggcttcagcgacggcaagcatgtaggccccgttcatgtcgaggctcttacggttccggaagaggagaaaccatctgagcctccaaccgcaactccagaacctccaataaagcctcgcctgggtgaactaactgtcacggacgctacaccggattccctctcgctttcttggactgttccagagggacagtttgaccatttcttagtccagtaccgtaatggggatggtcagccaaaggcagttagagtcccagggcacgaagagggagtcactatctcgggcctggaaccggatcacaaatacaaaatgaatttgtatgggtttcatggggggcagagaatgggacctgtttcggtggttggggtaaccgcggctgaggaagagacgccctcccccaccgaaccatccatggaggcaccggagccggctgaggagcctcttctcggcgagctcaccgtcactggttcttcaccagattctctgtccctgagttggactgtaccccagggacggtttgacagcttcaccgttcaatataaggaccgggatggacgtcctcaggtcgtccgtgtaggcggcgaggaaagcgaggtcaccgtaggaggtttggaacccgggagaaagtacaaaatgcacctatatgggttacacgagggcagacgggttggccccgtgagcgctgtcggggtgacggcccctgaggaagagtccccagatgctccactggcgaaactcaggttggggcagatgacagtaagggatattacttccgattctttgtccctgagctggacagtgcctgagggccagttcgatcacttcctagttcagtttaagaatggagacggacagccaaaagccgtacgagtccctggccatgaagatggggttacaatttccggtctagaaccagaccacaaatacaagatgaacctttacggctttcatggcggccagcgggtcgggccagtgtctgctgtgggcttgactgctcccgggaaggatgaagagatggcgccagcctcgaccgagccccccaccccagagccacccattaagcctcgactggaagaacttactgtcaccgacgctacgccagacagtctcagcctgtcctggacggtgcccgagggacagtttgatcattttctcgttcagtacaaaaatggagacggacaaccaaaagccacccgggtgcccggacacgaagatagagtgacaatctcaggcctggagcccgataataagtacaagatgaatttatatggatttcatgggggccaacgggtggggcctgtgagtgctatcggcgtgacagccgccgaggaagagacccctagtccaaccgagccatctatggaggctcccgagcccccagaagagcccctcttgggcgagttaaccgtaactggcagcagtcccgactctcttagcctcagctggaccgtgccacaaggacgatttgactcatttacagtgcagtataaagacagagacggacgaccccaagtggtacgcgtgggcggggaggagtccgaagtcaccgtcggtggtttagagcccggccgcaagtataagatgcacctgtacggactgcacgagggacggcgggtagggcctgtatctacggtgggggtgactgctcctcaggaagacgtagacgagactccaagccccaccgagccagggaccgaggcccccgggccacccgaggagccactgctgggtgaactcaccgtgacaggtagtagtcccgacagcctgtcgttaagctggaccgtgcctcagggccgtttcgactcttttacggtacaatacaaggacagggacggtcgcccacaggccgttagggttggaggtcaggagtccaaggtgactgtgcggggattggagccggggcggaagtataagatgcacctgtatggtctgcacgaggggcgtcggctcggccccgtttcagccgtcggggttacagaggacgaagctgagactactcaggctgttcccactatgacacccgaaccccctattaagcccaggctgggagagctgaccatgacagatgccactcccgactcactgagcctgtcctggaccgtaccagaagggcagttcgatcactttctggtgcagtatcggaatggggacgggcagcctaaagctgtgcgtgtgcccgggcacgaagatggggtgacaatcagtgggctggaaccagaccacaagtataaaatgaacttatacgggttccatggaggacagagggtggggcccatttctgtgatcggcgttactgctgcggaggaggaaaccccctcacccacggaactgtccacagaagcccccgagccaccagaggagcccctgttgggggagctgacagtcactggctcttcccctgactctctatccctttcctggacaataccccagggtcactttgacagtttcactgtgcagtacaaggatagggacggccggccccaggttatgcgcgttaggggcgaggaaagcgaagttaccgttggcggcctggaacccggccgcaagtataaaatgcatctgtatgggctgcatgaggggcgacgcgtgggccctgtgtctacagtgggagtgacagcaccagaggacgaagcggaaactacccaagctgtgccaactaccacacctgaacctcccaacaaaccccgtttgggtgagttaacagttaccgacgctaccccggattccctcagtctaagttggatggtcccggagggccagtttgatcatttcctggtccaatacaggaacggggacgggcaacccaaggttgtgcgggtgccaggccatgaggacggggtcaccatctccggactagagccagatcataaatacaaaatgaacctttacggcttccatggggggcaaagagttggcccaatttccgtcattggagtcaccgccgccgaagaagagacccccgcccccacagagccaagtaccgaggcgcctgagcctccagaggaaccactcctgggggaattgaccgtgactgggagctcccctgactctctctctctgagctggaccattccccagggcagatttgattctttcaccgtacagtacaaagatcgcgatggcaggccccaggtggtgcgcgtgcggggagaagagtctgaggtaacagttggcggcctcgagccagggtgtaagtacaaaatgcatctatatggtctgcacgaaggacagcgggtcgggcccgtgtccgcagtgggcgttacagcgcccaaagatgaggccgagaccacacaggccgttccaactatgacacctgaaccccccatcaaacccagactgggtgagctcacagtaaccgatgctacacccgattctctgtccctctcctggatggtaccggaaggccaatttgatcacttcctggttcagtacaggaacggtgatggacagcctaaagcggtccgggtaccaggacacgaggatggcgtcaccatcagcggattagagcccgaccataagtataaaatgaatctatatggcttccatggcgggcagagggtggggccggttagtgcgatcggggtcactgaagaggaaaccccgagccccacggaaccctcaaccgaggctcctgaagcccctgaggagccactattgggcgaactgaccgttaccggttcaagtcccgattccctgagtcttagctggacggtgccgcagggacgcttcgactcctttacagtgcagtataaagacagagacgggcaaccacaggttgtcagagtgaggggtgaagagtccgaagtgacagtcggaggccttgagccaggacgcaagtacaaaatgcacctctacggactgcacgagggacaaagagtggggcccgtctcgacggtaggcattaccgcacccttgcccacccccctgcctgttgaacctcggctgggcgaactggctgttgctgctgtgacaagcgactctgtgggactttcctggaccgtggctcagggacctttcgacagcttcctggtgcaatatcgcgacgcgcaaggccagccgcaggccgtgcctgtctctggagatttgagggcggtcgcggtgagtgggctggacccagcaagaaagtacaagttcttactcttcggactgcaaaatggcaaacgacacggacccgtacccgtagaagctcggacagccccggacacaaaaccatcccctcgcctgggggaactcacagtcactgacgctacacctgactcggtgggcctatcttggacggtcccagagggagaattcgattcatttgtcgtccagtacaaggataaagacggccgcctgcaggtagtaccagtggctgctaatcagcgggaagtgaccgtccaaggccttgaaccatcgcggaagtatcggttcttgctgtatggcctgtctggacgcaaacgccttggtccaatctctgccgattctaccaccgcccccctggagaaagagcttccgccccatctgggggaattgactgtcgcagaggaaacttccagtagcctgaggctatcctggaccgtggcacaaggcccctttgacagcttcgtggtccagtaccgggacacagatggacagccacgggccgtgcctgtggcagcggaccaacgcaccgttacagtggaagatttggaacctggtaagaaatacaagttcttattgtacggcttgctaggaggcaagaggctcgggcccgtgtcagctctggggatgaccgcacctgaggaggacacccccgctcccgagttagccccagaggcccccgaacctcctgaggagcctaggctgggggtcttgactgttacagacacaacacccgacagcatgcgcctgagctggtctgtcgcgcagggcccattcgatagttttgtggttcagtatgaagatacaaatggacagcctcaggccctgctggtcgacggagaccaaagcaagatccttattagcggattggagccaagtaccccctatcgctttttgctatacgggctccatgagggtaagcggctggggcctctaagcgcagaggggactaccggtctggccccggctggacagacgtctgaagaatctaggcctaggctctcacagttgtctgttaccgacgtcaccacatcatctctccgcctcaattgggaagctccaccgggagctttcgactcctttctcctgcgattcggagtgccgtccccttctactttggagcctcatcctagaccattgttacagagagagctcatggtcccaggcaccagacattctgcagtgttaagggacctgaggtctggcaccctatactcactgaccttgtatgggctgaggggtccacacaaggcagactccattcaggggaccgccagaacactctccccagtgctggagagccccagagacctgcagttcagcgaaattcgggagacttcggctaaagttaattggatgccacccccgtcacgagcggattcatttaaggtcagttatcagcttgccgacgggggcgagccacagagtgtccaagtcgatggccaggccagaacccagaagcttcaaggtctcatcccaggggcccgatacgaggtcacagtggtcagcgtgagaggattcgaagagagcgaaccactgactggtttcttaacgaccgtgcccgacggcccaactcagcttcgcgccctcaatttaacagaagggttcgctgtgctgcactggaagccaccccagaatcccgtcgacacatacgatgtccaggtgacagcacccggcgcccccccgctccaagccgagacccctggaagcgccgtcgactatcctctacacgacctggtgctgcatacgaattataccgctactgtgaggggtctcaggggaccaaatctgacatctcccgcatcgattacattcactacaggcctggaggctcccagggacttagaagcaaaggaagtgaccccccgaacagcccttctcacctggacagagccacctgtgaggcccgctggttacctgctaagttttcacactccaggcgggcagaaccaggaaattctgctccccggcggcataacctcccaccaactgctggggctgttccctagcaccagttacaatgcaagactgcaagccatgtggggccagagcctgctgccaccagtgagcacttcctttaccactggggggctacgcattcccttcccaagggactgtggggaggagatgcaaaacggagcaggcgcgtctagaacaagcacgatttttctgaacggcaatcgggaacggccactgaacgtgttctgcgacatggagactgacggcggtgggtggttagtgttccaaagaaggatggacggccaaacagacttctggagggactgggaggattacgcccatggatttggtaacatttctggcgagttctggttgggcaacgaggcactgcatagcctgacccaggccggggactactccatgagggtcgatttgagagcaggcgacgaagcggtctttgcccagtatgactcattccatgtggattctgctgccgaatactaccgactccacttggagggctaccatggaaccgccggagattccatgtcataccattctggctcagtgtttagcgctcgggaccgggaccccaattctctgcttatctcatgcgcagtgtcctatcgtggcgcctggtggtaccggaactgccattatgctaacctgaacggactctatggctccaccgtcgatcaccagggtgtgtcttggtaccattggaagggattcgagtttagcgtgccattcactgagatgaagcttagacccagaaattttcgtagtcccgccggaggaggctag

SEQ ID NO: 17610 - DNA, 12729 bp, Artificial Sequence
  Description of Artificial Sequence: Synthetic coding sequence
atgatgcctgctcaatatgccttaacaagtagtcttgtgctactggtcttgttaagcactgcccgggccggacctttttcctcccgctccaacgtcactctccccgccccccggccccctccgcagccgggcgggcacacagtgggcgccggcgtcggaagtcccagcagccagctgtacgagcatactgttgaaggcggagaaaaacaggtggtgtttacacatcggattaatctgccaccatccactggctgcgggtgcccacctggcactgagcctccagtcttagcctctgaggtgcaagccctacgcgtgagattagaaatcctggaagagttggtaaaaggcttgaaggagcagtgcaccggaggctgctgtccagccagtgcacaggcagggacgggccaaacggatgtgcgaaccctgtgctcgctacacggcgtcttcgatctctctcggtgcacgtgctcctgcgagccaggctggggcgggcctacttgcagcgacccaactgacgccgagattcctccgtcaagccccccctcagcgtctggatcttgccctgacgattgcaatgaccagggcagatgcgtcagaggccggtgtgtttgtttccctgggtacaccggacccagctgcggctggccgagctgtcctggcgactgccagggacgaggcagatgcgtgcaaggggtctgtgtatgtcgcgccgggttcagcggcccagactgttcacagaggagttgcccgcggggatgctcacagagggggcgctgtgagggcggacgatgcgtttgcgaccctggctacactggagatgactgcggcatgagatcctgtcccagaggttgttcacagcgcgggaggtgcgaaaacggtagatgcgtgtgtaatccaggctatacaggagaagactgtggagttcgtagttgtccccgtggctgtagtcagaggggacgatgtaaagacggtaggtgcgtgtgcgatccggggtatacaggggaagattgcggtactcgctcatgcccatgggattgcggggaaggtggtcgctgcgtggatggcagatgtgtgtgttggccaggctatacaggagaagattgttcaacgcgtacatgcccccgagattgcagagggcggggtcggtgcgaggatggcgagtgtatctgcgacaccggatactcaggagatgactgcggagttcgctcttgccccggggattgtaaccagaggggtagatgcgaggatggccggtgcgtttgctggcctgggtacacaggtacagactgtggaagcagggcttgtccccgcgactgccgtgggcgcggtcgttgcgagaacggggtgtgcgtgtgcaacgcgggatatagcggcgaggattgcggggtaaggtcatgtcccggcgattgcagaggcagagggcggtgcgagtcgggccgctgtatgtgttggcctggctacaccggcagagattgcggcactcgagcctgcccaggggactgtaggggaagggggcgctgtgttgacgggaggtgcgtttgcaatcccggcttcactggcgaggactgcggcagtcggcggtgtcctggagactgccgcgggcacggactttgtgaggacggcgtgtgcgtctgcgatgccggctactccggggaagactgcagcacacgaagctgtccaggagggtgccgtggtcgggggcagtgtttggacggacggtgtgtttgtgaggacggatacagcggcgaggattgtggcgtgcgccagtgccccaacgactgttcccagcacggagtctgccaagatggtgtgtgcatatgctgggagggttacgtgtcagaggattgttcaatacggacatgcccaagcaactgccacggccgcggacggtgcgaggagggaaggtgcctgtgcgaccccggctacactgggcctacctgcgcaacccggatgtgccccgccgactgcagggggagaggcagatgcgtgcagggagtgtgtttatgtcacgtggggtatggaggtgaggactgcggccaggaggaaccacctgcttcagcttgtcccggaggctgtggcccaagagaattgtgccgtgcaggccagtgtgtgtgcgtcgagggattcagaggcccagactgtgccatccaaacatgcccaggggattgccgcggccggggcgagtgccatgatggaagttgcgtttgtaaggacgggtacgccggagaagattgtggcgaagaggtgcccaccatcgagggaatgagaatgcatctcctggaagagacgaccgtacgaactgagtggacccctgcccccggccccgttgacgcctacgaaattcagttcatcccaacgactgagggtgcctcccctccatttacagctcgagtccctagctcagccagcgcatacgatcagcgtggccttgccccgggccaggaatatcaggtcaccgtaagagccctgcggggtacctcatggggactcccagcatcaaagacaatcacaacaatgattgatggaccccaggacttgagagttgtggccgtaacacccacgaccctggagctgggctggctcagaccgcaggccgaggtcgataggtttgtagtcagctacgtgagtgccggaaatcaacgcgtgcggcttgaggtaccacccgaggctgacgggacgctcctcacagatctgatgcctggagttgagtacgtcgtgactgtgaccgctgaacgcggacgcgccgtctcttacccagccagtgtgcgggcgaatacagggtcatctcctctgggactcctcgggactaccgacgaacccccacccagcgggccatcaaccacgcagggcgcgcaggcccccctgctacagcagcggcctcaagagctcggagaactgcgagtgctgggccgagatgaaactgggagattaagagtggtctggacggctcagcccgataccttcgcgtatttccaactgcgcatgcgtgtccccgagggccccggggcacacgaggaagtgcttccaggcgatgttcggcaggctctcgtgcccccacccccacccggtaccccttatgaactttccctgcacggcgtgccaccaggcggtaagccgagcgatcccatcatttaccaggggattatggataaagacgaggaaaaacccggcaagtcaagcgggcctccccgcctaggagaactgacagtgaccgaccgaaccagtgactcattactcctgaggtggacagtgccggaaggagagtttgattccttcgtcatacaatacaaagaccgggacggacagcctcaagtagtccctgtcgaaggtcctcagcggtccgccgtgatcacgagtctggatcccggacgcaaatataaatttgtcctgtacggcttcgtcggtaaaaagcgacatggtcctctcgtggcggaggctaagatcctgcctcaatcggacccttcaccgggtacgccgccccacttggggaacctgtgggtgactgacccaacgcccgattctctccacctttcctggaccgtccctgaagggcaattcgacacgttcatggtccagtaccgggatcgggatgggagaccccaagtggtcccagtggagggacccgagaggtcttttgtagtctcatcactggacccagaccataagtaccgcttcactctgttcggcatcgctaataaaaagcgctacggaccgctgacagccgatggcacaaccgcacctgagaggaaagaagagccacctagacctgagtttttagagcagccactgctgggggaactgacagtcaccggtgttacccctgatagcctgcggctatcatggacagtggcacaagggcctttcgattcctttatggtgcaatacaaagacgcccagggccagcctcaggccgtacctgtggctggggacgagaacgaggtcaccgtacccggactcgaccctgaccggaagtataagatgaatctatatggcctgaggggacggcaacgtgtggggccagagtccgtcgtagctaaaacagccccacaggaggatgttgatgagacgccttcccctaccgagctcggaactgaggcgcccgagagcccagaggagccccttttaggagaactgactgtgaccggatcctcgcctgatagcctctcgctgttttggacggtgccccagggcagcttcgactcgttcaccgttcagtacaaggaccgtgatggcaggccacgcgcagtgcgggttggaggtaaggaatccgaagtcacggttggcggattggagccagggcacaagtacaagatgcacctgtacgggctccacgagggccaacgggtgggacctgtatctgcggtcggggtgactgcccctcagcaggaagagacaccgcctgctacagaaagtcctcttgaacccagactcggcgaacttacggttacagacgtcaccccaaactctgtaggtctgtcttggaccgtgcctgaaggccagttcgactcttttattgtccagtacaaggataaagacggccagccgcaggtcgtgcccgttgcggccgatcagcgggaagtcaccgtgtacaacctggagccagagcgtaagtacaagatgaatatgtacggtttgcatgatgggcagcggatgggcccactctcagtggtcattgttacagctccactgccacctgcacccgccacagaggctagcaagccacctctcgaaccacgactgggggaattaacagtcacagacataaccccggattctgtcggtttaagctggactgtgcctgagggtgagttcgattcctttgtcgttcaatataaggaccgtgacggacagccccaggtggtgcctgtcgccgcggaccaacgcgaggtgacaattccagatttggaacccagccgcaaatacaagttcctgctgttcggcatacaggacggtaagagacgaagtcccgtgtcagttgaggctaaaacagttgctcggggcgacgcctccccgggcgcaccccctcgactcggggagctgtgggttaccgacccgacgccggactctctgcgactgtcctggacggtgcctgagggacagttcgactcatttgtagtgcagtttaaggataaggatggaccccaggtggtgccagtggagggccacgaacgctccgtgaccgtgaccccccttgacgctggtcggaagtacagatttctgctgtatgggctgttaggtaagaaacgacacggaccgctcacggccgatggcacaactgaggctcgatccgccatggacgataccggaaccaagcgcccgcccaagccaagactgggagaggaacttcaggtgacaaccgtgacgcaaaattccgtgggactctcctggactgtacccgaaggacagtttgactctttcgtcgtccagtataaagacagggacggccagccgcaagtagtgcctgtggaaggctctcttagagaagtatctgtgcctgggctcgacccggcacatcgctacaaactgttgctctacggcctgcaccacggcaaacgcgtcggtcctatttcagccgtcgctataaccgccgggagagaagagaccgaaactgaaaccacagccccaaccccccccgctccagagccacacctgggagagctgaccgtcgaagaagccacatctcacacattgcatctctcatggatggtgaccgagggcgaattcgactcctttgagatccaatacacagatcgtgacgggcagctgcagatggtgagaatcggaggcgatcgaaatgacataacactgagtgggctcgaatccgaccatcggtatctagtaaccctatacggctttagcgatggcaaacacgtgggacctgtgcacgttgaggcactcactgtcccggaagaggagaaaccctctgaaccccctaccgccacccctgaaccccccatcaagccccggctgggcgagctcaccgtgaccgatgctacgccagatagtctctccctgtcatggactgtccccgaaggccagttcgaccactttcttgtgcagtatcgaaacggggatgggcagcctaaagcagtgagggtgcctggccatgaggagggtgtgacaatttctgggctggagcccgaccataagtataaaatgaacctgtacggctttcacggaggacagcggatgggacccgtctctgttgtcggagtcactgcagcagaggaagagactccctcaccgactgaaccaagtatggaagctcccgagccggcagaagagccattgctgggagagcttaccgtgactggctcgtccccagattctctttccctgtcatggaccgtgccacaaggtagattcgattcgtttaccgtgcagtataaggacagagatgggaggccacaagtcgtacgtgtgggaggtgaagagagcgaagtgactgtaggtggattggagcctggacgcaagtataagatgcatctctacgggctgcatgaagggcggcgggtaggacccgtgtccgccgtgggcgtgacggctcccgaggaggaatcgcctgacgcgcctctggccaagttgaggctgggtcagatgacagttagagatattacatcagatagcctttccttatcttggaccgttccagaaggacagttcgatcactttcttgtgcagtttaagaatggtgatggtcaacccaaagcagtccgggtgcccggacacgaagatggggttaccatctcagggctggaacccgaccacaagtataagatgaatctgtacgggttccatggcgggcagcgggtcggccctgtttcagcggttggtctgacagctccaggaaaagacgaggagatggcccctgcgagcaccgaaccacctacccctgaaccccctattaaacctcgcctggaggaactcactgtgactgacgccacccctgatagtttatctctaagctggacagttccagaggggcaattcgaccatttcctggtgcagtataaaaatggggacggccaaccaaaagcaaccagagtgccagggcacgaggacagagtaactattagtggtctggaacctgacaacaagtacaaaatgaacctttatggcttccatggaggccaaagagtgggccccgtatcggctataggagtgactgccgcggaggaggagacaccaagccccacggagccatctatggaggctcctgaacctcccgaagagcctctcctcggtgagctgaccgtgacgggatctagtccagattcactgtccctgtcatggacagtacctcagggacgatttgacagtttcactgtacagtacaaagacagggatggcaggccacaggttgttcgagttggcggggaggagagcgaggtaaccgtgggaggcctcgagcccggccgcaaatacaaaatgcatctctatggccttcacgagggcagacgtgtggggccagtatccactgtgggggtaacagcacctcaggaggacgtagacgaaacgcccagtccaaccgaaccaggcactgaggcaccgggtccgccagaagaacctctgctcggggaacttaccgtaactggcagttcaccagactccctgtcgttgtcctggaccgtccctcagggccgttttgatagctttaccgtccagtataaggatagggatgggagaccgcaggctgtgcgagtaggtggacaagaatctaaagtgacggtccgaggtctcgagccaggccgtaagtataaaatgcatctttacgggctccatgagggaagaagactgggacctgtctcagccgttggggtgaccgaagatgaagccgagacaacccaggctgtgccgacaatgacgcccgagcctcccataaagcccagacttggggaactgacaatgacagacgccactcctgattcccttagcttatcctggaccgtgccagaggggcaattcgatcacttcctcgtacagtatagaaacggagatgggcagccaaaagcagtcagggtaccagggcatgaggacggggtgactatttctggccttgaaccagatcacaagtataagatgaacctttacgggtttcacggaggccagcgcgtgggccctatctcggtcatcggcgtgacggccgcggaagaagagactccttcacctactgagctgtccactgaagcccccgagcccccagaggagcccctcctgggcgaactgaccgtgacagggtcgagccccgattctctgagtctctcttggaccatacctcagggccacttcgacagttttactgtgcaatacaaagaccgggacgggcggcctcaggtgatgagagtgaggggtgaggaatcagaagttaccgttggtggtctggagccggggcggaagtataagatgcacctgtatggcctgcacgaggggcgccgggtcggccccgtctcgactgtgggtgtcaccgaagatgaagcggaaaccacacaggctgttccgaccacaacacctgagcctcccaataagcccaggctaggggagctgaccgttaccgacgcaactcctgactccttgagcctgtcttggatggtgccagaaggacagttcgaccattttctcgtccagtacaggaatggtgatgggcaacccaaggtcgtgagagtgccaggtcatgaagacggtgttaccatctcaggtctagaacctgaccataagtataagatgaacctctacggattccatgggggccagagagtgggaccaatcagcgtgatcggcgtgactgcagccgaggaggaaactcccgcccctactgagcccagtacggaggctccagaacctcctgaggagcccctcctcggagaactcaccgtgactgggtcgtcccccgacagcctgagcttgtcttggaccattccccaggggagattcgatagctttacagttcaatataaggacagggacggccgtccgcaggtggtacgggtccgcggagaagaaagcgaggtgacagttggaggtctggagccaggttgtaagtataagatgcacctgtacgggctccatgaaggccagcgtgtgggccccgtttcagctgtcggtgttacagcccctaaagatgaagccgagacaactcaggctgttccgaccatgacccccgaaccacctattaagcctcgcttaggggaattaacagtaacggacgctacaccagattccctgtctttgtcatggatggtcccagaaggacagtttgaccatttcctggtccaataccgtaacggtgacggacaacccaaggccgtgcgcgtgcctgggcacgaggacggcgtgactatcagtggcctggagccagatcacaagtacaaaatgaacctgtacggctttcacggagggcagagggtgggacctgtgtccgccatcggagtgacagaagaggaaacaccatccccaaccgagccttccactgaagcgccagaggccccagaggagcccctgcttggcgaactcactgttactggatcctcccccgattccctctcactttcatggacagtacctcaagggcggtttgattccttcacagtgcaatataaggacagggacggtcagccccaggtcgttcgggtccgaggagaggagtcagaagtcacagtgggtggtttggagccaggcaggaagtataaaatgcacctgtacggtctccacgaaggacagcgagtgggtcccgtgtccaccgtgggtataaccgccccactccccacccctctacctgtggagcccaggcttggcgaactggccgtcgcagctgtcaccagcgactcagtcggcctgtcttggaccgtggcgcagggaccctttgattcctttctggtgcagtatcgtgacgcgcagggccagccacaggctgtgcccgtatccggagaccttcgcgctgtcgccgtgagcgggctggaccccgcacgtaagtacaagttcctgttatttggccttcaaaatgggaagcggcatggacccgtgccagtcgaagcccggaccgcccccgatacaaagcccagtcctcgactgggtgaactgactgttactgacgccacccctgactccgtgggcctctcttggacagtcccggaaggtgagttcgattcctttgtggtgcaatacaaggacaaagatggcaggctgcaggtcgtcccggttgccgccaatcagcgagaggtcacggtgcaaggactcgaaccttctagaaagtacagattcttgctctacgggctgtccgggagaaaaagactgggccctatttccgccgattctaccaccgccccactagaaaaggagctgcctccccacttaggtgagctcacggtagccgaggagacatctagctcccttcggctctcttggacagtggcccagggaccttttgattcgttcgtcgtgcaataccgagataccgatggacagcctagggcagtccccgtagcagctgatcagaggactgtgacagtcgaagacctcgagcccggaaagaaatacaaattcctcctatatggcctgcttggcggcaagcggttggggcctgtgtccgctttgggcatgactgccccggaggaggataccccagccccagaattagcacccgaggcacccgaacctcccgaggagcccaggctcggggtgttgactgtcactgatacaactccggactcgatgaggctaagctggtccgtggcacagggacccttcgattcatttgtggtgcagtatgaggacacaaatggacagccccaggccctcttggtggacggggaccagtctaaaatactcattagcgggctggagccatccaccccctatcgcttcctcttatacggtctccatgagggaaaaagactggggcccctgagcgccgaagggacaacaggcctcgcaccggctgggcagactagcgaagagagcaggccaaggctctctcagctgagcgtcaccgatgttactacttccagtctgaggttgaactgggaggcaccacccggcgcgtttgattcctttctgttgcgctttggcgtgcccagcccatctaccctcgagccccatcctcgtccccttctgcagagagaactgatggtgcccggcacccggcactcagcagtcctgcgggacctgagatccggcacactgtactctttaacactgtatgggctgagaggtcctcacaaggccgatagtatccagggcactgcccggactctgagtccagttctagaatcccctcgggatctgcagttctcagaaatcagggagacctctgccaaggtgaattggatgccccctcccagccgtgcagatagtttcaaagtttcctaccagttagcggacgggggggaaccgcaaagcgtacaggtggatggccaggctcgcacccagaaactgcagggcctaattccaggcgcccggtatgaggtaacggtcgtctccgttcgagggttcgaagaatccgagcctctaactggcttcctgaccacggtgccagacggaccaactcaacttcgcgccctgaacttaacggaagggtttgccgtactacactggaaaccaccacaaaatcctgtcgatacctacgatgttcaggtaacagcgcctggcgcgccccccctacaggccgaaactccaggcagtgccgttgattatccactgcacgatcttgtgctgcatacaaactatacagcaaccgtgaggggactccggggccccaatttaacatccccggcgagcattacctttaccactggtctggaagcgccaagagatctggaagccaaagaggtgacgccaaggacagccctcctgacttggactgagcccccagtacgtccagcaggctacctcttgtctttccacacgccgggggggcaaaaccaagaaatcttgctccccggcgggataacgagccaccagctcctcgggctgttcccttcaacttcttacaatgcaaggctacaggcaatgtggggacagtcactcctgcctccagtgtctaccagctttacaacaggagggcttcgtatcccctttccaagagactgcggcgaagagatgcaaaatggagccggagctagcagaacctcaaccattttcttgaacggaaatcgggagaggccactcaacgtattctgtgatatggaaaccgatggcggaggatggttagtatttcagagaaggatggatgggcagacggatttctggagagactgggaagactacgcccatggctttggaaacatctccggcgaattctggctgggaaacgaggccctgcacagcctgactcaagctggtgactatagtatgcgggtggacttgagagctggcgatgaagcagtgtttgcacagtatgattcctttcacgtggactcagccgctgaatactataggttacatttggagggataccatggaaccgccggggactctatgtcctatcattccggatccgtattctctgccagggatcgcgaccctaattctctactcatctcctgtgcggtttcatatagaggtgcctggtggtaccgcaattgtcattacgctaacctgaatggtctgtacgggtcgacagtcgatcaccagggagtttcttggtatcactggaaaggtttcgagttttctgttccttttaccgagatgaaattaagacctcggaattttagaagccccgccggaggtgggtag

SEQ ID NO: 17611 - DNA, 2022 bp, Artificial Sequence
  Description of Artificial Sequence: Synthetic coding sequence
atgcgactttcatggtcagtagctcagggcccgtttgactccttcgtggtccagtacgaggacaccaatggccaaccacaggccttgctcgtcgacggcgaccagagcaagattctaatcagtgggttggaaccctctaccccctatcggttcctactttacggcttgcatgagggtaaaagattgggaccattgagtgcagagggaaccacaggtctcgcgcctgctgggcagactagcgaggaatcccggcccaggttatcccaactgagtgtgacggatgtgaccaccagctctctccgtctcaactgggaggcccctcccggtgcgttcgacagcttcctgttgcggtttggggtgccttctccctctacactggaacctcacccccggccgctgttgcaacgagagctgatggtacctggtacacgccattctgccgtcctccgcgatctccgctcagggaccctttacagtctaacactgtatgggttgagagggccgcacaaagccgatagcatccagggtaccgctagaactctaagtcctgtgcttgagtcacccagggatttacagttttctgaaataagggagacaagtgccaaagtgaactggatgccaccaccctctagggcggacagctttaaggtgagttaccagctggcagacgggggggagccccaatcagtgcaggtggacggccaggcccggacccaaaaactgcaggggctgattcccggcgcaaggtacgaagtgaccgttgtttcggtcaggggtttcgaggagtcagaacccctgacggggttcttgaccaccgttcctgacgggccaacccaactgagagcactgaacctgacggaaggattcgcagtgcttcactggaagcctccccagaaccctgtcgatacatatgatgttcaggtgacggcccccggagccccgcccctgcaggcggaaactcctggcagcgccgtggattatcccctccacgatctggtgctgcacacaaattacactgccacggtgcggggactccgcggccccaacctgaccagcccagcatctatcaccttcactacgggccttgaagccccccgcgacctggaggcgaaagaggttaccccgagaaccgccctgcttacctggactgaaccaccggtgcgccccgccggctacttactctcctttcatactcccggcggacaaaatcaggaaatccttctgcccggcggcatcacaagccaccagcttttgggtttgtttcctagcacgagttataatgcgcggcttcaggccatgtggggccagtcccttctccctccagtctcaacctctttcacaacaggaggcctgaggattccatttccccgcgactgtggagaggagatgcaaaacggtgcaggcgcttctcgcacctcaactatttttctgaatggcaacagggagagaccgctcaatgtcttctgcgacatggaaactgatggcgggggatggctagtcttccaacggcgtatggatggacagacagacttctggagggactgggaggattatgcacatggttttgggaatatatctggggagttttggttaggaaatgaagctctgcacagtctgacgcaggccggagattactctatgagagtagacctgagagctggggacgaagccgtgttcgcgcaatatgacagcttccacgtcgactccgcagcagagtactacagacttcacctggaagggtaccacgggaccgcgggggactcaatgagttatcacagtgggtccgtattctctgctagagaccgcgaccctaattccttactcatctcatgtgccgtcagctacagaggtgcttggtggtaccgtaactgccactatgccaacctgaacggattatatggttcaactgttgatcatcagggcgtgtcttggtatcactggaagggcttcgaattttctgtccccttcaccgagatgaagttacggccccggaatttccggtcaccagcgggcggaggctag

SEQ ID NO: 17612 - DNA, 954 bp, Artificial Sequence
  Description of Artificial Sequence: Synthetic coding sequence
atggcaaaaaatccacccgaaaactgcgaggattgtcacatactgaacgccgaggccttcaagtccaagaagatttgtaagagtctgaagatttgtggcctcgtctttggcattttggctttgaccctaattgtgctattttgggggagtaaacatttctggccagaagtgcctaagaaggcttatgatatggaacacacgttttacagcaatggtgagaaaaaaaaaatctacatggaaatcgatcccgttaccaggacagaaatcttcaggagtgggaatgggaccgacgagactctggaagtgcacgatttcaagaacggttacacgggaatctactttgtaggtcttcagaaatgctttatcaaaacccaaataaaggtgatcccagaattctcagaacccgaggaggagattgacgagaatgaagagattacaacgaccttcttcgagcagtcagttatttgggtgccagccgagaagcctatcgagaacagggattttctgaagaattctaagatactagagatttgcgataatgtgaccatgtactggattaatcctaccctgatcagtgtgagcgagcttcaggattttgaggaggagggagaggacctacatttccccgccaacgaaaagaaaggcattgaacagaatgagcaatgggtggttccccaggtgaaggtggagaagacacggcatgcaagacaggcctccgaagaagagcttcccattaacgactacaccgaaaacggaatcgaattcgaccctatgctggatgaaagggggtattgttgcatttattgccgaagggggaatcgatactgtcggcgggtatgcgagccattgctgggttattatccatacccttattgctatcaaggagggcgggtgatttgccgggttatcatgccttgcaactggtgggtggccaggatgttaggccgcgtctag

SEQ ID NO: 17613 - DNA, 1356 bp, Artificial Sequence
  Description of Artificial Sequence: Synthetic coding sequence
atggcaacccctctggttgccggacccgccgccctgcggtttgcggccgcagcttcttggcaggtggtgaggggccggtgcgtggaacactttcctcgcgttctcgaattcctgcggtcgctgagggctgtggcgcctggcttggtgaggtatagacatcatgaacggttgtgcatggggctcaaggcaaaggtggtagtggagctcattctgcagggaagaccctgggcacaggtcttaaaggcgcttaaccaccattttccggagagcggacctattgtgcgtgaccctaaagccactaagcaggaccttcgcaagatcctggaagctcaagagacattctaccagcaggttaaacagctgtctgaggcacctgtggacctggcaagcaagctgcaggaactcgaacaagagtacggagagccgtttctggccgccatggagaagctgctcttcgagtacctctgtcaactggagaaggctctccccacacctcaagctcaacaactccaggacgtattatcctggatgcagcccggtgtgtctattaccagtagcctggcgtggcggcagtacggagtcgatatgggatggctgctgccggaatgctcagtcaccgactcagtcaaccttgctgagcctatggagcagaaccccccccagcaacaacgcctggccttacacaatcccttacccaaggccaaaccaggcacccacttgccccagggcccgagttcccgtacccatccagagcctcttgctggccgacattttaacctggcacccttggggaggcgcagagttcaatcccaatgggcttccactcgcgggggccacaaggagcgcccaacagtgatgcttttccccttcagaaacctaggctcccccactcaagtgattagcaagcccgaaagcaaggaggaacacgccatatacacagcggatcttgctatggggacaagggctgcttcaaccgggaaatctaagagtccttgtcaaactctgggtgggcgcgctctcaaggagaatccagtagaccttccagcaacagaacagaaagagaactgtctggactgctatatggaccctttgcgactgtctcttttgccacccagggctcggaagcctgtgtgtcctccgtcactgtgcagctccgtgataaccattggcgacctggttcttgattcagacgaggaggaaaatggacagggagaggggaaagaaagcctagaaaactaccagaaaacaaagtttgacacattgattcctacactttgtgagtacctgccgccatccggtcacggagctatccccgtgagctcttgtgattgtagagactccagccgcccgctgtag

SEQ ID NO: 17614 - DNA, 1065 bp, Artificial Sequence
  Description of Artificial Sequence: Synthetic coding sequence
atggctacacctctggtggctgggcccgcagctctgagattcgccgccgcagcatcctggcaggtggtgagaggccgttgtgtcgagcatttcccacgtgtcttagagttcttgaggtctcttcgggctgtggcgcccggccttgttcggtatcgacaccatgagagattatgcatggggctgaaggcaaaggtagtcgtcgaacttattttgcagggtaggccatgggcacaggttctgaaggcccttaatcatcactttccagagagcggcccaatagttcgagaccccaaggccacaaaacaagacctaaggaagatcttggaggcacaggagacgttctaccagcaggttaagcagctgagtgaggcacctgtggaccttgcttcgaagttgcaggaactggagcaggaatacggagagcccttcctggcagccatggaaaagctgctcttcgagtacttgtgccaactcgaaaaggcactgcctacaccccaggcacagcagttgcaggacgttctgtcatggatgcagcctggggtgtccatcactagctcgttagcttggaggcagtacggggtcgacatgggatggctgcttcctgagtgctccgttactgacagtgtcaatctggcagagccgatggaacagaaccccccccaacagcagcggcttgcgttacataacccattgcctaaggccaaacctggtacccatttgccacagggcccctcttcccgcacccaccccgaaccgctggctggacggcacttcaacctggcccccctgggcagaaggcgtgtacaatcacagtgggcaagcactcgggggggtcacaaagagcgcccgaccgtaatgctgtttccctttagaaacctcggctcaccaacacaggtaatctcaaagccggaaagcaaagaggaacacgcaatatataccgccgatctggctatgggcacaagagccgctagtaccgggaaatctaagagcccctgccagacgctcgggggtcgcgcactgaaggagaacccagtagatcttcctgctaccgaacaaaaagagtag

SEQ ID NO: 17615 - DNA, 423 bp, Artificial Sequence
  Description of Artificial Sequence: Synthetic coding sequence
atggaacaaaaccccccgcaacagcagagactcgcgcttcataatcccctcccgaaggcaaagccaggaactcatttgccacagggtccaagtagccgtacgcaccccgaaccactcgcaggcaggcactttaacctggcaccattgggacggcggcgcgtgcagtcccaatgggcaagcaccagggggggacacaaggagcggcccactgtaatgctctttcctttcaggaacctcggaagtccaacacaggtaatcagcaagccagagtctaaggaggagcacgctatctacacagccgacctggcaatgggtacaagggccgcatctacggggaaatctaagtccccttgccagacactcggcggacgcgccctgaaggaaaatccagttgacctacccgcaacagaacagaaggagtag

SEQ ID NO: 17616 - DNA, 1251 bp, Artificial Sequence
  Description of Artificial Sequence: Synthetic coding sequence
atggctacccccctcgtagcaggacctgctgctttgcgcttcgcagccgccgcctcttggcaagtggtccggggaaggtgtgtggagcactttccaagggttcttgaatttctacgttcgctgcgagccgtcgcccctggacttgtccgttaccgccatcatgaaagactatgcatggggctcaaggctaagaccaagcaagacttgcgaaaaattctggaggcacaggagaccttctaccaacaagtgaagcagctttctgaagcacctgtcgatcttgcctccaagctgcaggaactggaacaggagtatggagagccatttttagctgccatggagaaactcttgttcgagtacctctgccagctggaaaaagcattacccacccctcaggctcagcaacttcaggatgtgctcagctggatgcaacccggcgtgtcgataacttcaagccttgcctggagacaatacggagtggatatgggatggctcttgcctgagtgtagcgtgacggatagtgtgaaccttgccgagcctatggagcagaatccaccccagcagcagagattggcgctgcacaaccctctccctaaagccaagcccgggacacatctcccacaaggcccctcttcgaggacacatccagagccattagctggccggcattttaatctcgcccctctcggaagaaggcgcgtgcaaagccaatgggcgagcacccggggaggtcacaaggagaggccaacagtgatgctatttccttttaggaacctggggtcccctacccaggtcatctcaaaacccgaatcaaaagaggaacacgcaatttataccgcggacttggcaatggggaccagggctgccagtactgggaagagtaaatccccgtgccaaacactgggaggccgcgctctcaaggagaatcctgtggacctgcccgctactgaacagaaagaaaattgcctggactgctacatggaccctcttcggctgagtcttttgccaccgagagctcgcaagcccgtttgcccccccagcctgtgtagctcagtgatcactatcggtgacctggtgctggattccgatgaagaggagaatggccagggcgaagggaaggagtccctagaaaattatcagaagactaaattcgacactctcataccaactttgtgcgagtacctgccaccttccggtcacggagcaatcccagtgagcagctgcgattgccgggactcaagcagacccctgtag

SEQ ID NO: 17617 - DNA, 3498 bp, Artificial Sequence
  Description of Artificial Sequence: Synthetic coding sequence
atggaacaggacaggacgaatcatgtagaaggcaatcgcctgtcccctttcctcatcccctcccctcccatttgtcagacagagccactggccacaaaactgcagaacggcagcccccttccggaaagagcccatccggaggtgaacggcgacaccaagtggcactcgttcaagagctattacggcatcccctgtatgaagggttctcagaattctagagtctcgcccgacttcactcaggagtcacgcggttattcaaagtgtctccagaacggtggcattaagcgtacagtatccgagccatcactgagcgggctgcttcagattaagaaactcaaacaagaccagaaggccaacggtgagagaaggaacttcggtgtcagccaggagcgcaacccaggcgagtcctctcagcctaacgtatcagacctatctgacaagaaggagtctgtgtcttccgtggcacaggaaaacgccgtaaaagattttacatccttctcgacgcacaattgtagtggtcctgaaaatcccgaacttcagattctgaatgaacaggagggaaaaagtgccaattaccacgacaaaaatattgtgcttcttaagaacaaggctgtcttgatgccaaatggcgccactgtgtcggcatcctccgtcgagcatacccacggtgagcttctggagaaaaccctgagccaatactatcctgattgtgtgagtattgctgtccaaaagacaacgagccatatcaatgccatcaacagccaggccactaacgagttgtcctgtgagattacccacccttctcacacttcaggacagataaacagcgcccaaacaagcaactctgaactcccaccaaagccagcagcggttgtgagcgaggcctgtgacgctgacgacgctgacaacgcaagtaaactcgctgccatgctgaacacatgtagctttcagaagcccgaacaactgcaacagcagaaatctgtattcgagatatgccctagcccagccgagaacaatatccagggcaccaccaaactcgcatccggagaagagttttgctctgggtcgagcagcaacctgcaggctccgggcgggtccagtgaacgctaccttaagcagaatgaaatgaatggagcatactttaaacagagttccgtgtttacaaaagacagtttcagcgcaaccactacccctccaccaccttcccagttactactcagccctcccccaccgctgccccaggtcccacagcttcccagcgaaggaaagagtacccttaacgggggcgttctcgaggagcaccatcactaccctaaccagtccaacaccactctgttacgagaagtaaagatcgaaggaaaacctgaagcccccccaagtcaatcacctaatccatctacgcacgtgtgctcccccagcccaatgttgagcgagcgtccccagaataactgcgttaataggaacgatatccagactgccgggaccatgacagttcctctgtgttcggagaaaactaggcctatgtccgagcacttaaaacacaacccaccaatttttggctctagcggagaacttcaggacaactgccagcaactaatgaggaacaaagaacaggagatcttgaaggggcgcgataaggagcagactagggatttggttcctccgacccaacactacctcaagcccgggtggatcgagctaaaggccccgaggtttcatcaggctgagtcgcacttgaaaaggaacgaagctagcttacccagtatcctgcaataccagccaaatctcagtaaccaaatgacatcaaagcagtatactggtaacagcaatatgccaggcggcttgccacgccaggcctacacacagaagacaactcaactcgagcacaagtcacagatgtaccaggtggaaatgaatcagggccaatctcaaggaacggtggatcagcatctgcagtttcagaaaccttctcaccaagtgcacttctcaaagacggatcacctgcctaaagctcacgtgcaaagtctctgtggtacccggttccattttcagcagcgggcagactcacagactgagaagctgatgtccccagtgctcaaacaacacttgaaccaacaggcatcagagacggagcctttcagtaattctcatcttctgcagcacaagcctcacaagcaggctgcccagacacagccctcccagtctagccacctgccccaaaaccagcaacagcagcagaaactgcaaatcaaaaacaaagaagagattctgcaaacatttccacaccctcagtctaataacgaccaacagagggaagggagcttctttggccagaccaaggtagaggagtgctttcacggcgagaatcaatacagcaagagcagcgagtttgaaactcacaacgtgcagatgggcctggaagaagtacagaatataaaccggcgcaactctccatacagtcaaactatgaagtccagcgcttgtaaaatccaggtgtcatgctccaacaacacccatctggtcagcgagaataaggaacagactactcaccctgagctgttcgccggaaacaagactcaaaatttgcaccacatgcagtattttccaaacaatgttataccaaaacaagacctacttcaccgatgtttccaagagcaggagcagaagagtcagcaggcaagtgtgcttcagggctacaaaaacagaaatcaggatatgagtggacagcaggctgcgcagctggcacagcagagatatctcatccacaaccacgccaatgtattcccagtccccgatcagggtgggtcacacacacagacaccaccacagaaagacacacagaaacacgctgctctcaggtggcacttgttgcagaagcaagagcaacagcagacgcagcagccacagaccgaatcctgccattcacagatgcaccgcccaataaaggtggagccgggatgtaaacctcacgcctgcatgcacacggctcccccagaaaataagacatggaagaaggtgactaagcaggaaaaccccccagcatcttgtgacaacgtgcagcagaagagcattattgagacaatggaacagcacttgaagcagtttcacgcaaagtctctattcgaccacaaggccctgacgcttaaaagccaaaagcaggtgaaggtagaaatgagcggaccggtgaccgtgctaaccagacagactactgctgcagaactcgatagccatacacccgcccttgaacagcaaaccacttcaagcgagaagactccaaccaagcggacagccgctagcgttcttaataactttatagagagccctagcaagctgcttgacactcctattaaaaatctgcttgatactcctgtcaaaacacaatacgattttccttcctgtcgctgcgtaggaaagtgtcaaaagtgtacagagacgcacggcgtgtaccctgagctcgccaatctatcctccgatatgggattctctttcttcttttag

SEQ ID NO: 17618 - DNA, 6009 bp, Artificial Sequence
  Description of Artificial Sequence: Synthetic coding sequence
atggaacaagacagaaccaaccacgtggagggcaacagactcagtccttttctgatcccgagtcctcctatttgccagactgaacctctcgctaccaaactccagaacgggagccctctccctgaaagagcccaccctgaagtgaatggggataccaagtggcattctttcaaatcttattacggcatcccctgcatgaaggggtcacagaattctcgggtgtctccggatttcacgcaggagagtagaggatactcaaagtgcctgcaaaacggaggcattaagcgcacagtgagtgaaccgagtttgtcgggtctcctccagattaagaagctcaaacaggatcagaaggcgaacggagaaagaagaaatttcggtgttagccaggagcgaaatcctggggaaagcagccagccaaatgtctcagacctcagcgacaagaaggaatcagtgagtagcgtggcccaagaaaatgcagtgaaggacttcacaagctttagtacgcacaactgcagcgggccagagaaccctgaactgcaaatcctgaatgagcaggagggaaaatcggcgaattatcatgacaagaacattgtgctgctgaaaaataaggcagttctgatgcctaatggcgccacagttagtgcctcaagcgtggagcacacccatggagagctgctagaaaagactctgtcgcagtactatccggattgcgtgtcaatagctgtacagaaaacgaccagccacataaatgccattaattcgcaagccactaatgaactttcttgtgagatcacccatccctcacatacatcaggccagatcaactccgctcagactagcaattctgaactgcctccaaaaccagcagctgtcgtaagtgaggcatgcgatgcagatgatgcggacaatgcttctaaactcgccgctatgctgaacacttgttcttttcagaaaccagagcaactacagcaacagaagtccgtgttcgaaatttgtccttcccctgcagagaacaacatacagggaaccactaagctggcctctggggaggagttctgttcaggcagcagctcaaatttgcaggccccaggcggttctagcgagcggtaccttaagcaaaatgaaatgaacggggcctacttcaagcagtcctcagtgttcactaaagactcttttagtgccacgacaactccccctcccccgtctcagttgcttctctcccctcctccaccgctcccccaagtgcctcagctcccctctgaggggaagtccacactgaacgggggagtgttggaagagcaccaccactatcccaatcagagcaatactacgctcctacgcgaggtcaagatcgagggtaaacctgaagccccccccagccagtcgcccaacccttccacacatgtgtgtagtcccagccccatgttaagcgaaagacctcagaacaactgtgtgaaccgaaacgacattcaaacggctggaacgatgactgtcccgttgtgttctgagaagacacgaccaatgagcgagcatctgaaacacaaccctccaattttcggaagtagcggcgagctgcaggacaattgccagcaactgatgagaaacaaggaacaagagattctcaagggacgagacaaagagcagaccagggatctggtaccacccacccaacattacctgaagcctgggtggatcgagcttaaagccccgaggtttcaccaagcggaatcccacctgaagaggaacgaagcctcactgccaagcattctgcagtaccaacctaacctgagcaaccagatgacaagtaaacaatataccggaaactcaaacatgccagggggacttcctcgacaggcatacacccagaaaacaacccagctggagcacaaaagccagatgtatcaagtagaaatgaaccaggggcaaagccagggcacagtggatcaacacctacagtttcagaagccatcacaccaggttcactttagcaagaccgaccacctgccgaaggcgcacgttcagtccctgtgcggaactcgatttcatttccagcaacgggcagattcccagacagaaaaactgatgtcacctgtgctgaagcagcatctcaaccagcaggcttccgaaacagagccgttttcgaacagccatctgctgcagcataagccgcacaagcaggctgcccagacgcagccctcccaaagtagtcacttgccgcaaaatcagcagcagcagcagaagctgcaaatcaaaaacaaggaagagattctccaaacctttcctcaccctcagtccaacaatgaccaacaaagggagggctcgttctttggccaaaccaaagtcgaggaatgcttccatggcgagaatcaatactcaaagagttccgagtttgaaacacacaatgtgcaaatgggcctcgaggaggttcagaacataaacagacgaaattcaccttatagccagaccatgaaatcatctgcttgtaagatccaggtgagttgctcaaacaacacacacctcgtgtcagagaataaagagcaaaccacccaccctgagctgtttgctggcaacaagacgcagaatcttcatcatatgcagtattttccgaacaatgtgatcccaaagcaggacttgctacatagatgcttccaggagcaagaacaaaagagccagcaggcgagtgtgcttcaggggtataagaaccgtaaccaggatatgtcaggacagcaggcagcacagctggcccaacagcgttacctgatacataatcacgccaacgtattcccggtccccgaccagggaggcagccacacccagactccaccgcagaaagatacccagaagcatgcagctctgcgttggcacttgctgcagaaacaggaacaacagcagacccagcagccacagaccgagagctgtcactcccagatgcatcgacctattaaagtagaacccggctgcaaacctcatgcctgcatgcatacggcaccacctgaaaataaaacttggaagaaagtgacaaaacaggagaaccccccagcttcctgtgacaatgttcaacaaaaatctatcattgaaaccatggagcagcacttgaaacagttccacgccaagtctcttttcgaccacaaggcgcttacactcaaaagtcaaaaacaggtcaaggtcgagatgtctggtcccgtgaccgtgcttacaaggcagaccacggccgcagagctggattcccatactccagccctggaacagcaaaccacgagctctgagaagaccccgaccaagcgcaccgcagccagcgtcctcaataattttattgagtcaccgtccaagctgcttgatacacctatcaaaaacttgctggatacgccggtaaaaacccaatatgacttcccttcgtgccggtgtgtggaacaaatcatcgagaaagacgagggaccgttctatacccacctcggcgccgggcccaacgtggccgcaattcgtgagattatggaagaacgttttggacagaagggaaaagcaatccgaattgagagggtaatttacacggggaaggaagggaagtcatcacaaggctgtcctatcgctaagtgggtggtccgcaggagtagttctgaagaaaagctgttgtgcctcgtgagggaacgagctggtcacacatgcgaagctgctgtcattgtgattttaatcctcgtatgggagggaataccacttagtttagccgacaagctatattccgagctgactgagactttacgaaaatacggaactctgaccaacaggcgctgcgccctgaacgaggagagaacatgcgcctgccaaggcctcgaccctgagacctgcggagcaagcttcagcttcggttgcagctggtctatgtattacaacggttgtaaatttgccaggtctaagatacccaggaagttcaaactccttggagatgaccccaaagaagaggagaagctggagtcccacctccagaatctgagtactttgatggcccctacttataagaaattggctcccgatgcctacaacaaccagatcgagtacgagcatagggccccagaatgccggctgggactgaaagaagggagaccattctcgggcgtaacagcctgtctcgacttttgcgcccatgcccaccgggacctgcacaacatgcaaaatggcagcacactggtgtgcaccttgaccagggaggacaaccgggagtttggaggtaagccagaagacgagcagttgcacgtcctacctctctataaggtaagtgatgtcgatgagttcggcagcgtggaggcacaagaggagaaaaagcggtccggggccattcaggtcctatcatcttttagacggaaggtgcggatgctggcagaacccgtgaagacgtgtaggcagcggaagctggaggcaaaaaaggccgcggcagagaaactgtcctcattggaaaactctagcaataagaacgaaaaggaaaagagcgcaccttctagaacaaaacaaacggagaatgcctcacaagccaagcagttggccgaattgctgagattgtcaggtcccgtcatgcaacaatctcagcaaccccagccccttcagaaacaacctccccagccacagcagcagcagagacctcagcaacaacaaccccatcatcctcagactgagagcgtaaactcatactctgctagcggaagtaccaacccttacatgcgaagaccgaaccccgtgtccccttatccaaactcttcacacacaagcgatatatacggcagcaccagcccaatgaacttttacagcacaagctcccaggcggccggtagttatctcaattctagcaaccccatgaatccctacccaggcctgctgaaccagaatacacagtacccaagctaccagtgtaatggcaaccttagcgtggacaattgctccccgtatctaggcagttactcgccacagtcacagcccatggatctctaccggtaccccagtcaggacccactgagcaaactctctctgcctcctattcataccttgtaccagccccggtttggcaattcacaatctttcacatctaagtacctggggtatggaaaccagaatatgcagggcgacggttttagctcctgtactatacgccccaacgtccatcatgtgggcaagctgccaccataccctacacatgaaatggatggccacttcatgggcgcaaccagtaggcttcccccgaacctgtcgaaccccaacatggactataagaacggggaacatcactcaccctcacatatcattcacaactacagcgccgcgccaggcatgttcaacagtagcctgcatgcactgcacttgcagaacaaggaaaacgacatgttaagtcacacagcaaacggcctgtcaaagatgctgcccgctctcaatcatgaccgtaccgcgtgcgtccaaggcggacttcacaaattgtccgatgccaacggtcaagaaaaacagcctctcgcccttgtgcagggcgtggcttcaggagcggaagacaatgacgaggtgtggtccgacagtgagcaatcttttcttgatccagacatcggaggggtggctgtagcgccgacccatggctcaatcctgatagagtgcgccaagagggagctgcacgcaactacacccctgaaaaatcctaatcgtaatcaccccacccggatcagccttgtgttctaccagcataagagtatgaacgagcctaagcacggcctcgccctctgggaagcgaaaatggccgagaaggcccgcgagaaagaagaggaatgtgagaagtacgggcctgactatgtgccccaaaagtctcacggcaagaaagttaaacgggagcccgcagagccccatgagacctcggagccaacatatttgcgatttatcaagtccctcgccgaaagaaccatgtcagtcacaaccgattccacagtcacgacaagcccatacgcatttactcgggttaccggaccctacaatcggtatatttag

SEQ ID NO: 17619 - DNA, 3498 bp, Artificial Sequence
  Description of Artificial Sequence: Synthetic coding sequence
atggaacaagacaggacaaatcatgttgagggcaaccgcctctcccctttcctgattccctctccccccatttgtcagacggaacccttagccacaaagctccagaacggcagtccgctcccggagagggcgcatccagaagtgaatggcgacactaagtggcacagttttaagtcttattatggaattccatgtatgaaggggtcacagaactctagggtgtctcccgacttcacccaggaatcacgaggctatagtaagtgtcttcagaatggtggtattaagaggactgtgtccgagcccagcctgtctgggttgcttcaaatcaagaagctaaagcaggaccagaaggccaatggcgagaggcgaaacttcggtgttagccaggagaggaatcccggggaatcctcacagcctaacgtgtctgatctgagtgacaagaaggagagcgtcagctctgtggcccaagagaacgccgtgaaggactttacctctttttctacccataactgttcagggcccgagaacccagagctccagatcctcaatgagcaggaagggaaatcagctaactaccatgacaagaatatagtcttgctaaagaataaggcagtgctgatgcctaatggcgcaacagttagcgcctcctctgtggaacatacccatggcgaattgcttgaaaaaacgctcagccaatactatcctgactgcgtgtctattgcggtacaaaagacaacaagccatatcaacgcgatcaacagccaggctacgaacgaactgagctgcgagattacgcatccctcccacacttcaggccaaattaattcagcacagacaagcaatagcgaactgcctcccaagccggccgctgttgtgagcgaagcatgtgacgccgacgatgcggataatgcaagcaagctcgcagctatgctgaatacctgttccttccagaagccggagcagctacagcagcagaagagcgtgtttgagatttgtccaagccccgcagaaaacaacattcagggaaccaccaaacttgcctcaggcgaggaattttgctctgggtcatcctccaacctacaggcgccaggcgggtcaagcgagcggtatctgaagcagaatgagatgaacggagcctacttcaagcagagctccgtgtttaccaaggactctttttccgccacaactacacctccacctcctagtcagctactcctttctcccccgccgcccctgccacaggttccgcaactgccaagcgaagggaagagcacattgaatggtggtgtgttggaagagcatcaccactacccaaatcagagcaacaccacgctgctgcgtgaagtcaagattgagggaaaacccgaggccccaccatcccagagccccaatcctagcacccatgtctgctctccaagccccatgctgtctgagcgaccgcagaacaactgtgtgaaccggaacgatattcagaccgccggcacaatgacagtcccactatgttctgaaaagactcgacctatgtccgagcacctgaagcacaatccaccaatttttggctcctctggggagctccaagacaactgccaacagctcatgcgaaacaaggagcaggagattctgaaaggacgtgataaggagcagacaagagatttggtgccacctacacagcattatctcaaaccaggatggatagagttgaaggcgccaagattccaccaggccgagagccatttgaagaggaacgaggcaagcctcccaagcattttacagtatcagccaaacttgtctaaccagatgacgagcaaacagtatacgggcaatagtaatatgccaggtggcctgcctcggcaggcctatacccagaaaactacccaactggaacataagtcccaaatgtaccaggtcgagatgaaccagggtcagtcccaggggaccgtcgaccagcatttacagtttcaaaagcctagccaccaggtgcacttctcaaagaccgatcacctaccgaaagcccacgtccagagcctgtgtggaacccgctttcattttcagcagcgggccgactcgcaaaccgagaaactgatgagccccgtgctgaagcagcatctaaatcagcaagctagcgagacagagcctttcagcaattcccatttgttgcagcacaagcctcacaagcaagcggcccagacgcagccttcccagagctcccatctgccgcagaatcagcagcagcagcagaagctccagatcaagaataaagaggagattcttcagacatttcctcatccccagtcaaacaacgaccagcagcgggaaggttccttcttcggccaaaccaaagtagaggagtgtttccacggcgagaaccaatactccaagtcaagtgaatttgaaacacacaatgtacagatgggactggaagaagtacagaatatcaataggagaaacagcccctatagccaaacaatgaagtcctctgcttgcaaaattcaggtgtcctgtagcaataacacacatctggtgagtgagaacaaggagcagaccacccaccctgagctcttcgccggtaacaaaacccaaaacttgcatcatatgcaatactttccgaataacgtgatcccaaagcaagacctgctccaccgctgcttccaggaacaggagcagaaaagccagcaggcttcagtgttgcaggggtataagaatcggaatcaagacatgtccggccaacaggccgcacagctggcacagcagcgctacctcattcacaatcatgctaatgtgttccctgtgccagaccagggtggaagccatacacagactcccccccagaaggacacacaaaagcacgccgccctccgctggcatctcctgcagaagcaggaacagcagcagacgcagcagcctcagacagagagctgccatagccagatgcatcgcccgataaaagtggagccgggttgtaaacctcacgcttgcatgcatacagcacctcctgagaataagacatggaagaaggttaccaagcaggagaaccctcctgcgtcttgtgataatgtacagcagaagtctatcatcgagacaatggagcagcacctgaaacaatttcacgctaagtcccttttcgatcataaggccctgacactaaaatcccaaaagcaggtcaaggtggagatgtctggtcccgttaccgtgcttactcggcaaaccactgccgccgaattggacagccatacccctgctttggaacagcagacgacatcttcagagaagacgcctaccaagcgcactgctgcgagtgtgttgaacaacttcatcgagagccctagcaaactcctggacacccccattaaaaatttactcgacactcccgtaaagacccaatatgactttccctcgtgtagatgcgttggcaaatgccagaagtgcacagaaacacatggcgtctatccggaactcgctaacttgtcaagtgacatgggcttctcatttttcttctag

SEQ ID NO: 17620 - DNA, 333 bp, Artificial Sequence
  Description of Artificial Sequence: Synthetic coding sequence
atggaacaagaccgcaccaaccacgttgaaggtaatagactaagcccattcctcatcccttccccgcctatctgtcagacagagccgctagccacaaagctccagaatggttcccctctacccgagagggcacatccagaagtgaacggagacacaaagtggcatagctttaaatcgtactacgggattccatgtatgaagggctctcaaaattccagggtctccccggacttcacccaggagtcacgggggtattctaagtgtctgcagaatggcggcattaagcgtaccgttagcgagccttccttgtccggcctcctgcagataaagtag

SEQ ID NO: 17621 - DNA, 1914 bp, Artificial Sequence
  Description of Artificial Sequence: Synthetic coding sequence
atggagcaggatcggacaaaccatgtggaagggaataggctgagcccattcctgatcccaagcccccccatctgccaaacagaacctttggcgacaaagctgcaaaatggctcacccttgcctgagagagctcaccccgaggtcaacggagatactaagtggcactctttcaaaagctactatgggatcccgtgcatgaaaggcagccagaattctagagtctcccccgacttcactcaggagtctcgcggatactcaaaatgtctgcagaatgggggcataaagaggactgtgagcgaaccatcactcagtgggctgctgcagatcaaaaagcttaagcaggaccaaaaggctaatggcgagcgtcgaaatttcggcgtatctcaggagcgcaacccaggcgagtcaagtcagcctaatgtgtcagatttgagtgacaagaaagagtctgtgtcctctgtggcccaggagaacgcagtgaaggacttcaccagtttctcaacacataactgtagcggacccgaaaatccagagctacagatcctgaatgagcaggaaggaaagtcagccaactaccacgacaaaaacatcgtgctgttgaaaaacaaagccgtcttaatgccgaatggcgccaccgtctcagcctcttcagttgaacacactcacggcgagctgctcgaaaaaaccctttcccagtactaccccgattgcgtatccattgcggtgcagaagactacgtctcacatcaatgcaatcaactctcaggctacgaatgagctaagctgtgagatcacccacccttcccacacctcggggcagattaacagcgctcagaccagtaatagtgaactgccacctaaaccggcagctgtcgtaagtgaagcttgtgatgctgacgacgctgacaatgcctctaagctggcagcaatgctgaacacatgcagcttccagaagcccgaacagctgcagcagcagaagagcgtctttgagatctgtccttcccccgccgagaacaacatacagggaacaacgaaactcgcttcaggcgaggagttctgctctggttcaagtagtaatctccaggcgccaggcggaagttccgagcgatacctcaagcagaacgagatgaacggggcatatttcaagcagtcttcagtgttcaccaaggattctttctctgctaccactaccccacctcccccatcacagcttcttttgtccccgccccctccactgccgcaggtgccacagctcccttccgagggcaagtcaacactcaacggcggtgttctcgaagagcatcatcactacccaaaccagtcaaacaccactttactgcgggaggtgaaaatagagggtaagcccgaagccccaccatcccagtcccctaacccctccactcatgtgtgcagcccctcccctatgctgtccgagaggcctcagaacaactgcgtgaacagaaatgacatccagaccgcgggcaccatgacggtgcccctttgttcagagaagacccggcccatgtcagaacaccttaagcacaatcctcctatcttcggctcaagcggggagcttcaggacaattgtcagcaactgatgcgtaacaaagagcaggaaatccttaaaggcagagataaagagcaaacccgagacttggtccctcctacacaacactatctgaaacccgggtggatcgagctaaaggcacccagatttcatcaggccgaatcacatctaaaaaggaacgaggcttctctgccctctatcctgcaatatcagcccaacctctccaaccagatgaccagcaagcagtatacagggaactcaaacatgccggggggcctgccccgacaagcttacactcagaagactactcagctgagcacctcacacaagtgcactaagctgaaatag

SEQ ID NO: 17622 - DNA, 6009 bp, Artificial Sequence
  Description of Artificial Sequence: Synthetic coding sequence
atggagcaggatcgcaccaaccacgtggagggcaaccgcctcagcccttttttgattccgtccccccccatctgtcagaccgagcccctagcaactaaacttcaaaatgggagccctcttcccgagcgagcccaccccgaggtgaatggagatacaaagtggcacagtttcaagagctattacggtatcccctgcatgaaggggagccagaacagtagagttagcccagacttcacccaggagtcacggggttattctaaatgcctgcagaacggcgggataaaacggactgtatccgagccctctttatcaggtctcctccagatcaagaaattgaagcaggaccagaaggccaatggcgaacgcagaaactttggtgtgtctcaggaacgaaacccaggcgaatccagccaacccaatgtgagcgacctttccgataagaaagaaagcgtttcatccgttgcccaggagaacgcagttaaggattttacctcattttctacccacaattgctctggccccgaaaatcccgaactgcagatcctaaatgagcaagaggggaaaagtgccaattaccacgacaagaacatcgtcctcttaaaaaacaaggcagtgctgatgccaaacggtgccacagtgtccgctagctcagtcgaacatacccacggtgagctcttggagaagaccctgagccagtactaccccgattgtgtatcaatcgcagtgcaaaaaactacaagtcatatcaacgctattaactctcaagccacaaacgagctgtcctgcgagatcacgcacccttcacacaccagtggccaaatcaactctgcgcaaacaagcaactcagagctgcctccaaaacctgccgctgtggtaagcgaggcttgcgacgccgacgatgctgacaatgctagtaagttagctgcaatgcttaacacttgtagcttccagaagcccgagcaactgcaacagcagaagagtgtgttcgagatttgtcctagcccagcagagaataacattcaagggaccacgaagttggccagcggtgaggagttttgctccgggtcgagcagtaatctgcaggccccaggaggaagctccgaacgataccttaagcaaaacgagatgaacggtgcgtatttcaagcaatcatctgtctttactaaggattccttctctgcgaccaccactcctccccctccaagccagctcctactctcccccccgccgcctctgccccaggtgcctcagcttccctcagagggcaagtctacgctgaacggaggtgtcctcgaagaacatcaccactatcccaaccagtcaaatactacactgctaagagaagtgaaaatagagggtaaacccgaggccccacctagccagagccccaacccgagtacccatgtgtgctcaccttctcccatgctgtctgaacgcccacagaacaattgtgtgaaccggaatgatatccagacagcaggaacaatgaccgtgcctttatgcagcgagaaaacccgacccatgtctgaacatctgaaacataatcctccaatttttggaagcagtggtgagctccaggacaattgccagcaactgatgagaaataaagaacaggagattctgaaagggcgagataaggagcagacgcgcgacttagttccgccaactcagcactatctgaagcccggctggattgagctcaaagctccccggttccaccaggcagaaagtcacttgaagaggaatgaagcctctcttcccagtatattacagtatcagcctaatttgagtaaccagatgacatccaaacagtatacaggcaattctaatatgccaggcggactcccacgtcaagcctacactcaaaagacaacacagctggagcataagtctcaaatgtaccaggtggaaatgaatcaggggcagtctcagggtacggtcgaccagcatctccaattccaaaagccttctcaccaggtgcatttctctaaaactgatcacctcccgaaggcccacgtccagtctctgtgtgggactcgcttccactttcagcagagggctgattcacagacagagaagctgatgtccccagtcctgaagcaacacttgaatcagcaggcctcagaaacagaacccttcagcaacagccatctgctgcagcacaagcctcacaagcaggcagcacagacccaaccaagccagagctcccatctaccacagaatcagcaacaacaacaaaagctccaaataaagaataaagaggagatcttacagacgttcccccacccccagagcaacaacgaccagcaacgcgagggcagctttttcggtcagaccaaagtggaggaatgcttccacggagagaaccagtactctaaatccagtgaattcgaaacgcacaatgtgcagatggggcttgaggaagttcagaatattaatcggaggaattctccgtatagccagactatgaagagctcagcttgtaagatacaggttagctgctccaataatacccacctggtctccgagaataaggagcaaacgacgcatccggagttgttcgctggcaataaaacgcagaatctccaccacatgcaatacttccctaataatgtaattccaaagcaggatctccttcaccggtgctttcaggagcaggaacaaaagtcgcagcaagcttcggtattgcagggctataaaaataggaaccaggatatgtcagggcagcaggcggctcagctcgcacagcagcgctacctcattcataaccatgcaaacgtgttcccagtgccagatcaagggggaagtcacacgcagaccccccctcagaaagacacgcaaaagcacgccgccttgcggtggcacctgctccagaaacaggagcagcagcagactcagcagccccagaccgagtcctgtcactcccaaatgcaccggcctataaaggtagaacctgggtgcaaacctcacgcttgcatgcacactgccccaccagaaaacaaaacgtggaagaaggttactaaacaggaaaaccctccagcgagttgcgataacgtgcagcagaagagtataatcgagacaatggagcaacacctgaagcaattccacgcgaaatcgttgttcgaccacaaagccctcactctaaagtcacagaagcaggtcaaagtcgagatgtctgggcccgtgacagtgttgaccaggcagactacagcagcagaattagatagccatactcccgcccttgaacaacagaccacctcttcagagaagacccccaccaagcgcactgctgcctcagtgctgaacaattttatagagagccccagcaaattgctcgacacccctatcaagaatctgctagatacgccggtcaaaactcagtatgatttcccatcctgccgatgcgtggaacaaataattgagaaagacgaggggccattttacacccatctgggggctgggcctaatgttgccgctatcagagagatcatggaagagcggtttggtcagaagggaaaagctatcaggatcgagcgcgtcatttatactgggaaggaggggaagagctcacagggatgcccaatcgccaaatgggtggttcgtcgctcatcctccgaagaaaagttactgtgcttagtgcgcgaaagagccggtcacacttgtgaagctgcggtgatagtgatcttaatcctggtttgggagggtatccccttgtcgctggcagataaactgtatagcgagctgaccgagacactgcgcaagtatggaaccctcacaaaccgacgatgtgcgctcaatgaggaaagaacgtgcgcttgccagggcctagatcccgaaacttgcggtgcttctttctccttcggatgcagctggtcaatgtattataatggttgcaagttcgcacggtctaaaatccccaggaagttcaagttgctaggagacgacccaaaagaagaagagaagttggaatctcacctgcagaacctgtccaccctgatggcaccgacatataagaaactggctccagacgcctacaataaccagattgaatacgagcacagagcaccggagtgcagattgggtctcaaagaaggtcgtccattcagcggggtaaccgcgtgcctggacttctgcgctcacgcccatagagatctgcataatatgcagaatgggagcacactggtttgtacccttacgcgagaggataaccgggaatttggcggcaagccagaggacgagcagctccatgtgctccccctgtacaaagtgtcagatgtggatgagttcgggtcagtagaagcccaagaggaaaaaaaaagaagtggcgccatacaagtcctgtcatcctttcgtaggaaggtgcggatgctggccgagccggtcaagacatgtcgtcagcggaaacttgaggctaagaaagccgcagccgaaaagttgtcctccttggaaaatagctctaacaagaacgaaaaagaaaagagcgccccctctcggaccaaacagacagagaatgcctctcaggccaagcagcttgccgagctactgcgccttagcggccccgtcatgcagcagagccagcaaccccagcccctgcagaaacagccgccacagcctcagcagcagcagaggccccagcagcaacaaccccaccacccacaaaccgagagcgttaacagctactcagcgtctggctccaccaatccttacatgcgacgtcctaatccggtctccccatacccgaatagctctcataccagtgacatatatgggtccacatcgcccatgaacttttactcaacctctagccaggcggcgggctcctatctcaactccagcaatccgatgaatccttacccaggtttgctgaatcagaacacccagtacccgtcctaccagtgtaacgggaacttaagcgtagacaactgtagtccctatctcggaagttactccccccagtcccagcccatggacctgtacagatacccaagccaggatcccttatctaaactgagcttgccacctatacatacattgtatcagccccggttcggtaatagccaatccttcactagtaaatacctcggatatggtaaccagaacatgcaaggtgacggcttttcaagttgtacaattcgccccaatgtgcaccacgtgggcaaactccccccttacccgactcatgagatggatggacactttatgggagccacatcgcgtctcccaccaaacctctctaatcctaacatggattacaaaaacggcgagcatcattccccaagccacattatccataactattcggccgctcccggaatgtttaactcctcattgcacgcccttcacttacagaacaaagagaacgacatgctctctcatacagcaaacggactgtctaaaatgttgcccgctttgaaccatgatagaacagcctgcgtccagggaggacttcacaaactgtctgatgctaacggccaggagaaacagccactggccctggtgcaaggcgtcgcatccggtgccgaggacaatgatgaggtgtggtcagatagcgagcagtcgttcctggaccctgacataggcggcgtggcagtggcaccaacacatggcagcatactcatcgagtgcgcaaagcgtgaactccacgcaacaacccccctgaaaaatccaaatcgcaaccatccgactcggatcagcctagtcttctaccaacacaaaagtatgaatgaaccgaagcacggtttggccctgtgggaagcgaagatggccgaaaaggccagagaaaaggaagaggagtgtgagaaatacggcccagattatgtgccacaaaagagtcacggcaaaaaggttaagagagaaccagctgagcctcacgaaacatccgagccaacttatctaagatttatcaagagcctagccgagcgaaccatgagtgtcacaaccgatagtacagtgacgacgtccccgtatgcgtttacccgcgtgactggtccctacaatcgctacatttag

SEQ ID NO: 17623 - DNA, 3585 bp, Artificial Sequence
  Description of Artificial Sequence: Synthetic coding sequence
atggagcaggatcggaccaaccacgttgaaggaaaccgcttgtcaccctttctcattccatcacctcctatttgtcagacagaacccctcgccacgaagttgcaaaacggaagtcccctgccagaaagggcacatcccgaagtgaacggggacactaaatggcactccttcaaatcgtactatggaatcccatgtatgaagggcagtcaaaatagtcgcgtttcccctgacttcacccaggaatctcgagggtacagtaaatgcctccagaatggtggtatcaagagaaccgtgtcagagccgtccctcagcggcctgttgcagattaaaaagttaaagcaggaccagaaagcaaatggtgagagaagaaactttggagttagccaggaacgtaacccaggcgagtcttcacaacccaatgtctctgacctgagtgacaagaaggaaagcgtttcatcagttgcgcaggagaatgccgtcaaagacttcacctcattctctacacataattgttccggcccagaaaatcccgaactgcagattttgaatgaacaggagggtaagagtgccaactaccacgataagaacattgttctgctgaagaataaagctgtgctcatgcctaacggtgctactgttagcgcctccagcgtggagcacacacatggagagttacttgagaagaccctcagtcagtactaccctgactgcgtgtccatcgcagtgcaaaagaccacgtcccacatcaatgcaatcaattcacaggccactaacgaactgtcttgcgagattacacatcctagtcatacgtctgggcagatcaacagcgcgcagacctccaattctgagctgccaccaaagccagcagccgtggtgtctgaagcctgtgatgccgatgatgcggataatgcctcaaagttggcagctatgctcaacacatgcagcttccagaagccagagcagctgcagcagcagaaatctgtgtttgaaatttgcccaagtcccgcagagaataacatccaaggcactaccaagctggcaagtggggaagagttctgtagcgggagtagttcgaatctgcaggcccctggcggctccagcgaacggtatctgaagcagaacgagatgaatggcgcgtatttcaagcagagtagtgtgttcactaaagattctttttccgcaacaactacacctccacctccgtctcagctcctgctaagcccccccccacccttgccacaagtgccccagctcccttctgaaggcaaaagtacacttaatggtggcgtactcgaggagcaccaccattaccccaaccaatctaacaccacgctgttgcgggaggtaaagatcgagggtaagcccgaggcccccccctcccagagtcccaacccaagtacacacgtttgttccccaagtcctatgctgagcgaaagaccccagaacaactgtgtgaatcggaatgacatacagaccgccggcacaatgaccgtccctttgtgcagtgaaaagactcgccctatgtcagagcacctgaagcacaatccaccaatcttcggttcatctggcgagctgcaggataattgccagcagctcatgaggaacaaagagcaagagatcctcaaaggccgggacaaggagcagaccagggatttagtgccacccacccagcactatttgaagccggggtggattgaacttaaggctcctcgtttccaccaggccgaatctcacctgaaacgtaacgaggcttcgctcccctccattctgcagtatcagcctaacctgagtaaccagatgacctcaaaacaatacaccggaaattccaacatgccaggaggtttgccacggcaggcctatacacagaagactacacagttggagcataaaagtcagatgtaccaggttgaaatgaatcaagggcagtcccaggggacagtggaccagcatctgcaattccagaagccttcacaccaggtccacttttcaaagactgaccatctgccgaaggctcatgtgcagtccctatgcgggacacgcttccacttccaacagagagcagattcacaaacagagaagctgatgtccccggtgctgaaacagcaccttaaccagcaggccagtgagaccgagcctttttcaaattcccacctactacagcacaaacctcacaaacaggccgctcaaacccaaccaagccaaagctctcatctgccgcaaaatcagcagcagcagcagaagttgcagattaaaaataaggaggagatcttgcagacctttccacaccctcagagtaataatgatcagcagcgcgagggatccttttttggacagactaaggtggaggaatgtttccatggggagaaccaatatagcaaatcgtctgagtttgagacacataatgtccaaatgggtctcgaggaggtgcagaatatcaatcgccggaacagtccttattcgcagacaatgaagagttctgcctgtaagattcaggtgtcttgctccaataatactcacctcgtgagtgagaacaaagaacagactacacatcccgagctctttgccggcaacaagactcaaaacttacatcacatgcaatatttcccaaataatgtgatacccaaacaggacctgctgcaccgctgttttcaagagcaggagcagaagagccagcaggcaagcgtcctacaggggtacaaaaacagaaaccaggacatgagcggacagcaggctgctcagcttgcccagcaaaggtacctgattcataatcacgcaaacgtgtttccggttccagatcaaggcggaagtcacacccaaaccccaccgcagaaggacacacagaagcacgctgccctgcggtggcacctactgcaaaaacaggaacaacagcagactcagcagccacagactgaatcatgccatagccagatgcaccggccgattaaggtggagcccggatgtaagccacatgcttgtatgcatacagctccgcccgaaaataagacttggaaaaaggtgacaaaacaagaaaacccaccggcgtcctgtgataacgttcagcaaaagtccataatcgagacgatggagcagcatctcaagcagttccacgcaaagagcttattcgaccacaaggcactcacactgaaatcgcagaaacaagttaaagtcgagatgtcagggcccgtgactgttctgacgcggcagacgacagccgcagaactggactcccacacccctgccctggagcaacagacaacctcatccgaaaagacaccaactaagagaacagccgccagcgtccttaataacttcatagaaagtccatctaagctgctggatacccccataaaaaatttgctggacacaccagtgaagacacagtacgacttcccatcttgtcggtgtgtcggactggataggcgcgtgaagttgctcgggctgaaggaatctagtatacttgtgaaaaaggctaaagtgcttagagacgtgttactgctgtctggttggtttgccgaagctgccgtgaagcgcagttattgcgtctggtgcggtagcgagctcgcgactcccgtgaggcttcagtag

SEQ ID NO: 17624 - DNA, 6072 bp, Artificial Sequence
  Description of Artificial Sequence: Synthetic coding sequence
atgatccaggaggagcagatccagctggagggatcgcttgttgatgggccagaggccagcttgatggagcaagatagaacaaaccatgtcgaagggaatcggttgtccccctttctgatcccttcccctccaatttgccaaactgagccactggccacaaaactgcaaaacggatcaccactgccagagagagcgcacccggaagttaacggggatacgaagtggcatagcttcaagagttactacggcattccgtgcatgaagggcagccagaacagccgagtaagccccgacttcacccaggaaagccgaggttattcgaaatgcctccagaacgggggcatcaaaaggaccgtaagcgaaccttcactgtcaggattactgcagatcaagaagctcaagcaggaccagaaagcaaatggagaacgccggaacttcggggtctctcaagagcgcaatccaggcgaatcttcgcaacctaatgtgagcgatctgagcgacaagaaagaatccgtgtctagtgtggcccaggagaatgctgttaaggatttcactagcttttccacacacaactgttccggacctgagaaccccgagctccaaatattgaacgaacaagagggcaagagcgcaaattatcatgacaagaacatcgtcttgctgaagaacaaagcggtcctgatgccaaatggcgccacagtgagtgcttcctctgtagagcacacccatggtgaactgttggagaagactctgagccagtactaccctgattgtgtgtcgatcgctgttcagaaaacaacatcccacattaacgctatcaacagtcaagcgaccaatgaactgagctgcgagatcacacacccatcacatacaagtggacagattaacagcgcacaaaccagtaactctgaactacctccaaagcctgctgctgtagtgtctgaggcctgcgacgccgacgacgctgataacgcatccaagttagcagctatgctaaatacctgctcgtttcaaaagccagaacaactgcaacaacagaaatctgtctttgaaatctgtcctagtcccgccgaaaacaacatccaaggtactaccaaactcgctagcggcgaggagttctgtagcggctcgtcttctaacttgcaggcccccggcggctcctcagagaggtatttgaaacaaaatgagatgaacggggcatattttaagcaaagttccgtattcaccaaagacagctttagtgctaccactacgccaccccctcctagtcagctgttgcttagtccgcctccacccctgccccaggtgcctcagcttcccagtgagggtaaatctacactgaatgggggagtattagaagaacatcaccactaccctaaccagtccaataccaccctcctgcgggaggtcaaaatcgagggcaagccagaagctcctccaagccaatccccgaatccatccacacacgtgtgctcgccatcaccgatgctttctgagaggcctcagaataactgcgtgaacagaaacgacattcaaaccgcgggaacaatgacagtccctctgtgctccgagaaaacccgccccatgagtgaacatctgaagcacaaccctcccatcttcgggagctctggcgaactgcaggataattgtcaacagctgatgcggaataaggaacaagagatacttaaggggcgggacaaggagcagactagagatttagtccccccaacgcagcactaccttaagcccgggtggattgaattgaaagctccccgtttccatcaggcggagtcacatcttaagagaaatgaagctagcctgccttcaatactgcaatatcaacccaacctgtcaaaccagatgacttcaaagcagtacactggaaactccaacatgcctgggggcctgccgcggcaggcctacacacagaaaacaactcagctggagcataagagtcaaatgtaccaggtggaaatgaatcagggacagtcccaagggacggtggaccagcacctacagttccagaagcctagtcaccaggtacacttctccaaaactgaccatctaccgaaagcccatgtacagtccttatgcggtacaagatttcactttcaacaaagagccgattcccagactgagaaactgatgtctccagtgcttaagcaacacctgaatcagcaggcaagcgagacagaacccttcagtaactcccatctactccagcataaaccgcacaagcaggctgcccaaactcagccgtctcagagcagtcatctgccccagaatcaacagcagcagcagaagctgcagattaagaacaaggaggagattcttcagacgtttccccatccgcagtccaataacgatcagcagcgcgagggtagcttctttggacagaccaaagtggaggaatgctttcatggagagaaccagtacagcaaaagctcggagttcgaaactcacaacgtgcagatgggacttgaagaagtacaaaatattaaccgtcggaatagtccctactcacaaacaatgaaatcatccgcctgcaaaattcaagtttcctgcagcaataatacccacctggtgtctgagaacaaagagcaaacaacccatccagagctgttcgccgggaacaaaacccagaatctgcaccacatgcagtacttccctaacaacgtcattcccaagcaggatctcctgcaccgatgttttcaggagcaggagcagaagtcccaacaggcctcagttttacaagggtataagaaccggaatcaagacatgtctggccagcaagccgcacagttggcacagcaaagatatctcatccataaccacgctaacgtatttcccgtgccagaccaggggggttcacacacacagacaccccctcagaaggatacacagaaacatgcagccctccgctggcaccttctccagaagcaggaacaacaacaaacccagcagccccagacagagagctgccacagtcagatgcacaggcccattaaggtcgagccaggctgcaagccccatgcttgcatgcataccgcgccacccgaaaataaaacttggaagaaagtaaccaaacaagagaatcctccggcctcgtgtgataacgtgcagcaaaaatcgataatagagacgatggaacagcacctgaaacagttccacgctaaatctctgtttgatcacaaggccctcacactcaagtctcagaagcaggtgaaagtggagatgtcggggcccgttaccgtgctcacccggcaaaccacagcagctgagctggatagccacaccccagctctcgagcaacagactaccagcagcgaaaagacacctactaaacgcacagccgcaagcgtcctgaacaacttcatcgagagccccagtaagctgctggatacccccattaaaaacctgcttgatacccccgtgaagacacagtacgattttccaagttgtaggtgcgtggaacagattatcgagaaggacgagggccccttctacacccacctgggtgccggcccaaacgtggcagccatacgtgagataatggaggagcggttcggtcagaaaggaaaggcgatccgcatagagagggtcatttataccggaaaagagggtaaaagttcccaagggtgcccaattgctaagtgggttgtgcggcggagttccagtgaagagaagctcctgtgtctggtgcgtgagcgtgccggccacacctgtgaggcagcggtgatagtgatccttatcctggtatgggaaggaataccactgtctctcgcggacaagctatatagtgaactcactgaaactttgcgaaagtacgggaccctgacaaataggaggtgtgctttaaatgaagagagaacgtgtgcctgtcaaggactcgacccggaaacctgcggagcctcattctccttcggctgctcatggagcatgtattacaatggatgtaaattcgcccgttctaaaatccctaggaagttcaaactcctgggagacgacccgaaagaggaagaaaaactcgagagccacctccagaatctgtccaccctgatggcacccacatacaagaagctggcacctgacgcctataataatcaaatagagtacgagcatcgagctcccgagtgccgtctgggattaaaagagggcagacccttttcgggcgtgacggcgtgtctggatttctgcgcccacgcccacagagaccttcacaacatgcagaacggcagcaccctcgtgtgtaccctcacacgggaggacaatagagaatttggtggcaaacccgaggacgaacagctgcacgtgctgccgctctataaagtctcagacgtagatgaatttgggtcagtagaggcacaggaggagaagaaacgctccggcgctatccaagtactgtcctccttcagaaggaaggttcgtatgctagccgagcctgtgaagacctgtcggcaaagaaaactggaagccaagaaagcagcagcagaaaaactatcatccctcgaaaactcatctaacaagaacgagaaagagaaatccgcccccagtaggaccaagcagaccgaaaacgccagtcaggcaaagcagcttgccgagctgttacggttgtctggccccgtcatgcaacaatctcagcagccacagcccctgcagaagcagccacctcagcctcagcagcagcagcgtccccaacagcagcagccacaccacccccaaaccgaatccgtcaacagctacagcgcttctgggtcgactaacccttatatgagaagacctaatcccgtgtccccgtatccaaactctagccacacctccgatatctacggcagcactagccctatgaacttttacagcacgtccagccaggctgcgggttcatacctgaatagctctaaccccatgaatccttaccccggactgcttaaccagaatacgcagtatccaagctaccagtgcaatgggaatcttagcgtggataattgcagtccatatttgggatcctactctcctcaatcgcagcctatggatctgtacaggtatccgtcccaagacccgctttcgaaactttcgttgccacccatccataccctgtatcagcctcggtttgggaattctcagagctttacgagcaaatacctggggtatgggaatcagaatatgcagggcgatggcttctcaagttgcacaatccgcccaaacgtccatcacgtcggcaaactcccaccgtatcccactcatgagatggacggacactttatgggcgcaacgagccgccttcctcccaacttaagcaaccccaacatggattacaagaacggcgaacaccattccccaagtcatatcatccacaactattcggccgctccggggatgttcaattcaagcctccacgccttacatttgcagaacaaagagaacgatatgctgtcacataccgccaatggccttagcaaaatgctgccagcccttaaccatgatcgcacagcttgcgtccagggcgggctgcacaagcttagtgatgctaacgggcaggagaaacaacccctcgctttggtgcagggcgtagcttccggggcagaagacaacgacgaggtgtggtccgatagtgaacagagttttctagaccccgacatcgggggagtggctgtggcacctacccatgggagcattctcatcgaatgtgcaaagcgagagctgcatgctaccaccccactaaaaaatccaaacaggaatcatcctaccagaattagcctggtgttttaccagcataaaagtatgaatgaacccaagcatggcctggccctgtgggaggcaaaaatggccgagaaagcgcgggaaaaggaggaggagtgtgagaagtatggaccagattatgtccctcagaagagtcacggaaagaaggtcaaacgggaacccgcagaacctcatgaaacctccgaacccacctatctgaggttcatcaaaagcctagcagagagaaccatgtctgtcaccacagattcaacagtgacaacatccccttatgccttcacccgcgtgacgggtccttataaccggtatatttag

SEQ ID NO: 17625 - DNA, 615 bp, Artificial Sequence
  Description of Artificial Sequence: Synthetic coding sequence
atggtgtgcggtggtttcgcctgcagcaaaaactgcctttgcgcccttaatctattgtatacactggtctctctattactgatcgggatagctgcatggggcattggcttcggcctgatttcatctctgcgcgtcgtgggcgtcgttattgccgttggaatttttctctttttgatagctctagtaggcctgattggtgcagtgaagcaccaccaagttctgctgtttttttatatgatcatactgttgctggtcttcattgtacagttctctgtgtcatgcgcctgccttgccctcaaccaggagcagcaagggcagctgctggaggtggggtggaataataccgcttctgctagaaacgacatacagcgcaacctgaactgctgcggcttccgaagtgtaaatccgaatgatacttgcttggcatcctgtgttaaaagtgatcacagctgcagcccctgcgccccaatcattggtgagtacgcaggggaggtgttgcggttcgttggaggaatcggactgttttttagctttaccgagatcttaggcgtgtggctcacgtatcgttatcgtaatcagaaagatcctagagcgaaccctagcgccttcctttag

SEQ ID NO: 17626 - DNA, 738 bp, Artificial Sequence
  Description of Artificial Sequence: Synthetic coding sequence
atggcctctccctcacgcaggctccagacaaagcctgtgataacatgctttaaatctgtgctactcatctacactttcatattctggatcactggggtcatcctcctcgctgtcggcatatggggtaaggtgtccctggaaaactacttttccctcctgaatgaaaaagccaccaatgtgccattcgtgctaatagctaccgggacggtgatcatcttgctcgggaccttcggctgtttcgcaacatgtcgcgcttctgcgtggatgctcaaactgtacgccatgtttttgacactggtctttctggtcgagctagtcgccgccattgttggctttgtctttcggcacgagatcaagaacagcttcaagaataattacgaaaaagctctgaagcagtacaattccacgggcgattataggagccacgccgtggacaagattcaaaacacacttcattgttgtggggtgactgactatcgagactggacggacacaaactattactccgagaagggttttcccaaaagttgctgtaaactcgaggactgcacaccccaacgggatgcagataaagtaaataatgaggggtgtttcattaaagtaatgactatcatagaatccgaaatgggagttgtagccggcatctcctttggtgtcgcttgcttccagttaatcggtatattcctggcctactgcctgagcagggcgatcacaaataaccagtacgagattgtctag

SEQ ID NO: 17627 - DNA, 684 bp, Artificial Sequence
  Description of Artificial Sequence: Synthetic coding sequence
atggcatccccctccaggagactgcagacgaagcccgttatcacgtgcttcaagtcagttctgctgatctacacatttatattctggatcacgggggtgatccttctggcagttgggatctgggggaaagtgtccctggagaattatttcagccttttgaacgagaaagccacatttggatgtttcgccacttgcagggcatctgcttggatgttgaagttatacgctatgttccttacactcgtctttctcgtcgaactggtggcggccatcgtgggtttcgtattccgtcacgaaattaaaaacagctttaaaaataactacgaaaaggccttgaagcagtataactctactggagactaccgctcccacgccgttgataagattcagaataccctgcattgctgtggagttacagattaccgggactggactgacaccaattactatagtgagaaagggtttcccaagtcctgctgcaagctcgaggattgcactccccagagggacgcagacaaggtcaataacgagggttgtttcataaaggtcatgaccatcatcgaatctgagatgggtgtcgtggccggtatcagttttggcgtggcatgcttccagctaattggcattttcctcgcttactgtttgagtagagcaattacgaataaccagtatgagatcgtctag

SEQ ID NO: 17628 - DNA, 669 bp, Artificial Sequence
  Description of Artificial Sequence: Synthetic coding sequence
atggagagaaaaggctccgctgccggagccaagggcaatccctcaccccccgcggcaggtgaggggcaacggccaccgcccccactctgcgtgccaggcgggggcggaggcgcccccgccaggggccaggtaggtgctgccgctgagcccgctgagctcatccggagagcccatgaattcaagagccagggggcccagtgttataaagataagaagtttcgggaagcgattggaaaataccatagggctctcctggaacttaagggcttactccctcctccaggtgagcgcgagcgggacagccgccctgcctcacctgcgggtgctctgaagccaggccggctgagtgaagagcagtctaaaacagtggaagcaatcgaaatagactgttacaattcacttgcagcctgtctgctgcaggcagaattggttaactacgagcgcgtgaaagagtattgtctgaaagtattgaagaaagaaggcgagaactttaaggccctgtacagatctggcgtggctttctaccatttaggagattacgataaggctctgtactacctgaaggaggccagaacacaacaaccaaccgataccaacgtgatccgatatatccaactcaccgagatgaaattatccagatgttctcaacgggagaaggaggcaatgtag

SEQ ID NO: 17629 - DNA, 258 bp, Artificial Sequence
  Description of Artificial Sequence: Synthetic coding sequence
atggtcaaacagatagaatcaaagacagcctttcaggaggcgttggacgccgccggtgacaagctggtggtggtcgacttctctgctacatggtgcggcccctgcaagatgattaagccatttttccacgatgtagcctcagagtgtgaagtgaaatgtatgcctaccttccaattcttcaagaagggacagaaggtgggtgagttctcgggggcaaataaggaaaagctagaggccacaatcaacgaattggtatag

SEQ ID NO: 17630 - DNA, 318 bp, Artificial Sequence
  Description of Artificial Sequence: Synthetic coding sequence
atggtcaagcagatagaaagtaagactgccttccaggaagcattagatgccgccggcgacaaactggttgtcgtggacttttcagctacatggtgcggcccgtgcaaaatgattaagccatttttccactctctctcagaaaagtattctaatgtgatttttttagaggtggacgtggacgactgccaggacgtggcttcagagtgcgaggttaaatgcatgccgacctttcagttcttcaaaaagggccagaaagttggtgaattcagcggagccaacaaagagaaactggaggccaccatcaatgagctggtgtag

SEQ ID NO: 17631 - DNA, 1176 bp, Artificial Sequence
  Description of Artificial Sequence: Synthetic coding sequence
atggttatgtttaagaaaatcaaaagcttcgaagtggtcttcaacgatcccgaaaaagtgtacggcagcggcgaaaaagtggccgggagagtgattgtagaagtgtgcgaagtcacacgggtgaaggccgttaggatcctggcttgtggtgttgctaaggttctgtggatgcaaggcagccagcagtgcaagcagacaagtgagtatcttcgttacgaagataccctgctactggaagaccaacctactggtgagaatgagatggtgataatgcgacccggcaataaatatgagtataaattcggctttgagttaccccagggcccgctaggcacttcttttaagggtaaatatggatgtgtggactattgggttaaagctttcctggatagaccatcacaaccaactcaggagactaaaaagaatttcgaagtagttgacctagtcgacgtgaatacacctgatctcatggcaccagtgtcagcaaaaaaggagaaaaaagtctcttgcatgttcatccccgacgggagggtgagcgtgtcagccaggatcgacaggaaggggttttgcgagggcgatgaaatctccattcatgctgattttgaaaacacttgctctcgaatagtggtacctaaagcggccatcgtggctcgacatacctacctggcgaacggccagaccaaggttctgacacagaaactgtcatccgtacggggaaatcatataatttcaggcacctgtgccagttggcgcgggaaaagcctgcgagtgcagaagatccgcccctctatcctgggctgtaatatcctacgcgtcgagtatagccttcttatttacgtcagcgtaccaggtagcaaaaaggtcatcttagacctgcctcttgtcatcggctcacgctctgggctcagttctaggacttccagtatggcttctcggacctcctcagagatgtcgtgggtcgatctgaacatccccgacactccagaggctcctccatgttacatggacgtcattccagaagatcataggttggaaagtcccaccacaccgctacttgatgatatggacgggagccaggattccccgatcttcatgtacgctcccgagttcaagtttatgcctccaccaacgtataccgaagttgatccttgtattctaaacaataacgtccagtag

SEQ ID NO: 17632 - DNA, 1494 bp, Artificial Sequence
  Description of Artificial Sequence: Synthetic coding sequence
atgaatgggcccgaggatttgcctaaaagttacgattacgacttgatcatcatcgggggtggatccggaggcctggcggccgccaaggaggcagcccaatacggcaagaaagtgatggtgttggactttgtcacgccaacccccttgggcacccgttggggcctgggggggacatgcgtgaacgtgggctgcattccaaagaaactgatgcaccaggctgccttgctcgggcaggcactgcaagattcacgcaactatggatggaaagtagaggagactgtgaagcatgactgggatcggatgattgaggctgttcagaaccacatagggtccctcaactggggctatcgggtcgcactgcgcgagaaaaaggtggtgtatgagaatgcttacgggcagttcatcggccctcacagaatcaaagcaactaacaacaagggtaaagaaaagatttatagtgcggaaagatttttgatcgcgacaggggagcgacccagatatttgggtatccccggagacaaagagtattgcatttcaagcgacgacttattctctttgccgtactgtcctggcaagaccctggtagtcggagcgagttatgtggccttggaatgcgccggatttctggctggcattggcttggacgtaaccgtgatggtgcgctccattttgctgagaggcttcgatcaggacatggctaataaaattggggaacatatggaggagcatggtattaagttcatcaggcagtttgtgcccatcaaagtggagcagatcgaggcaggcacccctgggcgactgagggtggtggcacagagtaccaattctgaggagatcattgagggcgagtacaataccgtaatgcttgccatcggtagagacgcatgcacacggaaaattgggctggaaaccgtgggcgtaaaaatcaatgaaaaaactggaaaaatcccagtgacagacgaggagcaaaccaacgttccttacatttacgctatcggggacatcctcgaagataaagtagagctgactcctgtcgcaatccaggcgggccggctcttggcccaaagactgtatgcagggtctacagtgaagtgtgactacgagaacgtacctaccacggtctttacgcctctcgagtacggggcctgtgggctcagcgaggaaaaggccgttgagaagttcggcgaagagaacattgaggtttaccactcctacttctggccgctggagtggaccatacccagtagagacaataacaaatgctatgctaagataatctgtaacactaaagacaatgagagagtggtcggcttccacgtgctcggcccaaacgctggagaagtcactcaaggctttgctgccgccctcaagtgcggcttgacaaaaaagcagctcgatagcacgatcggcatccatccggtgtgtgctgaagtctttacaaccctgtccgtcaccaaacggtctggggcatcaatcctgcaagccgggtgttag

SEQ ID NO: 17633 - DNA, 1746 bp, Artificial Sequence
  Description of Artificial Sequence: Synthetic coding sequence
atgcaacaagtgatgctgacttgcaaaggagtgaatagaggtcacgctgtgcccgctggcccaggtcgaaagcctcggcccagaaggtcttcgcgactgctagcaggcgaaaaacatctaacacgaagcgctttacttctgtgtcatacagaggacggcagagccttagaggggacgctgagcgagctcgccgccgagaccgacctccccgtcgttttcgtgaagcagcgcaaaatcggcgggcacggtccaaccttgaaagcgtaccaggaaggtagattgcaaaagttgctgaaaatgaatggacctgaggatttacctaaatcttatgattacgatttgataatcataggcgggggatccggtgggctcgctgcggctaaggaggccgcccagtacggcaaaaaggtgatggtgctggattttgtgacaccaacacctttgggcacccgctgggggctcggtggcacctgtgttaatgtaggctgtatccccaaaaaattgatgcatcaggcggccctgctaggacaggctttgcaggacagtcgaaactacggttggaaggtagaggaaacagttaagcacgattgggatagaatgatcgaagcagtccagaatcatattgggagcctgaactggggatatcgcgtggctttgagagagaaaaaagtggtatatgagaatgcatatggacagtttattggaccacatcgaatcaaagcaaccaacaacaagggcaaggaaaaaatatatagtgcagaacggttcctaattgccacaggcgaacggcctagataccttggtatccctggtgataaggagtattgcatctcaagtgatgacctattcagcttaccatactgtcctggaaaaactttagtagtgggggcttcatacgtggcacttgagtgcgccggattcctcgccgggatcgggctagacgtgaccgtgatggtgcgatctattcttttgcggggcttcgatcaggatatggcaaacaaaatcggtgagcacatggaagaacacggcatcaagttcatccgccagttcgtgcctatcaaggtcgagcaaatcgaggctggtacgcccggcagacttagagtggtagcacagagtacaaacagtgaggagatcatcgagggcgaatacaacacggttatgctggcgatcggcagggacgcctgcacccgcaagatcgggctggagactgttggggtcaaaatcaatgaaaaaacgggcaaaattccagtaacagatgaggagcaaaccaacgtgccttacatttatgccattggagatattctcgaggacaaagttgagctcactccagttgccattcaggccggccgactcttagcacagaggctgtacgctggatcaacagtgaagtgcgactatgaaaatgttcccaccaccgtgttcaccccgctggaatacggcgcttgtgggctctccgaagagaaggcggtggagaaatttggagaggaaaacatcgaagtttatcactcgtatttttggcctttggaatggacgatacccagccgtgacaataacaaatgctacgcgaagattatctgcaacacaaaggacaacgagagagtggtaggattccacgtgctcggcccaaacgctggcgaggtgacccaaggtttcgccgcagcgctgaagtgtggccttaccaagaagcagctcgattctacaatcggaattcacccggtctgcgccgagtttttttccttcatatag

SEQ ID NO: 17634 - DNA, 1650 bp, Artificial Sequence
  Description of Artificial Sequence: Synthetic coding sequence
atgtcctgcgaagacggacgcgcgcttgagggaaccctaagtgagctcgcagcagagaccgaccttcctgtggttttcgtgaagcagcgcaaaataggaggccatggccccaccctgaaagcataccaggagggaagactgcaaaagttattgaaaatgaacgggccagaggaccttcccaaatcatacgattacgatcttatcatcattgggggaggaagtggtggactggcagctgccaaggaagctgctcagtacggcaaaaaggttatggtattagatttcgttactcccactccgctggggacccgttggggtctgggcggcacctgtgtgaacgttggatgcattcccaagaagctgatgcaccaggcggctttgttgggtcaggcgctgcaggactcgcgcaattacggctggaaagtggaggagacagttaagcacgattgggaccgcatgattgaagccgttcagaatcatattggttccttgaactgggggtatcgggtggccctgcgcgaaaaaaaggttgtatacgaaaatgcttacggccagttcatcggtccccatcgaattaaagccacaaacaataaaggaaaagagaagatttattctgcagagcggtttttgattgctaccggggagaggcctagatatctgggtattcctggagacaaggagtattgtatcagctctgacgacctgttttcattgccttactgccctggcaagacacttgtcgtgggcgcatcctatgtggccctggagtgcgctggcttcctggcgggtatcgggttggacgtgacggtgatggtccggagcatactgctccgcggctttgaccaggacatggctaataagatcggagagcacatggaggagcatggcatcaagtttattcggcagtttgtgcctatcaaagtggaacagattgaggctggcacaccagggcggctgagagttgtggcccagtctaccaactcggaagaaatcattgagggagagtataatacagtgatgcttgcaattggtagagacgcttgcacgagaaagatcggccttgagactgtcggggtaaagatcaatgagaaaaccggaaagattcctgtaacagatgaagagcaaacgaacgtcccttacatctatgcaattggcgacatccttgaagataaagtcgagctcactccagtggccatccaagcaggtagattactggctcaacggctgtacgcgggctctaccgttaagtgtgattacgagaatgtgccaacaactgtttttacacccttagaatacggcgcatgtggactatcagaagaaaaggccgtggaaaaattcggcgaggagaatattgaagtttatcattcttacttctggcctctggagtggaccattcccagccgcgacaacaacaaatgctacgcgaagatcatttgcaatactaaggacaatgagcgggtggtaggcttccacgtgttgggtcccaacgctggtgaggttacacaagggtttgctgccgccctgaagtgtggtctcaccaagaaacagcttgacagcactattggcattcacccagtgtgcgccgaagtcttcacaaccttgtctgtcacaaagaggtccggcgcttcaattctgcaggccggttgctag

SEQ ID NO: 17635 - DNA, 1626 bp, Artificial Sequence
  Description of Artificial Sequence: Synthetic coding sequence
atgcttagtcggctcgtccttaactcctgggcccaagccattattcgcccgcgtcctcccaaggtgttgggcctgcaggtcactacctttagcgaggcctaccaggagggcaggctccagaagttactcaagatgaatgggcctgaagatctccccaagtcttatgattacgacctgattattatcggtggcggatcaggcgggttagctgccgccaaggaagctgcacagtatgggaaaaaagttatggtccttgactttgtaacacccacacctctcggcactagatggggactggggggcacttgtgttaatgtggggtgcattcccaagaagctgatgcaccaggcagcgctgctgggtcaggccctgcaggatagccggaactacgggtggaaggtcgaggaaaccgtgaaacacgactgggatcgcatgatcgaggccgtccagaatcacattggcagccttaactggggataccgcgtggcattacgcgaaaaaaaagttgtttacgagaacgcgtacgggcagttcatagggcctcatcgcatcaaggcgacgaataataaggggaaagagaagatctactctgctgagagattcctgatagccaccggcgagcgtccccggtatctagggattccaggagataaggaatattgcatctcatcagacgatctcttttccttgccatattgccctgggaaaaccctagtggtcggggcaagctacgtcgccttggaatgtgcaggattcctcgctggcattggccttgacgtgactgtgatggtccgaagcatactactaagaggcttcgatcaggatatggccaacaagatcggagagcacatggaggagcatggtattaagttcatcaggcagtttgtcccaataaaagtggaacagattgaagctgggacaccaggacgcctcagagtggttgctcagtctaccaacagcgaggagatcattgagggagagtataacacggtgatgcttgcaatcggaagagacgcatgcactcgcaaaattggactggagacagtgggcgtgaagataaatgaaaagaccgggaaaatccctgtcaccgacgaggaacagaccaatgtaccatacatttacgctataggggatatcctggaggataaggtggagctcactcctgtagccatacaggctgggcgcttacttgcccaaaggttgtatgctggctctaccgtaaagtgtgactacgagaacgtgcccaccacagtatttaccccactcgaatacggtgcctgtggcctgagcgaggagaaagcagttgagaagtttggcgaggagaacatagaagtgtatcacagttacttctggcccctggagtggacaatcccatccagggacaataacaagtgctacgccaaaatcatttgtaacacaaaggacaacgagcgggttgtggggttccacgttctggggcctaatgctggcgaggttacccagggtttcgccgctgctctgaagtgcggacttactaagaagcagcttgattctacaataggcatccaccctgtctgcgcggaggtgtttacgacattgagcgtcaccaagagatcaggcgctagcattcttcaagcaggatgctag

SEQ ID NO: 17636 - DNA, 1839 bp, Artificial Sequence
  Description of Artificial Sequence: Synthetic coding sequence
atgccagtcgacgactattggctctgcctcccagcctcctgtgccagaccgttcgtccaaaccgtcagggttgtgcaatcttgtccccactgctgttggtttcccggcgttctgccatcagtccccgaacctttacgcatgccagcaatgctgcctaccggttcccacagcgctgtgctgccaccctcacactgctctaccgctcctccctctactagccaggaaccatcctccagtgccgatccaaaactgtgcctgagccctcctacaagcgattcacgccaagagcggaacgtgcaattcggactagcttaccaggagggccggctgcaaaaattattaaagatgaatggacctgaggatctgcccaaatcttatgactatgatctcattatcattggagggggctctggggggctagctgccgccaaagaggcagcccagtacggcaaaaaggtcatggttttggattttgtaacgcccacacccttaggcacacgatggggcctgggcgggacgtgcgtgaatgtgggctgtattcccaaaaagctcatgcaccaggccgcactgcttgggcaggccttgcaagatagccgcaattatggttggaaggtcgaggaaacagtgaaacatgattgggaccgaatgattgaagcggtgcaaaatcatatcggtagccttaactgggggtaccgtgtcgccctcagggagaaaaaagtagtgtatgaaaatgcttatggccaatttattgggccgcacaggataaaagcgaccaataataagggcaaggagaagatctatagtgctgaaagattcctaattgcaaccggagagcggcctaggtacctgggaatccccggcgacaaggagtactgtatctcctcagacgacttgttttctcttccgtactgtccaggcaaaaccctcgtcgtcggagcgtcatatgtggcccttgaatgtgctggttttctggccggcatcggactggacgtcaccgtcatggtgcggtcaatcctgttgcgtggatttgatcaagacatggcaaacaagatcggtgagcatatggaagaacacggcattaagttcataagacaattcgtgcccatcaaagttgagcagatcgaggccgggaccccaggacgactgcgagttgtggctcagagcactaactctgaggagattattgagggggagtataataccgtcatgttggccatcggtagagatgcttgcacgaggaaaatagggctggagactgtgggcgtcaagattaacgaaaaaactggaaaaatcccggtcactgatgaagaacagactaacgtcccctatatctatgccataggcgacattctggaggacaaagtagaacttacgcctgtggctattcaagctggcaggttacttgcacagagactgtatgctgggagcaccgtgaagtgcgattatgaaaacgtgcccactaccgtgtttaccccactggagtatggggcatgcggtctgtctgaagagaaggcagtcgaaaagtttggggaggagaatatcgaagtatatcattcttatttctggccacttgaatggacaataccctccagggacaacaataagtgctatgcgaaaataatatgcaacactaaggataacgagagggtggtgggctttcatgttctgggacctaatgccggggaagtgactcaggggttcgccgccgcactcaagtgcgggcttaccaaaaagcaactcgatagcactatcgggatccacccagtgtgcgccgaggtttttaccaccctctcggtaacaaagcggagcggagcaagtatcctccaggcaggctgttag

SEQ ID NO: 17637 - DNA, 1944 bp, Artificial Sequence
  Description of Artificial Sequence: Synthetic coding sequence
atggggtgtgcagaaggcaaggctgttgcggccgccgcgccaactgagcttcaaactaaaggtaagaacggagacggcaggcggcgtagcgctaaggaccaccacccaggcaagacgcttcccgagaaccccgccggatttacgtcaaccgcgaccgccgactcgcgggcccttctacaggcctatatcgatggacattccgtggtgatcttcagtaggagcacttgcactcggtgtaccgaagtgaagaagctttttaagtccctctgcgttccctactttgtcttggaattggaccaaactgaggacggtagagcattagaggggactttatccgagctggcagcagagacagatctccctgtggtgtttgtcaagcagcggaaaatcggaggtcatgggcccacgctgaaagcctaccaggagggccgccttcagaaactcctgaaaatgaacgggcctgaggacctgcctaagtcttatgactacgacttgatcataattggaggcggctccggcggcctggccgctgcaaaggaggccgcacagtacggcaagaaggtgatggtgcttgactttgtcacccctacaccactgggtaccaggtggggcttggggggtacctgcgtgaatgtggggtgcatccccaaaaaactcatgcaccaggccgccttgttggggcaggctctccaggacagcagaaactatgggtggaaagtagaagagacagtgaagcacgactgggatcgcatgatcgaggcggttcagaatcatatcggatccctgaattgggggtacagagtggctcttcgcgaaaagaaagtggtgtatgagaacgcctacggccaattcataggtcctcatcgaattaaagccaccaacaacaagggcaaagaaaagatctacagtgcagaacgctttttaattgccaccggggaacgacccaggtacctcggcattccgggggataaggagtattgtatttccagcgacgatttgtttagtctaccatactgtccgggaaagacgctggtcgtcggggcatcctatgtcgctttagagtgcgctggtttcttagccgggatcgggttagatgtaacggtcatggttcggagtattctgcttagagggtttgatcaagacatggccaacaaaattggagaacacatggaagagcacggaatcaagtttattagacagttcgtacccataaaagttgaacagatagaagccggaacccctggaaggttgcgggtggtcgctcagagtacaaactccgaggagattatcgagggggaatataacaccgtgatgcttgccataggtcgggacgcttgcacccggaagatcggcctcgaaaccgtgggcgtcaagataaatgagaagacaggcaagatcccagttaccgacgaggagcaaaccaatgttccatacatatatgctataggcgacatactcgaagataaggtggagcttaccccggtagctattcaagcaggccggctgctagcacaacgcctgtatgccgggtcgacagtcaagtgtgattacgaaaatgtccctaccactgtgttcactccgctggagtatggggcctgcggtctgtccgaggaaaaggccgttgagaaattcggggaggaaaacatagaggtctatcactcctatttctggccccttgagtggactatcccgtcgagggacaataataagtgctacgccaagattatttgcaacacaaaggataatgagcgtgtggtggggttccatgtgctggggccaaatgctggagaggtgacccagggcttcgcagccgccctgaaatgcgggctcaccaaaaagcagctggattcgacaataggaattcatcccgtctgcgccgaggtatttacaacgctcagcgtcaccaagcggtctggggcatctatattgcaggctggctgctag

SEQ ID NO: 17638 - DNA, 1500 bp, Artificial Sequence
  Description of Artificial Sequence: Synthetic coding sequence
  Description of Combined DNA/RNA Molecule: Synthetic coding sequence
atgaatggaccggaagatcttcctaaaagctacgactacgacttgattatcataggcggcggtagcggggggctcgccgcagcaaaggaggccgcacagtacggaaagaaggtgatggtactggactttgtcacccccacgcccttagggacacgctggggcctcggtgggacatgcgttaacgtgggatgcattccaaagaaattaatgcatcaggccgcgctgctgggacaggctcttcaggactccagaaactatgggtggaaggtcgaagaaaccgtgaagcacgattgggaccggatgatcgaagccgtgcagaatcatattggatcattgaattggggctacagagtggcacttagggaaaagaaggtcgtctacgagaatgcttacggacagttcatcgggccgcaccgcataaaggcaacaaacaataagggaaaagagaaaatctattcagcagaaagattcctgatagctacgggcgagagacctcgatatcttggaatcccaggtgataaggagtactgcatctcctcagacgacctgttcagtctcccatattgtccgggtaagaccttggtcgttggtgcctcatacgtggcattggaatgcgcaggcttcctagctggaatcggactcgacgttactgttatggtcagatctattctgttacgaggcttcgaccaggacatggcaaataaaatcggtgaacacatggaagagcacggcattaagttcatcagacagttcgtgccaatcaaagtcgagcagatagaggccgggacccccggtcgcctacgggttgtggctcagtcaaccaattccgaagagatcattgaaggagagtataacacagttatgttggctataggcagggacgcctgcacaagaaaaattggtctcgagacagtaggagtgaagattaacgagaagacaggtaaaatccccgtgactgacgaagagcaaacaaatgtgccctatatctatgccattggagacatcctggaggacaaggtggagctgacacctgttgccatccaggcaggcaggttgcttgctcagcgcttgtacgcgggctctaccgttaagtgtgactatgaaaacgtccccacaaccgtcttcacgccgctggagtatggtgcatgcgggctgagcgaggaaaaggcagttgagaagtttggtgaagaaaacattgaggtgtaccatagctacttctggcctctggaatggactatcccctccagggataataacaagtgctacgcgaagataatctgcaacaccaaggataatgagcgagtcgtgggattccatgtgctcggcccaaacgccggagaagtgactcaggggtttgcagccgcactgaagtgtggcctcaccaaaaagcagttggattccaccatcggcattcatcctgtatgtgccgaagtgtttactactttgagcgtaacaaaaagatcgggcgcttcgatccttcaggccgggtgtugagggtag

SEQ ID NO: 17639 - DNA, 1500 bp, Artificial Sequence
  Description of Artificial Sequence: Synthetic coding sequence
  Description of Combined DNA/RNA Molecule: Synthetic coding sequence
atgaacggaccagaggaccttcccaaaagctatgactacgatctgatcattattggaggtggaagcgggggactcgcggctgccaaagaggcagcccagtatggcaagaaagtgatggtcctggacttcgttacacctacacctctgggtacacgatgggggttaggcggcacgtgcgttaatgtgggatgtattccgaagaagctaatgcaccaggccgccttgctcgggcaggcattacaagactcaaggaactatggatggaaggtcgaggaaactgtaaagcacgactgggacaggatgatagaagctgtccagaaccacatcggttccttaaattgggggtaccgagtggccctgagagagaagaaagtggtttatgaaaacgcatatggacagtttattggaccccaccgcatcaaagctacgaataataagggcaaggagaagatctactcggcagaaagattcctaatcgccactggcgagaggcctcgctatctaggcattccaggggacaaagaatattgtatctcctcggatgaccttttctctctcccttattgtcccggtaaaaccctcgtggtgggagcatcctacgtggctcttgagtgcgccggattcctggctggcattggtctggacgtgacggtaatggtgagaagtattctactgagagggttcgatcaggacatggcgaacaagattggagagcatatggaggaacacggcatcaaatttattagacaattcgtgcctattaaggtcgagcagattgaagctgggaccccaggccgccttcgggtggtggcccagtccaccaatagtgaggaaataatcgagggtgaatataatacagtgatgctcgcaattggccgggacgcatgcactagaaaaatcggcctggaaaccgtcggggtgaaaatcaatgagaagactggaaaaatcccagtgacggatgaagagcaaactaacgtcccatacatttatgcgataggcgatattctggaggataaagtcgaattaacccctgtggccattcaggctggcagattgttggcccagcggttgtacgccggcagcacagtaaagtgtgattacgaaaacgtgcctaccaccgtgtttacacctctggaatacggggcttgtggcctgagtgaggagaaagctgtggaaaaattcggagaggagaatattgaagtctaccatagttacttttggccattggaatggaccatcccctctagagacaataataagtgttatgcaaagattatttgcaacacaaaagataatgagcgtgtggtaggctttcacgtcctcggaccaaacgcaggcgaagtcacccagggattcgccgccgcactaaaatgcggccttaccaagaagcagctggacagcacaatagggattcatccagtctgcgctgaagtgtttaccaccctgtccgttacgaaacggtcgggggccagtatactgcaggcggggtgcugagggtag

SEQ ID NO: 17640 - DNA, 1950 bp, Artificial Sequence
  Description of Artificial Sequence: Synthetic coding sequence
  Description of Combined DNA/RNA Molecule: Synthetic coding sequence
atggggtgcgcagagggcaaggccgttgcggccgcagcgcccaccgagctgcagactaagggcaaaaacggagacgggagacggcggtcagctaaggatcaccatccggggaaaacgttgccagagaaccccgctggatttacctccacagcgacggccgattcacgcgccttgttacaggcgtatattgatggacattctgtggttatattctcaagatccacctgtacgcgctgcaccgaagtcaagaagctcttcaagagcctctgcgttccttatttcgtactggagctagatcagacagaagatggtagagcactcgagggaacgctctccgagctggccgcagaaaccgatctgcctgtcgtgttcgttaagcaaaggaaaatcggaggccatggccctacactcaaagcctatcaagaagggaggctccagaagctgttgaagatgaatggcccagaagatctgcctaaatcatacgattacgacctgattattatcgggggtggttccggcggcctggctgcagccaaagaagccgctcaatacggcaaaaaggtaatggtactggattttgtcacccccaccccattagggacccgctggggcctcggaggaacttgtgttaatgtgggatgtataccgaagaaactgatgcatcaagccgccctccttggacaggctcttcaagattcccgaaattacggatggaaggttgaggagactgtgaaacatgactgggacagaatgatagaagcagtccagaatcacatcggatctctgaattggggctacagggtcgccctccgagaaaagaaagttgtgtatgagaacgcatacggacagtttatcggacctcacaggattaaagccactaacaacaaaggcaaagagaaaatttatagcgcagagcgattcctaatcgctactggtgagagacccagatatctgggcatacccggcgacaaggagtattgcatctccagcgacgacctgttctctctgccttactgccccggaaagacactagtggtgggagcctcctacgtggccctggagtgcgccggttttctggccggtatcggactagacgtgaccgtcatggtgcgctcaatcctgctgaggggatttgaccaggatatggctaacaagatcggtgagcatatggaggagcatggaattaaatttattcggcagtttgtcccaattaaggtggagcagattgaggcgggtactccgggccgtctgcgcgtggtcgcccaaagcactaactctgaagagataatcgagggtgaatacaacaccgtcatgctcgctataggcagggacgcgtgcacccgaaaaattggactcgaaacggtgggcgtgaagattaatgagaaaacaggcaagatccccgtaacagacgaagagcaaacaaatgtgccttacatttacgctataggagacattctggaggacaaggttgagctcactccggtggcgatccaggcgggaagactccttgcccagaggctttacgctggatccaccgtaaaatgcgattacgagaacgtgcccaccaccgtctttacacctctagagtacggagcttgcggcctctccgaagagaaagccgttgaaaagtttggggaggagaacatcgaagtgtaccactcttacttctggccccttgagtggactattccctcacgcgataataataaatgctatgcgaaaattatctgcaacaccaaagacaatgagcgtgtggtcgggtttcatgtgttggggccaaacgccggagaggtgacgcaagggttcgctgctgcactgaagtgcgggctaactaaaaagcagttagattccacaatcggaatacatccagtttgtgctgaggtgtttactacattatccgtgacgaagagatcgggggccagtatcctgcaggctggctgtugaggatag

SEQ ID NO: 17641 - DNA, 213 bp, Artificial Sequence
  Description of Artificial Sequence: Synthetic coding sequence
atgaacggcccagaggacttgccaaaatcttatgattacgatctcatcataataggtggaggttctggggggcttgccgcagccaaggaagccgcccaatatggcaaaaaagtgatggtgctggactttgttacacccacacctctgggtactcggtggggactcggcggaacttgtgtgaacgtcggctgcatcccgaagaagttgatgtag

SEQ ID NO: 17642 - DNA, 1632 bp, Artificial Sequence
  Description of Artificial Sequence: Synthetic coding sequence
  Description of Combined DNA/RNA Molecule: Synthetic coding sequence
atgctgtcccggttggtgctcaatagctgggcccaggccatcattcgcccccgtcccccaaaagtgctcggactgcaggttacaacatttagcgaggcataccaggaaggcaggctacagaagcttctgaagatgaatggaccagaggaccttcctaaatcttacgactatgacctcattattattgggggaggttcagggggacttgctgccgcaaaggaagcagcgcaatacggtaagaaggtgatggtgctcgactttgtcacacccaccccactggggacacgttggggcctgggggggacctgtgtcaacgtcggatgtattcctaaaaagctgatgcatcaggcagccctgctaggtcaggctctgcaggattcacgcaactacgggtggaaagtggaggaaaccgttaagcatgactgggaccggatgattgaggcagttcagaaccacatagggtcccttaattggggctaccgagtggccctgcgtgaaaaaaaggtggtgtatgagaatgcctatggccagttcatcggccctcataggatcaaggccacaaacaataaggggaaggaaaagatctactccgctgagaggttcctgatcgcaaccggggaaaggccgaggtacctgggtatccctggagataaagaatactgtataagttccgatgacctgttttctctgccgtactgccccggcaaaaccctggtcgtgggtgcctcctacgtggccctggaatgcgctgggtttctcgcagggatcggactggacgtcaccgtgatggttcgctctatcttgctgcggggattcgaccaagacatggctaataaaataggggagcacatggaggagcacggcataaagttcattcgtcaatttgtccctattaaagttgaacagatcgaggctggtacaccaggtaggctgcgtgtcgtagctcagtctacgaattccgaagaaatcatcgagggggagtacaatacagtgatgcttgctatcggacgcgatgcctgtaccaggaaaatcggccttgaaactgtgggcgtgaagatcaatgaaaagacagggaagatccccgtcaccgatgaagagcagactaatgtgccttatatttacgctatcggcgacatcctggaagacaaggtcgagctgactcccgttgccatacaggccggtagactgttggctcagagactgtacgcaggttcaaccgtgaagtgcgattacgagaatgtaccaacgacagtgtttactcccctggaatacggcgcgtgcgggctgtccgaggaaaaggcggtggagaagttcggggaagagaatatcgaggtgtaccacagttacttctggcccctggaatggactattccctcccgagacaataacaagtgctacgcaaaaattatctgcaacaccaaagataatgagagagttgtcggttttcatgtgttagggcctaatgctggagaggtaacacagggcttcgcagccgcacttaagtgcgggctaactaaaaagcagcttgactcaaccatcgggatccaccctgtatgcgcagaggtcttcactacactttcagtcactaagcgctccggggcatccatattgcaggccggatgtugaggttag

SEQ ID NO: 17643 - DNA, 315 bp, Artificial Sequence
  Description of Artificial Sequence: Synthetic coding sequence
atgaatggacccgaggatctgcctaagtcttacgactacgacctgatcattattggcggcggctcgggaggcctcgcggcagccaaggaggccgcacagtacggaaaaaaagtaatggtgctagactttgtaacacctaccccactgggtacgcgatggggcctagggggaacatgtgttaacgtgggttgcattccaaagaaactgatgcatcaggccgctcttctggggcaggccttacaggattcccggaactacggttggaaggtcgaagagactgtgaaacacgactgggacaggatgattgaagcctag

SEQ ID NO: 17644 - DNA, 1656 bp, Artificial Sequence
  Description of Artificial Sequence: Synthetic coding sequence
  Description of Combined DNA/RNA Molecule: Synthetic coding sequence
atgtcgtgcgaagacggccgggccctcgaagggacacttagtgagcttgccgccgagactgacctgcctgtggtgttcgtcaaacagcgcaaaattggaggacatggccccaccttgaaagcctaccaagaggggcgattgcaaaaactgcttaaaatgaacggccctgaagacctgcccaagtcttacgattacgacttgataatcattgggggcggctctggcgggctagcagcagcaaaagaggccgcacaatatggcaaaaaggttatggtcctggactttgtaacccccaccccattggggacccgctgggggctcgggggaacctgtgttaatgtgggctgtattccaaaaaaattgatgcaccaggccgccctgttgggacaggcgctgcaagacagccggaactatggctggaaggttgaggagacagttaaacatgattgggaccgcatgattgaggctgtgcagaaccacattggctctctgaactgggggtatagagtagccctgcgggagaagaaggtcgtctatgaaaatgcctatggccaatttatcggaccccacagaatcaaagccaccaataacaaaggaaaagaaaagatttactccgcagagaggttcctcatcgccaccggggagaggcccaggtatttggggatcccgggtgacaaggagtattgtatttccagcgatgacctcttcagcctgccctactgtccaggaaagaccctagtggtcggcgcctcgtacgtggcactggagtgcgccggtttcctcgcggggatcgggcttgacgtgactgtcatggtcaggagcatacttcttagaggatttgaccaagatatggctaacaaaattggggagcatatggaggagcatgggattaaatttatccgccagtttgtgcctatcaaggtggagcaaatagaagccggtacccctggccggcttagggtagtcgctcagtcaaccaactctgaagagattattgagggcgaatataacacagtgatgttagcaatcggtcgagatgcttgtacaaggaagatcggactcgagacagtgggtgtgaaaattaacgagaagacaggcaaaattccagtgaccgatgaggagcagacaaatgtcccgtacatttatgcaatcggcgatatcctcgaggacaaagtggagttgacacctgtagctatccaggccgggaggctcttggctcaacggctgtatgcagggagcactgtgaaatgtgactacgaaaacgtgcctacaactgtctttaccccgctggagtacggtgcctgcggactcagcgaggaaaaagctgtggagaagtttggggaagaaaacatcgaggtgtaccatagctacttttggccgctggagtggacaattccaagccgagacaataataagtgttatgccaagatcatctgcaacactaaagacaatgaacgtgtggtagggtttcacgtgctggggcctaatgctggtgaggtcactcagggattcgcagccgctctgaagtgtggtcttacaaaaaagcagcttgactcaaccattggaattcaccccgtgtgtgcagaagtcttcacgaccctgtccgttaccaagcgttcaggtgctagtatcctgcaggcaggatgcugagggtag

SEQ ID NO: 17645 - DNA, 1707 bp, Artificial Sequence
  Description of Artificial Sequence: Synthetic coding sequence
  Description of Combined DNA/RNA Molecule: Synthetic coding sequence
atgccagcgatgctgccaaccggctcacactcagcagtgttgccgcccagtcattgcagcacagctccaccttccacgtctcaggagcccagctcatcagctgaccctaaactctgtttgagtccgcccacaagtgactcccggcaagagcgcaatgtgcagtttggcctagcataccaggaggggagattgcagaagctgctgaagatgaatgggcctgaagatctgccgaagagctacgattacgatctgattatcataggggggggcagtggagggctggcggctgctaaggaagccgcccagtacggaaagaaagtcatggttctcgacttcgtgacacccacccccttaggaacacgctggggtctgggcgggacctgcgtgaatgtgggatgtattcccaagaagctcatgcatcaggcggcactgcttggccaggcactccaggacagccgtaactacgggtggaaagtggaggaaactgttaagcacgattgggaccggatgattgaggccgttcagaatcacatagggtctttaaattgggggtatcgcgtggctctacgagagaagaaggtggtctacgaaaacgcctacgggcagtttatcggaccccatcgaattaaagcaacaaataataagggaaaggaaaagatctatagcgccgagagatttctaattgccacaggggagcgcccacggtaccttggtatcccaggagacaaggaatattgtatctcgtcggacgatctgttctctctaccctattgcccagggaaaaccttggttgtcggtgccagctacgtggcactggagtgtgccggttttcttgcaggcataggactcgatgtcacggtgatggtgcggagcattctcctgaggggctttgaccaggatatggcgaataagattggcgagcatatggaagaacatgggattaaatttatacgccagttcgtcccaatcaaggtggaacagattgaggctggaaccccaggacgtctcagagtggtggctcagtctacaaattcagaggagattatcgagggcgaatacaacacagtaatgttagccatcggccgggatgcatgcactcgaaagatcggcctggagaccgtgggggtgaagattaacgagaaaactggcaagatcccagtgactgatgaagaacaaaccaatgtaccgtatatctacgccatcggtgatatcctcgaagataaggtggaactcactcctgtggctattcaggctggcagacttctggcccagagattgtatgcaggtagtaccgtcaagtgtgactacgagaatgtgccaacaacagtctttacacccctcgaatacggcgcctgtggcctgagcgaggagaaggccgtggaaaagtttggagaggagaatattgaggtctaccattcatatttctggccgcttgagtggactattccttctagagacaataacaagtgctacgcgaaaatcatttgcaacactaaggacaacgagcgcgtggtcgggtttcacgtgcttgggccgaacgctggcgaggtgacacaggggtttgccgcggccctgaagtgtggcctgactaaaaaacagctggactctaccattggaattcatcctgtgtgtgccgaggtgttcacgacgttgtctgtcaccaaacgaagcggcgccagcatactccaggctggttgcugaggatag

SEQ ID NO: 17646 - DNA, 528 bp, Artificial Sequence
  Description of Artificial Sequence: Synthetic coding sequence
atgaacggtccagaggaccttcctaagtcctatgactatgatcttatcattatcgggggtgggagcggagggttagctgccgccaaagaggctgcccagtacggaaagaaggtaatggtcctggactttgtgactccgacccccctgggcactcgttgggggctgggggggacctgcgtgaatgtggggtgcattccaaagaagctgatgcaccaggctgccctcctcggacaagcattgcaagattctagaaattacgggtggaaggttgaagagaccgtgaagcacgactgggatcgaatgatagaggcagttcagaatcatataggcagcttgaactggggctacagggtcgccctaagggaaaagaaggtagtgtacgaaaatgcatacggtcagtttattggcccacatcgcattaaggcaacgaataataaaggtaaggagaaaatttactcagcggaaagatttctgattgctacaggggagaggccaagatacctgggcattccaggtgacaaggaatag

SEQ ID NO: 17647 - DNA, 162 bp, Artificial Sequence
  Description of Artificial Sequence: Synthetic coding sequence
atgaatggccctgaagacttgccgaagagttatgactacgatctgatcatcataggaggggggtccggcgggttggcagcggcaaaagaggcggctcagtatggaaagaaagtgatggtcctggactttgtgactccgacacccctggggacacgatggtag

SEQ ID NO: 17648 - DNA, 219 bp, Artificial Sequence
  Description of Artificial Sequence: Synthetic coding sequence
atgaatgggcctgaggaccttcctaagagctatgattatgacctaataattataggaggcggaagtggcggcctcgctgccgctaaggaggccgcacagtatggcaagaaagtgatggtgttggatttcgtgacccctacaccacttggcacaaggtggggcctggggggcacttgcgtgaacgtcggctgtattcccaagaagcttatgcaccagtag

SEQ ID NO: 17649 - DNA, 420 bp, Artificial Sequence
  Description of Artificial Sequence: Synthetic coding sequence
atgctgtctagacttgtcctcaatagctgggcccaggcaattatcaggcctcgaccccccaaggtgctaggcttacaggtgacgacgttttcggaagcctatcaggagggccgcttacagaagcttcttaagatgaacggtccagaagaccttccaaaaagctatgattatgacctgataattattggcgggggcagcggtggcctagccgcggccaaggaagctgcacaatatggaaagaaggttatggtcctcgacttcgtgacccccaccccactgggcacaaggtggggtttaggagggacatgcgtcaacgtcgggtgcatccctaaaaagctgatgcaccaggctgctctgctcgggcaggcactacaggactctcggaactacggctggaaggtggaagagactggaatgtag

SEQ ID NO: 17650 - DNA, 1380 bp, Artificial Sequence
  Description of Artificial Sequence: Synthetic coding sequence
atggtgctggatttcgtaacccccacccctctaggcactcgttgggggttgggaggaacgtgcgtgaacgtgggctgtattcccaagaagcttatgcaccaggctgctctgctaggacaggcactgcaggacagccggaactacggctggaaggtagaagagactgtgaaacacgactgggaccgtatgatcgaggctgtccagaatcacatcggcagtctgaactggggataccgcgtggctttgcgtgagaagaaggtggtgtatgagaatgcttacggccagtttataggccctcacagaatcaaagccacaaataacaagggcaaagaaaagatctactctgcagagcgtttcttaattgctactggggagcgaccgaggtatctcggtatcccaggcgacaaggagtattgcatctcctctgacgatcttttctctctgccttactgtccaggaaagaccctggtggtgggcgcatcctacgtggcccttgagtgcgcagggtttctcgccggtatcgggcttgacgtcactgtgatggtgagatccattctcctccggggcttcgaccaggatatggccaacaagataggcgaacatatggaggagcacggaattaaattcatccggcagtttgtgccgatcaaggttgagcagatcgaagctgggacgcccggacgtttaagggtggtcgcccaatccacgaactccgaggaaataatcgaaggcgaatataacactgttatgctggcgatcggcagagacgcttgcaccaggaagataggattggaaactgtaggcgttaaaataaatgagaagacagggaaaatacctgtgacagacgaggaacagacaaatgtcccttatatatacgcgatcggagacatccttgaggacaaggttgaattaaccccggttgctattcaggccggtaggctattggcccagcgcctttacgcaggctctaccgtaaaatgtgactatgaaaatgtgcctaccactgtgtttacacccctggagtatggcgcctgcggcttgagtgaagaaaaggcggtggaaaaatttggtgaggagaacattgaggtataccacagttacttttggcctctcgaatggaccatcccaagcagggacaacaacaagtgttatgccaagatcatctgcaatactaaagataacgagagagtagttggcttccacgtgctggggcccaacgcaggggaggtgacacagggtttcgccgctgcccttaagtgtggattgactaagaaacaactggactccacaataggaattcaccctgtgtgcgcagaagttttcacgaccttgtccgtgactaagcgatccggcgcgagcattctgcaagctgggtgttag

SEQ ID NO: 17651 - DNA, 1644 bp, Artificial Sequence
  Description of Artificial Sequence: Synthetic coding sequence
atggaggatgggcgcgccctagagggtaccctgtccgagcttgcagccgagaccgacctgcctgtcgtcttcgtcaagcagcgcaaaattggcggacacggtccaacattgaaagcttaccaggaaggacgccttcagaagctgctgaagatgaatggacctgaggacttgccaaagagctacgactacgaccttatcattattgggggaggttcagggggcttggcagcggctaaggaggcagcgcagtacggaaagaaggtgatggtgctggattttgtgacccccacgcctctcgggacacgttgggggttaggaggaacctgtgtcaacgtggggtgtattcctaaaaagctgatgcatcaggccgccctattaggccaggcgctgcaagatagccgcaactatggctggaaggtcgaagaaacagtgaaacatgactgggatagaatgatagaggctgtgcagaatcatatcgggtctctgaattgggggtaccgggtggccttgagagaaaaaaaggtcgtgtatgaaaacgcctacgggcaattcatcggaccccaccgaatcaaagctactaacaacaaaggcaaggagaaaatttacagcgctgagaggttcttgattgccactggcgagcggccgaggtatcttgggatccctggggacaaggagtactgtatctcatccgacgatctcttttcccttccctactgtccaggaaaaaccttggtggttggcgccagttatgttgcccttgaatgtgctgggttcctggccggaattggactcgacgtgacggtgatggtccggtcaatcctgctgcggggttttgaccaggatatggctaacaagataggcgagcatatggaagagcatggcattaagttcattcggcagtttgtgccaatcaaagtcgaacaaatcgaagcaggtacacccggacgcctgcgcgtagtcgcgcagtcaaccaactccgaagagataatagaaggggaatacaatactgtgatgttggcaatcggtcgcgacgcttgcacccgtaagattggcttagagacagtgggggtgaagatcaacgagaagacaggaaaaattccagtcactgacgaggaacagaccaatgtgccatacatctacgccattggcgatatcctcgaggataaggttgagttgacgcctgtggcaatccaggccggcagattactcgctcagcgactgtatgcaggtagtaccgtgaagtgtgattatgaaaacgttcctacgactgtttttacgcctctcgagtatggtgcctgcggactgtcggaggaaaaggcggtggaaaagttcggcgaggagaatattgaagtctaccattcttatttctggccacttgagtggactatcccatcgagagacaacaacaagtgctacgctaagataatatgcaacactaaggacaacgaaagagtggtcgggtttcacgtcttaggcccgaatgcaggggaggtcactcagggattcgcggccgctcttaaatgtgggttgaccaagaaacagctggattcgaccattgggatacaccccgtttgtgctgaggtcttcacaaccctatcagtgactaaacggagcggggccagcatcttgcaagctgggtgttag

SEQ ID NO: 17652 - DNA, 945 bp, Artificial Sequence
  Description of Artificial Sequence: Synthetic coding sequence
atgggctcccaagccctgccccctggaccgatgcaaacgctcattttttttgacatggaagctacaggcctgcccttctcacaaccaaaggtgacagaactgtgcctgctggcagtccacaggtgcgcactcgaatctcctcccacgagccaagggcctcctcctaccgtgccaccaccacccagagtggtggacaaactgtccctgtgtgtagctccggggaaggcctgttctccagcagctagtgagatcacaggcctgtcgacagcagttttggccgcccatggtaggcagtgttttgacgacaacctagcaaatctgctgttagctttcctcagacgccaaccacagccctggtgcttagtggctcacaacggcgacagatatgattttccactgctgcaggctgagctcgctatgctcggcctgacgtctgccctcgacggcgctttctgcgtggacagcatcactgcccttaaagcgttagagcgcgcctcaagccctagcgaacacgggccccgaaagagttactcgttaggatccatctacacacggttgtatggccagagccctcccgactctcacacggcagagggtgatgtgctggcccttctgtcaatctgtcagtggcgcccacaagctctgctcagatgggttgatgcccatgccagacctttcgggaccattcggcccatgtacggagtgaccgccagcgcaaggaccaagccccgcccttccgccgtgaccacaacagcccatctggcaactaccaggaatacgtccccatcactgggcgagtctcgtggcactaaggacctacccccagtgaaggaccccggtgccctcagcagggagggcttgttagctcctctgggcctgctggctatcctaacactggccgtggcgactctgtacggactaagcctggcaacccccggcgagtag

SEQ ID NO: 17653 - DNA, 1110 bp, Artificial Sequence
  Description of Artificial Sequence: Synthetic coding sequence
atgggtccaggagctcggcgacaaggtagaatagtacaaggaaggcccgagatgtgtttctgcccccctcccacacccctgcctccactaagaatcttgaccctaggcacccacacccccaccccgtgtagctcgcccgggtctgcggctggcacttaccccaccatggggagtcaggcgttgccgcccgggcctatgcagacgctcatatttttcgatatggaggctaccggtctgcctttcagccagccaaaagtgaccgaactgtgtctgctggcagttcatcgatgcgccctagagtcccctcccacttctcaaggtccaccaccgacagtgcctccgcctcccagagtagtcgacaagttatctctgtgcgtcgctccgggaaaagcctgtagccccgcagctagcgaaattactgggctgagcactgcggtcctggctgcgcacggcagacagtgctttgatgacaatctggctaatctgctgctcgctttccttcgccgccagcctcaaccttggtgcctagtcgcacataacggagatcgctatgacttccccctgttacaggccgaactcgcgatgttagggctcaccagtgctcttgacggcgcattctgtgtcgatagcattacggccctgaaggctcttgagagagcttcatccccttccgagcacggacccagaaaatcctacagcctgggatctatttacactcgcctgtacggacagtcaccacccgattcacataccgccgaaggagatgtattggcacttctaagtatttgccagtggcgcccccaggctcttctcaggtgggtggacgcgcatgctcgcccttttggcacaatccggcccatgtatggggtaaccgctagcgcacgcacaaagccacgtccttcagcagtgaccactaccgcccacctagctacaacgagaaacaccagccccagccttggcgaaagcaggggaaccaaagacctccctcccgtcaaggacccgggagcgctcagcagagaaggacttctggcaccgttaggcctcctagcaatcttgacactagcagttgctacgctttatggccttagcttggccactcccggtgaatag

SEQ ID NO: 17654 - DNA, 528 bp, Artificial Sequence
  Description of Artificial Sequence: Synthetic coding sequence
atgctcgggttgacgagcgctctggatggagctttctgtgtggactcaatcaccgctcttaaagcgttagagagagcttccagcccaagcgagcacggcccacgtaaatcctatagcctcggaagtatctacacgcgactctacggccagagcccccctgattcacatactgctgagggagatgttctggcgctgctgagcatctgccagtggcgcccacaagccctattgcgctgggtggacgctcatgcccgcccatttgggaccatacggcctatgtacggggtgacggctagtgcaaggaccaagcccagaccctccgccgtgactacgactgctcacctggccacaaccaggaacacatctcccagccttggggagtccaggggtacaaaagacttgccacccgtgaaagacccaggcgccctgtctagggagggattgttggcgcctttgggcctgctggcaatactgaccttagcagtcgctaccctgtacggcctaagcttggcaactccgggtgagtag

SEQ ID NO: 17655 - DNA, 945 bp, Artificial Sequence
  Description of Artificial Sequence: Synthetic coding sequence
atgggctctcaggccctcccgcccggtcctatgcaaacccttatcttttttgacatggaagcgacaggcctgccatttagtcagcccaaggtgactgagctctgtttattggccgtacatcgctgcgcactggagtctcccccgacctcacaaggcccgcctcccactgtgcccccgcctccccgggttgtggataagctgtctttatgtgtcgctcccggaaaggcttgtagcccagctgccagcgagatcaccggcttatccaccgccgtcctcgccgctcatggtcgccagtgcttcgacgataatctggccaacttgttactcgctttcctgcgtcggcagccacaaccttggtgtctggtggcccacaatggtgacaggtatgacttcccgctgctgcaggcagagctagccatgctgggactgacaagcgctctggacggggccttttgtgtcgacagtatcactgcattgaaggcccttgaacgtgccagttctccaagtgaacatggccccaggaaatcgtacagccttggatctatttacactcgcctatacggacagtctccacccgatagccacaccgccgagggtgacgtgttagccctgctgagtatttgtcaatggcggccgcaggcactcctcaggtgggtggacgcccatgccagacccttcggaaccatacgccctatgtatggtgtaaccgcctctgctcggacaaagccgcgcccaagtgcagttactacgacagcccatctcgccaccacgaggaacacgtcgccatcccttggagaatctcgaggcacaaaggacttgcctccggtgaaagaccccggggcactctcaagagaaggactgctcgctcccctaggccttttagccattctgacccttgccgtggcaaccctatatgggctgtctttagcgacaccgggcgagtag

SEQ ID NO: 17656 - DNA, 915 bp, Artificial Sequence
  Description of Artificial Sequence: Synthetic coding sequence
atgcaaacactgatcttcttcgatatggaagccacggggctgcccttctctcagcccaaggttaccgagctgtgtctgctggcagtgcaccgatgtgccctggaatcccctcctacatctcaggggcctccgcccactgtgcctcctccccctcgggtggtggacaagcttagtttgtgcgtggcacctggtaaagcttgtagcccagctgcaagtgaaattacagggttgagcacagctgttctcgccgcccatggccgacagtgtttcgatgacaacttggctaatttactgctggcgtttctgaggaggcagccccaaccttggtgccttgtagcccacaacggtgataggtatgatttccctcttctccaggctgagttggctatgttgggcctcactagtgcattagatggtgccttctgtgttgattcgataaccgcactgaaagctttggagagagcctcgtccccaagcgagcacggcccgcgtaagagttattctctgggctctatatacacgcgtttgtacgggcagtctcctccagattcccacactgcagagggtgatgtgctcgctctactgtccatttgccagtggcgtcctcaggctttgctccgatgggtggatgcccatgccagaccctttggaacaatcaggccaatgtacggggtgacagcatctgcgcggacgaagcctagaccatccgccgttaccactactgcgcacctggcaaccacaagaaatacgtcacccagcttgggcgagtcaagaggtaccaaggacctgccacccgtgaaagatccaggggccctgtcccgagaaggcttgctcgccccgttggggctgctggcgatcctgactctggctgttgctactctgtacggactatccctggcaacaccaggagagtag

SEQ ID NO: 17657 - DNA, 528 bp, Artificial Sequence
  Description of Artificial Sequence: Synthetic coding sequence
atgctcgggcttacttcagccttagatggcgcattctgtgtggactcaatcaccgcgctcaaggctctcgaaagagcatcatctccatcagaacacggaccaaggaagagttactccctaggctctatttataccaggctgtatgggcagtcacctcccgactctcataccgcggaaggtgacgttctggcgctcttaagcatttgtcagtggcgcccacaggccctactgagatgggtggacgcgcacgcacgcccattcggcaccattcgacccatgtacggagtgacagcgtctgccaggactaaaccgcggccgagcgctgtcactacaacagcccatctggccactacgcggaatacatcaccgagcctcggcgagagtcgcggaacaaaagacctcccgcccgtgaaggacccaggcgcgctgagtcgggagggcctgttggctcctcttggtttgctggctatacttaccttggcagtggccacgctgtacgggctcagcttagcgacccccggggaatag

SEQ ID NO: 17658 - DNA, 3513 bp, Artificial Sequence
  Description of Artificial Sequence: Synthetic coding sequence
atgggcctggcatggggtctgggagtgctgtttttaatgcacgtttgtggaactaataggatccccgaatccggcggggacaacagcgtgtttgatatcttcgaattaacgggcgcagcgagaaaggggagtggaagacggctggtgaaagggcccgacccttcctctcccgcgttcagaatcgaagacgccaacctgatccccccagtgcctgacgacaaatttcaggacctcgttgatgctgtccgcgcggaaaaaggctttctcctgctcgctagtctgaggcagatgaaaaagacaaggggaacgctgctagcactggaaagaaaagaccactcaggccaggtattctccgtggtctcaaacgggaaggctgggacattggaccttagcctgacagtgcaggggaaacagcatgttgtttcagtcgaggaggctctgctagctacgggacagtggaagtcgatcactctgttcgtgcaggaagatagagcgcagctgtacatcgactgcgagaagatggaaaatgctgaacttgacgtgccaatccagagcgtgtttacacgggacctcgcgtctatcgctagattgcggattgctaaaggcggagttaacgataattttcagggagttttgcagaacgttagatttgtgttcggcacaacacccgaagatatccttaggaacaaaggttgctctagcagtaccagcgtgcttttaacactggataataacgtggtaaacgggtcttcccctgccattaggacgaattacataggccacaagacaaaagacctccaggccatttgtggcatctcttgtgacgagctctcgagcatggtcctggagttacgcgggttgcgtaccatcgtgacaaccttgcaagatagcataagaaaagtgactgaagaaaataaggaactcgcaaatgaactacgcagaccccctttatgctatcataacggagtccagtaccgcaataatgaagagtggaccgttgacagctgcacggagtgtcattgccagaactccgtcaccatatgcaagaaagtgagctgcccgatcatgccgtgctcaaatgctactgttcccgacggggaatgctgccctagatgttggccctccgacagcgcagatgacggctggtctccatggtccgagtggactagctgttcaacatcctgcggcaacggcatacagcagcgcggaagatcatgcgattctctgaataataggtgcgagggcagcagcgtccagacacgtacatgtcacattcaggagtgtgataaaagattcaagcaggacggtggatggtcacactggagcccgtggtcttcctgctccgtaacgtgcggagatggagtgatcacccgcattcgcctgtgtaacagcccctctccacagatgaacggaaagccttgtgagggggaagcacgggagactaaagcttgtaaaaaagacgcctgtcctattaacggggggtggggtccctggtccccctgggacatttgctccgttacctgcggcggcggcgtgcagaaacgctcaagactatgcaataacccaacgccccagtttggtgggaaagattgcgtgggtgacgtgacggaaaaccaaatctgtaataagcaggactgcccaatcgacggctgccttagcaatccctgcttcgcaggtgtgaagtgtacctcataccccgatgggagctggaaatgtggggcatgcccccctggatactcgggcaacgggatacaatgtaccgacgtcgacgaatgcaaagaagtgcctgacgcatgttttaatcacaacggagagcaccgttgcgaaaacaccgatccagggtataattgtttgccttgtcctccgcgcttcacgggatcacagccctttggacaaggcgtggaacatgctaccgctaacaaacaagtttgcaagccgcgaaacccgtgcaccgatggcacccacgactgcaataagaacgccaagtgcaactatcttggtcattactcagaccccatgtaccggtgcgaatgtaagccaggatatgccggtaatggcattatctgcggtgaagacacagacttggatggatggcctaatgaaaatctcgtctgtgtcgctaacgcgacgtaccactgtaagaaggataattgccctaacctacctaattccggccaggaggattatgataaggacggcatcggggacgcatgcgacgatgacgatgataatgataaaattcccgatgatagagacaattgccccttccactacaatcctgctcagtacgactatgaccgggacgatgtcggcgatcggtgtgataattgcccctataatcataatccagatcaggctgacacagataacaacggagaaggcgacgcctgcgccgcagatattgacggggacggtattctcaatgaaagagacaattgccagtacgtgtataatgtcgaccaacgcgataccgacatggacggcgtgggagaccagtgcgataactgccctctcgaacacaatcctgaccagctggattccgattcagatcgtatcggcgatacctgcgataacaatcaagacatagatgaagatgggcaccagaataatctggacaattgtccatatgtgcccaacgctaaccaggcagaccacgataaagacggcaaaggtgacgcttgcgaccacgatgatgacaatgacggaatccccgacgataaagacaactgtcgtttggtccccaatcccgatcagaaagactctgacggagatggaaggggcgatgcgtgtaaggacgattttgatcatgacagcgtgcccgatatcgacgacatttgtcctgagaacgtggatatcagtgaaacagatttccgccggtttcagatgattcccctcgacccaaaagggacatctcagaacgacccaaattgggtcgttaggcaccagggcaaggagcttgtgcagaccgttaactgtgaccccggactggcagtaggttacgacgaattcaacgccgtggatttttctggcacgttctttatcaataccgaacgcgatgatgactacgctggctttgtgtttggctaccagagcagtagccgattttacgtcgtgatgtggaagcaggtgactcagagctactgggacaccaatcctacaagggctcaaggctactcgggactttcagtgaaggtagttaattcaactacaggccctggcgaacacctaagaaatgcattgtggcacacaggcaatacaccaggtcaggtgagaactttgtggcatgacccccggcatattgggtggaaggattttaccgcctacagatggcggctgtcccaccgacccaagaccgggttcatcagagtggtgatgtatgagggaaagaagataatggcagattctggccccatctatgataaaacatatgccggtggcagactgggcctgttcgtgttctctcaggagatggtgttttttagcgacttgaagtacgagtgccgggatccctag

SEQ ID NO: 17659 - DNA, 285 bp, Artificial Sequence
  Description of Artificial Sequence: Synthetic coding sequence
atgggactggcctggggcctgggtgtgctatttctcatgcacgtttgcggtacgaaccggatccctgaatcaggaggagacaattctgtgtttgatatttttgaacttactggcgccgctagaaagggaagcggccgcagattagtcaagggcccggacccctcttctcccgcctttaggatcgaggatgcaaatctgatcccacccgtccccgacgataaattccaggatctggtggacgcagtgcgagcagagaaaggcttcctactactcgcatctttgtag

SEQ ID NO: 17660 - DNA, 501 bp, Artificial Sequence
  Description of Artificial Sequence: Synthetic coding sequence
atggccgccggcaatgttgtgttagtccctctcgtcaccgttgaaatggcctccagcgcccagatgctgatgagtgccaagaaatgcctaatgccggcttctacaaccatggaaagcacaggcgtacggaccagaacccccgctactacagcttgtcctgccccacacgccagtcctgctcacagcccgagcgcccgtgtctcgaatatgccaaggccaaccaatcgctgcgcttccccgatccctctgtgtctgtgtcacagagcaggctgctattgcgaggctatctccgaacagtggacacagaagcatttccaagcttgccagcgacgcgaggatagcttggagttagccaacaaaacaacactcactagctcatttagaaataccggtagcaggggccaaagcaccaagggacgtgcccacacacgcgatgattgcatgaagaagatctggcgtaactgttacatgttcggcactaagagtttctccggagactag

SEQ ID NO: 17661 - DNA, 3519 bp, Artificial Sequence
  Description of Artificial Sequence: Synthetic coding sequence
atggtgtggcggctggtgctcctcgctctgtgggtttggccctctacacaagccggtcaccaggataaagacaccacgtttgatctattcagcatctccaatattaatcgaaaaaccattggtgcaaagcagttccgggggccggatccaggtgtccctgcctacaggttcgtacgcttcgactatatcccaccagtgaacgcagacgatttgtcaaagatcactaaaattatgagacagaaagaggggtttttcctcactgcccagctgaagcaggacggcaaaagcaggggcacgttattagcgcttgagggccccggcctcagccagcgacagtttgagattgtgtcaaatgggccagctgacaccctggatctgacgtactggattgatggcacacgccatgtggtgagtcttgaggacgtggggcttgccgacagccagtggaagaatgtgactgtacaggtggccggcgaaacctacagcctccacgtgggatgcgatctgatagattccttcgcactagacgagcctttctatgagcacttgcaggccgagaagagtcggatgtacgttgctaaaggctcagcccgcgagtctcacttcagagggttactgcagaatgtccaccttgtcttcgagaattctgtggaggatatcctgtccaaaaagggctgccagcagggacagggcgccgaaataaatgctatctccgaaaacacagaaacactcaggctgggtcctcatgtgacaacggaatatgtgggaccttcctcggagaggaggcctgaggtttgcgaacgttcctgcgaagagctgggcaatatggtgcaggagctctccgggcttcacgtgctcgtgaaccagttgtcagagaacctgaaacgagtcagcaatgataaccagtttctttgggagctcattgggggacctccgaaaacgcgcaacatgtctgcttgttggcaagatgggcggttcttcgcggaaaatgagacgtgggtggtagactcgtgcactacctgcacctgtaaaaaattcaagactatatgccaccaaattacgtgcccgcctgccacctgtgcaagcccatctttcgtggaaggcgagtgttgcccttcttgtctgcacagcgtcgacggtgaggagggctggagcccgtgggcggaatggacacagtgttccgtgacatgtggcagcggtacacagcagcgaggccgctcgtgtgatgttaccagcaacacatgtttgggtccttccatacagactcgggcctgctccttatccaaatgtgatacgcggattagacaggatggcggctggtcccattggagcccatggtccagctgtagcgtgacttgtggggtcggtaacatcacccgaataagactgtgcaactcccccgttccccagatgggcggaaagaactgcaaaggctctggtagggagactaaagcctgccagggcgccccatgccccatagatggcagatggagtccctggtctccatggagcgcctgtactgttacatgcgcaggaggtattcgagagaggacccgggtctgcaacagtcccgagccacaatatggcggaaaagcatgtgtgggagatgtacaggagcggcagatgtgtaataagcggagctgtccggtcgatgggtgtctgtccaacccttgttttcccggggctcagtgttcaagctttccagacgggtcttggtcatgtggctcatgtcctgtcggtttcctggggaacgggacccactgtgaagacctggatgaatgcgcactggtccctgacatttgcttctccacgtctaaagtgcctagatgcgtgaatacgcaacctggttttcattgcttaccttgtccgccaagataccgcggcaaccagcccgtgggcgtgggcctcgaggccgccaaaaccgaaaaacaggtttgtgagccagagaacccctgtaaagataagacacataactgccacaagcatgctgaatgcatatacttggggcattttagcgaccccatgtataagtgcgaatgccagactggctacgcgggtgatggtttaatctgtggcgaagactccgatctggacggctggcctaatctcaacctggtatgtgccaccaatgccacgtatcactgcataaaggataattgcccgcacctacccaactccggtcaggaggatttcgacaaggacggcatcggcgatgcctgcgacgatgatgacgacaacgacggtgtgaccgatgagaaagataactgtcagctcctttttaatcctagacaggcagactacgacaaggatgaggtaggtgacaggtgtgataattgcccctacgtccataaccctgcccagatagataccgacaacaacggcgaaggagatgcatgtagcgtggatatcgacggagatgatgtgttcaacgagagggacaactgcccctatgtctacaatactgatcaacgcgacacagacggtgatggcgtgggggatcactgcgacaattgcccccttgtccacaaccctgaccaaaccgacgtggataacgacttggtgggagatcagtgcgacaataacgaggacattgatgacgacgggcaccagaataaccaggacaattgtccctacatttccaacgccaatcaggctgatcatgatagagacggtcaaggagatgcctgcgatcctgatgatgacaacgacggcgtaccagacgaccgggataattgtcgcttagtatttaatccagatcaggaggatctggacggcgatgggcgaggagacatctgcaaggatgatttcgataacgacaatatcccggatatcgatgatgtgtgccccgagaataacgcaatctcagaaactgattttaggaacttccaaatggtgccactcgatccgaaaggcacgactcagatagatcctaattgggttatcagacatcagggcaaggaactcgttcagaccgctaatagcgacccaggcatcgccgtgggtttcgacgagtttggctcagtggacttcagtggcacattctacgtaaacaccgaccgcgatgatgactacgcaggtttcgtgttcgggtatcagagctcaagcaggttttatgtagtgatgtggaagcaggtgacccagacatattgggaagatcagcctacacgcgcatatggttactccggggtgtctctcaaggttgtgaactcgaccactggaaccggggagcaccttcgaaacgcactatggcacactggcaacacccccgggcaagtcaggaccttgtggcacgatcccagaaacatcgggtggaaagattataccgcgtatcgttggcacctgacacaccggcctaagaccggctatatccgagtgctagttcatgagggcaagcaggtgatggcagattctggtcccatttatgaccagacctacgccggggggcgcctgggcctgtttgtgttctcgcaggaaatggtgtatttctccgatcttaagtacgagtgtcgggatatatag

SEQ ID NO: 17662 - DNA, 1293 bp, Artificial Sequence
  Description of Artificial Sequence: Synthetic coding sequence
gacgatgataatgatggggtcaccgatgagaaagataactgccagctcttgttcaatcctcgtcaggctgattacgacaaggacgaggtgggtgacaggtgcgacaactgtccttacgttcataacccagcgcaaattgacaccgataataacggtgagggggacgcttgctccgtggacatcgacggcgacgacgtgtttaacgaaagagataattgtccttacgtgtacaacaccgatcagagggatacggacggtgacggagtaggagaccactgcgataactgccctctggtgcacaaccccgatcagacggacgtcgacaacgacctagtgggcgaccaatgcgacaataacgaggatatcgacgacgacggacaccaaaataaccaagacaattgcccgtacataagtaatgcaaatcaggcggaccatgatagagatggtcagggtgacgcctgcgacccagacgatgacaacgacggagtgcccgatgaccgtgacaattgtcgcctcgtgttcaatccagatcaggaggacctcgatggcgatggaagaggggacatatgtaaagatgactttgataacgataatattccagatatcgatgatgtttgtccagaaaataacgccattagcgagaccgattttcgaaactttcagatggtgccccttgacccaaaaggcactactcagatcgacccgaattgggtcataaggcatcaaggaaaagaactcgtccagaccgcaaattcggatcctggaatcgcagtcgggttcgatgaatttggtagtgtggatttcagcggcacattttacgttaacacggatcgtgatgatgattatgccggctttgttttcggttatcagtcaagttctcgcttctatgttgtgatgtggaaacaggtaacacagacgtactgggaggaccaacccacccgggcatatggctactctggggtttctcttaaggtcgtgaacagcaccaccggcacaggggagcatcttcgtaacgctctgtggcatactgggaacacccctggccaagtgcggacactatggcatgatccaagaaacattgggtggaaagactacactgcttacagatggcatcttacccaccgaccgaagaccggctatatccgggtgttggttcacgaagggaagcaggtcatggccgattccggtcctatctacgaccagacctacgcaggtggccgcctgggactgtttgttttttcacaggaaatggtgtacttcagcgacctgaaatatgaatgtcgggtaatctag

SEQ ID NO: 17663 - DNA, 252 bp, Artificial Sequence
  Description of Artificial Sequence: Synthetic coding sequence
atggtctggcggctggttcttctggcactatgggtgtggccgagcacccaagctggacaccaggacaaggatacgactttcgacttgttttcaatcagtaacataaataggaaaacaattggtgctaagcagtttcgagggcctgaccccggcgtaccagcttatcgttttgtcaggtttgactacatcccccctgtgaatgcagatgacctgagtaaaattacgaagattatgagacagaaggaggggtag

SEQ ID NO: 17664 - DNA, 1449 bp, Artificial Sequence
  Description of Artificial Sequence: Synthetic coding sequence
atggcggcactgatgacaccagggaccggcgctcctccagctcccggggattttagtggcgaaggatcccagggtctgccggatccctcccctgagcccaagcagctgccagaactcattagaatgaagagagatggagggagactgtccgaggccgatattagaggttttgttgctgctgttgtcaacggctcggcacaaggcgcccaaattggggccatgcttatggcaatccggctccgcgggatggacctcgaggagacctccgtgctgacccaggctttagcccaaagcggacagcagcttgaatggccagaggcctggcgccaacagctcgtcgacaaacattctacagggggagtgggcgataaggtcagtctagtgttggctcctgccttggcagcatgcgggtgtaaggtcccaatgatcagcggcagaggattgggccacaccggaggtacgctggataaacttgagagcattcccggctttaatgtgattcagtctccggaacagatgcaagtgctgctcgaccaagcaggttgctgcatcgtcgggcagagcgagcagcttgttcctgctgatggcatcttgtatgcagctcgcgatgtgactgccacagtcgattctctccctttgataactgcttccatattgtctaagaaactcgtcgagggcctctctgcactggtagtcgacgtgaagttcggaggcgccgccgttttcccgaaccaggagcaggctagagaattggcgaagaccctggtcggggtgggagcctctttggggctgagagtcgccgctgctttgaccgccatggacaagccactcggccggtgcgtggggcacgcactagaggtcgaagaggccctgctctgtatggatggcgcgggcccgcccgatctccgcgacctggtgaccacactcggcggcgctctgctgtggctttcaggccacgccggcacacaggcccagggagctgcaagagtagccgccgccctggacgatggctccgcacttggcaggtttgagaggatgctggctgctcagggagtggatcccggattagcccgggctttgtgcagcggcagtccagcggaacgccggcagctgctcccgagggctagggagcaagaggaactgctcgcacctgccgatggtaccgtcgagcttgtcagagctctcccactggcgctcgtgctccatgagctgggagcaggtaggtcgcgagctggcgagccactgcgtctcggagtgggcgccgaactccttgttgacgtcggacaacgacttagaagggggaccccatggctgagagtacacagagacgggccagcactctccggccctcagtcacgggctcttcaagaagcactggtgttgagcgatagagccccctttgctgcaccctctcctttcgctgaacttgtcctgcctcctcagcagtag

SEQ ID NO: 17665 - DNA, 1449 bp, Artificial Sequence
  Description of Artificial Sequence: Synthetic coding sequence
atggctgctttaatgactcctgggactggagctccccctgccccgggagacttctctggcgaaggttcccaaggcttgcccgatccctcccccgaaccaaaacagctacccgagctaattcgtatgaagcgggatggaggtcgcctgtctgaagccgatatcaggggcttcgttgccgcagtggtgaatggcagtgctcagggagcacagatcggggccatgcttatggcgattcgactaagaggcatggatcttgaagagacaagtgttttgacacaagctctggctcaaagcggccaacagctcgaatggccggaggcatggcgccaacaactggtcgacaaacatagcaccggcggagtaggcgacaaagtgtctctcgttctagctccggcccttgcagcctgcggctgtaaggtgccaatgatatccggccgcggtctgggccacacgggcggcacattagataagctggaatctattcccggattcaatgtgattcagtcccctgaacagatgcaggtattgctggatcaagcaggttgttgcatcgtgggtcagagcgagcagctggtgcccgcggatgggatactgtacgctgctcgggacgtcacagcaacggttgacagcctaccactgatcactgctagtatattgtctaagaaacttgtggagggcctgagtgccctagtagtggacgtcaagtttggaggagctgcagttttcccaaatcaagagcaagctagagagctcgcaaagacactggtcggggttggcgcatccctgggtctgcgcgtggctgctgcacttactgccatggacaaacccctcgggaggtgcgtggggcacgctttagaggtggaggaagcgttgctgtgtatggatggcgctggcccacctgatcttcgtgatctcgtgaccactctgggcggagctctcctgtggcttagtggtcacgccggtacacaggcccaaggggcagctcgggttgcagcagccctcgatgacggttcagcacttggtcgcttcgaaaggatgctggccgctcagggcgttgaccctgggctcgctagagccctatgttcgggctcccctgccgaacggaggcagttactgccccgggctcgcgagcaggaggaactcctggcgcccgccgatggaacagtggagcttgtacgcgccctcccgttggctctggtgcttcacgagctgggggctggtcggagcagagcaggagaacctctccggctcggtgtgggtgctgagctgctggtcgacgttggtcaacggcttaggcgggggacgccttggctgcgggttcatcgagacgggcctgccctctcaggccctcaaagtcgggctctacaggaggccctggtcctcagtgatcgtgccccgttcgccgctccaagcccctttgccgagctggtgctgccacctcagcagtag

SEQ ID NO: 17666 - DNA, 1449 bp, Artificial Sequence
  Description of Artificial Sequence: Synthetic coding sequence
atggcggccttgatgacacctggcaccggagcaccgccggcaccaggagacttttcaggggaggggtctcagggcttaccagatccatcacccgagcccaagcagctaccagagttaatcagaatgaaaagagacgggggccgcctcagcgaggccgacataagggggttcgtcgccgccgtggtaaacggcagtgcccagggagctcaaataggtgcaatgctcatggcgattaggctgagaggcatggacctcgaggagaccagtgtgctcacacaggctttagcgcagagcgggcagcagctggagtggcccgaagcttggaggcagcaactggtggataaacacagtaccgggggcgtgggggacaaggtaagcctcgttttggcacctgccctggctgcatgcgggtgtaaggtacctatgatttccggtaggggattaggacatacaggaggtactctcgataaactcgaatccatccctggatttaatgtaattcagtctccagaacagatgcaggtgctgttggatcaggccgggtgctgtatcgtgggtcaatcggaacagttggtgccagccgatgggattctatatgcagcgcgggacgtcacagccacggttgattccctacctctgattaccgcctctattctttcaaagaagctggtcgagggattatccgctctcgtcgtagacgtaaagtttgggggggcagcagtgttccccaaccaggaacaagcccgggagctggcaaagactttagtcggcgtaggcgcaagtttagggctgcgggtggctgccgctctgaccgccatggacaagccattaggacgttgcgtgggccacgcgctggaggtcgaggaggcactgctgtgtatggatggggctgggcctccggatctgcgggacctggtaaccaccctaggcggagccctactgtggctatccggccacgccggcacccaggcacagggagccgcaagggtggctgcagccctggacgatggctccgccctcggccgcttcgagagaatgctggcagctcaaggagtggatccaggtctggcacgggctctctgctcgggatcacccgctgaaagaagacagcttctacctagggcccgggaacaggaggagttacttgccccggctgatggcacagttgagctcgtgcgagccctcccactcgcccttgtcctgcacgagttaggcgctgggcgatcacgggccggggaaccactccggcttggcgtgggagccgaactgctggtggatgtgggtcagcggctgagaagaggcactccatggctgcgcgtccaccgagatggccctgccttgtccggaccacagagtcgggccctccaggaagccctggttctgagcgatcgcgcgccatttgcagcaccttccccctttgccgagctggttctgcctcctcagcagtag

SEQ ID NO: 17667 - DNA, 1233 bp, Artificial Sequence
  Description of Artificial Sequence: Synthetic coding sequence
atggaagctgaaaacgctggcagctatagcttgcagcaggcccaggctttttatacgtttccatttcagcagctgatggccgaggcacccaatatggccgtagtgaatgagcagcagatgcccgaagaagtgcccgccccagcacccgcacaggagccggtccaggaggcccctaagggcagaaagcggaagccacggaccactgaacccaagcaacctgtcgagccaaagaagccagtcgagtcgaagaaatccggaaagagtgctaagtccaaggagaaacaggaaaaaatcaccgatacctttaaggtcaaaagaaaggtggacagattcaacggtgtaagtgaggcggagttactgactaagacactgccagatatcctgaccttcaacctcgatattgtcattatagggattaacccaggccttatggctgcatacaaaggacaccattatcccggaccaggcaatcacttttggaaatgtttgtttatgtccggactgtccgaagtgcagcttaatcatatggatgatcacaccctccctggaaagtacggaattggctttactaacatggtggagagaacaactccaggttccaaggacctatcgtcgaaagaatttcgggaagggggtagaattctagtgcagaagcttcagaaataccagccgcgcatagcagtgttcaacggaaagtgcatttacgagatcttctctaaggaagtgtttggagtgaaagtgaaaaacttagagtttggtctgcagccccataagataccagacactgagacactatgttacgtgatgccatcatcttcggcccggtgtgcccagtttcccagagcgcaggataaagtacattattatattaagcttaaagacctacgcgaccagctgaaagggatcgagcggaacatggatgtccaagaagttcagtatacctttgaccttcagcttgcacaggaagacgcgaagaaaatggcagttaaggaagagaagtatgatcctggttatgaagctgcctatggcggtgcctacggtgaaaatccatgtagttcggaaccctgtggcttttcctctaacggcctgattgaatccgtagaacttcgcggcgagagcgctttttcaggcatccctaatgggcagtggatgacccagagcttcacggaccaaatacccagcttttctaatcattgcggcacacaagaacaggaagaagaatcccacgcgtag

SEQ ID NO: 17668 - DNA, 621 bp, Artificial Sequence
  Description of Artificial Sequence: Synthetic coding sequence
atgattaccctgtatcagggcagcatggtcctcgatctgccaacatggtggaaaggcccccggcctgctgctaagatctcacccgggatctatgagattttctccaaggaagtgttcggggttaaggtaaaaaacctcgaatttggccttcaaccccacaagatccctgacacggaaaccttgtgctatgtgatgcccagcagttccgccagatgtgctcagttcccacgcgcgcaggataaagtccactattatattaaactgaaggacctccgtgaccagctcaaggggatcgagaggaatatggacgtgcaggaggttcagtataccttcgatttgcagctggctcaggaggatgcgaagaagatggccgtgaaggaggagaagtatgacccaggttatgaagcggcctacggaggggcctacggtgagaacccctgcagttctgagccgtgtggcttttcctcaaacggacttatcgagtccgttgaactcagaggtgaatccgcattttcggggataccaaacggtcagtggatgacccagagtttcacagaccaaattccctctttttcgaatcactgcggaacccaggagcaggaagaagagtcccatgcttag

SEQ ID NO: 17669 - DNA, 3294 bp, Artificial Sequence
  Description of Artificial Sequence: Synthetic coding sequence
atgagctcttgcaggtccctgtgttgcggcgatatcagtcagtcggcagtgctattcctgtgtcagggcactctggccatgctggattggcagaacggttctatgggccgtagtggggaagccttgttgctggataccgcacatgttctctttacccttagctcccagataaaagagcctactctggagatgttcttaagcaggattctggccagctggacgaatagtgctattcaggtgctagaatcctcctcaccgagcctaacagactccctcaacggcaactcgtcaatcgttggtaggcttctcgaatatgtgtatacccactgggaacacccactcgatgccctgagacaccagacaaagatcatgttcaagaacctgctgcaaatgcacagactgacagtggagggcgcggactttgtccccgatcccttctttgttgagctgacggagtctttgttgaggctcgagtggcacataaaggggaagtacacctgcctaggttgtctcgtggagtgtattggtgttgagcacattctagccatcgataagactattccttcccagattcttgaagtgatgggggaccaatcactggtcccatacgccagcgatctgctggagaccatgttcagaaatcacaaaagccatttaaagagccaaacagccgaatcatcgtggatagatcagtggcacgaaacctgggtaagtccgctactcttcatcctttgcgaggggaatctcgatcaaaagagctacgtgattgattattatctgccaaagttgctctcatattcccctgagtcattgcagtatatggtcaagatattgcagactagcatagatgcgaagactgggcaggaacagagcttcccgagcctgggcagttgtaatagccgcggcgcattaggcgccctaatggcatgtctgcggattgccagagcccacggccatctccagtccgctactgatacatgggagaacctcgtttctgatgcccgtatcaagcaggggcttatacatcaacactgccaggtacgaatcgacacgctggggctcttgtgtgaaagcaatcgttcaacagaaattgtcagcatggaagaaatgcagtggattcagttcttcattacctataatttgaacagccaatctcctggagtacgacagcagatctgctctttactaaaaaagcttttctgccggattcaggagtcttctcaggtgctgtataaattggaacagtccaaaagcaaaagggagccagagaacgaactgaccaaacaacacccctccgtttctctccagcaatataaaaactttatgtcttcaatatgcaattcgttatttgaagctcttttccccgggagttcgtattccacacgcttcagcgccctaactatactgggtagcatcgccgaggtctttcacgtgcccgaaggccggatatatactgtgtaccagctgtcccatgatatcgatgtgggacggtttcaaactctcatggagtgcttcacatctaccttcgaggacgtgaaaatccttgccttcgatctgctcatgaaactgtctaagaccgcagtccatttccaagattcaggcaagcttcaggggctattccaggcggcactggaactttccactagtaccaagccgtatgactgcgtgaccgcatcctatctgctgaactttctgatttggcaagatgctcttcctagttcactgagcgcctacctaactcaacaggtcgcctgcgataacggcgatcgccccgctgcagtggtggagcgcaatacgttgatggtgatcaaatgcctgatggaaaatcttgaagaagaagtgtcccaagccgagaattcccttttacaggccgccgcagcatttcccatgtatggccgggtgcattgcattactggagcactacagaagctgtcccttaattctctgcagctcgtgtctgaatggcgcccagtggtggaaaaactgttgttgatgtcctacagactatccacggtggtaagtcctgtgatacagtcaagtagtccagaaggcctgatacccatggataccgatagtgaatccgcttccagattgcagatgatcttgaatgaaattcagccccgggacactaatgattatttcaatcaggctaagattctgaaagaacatgattcgttcgatatgaaggacctcaacgctagtgtcgtgaacatcgatacgtccactgagatcaagggaaaggaggtcaagacatgcgacgtgacggctcagatggttcttgtgtgttgttggcgttccatgaaagaggtggccctccttctcggaatgttgtgccagttattgccgatgcagcccgtcccagaatcgtctgatggactcctgaccgtcgagcaagtaaaggagataggcgattacttcaaacaacatctcctgcagtctagacaccgcggggcctttgagctcgcctatacaggatttgtcaaactcaccgaggtgctcaataggtgtccaaatgtgtcactgcagaagcttccagagcagtggctttggtctgttctggaagaaatcaagtgttcggacccttcctcgaagctctgtgccaccagacgaagtgcgggtatacctttctacatccaggcactgctcgcctctgaaccaaagaagggccgaatggatctgttgaagatcactatgaaggagctgatcagcctggccgggcctaccgacgacattcagagcaccgtgccccaggtgcacgctttgaatatactgcgagccttgttcagagacaccagactgggggagaacattataccttatgtggccgatggcgccaaagccgcaattctggggttcacttcccctgtgtgggctgtccggaacagctccacactgctcttcagcgcactgatcactaggattttcggagttaagagggccaaagatgaacatagtaagacgaatcggatgaccggacgggaatttttcagcaggtttccggaattatacccttttctgttaaagcaattggagaccgtcgccaacacagttgattccgacatgggagagcctaatcgccatccttcaatgtttttactccttctcgtgctcgaaagattatatgcttcccctatggacggcacaagttcagctctgtccatgggccctttcgtgccgtttatcatgcgcgtcctgctgtgctgccccgggtggtctgccgtcgcaagatcccagcttaccgccacttctacctcatgggtgcaggcaatcctcttaccccagccaccagaatag

SEQ ID NO: 17670 - DNA, 5643 bp, Artificial Sequence
  Description of Artificial Sequence: Synthetic coding sequence
atgggggtgaagaaaaaaaaggaaatgcaggttgcggccttgaccatctgtcaccaggacctggaaacactaaagtcatttgccgatgtagaaggtaaaaatctcgcctctctgcttctacattgcgtgcaactgactgatggggtcagtcaaatccattatatcaaacagattgtgcctcttctcgagaaggcggataagaatggtatgtgcgatcccaccattcagagctgcctagatatcctggccggcatttatctaagcctgtcattgaagaatccactgaaaaaggtcttagcctcttctcttaacagcctgcccgacttttttctcccagaagctatgcacagatttacttccagactgcaggaagagttgaacaccacagatctgtactcgtacagaaaagtgactgataacatctcatcatgcatggaaaactttaacttaggcagggcctcagttaacaatctgctgaagaacgtcctccatttccttcagaagtcactaattgagatcctcgaagagaatcgcaaatgtgcaggcaaccacatcattcaaacgcagcttatgaatgatctgcttgtgggtataagggtgtcaatgatgctggttcaaaaagtccaggattttcagggaaatctctggaagacttccgactcccctatttggcagaacatgtgcggccttctctccatatttacgaaagtcctgagcgatgatgatcttcttcagacagtgcaaagtacatcaggcctggctatcatcctcttcatcaagactatgtttcatccttcagaaaagatcccccatttgatcagcagcgtgctgttgagaagcgtagactgcacctccgtgccagaatggttcatgtcgtcgtgtagaagcctgtgctgtggcgatatctctcagtcagcagtgcttttcctgtgtcagggtactctggctatgctggattggcagaacggctctatgggtcgttcaggcgaagccctgctcctggacacagcccacgtcctcttcaccctttcgtcccagatcaaagagcccacgcttgaaatgttcctctctcgcattcttgccagctggaccaattccgctatccaggtgctggaaagcagcagtccttcgttaacagactccctcaacgggaattcgtcgatcgtggggagactgcttgagtacgtctacacacattgggaacatcccttggacgccctgcggcatcagacaaaaatcatgttcaaaaacctgctgcaaatgcacaggctgacggtcgagggcgccgattttgtgcctgacccttttttcgtagaactaacggaatcgctgcttcggttggaatggcacattaaaggtaagtatacctgtcttggctgtcttgtggagtgcatcggggtcgagcacatcctggcgatagacaagactattccatcgcagatcctagaagtcatgggggaccaatctctagtcccgtacgctagcgacctgctggagactatgttccggaatcataaaagccatttgaaatctcaaaccgccgaatcgagttggatcgatcagtggcacgagacatgggtctcgcccctccttttcatactctgtgagggaaaccttgatcaaaaatcatacgtcatcgactattatctaccaaagctcttgtcctactcccccgaatcgctgcagtacatggtgaagatccttcagaccagcattgacgcaaagacaggacaggaacagagcttcccgtcccttggcagctgtaactcccggggggctttgggggccctgatggcctgcttacgaatagcacgcgctcacgggcatctgcagtcagccacggacacgtgggaaaatctcgtgtcggatgcacggatcaaacagggtttgatccaccagcactgccaagtgcggatcgacactctcggattactgtgtgagtccaaccgctcaactgaaattgtgtccatggaggagatgcagtggatacagtttttcattacatacaacctcaattcacagtctccgggggtgagacagcagatatgtagccttttgaagaagaaactcttctgcagaatacaggaatcttcgcaggtcttatataaactcgaacagagcaagtctaaacgcgaaccagagaatgagcttacaaagcaacacccatcagtgtctctgcagcagtacaaaaacttcatgtcatccatctgtaacagtcttttcgaggccctatttcccggttctagctacagcaccagattttctgctctgacaattctcgggtcaatcgcagaggtgttccacgtgccagaagggaggatctataccgtatatcaactttctcacgatattgatgtggggcgctttcagaccctcatggaatgtttcacctccacattcgaggatgtgaaaatcctcgcctttgatctcctgatgaagctttcaaagaccgccgtccacttccaggatagtggcaaactccagggactcttccaagccgctttggaattaagtactagtactaagccttatgactgtgtaaccgcatcttacctcctgaactttcttatatggcaggatgccctgccctcttctttgtccgcttatttgacccaacaggtggcgtgtgataatggagatagacccgctgctgtcgtggaacgtaacactttaatggtgattaagtgtcttatggagaatctggaagaagaggtgagccaagccgagaatagccttctgcaagccgccgctgccttcccaatgtacggaagagtgcattgtatcacaggggctctacagaagctgtccttgaactcactgcagcttgttagcgaatggaggcccgtggtcgagaaattgctccttatgagttatcggttgtctactgtggtgtcccctgtaatccaatcctcaagcccagaggggctgatcccaatggacacagacagtgagagcgcaagccggctgcagatgatactcaacgaaatccaaccccgggatacgaacgattattttaatcaggcgaagatcctgaaagaacatgattccttcgacatgaaagacttaaatgcttcagtcgtcaatatcgatacaagcactgagataaaaggcaaggaggttaaaacatgcgacgtgacagcacagatggtgcttgtttgctgctggaggtccatgaaagaggtcgctctgctactgggcatgctctgccagctgctacctatgcaacctgtacctgagtctagcgatggtctgctcaccgtggagcaggtgaaggaaattggcgactacttcaaacagcacctacttcagagccgccatcgcggcgcttttgaactcgcttacacggggttcgtgaagctgactgaagtgttgaacagatgccccaatgtctcccttcagaagttaccagaacagtggttgtggagtgtgcttgaagaaattaaatgtagcgacccctccagcaagctgtgcgctaccaggcggtccgccggaattccattctacatacaggcactgttggcctctgaacctaagaagggacgcatggatctactgaaaataacgatgaaggaacttattagcctggctggacctaccgacgacatccaaagtaccgtgccccaggttcacgccctcaacatccttcgcgctctcttccgggacacccgccttggcgagaatatcataccatacgtggccgacggcgcaaaggccgctatcctcggcttcacctccccagtgtgggcggtgaggaactccagcactctcctgttcagcgcgctcatcaccagaatttttggagtgaaaagagccaaagatgaacattctaagacaaacagatgtgggcactctccagtgtatcattcgcgtgaaatggccgccagagcccttgtgcctttcgtgatgatagatcacataccaaatacaattaggacactcttgtcgacattgccttcttgcacagatcagtgctttcgccagaatcacatccacgggactctgctccaagtctttcatttgctacaggcatactccgacagcaaacacgggacaaattccgatttccagcatgagttgacagatatcaccgtatgtacaaaagccaaattatggctggcaaaacggcagaacccctgcctcgtgaccagagctgtgtacattgacatcttgttcctactaacttgttgtctcaataggtctgcaaaagacaatcagcccgtactggagtccctcggtttctgggaggaggtcagagggataatctctgggtcagaactcatcacagggttcccatgggcgttcaaggtgcctgggttacctcagtatcttcagagtctgaccagactggccatagccgcggtctgggccgccgcagcgaagagcggcgaaagggaaacgaacgtgcctatctccttttcccagctactggaaagcgcatttcccgaggttaggtcactgacactggaagcactattagagaaatttcttgctgcggcctccggtctgggtgaaaagggagtcccacccctgctgtgtaacatgggtgaaaagttcctgctgcttgccatgaaggagaaccatcccgagtgcttttgtaagatccttaaaattcttcactgcatggatcctggggaatggctgccgcagactgagcattgcgtgcacctcactcccaaggaattcctaatctggactatggacatcgcatcaaatgaaagaagcgagatacagtcagtcgcccttcggttggccagcaaagtcattagccaccacatgcagacttgcgtggaaaatcgtgagcttatagctgccgagttgaaacaatgggtacagcttgtgattctgagttgtgaggaccacctgccaactgagtctcgactggctgtagtagaggtcctgacctcaacaaccccactgtttctcacaaatccgcatcctatcctcgaactccaggacaccttggctctgtggaagtgcgttcttacgctgctgcaatcggaggagcaggctgtccgggatgcggccaccgaaactgtgactaccgctatgtcacaggagaacacgtgtcaatccactgaattcgccttctgccaggtcgacgcatcaattgccctggccctcgcactcgccgtactgtgtgatctgctacaacaatgggatcaattggctccgggtctgcctatcctcttgggatggctgctgggggagtcagatgatctggtagcctgcgtcgagagcatgcatcaggtggaggaagattatctgttcgagaaagcagaagtcaatttctgggctgagacactcatatttgtaaaatacttatgtaaacatcttttctgtttgctgtcaaaatccggctggcgaccaccaagcccagaaatgttgtgccacctgcagagaatggtaagcgaacagtgtcatcttctgtcccaatttttccgggagctgcccccagccgctgaattcgtcaagactgtggaattcacaagacttagaatccaagaagagcggaccctagcttgcctacggttacttgctttcctcgagggaaaagagggagaagacacattagttctgagcgtttgggacagctacgccgagagccgccagctcacattgccccgtaccgaagccgcctgttag

SEQ ID NO: 17671 - DNA, 5862 bp, Artificial Sequence
  Description of Artificial Sequence: Synthetic coding sequence
atgggggtcaaaaagaaaaaagagatgcaggtagcggcattgacaatctgccaccaggatctagaaaccttaaagtcattcgccgatgtggaggggaagaatctcgctagtctcttgctacactgcgtgcagcttacagacggagtttcccaaatccactatataaagcagatagttccactgctggagaaagccgacaagaatgggatgtgcgaccctaccatccaatcctgcttggacatccttgctggaatttatctgagtctgtccttgaaaaatcctttgaagaaggtgttagctagctcgctaaactccctgccggatttttttctgccagaagcaatgcacaggttcacaagtaggctgcaggaagagctgaacacaactgatctctactcatatcgaaaggtgactgacaatataagctcctgtatggaaaactttaacttgggccgggcctcagttaacaatctgctgaaaaacgttctgcatttccttcagaagtccctaatcgagattcttgaggagaatcgcaaatgcgccgggaaccatataattcagacacaactgatgaatgacctgctggtcggaatcagggtgtctatgatgttggtgcaaaaggtgcaggattttcagggcaacctgtggaagacctctgactctccaatatggcagaatatgtgtggcctgttatctatttttacaaaagtcctgtcagatgatgaccttctccagaccgttcagagtacatccggactggctatcattttgtttatcaaaaccatgttccaccctagtgagaagatcccacatttgatcagctctgtcttactgcgctccgttgattgtaccagcgttcccgaatggttcatgtctagctgccggagtctgtgttgtggcgatatatcccagagtgctgttctgtttttatgccaaggaaccttagctatgctggactggcaaaacggctcaatgggaaggagcggcgaggcattactgctcgataccgcacacgtactgtttactctaagctcacagattaaggagcctacgctggagatgtttctgagccggatccttgccagctggacaaattctgccatccaagtcctcgagtcttcctccccctcgctcactgactccctcaatggcaactcaagcatcgtgggccgcctgttagagtacgtatatacacattgggaacaccccctcgacgcgctccgccaccaaacgaaaattatgtttaagaatttactccagatgcacaggctgaccgtagagggggcggattttgtgccagacccgttttttgtcgaactcaccgaaagcctcctgcggctcgagtggcatatcaagggaaagtacacatgcctgggatgcctggtggagtgtatcggggttgagcacatcttggcaattgataaaacgattccctcacagatactagaagtcatgggcgatcagtctctcgtgccgtacgcatccgacttgttagagaccatgttccgtaatcataagtctcatctcaagtctcaaactgcagagtcctcttggatcgaccaatggcatgaaacgtgggtgtccccgttattattcatcctttgcgagggaaacctcgaccagaaaagctacgtgatagattactatcttcccaagctgctgagctatagtcccgagtctctgcagtatatggtgaagattctccagaccagtatcgacgctaaaacagggcaggagcagagcttccctagtctcggcagctgcaactcccggggcgcattaggggctctgatggcttgcctgagaatagccagagctcacggacatctacagtcggcaaccgatacttgggaaaacctggtgtctgacgctcgtattaagcaggggctgattcaccagcattgccaggtgcgaattgacacgctcggcctgctctgcgagagcaaccgctctaccgagatagtttctatggaggaaatgcagtggattcagttctttattacatataacctgaacagccagagtcctggcgtgcggcagcaaatttgcagtctactcaaaaagctcttttgtcgaattcaggagagcagccaggttctgtacaagcttgagcagagtaaatcgaagagggaaccagagaatgagctcaccaaacagcacccttctgtctcactgcagcagtacaaaaatttcatgtcttcgatttgtaattctctgtttgaggccctcttccctgggagcagctattccacccgctttagcgctctgaccatcttgggatccatcgccgaggtcttccacgtacccgagggaaggatttatactgtttaccagctgagccacgacatcgacgtggggagatttcagactctcatggagtgtttcacatcgaccttcgaggacgtgaagatactcgcctttgaccttttgatgaagctgtcaaaaactgcagtgcactttcaggattcaggaaagctgcagggtctgttccaggcggctctggagctgagcaccagtacaaaaccatatgactgtgtcacagctagttacctgctcaatttcttgatttggcaagatgcgttgcccagttccctcagtgcttacttaacccaacaagtagcttgcgacaacggggaccgccctgcagcagtcgtagagcggaatacactgatggtgatcaagtgtctgatggagaatctggaggaggaagtgtctcaggcagaaaattccctactgcaagcggccgccgccttccctatgtatggaagagtgcactgtattacaggcgccctgcagaagctatccctgaactcactccagcttgtctccgagtggaggccggtcgtcgaaaagctcctgctgatgtcctaccgactgagtacagttgtgtcccctgtgatccagagctctagtccagaaggcttaatcccaatggacacagacagtgagagtgcatctagactgcagatgattctcaatgagattcaacctcgagacaccaacgattattttaaccaggctaaaattctcaaggagcacgactcctttgacatgaaggacctgaacgcgtcagtcgtaaacattgacaccagcactgagatcaaagggaaagaggtcaaaacctgcgacgtgaccgctcagatggtgcttgtctgctgttggcgcagtatgaaggaggtggccctgttgctcgggatgctgtgtcagctgctgcctatgcagccagtacccgagtcttctgacggactactgactgtggagcaggtcaaagaaataggcgactacttcaagcagcatctcctgcagagcagacatagaggagccttcgaattggcctacacgggcttcgtcaagctcacagaggtcctgaacagatgcccaaatgtcagcctgcagaaattaccggagcagtggctatggtccgtcttagaagagatcaaatgcagcgaccctagctctaaactatgcgcgacccggcgctctgccggcatcccattctacatccaggccctcctcgcgagcgagcctaagaaaggaagaatggacctgcttaaaatcaccatgaaagagctgatttccctcgctggcccgaccgacgacattcagagtacagtgccgcaggttcacgctctgaacattctgagggcccttttccgggatacacgtctaggcgagaacatcatcccctacgtggccgatggcgccaaggccgcaatcctgggcttcacctcccctgtatgggccgtaagaaacagctctacgctgctgtttagtgctctgatcaccaggatcttcggggtgaaaagagccaaagacgaacactctaaaaccaatagaatgaccggcagggagttcttcagcaggttcccagaactatacccgtttctccttaaacaactggagacggttgccaatactgtggactctgatatgggggagccgaaccgtcacccctcaatgtttttactgctcctggtcctggagcgactttacgcaagtcctatggacggaacctcttctgcactttctatgggaccttttgtcccttttatcatgaggtgcggtcacagccccgtctaccactcacgagagatggcagctagagccttggtaccattcgtgatgattgatcacatccccaatacaatacgaacactcctgtcgaccctgcctagctgcacagatcagtgcttccgccagaaccatattcacggcacgctccttcaagtgttccacctgttgcaggcgtacagcgattccaaacatggtacgaattccgatttccagcacgagctcactgatattacagtgtgcacaaaagcgaagttgtggctcgccaagcggcagaatccatgcctcgtcactcgcgccgtgtacatcgacattctctttttactgacatgctgccttaatcgatcagctaaggacaaccagccggtcctggaatccctcggcttttgggaggaggtgcgtgggatcatctcgggctctgagctgattactggctttccctgggctttcaaagtccccggactcccccaataccttcaaagcttaacccggttggcgattgccgcagtatgggcagctgcagccaagtccggggaacgggagaccaacgtgccaatttcgttcagtcagctgctggaatcagccttccctgaggtgcggtccctgaccctagaagccctgctcgagaagttcctcgccgccgcttcagggctgggagaaaagggcgtcccaccacttctatgcaatatgggcgagaagtttctgttgctggccatgaaggaaaatcacccagagtgcttctgtaaaatccttaagatactccattgcatggaccccggcgagtggttgccacagacagagcattgtgtccacctcaccccaaaggagtttctgatctggacaatggacatcgcctccaatgagcgctccgagatccagtctgtggctctgcggttggcttcgaaagtgatttcccaccacatgcaaacatgtgtggaaaaccgggaactcattgccgccgagttaaaacagtgggttcagcttgtgattctatcatgcgaggaccacctcccaactgaaagtaggctggcagtggtcgaagttttgacatccaccactccgctctttctgaccaaccctcacccgatcttggagctgcaggacacactcgctctgtggaaatgtgtgttgaccctgctccagagtgaagaacaggctgtgagagacgcagcaacagagacagtcaccacagcgatgtcacaggaaaacacctgtcaatccacagagttcgctttctgtcaggttgatgccagcatcgctctggccttggccctggctgttctgtgcgatttgttgcagcagtgggaccaattagcaccggggttacccatcctgctgggatggctcctgggcgaaagcgatgacctggtggcctgtgtggagtctatgcaccaggtcgaggaggactacctgttcgagaaggccgaggttaacttctgggccgaaactctgatctttgtgaaatacctctgcaagcatctgttttgcctgctgagcaagagtgggtggaggccaccatccccagaaatgctttgtcacctgcagcgcatggtatccgagcagtgtcacctcctctcacagtttttccgtgaactccccccagcagctgaattcgtgaagaccgtggagtttacgcggttaaggattcaagaggagaggactctggcttgcttaagattgctggccttcctcgaggggaaagaaggtgaggacacgttagtgctctccgtttgggatagttacgcggagtcaaggcagctaacccttccccgcaccgaagcagcttgttag

SEQ ID NO: 17672 - DNA, 5862 bp, Artificial Sequence
  Description of Artificial Sequence: Synthetic coding sequence
atgggtgtgaagaagaaaaaggagatgcaggtcgctgcccttacgatatgtcaccaggacttagagaccctgaagagtttcgccgacgtggagggcaaaaacctggcgtcactgcttttacactgtgtgcaactaacagatggggtttctcagatccactacattaaacagatcgtgccccttctggaaaaagccgataaaaacggcatgtgtgatcccaccatccagtcttgtttggacattctagcaggaatctacctatctctctccctcaagaaccctttaaaaaaagtgctcgccagtagcttgaattcacttcctgacttttttctgccagaggctatgcacaggttcacgtcccgcttgcaggaggagcttaacactactgacctttattcctatagaaaggtaaccgataacatctcttcttgtatggaaaatttcaacttaggtagggcctccgtcaacaacctgctcaaaaatgtcctgcattttctccagaagagtctgattgaaattttggaagaaaaccgtaaatgtgcaggtaatcacattattcagacacagctgatgaatgatctgttggtcggtattcgcgtttccatgatgctagtgcaaaaggttcaggatttccaggggaacctgtggaagacgagcgatagtcccatttggcagaacatgtgcggactgctctcaatcttcacaaaagtgctgtcagatgacgacctgctccaaactgtccaatcaactagcggccttgccataattttgttcattaagaccatgttccatcctagtgagaaaatcccgcatctcatctcatccgtgctgctccggagtgttgactgcacatcagtcccagagtggtttatgagctcatgcaggtccctatgctgcggagacatctcccagtctgcagtattgttcctgtgtcagggcactcttgctatgcttgactggcagaacgggtccatggggcgaagcggcgaggcactgcttctggacactgcccatgtgttattcaccctgagctcccagatcaaggagcccactctggagatgttcctgagcagaatcctggccagctggaccaattcagccattcaggtcctggaatcctctagcccgtccttaacagattcactgaacggcaacagttcgatcgttggcagattgcttgagtacgtatacacacactgggagcacccattggacgccctccggcatcagaccaaaatcatgtttaagaatctgttgcagatgcatcgtctgaccgtcgagggggcggactttgttccagacccctttttcgtagaactcaccgagtcactgcttaggctagagtggcatataaagggaaaatacacgtgcctgggatgtctggttgaatgcataggagtcgagcacatcctggcgatcgataaaaccatccctagccaaatcctggaggtgatgggtgaccagagcctagttccatacgcgtcagatctgctggaaaccatgttccgaaatcacaagagccatctaaagagtcaaactgccgagtcctcatggattgatcaatggcacgagacctgggtgagcccgctgctgtttattctctgcgagggcaacctggatcaaaaatcatacgttatagactattacttgccaaagttactctcttactcacccgagtcactacagtatatggtaaaaatacttcagactagtatcgatgctaagacaggccaggagcaatcctttccaagcctgggctcctgcaactcacggggtgcccttggcgcgctcatggcgtgcctgcggattgcccgcgctcacggacatctgcagtccgccacggacacctgggagaatctggtgtcagacgcgaggattaaacaggggctgatacatcaacattgtcaagtcaggatcgacacactaggactactgtgcgaatcgaaccggtctacggagatcgtctctatggaggaaatgcaatggatccagttttttatcacatataacctgaattctcagtcccccggtgtgcgacagcagatctgttcactgttgaaaaagctcttctgcaggatccaggagagctcacaggtcctctataagctggagcagtcaaaaagcaagagggagccagaaaatgagttgacaaaacagcacccctccgtgtccttgcagcaatataagaacttcatgtcttcaatctgtaattcgctatttgaggccctatttcctgggagcagctactcaacacgattcagtgccctcacgattctgggttccatcgcggaagtattccatgtgccagagggcaggatctatacggtgtaccagctctctcacgacatcgacgtcgggaggtttcagaccttaatggagtgcttcacctccacatttgaggacgttaagatcctggctttcgacctgctgatgaaactgagcaagacagcagtccacttccaggattctggtaaattgcagggcctgttccaggcggccctcgagctctccaccagcactaagccatatgactgcgtgactgcctcatatctcctgaacttcttgatttggcaagatgccctgcctagcagcctttccgcttatctcacacagcaggtcgcgtgtgataacggcgacaggcctgcggcagttgtggagagaaataccctgatggtcatcaaatgcctaatggagaacctggaggaagaagtcagccaagcagaaaacagtctgctccaagccgctgccgcctttcccatgtatggacgagtccattgtataactggggcactgcaaaagctttcactgaatagccttcagctggtgagtgagtggcgaccagtggtggagaagctgttattaatgagctaccggctatccaccgttgtatcccctgtcatccaatcctcttctccagaaggacttattccgatggataccgattccgaatcagccagcagactccagatgatattgaacgagatccagccccgcgataccaacgactactttaaccaggccaagatcctgaaagagcacgattccttcgatatgaaagacctcaacgctagcgtggtaaatatcgacaccagcacagagataaagggcaaagaagtgaaaacttgtgatgtgaccgcccagatggtgctggtttgttgttggcgctcaatgaaggaggtggcactattactaggcatgctgtgtcagttgttgccaatgcaacctgtaccagaaagctccgatggactgttaacagttgagcaagtgaaagagatcggagactattttaagcaacacctcctgcagtcaaggcacagaggcgcgtttgagttggcatacaccggattcgtcaaactgactgaggtccttaatcgctgtcctaacgtgtctcttcagaagttacccgaacagtggctatggagtgtactagaggagattaaatgcagcgatccatcaagcaagttatgtgccacacgcagatctgccggaattcctttctacatccaagcgcttctggcctccgaacctaaaaaggggagaatggacctgctgaaaatcacaatgaaagagctcatctcactcgcagggcctacagacgatatccagagcactgtgcctcaggtacacgcgctaaatatccttcgggcccttttcagggacacacggttgggtgagaacattatcccttacgtggctgatggcgccaaagctgctatcctcggcttcacttcgcccgtttgggcagtgcggaattcttccacattgctcttcagcgccctgattacccgaatctttggagtgaagcgggctaaagatgaacattccaagactaatcgcatgaccggcagagaattcttttctcgatttcctgagctgtacccatttctgctaaagcagctcgaaacagtcgctaacaccgttgactctgacatgggtgaacccaacagacacccctcgatgttcttgctactgctcgtgctcgagaggttgtacgccagtccaatggacgggacatcaagtgctctgtccatgggcccattcgtgccttttattatgagatgtgggcacagtccggtgtatcattcccgagagatggcagctcgggccctggtgccatttgttatgattgaccacattcccaacacaattcgcacactgctctctactcttcctagctgcaccgatcaatgcttcaggcagaatcacattcacggcacacttctccaggtattccatctgctgcaagcatacagcgactccaagcatgggacgaattccgactttcagcacgaactaacagatataacagtgtgtacaaaagctaaattatggctcgcaaagcgccagaacccttgcttagtgacaagggcagtctacatcgatatcctttttcttctgacctgctgtcttaaccgtagcgccaaggataaccagccagtgctcgaatcccttgggttttgggaggaggtgcgaggaatcatcagtgggagtgaactgattacaggatttccttgggcattcaaagtccctgggttaccacagtatctccagtcacttacacgactggctatagccgcggtgtgggcagcagctgccaagagtggtgaaagagagaccaacgtgccaatttctttctctcagcttctggagagcgcttttcccgaagtgaggtccctgactctggaggcactgctggaaaagttccttgcggctgcgagtggccttggagagaaaggggtccctcccctcttgtgcaacatgggcgagaagttcctcctgctagctatgaaggagaaccaccccgaatgtttttgcaagattctgaaaatcttgcattgtatggaccccggcgagtggctgccacagacagagcattgcgtgcatctgacccccaaggagtttctcatctggacaatggatattgccagcaacgagcgctcggaaattcagagcgtcgcactgcgtttggcctccaaggtgatctcccatcatatgcagacatgcgtcgagaatcgtgaactcatagctgctgagctgaagcagtgggtgcagttggtgattctgtcttgcgaggaccatttgcccacagaatctcgtctggccgtggtggaggtgctgacttctaccacccctctattcctgacgaatccacatcctattcttgaactccaggatactctggccctgtggaagtgtgttctcacactcctgcagtccgaggagcaggccgtccgtgacgctgccactgaaactgtgaccacggctatgtcacaggagaatacatgtcagagtacagagttcgccttttgccaggtggacgcgtccatcgcactagctttagcgttagcggttctgtgtgatctcctccagcagtgggatcagttggcccccggcctgcccatcctgctcgggtggctgctaggagaatctgacgatttagtagcctgtgtggaaagcatgcaccaagtggaggaagattatctatttgagaaagccgaagtgaacttctgggccgaaaccctgattttcgtcaaatacctgtgcaagcacctgttctgtcttcttagcaaaagtggatggaggcccccaagtcccgagatgctctgccatcttcagcgaatggtctcagaacagtgccacctgctgtcccaattcttccgtgagctccccccagccgccgaatttgtgaaaaccgttgagtttacccgtctgagaatccaagaggagagaacacttgcttgtttgagactcctagcctttctggaaggaaaggagggcgaagatacactggttctctccgtgtgggattcatacgcggaatcgcggcagctaaccctgcctaggaccgaagctgcttgctag

SEQ ID NO: 17673 - DNA, 4905 bp, Artificial Sequence
  Description of Artificial Sequence: Synthetic coding sequence
atgagcagttgtagatctttgtgctgcggagacatcagccagagcgcagtgttattcctgtgccagggaacgctggcaatgttagactggcaaaacggcagcatgggcaggtccggtgaggctttgctgctcgatacggcacatgttctgttcaccctgtccagtcaaataaaggagcccaccttggagatgttcctgtctcggatactggcgagctggactaactctgccatacaggtcctggagagctcatcaccttcactgactgactctctcaacggaaactcaagcattgtcggtcgattactcgagtacgtttatactcactgggagcacccacttgacgctttaagacaccagactaaaataatgttcaaaaatctgctccaaatgcaccgcctaaccgtggagggagccgattttgtccctgatcctttttttgtagagctcacagagtctctgttgaggctagaatggcatatcaaaggtaagtatacctgcctagggtgcctagtggagtgcataggcgtggagcatatcctggctatagataaaacaatcccctcacagattctggaagtcatgggtgatcaaagtctcgtgccatacgcaagcgacttgttggaaactatgttcagaaaccacaaaagtcacttgaagtctcagaccgcagagtcatcctggatcgaccagtggcatgagacttgggtgagccctctcttgtttatactttgcgagggcaatctcgatcaaaaatcttatgtcattgactactatcttccaaagctcctgagctacagtcctgaaagccttcagtacatggtcaagatcctgcagacttctatcgatgcaaagacaggccaggagcaatccttccccagcctggggagctgcaactctcgaggggcacttggtgctctaatggcctgtctcagaatcgcccgcgcacatgggcatctgcagtcggctactgatacatgggagaacctggtatcggatgcaagaattaagcagggcctgatacaccagcattgccaagtccgcattgacacactgggtctgctctgcgaaagtaatagatccaccgagattgtatccatggaggaaatgcagtggatacagttttttattacatacaacctgaactcccagtctccgggggtgcggcaacagatttgctctctgctgaagaaattgttctgcaggatccaggagtcttcccaagtgctctacaaacttgagcagtcaaagagcaaacgtgagccagagaatgagctgacaaaacagcatccttcagtgagtctgcagcagtacaaaaactttatgagctccatttgtaattctctcttcgaagcactctttcctggttcatcttactccacgcggttcagcgcattaaccatcctgggatcgatagcggaagtcttccatgtgcccgaggggcgcatttatacagtctatcagctgtcccatgatattgatgtgggaaggttccagactctgatggagtgtttcactagcactttcgaagatgtgaagatcttggcctttgatctgttaatgaaactgtctaagacggcggttcacttccaggatagcggcaagttgcagggacttttccaggccgccttggagctgagtactagcaccaaaccgtatgactgcgtcacagcaagctatttattaaactttctgatctggcaggatgccctgcccagctccctatcggcctatctaacccagcaggtggcgtgcgataatggcgatcggcctgctgccgtggttgagcgcaacacgctcatggtcattaagtgccttatggagaatctggaggaggaggtgagccaggcagagaactctctgttacaagctgccgccgctttcccaatgtacgggagggtacactgcatcactggcgctcttcaaaaactgtccctgaatagcctgcagctggtgtctgaatggaggcctgttgtagagaagctgctactaatgtcctatagactaagcaccgtcgtctctccagtgatccagagttcgtcaccagagggcttgatcccaatggatactgattctgagtctgcatccagattacagatgatcctcaatgagattcaacctagagacacgaatgattacttcaaccaagccaagattctcaaggaacacgacagcttcgatatgaaagatctgaatgcctcagtggtcaacatcgatacttcaacagagatcaaaggaaaagaagtaaagacatgcgacgtgacagctcaaatggtgcttgtttgttgctggcgatctatgaaggaagtcgcgctcctattgggcatgctctgccaactccttccaatgcagccagtgcccgaatcatcggacgggctccttaccgtcgagcaggttaaggagattggtgactattttaagcagcacctactgcaaagccggcatcgcggggcttttgagctggcctatacaggcttcgtaaaactgacggaggttttgaaccggtgtcccaacgtgagtctgcaaaagctccctgagcagtggctgtggagcgtgttggaagagatcaaatgtagcgatccttcttctaaattatgtgctacccgcaggtctgccgggatccctttttacatccaggcccttctagcctccgagccgaagaagggcagaatggacctgctgaagatcactatgaaggagttaataagcttagccggtccgactgacgatattcagtcgaccgtccctcaggttcacgccctgaatatccttagggccttgttccgtgacactcgtctgggcgaaaatattattccctatgtcgccgatggggcaaaagcagcaatactgggatttacttcaccagtttgggcttcccagatgacgggacgggagtttttctcacgattcccagagctttatcccttccttctcaagcagctcgaaaccgtggctaatactgtggattccgatatgggtgagcctaatcgccacccctccatgtttctactcttattagtactcgagcgactctacgcatctcctatggatggtacatcctcggccctgagcatgggacctttcgtgcctttcatcatgagatgtgggcatagcccggtttaccactctcgcgagatggcggcccgcgccctcgttccctttgttatgatcgatcatattcctaatactatccgaacccttctgagcacgctaccttcctgcacagaccagtgcttccggcaaaatcatatccacggtactctgctccaggtattccatctactgcaggcctatagcgattccaagcatggcaccaatagcgactttcagcatgaactcaccgatatcaccgtgtgcacgaaggctaagctctggctggccaagcgccagaacccatgccttgtgaccagggccgtgtacatcgacatcttgttcctactgacttgttgccttaatcgtagcgcaaaggacaatcaaccagttcttgagtcgctcgggttttgggaagaagtccggggaatcatttccgggtccgaattgatcacaggcttcccttgggccttcaaggtacctggccttcctcaatacctgcaaagtctgaccaggctcgccattgctgccgtatgggctgcggccgccaaatccggtgagcgggagaccaacgttcccatttctttttcacagctgttagagtccgcttttcccgaggtccgctccctcactctggaggccctcctggagaagtttctggccgctgcaagtggccttggtgagaaaggagtgcctcctttattatgtaacatgggagagaagtttctcctactggccatgaaggagaaccacccagagtgcttttgcaagatattaaagatcctccactgcatggaccccggtgagtggctgccccagacggagcactgtgtgcacctaacaccaaaagagtttttaatctggactatggacattgcctcgaatgaacgctccgagatacagtccgtcgcattgcggctggcaagcaaagttatttcccaccatatgcaaacctgtgtggaaaatagagagcttatcgcagccgaactgaaacagtgggtccagttggtgatactgagctgtgaagaccacctccccacggaatctcggctcgcagttgttgaagtcctcactagcaccacccccctgtttctgacaaatcctcaccctattctggagctccaggacaccctcgcgctgtggaaatgcgtgttgaccctgctgcagtccgaggaacaagccgtgagggatgccgccaccgagactgtaacaactgccatgagtcaagagaatacctgtcagtcaaccgagttcgccttctgtcaggtcgacgctagcattgctttagcgctcgccctggccgtgctgtgcgacctgctgcaacagtgggatcagctggcacctgggctgcccatcctactgggatggctgcttggggaatccgatgacctggtggcatgtgtggaaagtatgcatcaggtggaagaagactacctcttcgagaaggctgaagtgaatttttgggcagaaacgctgatcttcgttaagtacctgtgtaagcacctgttttgcctcctgagtaagagcgggtggcgccccccctcgcccgaaatgctctgccatctgcagcggatggtgtccgagcaatgtcatctgctttcacagttctttcgggagctgccgcccgccgcagaattcgtgaagacggtcgagttcactaggctgcggatccaggaggaaagaacactggcatgcctccgcctgctggctttcttggaaggaaaggagggagaggacactcttgttctttctgtatgggactcttatgctgaaagccgccaattgactcttccccggacggaggcagcatgctag

SEQ ID NO: 17674 - DNA, 2685 bp, Artificial Sequence
  Description of Artificial Sequence: Synthetic coding sequence
atgggtgtcaagaagaaaaaagaaatgcaggtagccgccctcacaatttgtcatcaggacctcgaaactctgaaaagctttgccgacgtcgagggcaagaacctcgcatccttgttgctgcactgtgtgcagctgaccgacggcgtttcccaaattcattacataaagcagattgtcccactccttgaaaaagcggataagaacggaatgtgtgatccaaccatccagtcttgcctggacatccttgccgggatttatctgtctctgtcactaaaaaacccccttaaaaaagtcctagcatcatccttaaatagtcttccagatttctttctgcccgaggctatgcaccgcttcacatccagactgcaggaggagttaaacacaaccgacctctactcctaccgaaaggtgaccgataacatatctagttgcatggaaaattttaatttggggcgggctagcgtaaataacctcctgaagaacgtgctccacttcctgcaaaagagcttgatcgagatcctcgaagagaaccggaagtgtgcaggaaatcatatcatccagacgcaactgatgaatgacctgctcgtggggatccgtgtgtccatgatgctcgtgcagaaagtacaggactttcaggggaatctgtggaaaacatccgactccccaatatggcagaatatgtgtgggctgttgtctatcttcacaaaggttctgagcgacgacgatctgctccagacagtacaaagtacttctgggctggcaattatactgttcattaaaactatgttccacccaagcgaaaaaattccacacttgatctcgagcgtgctgctgcgctccgtggattgcacttcggttcccgagtggttcatgagctcttgcaggtccctgtgctgcggcgatattagccagtccgcggtgctgttcctgtgccagggtacactggccatgcttgactggcagaacggttcaatgggccgctcaggagaggccctcctgctggacacagcccacgtgctgttcaccctatcttcccagatcaaagaaccaaccctcgagatgttcctgtccagaatacttgcctcatggaccaattccgcaatacaagttctggagtcatccagcccttctctcacagactcactcaacggaaatagttctatcgtgggccggctgttggagtacgtatatacccattgggaacatcctctcgacgccctcagacaccagaccaagataatgttcaaaaatctccttcagatgcacagattgacagtcgagggggccgacttcgtgcccgaccccttcttcgtcgagctcacagagtcactgttaagactggaatggcacatcaaaggtaagtacacttgtctcggctgcctggtcgagtgtattggggtagagcacattctggccatcgataagaccatcccgagccagatactggaggtgatgggagatcagagtctcgtgccatatgcaagcgacctgttagaaactatgtttagaaaccacaagtcccacctcaagagtcagactgccgagtccagctggatcgaccaatggcacgagacttgggtgagcccgctcctgttcattttatgcgagggaaaccttgaccagaagagttacgttattgactattacttacctaagctgctatcctattcacccgagtctctccagtacatggttaagatcctgcaaacgtccattgacgccaagaccggccaggagcagagcttccctagcctgggcagttgcaactctaggggcgctctgggcgcgctgatggcttgcctccggattgcccgagctcacggccatttgcagagcgcgacagatacttgggagaatctggtgtcagacgcaagaattaagcaggggctgattcatcagcattgtcaagtgcgtattgatactctgggtcttttgtgtgaaagcaacaggtctacagagatagtcagtatggaagagatgcaatggattcagttttttataacctacaatctgaacagtcagagtcctggtgtgcgccagcagatctgtagcctgctgaagaagctcttttgcagaattcaggagtcatctcaagtactgtataagttggagcaaagtaagagtaagcgcgagccagaaaacgaactaaccaaacagcatccaagcgtgagcctccagcagtataaaaacttcatgtcctcgatctgcaactccctgtttgaggcactgtttccagggagctcatattctacacgattcagcgctctgaccattctgggaagtattgccgaagtgtttcatgtaccagaagggcgaatctatactgtgtaccagcttagccatgatatcgacgttggaaggtttcaaaccctgatggagtgctttacctctacctttgaggacgtgaaaatcttagcttttgatctgctaatgaagctgtcaaaaaccgccgtgcactttcaggactccggaaagctacaaggactcttccaggccgccctggagctctccacaagtacgaaaccatatgattgtgttaccgcctcatacttgctgaactttctgatttggcaagacgctctgccatcctctctctccgcctatctgacacagcaggtcgcgtgcgataatggcgaccggccagccgccgtagtggaaagaaacacgttgatgggcctgtactag

SEQ ID NO: 17675 - DNA, 2268 bp, Artificial Sequence
  Description of Artificial Sequence: Synthetic coding sequence
atgagcggtactaatctggacggcaacgatgaatttgatgagcaactccggatgcaggagctctatggcgacggaaaagacggggatacccagaccgacgcgggcggcgagcctgacagtctggggcagcagcctacagacacaccatacgaatgggacctcgacaagaaggcctggtttccaaagattactgaagatttcatcgcgacttaccaagccaactacggcttttctaatgatggcgcttcgtctagcaccgcgaacgtggaggacgtccacgcacgcacagcggaggagcccccacaggagaaagccccagagcccactgacgctaggaagaagggcgagaagcgcaaggccgaatccggctggtttcatgtcgaagaggatcggaacacaaatgtctacgtttcaggtttgccacctgacataaccgtggacgagttcattcagcttatgagtaaatttggaataataatgagagacccgcagacagaagagttcaaggtcaagctgtacaaggacaatcaggggaatctcaaaggagacggactatgttgctacctgaaaagggagtctgtggagctggccttgaaactcctggatgaggacgagatccgcggctacaagctgcacgttgaagtagccaaattccaattgaagggcgagtatgacgcttccaaaaagaagaaaaagtgtaaggactataagaaaaaactgagcatgcaacagaaacagttagattggcggccagagcggcgggctggtccaagcagaatgagacatgaaagggttgtgattattaaaaatatgttccacccgatggattttgaagatgacccattggtactgaatgaaatcagagaagaccttcgggtggagtgctctaagttcgggcagattagaaagctactcctttttgaccgccatccagacggagtggcttccgtgagtttcagggacccagaggaagcagactattgcattcaaacactggacggcagatggtttggggggaggcaaataactgcccaggcgtgggatggcactactgattatcaggtggaagagaccagtcgcgaaagggaggaaagactcaggggatgggaagcattcctgaacgcccctgaggccaaccggggactccggagatctgatagcgtaagtgcctccgaacgggcgggcccttctagagcccgacatttcagcgagcaccccagtactagtaagatgaatgcccaggagactgccaccggtatggcttttgaggaacctatcgatgagaagaaatttgaaaaaacagaggacgggggcgagtttgaagagggtgccagcgagaacaatgccaaggaatcctctccggagaaagaggccgaagagggttgtccagagaaagagtcagaggaagggtgcccgaagcggggatttgagggaagctgcagccagaaagagtcagaagagggcaaccccgtgagaggatctgaagaggactccccgaaaaaggagtcaaagaagaaaaccctcaaaaacgactgcgaggagaacggcttagccaaggagtccgaggacgaccttaataaggaatccgaagaagaggtcggtcctaccaaagagtctgaggaagacgactctgagaaggagtccgatgaagattgtagcgagaagcagtctgaagacggatctgagcgcgagtttgaggaaaatgggctggaaaaagacctcgacgaggaagggtccgagaaagagttgcacgaaaacgtgctagataaggaattggaggaaaacgacagtgagaacagcgagtttgaggacgacggctctgaaaaggttctggatgaagagggatccgaacgcgaatttgacgaagacagcgatgaaaaggaggaagaggaggatacttatgaaaaggtctttgacgacgagtctgatgaaaaagaagacgaagagtacgccgacgaaaagggtttagaggccgcagataagaaggcagaggagggcgacgctgatgaaaagttgtttgaagaatctgacgacaaggaggatgaagatgctgacggtaaagaggtcgaagacgcggatgaaaagttattcgaggacgacgacagcaacgagaagttattcgacgaagaggaggacagcagtgagaaactgtttgacgatagtgatgagagaggcaccctaggcgggtttggcagcgtggaagagggccccctaagtacagggtcttcattcatcctcagctctgacgatgatgacgacgacatttag

SEQ ID NO: 17676 - DNA, 432 bp, Artificial Sequence
  Description of Artificial Sequence: Synthetic coding sequence
atgaccaaaatgtataagggattccaggcactcggagatgctgcagatattagattcgtttacacccctgctatggaatccgtctgtggttatttccacagatctcataaccgtagcgaagagtttctgatcgcaggcaaattgcaggacggactgctacatattaccacatgtagttttgtggctccctggaactctctgagcttggcccagcggagaggttttacgaagacctatactgtaggatgtgaagagtgcactgtgtttccatgtctgagcatcccatgcaagctgcaaagcgggactcactgcttgtggacagaccagctgttgcagggctctgagaagggatttcagagtagacacttagcatgtcttcccagggaacccgggttgtgcacgtggcagtccctcagatcacagattgcctag

SEQ ID NO: 17677 - DNA, 786 bp, Artificial Sequence
  Description of Artificial Sequence: Synthetic coding sequence
atgccactgacctctggctcctcaacaccccctccctggagagtgtccgcagatacttcaacagggcctactacagccgctcggtctttcagcttgctggtgaggcacaggccaagagccctgtgccatacaaaccagagtctgggacgagggttggccacgactagaggacgcggctctgatgggaacgggccaacaggtaatggtgatcatcccaatttctccctgagcgagggccgagcatttggaagcctggctgctcagcctatcacttcctgtctgtctgtgcccgcgccgccattctctctcgggaaactgcaggacggcctgctgcacattactacctgctctttcgtcgccccttggaattcgctctctcttgctcagagacgtggattcaccaaaacttatacggtgggatgtgaagagtgcactgtaagtgcctggactttaacttctaatggcagatctttccccggacccttccccaaaagctgggcgtgcttccttctcccactcgccattctctgtccttgcggctgcagccctactctgagagccgttccagatctgtcatgctatttccccaaaccagagaccgctcccctgcaaattctggctgccccttttccttgtgtccaatacagagtcataacctgcccatctctcgtgccgcttattctcccctgcgattactctgttatccccctcccagtccccgaacccccaggtctcttcctcggctcccccgagtgttcccctagaacacagtcagcagtgccatag

SEQ ID NO: 17678 - DNA, 291 bp, Artificial Sequence
  Description of Artificial Sequence: Synthetic coding sequence
atgcccgtatactcggcatggccagctgaaccaacaatggcaccatttgaacccttggcttcaggaattctgctcctgctgtggctgatcgccccctcccgggcttgcacttgtgtgccaccccacccccaaaccgctttttgcaactccgacctggtaattagagccaaattcgttgggactcccgaggtcaatcagactactttatatcaaaggtacgaaatcaaaatgaccaagatgtataaaggattccaggccttgggggacgccgccgatatcaggtttgtgtag

SEQ ID NO: 17679 - DNA, 498 bp, Artificial Sequence
  Description of Artificial Sequence: Synthetic coding sequence
taaccacgcgctctgtgtcacaccaaccagagtctaggtcgaggcttggctactacccgtggacgaggtagcgacggtaacgggcctactggcaatggcgaccaccccaatttttcattatcagaaggacgggccttcggttcgctagctgcgcagccaataacatcatgtctttccgtccccgctcctccattctctcttggaaagctgcaggatggcctcctccacatcacgacctgcagctttgtggccccctggaacagtctgtctctggcccagcgaagagggtttaccaagacctataccgtcggatgtgaggagtgcacagtgttcccatgtctttccattccctgtaagttacaaagcggcacccattgcctgtggacagaccagctcctgcaaggatctgaaaagggctttcagagcaggcaccttgcttgtctccctagggagccggggctgtgcacatggcagagcctgagatctcagatcgcttag

SEQ ID NO: 17680 - DNA, 411 bp, Artificial Sequence
  Description of Artificial Sequence: Synthetic coding sequence
atggcaccatttgagccgctggcatctgggatccttttgttgctttggctgatcgccccatctcgcgcctgcacctgtgtgccacctcacccccagaccgccttttgcaactcagatctggtcatccgcgcaaagtttgtgggcacccctgaggttaaccagaccacattgtaccagaggtacgagataaagatgacaaagatgtacaagggctttcaagccctgggtgatgcggcggatatccgcttcgtctatacccctgctatggagtctgtgtgcggatactttcatagatctcataatcggtccgaggagttcctgattgccggtgaagccccatccccccgcccagtcccccatcagcccgtgccaggagctagaccgtctaatcatgagggtgcaaggctctag

SEQ ID NO: 17681 - DNA, 663 bp, Artificial Sequence
  Description of Artificial Sequence: Synthetic coding sequence
atgggagcagctgcccgtactcttcggctcgcgttgggcctgcttctgctggcgactctgctgaggcccgccgacgcttgctcttgtagccccgtgcaccctcagcaggcattttgtaacgcagatgttgtgataagggcaaaagccgtgagcgagaaagaagtggacagcggcaatgatatatacggtaatcccatcaagagaattcagtatgagatcaagcaaatcaaaatgttcaagggtccagaaaaagatatagagttcatctacactgctccaagttccgccgtttgcggggtttctctggatgtggggggcaagaaagagtatctgatcgccggcaaagctgaaggagacgggaaaatgcatattactttatgcgattttatcgtgccttgggacacacttagtactacccaaaagaagtcactcaaccataggtaccaaatggggtgcgaatgcaagatcaccaggtgcccgatgatcccttgttacatttctagtcctgacgagtgcctgtggatggactgggtaacagaaaaaaatatcaatggtcatcaggccaaattctttgcctgcattaagagatctgacggatcctgcgcctggtatagaggggccgccccaccgaagcaagaatttctcgatattgaggacccatag

SEQ ID NO: 17682 - DNA, 432 bp, Artificial Sequence
  Description of Artificial Sequence: Synthetic coding sequence
atgttcaaggggccagaaaaagatattgagtttatttacacagcgccctcttccgcggtctgcggcgtgagccttgacgttggcggaaagaaagaatacctgattgcgggtaaggctgagggtgacggcaagatgcacatcaccctgtgtgactttatcgtcccttgggacacattgagcacgacgcagaagaagtcgcttaatcaccggtatcaaatgggctgcgagtgcaagatcaccagatgtccaatgattccctgttacatttcctctcctgacgagtgcctatggatggattgggtgacagagaaaaatatcaacggccatcaggcgaagttctttgcatgcatcaagagaagcgatggttcgtgcgcttggtaccggggcgccgccccacccaagcaggagttcttggatattgaagacccctag

SEQ ID NO: 17683 - DNA, 636 bp, Artificial Sequence
  Description of Artificial Sequence: Synthetic coding sequence
atgacgccctggctggggctgattgttttattgggcagctggagcttaggggactggggcgctgaagcctgtacttgttccccctcccatccccaagatgcgttctgcaacagtgatatcgtgatccgagcgaaagtcgtgggcaaaaaacttgtgaaggaggggccctttggaactctggtttataccatcaaacagatgaagatgtatagagggtttaccaaaatgcctcatgtgcagtatatacacaccgaggcgtccgagtccctttgcggcttgaagctcgaagtgaacaaataccagtaccttctaacaggccgagtttacgacggtaaaatgtacacaggtctctgcaatttcgtcgaaagatgggaccagttaacactatcccaaagaaagggtctaaattataggtaccacctaggatgtaattgcaagataaagtcttgttattatctgccttgttttgtcacctcaaagaacgaatgcttgtggacagatatgctgagcaactttggctaccctggctatcagtccaagcactatgcctgcatcagacaaaaagggggttattgctcctggtatagagggtgggctcctcctgacaaatctattattaatgctaccgacccttag

SEQ ID NO: 17684 - DNA, 438 bp, Artificial Sequence
  Description of Artificial Sequence: Synthetic coding sequence
atgaagatgtatcgcggattcacaaagatgccacatgtgcagtatatccacaccgaggcctctgagtccttgtgcggtcttaagctggaagtgaacaagtaccagtacctgctgaccggccgcgtctacgatgggaaaatgtataccggcctctgcaatttcgtggagcgttgggaccaactgaccctgagtcagaggaaagggctgaactatcgataccatcttgggtgtaactgcaagatcaagagctgctattacctgccgtgtttcgttacctcaaaaaatgagtgtttatggactgacatgctgagcaattttggatatccaggatatcaatctaagcactatgcttgtatccgccagaaaggcggctattgctcatggtataggggttgggctccaccagacaagagtatcattaacgccactgacccgtag

SEQ ID NO: 17685 - DNA, 675 bp, Artificial Sequence
  Description of Artificial Sequence: Synthetic coding sequence
atgcctggatccccaaggccagcaccctcttgggtactactgcttagactgttggcccttctgcgcccacctggtttaggtgaggcatgttcatgcgcgcctgcacacccccaacagcatatctgccattcagcgttggtaattcgcgcgaaaatcagctctgaaaaggtggttcccgccagcgcagatccggcagatactgagaaaatgttgagatacgaaataaaacagattaagatgttcaagggatttgaaaaagtcaaggacgtacagtatatctacactcctttcgactccagcctctgtggggttaaactggaagcaaattcccaaaaacagtacttgcttaccggccaggtactgtccgatgggaaagtgtttatacatttgtgcaactacatcgagccctgggaggacctttctttagtgcagagagagtctctcaatcaccactaccatctgaactgtgggtgccagatcacgacgtgctatacggtcccttgcaccatcagtgcaccaaacgagtgcctatggactgattggctcttagaaagaaaactgtatggataccaggctcaacattatgtttgtatgaagcatgtggatggcacatgcagttggtaccgaggacacctgccattgcgcaaagagttcgtggacattgtgcagccttag

SEQ ID NO: 17686 - DNA, 1164 bp, Artificial Sequence
  Description of Artificial Sequence: Synthetic coding sequence
atggtgcactgctcctgcgtgctgttccggaaatacgggaacttcattgacaaactcaggctgttcactcgaggtggaagtggtgggatggggtatccccggttggggggcgaagggggaaaaggaggcgacgtgtgggtggttgcacagaacaggatgaccctgaagcaacttaaggacaggtatcccagaaaacgattcgtcgcaggcgtgggagcaaatagtaaaatcagcgccctgaagggcagtaagggaaaggactgtgagatccctgttcccgttggcattagcgttaccgatgaaaacggcaaaataattggcgaattaaataaggagaacgatcggattctggtagcccagggtggactgggcggcaagttacttaccaattttctacctctgaaggggcaaaaacgcattattcatctggatttaaaactcattgcagacgttgggctcgtggggttcccgaacgcgggaaaatcttcactgctgtcctgcgtgtcacatgccaagccagcaatcgccgattacgccttcacaaccctgaaaccagaactgggtaagataatgtattctgatttcaaacagatctccgtcgctgatctcccgggtcttatagaaggcgcacacatgaataaagggatgggacacaagttcctgaaacacattgagcggactcgacagttgctgttcgttgtcgacattagtggatttcagctcagtagccacactcagtataggacagcctttgaaaccatcattctgctcacaaaggagttagaactgtataaagaggagttgcagacaaaacccgccttattggccgtgaataagatggatctgcctgacgcccaagataagttccatgaattgatgagtcaactacagaacccgaaggattttctgcatctgtttgagaaaaatatgataccagaaagaacagtggaattccagcacattattccaatatccgcagtgacaggcgaaggaatagaagaattaaagaactgcattcgcaaatcactcgatgaacaggccaatcaggaaaacgacgcacttcacaaaaaacaactgttgaatctgtggatctcagatactatgtcctctacagagcccccctcaaagcatgctgtgactacaagcaaaatggacataatatag

SEQ ID NO: 17687 - DNA, 375 bp, Artificial Sequence
  Description of Artificial Sequence: Synthetic coding sequence
atggatcctgctagaccacttgggctgtccatcctcctgctctttctgaccgaggcggcgcttggggacgcagcccaggagcctacaggcaataacgctgagatatgtctcctgcccctggactacggtccctgccgagctctgctgctgaggtactactacgatcgctacacacagagctgtcgacaatttctgtacggcgggtgcgaaggaaatgccaacaatttttatacctgggaagcatgtgatgacgcttgctggcggatcgagaaagtgcccaaattgagctcaatgacttctctgaagaagaaaaaaaaaatgcccaagctgcgtttcgcttccaggatccggaagatcaggaagaaacagttctag

SEQ ID NO: 17688 - DNA, 1506 bp, Artificial Sequence
  Description of Artificial Sequence: Synthetic coding sequence
atggcggctgctagcgttaccccgcccggatctctggagctcttacaacctggattctcgaaaacgcttctgggcaccaagttggaggccaagtatctgtgttcagcatgtcggaacgttctgaggagacccttccaggctcagtgcggtcaccggtattgctccttttgtctggccagtattctatccagtggcccccagaactgtgccgcctgtgtccacgaaggaatttatgaggagggaatctcgattctggagagcagctccgcgtttcccgacaacgcagctcgccgtgaggtggagtccttacctgctgtgtgcccaagtgacgggtgcacctggaagggcactttaaaagagtacgagtcctgtcatgagggcagatgtccattgatgctgaccgaatgtcctgcctgcaagggtttggtgagactcggggagaaggagagacatctagaacacgaatgtccggagagatccctttcgtgtaggcattgtagagcaccttgctgcggcgccgacgttaaagcgcaccacgaggtttgtccgaaatttcccttaacctgtgacgggtgtggcaagaaaaaaattccaagagaaaagtttcaagatcacgtcaagacttgcgggaaatgccgggtgccctgtagattccacgccatcggttgcctggaaaccgtcgaaggggagaaacagcaggaacatgaagtgcagtggctacgggagcatcttgcaatgttactctcctctgtgctcgaggccaagccgctgctgggagatcagtcccatgccggctcagagctgctgcagcgctgtgaatctttggagaagaaaaccgccacctttgaaaacattgtgtgtgtgctgaaccgtgaggtcgagagggtggcgatgactgcagaggcctgttcaaggcaacatcggcttgaccaggacaagatagaggccttgagctccaaggtgcagcagctggagcgcagcattggtttgaaggacttggccatggcagacctggaacagaaagtcctggagatggaggcctcaacatacgacggcgtgttcatctggaaaatttctgatttcgccagaaagagacaagaagccgtcgctgggcggatccctgccatttttagtcccgctttctacacatcccgatatgggtacaagatgtgcctccgcatctacctgaacggcgatggcactggcaggggcactcatttgtcactatttttcgtcgtgatgaaaggccctaatgatgctttactgagatggccgttcaaccaaaaagtgacacttatgctcctggaccagaacaatagggaacacgttatcgatgcctttaggcctgacgtgactagctcctcttttcagaggcccgttaatgatatgaacatagcgtcagggtgcccacttttttgtccagtgtccaaaatggaggccaaaaattcttacgtgcgcgacgatgccattttcatcaaggctattgtggatctgacggggctgtag

SEQ ID NO: 17689 - DNA, 1662 bp, Artificial Sequence
  Description of Artificial Sequence: Synthetic coding sequence
atggctgctgcatccgtcactccgcccggctctcttgagctgctccagcccggattctccaaaaccctgctgggtacaaaacttgaagccaaatatctttgctcagcatgtaggaacgtgttacgtcggccattccaggcgcagtgcggtcataggtattgttcgttttgtttggcctccatcctgtcgagcggccctcagaactgcgccgcctgcgtgcacgagggaatttacgaggaagggattagtattctggaaagttcgagtgccttccccgacaatgcagccaggcgggaagtggaaagccttccagcggtttgcccctccgacggttgcacttggaagggaacactcaaggagtatgaggtcaaaatgccagcatgcggtatggtcaccgaggccccagcagtggggtcacgacctcgctcaccttcgtcgtatgacttggttttgcacgtgcccctaaccggggccgaagcttgcctgatgtctgtggaagaggagactgaattactattgcggtcctgtcatgaggggcgatgtccactaatgctcactgagtgcccagcctgcaagggacttgtacgtctaggtgaaaaagaacgacacttagaacatgaatgccccgagcgctctctctcctgcagacattgccgtgctccctgctgtggagctgacgtgaaggcccatcacgaagtgtgccctaagtttccgctgacctgcgacgggtgcgggaagaagaagattcctcgggaaaagtttcaggatcacgtcaagacctgcggaaagtgccgtgtaccctgtaggttccacgctattggatgcttggagaccgttgagggcgagaagcagcaggagcatgaagtgcagtggcttcgggaacacttagcaatgttactgagctctgtgctcgaggcgaagccactccttggcgatcagagtcatgcgggttccgaattgctccagcggtgcgagagtctggagaagaaaactgcaacttttgagaatattgtctgcgtacttaatcgtgaggtggagcgcgttgcaatgaccgcagaggcttgctctcgccagcacagactcgatcaggacaagattgaggcgttgagctccaaagtgcagcagctggagagatctatcgggcttaaggatctggccatggccgaccttgaacaaaaggtcctggaaatggaagctagtacctacgacggcgtttttatttggaaaatcagcgattttgctcgcaaacgccaggaggccgttgcaggccgcatcccagccatcttttctcccgcgttttacacgagcaggtacggctataaaatgtgtctgaggatctatctaaatggagacggaactggtagaggaacacatctcagtctctttttcgtggtgatgaagggacctaatgacgcactgctgaggtggccgtttaaccagaaggtcactttaatgctgctggaccagaacaaccgcgagcacgtaatagatgcctttaggccggacgtcacctctagctcctttcagaggccagtgaacgatatgaacatcgcaagcggctgtccgttattttgtccagtcagcaaaatggaagcgaaaaattcctacgtgcgggacgacgccatctttattaaggccatcgtcgatctgaccggtctctag

SEQ ID NO: 17690 - DNA, 1269 bp, Artificial Sequence
  Description of Artificial Sequence: Synthetic coding sequence
atggcagctgcttctgtaactcccccagggtctcttgagctgctgcaacccggattctccaagaccctgttgggcacaaagctggaagcaaaatacctgtgttctgcttgccgaaatgttcttcggcgacccttccaggcccagtgtggccatcgttactgtagcttttgtctcgcctccatactttcctccggccctcaaaattgcgccgcatgtgtgcatgagggaatatatgaggagggcatttcgatcctggagtcatcaagcgctttccccgataacgcagcaaggagagaggtcgagagcttacctgccgtgtgtccctccgatggctgcacgtggaaaggaactctgaaggaatacgaggttaaaatgcccgcatgcggtatggtcacagaagcacctgccgtggggagcaggcctcgctccccctcttcttacgatctcgtgttacatgtgcctctcaccggggctgaagcctgtctgatgagcgttgaggaagagaccgagctgctattacggtcctgccatgaggggcggtgtccactgatgttaaccgaatgtcccgcctgcaaaggacttgtcaggctgggtgaaaaagaaaggcacctggaacacgaatgtccagaacgatcactgagttgcaggcattgcagagctccctgttgtggagccgacgttaaaaggttggaccaagacaaaattgaagctctgtccagcaaggtgcagcagttggagcgctcgatcggactcaaagacctggccatggcagatttggaacagaaggtgttagagatggaagcgagcacatacgatggagtcttcatctggaagatcagtgacttcgctaggaagagacaggaagcagtggctggacggattcctgccattttttcccccgccttttacacaagtagatatggctacaaaatgtgcctcagaatttatctgaatggggatggaacaggccggggcactcacctgagtcttttctttgtggtcatgaaggggcctaatgacgcacttttgcgctggccatttaatcagaaggtgactttgatgttgctcgatcaaaataatagggaacatgtgatagacgcgtttaggcccgatgtgaccagcagcagctttcagagacccgtcaatgacatgaatatcgcgtccggttgtccgcttttctgtcctgtgagtaagatggaagcaaaaaatagttacgtccgagatgacgccatcttcataaaagcgatcgtggatctgacaggcttatag

SEQ ID NO: 17691 - DNA, 366 bp, Artificial Sequence
  Description of Artificial Sequence: Synthetic coding sequence
atggccgccgcgtccgtcacccctccaggttcactggaactgcttcagcccgggttctccaagaccttactgggcacaaagcttgaagccaagtacctctgttcagcttgtcgcaatgttctacgccgccccttccaggcccagtgcgggcacaggtactgctcgttctgcctggcatctatcctcagctccggaccacagaattgcgccgcgtgcgtgcatgaggggatttacgaggaaggtataagtatcctggagagctctagcgcgtttcctgataatgctgcgcgccgcgaagtggaatcattacctgctgtgtgcccaagtgatggatgcacctggaaggggacactcaaggagtactag

SEQ ID NO: 17692 - DNA, 519 bp, Artificial Sequence
  Description of Artificial Sequence: Synthetic coding sequence
atggcggccgcatctgttacacccccaggcagcctggagctgctgcaacccggatttagtaaaaccctcctaggaacaaaactcgaagctaagtatctatgcagcgcttgtcggaatgtgctacgacggcccttccaggcacagtgcggccaccgatattgttcattttgcctggcctcaatcctgtcgagtggcccacagaattgcgccgcctgtgttcacgaagggatttatgaggaggggatatctattctcgagtcctccagcgcctttcccgataatgctgccaggagagaggtggagtcccttccggccgtgtgtccttccgacggctgcacttggaaggggaccctaaaggaatacgaaagctgtcatgagggcaggtgcccactgatgctaactgaatgtcctgcctgcaagggtctggttcgtcttggtgaaaaggagcgccatctggaacacgagtgtcctgagcgcagcttaagctgtaggcattgtcgtgcaccttgttgcgggtag

SEQ ID NO: 17693 - DNA, 582 bp, Artificial Sequence
  Description of Artificial Sequence: Synthetic coding sequence
atggcggctgccagcgtaaccccaccaggatcccttgaattgctacagccaggattcagcaagacactgctggggaccaaacttgaggccaagtatctgtgctcggcttgtcgtaatgtgctccggagacccttccaggcccagtgcggtcaccgttactgctccttttgcttggccagcatcttaagtagcggccctcagaactgcgcggcctgcgtccatgaggggatatacgaagaaggaatcagcattttagagtcttcgtccgcttttccagataatgcagcccgtcgcgaggtggagagcctgcccgccgtgtgtccatcggacgggtgtacttggaaagggacacttaaagagtacgagtcctgtcacgaagggcgctgcccactgatgctgaccgaatgcccagcttgcaaaggactcgtgcggctgggtgagaaagagaggcacctggaacatgaatgccccgagagatctctgagttgcaggcactgccgggccccctgttgcggagctgacgttaaagcccatcacgaagtgtgtcccaaatttcccctcacctgtgacggctgcggttag

SEQ ID NO: 17694 - DNA, 1503 bp, Artificial Sequence
  Description of Artificial Sequence: Synthetic coding sequence
gtggccggaagagccctcagttccggccgagccgcaactgtaggagccctttttgccggtgttaccgccctaatggctgccgcatccgtgacaccacctgggtcactggagctcttgcagccgggatttagcaagacgcttctcggcactaaactggaagctaagtatctgtgttcagcctgccgtaatgtattgagacgaccattccaggctcagtgcggccacaggtactgttccttctgtctagctagtattctctcaagcgggccccagaactgtgccgcatgcgtgcatgaaggtatttatgaagagggcatttcaattctggagagttcatctgctttccccgacaatgctgcgcgccgggaggtggaatccttgcctgctgtgtgtccatctgatggatgtacatggaaagggaccctcaaagaatatgagtcatgccatgaggggcgctgcccactgatgctcacggagtgccctgcatgcaagggtcttgtgcgactcggcgagaaggaacgccacctcgaacatgagtgtcctgaacgctcactgagctgtcgccactgcagagccccatgttgtggcgccgatgtgaaatttcaagaccacgtgaagacatgtggaaagtgcagggtaccctgcagattccacgcaataggatgcctggagactgttgagggggaaaagcagcaggagcatgaagtccaatggttacgggaacatttggcaatgttgctgagctctgtgcttgaagctaagccacttctgggtgatcaatctcacgctggctccgaactgctacagcgctgcgagtccctggagaagaagaccgccacattcgaaaacatcgtgtgcgtactgaacagggaggtagaacgcgtggcgatgaccgccgaggcttgcagcagacagcatagactcgatcaggacaagattgaagcgctttccagtaaggtgcagcagcttgagcgtagcattggactcaaggacctcgctatggctgacctcgaacaaaaagtcttggaaatggaggcttccacttacgatggagttttcatatggaagatcagcgacttcgcgcgcaagagacaagaagcagtagccggcagaatcccagctatctttagccctgcattttatactagccgatatggatataagatgtgcttgagaatctaccttaacggggacggaactggtagggggactcatttgagcttgttcttcgtggtgatgaaggggccaaatgatgcactgttacggtggccttttaaccagaaagttactctgatgctcctggatcagaacaatcgggagcacgttatcgatgcctttagaccagatgtgacttctagcagtttccagcgcccagtcaatgatatgaacattgccagtgggtgccctctattctgccctgtgtccaaaatggaggccaagaactcatacgtgcgagatgatgccatctttatcaaggccatcgtagatctaacaggtttatag

SEQ ID NO: 17695 - DNA, 1506 bp, Artificial Sequence
  Description of Artificial Sequence: Synthetic coding sequence
atggcggccgcctctgtgaccccaccagggtccttggaactgttgcaacccggcttcagcaagacattgcttggaactaaattagaagcaaaatacctgtgtagcgcatgtcggaatgtgctgagaaggcccttccaagcacagtgcgggcatagatactgctcattctgtctcgcctcaattcttagctcaggtccccagaactgcgccgcatgtgtgcacgagggcatttatgaggaaggtatctccattctggagagctccagcgcattccctgacaacgctgcacggagagaggtggagagcctgcctgccgtgtgtccatcggacggttgcacgtggaagggcactcttaaggaatatgaatcttgccatgagggaaggtgtccccttatgctgacagaatgtccagcttgtaaaggccttgtgcgcctgggcgaaaaggagcggcacctggaacacgaatgtccggagcgaagcctatcttgtaggcactgccgtgcgccctgctgcggggctgatgtgaaagctcatcatgaagtgtgccccaagtttcctcttacttgcgacgggtgtggcaaaaaaaagatcccaagggaaaagttccaggaccacgtgaaaacatgtggtaagtgcagggtaccttgtcggtttcatgcaattggatgtctggagaccgttgagggggagaagcagcaggagcacgaagtgcagtggctgcgggagcacttagccatgctactctcatctgtcctggaagccaaacccctacttggcgatcaatcgcatgccggcagcgagctgctacagcggtgtgagtccttagagaagaaaacagccactttcgaaaacatcgtgtgtgtgctcaatagagaagtggagagagtagccatgacggccgaagcttgtagccggcagcaccgcttagatcaagacaaaattgaggccctgtcaagtaaggtgcagcaactggaacgtagtatcgggctaaaggacctggcaatggccgacctggagcagaaggtgttggagatggaggcatccacctacgatggagtctttatctggaagataagcgatttcgcgcgcaaaaggcaggaggcagttgctggtagaattcctgctattttcagtccggccttttatacctcccgatacggctataaaatgtgcctgcggatttatcttaacggcgatggtacgggcaggggaactcatctgtccctattcttcgtcgttatgaaagggcctaacgacgccctgctcaggtggcccttcaatcagaaagtgactctgatgctgctggaccagaacaatagagagcacgtcatcgatgcttttcgtccagacgtgacatcctctagttttcagcgaccggtgaatgacatgaatatcgcatctggctgtcctctcttttgtcccgtgagcaaaatggaggccaagaactcctatgtcagagacgacgccatttttatcaaggcgatcgttgaccttactggactgtag

SEQ ID NO: 17696 - DNA, 1632 bp, Artificial Sequence
  Description of Artificial Sequence: Synthetic coding sequence
atggagagcagtaagaagatggactccccgggtgctctgcagactaatcctcccttgaaactgcacactgacagatccgcaggtaccccggtattcgttcccgagcaaggaggatacaaggaaaagttcgtaaagacagtggaagacaagtataaatgtgagaagtgccacttggtgctgtgcagtcccaaacagactgagtgtggtcataggttctgcgagtcatgtatggccgcacttttatcgtcctcatcaccaaaatgcaccgcctgtcaggaatcgatcgtaaaggacaaagtgttcaaagataattgttgcaaacgggaaatcctggccctgcagatctattgtagaaatgaatcccgcggatgcgccgagcagcttatgttaggccacctcttggtgcacttaaaaaacgactgtcatttcgaggagcttccctgtgtacgaccagactgcaaagaaaaagtgttgcgtaaggacctgagagatcatgtggagaaagcctgtaagtacagagaagccacatgttctcattgcaaatcacaggtccccatgatcgcccttcagaagcatgaagataccgattgcccctgtgttgtggtctcgtgccctcataaatgctctgtgcagaccctcctgcgcagtgagggtaccaatcaacagattaaggctcacgaggcttcttcagcagtgcagcacgtcaatctgttaaaggagtggtccaactcactggagaaaaaagtgtccctactccaaaacgagagtgtggaaaagaataagtcaattcagtctctacacaatcagatttgcagttttgaaatagagatagagcgtcagaaagagatgctaagaaacaacgaaagcaagatactgcacctgcagagagttatcgattcgcaggctgagaagcttaaggagctggacaaggagatccgcccattcagacagaactgggaggaggctgacagcatgaaaagcagcgtagaaagcttgcaaaatagagtcacagagctcgaatccgtcgacaagtccgcaggccaggtagcccgaaacactggcctgcttgagtcacagctctccaggcatgaccaaatgctctctgtgcatgatatcagattagcagatatggacctaaggttccaggtgttggaaaccgcctcttataatggcgtgctgatctggaaaattcgggactacaagcggcgcaaacaggaggccgtgatgggaaagacactgtctttgtatagccagccattctacacaggatattttggctacaaaatgtgcgctcgagtgtatctgaatggcgatggaatgggaaaaggcacccacctgtccttattctttgtgatcatgcggggcgaatatgacgctctgctgccttggccttttaaacaaaaggttaccttgatgttgatggaccagggcagctctaggcgacacctgggggatgcattcaagcccgacccaaacagctcctcttttaaaaagcctaccggggaaatgaatatagccagcggttgtccggtttttgtagcccagaccgtgcttgaaaacggaacctacatcaaagatgataccatctttatcaaagtcatcgttgatacttctgacctcccagatccatag

SEQ ID NO: 17697 - DNA, 1632 bp, Artificial Sequence
  Description of Artificial Sequence: Synthetic coding sequence
atggagagctcgaaaaaaatggacagccccggggcgctgcagactaaccctccacttaaactgcatacggacaggagcgccgggactcccgtgtttgtgccagaacagggaggctacaaggaaaagtttgttaaaacggttgaggacaagtacaaatgtgaaaagtgtcacctcgtgctgtgcagccctaagcaaacggaatgcgggcaccgattctgtgagtcttgcatggctgcgctgctgtcctcgtcttcccccaagtgtacggcgtgtcaagaaagtattgtgaaggataaggtgtttaaggacaattgctgcaaacgggaaattctcgctttacagatatactgtcgtaacgagtcgcgggggtgcgcggaacagttgatgctggggcatctgctggtgcatctgaagaacgattgtcattttgaggagctgccttgtgttcggcctgactgcaaagagaaagtgcttaggaaggatctcagagaccacgtagagaaggcctgcaaataccgcgaagccacttgttcacactgcaagtcacaagttccaatgatcgccctgcagaagcacgaggacaccgactgcccttgcgtagtcgtgagttgcccccataagtgcagtgtgcagacactgctgcgatctgaagggaccaaccagcagatcaaggcccacgaagcctcatccgcggtccagcatgtgaacctgctgaaagagtggtctaatagcttagagaagaaggtatctcttttgcaaaacgagagtgtggagaagaataagtcaatccagagcctgcacaatcagatctgctcctttgagatcgaaatcgagagacagaaagagatgctgcgaaataatgagagtaagatcctgcatctccagcgcgtgatcgatagtcaggctgagaagcttaaagagctggataaggaaatacggccattccgccaaaattgggaagaagccgatagtatgaagagtagcgtcgaaagtctgcagaatcgggttaccgagctagaaagcgtggacaagagcgccgggcaggtcgctcggaatacgggcctactcgagtcccagctgtcaaggcacgaccagatgctgtccgttcacgacattcgtctggccgacatggatctgagatttcaggtgctggaaactgccagttacaacggagttctcatatggaagatcagggattacaagcgcaggaagcaagaggcagtgatgggcaaaacactatcattgtatagccagcctttctataccggatatttcgggtacaagatgtgcgcacgcgtatacctcaatggagatgggatgggcaagggcacccacctatccttgttctttgttatcatgcgaggcgaatatgatgcattgctgccctggcccttcaagcagaaagtgaccctcatgcttatggatcaaggtagctccagaagacacctcggagatgcatttaaaccagaccctaacagttcctcattcaaaaagccaaccggtgagatgaatatcgcatcgggttgccctgtcttcgtagctcagacggtactggaaaacggcacatatattaaagatgacactatcttcattaaggtgatcgtggacactagcgatcttcccgacccgtag

SEQ ID NO: 17698 - DNA, 1707 bp, Artificial Sequence
  Description of Artificial Sequence: Synthetic coding sequence
atggaatccagcaagaagatggattcaccgggggcccttcagaccaatccccctctgaagctgcacactgaccgatctgcagggactcctgttttcgtgcctgagcagggcggctataaagagaagttcgtgaagactgtggaagacaagtataaatgcgagaagtgtcacctggtgctctgttctccgaagcagaccgaatgtggtcatcgcttttgcgaatcttgcatggcagccttactctcctcctcttcgcccaagtgcacggcttgtcaagaatctatcgttaaggataaagtctttaaagataactgttgcaagagagaaatcctggctctgcagatttattgtcgcaacgaaagcaggggctgtgctgagcaactgatgctgggccacctcctggtgcacctgaagaatgactgtcacttcgaagagctcccctgcgtcaggcccgactgtaaggaaaaggtgctgagaaaggacctgcgtgaccacgtggaaaaggcgtgtaagtatagggaggcaacctgctctcactgcaaatcccaggtgccaatgatagcgcttcagaaacacgaggacactgattgtccttgcgttgtcgtttcatgcccgcacaagtgtagcgtccagacacttctcagatcggagctttctgcccacctgagtgagtgtgtcaacgcacctagcacttgcagtttcaagcgctacggctgtgtgtttcagggcaccaatcagcagatcaaggcccatgaggcctcctccgccgtgcagcatgtcaatctactgaaggaatggtcaaactccctggagaaaaaggtctcactgctccaaaatgagtccgtggagaagaacaagagcattcagtcgcttcacaaccagatctgcagttttgagatagagatagagaggcaaaaggaaatgctgcgtaacaacgaatctaaaatcctccacctgcagcgtgttatagattctcaggctgaaaaacttaaggagttggacaaggagattcggccatttcgtcagaattgggaggaggccgatagcatgaaaagcagcgttgagagcctacagaatcgagtgacagagctggagtccgtggataagagcgcagggcaagtggcacggaacactggcttgttagaaagtcagctgagccggcatgaccagatgctgtctgtgcatgacattaggctggcggacatggaccttcgattccaggttctcgagacagcctcgtacaatggtgtcttgatttggaagatcagggattataagaggaggaagcaggaggctgttatgggcaagacccttagcctatacagccagcccttctacaccggttacttcggctacaagatgtgtgcccgcgtgtacctcaacggcgacggtatgggtaaaggtacccacttgagtctatttttcgtcattatgcggggagagtacgatgcattgttgccatggccatttaagcagaaagtcactctgatgctaatggatcagggctcctcaagaaggcatctgggggatgcttttaaaccagatccgaacagcagttcctttaagaagccgaccggggaaatgaatattgcatccgggtgtcccgtctttgtggcacagaccgtcctcgagaatgggacatatattaaagacgataccattttcattaaagtaattgttgatactagcgacctacctgatccttag

SEQ ID NO: 17699 - DNA, 1458 bp, Artificial Sequence
  Description of Artificial Sequence: Synthetic coding sequence
atggaatcatccaagaagatggacagcccaggagcactccagacgaatccgccacttaaacttcatacagacaggagcgccggcactcctgtatttgttcccgagcagggcggctacaaagaaaaattcgtcaagacggtcgaagacaaatacaagtgcgagaagtgccacctggtgctttgttcaccaaaacagacagaatgcggccatcggttctgcgaatcttgcatggcagctctattatcttccagttcccccaagtgtaccgcttgccaggaatccattgtgaaggacaaggtattcaaggacaattgttgtaaacgggagatcctggctctgcagatctattgtagaaacgagagccgcggttgtgcggaacagttgatgctggggcacctcttggtgcacctgaagaatgactgccactttgaagagctcccatgtgtcaggcccgactgtaaagagaaagtcctccgcaaggacctgcgggaccatgtagagaaggcctgcaagtaccgcgaagcgacatgtagccactgcaagtcacaggtgcccatgatcgcacttcaggtcagtctgttgcagaatgagagcgtcgaaaaaaacaagtctatccagtcgctccataatcagatatgctcttttgagatagaaatcgagaggcagaaagagatgctgaggaacaacgaatctaaaattctgcatctccagcgtgtgattgatagccaagccgagaaattgaaggaactggataaagagattcgacccttccgccagaattgggaggaagcagatagtatgaagtcaagtgtggaaagcctgcagaatagggtgactgaactcgaatccgtcgataagtccgctggacaggtggccagaaatacagggttgctggagtcccagctgagccggcacgaccagatgctctcggttcatgacatccggctcgccgatatggatttgaggttccaggtgttagaaacagcaagttacaacggagtgcttatctggaagatccgggattacaagcgacgcaaacaggaggccgtgatgggaaagactcttagcctctacagtcaacccttctatactgggtactttggctacaaaatgtgtgcccgtgtttatcttaacggggacggcatgggcaagggcacacatctctccctgttttttgtgatcatgcggggggagtacgacgcactcctaccatggcccttcaaacaaaaagtgactctgatgctgatggatcagggctctagtcggaggcacctgggggacgcctttaaacccgatcctaattcatcttcctttaagaaaccaaccggcgaaatgaatatcgcttccggttgccccgtctttgttgcgcagacagttctggagaacgggacatatattaaggatgacaccatcttcatcaaggtgatagtggatacatccgaccttcccgacccatag

SEQ ID NO: 17700 - DNA, 1707 bp, Artificial Sequence
  Description of Artificial Sequence: Synthetic coding sequence
atggagagtagcaaaaagatggactctcccggggctctgcagacaaatccccccttgaaactgcatacagatcgttcagccggaacccctgtgttcgttccagagcaagggggatataaggaaaagttcgttaaaaccgtagaagacaaatataaatgtgaaaaatgtcatctagttctctgttccccaaagcagacagaatgtggccatcgcttctgcgaaagttgcatggctgcattgctgagttcttccagtcctaagtgcaccgcctgtcaggaatccattgttaaagacaaggtctttaaggacaattgttgtaaaagagagattctggccttgcagatctactgcagaaacgagtcacgagggtgcgcagagcagctgatgctgggacacctactggtgcacttgaagaacgactgccactttgaggagttgccatgtgtgcgccctgactgtaaagaaaaagtgctgagaaaggacctgagagaccacgttgagaaagcatgcaaatacagggaggccacgtgcagccactgcaaatcccaagtgcccatgatcgcactccagaaacatgaggacaccgactgtccttgtgtggtggtctcttgccctcataaatgcagcgtacagaccctgctaagatcagagctttccgcgcatctatcagaatgtgtcaatgccccatcaacatgcagttttaaaagatatggctgcgtatttcagggtacaaaccagcaaatcaaggctcatgaggcaagcagtgccgtgcaacatgtcaacctgctcaaagagtggtccaactcgctcgagaagaaggtgagtctgctgcagaatgagtctgttgaaaagaacaaatctatacagtctcttcataatcagatctgttcgtttgagatcgaaatcgagcgccagaaagagatgctcagaaataacgagagcaagatcctgcacctccagagagtgatcgatagccaggcagaaaagcttaaggagctcgacaaggagatccggcccttcaggcagaattgggaagaagcagattcaatgaaatcgtctgtcgagagcttgcagaaccgggtaaccgaacttgaaagtgtggataaatctgctggacaagtggctcgaaacacaggtcttctggaatctcagctgtcaaggcacgatcaaatgctttctgtgcatgatataagactcgccgatatggatctgcgttttcaggttctggaaaccgctagctataatggcgtgcttatctggaaaatcagggactacaaaaggcggaagcaggaagccgtgatgggcaagaccttgtctttgtattctcagccgttctataccggttactttggttataagatgtgcgcgcgggtgtacttaaacggggatgggatgggcaaggggactcacctgtcgctcttctttgtgatcatgcggggggagtacgacgccctgctcccttggccctttaaacagaaggtaacattgatgctgatggaccagggatcctctagacgccatctcggtgatgctttcaagcctgatcccaacagtagcagctttaagaagccaacaggagaaatgaacatcgctagcggatgtcccgtattcgttgcccagacagtccttgagaacggaacatatattaaggacgacactatcttcattaaagtaattgtggatacgagtgatctccctgatccatag

SEQ ID NO: 17701 - DNA, 285 bp, Artificial Sequence
  Description of Artificial Sequence: Synthetic coding sequence
atggagagctcaaaaaaaatggattcaccaggtgcattgcagacaaatccacccctaaaacttcacaccgacaggtctgctggaacaccagtgttcgtgccagaacaggggggatacaaggagaagttcgtaaaaacagtcgaagacaaatataaatgtgagaagtgtcacctggtgctttgttcacctaaacagactgagtgcggccacaggttctgcgaaagttgcatggctgcccttctgtcttcgtcttcacccaagtgcactgcttgccaggagtcttag

SEQ ID NO: 17702 - DNA, 939 bp, Artificial Sequence
  Description of Artificial Sequence: Synthetic coding sequence
atggctgcgggacagaacggtcatgaggagtgggtgggtagcgcttacctgtttgtcgagagctccttagataaagttgtgctttccgacgcttacgcccatccccagcagaaagtggctgtgtatagagctctgcaggccgccctcgccgaaagcggaggatctcccgatgtgctacagatgctcaagatccatcgtagtgaccctcagttgattgtccagttacgcttctgcgggcgccagccatgtggaaggttcttaagggcctaccgagaaggcgccctccgagccgctttgcaaagaagcctggctgccgccttagctcagcactcggtccctctccaattggaattacgcgctggcgctgaacgccttgatgcccttctggctgacgaggaaagatgcctgtcatgcattcttgcacagcagcccgataggcttcgggatgaagaactcgccgagctggaggatgccctgagaaacctaaaatgcgggtccggagcccgcggaggagatggcgaggtggctagcgcccctctgcaacccccagtgccatctttgtctgaggtgaagccacctcccccccctcctccagctcagacgttcctgtttcaggggcagcctgtcgtaaatcggccactgagtttgaaggatcagcagacttttgccaggagtgtgggcctgaaatggaggaaggtgggaaggtctctacagcggggttgtcgggctttgcgggaccctgcactggacagcctcgcttacgaatacgagcgggagggactgtatgaacaggccttccagcttctacgtaggttcgttcaggccgaaggaagacgcgccacacttcagcgcctggtcgaagcacttgaggaaaacgagctcacttctctggccgaggatctactcggtctgaccgatcccaacggtggcctagcttag

SEQ ID NO: 17703 - DNA, 825 bp, Artificial Sequence
  Description of Artificial Sequence: Synthetic coding sequence
atggccaccactgtaagtacccagagaggtcccgtgtatatcggtgagctccctcaggacttcctgcggatcactcctacacagcagcagcgccaggttcagcttgacgcacaggctgcacagcagctccagtacggcggcgctgtcgggactgtggggcgattaaatattaccgtggtccaggccaaattggccaaaaactatggaatgaccagaatggacccctattgccggctgcgtctggggtatgctgtatatgaaactcctacagctcataatggggccaaaaatccgcgttggaacaaagttatccactgcacggtgccacccggggtcgactcgttttaccttgagatcttcgacgagagagccttttccatggacgatcgtatagcttggacccatatcacaattcctgagagcttgagacaaggaaaggtggaagacaagtggtactcgctgtcgggacgccagggcgacgataaggaaggaatgatcaatcttgtcatgtcttacgccctgcttcccgcggccatggtgatgcccccacaacccgtggtcctcatgcctaccgtttatcaacaaggagtgggatatgttcccattactggaatgccggccgtttgtagtcccgggatggttcccgtggcacttcctcctgctgccgttaacgcgcagcctagatgttcggaggaggatctcaaggcaatccaggacatgttcccgaacatggatcaagaggtgattcgttcagtgttagaagcgcaaagaggcaataaggatgccgctattaattctctactacaaatgggcgaggaaccgtag

SEQ ID NO: 17704 - DNA, 1059 bp, Artificial Sequence
  Description of Artificial Sequence: Synthetic coding sequence
cagctgtccccttcgcaggcccccgccggcgcacaggaagtggcacgcagggtaaccgtgggcagcgcctcccacggaggacgacggtccacgatggctactactgtgtcaacccagcgcggtccggtttacattggcgagctgccacaagattttttgcgtattactcccacacaacagcaaaggcaggtgcaactggacgcgcaggccgctcagcagttgcaatatggaggcgctgtaggcactgtggggcggcttaacattaccgtggtgcaggcaaaactcgctaaaaactatggaatgacccgaatggacccgtactgtaggctgcggcttggttacgccgtgtacgaaacgcccacagcccacaatggtgcaaagaacccccggtggaacaaggtgatccactgcaccgtgcctcccggcgtcgattccttctacctggagatctttgatgagagggccttttcaatggacgaccgaatcgcttggactcacataaccattccagaatccctcaggcagggaaaagtcgaagacaaatggtacagcctcagtggtcgtcagggggatgacaaagagggcatgatcaacttggttatgtcctacgcactgcttcccgccgccatggtaatgcctccacagcccgtggtgttgatgcccaccgtctaccagcagggggttggctacgtgcctatcacagggatgcctgcagtgtgttcgcccggcatggtgccagttgccttaccacctgccgcagtgaacgcccagccaaggtgcagtgaggaggacctcaaagcaattcaggatatgttccctaatatggaccaggaagtgattcgcagtgtgcttgaggcgcaaagggggaataaagacgcagccattcccagccatctggtactgggagggctgtctgctctgtcttgtccatgggatgtgcgactttcattctcctgtcggtcagggaagtgctcatgctgtcgggagcagctgctcttgcccggctgttggaggtggtggagtgcatttagatttcacagttggcactttgtgatgtag

SEQ ID NO: 17705 - DNA, 675 bp, Artificial Sequence
  Description of Artificial Sequence: Synthetic coding sequence
atggccacgacggtctctacacagcgcggcccagcaaagctggctaagaattatggcatgaccaggatggacccatactgcaggcttcgtttgggatacgcggtgtatgaaactcccaccgcacacaacggggccaagaacccacgctggaataaagtcattcactgcaccgttccacccggagtcgactctttctaccttgaaatatttgatgagcgagccttcagcatggacgacagaatcgcctggacccacattaccatcccagagtctctgagacagggcaaagtggaggataaatggtactcactgtctggaaggcagggagatgacaaagagggtatgattaatctcgtcatgtcttatgcccttctcccagccgcaatggttatgcccccacagccagtcgtgcttatgccaaccgtttaccaacagggagtgggctatgtcccgattacgggaatgccagccgtttgcagccccggcatggtgcccgttgcacttcctccagcggccgtgaacgctcagccccgatgtagcgaagaagacctgaaggcaattcaggatatgttccccaacatggatcaagaagtcataaggagtgtgttagaggcccaacggggcaacaaagatgcggccatcaacagtctcctgcagatgggtgaagagccatag

SEQ ID NO: 17706 - DNA, 768 bp, Artificial Sequence
  Description of Artificial Sequence: Synthetic coding sequence
atggcctcatcaacatcattgcctgcaccaggctctaggcctaagaagcccctggggaagatggccgactggtttagacagaccttactgaaaaagccgaagaaacggcccaattcgcccgaaagtactagctctgatgcttcccagccaaccagccaggatagtcctctcccaccatcgctttcaagcgtgaccagtccctccctccccccaacccacgccagcgactccggctcatctaggtggtctaaagactacgacgtgtgcgtgtgccattcagaggaggatctggttgccgcccaagacctggtgagctatttggagggctccacagcatcactgcgatgcttcctgcaactgagagatgcaactcctggtggggccatcgtgtccgaactttgtcaagcattgagttcttcccattgcagagtactgctcatcactcctggctttcttcaggacccgtggtgtaaataccaaatgcttcaggctcttacagaggctcctggagccgagggatgtacaattcctctactgtccgggttatcgagagcagcatatccacccgaactgcggtttatgtactacgtcgacggacggggccctgacggtggctttcgtcaagtgaaagaggccgtgatgagatccaaccaagttctcaagcacctgctgtatcatggcacccccgagataggggtgaaactggaaactgaaaatccatgtcgggcgtctgatagccacaaatgtgacaagcgataccgagaatag

SEQ ID NO: 17707 - DNA, 708 bp, Artificial Sequence
  Description of Artificial Sequence: Synthetic coding sequence
atggccagctcaacaagcttacccgcacctggatcccgaccgaaaaagccactggggaagatggctgattggttccggcagacactgctgaagaagcccaagaaaagaccaaatagtccagagagcacatcctcagacgcttctcagcccacgagccaggatagtcctctgcccccttctctcagtagcgttacatcgcctagtctgccccccacgcacgcctctgatagcggcagtagccggtggtccaaagactatgatgtgtgcgtatgtcacagcgaagaagatctggtagctgcacaggacttagtctcatacttggaaggcagcactgccagcctgaggtgctttcttcagctgagagacgccacccccggaggggcaatcgtgagtgagctatgccaggccctgtcctctagccactgtagggtcctgctgatcaccccgggctttttgcaggacccctggtgcaaataccaaatgctacaggccctgacagaggcacccggagccgaaggctgtaccattccactgctgtctggcctgagccgcgctgcctacccccccgagcttcgattcatgtattatgtcgatggaaggggtccagatgggggtttccggcaggtgaaagaagcggtgatgaggtgtaaattgttacaggaaggcgaaggggagagggacagcgcaaccgtgtccgatttactgtag

SEQ ID NO: 17708 - DNA, 666 bp, Artificial Sequence
  Description of Artificial Sequence: Synthetic coding sequence
atggcctcgagcaccagcctgcctgcaccagggtctaggccgaagaaaccccttggaaaaatggccgactggttccgacagacattgctgaagaagcctaaaaagcgtccgaattctcccgaaagcacctcaagcgatgcatcccagccaaccagccaggattctcctctgccacccagccttagtagtgtaacgagccctagtttgcctcccacacacgccagtgattcaggcagttcacggtggagcaaggattatgacgtgtgcgtgtgtcacagcgaagaagatctcgtggcagctcaggatctagtgtcataccttgagggaagcacagcttccctccgttgcttcttacagcttcgggatgccacccctgggggtgcgatcgtctccgagctttgtcaagcgctatctagctctcactgtcgcgtgctgctgattacccccgggtttctgcaggacccttggtgtaaataccaaatgctgcaggcattgacagaggcccctggcgccgaaggatgcaccatccctttgctgtcaggcctgtctcgcgcagcatatcctccggaactccgttttatgtactacgtagacggcagaggacccgatggaggctttcgacaagtcaaggaggccgtaatgagatatcttcagaccttgagctag

SEQ ID NO: 17709 - DNA, 666 bp, Artificial Sequence
  Description of Artificial Sequence: Synthetic coding sequence
atggccagctccacctcacttcccgctcccggtagtagacctaaaaagcctctgggtaaaatggcagattggttcagacagactttgctgaaaaaacctaagaagagacctaatagtcccgaatctacctcaagcgatgccagccagcctacgtctcaggattctcctctgcccccttccctgtcaagcgtgacatctcccagcttgcccccgactcacgcctccgactcaggcagctccaggtggagcaaggactatgatgtgtgtgtgtgccactctgaggaggatctggttgccgcccaagacttggtctcttacctcgaggggtctaccgcatcactccgctgctttctgcaactacgcgatgcaacgcctggcggggcaatcgtgtctgaactgtgccaggctctgtcgtcatctcattgccgcgtcctcttaatcacaccgggctttctccaggatccttggtgcaagtatcaaatgcttcaagcattaactgaggccccgggagcagaggggtgtaccattcccttactcagcgggctgtctagagccgcgtatccgccagagctaagatttatgtactacgttgatggtcggggccctgatggaggcttcaggcaggtcaaggaggccgtgatgagatatttgcagactctcagttag

SEQ ID NO: 17710 - DNA, 666 bp, Artificial Sequence
  Description of Artificial Sequence: Synthetic coding sequence
atggcttcttcgacctcgctccccgcacccggtagccgccccaaaaaaccccttggtaaaatggccgattggtttcggcaaacactgttgaagaaacccaagaagcgccctaactctcctgagtccacatctagtgacgcctcccagccaacatctcaggattcccccctgcctcccagtttgtcatctgtaaccagtccgtccctgccccccactcatgcctcagacagtggctccagccgctggtccaaggactatgacgtttgcgtgtgtcatagcgaggaggatttggtcgccgctcaggacctggtctcttacctggaggggtctacagcgagtctgcggtgtttcctgcagctaagagatgctacccctgggggggctatagtttctgagctgtgccaagccctgtctagttcgcactgtagggttttacttatcactccgggcttcctccaggatccctggtgcaaatatcagatgttgcaggccctcactgaagcacctggagccgaagggtgcaccatccctttgctgtccggactgtcaagagcggcctacccccccgaacttaggttcatgtactacgtggatggccgaggtccggacggcggcttccggcaggttaaagaagcagtcatgagatacctgcagacactctcctag

SEQ ID NO: 17711 - DNA, 2520 bp, Artificial Sequence
  Description of Artificial Sequence: Synthetic coding sequence
atgatgtctgcatctcgcctggctgggacgctcatacccgccatggccttccttagctgtgtgaggcctgagtcgtgggaaccatgcgttgaggtagtgccaaatattacctaccagtgcatggagctgaatttctacaagatccctgataatctgcctttctcaacaaaaaatctcgaccttagcttcaatccgctcaggcacctgggaagttactctttttttagttttccggagctacaggtgctggacctgtctcgatgcgaaatacagactatcgaggacggggcttaccaatcattgtctcatctttcaacacttattctgaccgggaatcctatccaatctttagcgctgggcgccttctcgggactatcgagtctgcaaaagctcgtcgctgtggaaacgaatctggcttccctggagaacttccccattgggcaccttaagacgctcaaagaactcaatgtggcccataacttgattcaatcgttcaagcttcctgaatactttagcaaccttaccaatctggagcacctggatctgtcttcaaataagatccaaagcatttactgtaccgatctgagggtcctgcatcagatgcccctcctgaatctaagtctggaccttagtctgaatcccatgaatttcattcaacctggagcttttaaggaaatcaggctgcataagcttaccctgagaaataatttcgactctctaaacgtgatgaaaacctgtatccaagggctggcaggactcgaggtgcatcgactggtccttggcgagttccgaaatgaggggaaccttgagaaattcgacaagtctgcacttgagggcctgtgtaacctgaccattgaagagttccggctagcttatcttgactattaccttgatgacattatcgacttgtttaactgcctcaccaacgtcagctctttctctctggtgagtgtgactattgaaagggttaaagatttcagttacaactttgggtggcagcatttagagctggtgaattgtaagttcgggcaattcccaactctaaaactcaaatcgctgaagcggttaacattcacaagtaacaaaggcggaaatgcattttctgaggtggacctgccatcacttgagtttctggacctcagtagaaacggcctgtctttcaaagggtgttgcagccagtcagattttggcaccacgtcccttaagtatttagacctctctttcaacggagttatcacgatgtctagcaatttcctgggcttagagcagcttgaacatttagacttccaacatagtaatctaaagcagatgtctgaattcagcgtttttctttccctgagaaacctcatttatctcgatatctcacatacccatactagagtggcttttaatggtatttttaatggactgtcttcgctggaggtgctcaagatggccggaaactcatttcaagaaaacttcctgccagatatctttacagagctgagaaacctgacttttttagatctctcccagtgtcagctagagcagctctcacctactgctttcaatagtctatcctccctgcaggtcctcaacatgagtcataacaacttctttagcctggatacttttccatataagtgtctcaatagtcttcaagtactcgattactcactgaatcatattatgacgagcaaaaagcaggaactgcagcacttcccttcaagcttggcctttttaaatcttactcagaatgatttcgcttgcacgtgcgaacaccaatccttcctgcaatggatcaaggatcagaggcagcttctggttgaggtagagcgcatggaatgcgcgacaccatccgataaacagggaatgccggtactgagccttaacataacatgccagatgaacaaaactataattggtgtatccgtcctcagtgtgctggtagtgtcagtggtggctgttttagtttacaaattttacttccatctaatgttgctggctgggtgtatcaagtatggccgtggcgagaatatctacgatgccttcgtcatctattcttcccaggacgaggattgggtcaggaatgaactcgtgaagaatttggaagaaggtgttccacccttccagctttgcctacattacagagatttcattcctggcgtggccatcgctgctaatattattcacgaaggcttccataaatctcggaaagtcatcgtggtcgtgtcccagcattttatccagtcgagatggtgcatcttcgagtacgagattgcccagacatggcagtttctcagctcaagggcgggcatcatatttattgtactccagaaagttgagaaaacattactccgccaacaggtcgagctatacaggcttctgtcccggaacacctatttggaatgggaggactccgtgctgggaagacacatattctggagaaggcttcggaaggctctgttggatggcaagagttggaatcctgagggcaccgtgggcacaggctgtaactggcaagaagccacatccatatag

SEQ ID NO: 17712 - DNA, 2400 bp, Artificial Sequence
  Description of Artificial Sequence: Synthetic coding sequence
atggaactgaacttctacaagatccctgataacctccccttcagcaccaagaaccttgatctgtcgttcaacccactgagacatttgggcagctactcattcttcagtttccccgaactccaggtgctggacttaagtagatgcgagatccagacgatagaggacggcgcttatcagtcactctcgcacctgtccaccctgattctgacaggtaatccaattcaatctctggcacttggcgcattttcaggcctgagctccctgcagaaacttgtggcggtggagacaaatctagcttccctggagaattttccgatcggccatctcaaaactctgaaagaattaaatgtcgcccacaacctgattcaatctttcaaactgccagagtacttttctaatttaaccaaccttgagcacctggacctgagttcaaataagatccagtccatatattgcactgatcttcgtgtgctgcaccagatgcccctgttaaacctgagcctagatctgtccttgaatcccatgaattttattcagccaggtgcgttcaaggagatccggctccacaagctcacactcagaaacaattttgattctctcaatgtgatgaaaacatgcatccaaggactggctggccttgaagtgcaccgcctcgtccttggcgaattcagaaacgagggaaacctggagaagttcgataagtcagctctggagggcctgtgcaatctgaccattgaggagttccgcctggcctacctcgactactaccttgacgatatcatagacctctttaattgtcttactaacgtaagctcttttagcctggtatctgttaccatcgagcgtgtgaaggatttcagctacaacttcggctggcagcacttagaactagtgaactgtaaatttggacagtttcctaccctgaagctgaaatccctcaagcggctcacattcacaagcaataagggtgggaacgccttttctgaggtggacctgccttctttagaattcctagacttatcaaggaacggcctgtcttttaaggggtgttgttctcaatcagatttcggaacaacatctctcaagtatctcgaccttagctttaatggggtcattacaatgtcctcaaactttctcggcctagaacaattggaacatctggatttccaacattcaaacttaaagcagatgtcagagttttccgtgttcctttctctgcgcaatctgatatacctggacatcagccatacccacacacgggtggcattcaacgggattttcaatggactgtcttcattagaggtgcttaaaatggctgggaacagcttccaggagaactttttgcctgacatctttaccgagctcaggaatctgacatttcttgacctgagccagtgccaattggaacagttgtcacctactgccttcaatagtttgtcttcactccaggtgctgaacatgtctcataataattttttttccttagatactttcccgtataaatgcttaaacagcctccaggttctggactactcactgaatcatataatgacctcgaaaaaacaggagctgcagcacttccctagctcgctggccttccttaacttgactcaaaacgattttgcttgtacatgtgagcaccaaagcttccttcaatggatcaaggatcaaaggcaacttctcgttgaggtagagcgcatggagtgtgcaacgccatcggataagcagggaatgccggtgttaagtctaaatattacttgccagatgaacaagacaattattggggtgtctgtactaagcgtcttagtggtctctgtcgtggccgtcctggtatacaaattctatttccacctgatgctgctcgcaggatgtatcaaatatggtcggggggagaatatctacgatgcttttgttatctatagtagccaggacgaagactgggttagaaatgaattggtcaagaacctggaagaaggtgtgcctccctttcagttgtgtctgcattatagggactttattcctggggtagcgattgccgccaatataatccacgagggatttcacaagtctaggaaagtgatagttgtggttagtcagcatttcatccagtcaaggtggtgcatcttcgagtacgagatcgcacagacttggcagtttctgagtagtcgggccgggattatcttcattgtcttgcagaaagtcgagaagaccttactccgccagcaggtagagctctatcgtcttctgtctaggaatacctacttggaatgggaagactccgtcttgggtaggcacatattttggcgtagactgaggaaagctctcctcgatgggaagtcttggaatccggaaggcactgtggggactgggtgcaactggcaggaagcgacttccatctag

SEQ ID NO: 17713 - DNA, 2577 bp, Artificial Sequence
  Description of Artificial Sequence: Synthetic coding sequence
atgggcgaccaccttgacttacttcttggcgtcgtattgatggccggacccgtattcggaattccttcctgctctttcgatgggagaatcgcattttaccggttctgcaacctgacacaagtgcctcaggtactgaatacaaccgaacggttgctgttgtcctttaattacatccgcactgtcactgcctccagttttccgtttttggaacagctgcagctgctggagctcggctcccagtacacccctctgactatcgataaagaggcgtttcggaatctgcccaacttgcgaattcttgatctgggcagctccaagatctattttttacatcccgatgcgtttcaagggctttttcatctcttcgaactgcgactctacttttgcgggctgagtgatgcggttctgaaggacggttattttcgcaacctgaaggcactgactcgactggatctgtctaaaaaccaaattcggtctctatacctgcacccctcattcgggaaactgaacagcctgaaatctattgacttttccagcaatcaaattttcctggtgtgcgagcatgaactcgagccactccagggaaagacattgtctttcttcagtctggccgccaactcactctactccagggtaagtgtcgattggggaaagtgtatgaatccgtttcgcaatatggtgctggaaattttagacgtctccgggaatgggtggactgtcgatataaccggaaactttagtaatgccattagcaagtctcaagcgttcagtctgatccttgcgcaccacattatgggcgctgggtttggttttcataacattaaggatccagaccagaacacttttgctggtcttgctaggagctctgtaaggcacctcgacctttcacacgggtttgtcttcagcttgaatagtcgcgtctttgaaaccctgaaggacttaaaggtgctaaacctggcttataataaaataaacaagatcgcagatgaagctttctatggtcttgacaatcttcaggttttaaacctgagctataacctgctgggcgagctgtactcctccaatttctatgggctgcctaaggtggcctatatagatctgcagaagaatcacatcgcaataatccaggaccagacatttaaattcctggaaaagcttcaaacactggacctcagagataacgctctgaccactattcacttcatccctagtattcccgatatcttcctgtctggtaacaagcttgtgaccttgcctaagattaacctgactgccaacctgatacacctgtctgaaaatcgactggaaaatctggatatcctctatttcctgctgcgcgtcccccatctgcagatcttgattttgaaccaaaatagatttagttcctgctcaggggaccagaccccctccgagaatccatcccttgaacaactgtttctcggtgaaaacatgctgcaactggcatgggaaaccgagctttgttgggatgtttttgagggactgagccatcttcaggttttgtacctaaatcataattatctcaattcacttccccccggggtgttctcacacctaaccgcgctgaggggactgagtctgaacagtaaccggctgacagtattgtcgcacaacgatctcccagccaacttagaaatactagacatttcgaggaaccagctgctcgcgccaaaccccgacgtattcgtgtccctttctgtgcttgacatcactcacaacaaatttatctgcgaatgcgagcttagtacatttatcaactggctgaatcatactaacgtgacaatcgccgggccgcccgctgatatctactgtgtgtaccccgacagctttagtggcgtctctctgttctcgctatctaccgaaggatgcgacgaggaggaggtgctcaaatcccttaagttctccttatttatcgtctgcacagtcacactgaccctgtttttgatgaccatcctaacagtcaccaaattccggggattctgttttatttgttataaaacagctcagcgtctcgtttttaaagatcacccacaggggactgagcccgacatgtataagtatgatgcttacctctgcttttcgtcaaaggattttacctgggtccagaatgctctgctgaaacaccttgatactcaatatagcgaccaaaaccggttcaacctgtgctttgaggagagggacttcgtgcctggtgagaaccgcattgcaaacatacaggatgccatttggaacagcaggaagattgtgtgtttggtttccagacattttctcagggacggttggtgtctggaagcatttagctatgctcagggcagatgcctgagcgacctgaactctgccctaattatggtagtagtggggagtctgtcgcagtatcagttgatgaagcatcagtctattagaggatttgtccaaaagcagcaatacttacgctggccagaggactttcaggacgtgggatggttcctgcataagttgagccagcagatcttaaagaaagaaaaagaaaaaaaaaaagataacaatattcccttgcagacagtggctacgatcagttag

SEQ ID NO: 17714 - DNA, 2577 bp, Artificial Sequence
  Description of Artificial Sequence: Synthetic coding sequence
atgggcgatcatctcgatctgctgttaggcgttgtcctgatggccggaccagttttcgggattccatcttgctcttttgatgggagaattgcattctatcgcttctgtaacctcactcaggtcccgcaggtgttaaacacaacagagcgcctactgctgtcctttaattacattagaacagttaccgcctcatcattccccttcttggagcaactgcagctgctagagttaggctctcagtacactcctctgacaatcgataaggaggccttcaggaacctccccaatttgaggatcctcgatcttggatcatcgaagatttatttccttcatcccgatgccttccaggggctatttcatctgtttgaactgcgactctatttctgcggcctgtctgacgccgtgctcaaggacggttacttcaggaacttgaaggctctgacccggctggatttgagcaagaaccaaatcagaagtctgtacctgcaccccagtttcggaaagctgaattccctcaagagcatcgacttcagctccaatcagattttcttagtttgtgagcacgagttggagccacttcagggaaagaccctgtccttttttagcctggcagcaaatagcctgtattctagagtgtccgttgactgggggaaatgtatgaatccatttaggaatatggttctggagattctcgatgtgtcgggaaatggttggacagtagatataactggaaatttttcaaatgccatctccaaatcccaggctttcagtctgatactcgcacatcatataatgggcgccggatttgggtttcataatattaaagaccccgaccaaaacacttttgccggactggctcgctcatccgtccggcatctggacctgagtcacggcttcgtttttagcctcaatagcagagtgttcgagacactcaaggacctgaaggtgctgaacctcgcctacaataaaataaacaagatcgccgatgaggcgttctatggcctggataaccttcaggtcctcaatcttagctataacctcttgggcgaactttactccagtaacttctacggcctgcctaaggttgcatatatcgatctgcagaagaaccacatcgccatcatacaggaccagacctttaagtttcttgagaagctgcagacactggacttgagagataatgcgctcactacaattcattttatcccatctatccccgacattttcctgtcaggtaacaaactggtgactctgcccaagatcaatctcactgcgaacctgattcacctttccgagaataggttagaaaatctcgatatcctgtatttcctcctcagggtcccacacctccagattctgattttgaaccagaaccggtttagtagctgctcaggcgaccagaccccatcagagaatccatctctcgaacaactgtttctcggggaaaatatgctgcagctggcctgggaaactgagctgtgctgggacgtgttcgaggggttgtcacatctgcaggtgctctatctgaatcataattatctgaatagcctgcctccaggcgtcttttcccatctgacagctctcagaggcttgtctctcaatagcaatagacttactgtactgtcccacaacgacctgccagccaatcttgaaattctggatatctcccggaaccagctgctggcgcccaaccctgatgtgtttgtgagcttatcagtcctggacatcacccacaacaaatttatatgcgaatgtgagttaagcacttttatcaattggctgaatcacactaatgtcactatagctggaccacctgctgacatatactgcgtgtatccagacagcttctctggagtgtccctcttttctctgagtaccgaaggctgcgatgaagaagaggtactgaagagcctcaagttttctctgttcatcgtatgcacagttaccctgacactttttctgatgaccatcctgacagtcacaaaatttcgggggttttgcttcatctgttataaaacggcgcagagactggtgtttaaggaccacccccaggggaccgagccagacatgtataaatacgatgcttacttgtgtttctcctccaaggacttcacatgggtccagaatgccctgttgaaacacctcgacacccagtactccgatcagaacaggttcaatttgtgttttgaggaaagggatttcgtacccggcgaaaaccgaatcgccaacattcaggatgcaatttggaactctaggaaaatagtgtgtctggtgagccggcacttccttcgagatgggtggtgtctggaggcattttcatacgcacaagggcgatgcctctctgacctcaattccgctctaatcatggtcgtggtaggttccctttcacagtaccagttgatgaaacaccagagtattcgcggcttcgtccagaaacaacagtatttgcgttggcccgaggacttccaggatgtcgggtggtttctccacaagttaagccaacagatcttgaagaaggagaaagaaaagaaaaaggacaacaacatccccctgcagactgttgctaccatctcgtag

SEQ ID NO: 17715 - DNA, 66 bp, Artificial Sequence
  Description of Artificial Sequence: Synthetic coding sequence
atgggagaccatctggacctgctcttaggcgtggtgctgatggccggaccagtgttcggcatatag

SEQ ID NO: 17716 - DNA, 2577 bp, Artificial Sequence
  Description of Artificial Sequence: Synthetic coding sequence
atgggcgaccacttggacctccttctgggagttgtactgatggctggccctgtatttggcataccaagctgttctttcgatgggcggatcgccttttatcgcttttgcaacctgacacaggtgccacaagtactcaatacaactgagaggctgctgctctcctttaattacattcgtacagtaacagccagttcgttccctttcttagagcagctgcagctgctggagctggggagccagtacacacccctgacgatagataaagaggctttcagaaatctgcccaacctacggatcttagaccttggaagcagtaaaatatacttcttgcatcccgacgcctttcaaggcttgttccacctgttcgagctgaggctctatttctgcggactgagtgatgctgtattgaaggacggatacttccgcaacctgaaagctttaacccggctcgatctgagcaaaaatcagatccggtccttgtacctacacccaagttttggaaaactgaattccctgaagtcgatagatttcagttcaaaccagattttcctcgtttgtgagcacgagctcgagcctctccaaggaaaaaccctgtctttttttagccttgcggctaactccctctatagccgggtgagcgtggactgggggaagtgtatgaaccccttcagaaacatggtgctagaaatcctcgatgtctccggaaacgggtggacagtggatatcacgggaaacttttctaatgccatttctaaatctcaggcatttagcctgattctagcacaccatatcatgggcgctggcttcggctttcacaatatcaaggaccccgaccagaatacttttgccgggttagctcggagctccgtgcggcacttggacttatcacacggatttgttttttctctaaacagcagggtttttgagaccctgaaggatcttaaagtgctgaatctggcctacaacaaaattaataagatagcagacgaggcattctatggccttgataatctgcaagttttaaacttgtcttacaatttgctgggggaactgtacagttctaatttctatggcctacctaaggttgcatacattgacctacagaagaatcacattgccataattcaagatcaaacatttaaattcctggagaaactgcagaccctggacctgcgcgacaatgccctgacgacgatccacttcatccctagcatacccgatattttcttatccggaaacaaattggttactctgccaaaaatcaaccttacagccaacctgatccacctgtctgagaacagactggagaacctggacatactttacttcctgctaagagtaccacatcttcagatcctgattctgaaccagaaccgattctcgtcctgctccggcgatcagaccccaagcgaaaacccctctctggagcagctctttctcggagagaacatgttgcaactcgcatgggagaccgaactgtgttgggatgtgtttgagggtctttctcatctgcaagtcttgtacctgaatcacaactatctgaattctttacctcctggcgtattctcgcatctgacagcactcagaggcctcagcctgaattctaacaggctgactgtgctcagtcacaacgatctcccggcaaacttagagatactggacatcagccggaaccagctgctcgcacccaatccagacgtgtttgtgagcctatcagttctggatatcactcataataagttcatttgcgagtgcgagctgagcaccttcattaattggctaaaccacactaatgtcacgatcgccgggccaccagcagatatatattgcgtgtatccggacagctttagcggtgtgagcctgttctctctgagtacagaggggtgtgatgaggaggaagtcttgaagagtctgaagttttccctctttatcgtttgcaccgttaccctgaccctctttttgatgactatcctgaccgttaccaagttcagagggttctgtttcatttgttataagacagcgcaacggctcgtgtttaaggaccatcctcagggaacagaacccgatatgtataagtatgatgcatatctttgcttttcttctaaggactttacctgggtccaaaatgcactccttaagcatcttgacactcagtacagtgaccaaaaccgcttcaacttatgtttcgaagagagagattttgtgcctggcgaaaatcgcattgcaaatatacaggacgctatttggaattcccgcaaaatagtatgtctagtatctcgacatttcttgcgagacggctggtgtctggaggcctttagctatgcccagggacggtgcctgtcagacctgaacagcgcgttgattatggtcgttgtggggtctctctcacaataccagctgatgaaacaccaaagtattcgaggattcgtccagaaacagcagtatctcagatggcctgaagacttccaggatgttggttggttcttacacaagctttctcagcaaatcttgaagaaggaaaaagagaaaaaaaaagataataacatccccttgcagaccgtcgccacaatctcctag

SEQ ID NO: 17717 - DNA, 4836 bp, Artificial Sequence
  Description of Artificial Sequence: Synthetic coding sequence
caggtgagcccctcccatcctgtaaatgagaacatgcaggtcaataagatcaagaaaaatgaggacgccaagaagagattaagtgttgagaggatctaccagaagaagacccagctggaacatattctcctcaggccagatacctatatcggttcggtggaactggtgacccagcagatgtgggtgtacgacgaggacgtggggatcaattaccgggaagtcaccttcgtgccaggcctgtataagatttttgatgaaattctggtgaacgctgcggataacaaacaacgggatccaaaaatgtcttgcattagggtgactatcgatccggagaacaatctgattagcatttggaacaacggaaaaggcatcccagtcgtggaacacaaggtggagaaaatgtacgtccccgctttgatcttcggccagctgttaacatcctctaactacgatgatgatgaaaagaaagtcaccggcggaaggaacgggtatggggctaagctctgtaatatcttttctactaagtttacagtggaaacggctagccgcgagtataaaaagatgtttaagcagacatggatggataacatggggcgggccggagagatggagttgaagccattcaatggcgaggattacacctgcatcacctttcagcctgacctcagcaagttcaaaatgcaaagcctggacaaggatattgtggcccttatggttcgcagagcatatgacatagcaggctccaccaaggatgtcaaggtgtttctgaatggcaataagcttcccgtaaagggatttaggtcctatgtcgatatgtacttgaaggataagctggatgagacaggcaatagcctaaaagtcattcatgagcaggtgaatcatcggtgggaagtttgcctgacaatgagcgagaaaggcttccagcagatctcgttcgtcaactctatcgccacctccaaggggggacgccacgtggactacgtggcagatcagatcgtgactaagctagtggatgtcgttaaaaaaaaaaacaaaggtggtgtagctgtaaaagcacaccagcgactggaatgctccggaaccatctctgctcactgcaacctaaggctgcttggcttctcagactctctggccagtgcgtctagagtggccgagatcacagacatgcatcaccatattcagctgatcttcgtatttctgattgagatgggattctaccatgtcgggcaggctggcctggaactattggcgagtctcgacccgccctctagtgcatcgtgcgtttctcactgtactcagttgtttgtgtcgaatttcatctacctgtttttaatttttctcaggaggagcttcactttcgtgactcaggccggcgtgcagtgcactatctcgccaaccagtagctccgtgttagcgcagttcttcgagtctttcctgttcgtcgccatcggatgtggaattgttgagtctatattaaactgggtgaaatttaaagcccaggttcagctgaataaaaagtgctccgctgtgaagcacaaccggataaagggcattccaaagttggatgacgctaacgacgccggtgggcgcaactccaccgagtgcactttgatcctgacggagggtgacagtgctaaaaccttggccgtcagtggattgggagtggtcggtcgcgataaatatggcgtgtttcctctgcgcggtaagattctgaatgttcgcgaagcttctcataaacagattatggagaatgcagaaatcaataacatcatcaagatcgtcgggttgcagtataaaaagaactacgaggatgaggacagtctaaaaactttacggtatggaaagataatgatcatgaccgatcaagaccaggacgggtcccacattaaaggtctactgattaattttatacaccacaattggccatctttgctgaggcatagatttttagaagaatttatcacccctatcgtcaaagtgtccaagaacaagcaggagatggcattctactccttacccgagttcgaagaatggaaatcctctactcctaaccacaagaaatggaaggtcaagtattacaagggcctcggcacatcaacttccaaagaggctaaggagtactttgccgacatgaagaggcacagaatacaattcaagtattccggacccgaagacgatgccgcaatctctttagcctttagcaaaaaacagattgatgaccgcaaggaatggctaacaaatttcatggaggatagacgccaaagaaagctactggggctgccagaagattacctgtatggccagacaacgacttatctgacctacaatgactttattaataaggagctcatactgtttagcaattccgacaatgagagatcgattcctagcatggttgatgggttaaagcctgggcagagaaaggtgctgttcacctgttttaaacgcaacgacaagagagaagttaaggtggctcaactcgctggctctgtggccgaaatgagtagctatcaccacggggaaatgagtctcatgatgacaattattaatctggcacaaaactttgtaggctctaataatctcaatcttctccagccaatcggccagtttggaactcggctgcacggcgggaaggactcggcatcaccccgctatatttttacaatgctttccagcctggctaggctcctctttccacccaaagacgaccataccctgaaattcctatacgacgataatcagcgggtggaaccggaatggtacatccctatcatacctatggtcctgatcaacggagctgagggtatcggaacaggttggtcttgtaagatccccaattttgacgtgagagaaattgtcaataatatccggaggctgatggatggggaagagccgctgcccatgttgccaagttacaaaaacttcaagggaaccatcgaggagcttgccccaaatcagtacgtgatttccggcgaggtagcgatcctcaactcgacaaccatcgaaatcagcgaactgcctgtgcgtacgtggacccagacttacaaggaacaagttcttgagcccatgttgaacgggaccgaaaagacacccccactcattaccgattatagggagtatcatacagacacgactgtcaaatttgttgtaaaaatgacagaagagaaacttgcggaagccgagcgtgtcggtctgcacaaggtgtttaaattgcaaacttcgctgacttgtaactctatggtcctgtttgatcacgtgggatgtttgaaaaaatacgacacagtcctcgatatccttagggacttcttcgagctcaggctcaagtactatggactgcggaaggagtggctgctgggcatgctaggagcagagagcgcaaagctgaataatcaggcacgcttcattttagagaagatcgacgggaagattataattgaaaataaaccgaaaaaggagcttatcaaggtcctgattcaaagggggtatgactccgacccagtaaaagcttggaaggaggctcaacagaaagtcccggatgaggaggagaatgaggagagcgacaacgaaaaagagaccgagaagtctgactcagtgactgacagcggacctactttcaactacctcctggatatgcctttatggtatctgaccaaagaaaagaaggatgaactgtgtcgactgaggaacgagaaagagcaagaactggacaccctgaagagaaagagtccatccgacttgtggaaagaggacctcgccacctttatcgaagaactggaggctgttgaggccaaggaaaaacaggatgagcaggtggggctgcctgggaaaggtggaaaagcaaaaggtaagaaaactcaaatggccgaggtcctcccatctcctaggggtcagagagttattcccagaatcactatagaaatgaaggctgaggccgagaagaaaaacaagaaaaaaattaaaaatgaaaatacagagggttccccccaggaggacggcgtggaactggaaggactcaaacagagattagagaagaaacagaaacgggaacccgggactaagaccaaaaagcaaacaactcttgcattcaaaccgatcaaaaaggggaaaaaacgtaacccctggtccgactccgagtccgataggagctctgacgagtccaatttcgacgtgcccccgagagaaaccgagcccaggagagcagccaccaaaacaaagttcactatggacctcgacagtgacgaggacttttctgattttgatgagaaaacagatgacgaggattttgttccgtccgatgcaagccctccaaaaaccaagacatctcccaaactttccaataaagagctcaagccacagaagagtgtggtgagcgatttagaggctgacgacgtgaagggcagcgtgcctctgagctcctcaccgcccgccacccactttccagacgaaacagagattaccaatccagtgccaaaaaaaaacgtaacggtgaagaaaaccgccgctaagtctcagtcctccacctcaaccactggggctaagaagcgggccgcgcctaaaggaaccaaacgtgatcccgccttgaattccggcgtgtctcagaagcccgatcccgctaaaaccaaaaacaggcggaagcggaagcccagtaccagcgacgattcggattcaaatttcgaaaaaatcgtcagcaaggccgtaacatcgaagaagagcaaaggggaatctgatgattttcatatggattttgattctgccgtggccccacgagcaaagagcgtgagagctaaaaagccgatcaagtacctggaagagtcagacgaggatgacctgttctag

SEQ ID NO: 17718 - DNA, 4665 bp, Artificial Sequence
  Description of Artificial Sequence: Synthetic coding sequence
caggttagtccatcacaccccgtgaacgagaatatgcaggtgaacaagatcaagaagaatgaggacgccaagaagagacttagtgtcgaaaggatataccagaaaaagacccagctcgaacacattctcctgcgtcctgacacgtatataggatccgtggaactggtgacccaacagatgtgggtatatgacgaggacgtcggcattaattatcgcgaagtcaccttcgttcctggtctctataagatttttgatgagatcctcgtgaatgctgccgataacaaacagcgtgatcccaagatgagctgcattagggtcactatagatcctgagaataatctgatctctatttggaacaatggtaaggggattcccgtggtcgaacataaggtcgagaagatgtatgtgccagccctcatcttcggccagttgttgacatcctcgaactacgatgacgacgaaaagaaagtgaccggggggcggaatgggtacggagccaaactgtgcaatattttcagcaccaagttcacagtggaaaccgcaagtcgggagtacaaaaagatgtttaagcaaacctggatggataacatggggcgggctggagaaatggagcttaaaccgttcaacggcgaagactatacatgcatcacattccagcccgacctgagcaaatttaaaatgcaaagtctggataaagatattgttgcacttatggtacgccgtgcatatgacatcgcaggcagcaccaaggacgttaaagtctttctaaacgggaacaagctgcctgtgaaggggttccggagctatgtggacatgtatctcaaggacaaactagatgagacaggcaatagcctgaaggtgatccacgagcaggtgaatcacaggtgggaggtgtgtctgacaatgtcggagaaaggttttcagcagatatctttcgtgaattccatagcgactagcaaaggcgggcggcatgttgattacgttgctgaccaaatagtgacaaagctggtggacgtcgtcaagaaaaagaataaagggggtgtcgctgtgaaagctcaccaggtgaagaaccacatgtggattttcgtaaatgcactgattgagaacccaacatttgactctcagacaaaagagaatatgaccctccaacctaaaagctttggctctacttgccagctctccgaaaagttcataaaagccgcccacctgtacagccgctttcttatcgacccattttttcctaacatgattcccaatatgaatctcttccaagccattggatgtggcatcgtcgaatcgattctgaattgggtaaaatttaaggcgcaggtgcaattgaacaagaagtgcagcgccgtgaagcacaataggatcaagggcattcctaaactggacgatgccaatgatgcagggggcagaaactccaccgagtgcacactcattttgaccgagggtgactccgctaagaccctggctgtttccgggctgggtgtggttggccgagacaaatacggcgtttttcctttacgggggaaaatcctgaatgtccgcgaggcttcgcacaagcagataatggagaatgctgaaataaacaacataatcaagatcgttggattgcagtacaagaaaaactacgaggatgaggactcactgaagactctccgatacggaaagataatgatcatgacagatcaggatcaagacgggtcgcatataaaagggcttctcattaatttcattcatcataattggccatcgcttctcagacatagattcctcgaagagtttataacgcctatcgtgaaggtatctaaaaacaagcaagaaatggctttttactcactaccagagttcgaggaatggaagagctcgactccgaatcataagaagtggaaagtgaagtattacaaggggctgggaactagcacgtccaaagaagccaaggagtacttcgcagatatgaagcggcacaggatccagtttaaatactcaggccccgaagatgacgccgcaatttccctggccttttcgaaaaagcaaatagatgatcgcaaagaatggctgaccaattttatggaagacaggcgccagcgcaagcttttaggcctgccagaggactacttgtatggacagacgaccacctatctcacgtacaacgattttattaacaaagagctcatcctgttttctaactccgataatgaacgttctattccgagcatggtggatggactgaagcctggccagcggaaggtactgttcacatgttttaagcggaacgataagcgagaggtgaaagtggcccagctggccggcagcgtagcagagatgagctcgtaccaccatggcgagatgtcactaatgatgacgatcatcaatttagcccagaatttcgtgggcagtaataacctcaacctattacagcctataggacagtttggaactaggctgcatggcggaaaagattcagccagtcctcgctacattttcaccatgctgagtagcctggctagactgctctttcccccaaaagatgatcacacactaaagtttctgtacgatgataaccagcgcgtggaacctgagtggtacatcccaatcattcccatggttctgatcaacggcgcagaggggatcggaacagggtggtcttgcaagattccaaatttcgacgtgcgcgagattgttaacaatattcggcgtttgatggacggtgaagagccattgccaatgttaccatcctacaaaaatttcaaaggaactattgaggaactggcacccaatcagtatgtgatttctggggaggtcgccattctcaacagcactactatagaaatcagcgaactccccgtgaggacatggactcagacttataaggaacaggtgcttgaacccatgctaaacggcacagagaagacacctcctctgatcacagactatcgggagtaccacacggacaccaccgtgaaatttgttgtgaaaatgacggaggagaaattggccgaagcagagagagtggggcttcacaaggtttttaagctgcaaactagcttaacatgcaactccatggtgttgtttgaccacgtgggctgcctgaagaagtatgacacagtcctagatatcctccgcgacttctttgaactgagactcaaatactacggattgcggaaagagtggttgctaggcatgctgggggctgaaagcgccaagctgaacaatcaggcccgctttatccttgagaagattgatgggaagatcattatcgaaaacaaaccaaagaaggaactgataaaagtgttgatccagagagggtacgattccgatccagttaaagcctggaaggaagcccagcagaaggtaccagatgaggaagagaacgaggagtcagataatgaaaaagagacagaaaagtccgatagcgtcaccgattccggaccgaccttcaactacttgctggatatgcctctgtggtatctgacaaaggagaagaaagacgaactatgccggttaagaaatgaaaaagaacaagagttggacaccctgaagaggaagagcccttccgatctttggaaggaagacctggccacattcatcgaggagctcgaggccgtggaggctaaagaaaaacaggatgaacaggtagggcttccggggaaaggaggtaaagcaaaggggaaaaagacgcaaatggcagaggttctgccttctcctagggggcagcgcgttatccctcgtattactattgagatgaaggctgaagccgagaaaaaaaacaaaaaaaaaataaaaaacgagaacactgaaggaagcccacaagaagacggcgtagagctcgaagggctgaaacagcgcctggagaaaaagcagaagcgagaaccgggaacgaaaacaaaaaaacagactacgcttgccttcaaaccaatcaagaaaggtaagaaaagaaatccttggtccgattcggagtcggaccgcagctcagacgagtccaatttcgacgtgcccccccgagagaccgagcccagaagggccgccaccaagacgaagtttacaatggacctcgattctgacgaggactttagcgatttcgacgaaaaaactgatgatgaagacttcgtgccatcggacgcatccccccctaagaccaaaacctcccccaaattatccaacaaggaacttaaaccccagaaaagcgtcgtttctgacctcgaggctgatgacgtgaaaggctccgtgccgttgagctcaagcccgcccgccacacatttccctgacgaaacggaaataactaatccagtccctaaaaaaaatgtcacggtgaagaagaccgccgcgaagtctcagagtagcacttccactaccggcgccaagaagcgcgccgccccaaaaggaaccaagagggatcctgcgctgaactccggggttagccagaagcctgacccggcaaagacgaaaaatcgcaggaagcgcaaaccgagtacatctgatgactccgattccaatttcgagaagattgtgtctaaagccgttacatcaaagaagagtaagggcgaatcagacgacttccatatggacttcgatagtgccgtggccccccgggctaagagtgtgagagctaaaaagccaatcaaatatcttgaggaatccgatgaggatgaccttttctag

SEQ ID NO: 17719 - DNA, 4707 bp, Artificial Sequence
  Description of Artificial Sequence: Synthetic coding sequence
atggaggtgtcaccgctgcaaccggtcaatgaaaacatgcaagtgaacaagattaaaaagaacgaggacgctaagaagaggcttagcgtggagagaatctaccagaagaaaacacagctggaacatatcctgctcagaccagatacatacatagggagtgttgagctggtaacacaacagatgtgggtgtatgatgaggatgtcggcataaactacagggaagtgacattcgttccgggactgtataaaattttcgacgagatccttgtgaacgctgcggacaacaagcagagagatcctaagatgagttgcatcagagttactatcgaccctgagaacaatctgattagtatctggaacaatggaaaggggatccccgtggtcgagcacaaggtggagaaaatgtatgtcccagcactgatttttgggcagctcttgacctcttctaactatgatgacgacgagaagaaggtgaccggcgggaggaacggttatggagcgaaactctgcaacatcttcagcacaaagttcactgtcgaaacagcaagccgggaatacaaaaagatgttcaagcaggcaatcacttggatggacaatatgggccgggcaggagagatggagctgaaaccctttaatggcgaggattacacctgtatcacatttcagcctgacctgtccaaatttaaaatgcagtctctggacaaggacatcgtggctctaatggttaggcgagcctacgatatagccggcagtacaaaagacgtcaaggtattcctgaacgggaataagctgcccgtaaaaggctttcgctcctatgtggatatgtacctcaaagataagctagatgagactggtaatagcctgaaagtgatccacgagcaggtcaaccaccgatgggaagtctgtttgactatgagtgaaaagggctttcagcaaattagcttcgtaaactccatagcaacctcgaaagtcatcctgtttctcaattacatgatttacttgtacatctacgtgttcctgctgttcctcatttacaaagttgatctgaatatcggtttagcctattttaccggtggacgacacgtggactatgtggcggaccagatagtgaccaagttggtagacgtggtcaagaagaagaacaaaggtggagttgccgtaaaggcacatcaagttaaaaaccacatgtggattttcgtgaacgcactgattgagaaccctacgtttgactcccaaaccaaggaaaatatgacactgcagccaaagagcttcggctctacatgccagctgtcagagaagttcattaaagcagcaattggctgcggcattgttgagagtattttgaattgggtaaaattcaaggctcaggttcaactgaataaaaagtgcagcgcggtcaaacataataggataaagggaattcccaagctggacgatgctaacgacgccggcgggcggaactcaaccgagtgcactttgatcctaactgaaggagatagcgcgaaaacactggctgtatccggactgggcgttgttgggcgagataaatacggcgtatttcctttaagaggaaaaatcttaaatgtgcgcgaagcttctcataaacagatcatggaaaatgccgagatcaataatattattaagatagtaggacttcagtataaaaaaaactatgaagatgaagactcgctgaagactctgaggtatgggaaaattatgatcatgacagatcaggaccaagacggctcccatatcaagggcctcctgatcaacttcatacaccacaattggcccagcctcttgcggcacaggtttctggaggagtttatcactccaattgtgaaggtgtcaaaaaacaaacaggaaatggctttttactctctgcctgaatttgaagaatggaagtcctctactcctaaccataagaaatggaaagttaagtattacaaaggacttggcacttctacctctaaggaggcgaaggaatactttgctgatatgaagaggcataggatccagtttaaatattcaggtcctgaggacgatgctgcaatttctcttgctttttccaaaaaacagatagatgaccggaaagagtggttaacgaactttatggaagacaggcgtcagcggaagctgctgggcctgcccgaggattacttatacggccagactacgacatatctaacgtacaatgatttcattaacaaagaactgatcctgttctcgaattcggacaacgagcggtccatcccaagcatggtggatggactgaagcctgggcagaggaaggtgctcttcacctgctttaaacggaacgacaaacgagaggtgaaagtggcacaattagccggcagtgttgctgagatgagtagctaccatcacggggagatgagcctgatgatgaccataattaatcttgctcagaatttcgttggcagcaataacctcaatctgttacaacctattgggcaattcggaactcgcttgcatggtggaaaagattcggcctccccgcggtacattttcacaatgttgagctctctcgcaagactcttgttccctccaaaagatgaccacaccttgaagtttctctatgacgataaccagagagtggaacccgagtggtacattcccatcatcccaatggttctgatcaatggggcagaggggattggtacaggatggtcatgtaagattccaaacttcgatgttcgtgagatcgtaaataacatccgaagattgatggacggtgaggaaccactgcctatgctacccagctataagaattttaaagggacaatcgaagagcttgcgcccaatcagtatgttatcagtggtgaagttgctattttgaatagtacgaccatcgaaattagcgaactgcccgttcgaacctggacccaaacgtataaggaacaggtgctggaacccatgttaaacggtacagaaaagaccccccctctgatcacagattatagagaataccacacagacactaccgtcaagtttgtggtaaagatgacagaggaaaaactggccgaggcggaaagagtgggtctgcataaggtcttcaaattacagacgtctctgacctgcaatagcatggtcctgtttgaccatgtgggctgtcttaagaaatacgacaccgtcctggatattctccgcgactttttcgaattacgcttaaaatattacggcttgcggaaagaatggctcctaggcatgctcggagcagaatccgccaagctcaataatcaggctaggttcattttagagaagattgatggcaaaataatcatagaaaacaagcctaaaaaggaacttattaaagtactgatccagcggggctacgacagcgatccagtaaaggcctggaaggaggcccagcagaaagtccctgacgaagaggaaaatgaagagagtgataatgagaaggagaccgaaaagagcgactcagtcacggactctggtcccacgttcaattacctactcgacatgccactctggtatctgacaaaggagaaaaaggatgaactttgccgcctgcgcaatgaaaaggagcaagagctagataccctcaagcgcaagagcccatccgacctgtggaaagaggatctggcaacctttatcgaggagttggaggcggtagaggcaaaagaaaagcaagatgagcaagtaggattaccggggaagggcggcaaagctaaggggaagaaaacacagatggctgaggttttgccttcaccccgcggtcagagggtgattccccgtattaccatagagatgaaggccgaggccgagaagaagaataagaaaaaaatcaaaaatgagaacaccgaagggtcaccccaggaggacggagttgagctggagggcctgaaacaacgcctggagaaaaagcagaaaagggagcctggcactaagaccaaaaaacagacgactctcgctttcaaacctatcaagaaggggaaaaaacgcaacccctggtcagacagcgagtcagataggtctagcgatgagagtaactttgacgtccctccccgagagacagagccacgtcgagctgcaaccaagactaaatttaccatggatctggattctgacgaagatttctccgatttcgacgagaaaactgacgatgaggatttcgtgccatccgatgcctccccgcctaagacgaagacttcccccaaacagaattgcaataaagagctgaagccgcaaaaaagcgtggtctctgatcttgaagcggacgacgtgaaaggttcagttccactctcctcgtcacccccagcaactcacttccctgatgaaactgagattaccaatcccgtccccaagaaaaacgtaactgtaaagaagacagccgccaaaagccagagtagtacgtctactacaggcgccaaaaagcgcgcagcgcctaaaggaactaaacgggaccctgccctgaatagtggtgtgtcacagaagccggaccctgcaaaaaccaagaatcgtcgcaaacgcaagccttccaccagcgacgattcggattctaacttcgagaagatcgtctcaaaggccgtgacatcaaagaaatctaaaggggagtccgacgacttccacatggatttcgatagcgcagtcgccccccgcgccaagtcagtaagagccaaaaagcctattaaatacctggaggaatccgacgaagacgacctgttttag

SEQ ID NO: 17720 - DNA, 4596 bp, Artificial Sequence
  Description of Artificial Sequence: Synthetic coding sequence
atggaagtgagcccgctgcagccggtgaacgaaaatatgcaagtcaacaaaattaagaaaaatgaggacgcaaagaaacggctctccgtagagagaatctatcaaaaaaaaacccaactcgaacatatcctgttgcggcccgacacctacattgggtccgtggagttagtgacacagcagatgtgggtgtacgatgaggatgtgggaattaactaccgcgaagtgaccttcgtgccaggactctacaagatcttcgacgaaatcctcgtcaatgcagctgataacaagcaaagagatccaaaaatgagctgtatccgcgtgactattgatcccgagaacaatctcatctccatttggaacaacggaaaaggaattccagtggtggagcataaagtagagaagatgtacgtcccggcgctgatttttggccagctcctgacaagcagcaattatgacgatgatgaaaagaaggtgaccggaggtaggaacggctacggagctaagctgtgtaacatcttttccaccaagtttaccgtagaaaccgccagccgggaatacaagaaaatgtttaaacagacgtggatggacaatatggggcgcgccggggaaatggaattgaagcctttcaatggcgaggactatacatgcatcacatttcagcctgatttatctaagttcaagatgcaatcactcgataaagatatcgttgccctgatggtcaggcgggcttacgatatagcaggcagtaccaaagacgttaaggttttcttgaatggaaataaattgccggtcaaggggttcagatcttacgtcgacatgtatctgaaggataaactggacgagactggcaatagtctcaaagtgatacacgaacaggtaaatcataggtgggaagtctgtctcaccatgagtgagaagggcttccagcagatctcgtttgtcaactccattgctacaagcaaaggcggccgacatgtcgactatgtggccgatcagattgttacaaagcttgtggatgtggtcaaaaagaaaaataaaggtggtgtggcagtcaaagctcaccaggtgaaaaaccatatgtggattttcgtcaatgcactaatcgagaatcctacgttcgattcccaaaccaaagaaaatatgactctgcagccaaaaagttttggctctacatgccagctgtcagaaaaatttatcaaagcagccatcgggtgtggtatagtggagtctatcctgaactgggtcaaattcaaggcacaggtgcagctgaacaaaaaatgcagcgccgtgaaacacaataggatcaaggggatcccaaagttggacgacgccaacgatgctgggggcaggaatagtacagagtgtacattaatacttaccgagggggatagtgctaaaacgctcgccgtatcaggcctgggagttgttggtcgcgacaagtacggggtattccctttgaggggtaagattctgaatgtgagggaagctagtcacaagcaaattatggaaaacgctgagattaacaacatcattaagatagtgggactgcagtataaaaaaaactatgaagacgaagactccctcaaaactcttaggtacggcaaaattatgataatgacagaccaagaccaggacggtagccacatcaaaggactcctcattaacttcatccatcacaattggccctcactgctaagacaccgcttcctagaggagttcatcacccctattgttaaagtgtccaagaacaagcaggaaatggctttctattccctgccagagtttgaagagtggaaaagcagcactcctaatcacaaaaagtggaaagttaagtattataaaggactcggcacgtcaaccagcaaggaagcaaaggaatactttgccgatatgaaacggcatcggatccaatttaaatactctggtcccgaggacgacgccgcaatcagtcttgctttttcaaagaagcagatcgatgacagaaaagagtggctgaccaacttcatggaggaccgtcgtcagagaaaattacttggactgccagaagattacctctatggccaaaccacgacctaccttacttacaacgattttatcaataaggaactgattctttttagcaattccgacaatgaacgctcaatcccctcgatggtcgacggcctgaaaccgggacagcggaaggttctgtttacatgctttaaaagaaatgataagagggaggtgaaggtggcacagctggcgggcagcgtggctgagatgtccagctatcaccatggggagatgagcctgatgatgactatcattaatctggcccagaacttcgtaggatccaataacctgaacctcctgcagcccatcggccaatttggtacaaggttacatggagggaaggattcagcctcaccacgttacatatttacgatgctgtcgagtttagccaggctgctcttcccccctaaggatgatcacacactgaaattcctgtatgatgataatcagcgagtcgagcctgaatggtatattcctatcatcccgatggtgctgattaatggcgcagaggggatcggaactggctggtcgtgcaaaattcctaacttcgacgtgcgtgagatcgtgaacaacatcaggcgcctgatggacggtgaagaacccctcccaatgctgccctcttataaaaactttaaaggaacgatcgaggaactggcccccaaccagtatgtcatctcgggcgaggttgccatcctgaattctacaacgatcgagatttctgagctgcctgtgcggacttggacacagacctataaagaacaggtcctcgagcccatgttgaatgggaccgagaagactccccctctcatcactgattatcgagaatatcacaccgataccactgtaaaattcgtcgtgaaaatgacagaggagaagttggcggaggcagagagggttggcttgcataaggttttcaaattacaaaccagtctcacctgtaactctatggttctgtttgaccatgtggggtgcctgaaaaaatacgataccgtcttggacattctcagggatttcttcgagctgcggttgaagtattacggactccgcaaagagtggctgcttggcatgctaggcgccgagtctgccaagctgaataaccaggcccgattcattctggagaagattgacggcaaaattataatcgaaaataaaccaaagaaagaactcattaaggtattgatccaaaggggttatgattcggatcccgtcaaggcatggaaagaggcgcaacagaaggttccggacgaagaagaaaatgaagagagcgacaatgaaaaggaaaccgaaaaaagtgattcggttaccgacagtgggccaaccttcaactacctgttagacatgcccctgtggtacctaaccaaggaaaagaaagacgaactgtgtcgtctgaggaatgagaaagagcaggagctcgacactttgaagaggaaatctccctccgacctgtggaaagaggatctagccactttcatcgaagagttggaagcagtcgaagcaaaggagaagcaggacgaacaagtggggctccccgggaagggaggcaaggctaagggtaagaaaacccaaatggccgaagtgctgccttcacccagaggccagcgcgtgatcccacgcattacaatcgaaatgaaggccgaagccgaaaagaagaataagaagaagatcaagaatgaaaacaccgagggctcaccccaggaagacggagtggagctcgaaggcctcaaacagagactggaaaaaaagcagaagcgggagccaggaaccaaaacgaagaagcaaaccactctggcctttaagcccattaagaagggcaagaagcgaaatccctggtccgactcagaatctgacagaagctccgacgagtccaactttgatgtgcccccccgggaaacggagccccggagggcggccactaagaccaaatttactatggacctagacagcgacgaagatttcagcgactttgacgagaagaccgatgacgaagacttcgtgccatctgatgccagcccccctaaaaccaaaaccagtccaaagctatctaacaaagaattgaagccccagaagtcagtggtgtccgacctggaggcagacgatgttaaaggttccgtgcccctctccagttctccccctgcaacccactttccagacgagaccgagatcacaaatccagttcccaagaagaatgtcactgtgaagaagacggcagccaagagtcagtccagcacatctactactggggcaaaaaaacgcgcggcgcccaaaggtaccaagcgggatccggcgttaaactcaggagtcagccagaagcccgatcccgctaagacaaaaaacagacggaagagaaagccatccaccagcgacgacagcgattctaacttcgaaaagatcgtaagcaaagctgtgaccagtaaaaaatctaaaggcgaaagcgacgattttcacatggactttgactcagctgtggctcctcgcgccaaatcggtgcgcgctaagaagccaattaaatacctggaggagagcgatgaggacgacctgttctag

SEQ ID NO: 17721 - DNA, 4881 bp, Artificial Sequence
  Description of Artificial Sequence: Synthetic coding sequence
atggcgaagagcggagggtgcggcgcaggggcgggggtgggaggcgggaacggcgcactcacgtgggttacactgttcgatcagaacaacgccgctaagaaggaagagtctgaaaccgccaataagaacgacagcagtaagaagctgagcgtcgaacgggtgtatcaaaaaaaaacacagctggaacacattcttttgagaccagacacctacattggctctgttgagccgctgacacagttcatgtgggtttacgatgaagatgtcgggatgaactgtagggaagttaccttcgtaccaggactgtacaaaatcttcgacgagattttagtgaacgctgctgataacaagcagagggacaaaaatatgacatgcataaaggtttcaattgatcctgaatctaatatcattagcatttggaataacggaaaaggtatccccgtggttgagcataaagtagagaaagtttatgttcctgctctcatattcgggcagctgctgaccagttccaactacgatgacgacgagaagaaagttacgggagggcgaaacggctatggggctaagctgtgcaatattttctctacaaagtttaccgtggaaacagcctgcaaggagtacaaacactcctttaaacagacttggatgaataacatgatgaagacaagcgaggcaaagattaagcactttgacggggaagattacacatgtatcacttttcagcccgacttgtctaagttcaagatggaaaagctggacaaagatatagttgccctgatgaccaggagagcctatgaccttgccggatcctgcaggggagtgaaggtaatgtttaatggcaaaaagctgcccgtcaacggattccgctcttatgtggatctgtacgtcaaagacaagctggacgagactggggtggctctcaaggtgatccacgagctagcaaatgaaagatgggatgtgtgcttgacgctctccgaaaaaggctttcagcagatctctttcgtcaattctatcgccacaacaaagggcggtcggcacgtcgattacgtcgtggatcaggtggtggggaaattaatcgaggttgtaaagaagaagaacaaggctggcgtctcggtcaaaccgttccaggtgaaaaaccatatctgggtgttcatcaattgtctgatcgaaaacccgacgtttgattctcagactaaagagaatatgacactccagcctaagtcctttggcagcaagtgccagctatctgagaaattttttaaggcagcctcaaactgtggcatcgtcgagtcaattctcaattgggtgaagttcaaggctcagacacagctgaataaaaaatgctcctccgtgaaatactctaagatcaaaggaattcccaaactggacgatgcaaatgacgccggcggcaaacactctctggagtgtactctgattctgactgaaggagatagcgccaaaagtctggcagtaagcggtctgggagtcattgggcgtgataggtatggcgttttccccctgcgtggaaagattctaaacgtccgggaagcgtcacataagcaaataatggaaaacgcggagatcaataatatcattaaaatagtcggattgcaatacaagaaaagctacgatgatgccgagtcattgaaaacattgcgctatggtaagatcatgatcatgacggatcaggaccaggatggctcgcatattaagggcctgctgatcaatttcatccaccataactggccttccctgcttaagcatggattcctggaggaattcatcactcccatcgtgaaagccagcaagaataaacaagagttatcattttactccataccagagtttgacgagtggaaaaaacacatcgaaaaccagaaggcctggaagattaaatactataagggtctgggaacgagcaccgctaaagaagctaaggagtacttcgcagatatggaacgccatcgtatcctctttcgatacgctgggccagaggatgacgccgcaattactcttgccttcagtaagaagaaaatcgacgacagaaaggagtggctcactaacttcatggaggatcgtcgacagcgaagactgcacggactaccagagcagtttctgtacggcactgctacgaagcacctaacttacaatgatttcattaataaggagctgatcctcttctccaacagcgacaatgaacgcagcatcccgagtctggtggatggatttaagcctgggcaaaggaaggtgttgttcacatgcttcaaaaggaacgataagagagaagttaaggtggcccaattggctgggtcagttgctgaaatgagcgcctatcatcatggggagcaggcactcatgatgacaatcgttaatcttgcccaaaactttgtggggtcaaataacattaatttgctgcagccgattggccagttcggtaccagactgcacggcggcaaggacgccgcctcacctaggtatatctttacgatgctgtcgaccttggccagattgctcttcccagcggttgacgataacctgctcaaatttctgtatgatgacaatcaaagggtggaacctgagtggtacatacccattatccccatggtgttgatcaacggggcagaaggaatcggaaccggctgggcatgtaagctccctaattatgatgcccgggagatagtgaacaatgtcaggcggatgctagacggattagacccacaccccatgctgcccaactacaaaaatttcaaaggaaccatccaggaactcggacagaatcagtatgctgtgtctggcgaaatttttgtggtagacagaaatacagttgaaataactgagcttcctgtgaggacatggacacaggtgtacaaggagcaggtacttgagcccatgctgaatgggactgacaagactccagccctgattagcgactacaaagagtatcataccgataccaccgtgaaatttgtcgtcaagatgacagaggagaagctagctcaggctgaagctgcagggctgcataaggtgttcaagcttcagacgactttgacctgcaattctatggtgctgtttgatcatatgggctgcctgaaaaagtatgaaactgttcaggatatacttaaggaattcttcgatctgaggctcagctactatgggcttcgcaaagagtggctggtaggcatgctcggtgctgaaagcaccaaacttaacaatcaggctcggttcattcttgaaaagattcagggaaagataaccatcgaaaatcgatctaagaaagacctgatacagatgctagtgcagcgaggatacgagtccgaccctgtaaaggcctggaaagaggcccaggagaaggctgctgaggaagacgagactcaaaaccagcatgatgacagctcctctgactccggcactccatccggacccgacttcaattatatcctgaacatgagtctctggtcactgacgaaagagaaagttgaggaactgattaaacagagagatgcgaaggggagggaggtaaatgatctgaaaaggaagagccctagcgatctttggaaggaagacctggcagcattcgtcgaagaattggacaaggtcgaatcccaggagcgggaagacgtcctcgctggtatgtcaggaaaggctatcaaagggaaggtggggaagcccaaggttaaaaaactccagttagaggaaacgatgcctagcccatacggccgaagaataatcccagaaattaccgctatgaaggccgacgcttctaagaagttgctaaagaagaaaaagggtgatttggacaccgcagcagtgaaagttgagttcgacgaggaattttcgggggcacctgttgaaggagccggggaggaagctcttacaccctccgtgcctattaacaaaggacctaagcccaagcgcgagaaaaaagagcctggcacccgcgtacggaaaacacctacatcctctggtaaacccagcgctaagaaggtgaaaaagcggaacccctggtctgacgatgagtctaagagtgaatctgatctcgaggagactgagccagtggtcatcccgagggactccctgcttaggcgggccgcagccgagcgcccaaagtacacgtttgatttttccgaggaagaggacgatgacgccgatgatgacgacgatgacaacaacgatctcgaggaactcaaagtcaaggcgagccccattacaaacgacggtgaggacgagttcgtcccatctgacggactggacaaagacgaatacactttttccccaggcaaaagcaaggccactcccgagaagagtctgcatgacaaaaaatcacaagattttggcaacttgttctccttcccaagttactcacagaaatcagaggatgacagcgccaagttcgattcaaacgaagaggattctgcctctgtattttccccctcgttcggactaaagcagactgataaagttcctagcaagacagtggcggccaaaaagggaaagccttcctccgatacggtacctaaacctaaaagagctcctaaacagaagaaggtcgtggaggccgtgaacagcgatagtgatagcgaattcgggattcctaaaaaaacgacaacacccaaggggaaaggccggggcgccaaaaagcgcaaggcaagcggaagcgaaaacgagggtgactacaatccaggacgcaaaacctcaaagacgacctccaagaaaccgaagaagacatcattcgatcaggattctgacgtcgatatctttccttccgactttccaactgaaccaccttctctcccacgaaccgggcgggcgcgtaaagaagtgaaatactttgccgaatcagacgaggaagaagatgatgtggatttcgcgatgtttaattag

SEQ ID NO: 17722 - DNA, 3453 bp, Artificial Sequence
  Description of Artificial Sequence: Synthetic coding sequence
atggcgaagtccggcggctgtggtgcaggggccggagtcggcggcggcaatggggccctgacgtgggtgaacaatgctgcaaagaaagaggagtctgagaccgccaacaagaacgattcttctaaaaaattgtccgtcgagagagtgtatcagaagaaaacccaactcgaacatatcctactgcgcccagacacgtacatcgggtctgttgagcccttgacccagtttatgtgggtgtatgatgaggacgtggggatgaactgtagagaagtaacattcgtgcccggtctgtataagatcttcgatgagattctggtaaatgcagccgataacaagcaacgggacaagaatatgacctgtatcaaagtctccatcgatcctgagtcaaacataatttctatttggaataatggtaagggcattcctgttgtggagcataaggtggagaaggtctacgttccggctctaatcttcggtcagctgctcacctctagcaactatgatgatgacgaaaagaaggtcacgggcggcagaaatggctatggtgccaagttgtgtaacattttctctaccaagtttaccgtggaaaccgcctgtaaagaatacaaacactcgtttaaacagacctggatgaataatatgatgaagacaagcgaggcgaaaatcaaacacttcgacggtgaagattatacttgcatcacatttcagcccgacctgtccaagtttaagatggagaagctagataaagatatcgtcgcactgatgacaaggcgtgcgtacgacctcgcagggtcctgcagaggcgtgaaagtgatgttcaacggaaaaaaactaccagtcaatgggtttcggtcttatgtggatctgtatgtgaaggataaactggatgagacgggagtggccctgaaggtgattcacgagctcgcgaacgagaggtgggacgtttgtctgactttaagcgaaaaaggttttcaacaaatcagtttcgtgaatagcatcgccaccacaaaaggtggaaggcacgtggattacgtggtggaccaggtggtcggtaaactgattgaggttgtgaaaaagaagaacaaagccggtgtctccgtcaaaccgtttcaggtgaaaaatcatatatgggtatttatcaattgtctgatcgaaaatccaacatttgacagtcagaccaaagagaacatgacgctccaacccaaaagcttcgggagtaagtgccagctgtcggagaagttctttaaagccgcaagcaattgcgggatagtggaatcaattctgaactgggttaagttcaaagcgcaaactcagctgaataagaaatgctcgagcgtcaagtactcaaagataaagggaatcccaaagctggatgacgctaatgatgctggaggaaagcacagcctagagtgcaccctgatcctgaccgagggggattccgccaaatccctggccgtgtctggcctgggcgtgatcgggagagatcggtacggcgtattccccctgcgaggtaagattctgaacgtcagagaggcgtctcacaagcagataatggagaacgctgagattaacaacatcataaaaattgtaggacttcaatacaagaaatcttacgacgacgcggagtcgctcaaaaccctgaggtatggcaaaattatgatcatgacggaccaagaccaagacggtagccatattaaagggctgctgatcaactttatccatcacaattggccttctttgctgaagcatggattccttgaggagtttatcacacctatcgttaaagcctctaaaaataagcaagagctgtctttctatagcatcccagagtttgatgaatggaaaaagcacatcgagaaccagaaagcatggaagatcaaatactacaagggtttaggcacctcaaccgctaaggaggctaaggagtactttgcggatatggagcgccataggatactgttccggtatgcaggtcccgaggacgatgccgctatcacgctggctttctctaaaaaaaagattgacgatcggaaggagtggctcactaatttcatggaggatcgtcgccagcgccggctgcacgggctccccgagcaattcctatatgggacagctactaagcacttgacttataatgattttattaacaaagaactgatcctgtttagcaactccgacaacgaacgtagcattcctagcctcgtggacggatttaagcccgggcagagaaaggttttattcacttgtttcaaacggaatgataagcgcgaggttaaagtcgcccaactcgccggaagcgtcgcggaaatgagcgcttatcatcacggcgagcaggccctgatgatgacaattgtgaatctcgcccagaacttcgtaggctctaataatatcaacctgctacagcccattggacagttcgggactcgtctgcatggaggcaaggatgccgcttcaccaagatacatcttcacaatgctgtccactttggcgcggttgctttttcccgcagtggacgacaatctgctcaagtttctctacgacgacaatcaacgggtggagccagaatggtacattccgattatccctatggtgctgatcaatggagcagaagggatcgggactggctgggcgtgcaagctgcctaattacgatgccagggaaattgtgaacaatgttagacggatgctggatgggctggacccacatccaatgctccccaattacaaaaatttcaaaggcacaattcaagagctgggccagaaccagtacgctgtgagcggggagatcttcgtcgtggataggaacaccgtggagatcaccgagctccctgtgcgaacttggacacaggtgtacaaagaacaggtgctcgagcccatgcttaacggtacggataagaccccggccctcatcagcgactacaaggaatatcacactgatacaacggtcaaattcgtagtcaaaatgacagaggaaaaattggcccaggcagaggctgccggactgcataaggtctttaaattacagactaccttgacctgcaattcaatggtgctgtttgatcatatgggctgcctaaaaaaatacgagactgtgcaggacatcctgaaggaattttttgacctccgtttatcttactacggcctgcggaaggaatggttggtggggatgctgggtgccgaaagcacgaagctcaataaccaggcaaggttcattctggagaaaatacagggcaagatcacaattgagaatcggtcaaaaaaagatcttatccagatgcttgtgcaaagaggttatgagagcgatcccgttaaggcctggaaagaggcccaggagaaggccgccgaagaggatgaaactcaaaatcagcatgatgacagtagtagcgactctggcacccccagcggcccagacttcaactacatcctgaacatgagcttgtggagtctgacctag

SEQ ID NO: 17723 - DNA, 4866 bp, Artificial Sequence
  Description of Artificial Sequence: Synthetic coding sequence
atggctaaaagtgggggatgtggcgccggggccggagttggtggtggtaacggagcccttacctgggtgaacaatgcagccaagaaagaagagagtgaaacggccaacaagaacgattcgtctaaaaagctgtcagtggagcgcgtataccagaaaaagactcaactggagcacatcctattgcggcctgacacttatatcgggagtgtggagccattgacccaatttatgtgggtgtacgatgaggacgtggggatgaattgtcgcgaggtgacctttgtgcccgggctgtacaagattttcgacgagattctggtgaacgccgcggacaacaagcaacgggacaaaaatatgacttgcatcaaggttagcatcgaccctgagagtaacattatttctatttggaataacgggaaaggaatcccagtggttgaacataaggttgaaaaagtctacgtgcccgcactcatatttggacagctgttgacatcctcaaattacgatgatgatgaaaaaaaagttacagggggaaggaatgggtacggggctaagctgtgtaacattttctcgactaaatttacagtggagaccgcttgcaaagaatacaaacacagcttcaagcagacatggatgaacaacatgatgaaaaccagtgaagctaagatcaagcactttgatggagaggactatacatgtattacatttcaacctgacttgtcaaagttcaaaatggaaaaattggacaaagatatcgttgcactcatgactcggcgcgcctatgacctggcgggatcctgccggggcgtcaaagtgatgtttaatggaaaaaagcttccggtgaacgggttccgctcttacgtggatctttacgtgaaagacaaattagacgaaacaggagtagctcttaaggtgatccacgagctggccaatgaacggtgggatgtttgcctgacgctgtctgagaaaggttttcagcaaatttcttttgtgaattcgatcgccactaccaagggcggacgtcacgtggattatgtggttgaccaggtagtgggtaagctgatagaggtcgttaagaaaaaaaacaaagccggtgtttctgtcaaaccctttcaggtcaaaaaccatatctgggtgtttatcaattgtttgattgaaaaccctacttttgactctcaaactaaagagaacatgacactgcagcctaagtctttcggaagcaagtgccaattgtctgagaagtttttcaaggccgccagcaattgtggaatcgtggaaagcatattgaactgggttaaatttaaagcgcaaactcagctcaataagaaatgttcgtctgtgaaatacagcaagattaaaggaatcccgaagctcgacgacgccaatgatgccggcggaaagcacagcttagagtgtaccctcatcctgaccgaaggtgactccgctaaatccctagccgtgagcggcttgggagtcatcggaagagataggtatggagttttcccactaaggggtaagattctgaatgttcgggaggcctcccacaaacaaatcatggagaacgccgagatcaacaatatcattaagatcgtcggtttacaatacaagaagtcttacgacgatgctgagtccctgaaaaccttgcggtatggaaagatcatgattatgacagatcaggaccaggatgggtctcatatcaagggcctcctgattaattttatccatcacaactggcctagtcttctgaaacatggatttctggaggaatttataactccaattgtcaaggctagcaagaacaaacaggagctctctttttacagcatcccagaatttgatgagtggaaaaagcatattgagaatcagaaggcctggaaaataaagtattacaaggggttgggcaccagcaccgctaaagaagctaaagaatacttcgcagatatggagaggcatagaatcctgttccgttacgcgggaccagaagatgatgctgctattactttggccttcagcaaaaaaaaaatcgatgatcgcaaagagtggctaacaaatttcatggaagatcgccggcagcggaggctccatgggttaccggaacagttcctatacggaacagctactaagcatttgacctacaatgactttattaacaaggagctgatcctcttctcaaacagtgataacgagagatccatcccgtctctggttgatgggttcaagccaggacagaggaaggtgctcttcacatgtttcaagaggaatgataagcgtgaggtgaaggtagcgcagctcgccggtagcgtggccgagatgagcgcctaccaccacggggagcaggcattgatgatgaccatcgtcaatctcgcccagaatttcgtggggtccaataacattaatctcttacagcctattggccagttcggtaccaggctgcacggaggtaaagatgctgcttctccaaggtacatttttacgatgttaagcactctggccagactgcttttcccagcggtggatgataacttgctcaagtttctgtatgacgacaatcagcgggtggagccggagtggtacattcctatcattcccatggtccttatcaacggggcagaagggataggaacaggctgggcctgcaagctacctaactatgacgcaagagaaatcgtcaataacgtacgccgcatgttggacggcctcgatcctcatcctatgctccctaattacaagaactttaagggcactatccaggagttaggacagaaccagtacgcagtgagcggcgagatctttgtagtggaccggaacacagtagagatcacagagttgccggtcagaacatggacacaggtgtacaaagaacaggtgctagagcctatgctgaacggtactgataagacgcccgcactaatttcggattacaaagagtatcatacggacactaccgtcaagtttgtcgttaaaatgactgaggagaagcttgctcaagcagaggccgcggggctccacaaagtatttaaactgcagaccacactgacatgtaattcaatggtgctgttcgatcatatgggctgtctcaagaagtacgaaaccgtgcaggacatactaaaagagtttttcgacttacgcctcagctactatggtctgcgtaaggagtggttggtggggatgctgggtgcagaatctactaagctaaataaccaggctcggtttattctagaaaagatccagggaaaaatcactatcgagaaccgaagcaaaaaagacctgatccaaatgttagtgcagcggggatacgagtccgaccctgtgaaggcatggaaagaggcacaggaaaaagctgccgaggaggacgagacccagaaccaacacgacgacagtagctccgatagtggcaccccgtcaggtccagatttcaactatatcttaaatatgtctttatggagtttgacaaaggaaaaagttgaggagctgatcaagcaaagggacgccaaggggagggaggttaatgaccttaaaagaaagagccctagcgatctctggaaggaagacctggcagccttcgtcgaagagcttgacaaggtggaatcccaggaaagggaagatgtgctggctggtatgagcggcaaggcaattaagggaaaggtcggcaagcctaaagtgaagaagctccagcttgaagagacgatgccatctccctacggaagacgaatcattcccgagatcacagcgatgaaagcagacgcttccaaaaaactgctgaagaaaaagaaaggggatttagatacagctgccgtcaaggtggagtttgatgaagagtttagcggcgcaccagtggagggggccggggaagaagccctgactcccagtgttcccatcaacaagggcccaaagcctaagagagaaaaaaaggagccgggcaccagagtgaggaaaacaccgactagttctggcaagccatcagccaaaaaggtgaaaaaacgtaacccctggtctgacgatgaatctaaatcagagtctgatttggaagagaccgagccggtggtgatcccacgggacagtttgctgcggcgggccgccgctgagcgacccaagtataccttcgacttcagcgaggaggaagacgatgatgctgacgatgacgatgatgacaataatgacctcgaggagctcaaggtgaaagcgagcccaattaccaatgatggggaagacgagttcgttcctagcgacggcctggacaaagatgagtatactttttctccggggaagagcaaagcgacccccgagaagagcttgcatgataaaaagtcacaggacttcgggaacttgttcagctttccgtcctattcccagaagtcagaggacgacagcgccaagttcgatagcaatgaggaagattctgccagtgtattcagcccatcgttcgggctcaaacagacggacaaagtgccctcaaagaccgttgctgcaaaaaaggggaagccgagctccgataccgttccaaagccaaaacgtgcacctaaacagaaaaaagtcgtggaggccgtcaacagcgactcagatagtgaatttgggattcctaaaaaaacaactacacccaaaggaaagggtcgaggagcaaagaaacgaaaggcgagcggaagtgagaatgagggcgactataaccctggcagaaaaacatctaagaccacgtccaagaagcctaaaaagacgtccttcgaccaagattctgatgtggacattttcccgagcgactttcctactgagccaccttccctaccacgtaccggcagggctagaaaggaggtgaagtacttcgctgagtctgatgaggaagaagatgatgtggacttcgcaatgttcaattag

SEQ ID NO: 17724 - DNA, 174 bp, Artificial Sequence
  Description of Artificial Sequence: Synthetic coding sequence
accttgtttgaccagaacaacgccgctaagaaggaagaatctgagactgctaacaagaacgattcttcaaaaaagttaagcgtggagcgtgtgtaccaaaaaaaaacacagctcgagcacatactactccgacctgacacctacattggttcggtcgaacccctcactcagtag

SEQ ID NO: 17725 - DNA, 1437 bp, Artificial Sequence
  Description of Artificial Sequence: Synthetic coding sequence
atgtcgctctggagccttaccaaagaaaaggtggaggagctgattaagcagagagacgcaaagggaagggaagttaatgatctgaaacgtaagagtccaagcgacctctggaaggaagacctcgccgctttcgtcgaagaactagacaaggtggagagtcaagaaagagaggatgtcttagccggcatgtctgggaaggcaatcaaaggtaaagtcggcaagccaaaagtgaagaagctgcagctggaagagaccatgccctccccgtacgggaggagaattatcccagagatcaccgctatgaaggccgatgctagtaaaaagctgctcaaaaaaaaaaaaggcgatctcgatacagcggccgtgaaagtggagtttgatgaagagttttctggggcccccgtcgaaggcgctggagaggaggcccttacccccagtgtccctatcaataaaggccccaagccaaagcgggagaagaaggagcccggcactcgcgtcagaaaaacacctacatcatctggaaaacctagcgccaagaaggtgaaaaaacgcaacccgtggagcgacgacgaatccaaatccgaatctgacctcgaagagactgagcccgtggttatcccaagagattcgctgcttcgtagagccgcagccgagaggcccaaatatacgttcgacttctcagaggaagaggacgacgatgccgatgatgacgatgatgataacaacgacctggaagaactgaaagttaaggcgtcacctattaccaacgatggcgaggacgaattcgtcccgtccgatgggctggataaagatgagtatacttttagccccggcaaatccaaagccacacctgaaaagtctctgcatgacaagaaaagtcaagacttcggcaaccttttttcttttcctagttatagccagaagtccgaggacgacagcgctaaattcgactccaacgaagaagatagtgcatctgtcttctctccatcatttggccttaagcagacagataaagtaccttctaagacagtggcggctaagaaaggtaaaccatcctcggacacagtgcctaaaccgaagagggcacctaaacaaaaaaaggtcgtggaggctgtaaattcggacagtgactcagagtttggaataccaaagaaaaccactacaccaaaagggaagggacgtggcgccaagaaaaggaaggcttcagggagcgaaaacgaaggcgactacaacccaggacgtaaaacaagcaaaaccacctctaagaagccaaagaagacctccttcgatcaggattccgacgtcgatattttccctagcgacttcccgacagagcctcctagcttacccagaacagggagagctcgcaaagaagtgaaatatttcgcagagtctgatgaggaagaggatgacgtcgacttcgcaatgttcaattag

SEQ ID NO: 17726 - DNA, 1437 bp, Artificial Sequence
  Description of Artificial Sequence: Synthetic coding sequence
atgagcctgtggagtctgacgaaagaaaaggttgaagagctcattaaacagagagacgcaaaaggtcgcgaagtaaatgacttgaagcggaagagtccttcagatttatggaaggaagatctcgccgctttcgtggaagagctggacaaagtggaatcacaggagcgtgaggatgtgttggctggaatgtctgggaaggccattaaaggaaaagtaggcaaacccaaagttaaaaaactacagctcgaggagacaatgccgtccccatacgggaggcggatcatccccgagattacagctatgaaagccgatgcctccaagaagttgctgaaaaagaagaagggtgaccttgataccgctgcggtcaaggttgaattcgacgaggagttcagtggagcccctgtcgagggagcaggcgaggaagccctcaccccatcagtgcccattaataagggcccaaagcctaagcgagagaaaaaagaacctggtacacgcgttaggaaaacgccaacaagttctggaaaaccttcagccaagaaggtcaagaagagaaacccctggagtgacgacgagtccaagtctgagagcgacttagaagagacggagccagttgttatcccacgggacagtctgctccgaagagccgctgccgagcggcccaagtatacattcgacttttccgaggaggaagacgatgacgctgacgatgacgacgacgacaataacgatctcgaagagcttaaagtaaaagcatcgcctatcacaaacgatggggaagatgagttcgtgccctctgatggactcgataaagatgagtacacctttagtcctggaaagagcaaggccacacccgaaaagtcattacacgacaagaaatcacaggattttgggaacttgttttctttcccaagttactctcagaaaagtgaggacgacagtgccaaattcgattcaaatgaggaggacagtgccagcgtttttagtccaagctttggtttaaaacagactgataaagtgccatctaaaacggtggcagccaagaaggggaaacctagctccgataccgtgcccaagcctaagagagccccaaagcagaagaaggtggttgaggcagtaaactccgattcggatagcgaattcggtatccctaaaaaaacaaccacacccaaaggcaaaggtagaggggccaagaagcggaaagcaagcgggtccgagaatgagggcgattataacccgggcaggaagacaagcaagactacttcaaagaaacccaagaagacgtcatttgaccaagatagcgatgtggatatattcccatcagacttcccaactgagccacctagtctgccaaggactggccgcgcgcggaaggaggttaaatatttcgcagagtccgacgaagaggaagacgatgtagatttcgcgatgtttaattag

SEQ ID NO: 17727 - DNA, 3006 bp, Artificial Sequence
  Description of Artificial Sequence: Synthetic coding sequence
atgatcttcccagtggcccgttacgcactgaggtggcttcggagaccagaggaccgcgctttcagtcgcgccgccatggaaatggctttgcgcggcgtcaggaaagtgctttgcgtagcggagaagaacgacgcagccaagggaatcgctgacttactgtccaatggaagaatgcggagaagggagggcctgtccaaatttaacaagatttatgaatttgactaccatctatacggccagaacgtaactatggtcatgacttccgtgtcagggcatctgctggctcacgacttccagatgcaattcaggaagtggcagagctgcaatccactcgtcctgttcgaagccgagatcgaaaaatactgccctgagaactttgtggacatcaagaagacgcttgaaagagaaacacggcagtgccaagccctcgttatatggacagactgcgaccgtgagggagaaaacatcggtttcgaaattatacacgtgtgcaaggccgttaagccaaatctgcaggtcctacgagctagatttagcgaaattactccgcatgccgtgaggactgcgtgcgagaacctaacagaaccagaccagcgagtgagtgatgccgtggatgttcggcaggagctggacctgcggatcggcgccgcgttcactaggtttcaaacactgaggctccaacggatctttcccgaagtgctcgcagaacagctaattagttatgggtcctgccagtttcccaccctcgggttcgttgtggaaaggtttaaggctatccaggcattcgtgcccgagatcttccaccgaattaaggttacacacgatcataaggacggcatcgttgaattcaactggaaacgtcataggctttttaatcataccgcatgtctcgtactctaccagctgtgtgttgaggatccaatggccactgtggttgaggtccgctctaagccgaagtcaaagtggcggccccaggcgctggataccgtggagctcgagaaactcgccagccggaagctccgcatcaatgcgaaggaaactatgaggatcgcagagaagctctatactcaggggtacattagttacccaagaactgagacaaacatttttcctcgggatctgaatttaaccgtactggtcgaacagcagacccccgatccacggtggggcgcctttgctcagtccatcctcgagagggggggccctacacctcggaatggtaataagtcagaccaagctcacccaccaatacaccctaccaagtacactaataacttacaaggggacgagcagagactgtacgagttcatagtccgtcattttctcgcctgttgtagtcaggacgcacaaggacaggagaccacggtggagatagacattgctcaggaaaggtttgttgcgcatggcttaatgatccttgcacggaactaccttgatgtttatccatatgaccactggtccgataagattttgcctgtatatgagcagggctctcacttccagcccagcacagtagaaatggtggatggggaaacttctccccctaagctgctgacggaggcagacctcatcgccctgatggaaaagcatggaatcgggactgatgccacccatgctgaacacatcgaaacaattaaggcccgaatgtatgttggcctgacaccggacaagcgcttcctgccagggcaccttgggatgggtctggtcgagggttatgattctatgggatacgagatgagcaagcctgacctacgggccgagctagaggctgatttgaaactcatttgcgacggcaagaaggataaatttgtggtgctgagacaacaggtccagaagtataaacaggtcttcatcgaagccgtggcaaaggcaaaaaaactcgatgaggctttggcacagtactttgggaacgggaccgagctcgctcagcaggaagacatataccctgcgatgcctgagccgattagaaaatgcccccagtgtaacaaagatatggtgctgaaaaccaagaagaatgggggcttctacctatcatgtatggggttcccagaatgccgctccgctgtgtggctaccggactcagtgctggaagccagccgggactcaagtgtttgtccagtctgccagcctcacccagtttatagactgaaactcaagttcaaaaggggctctctgccacctactatgccactggagtttgtgtgctgtatcggcgggtgtgacgacacactccgcgagattcttgacctcaggttctctgggggccccccccgagcttcacaaccaagcgggcgtctccaagccaatcaaagcttaaaccgaatggacaattcacagcacccacagccagccgactctcggcagacgggcagctcgaaggctcttgcgcaaactctcccgcccccaactgccgccggagagtctaattcagtcacctgtaactgtggccaagaggcggtgctgctgacggtaagaaaagaaggccctaataggggcagacagtttttcaagtgcaatggggggagttgcaatttcttcctatgggccgattcacctaatcccggggcgggaggtcctccagcactcgcttacaggccattgggggcctctctcggctgtccacccggaccgggcatccacctgggcggcttcggcaatcctggcgacgggtccggatccggtacatcctgtctgtgctcgcagccgtctgtcacacgcactgtgcaaaaagacggccccaacaagggcaggcagttccacacttgtgcgaaaccacgggagcagcaatgcggattctttcagtgggtggacgaaaataccgctcctggaacatcaggcgcaccgtcttggacaggggatcgcggcagaactctggagtctgaggcgcgtagcaagaggccccgcgcctcatcttcagatatgggcagcactgccaaaaagccaaggaagtgtagtctgtgccaccaacccggtcacacacgccctttttgcccacagaatcggtag

SEQ ID NO: 17728 - DNA, 1170 bp, Artificial Sequence
  Description of Artificial Sequence: Synthetic coding sequence
taaagtagggccgccatggagatggctcttcggggtgtccgaaaagtgttatgcgtggcagagaagaacgacgctgctaaaggcattgcggatctgttgtcaaacgggcgtatgcggaggagggaggggctaagcaagttcaataaaatctacgagtttgactatcacctttacggccaaaatgtgacgatggttatgacttctgtgtcaggccatctcctcgcacacgattttcagatgcagttcaggaagtggcagtcgtgcaacccgttggttttgttcgaggcagaaatcgagaagtattgtcccgagaacttcgtagacattaaaaagaccctcgaaagggagactcgccagtgtcaggctctcgtgatctggacagactgtgaccgagagggtgaaaatataggcttcgagattatccatgtctgtaaagctgtcaaaccaaaccttcaggtcctgagggccaggttcagcgagatcacccctcatgccgtgaggaccgcttgtgagaatctgaccgaaccagatcagagagtctcagatgctgttgacgtgcgtcaggagctggaccttaggattggagcggcctttaccagatttcagacccttcgcttacagagaatttttcctgaggtgctcgccgagcaacttatctcttatgggagctgtcagtttccaacactcggctttgttgtcgagagatttaaagcaatccaggctttcgtccctgagatctttcatcggattaaagtgactcacgatcacaaggacggcatcgtcgagttcaactggaagcggcatcgcttattcaatcacacagcctgcctggtgttgtatcaactgtgcgtcgaggatcccatggcaacagtggtggaggttcggtcaaagccaaagtccaagtggaggccacaggcactggacaccgtggagctcgaaaagttggccagtcgaaaactgagaatcaacgctaaggagacgatgcgaatagctgagaagctgtatacgcagggctacatctcctaccccaggaccgaaacaaacatcttccccagggaccttaacttgacagttttagtcgagcagcaaacccccgatcccagatggggcgcctttgcccagagcatcttggaaagaggaggtcctaccccgcgaaacggtaataagtag

SEQ ID NO: 17729 - DNA, 1596 bp, Artificial Sequence
  Description of Artificial Sequence: Synthetic coding sequence
atgatccttgctcgcaattatctcgacgtatacccctacgaccactggagcgataaaatactcccagtttacgaacagggatctcactttcagcccagcacggtcgaaatggtggacggcgaaacatcaccaccaaaactactgacggaggccgaccttatagctctcatggagaaacacgggattggcacagacgcaacacacgccgagcatattgagaccatcaaagccaggatgtatgtaggcctgacgcctgacaaacggtttctacccgggcacctgggaatgggcttggtcgaaggttatgattcaatgggttatgagatgagcaaaccagacctgcgcgcagaattggaagctgaccttaagctcatatgcgacgggaaaaaagacaaattcgtggtcctgaggcagcaggtgcagaagtataagcaggtcttcatagaggcagtggccaaagccaagaagctcgatgaagctttagctcaatattttggcaacggcaccgagttggctcagcaggaggacatctatcctgccatgccggaaccgatccggaaatgcccgcagtgtaataaagacatggtactgaaaacgaaaaaaaacggggggttctatctgtcttgcatgggctttccagagtgccgctcagctgtgtggctgccagattcagtgctggaggcctcaagggattctagtgtctgccccgtttgccagccacacccggtctatcggttgaagcttaaattcaaaagaggtagcttacctcccaccatgcccttagagttcgtatgctgcattggagggtgcgatgatacattgcgcgaaatcctggaccttagattctctggggggccccccagggcttctcagccctccgggagactccaagccaatcagtccttgaaccgtatggataactcacaacacccccaacctgcagattcacgccagacggggtccagcaaagccctcgcgcagacattgcccccacctactgccgccggggagtctaatagtgtcacgtgcaattgtggtcaagaggctgtcttacttacggtgcgcaaagaaggccccaacagaggccggcaattctttaaatgcaatggaggctcctgcaatttctttttgtgggcagattcacccaatcccggcgccggcggcccccctgctttagcatatcggcctctcggcgcttcccttgggtgccctcctggtccagggatccatcttggtggattcggcaaccctggcgatggctccgggagtggtacctcttgtctgtgctcacagcctagtgtgacccggacggtgcaaaaagacggccccaacaaaggccgccaattccacacctgtgcaaagcctagggagcagcagtgtggcttctttcagtgggtggatgagaataccgctcccggtacaagtggagccccttcctggacgggagaccggggtagaacactcgagagtgaggcacgatcaaagcggccgcgcgcctcatcgagcgacatggggtccaccgctaagaaaccacgcaaatgtagcttatgccaccagcctggtcacaccaggcctttctgccctcaaaatagatag

SEQ ID NO: 17730 - DNA, 2721 bp, Artificial Sequence
  Description of Artificial Sequence: Synthetic coding sequence
atgaatctaattataatctgcatggcccggcagtcctgtaacccccttgtgctgtttgaagcggagattgagaagtactgtccggagaatttcgtggatatcaagaagaccctggaacgtgaaacaagacaatgccaggctttggtcatttggactgattgcgacagagaaggcgagaatatcggtttcgagatcattcatgtgtgtaaggcagtcaagcccaacttacaagtactccgggctcgtttctctgagattacacctcacgctgtcagaacagcctgcgaaaacctcaccgagccagaccagcgtgttagcgatgcagtagacgttaggcaggagttagaccttcgtattggcgcagcgttcactaggtttcagacactccggctgcagaggatctttccagaagtgcttgctgaacagctgatctcctacggtagttgccaattccccacactcggatttgtggtcgaacggtttaaagcaatccaggctttcgttccagagatattccataggataaaggtcacccatgatcataaggatggtatagtggagtttaactggaagcgtcaccggctcttcaatcacaccgcttgcctggtactgtatcagctgtgcgtcgaggacccaatggccacagttgtggaggtaaggagtaagccgaaatccaagtggcgtccacaggcactggatactgtggaactcgagaagctggcctctcgcaaactcaggataaacgctaaggagaccatgcggatcgctgaaaaactatacacacagggatatattagttacccaagaacagagaccaatatattccctagggatctgaacctgactgttttggtcgaacagcaaaccccagacccccgctggggggcttttgcacagtctattttggaaagaggcgggccaactccgcgtaatggcaataagtccgaccaggcacacccacctattcatcccacgaaatatactaataacctgcaaggagacgagcagcgactgtatgagttcatcgttcgtcactttctggcttgttgttcccaggacgctcaggggcaggagacaaccgtcgagatagatatagcacaggaaagattcgtagcacacggtctgatgatcctcgcgagaaactacctagacgtgtacccctacgaccattggtcagacaagatcctccctgtatatgaacagggcagtcattttcagccttcaacagtggagatggtcgacggcgaaacgtctccacccaaattactgacagaggccgacttgattgcactaatggagaagcatggcatcggcaccgacgccacacatgctgagcatatagagacaattaaggcccggatgtacgtcggcctgacacccgataagcgtttcctgcccggccacctggggatgggtcttgtggaaggctatgactcgatgggttacgagatgagcaagccggatctccgagccgagcttgaggctgatctgaagctcatttgtgacggcaagaaggacaaatttgtcgtgttgcggcagcaggtacagaaatataagcaggtgttcatcgaagccgtggcaaaggcaaaaaagctcgatgaagccctggcccagtatttcggtaatgggactgagctggcacagcaggaggacatctaccccgcaatgccggagcccattaggaaatgtcctcagtgtaataaggatatggttctcaagaccaagaagaacggcggcttttacctgagttgtatgggcttcccagagtgcagaagcgccgtgtggttacccgatagtgtgctggaagcgtcacgagattccagcgtttgcccagtgtgccaaccacaccctgtgtacagactgaagctgaaatttaagcgtggatcactgccacctactatgccgctggaatttgtgtgttgcatcggaggctgtgacgatacattacgggaaattcttgatctgcggttctctggcgggccacctagagcatcccagcctagtggcagactccaagccaatcaatcccttaatcgtatggataatagccagcacccccagcccgctgacagtcgacagactggcagttccaaagccctggcacagactttgcccccccccacggccgccggcgaaagcaactccgtgacttgtaattgtgggcaagaagccgttttgctcacagtaaggaaggaaggtcctaaccgtggtagacagttcttcaaatgtaatggaggctcctgcaactttttcttgtgggcggacagcccaaaccctggtgcaggcggcccacctgccctggcttatcgacctctgggtgcctcattaggatgtccaccaggacccgggatccatctgggcggctttggtaatccaggcgacggctcggggtcagggacaagctgcctgtgtagccaaccaagcgttaccagaacagtgcagaaggacggaccaaacaaaggccgtcagtttcatacttgtgcgaagcctagagagcagcaatgtggattttttcaatgggtcgacgagaacaccgcgccaggtaccagcggcgccccctcttggacaggagaccggggcaggacacttgagtcggaagcgcgctccaaaagaccgagggcctcttcctctgacatgggcagtaccgccaagaaaccacggaaatgctctctatgccaccagccgggtcacacccgccctttctgtcctcagaatagatag

SEQ ID NO: 17731 - DNA, 2589 bp, Artificial Sequence
  Description of Artificial Sequence: Synthetic coding sequence
atgaagactgtgcttatggtggccgaaaagccttcactcgcccagagcatcgcaaagattcttagtagaggatctctttcttcacacaaaggcttgaacggcgcctgctcagtgcatgagtataccgggactttcgccggccaacccgtaagattcaaaatgacctctgtctgtggccatgtaatgaccctggacttcctgggaaagtacaataagtgggataaggtggatccagcggagctcttttcacaggccccaaccgaaaagaaggaagccaatccgaagctcaacatggtaaagttcttgcaggtcgagggccggggctgtgactatatagtgctttggctggattgtgataaggagggggaaaatatttgcttcgaagtgcttgatgctgtgctgcccgtcatgaataaggcccacggaggcgagaagacagtgtttagggccaggttctcttctatcacagatacagacatctgcaatgcgatggcctgcttgggtgaacctgaccataacgaggcattaagtgtggacgcacgacaggagctggacttaaggattggctgcgcatttacgaggtttcagaccaaatacttccagggtaaatacggagatcttgacagtagtctcatctcctttggaccgtgtcagaccccaacccttggtttctgtgtggagaggcacgacaagatccagtctttcaagcctgaaacatactgggtgctccaggcgaaagtcaataccgataaggatcgcagcctcctgttggattgggatcgtgttagggtgttcgatagagagatagcacagatgttcttgaatatgacgaagctcgagaaggaggcccaggtggaggcaacaagccgaaaagaaaaagccaagcagagaccacttgccctgaataccgtcgagatgctgcgggttgcaagttcttctctgggaatggggccccagcatgccatgcagaccgccgagcgcctgtatacacagggctatatttcttatcctaggaccgagacgacacactaccctgagaactttgacctgaaggggagcctgcggcagcaggcaaatcacccttactgggcagatacagtaaagagactgcttgctgagggaatcaacaggccacggaaaggacatgatgccggcgatcatccgcccatcactcccatgaagagcgctaccgaggccgaattggggggggatgcttggagactttacgaatacatcacccgccatttcattgcaacggtctctcatgactgcaaatacctgcaatccaccattagctttcgtattggcccggaactgttcacttgctctgggaaaactgtgctgagccccgggttcactgaggtgatgccctggcagagtgtgccactagaagaaagcctcccaacatgccaacggggggatgctttcccggtcggcgaagtgaaaatgctggagaagcagaccaacccgccagactatcttacggaagcggaacttatcaccctgatggagaaacatggcattggaactgacgcatctatccccgtgcacattaataatatctgtcagaggaattacgtgacggtcgaatccggtcggcgcctaaaacctacaaatcttggcatagttctggtgcatggatactataagatcgacgcagagctcgttctacccacaatcagatctgcagtggaaaagcagttaaacctcattgcccagggaaaggctgattaccggcaggtgttgggccacacccttgacgtctttaaaaggaagttccactatttcgtggattctatcgctggtatggacgaattaatggaggtgagctttagccccctcgctgccacagggaaacctcttagccgatgcgggaagtgccacagatttatgaaatatatccaggcaaagcccagtcgcctgcattgttctcactgcgacgagacttatacgctcccccagaacgggacaattaaactgtacaaagagttaaggtgccctttggacgactttgagcttgtgctgtggtcatccggaagccgcggaaagtcatacccattgtgcccatactgttataaccatcccccctttcgcgacatgaagaaaggaatgggctgtaacgagtgtacacacccatcttgtcagcatagcttatctatgctgggcattggccagtgtgttgagtgcgagtctggcgtgcttgtgctggaccccacctcaggcccaaagtggaaggtcgcttgtaacaaatgtaatgtggtggcccactgttttgaaaacgcgcacagggtgcgtgtgtccgcggacacatgcagtgtctgtgaggcggctctactggacgtggacttcaataaggcaaaatcacccttgcctggcgacgagacacagcatatgggctgcgttttttgcgaccctgtattccaggagctggtggaattaaaacacgcagccagttgccaccccatgcaccgtggtggacctggaaggagacagggaagaggaagaggacgggcgcggaggccacctgggaagccaaatcctcggcgcccaaaagataaaatgagtgcactggccgcatactttgtgtag

SEQ ID NO: 17732 - DNA, 2589 bp, Artificial Sequence
  Description of Artificial Sequence: Synthetic coding sequence
atgaaaactgtactgatggtggcagagaaaccttcgctcgcccagtcaatcgcaaagatcctgagtcgcggcagtctgagctcacataaaggccttaatggtgcatgttccgttcacgaatataccggcaccttcgccggccagccagtcagatttaaaatgacctccgtgtgcgggcacgtcatgaccttggactttctgggaaaatacaacaagtgggacaaagtggatcccgcggagcttttctcacaggcccctacggaaaagaaagaagctaatccaaagctgaacatggttaagttcctacaagtcgaagggcggggctgcgactatattgtgctctggctggattgcgataaagagggtgaaaacatctgcttcgaagtcctggacgcagtcttgccagttatgaataaggcccacggcggggagaagaccgtgtttcgcgctcgcttttcttcaatcaccgacacagacatctgcaacgcgatggcatgtcttggggagcctgatcataacgaagctctgtctgttgacgcaagacaggagctcgatctcagaatcggctgcgccttcacccggtttcagacaaagtattttcagggaaaatatggtgatctggactcatccctcatctccttcggcccttgccagactcctacactgggcttttgtgttgaaaggcatgataagatccaatcttttaagccggaaacttattgggtgctccaggccaaggtcaataccgataaggaccgcagtcttctcttagattgggatcgagtgagggtttttgaccgcgagattgcccagatgtttctgaacatgaccaagctcgagaaagaggcacaagtggaggcgacatcgaggaaggagaaagccaagcagcggcctctggccctgaatactgtggagatgcttagggtggcgagcagctcactcggaatgggaccacagcatgccatgcagaccgcggagagactgtacacgcagggttacattagttatcctcgaacggagaccacacactaccctgaaaacttcgacctgaagggatctctgagacaacaggctaaccacccctactgggcagacaccgtcaagcggcttctggccgaaggaatcaataggccgaggaaagggcacgacgcgggcgaccatccacctatcaccccaatgaaatccgctacagaggcggagctcggtggcgatgcatggcggctgtacgaatatattactaggcactttattgcaacagtatcacatgattgcaagtacttacaaagtactatcagcttccgtatcggaccagaattgtttacctgctcaggtaagactgtactgagcccaggcttcaccgaggttatgccttggcagtcagtgcctctggaagagtcactaccgacttgccagcggggggatgcgtttcccgtgggggaagtaaaaatgctggagaaacagaccaaccctcccgactatttgactgaggctgaactcatcacccttatggaaaaacatggaatcggcaccgacgcgtcaatcccagtgcacatcaataacatttgccagcggaactatgtcacagtggaaagtgggcgacggttgaagccaacaaacttagggatcgtgctcgtacacggctattacaagatcgatgccgaactggtgctgcccacaatcaggtccgccgtcgagaagcaactgaatttaatagcccagggcaaggctgactacaggcaggttctgggccatactctcgacgttttcaagcgcaagtttcactatttcgtggattctattgccggtatggacgaattaatggaggttagtttcagtcccttggcagccacaggaaagcccctctcgagatgtggcaaatgccacaggtttatgaagtatatccaggcaaagccatcgcgcctgcactgttcacactgcgatgaaacgtacacattaccccaaaacggcacaatcaagctgtataaagagcttcgctgccccctggatgacttcgagctcgtcttgtggtcatctgggtcccgcgggaaatcctatccactgtgtccctattgttacaatcacccacctttccgagacatgaagaaaggcatgggttgcaatgaatgtactcacccgtcctgtcagcacagcctcagcatgctggggattggccagtgtgttgagtgtgagtctggcgtcctagtcctggacccaaccagcggccctaagtggaaagtcgcatgcaacaagtgcaacgtggttgcccactgctttgagaatgcgcacagagtacgggtcagcgccgacacgtgtagcgtgtgcgaggctgctctgctggatgtggacttcaataaggctaagagtcctcttccgggggacgagacccagcatatgggatgtgtcttttgcgaccctgtgttccaggagttggtcgaactgaagcacgcagcctcgtgccaccccatgcatcggggaggccccggtcgccggcagggacgaggccggggcagagctagacgtcctcctggaaaacctaacccccgcaggcccaaagataagatgtctgctttagccgcttatttcgtttag

SEQ ID NO: 17733 - DNA, 849 bp, Artificial Sequence
  Description of Artificial Sequence: Synthetic coding sequence
atgtttctgaacatgaccaagttagagaaagaagcacaggtggaagccacctctcggaaagagaaggcaaaacaaaggcctttggcattgaataccgtagagatgctgcgcgttgctagcagttcgttggggatgggacctcagcacgctatgcagactgccgagcgactatatacgcagggctacatctcatacccacggacggagactactcattatccagaaaactttgacctgaaaggctcattgcgccagcaggccaaccatccatattgggcagacaccgtcaaacgcctgctcgcagaaggtataaacagaccgcgcaaagggcacgatgcaggggaccacccacctataaccccaatgaagagcgcaacagaagccgaactcggcggcgatgcttggaggttgtacgaatacattacaaggcactttatagccaccgtgagccatgattgcaaataccttcagtcgactatcagctttcgcattggacccgagctgttcacctgctcaggcaagacagtcttgtctcctggcttcactgaggtcatgccatggcagtcagtgccgctcgaggaatcactaccaacatgtcaaaggggcgatgctttcccagttggggaggtgaagatgctggagaaacaaacaaacccccccgactatctcacagaagctgagctgatcactcttatggaaaaacacggtatcggcggatgtgcctgtccaggcccccgtgctggcagtgtttccagtacccaggcgagctctctgctgaccaagctgccccgccagccctgcgtgccgtctccggccccccttcacggtcttgtcagtggtaattggtag

SEQ ID NO: 17734 - DNA, 741 bp, Artificial Sequence
  Description of Artificial Sequence: Synthetic coding sequence
atgaagacagtgttgatggttgccgagaagccttccctcgcccagtccatagctaaaattctgtccagaggctctcttagctcacacaaagggttaaatggtgcttgttcagttcacgagtataccggcaccttcgccggacagcccgtcaggttcaagatgacatcagtctgcggacatgtgatgaccctggattttttgggcaaatacaataagtgggacaaagtggacccagctgagcttttctcacaggcacccacagagaagaaagaggccaaccctaagttaaacatggttaagttcctgcaggtcgaggggaggggctgcgactacatagtcctgtggctagactgtgacaaagagggggaaaatatatgttttgaagtgcttgacgccgtgctgcccgttatgaacaaggctcatgggggagagaaaactgtcttcagggcccgatttagtagcatcacagataccgacatctgcaatgccatggcgtgcttgggagaaccggatcacaacgaggcattgtcggtggacgcacggcaggaactcgacctgagaatcgggtgcgccttcacccggttccagactaagtacttccagggaaaatacggtgatttggatagcagcctgatctcatttggtccatgtcaaacccctacactcggattctgcgtggagcgtcatgacaaaattcagagctttaaacctgagacatactgggtcctgcaggccaagtag

SEQ ID NO: 17735 - DNA, 366 bp, Artificial Sequence
  Description of Artificial Sequence: Synthetic coding sequence
atgaagaccgtactaatggtggccgagaagccttcacttgctcagtccatcgctaagatcctgtctcgaggcagcttaagttctcataagggacttaacggtgcctgtagcgtacatgaatatactggtacatttgctggccagccagttcggttcaaaatgacgtcggtgtgtgggcatgtgatgacattagacttcctaggaaagtataacaagtgggataaagtcgaccccgccgagctctttagtcaagctccaacagagaaaaaggaggctaatcctaaactcaacatggtgaaatttttacaggtggagggcaggggttgtgattacatcgtcctgtggctagactgtgacaaggaatag

SEQ ID NO: 17736 - DNA, 66 bp, Artificial Sequence
  Description of Artificial Sequence: Synthetic coding sequence
atgaagactgttctcatggtcgcggaaaaaccgagcctggcacagtctatcgctaagatcctgtag

SEQ ID NO: 17737 - DNA, 129 bp, Artificial Sequence
  Description of Artificial Sequence: Synthetic coding sequence
atgaaaactgtccttatggttgcagagaagccatccctcgcacagtctattgctaaaattctgtcccggggaagtctgagttcccataagggactcaatggagcgtgtagcgtgcacgagtacacatag

SEQ ID NO: 17738 - DNA, 369 bp, Artificial Sequence
  Description of Artificial Sequence: Synthetic coding sequence
atgaagaccgtactgatggtggctgaaaaaccctctctcgcgcagtctatagcgaaaatcctgtcgagagggagtctgtccagccacaagggcctgaacggcgcgtgctccgtacacgaatacactgggacatttgcagggcaaccagtacgatttaagatgacttccgtctgtggacatgttatgactcttgactttcttggcaaatacaacaaatgggataaggttgacccggccgaactctttagccaggcacctaccgaaaagaaagaggcaaaccccaaactgaacatggtaaagtttctacaggtggaaggacgcggatgcgattatatcgtgctgtggctcgattgtgataaagaaggctag

SEQ ID NO: 17739 - DNA, 144 bp, Artificial Sequence
  Description of Artificial Sequence: Synthetic coding sequence
atgaagactgtcttaatggtggctgaaaaaccgagtcttgcccagagcatcgccaagatcctgagccgcggatcactgtccagccacaagggactaaacggtgcctgctccgtgcacgagtacactggaacttttgcgggttag

SEQ ID NO: 17740 - DNA, 399 bp, Artificial Sequence
  Description of Artificial Sequence: Synthetic coding sequence
atgaagaccgtgttgatggttgccgagaaacccagcctggcccagagtatagctaagattctgtctcggggtagcctgtccagccacaaaggcctcaatggggcctgtagtgtccacgaatacaccggcactttcgcggggcaaccagtccgcttcaaaatgactagcgtgtgcggccacgtcatgacactggatttcctgggcaaatacaataagtgggataaggtcgaccccgccgagctgtttagccaggccccaactgaaaaaaaagaagctaatccaaagctgccccaggcatccgtgtgcactcaggctgctcctggcgtgcggccccatccgtgcccccccgcggcggcccgggtcgcggatagagtggtgccctgcggacccgtcacctag

SEQ ID NO: 17741 - DNA, 183 bp, Artificial Sequence
  Description of Artificial Sequence: Synthetic coding sequence
atgaagacagtgctaatggtggctgagaagccttcactggctcagtcaattgcaaagattctgtcaaggggctcactgtccagccacaaaggactgaacggggcatgcagcgtccatgagtataccggaacctttgcggggcagccagtgagattcaaaatgaccagcgtttgtggccattag

SEQ ID NO: 17742 - DNA, 186 bp, Artificial Sequence
  Description of Artificial Sequence: Synthetic coding sequence
atgaagactgttctaatggttgcagagaaaccttctctggcccagtccatcgcgaaaatcttaagccgggggtccctctcttcccacaaaggacttaacggcgcatgctccgtacacgagtacacaggcaccttcgcaggtcagccggtgcgattcaaaatgaccagtgtctgcggacacgtttag

SEQ ID NO: 17743 - DNA, 1578 bp, Artificial Sequence
  Description of Artificial Sequence: Synthetic coding sequence
taactggattccagtctcattagtttcgggccgtgccagacccctactctgggcttctgcgttgaacggcacgataaaattcagagcttcaaaccggaaacctactgggtcctgcaggcgaaagtaaacacggataaagataggagcctgctgttggattgggatcgggtaagagtgttcgatcgtgagatagcacagatgttccttaatatgactaagctcgagaaagaagcacaagtcgaggcgacctcaagaaaagagaaagctaagcagcggcccctggccttaaacacggttgagatgctgagagtggcatcttcgtccttgggcatgggaccacagcacgccatgcagacagctgagaggctttacacacagggctatatctcttatccccggactgaaacaactcactatcccgaaaacttcgatctgaagggctcactacgccagcaggccaaccacccctactgggccgacactgtaaaaaggttgctggccgagggcatcaatcggcctcgcaagggccatgatgccggtgatcacccacctatcaccccgatgaagagcgctacagaagctgagcttgggggcgatgcatggagactgtatgaatatataacccgccacttcatcgccacagtgagtcacgactgtaagtacttacaaagtacaatttcctttcggatcggcccggagctttttacatgcagtggcaaaactgtcctttcccccgggtttactgaggtcatgccatggcagtccgttccgctcgaggaatccctcccaacatgccagagaggggacgcctttcctgtaggagaagtcaagatgctagaaaagcagactaatccgcccgactacttgaccgaggctgagttaattactctgatggaaaagcacggtatcggaacggatgcttccatccccgttcacattaacaacatttgccaaaggaattatgtgactgtggagtcgggtaggagattgaaaccgacaaatctgggaatagtgctggtccatgggtactataaaatcgacgcggaactggtcctcccgaccatcaggtctgcagtcgagaagcagttaaatttaattgcccaggggaaagctgattaccgtcaggtgctgggccacaccctggatgtcttcaaaaggaaatttcattactttgtggactctatcgctggcatggatgagttgatggaagtatcattcagcccactggctgccacaggcaaaccactcagtcgctgcggcaaatgtcaccgattcatgaaatacatacaagccaaaccaagccgtctacattgctcccactgcgacgagacttacactctcccacaaaatggtacaattaagctatataaggaactccgatgcccactggatgactttgaacttgtcttgtggagctccggctctcgtgggaaatcctaccctctctgcccttactgctacaaccatcctccattccgggacatgaagaaaggcgagtgttcccactcccttctctccacggggtcatgtagccttttcagcgtgcccacccctgccctgcaccaggctggactgtag

SEQ ID NO: 17744 - DNA, 951 bp, Artificial Sequence
  Description of Artificial Sequence: Synthetic coding sequence
atgagtgccgaggtggagacttcggaaggggtggatgaatctgaaaaaaagaacagcggggcactggagaaggaaaaccagatgaggatggccgacctcagcgaactgctgaaggaagggaccaaggaggcccacgatagagcagagaatacacagttcgttaaggacttcctcaaaggaaacatcaagaaggagctatttaaactcgccaccactgccctgtactttacttactccgcgctggaggaggaaatggagcgaaataaagatcatcctgcatttgcccccctatatttcccgatggaattacatcggaaggaggccctaaccaaggacatggaatatttcttcggtgaaaattgggaagagcaggtgcaatgccctaaggcagcgcagaagtacgttgagcgcatccactacattgggcagaacgaaccggaactgctcgttgcccatgcctatacccgctacatgggggatctgagtggcggacaggtgctgaagaaggtcgcccagagggccctcaagttgccctccacaggagagggaacccagttttacctttttgaaaacgttgacaacgcgcaacaattcaagcagctgtaccgagccagaatgaacgcccttgacctgaacatgaagaccaaggagcgcattgtggaagaggccaacaaggcattcgaatacaacatgcaaatttttaacgagttagaccaggcaggctcaacgctggccagggagacattggaagatggcttccctgtacacgacggtaaaggagatatgagaaagtgtcccttctatgctgccgaacaagacaagggtgctctcgaggggagctcctgtcctttccgaacagccatggcggtgctgcggaagccctccctccagttcattctagcggccggagtagccctggccgccgggctgctcgcatggtactacatgtag

SEQ ID NO: 17745 - DNA, 1716 bp, Artificial Sequence
  Description of Artificial Sequence: Synthetic coding sequence
atgaagtgccagccaagatcgggggctcgaagaattgaggaaagacttcattacctgattaccacctacctcaaattcggaaataacaataactacatgaacatggctgaagccaacaacgccttcttcgcagcgtccgaaaccttccacacgccgagtctaggcgacgaggagtttgagatcccacccatcacccctcctcctgagtcggaccctgccctgggaatgcccgatgtgctgctgcccttccaagccctgtctgatcccctgccgtcacaaggaagcgagttcacaccccaattccccccgcagagcctggacctgccgtcaataacaattagccgtaatctggtggagcaggatggtgtactgcactcctccggtttacacatggaccagtcacatacacaggtcagtcagtatcggcaggatcccagtctgattatgcgcagcatcgtgcacatgacagacgcagcccgaagtggcgtgatgcccccagcgcaactgaccaccataaaccagtcgcaattatcagctcaactgggcctcaacctggggggggccagcatgcctcataccagtcccagtccgcccgcatccaagagcgcgaccccttctccttcctctagtataaacgaagaagatgcggatgaggctaacagggcaatcggggaaaagagagctgcaccagatagcgggaagaaaccaaaaacccccaagaagaagaagaaaaaagatccgaatgaaccgcaaaagcctgtttccgcttacgcattgtttttccgcgatacgcaggcagcgataaagggtcagaaccccaatgcgaccttcggggaggttagtaaaattgtggccagcatgtgggactccctcggagaagagcagaaacaggtgtacaaacgaaagactgaggcagcgaaaaaggaatacctgaaagcactggcagcctatcgggcatcactagtgtccaaggccgcggcggagagcgctgaagctcagacaatccggtctgttcagcagacgctggccagtacaaatctgactagctccctgcttctcaacaccccattaagtcagcatggaacagtaagtgcctctccacagacgcttcagcagagcctgccacggagtatcgctcctaagccacttaccatgcgactcccaatgaatcagatcgtgacctccgtcacaattgcagctaatatgccttctaacatcggggctcctctcatttcctctatggggacgacgatggtcgggagcgcccctagcacccaagtatcaccttctgttcaaacccagcaacatcagatgcagcttcaacaacagcaacagcagcaacagcagcaaatgcaacaaatgcaacagcaacagttgcagcagcaccagatgcatcagcagattcagcagcagatgcaacaacagcatttccaacaccacatgcagcagcacctgcagcagcagcaacagcacctgcagcagcagatcaatcagcagcaactgcagcagcagctgcagcagcgtctgcagttgcaacagctacagcacatgcagcaccagtcgcagccttcaccgaggcagcactcgccagtggcatcacaaattaccagccccattcctgctatcggatctcctcaacccgcttcccagcagcatcagagccagattcagagtcagacccagacacaggtgctgtctcaggtttctatcttctag

SEQ ID NO: 17746 - DNA, 5817 bp, Artificial Sequence
  Description of Artificial Sequence: Synthetic coding sequence
atgcagagctttagagaacagtcttcttaccacggaaaccagcagtcatatccccaagaggttcacggttccagtcggcttgaggaattctccccacgccaggcccagatgttccagaatttcggagggactggcggaagctccgggtcttctggctccggttccggcggaggaaggagaggtgccgcggccgctgctgctgccatggcttccgaaacgtcgggccatcaggggtaccaggggtttaggaaggaggctggggacttctattatatggccggaaacaaagaccccgtgaccaccggaactccccagccacctcagcgccgaccgagcggaccagtgcagtcctacggccccccccagggctcatcattcgggaatcagtatgggtcggaaggacacgttggtcagtttcaggcacagcactcaggactgggtggtgtgagtcactatcagcaggattacacggggcccttcagtccaggaagcgcacaataccaacagcaagcctcaagtcagcagcagcagcagcaagtgcagcagctccgacaacagctttaccagtctcaccagcccttgccccaggccacgggtcaacccgcaagcagctcaagtcacctccagcctatgcaaagaccaagtaccttgccttcgtctgcagctggctatcagctaagagttgggcagtttggtcagcactaccagtcctccgcgagtagctctagcagctccagtttcccttccccgcaacgattttcccagtcaggacagtcctacgacgggtcctataatgtgaacgcaggtagccagtatgaagggcacaatgtggggtctaacgcccaggcttacggcactcaaagcaattattcctatcagcctcagtctatgaaaaactttgagcaagctaaaattccccagggcacccagcaggggcagcagcagcagcagcctcagcaacagcagcacccatcacaacacgtaatgcagtacaccaacgccgccacaaaactccccttacaaagccaggttggacagtataatcagcctgaggtaccagtgaggtcaccaatgcaatttcatcaaaatttctcccccatctccaacccttccccggctgcttcagttgtacagtcaccttcttgctcatcaaccccatcccctctgatgcagaccggcgaaaatcttcagtgtgggcagggaagtgtccccatgggatccaggaacaggatcctgcagctgatgccacaattgtcccccacgccctccatgatgccttcaccaaatagtcatgcagcgggctttaaaggctttggactcgagggcgtaccagagaagagactaacagatcctgggttgagctcactcagcgccttaagtacccaggtagccaaccttcctaacactgtacagcacatgttactgagcgatgctctgacaccccagaaaaagacttcgaaacggccctctagctcaaaaaaggccgatagttgtacgaattctgagggcagttcacagcctgaggagcagctgaagtcccccatggccgaaagcttggatggaggatgctccagctcctcagaagaccagggtgagcgggtgagacaattgtcaggacaaagtacttccagcgataccacttataagggcggtgcgtccgaaaaggcaggctcaagtcctgcgcagggagctcaaaatgagccgcctaggctgaatgcaagccccgctgccagagaagaggccacttccccaggtgccaaagatatgcccttatcgtctgatgggaaccccaaggttaatgaaaaaacagtgggcgttatagtaagccgggaggctatgactggacgcgtggaaaagcctggcgggcaggataagggcagccaggaagacgaccccgcagcaacacagcgtccaccaagcaacggaggcgcaaaagagactagtcacgcgtccctgcctcaaccagagcccccgggcggcggaggatcaaaaggaaataagaacggtgacaacaattcgaatcacaatggcgaaggcaatggccagagtggccattctgctgctgggcctggatttacctcccggacggagccatcaaaatccccgggctccttgcgctattcgtataaagacagctttggtagtgctgtgcctcggaacgtctcaggtttccctcagtatcctacaggtcaggaaaaaggagatttcactgggcacggggagcggaaaggaagaaacgagaagttcccatctctgcttcaggaagtgctgcaggggtaccatcaccaccctgaccgccgctactcgcggagcacccaagaacatcagggtatggcaggcagcctggaaggcacaacgcgcccaaacgttctcgtatcacagacaaacgaacttgcctcccggggcctgctgaacaagtccattgggtcccttctggaaaacccacattggggtccctgggagagaaagtcgagcagcaccgctccagagatgaaacagatcaacctgacagattacccaattccaagaaagttcgagattgaacctcaaagctctgcccatgagccaggcgggtcactgtccgaaaggagaagcgtgatctgcgacatctctcccttgaggcagatagtgcgcgatcccggcgcccattctttgggacatatgagcgcggacacgcgaattggcagaaacgaccggctgaaccctactctgagccagtctgtgatactgccgggagggctggtttcaatggagactaaactaaaatcccagagcgggcagataaaggaggaggacttcgagcaaagtaaatctcaggcaagctttaataacaagaagagcggcgaccactgccaccctcctagcatcaaacacgaatcataccgtggcaacgcatccccaggtgccgcgacccatgactccttgtctgactatggaccacaggattcgagacccacacctatgcggagagtgcccgggcgcgtcgggggtagagaaggaatgcgcgggcgttcgccctcacagtaccacgattttgcagagaaactcaagatgtccccaggaaggtctcggggtcctgggggcgatccccaccatatgaacccccatatgacttttagcgaacgtgcaaataggtcgtcactgcacacccccttctcacctaacagcgaaactctggcctcagcataccacgccaacacacgtgctcatgcctacggtgatccaaacgcagggcttaatagccaacttcactataaacggcagatgtaccagcaacagcctgaagaatacaaggattggtcgtcaggtagcgcccagggagttatagccgcagcccagcaccggcaggagggccccaggaagagccccaggcaacagcagttccttgacagagtacgctctcccctcaagaacgataaggacggaatgatgtacggcccccccgtgggtacttatcatgacccaagcgcccaggaggcgggtcgatgcttgatgtcctccgatggcctgccgaataagggtatggagctgaagcacggctcccagaaattgcaagagagttgttgggacctgtctagacagacatctcccgctaaatcatcaggcccccctggaatgtcaagccaaaagcggtatggacccccccatgagactgatgggcatggccttgctgaggccacacagtcaagcaaaccaggctctgtgatgctccgactgcccgggcaggaggaccactcaagccagaaccccctgattatgcgcagacgggtgcgcagttttatcagccccatcccgtcgaaaagacaaagtcaagatgtaaaaaactccagcactgaagataaaggcagattgcttcatagttccaaagaaggtgccgacaaagccttcaacagttacgcccatctgtcacactcacaggatatcaagagtatccctaaaagagactcttcaaaggacctcccgagccccgattcccgcaattgtccggccgtaacactgacatcccctgccaagacaaagattttaccgcctaggaaagggagaggactgaaactggaggcgattgtccagaagatcacctcccccaatatccgtcgttctgcgagctccaatagcgccgaggctggcggagacactgtgacacttgacgacattttgagtctcaaatccgggcctccagagggtgggagcgttgcagttcaggacgcagacattgagaagcgaaagggtgaggtggctagtgatcttgtctcacctgctaaccaggaacttcatgtggagaagcccttgccccggtcatcagaggaatggcgagggtccgttgacgataaagtcaagacagagacacacgccgaaactgtcaccgccggcaaggaacccccaggcgctatgacgtccaccacctcccaaaagcctgggagcaatcagggtagaccagacggaagtttgggcggaactgctcccctgatatttccagacagtaaaaacgtcccgccagtggggatcctggctcctgaagcgaacccaaaagccgaggaaaaagagaacgacacagttaccatcagtcccaagcaagagggctttcctccaaagggctattttccttctggtaaaaagaagggaagacccataggaagcgtgaacaaacagaagaagcaacagcagccacccccccccccacctcagccacctcaaatccccgagggctccgccgacggagagccaaagccgaaaaagcagcgacagcgacgcgaacggcggaaaccaggcgcccagccacggaaaaggaaaaccaaacaggccgtgccaattgtcgaaccccaggagccggaaatcaaactgaaatatgcaacgcagccccttgataaaacagatgccaagaacaagagcttttacccatacatccacgtggtgaacaaatgtgaactgggggctgtctgcaccatcattaatgcggaggaagaagagcagacaaagctggtgcgcgggaggaagggccagcgttccttgacccccccccccagctcaacagagtccaaggccttgcctgccagtagctttatgctacagggtccagtggtcacggagtcatccgtcatggggcatcttgtttgttgcttgtgtggtaagtgggccagttataggaatatgggtgacctgtttggtcctttctatccccaggattacgcggccacactgcccaagaatcctcctccgaagcgcgccactgaaatgcagtccaaagtcaaagtacgtcacaagtcagcctctaatggcagcaagacagatacagaggaagaagaggagcagcagcaacagcaaaaggagcagagaagtctggccgctcacccacgatttaaacggcggcatcgatccgaggactgcgggggcgggcctagatcattgtcacgtggtttaccttgtaagaaagcagctacggagggctcatccgagaaaaccgttttggactccaagcccagcgtccccaccaccagtgagggagggccagaattggagttacagattcccgaactgcccctcgattccaatgaattctgggtccacgaaggctgtatactctgggccaacgggatatatctggtctgcgggagattgtatggccttcaggaggccctggagatagccagggagatgaaatgctctcactgccaggaagctggagctacactgggatgttacaacaaaggatgctcctttagatatcattatccatgcgcaatagatgctgactgtcttctgcatgaagaaaattttagtgtccggtgccctaagcacaaggtgaggctttggaggtag

SEQ ID NO: 17747 - DNA, 5883 bp, Artificial Sequence
  Description of Artificial Sequence: Synthetic coding sequence
atgcagagctttcgggagcaaagctcgtatcacggcaaccagcaaagctacccacaggaggtccacggcagctcaaggcttgaggagttctccccccgccaggctcagatgttccagaacttcggcgggaccggtggctcctctggctcttctgggtctggatccggaggcgggcggcgtggggctgctgcagcagccgctgctatggccagcgaaaccagcgggcatcagggttaccagggattccgcaaggaggccggtgacttttactacatggcagggaacaaggatccagtgactacaggaacgccccagcctccgcagcgcaggccttccggacctgttcaaagctacggtccaccacaaggttccagctttggtaatcagtatgggagcgaagggcatgtgggccagtttcaagcacagcattcaggactcggaggcgtgtcccactaccagcaggattacaccgggccctttagtccaggttctgctcaataccagcaacaggccagctcccaacagcagcaacaacaggttcagcaactcagacagcagctgtatcagtcgcaccagccgctcccacaagctacggggcagccggcctcgagctcttctcacctgcagcctatgcaacggccaagcacacttcctagttccgctgccggatatcagctgcgggtggggcagttcggccagcattaccagtcctcagcaagcagctcatcttcctcttctttccctagcccacagcgatttagccagtcgggccagagctatgacgggtcttacaacgttaatgccggcagtcagtatgaagggcacaacgtggggagtaatgctcaggcttacgggactcagtctaactactcttatcagccccaaagcatgaagaatttcgagcaagcgaaaatccctcagggcacacagcagggacaacagcaacagcagccacagcaacaacagcacccaagccagcacgtcatgcagtatacgaatgccgctacaaagttgccccttcaatctcaggtgggacagtacaaccagcctgaggtgcctgttagaagtcctatgcaattccatcagaacttttcaccgatatccaatccctccccagctgcgagcgtggtccagagtccgtcctgctccagtacacctagccctttaatgcagacaggggagaatcttcaatgcggtcaaggctctgtgcctatggggtccagaaacaggatacttcagctgatgccccagctgagccctactccttccatgatgccctcaccaaattcccacgcggctgggttcaagggattcggtctggaaggagtcccagaaaaacgcctgaccgaccctggcctctctagtctctccgcactctctacacaggtggccaacttgcccaacaccgtgcagcacatgctgctcagcgacgcattgacaccccagaaaaagaccagcaagcggccctctagtagtaaaaaggccgattcctgcactaactccgagggatcaagccagcctgaagagcaactcaaatcccctatggcagagtctctcgacgggggttgttcgtcctctagcgaggaccaaggcgagcgagtgaggcaactttcaggacagtctacaagctcagacactacctacaagggcggcgctagtgaaaaagcggggagctccccggctcagggtgcccaaaacgagccacctaggctgaatgcaagtcctgctgcgcgggaggaggccacctctcccggtgctaaagatatgcccctgagttctgacgggaaccctaaagtaaatgaaaaaactgttggtgtcatcgtctccagagaggccatgactggcagggtggagaaaccaggtggtcaggataaagggagccaggaggacgaccctgctgctacccagcgtccgcctagtaatggaggggctaaagagaccagccatgcatcactccctcagccggaacctcccgggggcggtggctctaaggggaacaaaaacggcgacaataattccaaccataatggagaggggaacggccagtctggtcattctgcggctggacccgggttcacatccagaactgagccctctaaatcccccggctccctgcgctactcatacaaggacagcttcgggagcgccgttcccaggaacgtgtctgggtttccgcagtaccccactggacaggagaaaggcgatttcaccggacatggagaaaggaaagggcggaacgagaagtttcctagcctactgcaagaagttctgcagggatatcaccaccatcccgaccgccgctactcccgcagtacacaggagcatcaaggcatggctggctcgctggaaggaacgacccgacctaatgttctagtgtctcagacaaacgagctggcatccagaggtctattaaataaaagtattgggtccctgttggaaaatccacactggggcccctgggaacgcaaatccagcagcaccgctccggaaatgaagcaaattaacctcactgattatccgatcccccgtaagttcgagatcgaaccccagtcatctgctcacgaacccggaggtagtttgtccgaacggaggtcagtgatttgtgatatcagccctctgcggcaaattgtccgtgacccaggagctcattctctggggcacatgagcgccgatacccggatcggcaggaacgatcgcttaaatcctactctgtcacagagtgtaatcctcccaggcggtctggtgtctatggaaaccaagcttaagtcacaatctgggcagatcaaggaagaggattttgaacagtccaagagccaggcttcgtttaataataaaaaaagcggggaccattgccatcccccctctatcaagcatgaaagctacagaggtaatgctagtcccggggcagctacacatgacagcctgagtgattatggcccccaagattcgcgtccaactcctatgcggagggtgccgggaagagtgggtggtcgggaaggtatgaggggccgcagccctagccaataccatgacttcgcagagaaactcaaaatgagccctggacggtctcgcggaccaggaggggatccccaccatatgaatccccatatgacatttagtgaacgcgccaataggagctccttgcatactcccttcagcccgaatagcgagacactggctagtgcctaccatgccaacaccagagctcacgcttatggagaccctaacgccggcctcaattcacagctgcactacaagcgacagatgtaccagcagcagccagaggagtataaggattggagtagtgggagcgcgcaaggcgtgatcgccgccgctcagcatagacaagagggcccccgaaagagccctcggcagcagcagttcctcgatagagtccgcagcccattgaagaatgacaaagacggtatgatgtatggaccacccgttggcacgtaccatgaccccagcgcgcaagaggcaggccgctgtctcatgagttcagatgggctgccgaataaagggatggaacttaaacacggatcccagaagcttcaggaatcttgttgggatctgtcaaggcagactagccctgccaagtcatcgggcccacctggaatgtcttcacagaaacgctacgggcctcctcatgagacagacggccatggcttggcagaggcaactcagtctagcaaacctggctctgtcatgctccgcctgccgggacaggaggaccactcctctcagaatccattaattatgaggaggcgggtcaggtcatttatttcccccattccaagtaagcggcagtctcaggatgtgaaaaacagtagcaccgaagataaaggtcgactgctgcattcctccaaggagggagccgacaaggctttcaactcctatgctcatctttctcatagccaagatattaaatccatcccgaagagagactcaagtaaagatctcccttcacccgatagtcggaactgccccgcggtcacacttacttcgcccgccaaaaccaaaattcttccccctaggaaaggtcgtggcctcaaattggaagctatagtacagaagatcaccagccccaacatcagacgcagcgcttcttctaactctgccgaggcagggggggatacagttaccctcgacgatatcttaagtctcaaatccgggcctcccgagggggggagcgtagctgttcaggatgctgacatcgagaaacggaagggcgaagttgcatctgatttggtctcacctgccaaccaagagctgcacgtggagaagcccctaccaagaagttccgaagagtggagagggtctgtggatgacaaagtgaagacagagacacacgccgagactgtcacagccggcaaagaaccccccggggccatgactagtactacctcccagaagccaggatccaatcagggacgacctgatggttctctaggtggaacagccccacttatttttccagactccaagaatgtccctcctgtgggaatcctggcccctgaggctaaccctaaggccgaggagaaagaaaatgatacagttaccatttcaccaaaacaggaagggttcccccctaagggatacttccctagcggcaagaagaaaggtaggcctatcgggtcagtgaataagcagaaaaagcagcagcagcccccgcctcccccgcctcaacccccacagatcccagaaggctccgcggacggcgagccaaaaccgaagaagcagagacagcggcgggaacgcaggaaaccaggagcacagccgaggaaaagaaagactaagcaggccgtgcctatagtggaacctcaagagccagagattaagcttaaatatgcaacccagcctctggacaagaccgatgctaagaataagagtttttacccttatatccacgtcgtcaacaaatgcgagttgggtgccgtctgcactatcattaatgctgaagaagaggagcaaaccaagctagttagggggcgcaagggacagaggagtttaacccctcctccaagttcaaccgaatccaaggctctgcccgcttcctcatttatgctgcaaggccctgttgtaacagaatcctctgtgatgggtcaccttgtgtgctgtctctgtggaaaatgggcaagctaccgaaatatgggagacctctttggacctttttaccctcaagattacgcggccacccttcctaagaatccaccaccaaagcgagcaactgaaatgcagagcaaggtcaaggtgcgccataaatctgccagcaatggatccaaaaccgacaccgaggaggaggaagaacagcaacaacaacaaaaggaacagcgtagcctcgctgcccaccctcgattcaaaagaagacaccggagcgaagactgtgggggggggccacggtccctcagccgtggcctcccatgcaagaaggccgcaacagaaggctcatctgagaaaacggtgcttgactctaagcccagcgtacccaccaccagtgagggcgggccggaactggagctgcagatcccggagcttccgttagacagcaatgagttctgggttcacgaaggatgcattctgtgggccaacggaatctacttagtttgtggccggctgtatgggcttcaagaggccctggagatcgcgcgagagatgaagtgcagccactgtcaggaagccggagccaccctggggtgctacaacaaaggatgttcctttcgctaccactacccttgcgccatcgatgcggactgcctcctgcatgaggagaatttttcagtgagatgcccaaaacataagccccctctgccatgtcctctcccaccccttcaaaataaaaccgctaaggggtctctctctactgaacagagtgagcgaggatag

SEQ ID NO: 17748 - DNA, 540 bp, Artificial Sequence
  Description of Artificial Sequence: Synthetic coding sequence
atgagtaccggcagcctctccgatgttgaagacctgcaggaagtggaaatgctggagtgcgatggcctcaagatggactctaacaaagagttcgtgacctccaatgagtctacagaggagtcctccaactgcgagaacggcagcccccaaaagggacgaggaggtctgggaaaaagaaggaaagctccgacaaagaagagtccactctctggcgtgtcacaggaggggaaacaagttcagcgcaacgcggccaatgctagagaacgggctaggatgcgcgtgctcagtaaagcattctcccggctgaaaacgacgctgccgtgggttcccccggataccaagctttctaaactcgataccctgcgcctggcctctagctatattgcccacttaagacagattctggcaaatgacaagtacgaaaatgggtatattcatcctgtgaatcttacgtggccttttatggtagccggcaagccagagtctgacctgaaggaagtggtgaccgccagtcgtctgtgtgggacgacagcctcctag

SEQ ID NO: 17749 - DNA, 540 bp, Artificial Sequence
  Description of Artificial Sequence: Synthetic coding sequence
atgagcaccggatctctgtcagatgtcgaagatctccaggaggtggagatgctcgagtgcgatgggttaaagatggattcgaacaaggagtttgttacctctaatgagtccaccgaggagagttcaaattgcgaaaacggaagccctcagaaaggcagaggcggcctgggaaagaggcgaaaggctcctaccaaaaagtccccactgtcaggagtgtctcaagaggggaagcaagtgcagcggaacgcggcgaatgcaagggaaagggctcgcatgagggttctaagtaaagctttcagccgactcaagacaacactcccttgggttccccctgataccaagctgagcaaactggataccctacggctggcaagcagctacatagctcacctccggcagatcttggcaaacgacaaatacgaaaacgggtacatccatcctgtaaacctcacgtggcctttcatggttgccgggaaacccgaatccgacctgaaggaggttgtgaccgctagccgcctgtgtggcacaaccgcctcttag

SEQ ID NO: 17750 - DNA, 1965 bp, Artificial Sequence
  Description of Artificial Sequence: Synthetic coding sequence
atgaatcagccacaacggatggctcccgtaggcactgataaggagctttcagaccttttagatttcagtatgatgttccccctgcctgtgacaaacggcaaaggacggccagcttccctcgccggcgcacaattcggcgggtcagggctggaagatagaccttcatccgggagctggggaagcggtgaccagtcctcaagcagttttgacccctctcgaacattttccgaaggcacgcacttcactgagtctcatagctctctgtccagctctacattcctggggccagggttgggagggaagagcggcgagcgcggcgcctatgcatcatttgggagagatgccggcgttggtggcctcacccaggcggggtttctgagcggcgaattagccctgaattctccgggtcctctgagtccatccggtatgaaaggaacatcccaatactacccctcatacagtgggtcgtctcgacgacgcgcagccgacgggtcattggacactcagccgaaaaaggtgagaaaggtgcctcctggactacctagctcggtgtatcctcccagttccggagaggactacgggcgagacgccaccgcgtacccaagcgcgaaaacgccctccagcacctaccctgcacctttctacgtagcagacggctctttgcatccttcggccgagctctggagcccacctggtcaggcgggcttcggcccgatgcttggtggcgggagttcccctttgcctttaccgcctggatccggtccagtcgggtctagcggatcgtcaagcacattcggaggccttcaccagcatgaaagaatgggataccaacttcacggcgccgaagttaatggcggcctaccctcagctagtagtttcagcagcgcccctggggcaacttatgggggcgtatccagccacacgccacccgtgtccggtgccgactctttacttggctctaggggaacaaccgcgggtagcagcggggacgcattgggcaaagccctggcatcgatatacagtccagaccacagtagtaacaacttttctagctccccatccacccccgtcgggtccccgcagggactggcagggaccagtcagtggcctagagcgggcgccccgggcgcactctccccttcctacgatggggggttgcatgggcttcagtccaagatcgaggaccatctggatgaggcaatccatgtgctgcgctcacatgcagtgggaacagctggggacatgcatacactgctgccgggacatggcgccctcgcgtcagggttcaccggccctatgtccctcggcgggcggcatgctggccttgtcggtggaagtcacccagaggatggcctggctggatccacgtctctgatgcacaatcacgccgctttaccctcacagcctggaacccttcctgacttatcccggccacctgattcttacagcggccttgggcgcgccggagcaaccgcagccgcctccgagatcaaacgggaagagaaggaggacgaagagaacacttccgcggctgatcacagcgaagaggaaaaaaaagaactgaaggcaccacgtgctcggacctcacccgacgaggatgaagatgatctactgccgccggaacagaaagcagagcgcgaaaaagagcggcgcgtcgccaacaacgcccgtgagaggttaagggtccgcgacattaacgaggcgttcaaggagctaggtagaatgtgccagctgcatctaaactccgagaagccacagaccaaattgcttattttacaccaagccgtgtctgtgatattgaaccttgagcagcaagtgcgtgagcgtaacctgaatcccaaggccgcatgtctgaaaagaagagaggaggagaaagtatcaggagtggtcggtgatcctcaaatggtcctttcggccccccatcccggacttagtgaagctcacaatcccgccgggcatatgtag

SEQ ID NO: 17751 - DNA, 1956 bp, Artificial Sequence
  Description of Artificial Sequence: Synthetic coding sequence
atgaatcaaccccaacgaatggctcctgtgggcacagacaaagagctttcagacctcctagatttctcaatgatgttcccgttgccagtgacgaatggcaagggcaggcccgcctccctcgcaggtgcccagttcggcggctccgggctcgaagataggcccagtagcggctcctggggaagcggggatcagtccagctcatcctttgacccaagcaggaccttttccgaggggactcattttacagagtcgcattccagcctctcttcatctacctttctggggcccggattgggcggtaagtctggcgagcgaggtgcttacgcttctttcggacgcgatgccggcgtcggcggcctcacacaggcaggttttctcagtggggaactggctcttaacagccctggccccctgtcaccctccgggatgaagggaacaagccaatactaccctagttactccggatcatccaggcgccgtgcagccgatgggtctctggacacacaacccaaaaaagtccggaaggtgccaccaggattgccgtcctctgtctatccgccctccagtggggaggattatggacgggacgccacagcttatccatccgccaagacccctagctctacgtaccccgcccccttttatgttgcagatgggtccctgcacccttccgctgagctctggtctccacccgggcaagccgggttcggtccgatgctgggtggcggcagttcacccctgcccctgccaccaggtagcgggcctgtcgggtccagtggtagttccagtaccttcggcgggcttcaccagcatgagcgaatgggctatcagctgcacggcgccgaggtaaacggtgggcttccaagcgctagcagtttctcctctgcaccaggggctacttacggcggcgtttcatcgcacacacctcctgtaagcggagccgacagtttgttaggcagtagaggaaccaccgccggaagctccggagacgcgctcggaaaagcgcttgcttctatttactcaccagatcactccagcaataacttctcttctagtccaagcacccctgtcggcagtcctcagggattggccgggaccagccagtggccacgagctggagctcccggtgcactttccccgtcatatgacggcggtttgcacggtctgcagtcgaaaatcgaggaccatttagacgaggctattcatgttctgcgcagccatgccgtgggcacagccggcgacatgcatacccttttgcctgggcacggcgccttggctagcgggttcactggccctatgtctttaggagggcgccacgccggcctggtcggaggctcccaccccgaagatggcctggcaggatccacatctttaatgcacaatcacgccgccttaccgtcgcaacccggcacgctgccagacctgtctaggcccccagacagctattccggcttgggcagagcaggagccactgccgctgccagtgagatcaaacgggaagagaaggaagacgaggaaaacacaagtgcagccgatcactctgaagaggagaagaaagaattgaaggccccacgtgcccgcacttcttccactgatgaggttctttccctagaagagaaggacctgagagacagggagaggcgaatggctaacaatgctcgcgagcgcgtgcgggtccgagatatcaatgaagcatttcgcgaactcggccgcatgtgccagatgcatctgaaaagcgacaaggcacagactaaactcctcatcttgcagcaagccgtgcaggtgattctggggcttgaacagcaggtccgtgaaaggaatctgaaccctaaagcggcctgcctgaaaagaagggaagaagaaaaagtctccggagtggtgggagatccccagatggtcctgtctgcacctcaccccgggttgtccgaggcacataacccagcagggcatatgtag

SEQ ID NO: 17752 - DNA, 1977 bp, Artificial Sequence
  Description of Artificial Sequence: Synthetic coding sequence
atgaaccaaccgcaacgcatggcaccggttggaaccgataaggaattaagtgatctgcttgacttttccatgatgtttcccttacccgtaactaacgggaaagggcggcctgcttccctggcgggtgctcaatttggtgggagcggcaagtccggggaacgtggcgcttatgcaagcttcggcagagatgccggtgtgggagggctaactcaggccggttttttgagcggtgaactggcgcttaattcgccggggcctctgtctccttcaggcatgaagggcactagccagtactatccctcatactctggcagctcaaggagaagggctgccgacggcagcttagacactcagcccaagaaggtacgcaaagtgcccccagggctcccgagtagtgtttatcccccaagcagtggggaagattacggccgcgacgccaccgcgtatccttcagcaaagacgccatcatcaacctaccccgctcccttctacgtggctgatggctccctgcaccctagcgcggaattatggagtccaccaggccaggccggcttcggccctatgctcggtggggggtcatcaccgctgcccttgccacccgggtctggtcccgttgggtcatcgggcagctccagcaccttcggcggactgcaccagcatgaacggatgggctaccagctgcatggtgcagaagtgaacggcgggcttccttctgcatcgtcattctcctccgctcctggtgctacgtacggcggtgtgtcctcacacaccccacctgtgagtggggcggactccctcttagggagcagagggaccacagctggaagttctggtgacgctctcggaaaggcgctcgcctcgatttattcccccgatcattctagtaacaatttctcatctagccccagtactcctgtgggatcccctcagggccttgcggggacaagccagtggccacgggctggcgcaccaggtgccctaagtccctcttacgatggtggtctgcatggcctccagtcaaagatcgaggaccacctggacgaggctattcatgtcctcagatcacacgccgtagggactgcaggggatatgcacactctgctgcccggccatggcgccctggctagtggatttactggacccatgtccctgggcggccgacacgccggactggttggaggatcgcaccccgaggatggcctggccggcagcacctccctcatgcacaatcacgcggctctgccctcacagccagggactctgcctgatctgagtaggcctccagattcctatagcggtctaggccgagctggcgctacggcagccgcgtctgaaatcaagcgagaggagaaggaagatgaggagaatacatctgctgcagatcattcagaagaggagaagaaagaacttaaggctccgcgggccagaacccgctgccagcccacccccagacactctccgccctcgccacatcaagacgcccatgtgcataggccgcatgcccaccggacacacactggccgaccatcagccggtcctacgttgttcccccagccccactgtctcccacttgctccttcaaggcgcccccctcactctcctgacgaggatgaggacgacctcctgcctcctgaacagaaagccgagcgagaaaaggagagacgggtcgctaataatgcacgggagagacttagagtgcgtgatataaatgaggcgttcaaagaactgggacggatgtgtcagctccatctgaatagcgagaaaccgcaaaccaagctcctgatcctccaccaagctgtaagtgttatcctaaatctggaacagcaagtccgcgagaggaacctcaatccaaaagctgcctgcctaaagagaagggaggaggaaaaggtgtctggggtcgttggtgacccccaaatggtattgagcgcaccacaccctggcttgagcgaagcgcataaccctgctgggcacatgtag

SEQ ID NO: 17753 - DNA, 1956 bp, Artificial Sequence
  Description of Artificial Sequence: Synthetic coding sequence
atgaaccaacctcagagaatggctcccgtgggaactgataaggagctgtcagacctccttgatttctcaatgatgttccctctgccagtgacaaatgggaaaggacggcctgcgtctctcgccggtgcccagtttggaggatccggcctcgaggaccgcccgagctctggttcatggggctctggggatcaatcatcttcatccttcgatcccagcagaaccttctccgagggaacccacttcacagaaagccatagttccttgagctcatcaaccttcctgggtccagggctcggaggcaagtcaggcgagagaggggcgtacgccagcttcggccgggatgcaggtgtgggcgggctcactcaggctgggtttctgagcggcgaactggctcttaacagtcccggccctttgtccccatctggcatgaagggcacttctcagtattaccccagctacagcggcagttctaggcgacgagctgctgacggctcactcgacacccagcctaagaaggtgcgcaaagtcccacctgggctgccgagttctgtgtatccgccttcctctggcgaggactacggccgagacgcaaccgcttatcctagcgcaaagactccctccagcacatatcccgctccattttacgtggctgatggttcactccaccctagcgccgagctgtggtctcctccaggccaggctgggttcggccctatgctgggaggaggcagctctcccctgccactgcctccaggctcagggccagtaggcagctccggcagcagcagcacatttggaggcctgcaccagcatgagcggatgggataccagctgcatggagcagaagtgaatggaggtctaccgtccgccagttcatttagctctgctccgggggccacatacgggggcgtctcatctcatacacctcctgtgagcggcgcggacagcctgctcggttctagaggaacaacggccggcagcagcggggatgcactgggaaaggcactggcgagtatctactcccctgaccactcttcaaacaacttttcgtccagcccttcgactcccgtgggctcaccccagggcctcgctggtacatcccagtggccgcgggccggtgcacccggcgcgctgtctccgagctatgatggagggttgcacggccttcaaagtaaaatagaggaccatctcgatgaagctattcacgtcctgcgatctcacgccgtgggaacagctggcgatatgcacacactgctgccgggacacggcgccctggctagcggcttcaccggtcccatgtctcttggaggaaggcatgccggcctggtggggggaagtcaccccgaagatggcttagctggctctacctcgctgatgcataatcacgcagcactgccttcccagcctggtacgctcccggatttgtcgagaccccccgactcctacagcggactaggtcgggctggtgctacagccgctgcctctgagataaaacgtgaggaaaaggaggacgaggaaaatacctcagcagcggaccactccgaggaagaaaagaaggaacttaaggcccctcgcgcaaggacaagctctaccgacgaggtgttgtctcttgaagagaaggatctgcgggaccgagaacgcagaatggctaacaatgccagagagcgggtacgtgtcagagacataaatgaagccttccgtgaactgggacgaatgtgtcagatgcatctcaagtccgacaaagcacagacaaagctgctgattttgcagcaggccgtccaggtgatcctcgggttggagcagcaagttagggagagaaatcttaatccaaaagctgcgtgcctgaaacgcagagaagaggagaaagtgtctggtgtggttggggacccacagatggtgctgagtgctccgcacccagggctgtccgaagctcacaaccccgccggccacatgtag

SEQ ID NO: 17754 - DNA, 474 bp, Artificial Sequence
  Description of Artificial Sequence: Synthetic coding sequence
atgggatatcagttacatggcgctgaggtgaatgggggactgccatccgctagcagtttctccagcgccccaggggccacctacggaggggtctcttcccacacaccaccagtgagcggggcggacagcctgctagggtcccgcgggactaccgcaggaagctccggggatgctctagggaaggctcttgcctctatctacagccctgaccactccagcaataacttctctagcagcccctctactccagttggctccccccagggcttggcaggcacctctcaatggcctagggctggtgcccccggcgcactgagcccttcatacgacggggggctacatggactggtcgggggttcccatccagaggacggcctcgccgggtcaacttctcttatgcataaccacgccgcactgccatcacagcctggtactctgccagatctatcgagaccccctgattcttatagttag

SEQ ID NO: 17755 - DNA, 2016 bp, Artificial Sequence
  Description of Artificial Sequence: Synthetic coding sequence
atgcatcaccagcaaagaatggccgcacttggcaccgataaggaactgtcagacttactggacttcagcgcaatgttcagcccacctgtgtcatctggcaaaaacggacctacaagcctggcaagcggccattttactggttctaatgttgaagaccgcagctccagtggtagttggggcaatggcgggcatccttccccttctagaaattacggggacggaaccccctacgaccacatgacttctcgtgaccttgggagccacgacaacttgtcaccccccttcgtcaattctcggattcagagtaagactgagagagggtcttatagttcgtacggaagagagagcaaccttcagggctgccaccagcagagtctcttagggggtgacatggatatgggtaacccgggcacactgagccccactaaaccaggttctcagtattatcaatattccagcaataacccgcgacgacggccattgcactcatctgcaatggaagtccagacaaagaaggtcagaaaggtcccgccaggccttccaagcagtgtatacgccccttcagcgtcaactgctgattacaatagggattcacccggttacccctctagcaaaccggctaccagcactttcccatcaagtttttttatgcaagacggccatcacagcagcgacccctggagcagttcgtcaggcatgaatcagcccggctatgcggggatgctcgggaattcgagccatattccccagtcctcatcctattgctcactgcacccccacgagaggctgagctacccatcacactcctctgccgacatcaacagtagtttaccacccatgtctacatttcatcggtccgggactaaccactactcaacatcgagctgtacacctccggccaatggaaccgactcgatcatggccaaccgaggtagcggggctgccggatcatcacagaccggagatgcattgggaaaggctctggccagcatttactctccagatcacaccaataattccttctctagtaacccaagcacacctgttggcagcccaccttcactcagcgccggaacggctgtgtggagcagaaacggcggtcaggcgagctctagtcccaactatgagggacccttacatagcctgcagtcaagaatcgaagataggctggagcgcctggatgacgccatccatgtattgaggaatcacgccgtgggtccttccaccgctatgccgggcggtcacggggatatgcatggcattatcgggccatcacataacggcgcaatgggcgggctcgggtccgggtacggtaccggactgctcagcgctaatagacactctttgatggtagggacccatcgcgaggacggcgtggctcttagaggtagccactctctgctgcccaaccaggtccctgtcccccagttgcccgtccaatctgccacctcccccgacctgaatcctccccaagacccatatcggggcatgccacccgggctccagggccagtccgtctcatctggcagttctgagatcaaaagcgacgatgagggggatgaaaacctccaggatactaagagctccgaagacaaaaagctggacgacgacaaaaaggatattaaaagtatcactcggtcacggagtagcaacaacgacgacgaggacctaacccccgaacaaaaggcagagcgggagaaagagagaagaatggctaataacgctagagaaagattgcgagtccgggacataaacgaggcctttaaggagcttgggagaatggtacaactgcacctgaaatcagacaaacctcaaacgaagctgctcatcttgcaccaggccgtggcggtgatcctgagtttggaacagcaggtcagagagaggaatctcaatcctaaagctgcttgtctgaagcgccgcgaggaagaaaaggtgtcatccgagcccccgccgctttccctcgcaggcccccatccaggaatgggcgacgccagcaaccatatgggacagatgtag

SEQ ID NO: 17756 - DNA, 2004 bp, Artificial Sequence
  Description of Artificial Sequence: Synthetic coding sequence
atgcatcaccagcagcggatggctgctctgggcactgacaaggagctaagcgacctgttggactttagtgccatgtttagtccccctgtgtcgtctggtaagaatggccccacctccctagcctctggtcacttcaccggatctaacgttgaagacagaagctcttcagggtcatgggggaacggaggccatccttcccctagcaggaactatggtgacgggacgccatacgatcacatgacatcccgggacctcggatcccatgacaatctgagcccgcccttcgtaaatagtcgcattcagagcaaaacggagcggggctcctacagttcgtatggccgagaatccaacttgcaggggtgccaccagcaatctcttctggggggcgatatggatatgggaaatcccgggacactgtcacctactaagcctggctcacagtattaccagtactcaagcaacaatcctcgccgccggcctctgcatagctccgctatggaggtccaaactaaaaaggtccgaaaggtgcccccagggctgcccagcagcgtctacgctccgtctgccagtacggccgactacaatagagatagccccggctatccgtcctctaagcccgctacttcgacgttcccaagctccttttttatgcaggatggtcaccactcatctgacccctggagcagctcttccggcatgaatcagcccggctacgcaggcatgttaggaaactcttcgcatatcccacaatcctccagctactgctcactgcacccccatgaaaggctgagctatccgtctcattcttcagctgatataaactccagcctgccccccatgtctacttttcatcggtctggaacaaaccattactctacatcatcatgtactccccctgctaacggcaccgacagcattatggctaacagagggtcgggggcagccggcagctcacagaccggcgatgcactggggaaggcattggcgtccatttattctccggaccacaccaacaactcttttagctccaacccttccaccccagtaggctcaccaccttcgctatcagcggggacggcggtttggtcaaggaacgggggacaggcttccagtagtccaaactacgaagggcccctccacagcctgcaatccaggatcgaagacaggctggagagattagacgatgccatccacgtgctgcgcaaccatgctgtgggccctagcacagccatgcctgggggacacggagatatgcacggcatcattggaccatcccataacggggctatgggcggcctgggcagcgggtacgggactggactcctaagtgcgaatcggcattctctcatggtagggacacaccgcgaggacggcgtggcattgcgcggctcccattctttactgccaaaccaggtgcccgttccacagctacccgttcaaagtgccaccagtcctgacctcaacccaccccaagacccttataggggcatgcctcccggcctgcagggacagtccgtgagttctggttcaagtgagattaaaagcgacgacgaaggcgatgaaaatcttcaggacactaaaagttctgaggacaagaaacttgatgacgacaaaaaggacattaagagcatcacgagcaacaacgatgatgaagacttaacccccgaacagaaagccgaaagggagaaggagcgccgtatggccaataatgcccgagagcggctgagggttcgcgatatcaatgaggcatttaaagagctgggccgcatggtgcagcttcatctcaagtctgacaagccccagacgaagcttctgattctacaccaggcagtggccgtgatcctttcattggagcaacaggttcgtgaacggaacctgaacccaaaagccgcctgcctcaaacgccgtgaagaggagaaggtgtcttccgagcctcctccattgagtctggccggccctcaccctggcatgggggacgcgagcaatcatatgggacagatgtag

SEQ ID NO: 17757 - DNA, 2322 bp, Artificial Sequence
  Description of Artificial Sequence: Synthetic coding sequence
atgtttagcaaaagactggagaagattgcccaggtccctctgttatttccgttcatctttatcatcttaaccaattactcgaaaatggagggcgctgtggaaagccagccctctttcttcaagacctcccaggacattgtaacttgtacttgggtggagaactgctatagcagttttagccggaggccacttgaacagatgttttgcaaacaccagtcaaagaacattatctcttggaccggcatggtagctcacacctgtaaccccagtacactcggcggccagggactctgcgattttgccaagatgcatcatcagcagcggatggccgcattaggtaccgacaaggaactgtccgacctcctggattttagtgctatgttcagtcccccagtttctagcggtaagaatggccctacaagcctggcctcagggcactttaccgggtctaatgtggaggatcgttccagcagtggttcttgggggaatggcggccatcctagcccctccaggaactacggagatggcaccccctacgatcatatgacaagtcgcgatctcggctcccatgataatctgtctccgccattcgtaaacagtagaattcaatcgaagaccgaacgcgggagctacagcagttacggacgggaaagtaaccttcagggatgtcaccagcagtcacttctgggaggggatatggacatgggtaacccgggtacgctctctcctacaaaaccgggctctcaatactatcagtactcctctaacaatcctcgtagaaggcccttacattcctccgcaatggaagttcagaccaagaaggtgcgaaaggtaccacccggcctcccatcgagcgtgtatgcccccagcgcttcgaccgccgactacaatagggactcccccggctacccctccagtaaaccagcaacgagtacattcccttcttctttttttatgcaggacggccaccactcgagcgatccttggtcttctagttctggcatgaaccagccagggtatgctggcatgcttggcaacagcagtcacatcccacaatcctcatcttactgttcattgcatccacatgaaaggctgtcttaccctagccactccagcgcagatatcaactcttctcttccacctatgtctacttttcacaggtcggggacaaaccactattccacctcctcctgtacgcctcctgctaatgggaccgactccattatggccaatagaggctctggggcagcggggagctctcaaacaggggacgcactaggtaaagcactggcctccatctactcacccgaccataccaacaactctttcagctccaatccatcgacacctgttggaagtcctccgtctctgtccgcaggaactgcagtctggagccgcaacggtggccaggccagctcatctcctaattacgagggaccactgcattcgctgcagagtcggatagaagaccggctggagagattagatgacgctatccacgtcttacggaatcatgccgtgggccccagcacagcaatgccaggcggccacggtgacatgcacggaatcataggcccttcacataatggtgctatgggtggcctgggttccggttacggtaccgggctgctgtctgccaacaggcacagcttgatggtcgggacccacagggaggacggcgtggcactgaggggaagtcactcacttctgcctaaccaggttcctgttcctcagcttcccgtgcaatctgctacgtcccccgatcttaatcccccacaagacccatacaggggcatgcctccaggactccaggggcagagcgtctcgtcagggagctccgagatcaaaagtgatgacgaaggtgatgaaaatctccaggacaccaagtcttctgaagacaaaaaactcgatgacgataagaaagacatcaagtcgataactcggtctcgctcctccaacaacgatgatgaggatttgacccccgaacagaaagccgagcgagaaaaggagcgccgaatggccaataacgcccgagagcgccttagggttcgggatatcaatgaggccttcaaggaattaggccggatggtgcagcttcacctgaaatcagacaaaccccagaccaaactactcattctgcaccaagcagtggctgttatcctgtcattggaacagcaggtccgagagcgcaatctcaacccaaaggcggcttgcctaaagcgccgcgaggaagagaaggtttcctccgagcctcctccactttcactggccggcccacaccctggcatgggcgatgcctcaaatcacatggggcagatgtag

SEQ ID NO: 17758 - DNA, 1536 bp, Artificial Sequence
  Description of Artificial Sequence: Synthetic coding sequence
atgtactgcgcctacaccatccctggcatgggaggaaatagcctaatgtactactataatggaaaggccgtctacgccccctccgcttctacagcagactataacagagattcaccggggtacccgtcctctaagccggctacttcaacttttcccagctcattcttcatgcaggatggacaccactcttctgatccgtggagttcatcgagcgggatgaatcagccggggtacgccgggatgctcgggaacagctcccatatcccccagagctcgagctactgcagtttgcatccacatgaaagattgtcttatcctagccacagttcagcagatattaatagtagccttcctccaatgagcacatttcaccggagcggcactaaccattatagtacttccagctgtaccccacctgccaacggcaccgattccatcatggctaatagagggagcggagccgcagggtccagccagacaggggacgcgctgggaaaagctctcgcttccatatactcccctgaccacactaataatagtttctcttcaaacccatccacaccagttggatccccaccaagcctatccgcaggaactgccgtttggtcaagaaatggggggcaggcgagtagctcacccaactacgagggtccactgcactccctgcaatctcgcattgaggatagactggaaaggctcgatgatgcgatccatgtcctgcgaaatcatgccgtggggccctccactgccatgccaggtggtcatggtgacatgcacgggatcataggacccagtcacaacggtgctatgggcggactgggaagtggttatggcaccggccttttatcagcgaacagacactctctcatggtcggcacacaccgagaagatggagttgctctacgaggttcgcactccctcctgcctaatcaggtaccagttccccagctacccgtacagagtgctactagccctgatttgaatccaccgcaggatccctatcgcggcatgcccccgggtctccagggacagtcagtatcaagtggaagttctgaaattaagtctgatgacgagggggacgagaatctgcaagacacgaaatcttctgaagacaaaaagctcgacgatgataaaaaggacataaagtcaattacaaggagtcgctcctcaaacaatgatgacgaagatctcacccctgagcaaaaggccgaaagggagaaagagaggcggatggccaataacgcaagggaaagacttcgagtgcgggatatcaatgaggccttcaaggagctgggccgcatggtccaactccacctgaaaagtgacaaaccacagacaaagcttcttattcttcaccaggccgtggccgttatcctgtctcttgaacagcaggtgcgggagaggaacctgaatccgaaggcagcatgccttaaaaggcgtgaggaagagaaggttagttccgaaccacccccactgtctctggccggcccacacccaggcatgggtgatgcttctaaccatatgggccaaatgtag

SEQ ID NO: 17759 - DNA, 1944 bp, Artificial Sequence
  Description of Artificial Sequence: Synthetic coding sequence
atgttctccccacctgtctcttctgggaaaaacggacctacctctctcgcgtcaggccactttacaggatctaacgtggaggatcggtcctctagtggttcatgggggaacggcgggcacccatctccatcgcggaactacggcgacggcactccttacgaccacatgacgagcagggaccttggaagccatgataacctgagtcccccattcgtgaactcccgcatccagagcaagaccgaaagaggatcgtattcctcttacggtcgggagtctaatctgcaaggatgtcaccagcagtctctgctgggaggagatatggacatgggcaatcccggaactttgagccctaccaaacccggatctcagtactaccagtattcatctaacaatccccggagacgaccactccactcctccgccatggaggtccagaccaagaaggtccgaaaggttccacctggactgccctcaagtgtatatgccccctcagcctccaccgcagactacaaccgagattccccaggttacccaagcagcaaacctgccacttctacatttcccagtagcttctttatgcaagatggacaccacagctccgacccatggtcgtcctcgtccggtatgaaccagcccggctacgctggcatgctgggcaattcttctcatataccacagtccagtagctattgtagtctccaccctcacgagagactgtcctaccctagccacagctctgccgacattaacagcagcctgcccccaatgtccacttttcataggagcggcacaaaccattactccacctcatcttgcacacctcctgccaacggcacggatagcattatggccaataggggttctggcgccgcaggtagctctcaaactggtgacgctcttggcaaggccctcgctagcatatattctccagatcatacaaacaattcattctcctctaatccatccacccccgtggggagccctccatcactctctgccgggacggccgtgtggtcaagaaacggtggacaggcttcttcctcgccaaattacgaagggcccctccatagtctgcaatctcgaatagaggatagactagaacgtttggatgacgcgatccacgtccttcggaaccatgccgttggaccatccacagctatgcccggtggtcacggggacatgcacggcatcatcgggccgagtcacaatggagccatgggtggcctcggcagcgggtacggaactggactcttgagcgccaacagacatagtctgatggtgggtacccaccgtgaggacggcgtggctctcagaggcagtcacagccttctgcctaaccaggttcccgttcctcagctgcccgtgcaaagtgccacgtcccctgacctcaaccccccccaagacccctatcgcggtatgcccccgggactgcaaggccagtccgtgagttcaggtagctccgagattaaatccgatgacgagggagatgagaatctacaggacacgaaaagttctgaggataaaaagctagatgacgacaaaaaagacattaaatccatcacccggagtagatcgtctaataatgacgacgaagacctcacccctgagcagaaggcggagagggagaaggaaagacgaatggctaacaacgctagggagaggctccgggtccgggacatcaacgaagcgttcaaggagctggggcggatggtgcagctccatcttaaaagtgataaaccccaaaccaagctgttgatcctccaccaggccgtggcggtgatcctaagcctggagcagcaggtccgggagagaaatctgaaccctaaggctgcgtgtctcaaacgcagggaggaagagaaggtttcttccgagcctccacctttatccctcgctggccctcaccctggtatgggcgatgcatcaaatcacatggggcagatgtag

SEQ ID NO: 17760 - DNA, 1614 bp, Artificial Sequence
  Description of Artificial Sequence: Synthetic coding sequence
atggatatgggcaaccccggtaccctgagcccaactaaaccaggtagtcagtattaccagtatagctccaataaccccagacgacgtccgttgcattctagtgctatggaagtccagacaaagaaggtacggaaagttcctcccggcctgccatctagcgtctacgccccgagtgcttctacagccgactacaacagagacagcccaggctatccaagctccaagcccgcaaccagcactttcccttcatcatttttcatgcaagacggccaccacagcagcgatccgtggtcctccagctcaggaatgaatcagccaggttacgcaggaatgctgggcaattcaagccatatcccccaaagcagcagctactgctcattacaccctcacgaacggctttcttacccctcccactcttccgccgacataaatagcagcctccctcccatgagcacttttcaccgttccggcacaaaccattactccacaagtagttgtacacctcctgcaaacggtaccgatagcattatggctaaccgcggctccggagctgccggaagctctcagactggggatgctctcggcaaagcgctcgccagtatatactcgccagaccacactaacaactcgttcagctcgaaccccagtacccccgtaggctccccgcctagcctcagtgccggcaccgctgtgtggtcccggaatgggggacaggcctcaagctcccctaactacgagggccccttgcactcgctccaatcacgcatagaggacagactggaacgcctggatgatgccatccatgtgcttaggaatcacgccgttggcccctccaccgctatgcccgggggccacggcgatatgcatggcatcattggaccaagccataacggcgccatgggcggcttgggatccggttatggcacaggattactgtccgcaaaccggcatagcctgatggtagggacacacagagaggacggtgttgctctgcgcggaagccattctctgctgcccaaccaggtacctgtgccacagctgccggttcagagcgctaccagccctgatcttaatcctcctcaggatccttaccgaggtatgcctccagggctacaagggcagtccgtgagctctggctccagtgaaattaagagtgacgatgaaggggacgagaaccttcaagataccaagtcctcagaggataagaaactcgatgatgacaagaaagacatcaaatccatcacctctaataatgatgacgaggacctgaccccggagcagaaggccgaacgcgaaaaagagagaagaatggccaataatgctcgagagaggctccgagtgcgggacatcaatgaagctttcaaagagctggggcgtatggttcagctacaccttaaaagcgacaagcctcagaccaagttgttaattctgcaccaggccgttgccgtgatcctgtcgctggagcaacaggttcgagagcggaaccttaatccaaaggcagcgtgtcttaagaggcgggaggaggagaaggtctcatctgagccgcctccgctgtctctcgcaggtccacacccaggaatgggggacgctagcaaccatatgggtcagatgtag

SEQ ID NO: 17761 - DNA, 1932 bp, Artificial Sequence
  Description of Artificial Sequence: Synthetic coding sequence
atgttctccccacctgtgtcttccggcaaaaacggccccacgtctttagcttcagggcacttcactggttccaatgttgaagaccggagctctagcggcagctggggcaatggaggacacccatcaccgagccgtaattacggagacgggacaccctacgaccatatgacaagcagagacctgggctcgcacgataacctctcccccccattcgttaactcaagaatccagagtaagaccgagcggggatcttactcttcctatggacgggagagcaacctccaaggctgtcaccagcagtccttgctgggaggcgacatggacatgggcaacccaggcactctgagccccacaaaaccgggatcccagtattaccagtatagcagcaataatcctcggaggcgacctctccacagcagcgccatggaggtgcagaccaaaaaggttcgcaaggtaccacccggactgccttccagtgtttacgccccaagcgccagcactgccgactacaatcgggactcacctggatatccgagttctaagccagccaccagtacatttccgtcatcctttttcatgcaggatggccatcattcaagcgatccatggagctcatcctctgggatgaatcaaccagggtacgccggaatgcttggaaacagcagccacattccccagtcaagctcctattgtagccttcatccacatgaacgtctgtcataccccagccatagtagcgctgatatcaactcgtccttgccaccaatgtccacttttcaccgctcagggactaatcactacagcacaagctcgtgtacccccccagcaaatgggactgactcaattatggcaaaccggggatccggagccgcaggtagtagtcagaccggagatgccctcggcaaagcactcgcctctatttactcgcccgaccacaccaataactccttctcttctaacccctctactcccgtgggctcccctccctctctcagcgctggcactgctgtctggagccgcaatggaggacaggcttcctccagccctaactacgagggtccgttgcactcacttcagtcccggatcgaagaccggctagagcgtctggatgacgcaattcatgtactacgaaatcacgcagtaggcccttctacagcaatgccaggaggccacggagacatgcacgggattattggcccatcgcataacggtgcaatgggcggactgggaagcggctacgggacaggcctgttaagcgcaaacaggcatagccttatggtgggaacacatcgggaggatggggtcgcactgagaggttcacactctctcttgcccaaccaggtgcctgtgccccagctgcctgtacaaagcgccaccagccctgacctgaatcccccacaggatccctaccgtggaatgcctccaggcctccagggccagtccgtgtcgtctggcagttctgagattaaatcagacgatgagggcgatgaaaacttacaagacactaaatcaagcgaggacaaaaagctggatgacgataaaaaggatattaagtccattaccagtaataatgatgatgaagatcttactccagaacaaaaagcagagcgtgagaaagaaaggcggatggccaataatgccagggagaggctgcgggtgcgagacatcaacgaggcttttaaggagctgggacggatggtgcagcttcacttgaagagcgataagcctcaaactaagctcttgatactccatcaggccgtggctgttattctgtccctggaacagcaggtgagagaacggaacctgaaccctaaagcagcctgtcttaagagaagggaggaggagaaggtctccagcgagccaccgcctctgtctcttgctggaccccatccaggaatgggcgatgccagtaaccacatgggccaaatgtag

SEQ ID NO: 17762 - DNA, 1878 bp, Artificial Sequence
  Description of Artificial Sequence: Synthetic coding sequence
atggaagaggattctcgggacgtcgaagacagatctagttccggttcatgggggaatggaggccatccatcccccagccgtaattatggcgacgggaccccctatgaccacatgaccagccgggacttaggctctcatgataacctgtccccaccatttgtcaattcgcgaattcagtccaaaacagagcgggggtcttacagctcttacgggcgggagagtaacctgcaagggtgccaccagcagagcctgcttggtggagacatggacatgggtaacccggggacgctgagtccgacaaaacctggctcacagtactatcagtactcctcaaataatccaaggaggagacctttgcacagcagtgctatggaggtgcagacaaagaaggtcagaaaggtgccgccagggctaccaagctcagtgtacgcaccatccgccagcacagccgactataatagagactcgcccggatacccctccagcaaacctgccacttctacatttccatcctcgttcttcatgcaggatggacaccatagctctgacccttggagtagtagctctgggatgaatcagcccgggtatgctggcatgttgggcaatagctctcatatccctcagagtagcagctattgttcgctccacccccacgagagactttcctaccctagccactccagcgctgacattaactctagccttcctcccatgtccacctttcataggagcggcaccaaccactatagtacttctagttgcaccccgcccgccaacggcactgactcaattatggcgaaccgaggcagcggggctgcgggatcctcccagaccggagacgctctcggcaaagctctggccagcatttactctcccgaccacactaataactccttctcctcaaatccaagcaccccagtgggcagtccaccctctctgagcgccggaaccgcggtctggtcacgcaatggtgggcaggcttcatcaagtcccaattacgaggggcccctgcacagcctgcagtctcgtatagaagatcgactggaacggctggacgacgcaatccatgtgcttcgaaaccacgctgtgggccctagtactgccatgcccggagggcatggggacatgcacggtataataggacccagccataatggtgccatgggaggcctgggaagcggttacggaaccggccttctctcagccaatagacactccctaatggtgggcacacaccgtgaggatggcgtagctctcagggggtcgcattcactgctacccaatcaggtcccagtaccgcaattgcctgtccagagtgccactagccccgatcttaaccctcctcaggacccataccggggtatgcccccgggattacagggacagagcgtatcgtcagggtccagcgaaatcaagtctgacgatgagggagacgagaatctgcaggatacaaagtcgtccgaggacaaaaagctggatgatgataagaaggacataaaaagcataacaagtaacaatgatgacgaagacctgactcctgagcagaaggctgagagagagaaagaaaggaggatggccaacaatgcgagggaacgactacgcgtgcgggatattaacgaggcattcaaggagctaggccgcatggtgcagttacacctgaaatcagacaagccccagactaagctgctgattcttcaccaggccgtcgcggtgatcctatccctggagcagcaggtgagggaaaggaatcttaatccaaaggctgcctgtctgaagagaagagaggaggaaaaagtctcctccgagccaccacctctcagccttgctggaccacaccccgggatgggcgatgcgagtaatcacatgggacagatgtag

SEQ ID NO: 17763 - DNA, 1803 bp, Artificial Sequence
  Description of Artificial Sequence: Synthetic coding sequence
atgaaagatatcttcttccagttcattatagccagagtgcgcaagtgctactccctctcatgtctacacactctgccagtcgttcctactctgcggaagacagagagaggatcatactctagctacggacgcgagtcaaaccttcagggttgtcaccagtcgctccttggcggagacatggacatgggcaaccctgggacattgtctcctacaaaaccaggatcacagtactaccagtactctagcaacaacccgcggcgccgccctctgcacagttccgccatggaggtgcagaccaaaaaggtgagaaaagttccaccgggtcttccaagttccgtgtatgctccaagcgcttcaaccgccgactataaccgtgactctcccggctacccatcttccaagcctgccacttccacgtttccaagtagtttcttcatgcaggacggtcatcattcgagtgatccttggagttcttccagcggcatgaatcaacctgggtacgccggaatgctgggaaattcctcccatattcctcaatcttccagctattgtagtttacaccctcatgagagactgagctacccctctcattcttccgctgatatcaactcctccctcccgcctatgtccacttttcaccgcagcggaacaaaccactattcaacctccagttgcaccccgcccgccaatggcacggatagtattatggcaaatcggggatccggtgccgccggatctagccagaccggagacgctttgggcaaggccttggcctcaatatattctcctgaccacactaataattctttttcttcaaacccctcaactcctgtcgggagcccgccatctctgtctgccgggacggccgtatggagtagaaacggcggccaagcctcatcctctcctaattatgaaggccccttgcattcactacagtcgaggatcgaagacaggttagagaggctggacgacgcaatccatgtcctgcggaaccatgcagtgggcccatcgacagcaatgccgggcggacacggtgatatgcatggcataattggcccgtctcacaacggggccatgggtggactcggatctggctacggtacaggactcctcagcgctaacaggcatagcctaatggtggggacacaccgcgaagatggagtagccttgagaggtagtcacagtttactccccaaccaagtgcctgtccctcagttgccagtccaatctgcgacatcccccgatcttaaccccccacaggacccataccgagggatgccaccgggcctacagggccagtccgtctctagcggctccagcgaaattaagtccgacgacgaaggagacgagaacttgcaggatacaaagagctccgaggataaaaaattggacgacgacaaaaaggatattaagtcaatcacacggtcccgaagctctaataatgacgacgaagatttgacccctgagcagaaagcagagcgggagaaggagcgccgcatggccaataatgcccgggagaggctgagggtgagggacattaacgaagccttcaaggaattgggccgcatggtccagctacacctgaagagcgataaacctcagaccaaactgctcatcctgcaccaggccgtggccgtgattctgtctctcgaacagcaggtcagggagaggaatcttaatcctaaggcagcctgtctgaagcgacgggaagaagagaaggtgtcttctgagccccctcctctgtccttagcagggccccaccctggaatgggagacgcctccaatcatatgggccagatgtag

SEQ ID NO: 17764 - DNA, 1233 bp, Artificial Sequence
  Description of Artificial Sequence: Synthetic coding sequence
atggccaaggacgctgggctcatcgaggctaacggtgagcttaaggtatttatagaccaaaatctgtctcctgggaaaggtgtggtgagtctggttgcagtgcatccctctacagtgaatccgctgggaaaacaactgctacctaagaccttcggccaatcaaatgtaaacatcgcccagcaagtcgtcatcggcaccccacagagacctgctgccagtaacaccctggtggtagggagccctcatacccccagcactcattttgcctcccaaaatcaaccctccgattccagcccatggagtgcaggcaaaagaaatcgaaaaggggaaaagaatggaaagggtctgaggcatttttcgatgaaagtttgtgagaaggtgcaacgcaaaggcactacgtcttacaacgaggtcgcagacgagcttgtggccgaattcagtgcggccgacaaccacattctccctaatgagtctgcctatgatcaaaaaaacatcaggcgacgagtgtacgatgctctgaacgtcctgatggcaatgaatatcatcagtaaggaaaagaaggaaattaagtggataggcctgcctacaaatagtgcccaggaatgccagaacctggaggtagaacgccagagaagactggaaagaatcaagcagaagcagagtcagctgcaggagctcatccttcagcagattgctttcaagaacctggtccagcgaaatagacatgccgaacaacaggcgtctcgccctccaccgcctaacagtgtgattcaccttccctttataattgtcaatacgagcaagaagaccgtgatcgattgctccataagcaatgacaagtttgaatatctcttcaatttcgacaataccttcgaaatccatgacgacatcgaggtgctcaagcgaatgggaatggcctgtgggctggaatccggctcatgtagcgctgaagatttgaaaatggcgcgtagcctggttcctaaggctctggagccatatgtgactgagatggcccaagggactgtcggtggagtttttattaccaccgcagggtctacaagtaacggcacccgcttttccgccagcgacctgaccaacggtgccgacgggatgctagccaccagttcgaacggcagccaatatagcggcagcagagtcgagacgccggtttcctatgtcggcgaggatgatgaggaagacgatgattttaatgaaaacgatgaagatgattag

SEQ ID NO: 17765 - DNA, 711 bp, Artificial Sequence
  Description of Artificial Sequence: Synthetic coding sequence
atggccaaggatgccggcctgatcgaggccaatggggaactgaaagtcttcattgaccagaatttgtcccccggcaagggcgttgtcagcctggttgctgtgcacccttccaccgtgaacccactcgggaaacaacttcttcctaagacgtttggacagagcaacgttaacatcgcgcaacaagtcgtcatcgggacccctcagcggcctgcagcctccaatacccttgtcgtgggttctccccacacaccatcgacacacttcgcctcccaaaatcagcccagtgactccagtccatggtctgcgggcaagaggaaccggaagggcgaaaagaacggaaaaggacttcgccacttctccatgaaggtgtgtgagaaggttcagagaaagggaacgacctcctataatgaagttgctgatgagctagtggcggagttttccgccgcagacaaccacatcttgccaaacgagtccgcgtatgaccaaaaaaatatccgccggagagtgtatgatgccctgaacgtgctgatggctatgaacattattagcaaggagaagaaggagatcaaatggattggccttcccacgaactccgctcaggagtgccagaacctagaagtggagcgacaacggagactagagagaataaaacagaagcaatcacaactgcaggagctaatcctgcagcagattgcattcaaaaatctgtag

SEQ ID NO: 17766 - DNA, 480 bp, Artificial Sequence
  Description of Artificial Sequence: Synthetic coding sequence
atggcgaaggacgctggcctaatcgaggctaacggagaactaaaggtgtttatagaccagaacctctcccctggcaagggggtggtgtccctggtggcagtgcacccatctactgttaaccccttggggaaacagctgttgcctaagacgttcgggcaatccaacgtgaacatagcccagcaggtagtcatcggcactccccagaggcccgctgctagcaatactttagtagttggctcgcctcacacccctagcacccacttcgcatcacaaaaccagcccagtgattcaagtccatggagcgcaggaaagcgcaataggaagggcgagaaaaacggtaaaggcttgaggcatttttccatgaaggtgtgtgagaaagtgcaaaggaaaggcaccacctcgtataacgaggtggctgatgaacttgtggccgagttctcggccgctgataaccacattcttccaaatgaaagcgtgtag

SEQ ID NO: 17767 - DNA, 936 bp, Artificial Sequence
  Description of Artificial Sequence: Synthetic coding sequence
atgagcaccctgccatccaagtggaagcggaataggaagggtgaaaagaacggcaagggccttaggcacttctctatgaaagtctgcgagaaagtgcagcgaaaaggcacaacttcttacaatgaggtggccgacgaactagtggcagagttttctgctgctgacaaccatatcttgcctaatgaatctgcatatgatcagaagaatattagaaggcgcgtttacgacgccctgaacgttcttatggctatgaatattatcagcaaggagaagaaagagattaaatggattggactgcctaccaactcagcccaggagtgccagaatctcgaagttgaacggcagagaaggctggaaaggatcaaacagaagcagtcgcagctgcaggaacttatccttcagcaaatcgcgtttaagaacctggtccagagaaaccgtcacgcagaacagcaggcaagccgccctcctcctccgaatagcgtgatccacctgccttttatcatagtcaacacttcgaagaagaccgttatagattgctcaatctcaaacgataaatttgaatacttattcaactttgacaatactttcgagattcatgacgatattgaggtgctgaagcgtatggggatggcttgcggacttgagagcggctcttgcagcgcggaggacctgaaaatggcgaggagtttggttcccaaagcgctggaaccttatgtaacagagatggcacagggaaccgtgggtggggtgttcattactaccgccggctccacatcaaacggcacaagtgacctgaccaatggagcggacggaatgctggctaccagcagtaatggttctcaatacagcgggtcgcgcgtggagaccccagtctcttacgtgggggaggacgacgaggaggatgacgactttaatgagaatgatgaggacgactag

SEQ ID NO: 17768 - DNA, 1146 bp, Artificial Sequence
  Description of Artificial Sequence: Synthetic coding sequence
atgagcactctgccgagtaagtggaagcggaacaggaaaggtgagaaaaatggtaaaggcctccggcatttctcgatgaaggtctgcgagaaggtccagaggaagggaaccacctcctataatgaagtcgcggatgaactagtggcagagttcagcgcagcggataatcatattctgccaaacgaatctgcatatgaccaaaagaatattcgtagacgggtttacgacgcgctgaatgtgctgatggccatgaatataattagtaaggaaaagaaggaaatcaagtggattggcctcccaacaaacagcgcccaagaatgccagaaccttgaagttgagcgccagagaaggttagaaagaataaagcagaagcagtctcagctccaggagctcatcctgcagcagatcgccttcaaaaatcttgttcaacgaaacaggcacgcagagcaacaggccagccgccctcccccacctaatagtgtcatccatctcccatttatcattgtgaacacctccaagaaaaccgtaatagactgcagcatatctaacgataagttcgagtacttgtttaacttcgataacacctttgagattcacgacgatatagaagtgcttaagcgtatggggatggcctgcggtttggaatccggatcttgttctgcagaagaccttaagatggcccgaagcttggtgcccaaggcccttgaaccctacgtgacagagaagacaggtctgtgtgattgtaccgccgggtgtcctgctccgtggaggtctgtggaaaacaccggccaagctaaggatatcaggaagctgcttcagccatcggtcctgtggaactgcgcaagcttttgctggttaccagttagactggtcctgtttctcttccacgaccattccttaatcttctttcccttcagtgagatggctcaaggtactgtggggggcgtctttattacaactgccgggtcaacaagtaatggcacaaggttttctgccagcgacctgactaatggcgccgatggaatgcttgcgacaagcagcaatggttctcaatattctggctctagggtcgagacgcccgtgagttacgtcggcgaggacgacgaggaagacgatgatttcaatgagaacgacgaagatgattag

SEQ ID NO: 17769 - DNA, 1161 bp, Artificial Sequence
  Description of Artificial Sequence: Synthetic coding sequence
atgatcattagcaccccccaacgcttaacgagttctggctccgtgctcattgggtccccctatacccccgctcctgcaatggtgactcagacacatattgccgaggccacaggatgggtgcctggcgatagaaagagagccaggaagttcattgactcagatttcagcgaatctaagaggtcaaaaaaaggcgacaagaacgggaaagggctgagacactttagcatgaaggtgtgtgagaaggtgcagcgcaaaggcacaaccagttacaacgaggtcgcagacgaattggtgtcagagtttaccaactccaacaaccacctcgcagcagacagccaagcttacgaccagaagaatatccgccgccgcgtctacgacgccctcaatgtgctgatggctatgaacatcatttctaaagagaaaaaggaaatcaagtggattggtcttccaactaattcagcccaggagtgtcagaacctggaaatcgaaaagcagcggagaattgagcgaataaagcagaaaagagctcaattgcaggagttgttactgcagcagatcgccttcaagaatctggtccagagaaaccgccagaatgagcaacagaatcaagggccgcccgctctcaatagcactatccagctgccctttatcattatcaacacatcgaggaagaccgttatagactgttccatctcctcggacaagtttgagtatttattcaacttcgacaatacctttgagatccacgatgatattgaagtgttgaaaagaatgggtatgagctttgggctcgagtccgggaagtgctcgctggaagatcttaaactcgccaaaagtctggtgcctaaggccctggaggggtatatcaccgacatttctaccgggcccagttggctgaatcaagggctactcctgaacagcacccagagcgtgtcaaatctggatctaaccactggcgcgacacttccacagtcctccgttaatcaaggactttgtctggatgcagaggtggccctggccacaggccagttccttgctcctaactctcatcagagcagttccgccgcatcccattgcagcgaaagtagaggggagaccccttgctctttcaatgacgaggatgaagaggatgatgaggaagattccagcagtccagagtag

SEQ ID NO: 17770 - DNA, 1113 bp, Artificial Sequence
  Description of Artificial Sequence: Synthetic coding sequence
atgatcatcagcacacctcagcgcctcacctcttctggatccgtgctgataggctcaccatacacccccgctccggctatggtcacccagactcacattgctgaagccacagggtgggtgccaggcaagaggtccaaaaaaggagacaaaaatggcaaaggcctgcggcacttctccatgaaggtctgtgaaaaggtgcagaggaagggtacgacctcctataacgaggtcgccgacgaactggtgtctgaattcacgaacagtaacaatcacctcgcagcagattcacaggcatatgatcagaagaatattagaagacgagtttacgatgcccttaatgtgttgatggctatgaacataatttctaaggagaaaaaagaaatcaaatggatcggcctgcccacgaacagtgcacaggaatgtcagaatctggaaattgagaagcagaggaggattgaaaggattaagcagaaacgcgcccaactccaggaacttcttctgcaacaaattgccttcaaaaacctcgtccagcgaaatcggcagaacgaacagcagaatcagggacctcccgctctgaacagtaccatccagcttccatttatcataataaacaccagccgtaaaaccgtgattgattgttccataagctcagacaaattcgagtatctatttaatttcgataacacattcgagatccacgacgatatcgaagtactgaagaggatgggtatgtctttcggactcgaatcagggaaatgttcacttgaggatctgaagctggctaagtctctggtgccgaaggccctggaaggttacattactgatatttctactggcccttcatggttaaaccagggtctactgttaaattcaactcaatccgttagcaacctggatcttacaaccggcgctaccctgccccagtcttccgtgaatcagggcctttgccttgacgccgaggtggctctggccacgggtcagtttctcgctccgaacagccaccagtctagcagcgcggctagccactgcagcgagagtcggggagaaaccccctgtagcttcaacgatgaggacgaggaggacgacgaagaagactcttcttctccggaatag

SEQ ID NO: 17771 - DNA, 1257 bp, Artificial Sequence
  Description of Artificial Sequence: Synthetic coding sequence
atgcaaccagaaggaattatttttgaagcggaaaacaaaccctccccaggaacggagtcagccggtacatttattttggatctttctgccactagtcggaccattatctcaactccccagaggttaactagtagcggcagcgtgttgatcggatccccctacacaccggctccggccatggtaacccagacacatatcgcagaggcaaccggctgggtcccgggcgatagaaagcgcgcacgcaaattcattgattcagactttagcgagtctaaacgctccaagaaaggggacaagaacggaaaaggactccgccacttcagcatgaaggtctgtgaaaaagtgcaacggaagggtacaacatcctacaatgaggtggcggacgaactcgttagcgagtttactaactctaataaccacctggccgcggacagcgcatatgaccagaagaatattcggcgacgggtgtatgacgccctcaatgtgctcatggctatgaacatcatctccaaggaaaagaaggagattaaatggattggcttgcctacgaactccgctcaggagtgccagaatttagagatcgagaagcagaggagaattgagcggatcaagcagaagcgggcccagctgcaggagctgctgttgcaacaaatcgcattcaagaatttggtacagcggaatcgacaaaacgagcagcagaatcaggggccacccgcattgaacagtacaattcaactccctttcattatcattaacaccagccgcaagaccgtcatcgactgctcgatctctagcgataagttcgagtacctgttcaatttcgacaacacgttcgagattcatgacgacatagaggtgttgaaaaggatggggatgtctttcggcttggaatcaggcaagtgttccctggaggacctgaagctggctaagtctctggtgcctaaagctcttgaagggtatattaccgacattagcaccggcccctcatggttaaatcagggactcctactgaacagcacgcagtccgtgtctaatctcgatctcaccacaggcgccacattaccccagtctagcgtgaaccaaggactctgccttgacgctgaggtcgctttggcaaccggacagttccttgcaccaaactcccaccaatcctctagtgctgctagccattgtagtgagagtcgtggggagaccccctgtagcttcaacgacgaggatgaggaggatgacgaggaagacagcagctcacctgagtag

SEQ ID NO: 17772 - DNA, 1161 bp, Artificial Sequence
  Description of Artificial Sequence: Synthetic coding sequence
atgattattagcaccccccagaggctcacctcctctggctctgtgcttattggatctccctatacaccagcgccagccatggtcactcagacccacattgccgaggctacgggctgggtccctggggatagaaaacgcgctagaaaattcatagatagcgatttctccgagtcaaagcgatctaaaaaaggcgataagaacgggaagggcctccggcatttctcgatgaaggtgtgtgagaaggtccagaggaaaggaaccacctcctacaacgaggtggccgacgaactcgtgtcagagtttacgaacagcaacaatcacctggcagccgattcacaggcctatgatcagaaaaacatccgccggagagtatacgacgcactgaatgttttgatggcaatgaatatcataagcaaagagaagaaggaaatcaaatggatcggcttgcctacaaactctgcccaggagtgtcagaacctcgagattgaaaaacaacggcggattgagcgaatcaagcagaagcgcgcacaacttcaggaacttctgctgcaacaaattgcttttaaaaacctcgtccagcgcaatagacaaaatgaacaacagaatcaggggcctcccgccctgaatagcaccatccagcttcccttcatcataatcaacacatcaagaaagaccgtgatcgactgcagtatcagttccgacaaatttgagtacctctttaatttcgacaatacctttgaaattcacgatgatatcgaggttctgaaaagaatggggatgtccttcggattggagtctggaaaatgttccctcgaggaccttaagttagctaagtcactggtgccgaaagccttagagggatatatcaccgatatctcgacaggtccttcatggcttaaccaagggctcctgctgaattctacacagtctgtaagcaacttggacctaaccactggcgcgaccctcccccaaagttctgtaaatcagggactatgtctggatgccgaggtggcgttagctacaggccagttcctcgcacctaacagtcatcagtcaagctcagcagcctcccactgctctgagtctaggggagagaccccctgctcgtttaatgatgaggatgaggaagatgatgaagaagattcatccagcccagagtag

SEQ ID NO: 17773 - DNA, 261 bp, Artificial Sequence
  Description of Artificial Sequence: Synthetic coding sequence
atgaccgccaaaaacgtgggactgacatcaaccaatgcggaggtccgagggtttattgaccaaaatctgagtcccacaaaaggcaatataagctttgtggccttcccagtttccaatacgaatagccccaccaagatcttgcccaagactctcggccctatcaatgtaaacgtggggccccagatgataattagcactccacaaaggctcacctcttccggaagtgtcctgatcgggagcccttacactcccgccccctag

SEQ ID NO: 17774 - DNA, 141 bp, Artificial Sequence
  Description of Artificial Sequence: Synthetic coding sequence
atgatcatatccacaccccagcggttgacatcctctggaagcgtcttgattggtagcccatacactcctgcgccagcgatggtgacacaaacccacatcgcggaggccaccggatgggtccccggcgataggaaaagatag

SEQ ID NO: 17775 - DNA, 1158 bp, Artificial Sequence
  Description of Artificial Sequence: Synthetic coding sequence
atgatcatcagtacaccccagcgcctgaccagctccggatctgtgctgataggatcaccctatactccagctcctgcaatggtaacccaaacacacattgctgaagcgaccgggtgggtaccaggcgatagaaagcgcgcccgcaaattcatagactctgacttttccgaatcaaagaggtccaagaaaggggataagaacggcaaaggacttcgacacttcagcatgaaggtgtgtgaaaaagtgcaaagaaagggtaccaccagttacaatgaagtagcagatgagctggtaagtgagtttactaatagcaacaaccacttggccgccgacagtgcctacgatcaaaaaaatatcaggcgacgggtatatgatgccctgaatgtcttgatggccatgaatatcatttcgaaagagaaaaaggagatcaagtggatcggcctgcccaccaatagcgctcaagagtgtcaaaacctcgaaatagaaaaacagcgtcggattgaacggattaaacagaagagggcccaacttcaagagctactacttcagcagattgcatttaagaacttagttcaaagaaacagacagaacgaacagcagaaccagggaccaccagccctcaattccacaatccaactcccttttataattatcaatacctccaggaagacagtgatcgactgttccatctcaagcgataaattcgagtacctcttcaacttcgacaatactttcgagatacatgatgatatagaagttctgaagcgaatgggcatgtccttcgggcttgagagcggtaagtgctcactggaagacttgaaacttgcaaaatcattagtgcctaaggctctcgaggggtatatcactgatatttctaccggcccgagctggctgaaccagggcctgttgcttaactccacacagagcgtatctaatctggatcttaccactggtgccaccttaccccagtcatctgttaaccaggggctgtgcctcgatgcagaagtggcactcgccacaggccaatttctcgctcctaactcccatcaaagctcatctgctgcatcacactgtagcgagtctcggggcgaaaccccatgctcttttaacgacgaggatgaggaagacgacgaggaagacagttcgtcccccgagtag

SEQ ID NO: 17776 - DNA, 270 bp, Artificial Sequence
  Description of Artificial Sequence: Synthetic coding sequence
atgattatttcaacccctcagcgactgacttctagcgggtcggttttaattgggtcaccatatactcctgcgcctgcaatggtgacacagactcacattgctgaggctaccggatgggtccccggcgaccggaaacgcgcccgcaagttcattgactcagatttttccgagagcaaacgatccaagaagggggacaagaacggcaaaggattgcgccatttcagcatgaaggtgtgcgaaaaagtgcagcggaagggcaccacctcatag

SEQ ID NO: 17777 - DNA, 1341 bp, Artificial Sequence
  Description of Artificial Sequence: Synthetic coding sequence
atgaccgccaagaatgtcggcctgacttctacaaatgcggaggtgagaggcttcattgatcaaaatctgagtccaaccaaaggtaatattagttttgtggcctttcctgtgtccaacacaaacagtcccactaaaatactcccaaaaaccctgggccccatcaacgtgaatgtgggaccccaaatgataatctccaccccacaacggttaactagctctgggtccgtcttgataggttccccctacaccccagcacccgcgatggttactcagacgcacattgctgaggcaactgggtgggtcccaggtgacaggaaaagggcccggaagttcattgattccgattttagtgaaagtaaaagaagcaagaaaggcgacaagaacggaaaagggttgcgacatttcagcatgaaggtttgtgaaaaggtacaacgtaaagggactacctcatataatgaggtggcagacgaactggtcagcgagttcaccaatagcaacaaccacctggctgctgactcggcctacgaccaaaagaatatcagacggagggtttacgacgccttgaacgtgctgatggctatgaatatcattagcaaggaaaaaaaggagatcaaatggatcggcttacccaccaatagtgcccaagagtgtcagaacctagaaatcgaaaaacagagaagaatagagcggatcaaacagaaacgggcgcagctgcaggagttgcttttacagcagatagccttcaagaacctcgtccagcgcaacaggcagaacgagcagcagaatcaggggccccccgcactcaactccaccatacagctgccgttcataatcatcaatactagccgcaaaaccgtgatcgactgctctatttcgagcgataagttcgagtatctctttaatttcgataacaccttcgagatccatgatgatattgaagtgcttaaaaggatggggatgtccttcggactggagagcgggaaatgctccctcgaggatttgaaactggccaagagtctagtccccaaagctttagaagggtatataacggacatcagcacagggccctcctggctaaaccagggacttctactgaactctactcagtctgtatccaatttggatctcaccaccggggccaccctgccccagagcagtgtcaaccaggggctctgcctggatgccgaagtagcgctggccactgggcagtttctcgctcctaattcgcaccagagctcaagtgccgcaagccattgtagtgaaagccggggagagactccctgttctttcaatgatgaggacgaagaagacgacgaagaagatagcagtagccctgaatag

SEQ ID NO: 17778 - DNA, 84 bp, Artificial Sequence
  Description of Artificial Sequence: Synthetic coding sequence
atgatcatcagcacaccccagcgccttacaagttccggctccgtgctgattggcagcccttacacccccgcccccgcaatgtag

SEQ ID NO: 17779 - DNA, 1050 bp, Artificial Sequence
  Description of Artificial Sequence: Synthetic coding sequence
atgctcgatcccaagtgcgatcgcaagcgcgcacggaagtttattgattccgatttctcagagtcaaagcgcagtaagaagggtgataagaatggcaaggggctaagacacttctccatgaaggtgtgcgagaaagtccaacggaaaggcacaacgtcatacaacgaggtggcggatgagctggtgtccgagttcacgaactctaacaatcatcttgctgcagactctgcctacgaccaaaagaacattagacgcagagtgtacgatgctctgaatgtgctcatggccatgaatatcatcagtaaggaaaagaaagaaatcaagtggatcggattacccacgaacagcgctcaagaatgccagaacctggagattgagaaacagcggagaatcgaacgtattaagcagaagagggcccagctccaggagctgttgttgcagcagatagctttcaagaacctggttcagcggaacagacagaatgaacagcaaaatcaagggcctcctgcactgaattccaccattcagttgccattcatcatcatcaacacaagccgcaagaccgtaattgactgctcaatctcctctgataagtttgagtacctgttcaatttcgataatacgttcgagattcacgacgatattgaagtcttgaagaggatgggtatgagctttggactggaaagcgggaagtgcagtctcgaggatctgaaactggctaagagcctcgtcccgaaagccctcgagggctacataaccgacatttccaccggcccctcatggctcaatcagggcctgttgttaaactcgacacaatcagtgtcaaatctggacttgacaaccggtgccacgctgccccagagctccgtgaatcaaggactgtgtctggatgcagaggtcgcactggcaaccggacagttcctcgctccaaattctcaccagagcagttctgcggccagccattgctcggaatccaggggcgagacgccttgttctttcaacgacgaggatgaagaagatgacgaagaagactcctcttctcctgagtag

SEQ ID NO: 17780 - DNA, 663 bp, Artificial Sequence
  Description of Artificial Sequence: Synthetic coding sequence
atgatcatttctacaccccagcggctgacttcatcagggtcagtgctaatcggatctccgtacactcctgctccagccatggtaactcagactcatattgcagaggccaccggatgggtgccaggagataggaaacgggctcggaagttcatcgactccgacttctcagaaagtaagcgctctaaaaagggggacaagaacggtaaaggcctgaggcacttttccatgaaggtatgtgaaaaggtgcagcgtaagggaacgacttcttataacgaggtggccgacgagttggtttcagagttcaccaattctaataatcacctggcagcagactcagcctacgaccagaagaatattcggaggagagtgtacgacgccttgaacgtcctgatggctatgaacatcattagcaaggaaaagaaagagatcaagtggatcggtttacccaccaattccgctcaggaatgccagaatctcgagatcgaaaaacaacgccggattgagagaataaagcaaaagcgagcgcagctgcaggaactgctgctgcagcagattgcattcaaaaacttggtgcagagaaacaggcagaacgagcagcagaatcagggccctcctgcactcaatagcacaattcagctgccgtttataatcatcaatacctag

SEQ ID NO: 17781 - DNA, 1161 bp, Artificial Sequence
  Description of Artificial Sequence: Synthetic coding sequence
atgataatatcaacgccacagcggctgaccagttctgggagtgtgctcattggcagcccctacacccccgccccagcgatggtgactcagacccatatcgctgaggccaccggctgggtgcccggagatagaaagcgagcccgcaaatttatagatagcgacttttctgaaagcaaacgtagtaagaaaggagataagaacgggaagggccttcgacatttctccatgaaggtgtgtgaaaaagtacagcgcaagggcactacatcctacaacgaggttgctgacgagctggtaagcgaatttaccaattccaacaaccacctcgccgctgattcacaggcctacgatcaaaagaacattcgccggcgggtctacgatgccttgaatgtgcttatggccatgaatatcattagtaaagagaagaaggagatcaagtggatcgggcttcccactaattccgctcaggagtgtcagaatcttgaaatcgaaaagcagcgccggatcgaacgcatcaagcaaaagagagcccagctgcaagaattgttactccagcagatagcttttaaaaatctcgtgcagcgtaataggcagaatgagcagcagaaccaaggccctcctgcgcttaacagtacaattcagctgccttttattatcataaacacgtccaggaaaacagtgatcgactgctcaatcagcagtgataaatttgagtaccttttcaatttcgataatactttcgaaatacacgatgatattgaggttctcaagcggatgggtatgtccttcggtttggaatctggtaaatgttctctggaggacttgaagctggcaaagagtctcgttcccaaggcacttgagggctacatcacggacatctccaccggtccttcctggctgaatcaaggccttctattgaactccacccagagcgtttccaatcttgatttgacaaccggagctacactgccacaatcatcggtgaaccagggcctctgcctggacgccgaggtggcccttgctactgggcagtttctagctcccaactcacaccagtcgtcgtccgctgcttctcactgctctgagagccggggagagacgccttgcagttttaacgatgaagatgaagaagacgatgaggaagatagttcatcccctgagtag

SEQ ID NO: 17782 - DNA, 933 bp, Artificial Sequence
  Description of Artificial Sequence: Synthetic coding sequence
atgaaagtatgtgaaaaagttcaacgcaagggcacaacaagctacaacgaggtggcagacgaactggtaagtgaattcactaactccaacaatcatttagcggctgactctgcatatgatcaaaagaatattaggcggcgcgtgtatgacgcgctcaacgtcctaatggcaatgaatattatcagtaaagagaagaaagagattaaatggatcggtctgcccaccaattccgctcaggaatgtcagaacctggagatcgagaagcagcgtagaatcgaaagaataaaacagaagcgcgcacaactgcaagagcttctattacagcagatcgcctttaaaaatttggtgcagagaaatagacaaaacgaacagcaaaatcaagggccacccgctcttaacagcacaatccagcttccattcataatcatcaacacgtcccgaaagaccgtcatcgactgctccatttccagtgacaaatttgaatatctctttaacttcgacaacacttttgagatccacgatgacatcgaggtgttaaaacggatggggatgagcttcggcctggagagcggaaaatgcagtctagaagacctcaagttggccaaaagcctggttcctaaggccttagagggctacatcaccgatatttcaacaggccccagctggctgaatcaaggcctgcttctgaactcaacacaaagtgtttctaatcttgatctcactacaggtgcaacattaccccagagttctgttaaccagggcctctgcctggacgctgaggtggctctggccaccggtcagttcctggctccaaacagccaccaatctagcagtgctgctagccactgcagcgaaagcaggggcgaaactccttgcagctttaacgatgaagacgaggaagacgatgaggaagatagcagtagcccggagtag

SEQ ID NO: 17783 - DNA, 1335 bp, Artificial Sequence
  Description of Artificial Sequence: Synthetic coding sequence
atgcccagaagcggagcccccaaggagcgtccagccgagcccctcaccccacccccttcgtacgggcaccagccacagacaggaagtggagaaagttctggtgcatccggcgataaagaccacctctacagcaccgtgtgcaagccgagaagtccaaaacctgccgctccagcagcccctcccttctcaagctctagtggcgtcctgggtacgggattatgtgagcttgatcgccttttacaggaattaaatgccactcaattcaacattaccgatgagattatgtctcagttcccaagttccaaggtagccagtggggaacagaaagaggatcagtccgaggataaaaagcggccctccctgccatcttccccttctcctggactccccaaggccagcgccacatccgctactttggaactggatcggcttatggctagcctatctgactttcgggtccagaaccacctcccggcctccggtccaacccaaccacccgtggtgtcctcaacgaacgaaggctctccgagtccccctgagcctactggtaagggtagcctggacacaatgttaggactcctgcagagcgatctgagcaggcgtggggtcccgacacaggcaaaaggtctgtgcggctcctgtaacaagcctatagccggacaggttgtaacagcactgggtcgggcttggcaccctgagcactttgtatgtggaggatgttctactgcgctgggggggtcttccttttttgaaaaagatggtgctccattctgcccggagtgttatttcgagcgattctccccccgctgtgggttttgtaaccaacccatcagacataagatggtcaccgcacttggcacccattggcacccagagcacttttgttgtgtctcctgcggcgagccctttggtgacgaagggttccatgagcgcgaagggagaccctactgtcgaagagatttcttacagctcttcgcaccccgctgccagggctgccaggggcccatcctggataattacattagcgccttatccgccctctggcatcccgattgtttcgtgtgcagagagtgttttgctcccttcagcggcgggtccttctttgagcatgagggccgcccgctttgcgagaaccattttcatgcacgacgcggctcattgtgcgcgacctgcggtttacccgtcaccggacgctgcgtctccgctctggggcgtcgcttccaccccgaccactttacttgcaccttctgtctacggcctctaaccaagggctcctttcaagagcgagcaggcaagccctattgtcagccatgtttcctcaaactttttggctag

SEQ ID NO: 17784 - DNA, 1335 bp, Artificial Sequence
  Description of Artificial Sequence: Synthetic coding sequence
atgcccagatcgggcgctccaaaggaacggcccgctgaaccacttactcctcccccctcttatggccaccagcctcagaccggaagtggggagtcaagtggggcctcgggtgataaggatcacctctactctacagtgtgcaagccccggtcgcccaaacccgcagcaccagcagcgccaccctttagttccagtagcggcgtgctgggcactggcctctgcgagctagaccgcctgttacaggagttaaacgcgacacaattcaacatcacagatgagatcatgagtcagttcccatcttctaaagtcgcctccggagagcagaaagaggaccagagtgaggacaagaagcggccttctctgccctcatccccttctcccggcctcccaaaggcctctgcaacctctgccacccttgaactggaccgactgatggccagtctgagtgattttagagtgcaaaaccatctgcccgcctcaggcccaacccagccccccgtggtgtcaagcaccaatgaaggatctccatctcccccagagcccaccggaaaaggatctctggatacaatgctgggtctgctgcagtctgatctcagtagaagaggggtgcctactcaggctaagggtctctgcggaagctgtaacaagccaatcgcaggtcaggtggtgacggcccttggcagggcctggcatcccgagcattttgtctgcggaggatgttccaccgcactgggcgggagctctttcttcgaaaaggatggagccccattttgccccgagtgctactttgaaagattttcccctagatgcgggttttgtaaccagccaatccgacacaaaatggtcactgcattaggcacccattggcatcctgaacacttctgctgcgtgtcatgtggggagccttttggggacgaaggcttccacgagcgggaaggacgaccgtactgcagacgtgattttttgcaattgtttgcaccgagatgccagggctgccaaggtcccatccttgacaactacatcagtgcactttcagctttatggcacccagattgctttgtgtgtcgcgagtgctttgcaccattttccggtggttctttcttcgaacatgagggccggcccctctgtgaaaaccactttcacgcgagacggggctctctgtgcgccacatgtggcctgccagtaaccgggcggtgtgtgtcagccctgggtcggcgatttcaccccgaccacttcacttgcaccttctgcttgcgacccttgaccaaagggtccttccaggagagagcaggcaagccatactgtcagccctgttttctgaaactctttggatag

SEQ ID NO: 17785 - DNA, 1386 bp, Artificial Sequence
  Description of Artificial Sequence: Synthetic coding sequence
atggaagacctggacgcattactgagcgacctggaaactacaaccagccatatgccccggtctggggcccccaaggagcgaccagccgagccattaacacccccaccctcatacgggcatcagccccaaactggctccggcgagagctcaggagcttccggggacaaggatcacctgtattctactgtctgtaaacctagatcccccaaaccagcagcccccgccgccccccctttttcgtctagctcaggggtgctgggcacggggctgtgtgaactcgacaggctgctccaggaactcaacgctactcagtttaacatcacagacgagataatgtcacagttcccttccagcaaagtggcgagtggtgaacagaaagaagaccagtctgaggacaagaagagaccctccctcccatcttccccatctcctgggttgccaaaggccagcgccacctctgcgactcttgagctggaccggttgatggcaagcctcagcgacttccgcgttcagaatcatctgccagcttccggtccgacccagcctcctgttgtttcatccacgaacgagggctctccctccccccccgaacccacaggtaagggaagcttagacaccatgctcgggttactccagagcgatctgtctagacgaggcgtgccgacccaggccaaggggctttgcggctcgtgcaacaaacctatcgctggccaggtagtcacagccctgggacgggcgtggcaccctgagcacttcgtgtgcggagggtgctcaactgctcttggaggctccagcttctttgagaaggacggtgctcctttttgcccagaatgttatttcgaacgatttagcccaaggtgtgggttttgtaatcagcccattaggcacaagatggtcaccgcgctgggcacccactggcaccccgagcatttttgctgcgtgtcatgcggggaacctttcggggacgaggggttccacgagcgtgagggaaggccttattgcaggagagacttcctgcagcttttcgcccctagatgccaggggtgccaagggcccatactcgataattatatttctgcgctgagcgctctctggcatcctgactgctttgtgtgccgggagtgtttcgcccctttttccggcggctcttttttcgaacatgagggtcgtcccctttgtgagaaccatttccacgcgcgacgcgggtcactgtgtgccacctgtgggcttcccgtgactggccgttgtgtctcagcactgggcaggagatttcaccctgaccatttcacgtgcaccttctgtctgcgtcccctgaccaagggaagttttcaagaaagagccggtaagccctattgccagccctgctttcttaaactttttgggtag

SEQ ID NO: 17786 - DNA, 783 bp, Artificial Sequence
  Description of Artificial Sequence: Synthetic coding sequence
atggtgtggcctgccttatgggaactgtaccgcgagctgggactctttcagggacccgcactgggcctaagaaatcacctgggaagaaagctgagacgaagaaaaaagaagaaagcaaaaagaacgaccaactggaaaatcattacagaccgcccagggttccacgacgagagtgccatctatcctgtgggatattgcagcacacgcatctacgcctcgatgaaatgccccgaccagaagtgtctgtatacatgccagataaaagacgggggcgtacaaccacagtttgaaatcgtccccgaggacgatccgcaaaacgcaattgtctccagctccgcagacgcgtgccatgccgagctcttgcgaaccataagcactacaatggggaaactcatgccgaatctgttgcctgcgggagcggacttttttggcttctcacaccctgcaatccacaacctcattcagtcatgccctggcgcacgaaagtgcatcaattatcaatgggtgaaattcgacgtatgcaagcctggagacgggcaattgcctgagggactccccgagaatgatgccgctatgagcttcgaagcctttcagcggcaaatctttgatgaagaccagaatgaccctctcctaccaggcagtctggacttgcccgagctccagccagccgccttcgtttccagctatcaaccaatgtacctcactcacgagcctctcgttgatacccatttgcaacacctcaagagcccctcccagggctctcctattcaatcaagcgactag

SEQ ID NO: 17787 - DNA, 1236 bp, Artificial Sequence
  Description of Artificial Sequence: Synthetic coding sequence
atgtccctcctcgacgggcttgcaagttctcctagagctcccctgcagtcctccaaagcacggatgaagaagctccctaaaaagagtcagaacgagaagtacagattaaagtatctccgactgcggaaagcagccaaggccactgtttttgaaaacgcggccatctgtgacgaaattgcacgccttgaggaaaaattcctgaaagctaaggaggagcgtaggtacctgctaaagaagctgctgcagctacaggcactaactgaaggggaagtgcaggccgctgctccctcccatagctcaagtctgcctctaacgtacggggtcgcttcttcagtcggcactatccagggggcgggacctatcagcggacccagtacgggggcggaggagcctttcggtaaaaagacaaagaaggaaaaaaaggaaaaagggaaggaaaataataaattagaggtgctcaagaagacgtgcaagaaaaagaaaatggcggggggggctcggaagctggtgcaacctatagccttagatccaagtggccgacccgtgttccctatcgggctgggaggattgactgtgtacagcctcggagagatcatcaccgatcgacccggcttccatgacgaaagcgctatctacccggtaggatattgctccacgcgcatctatgcttctatgaagtgccccgatcagaagtgcctctatacatgccagatcaaggatggaggtgttcaaccccagttcgaaatcgtccctgaagacgatccccagaacgccatcgtgtcttctagcgctgacgcttgtcacgctgaattgctccggacaatcagtaccactatgggaaaactcatgccgaacctccttcctgctggggccgactttttcgggttttcccaccctgccatccacaacctgatccaatcctgtcccggcgcacgtaagtgtattaattaccagtgggtaaaatttgacgtttgtaaaccaggagacgggcagcttcccgagggactcccagagaatgatgccgcaatgagcttcgaggctttccagaggcagatctttgacgaggatcaaaacgaccccctcttgcctgggtccctggacctgcccgaactgcagccggccgcctttgtgagctcttaccaacctatgtatctaacgcatgaaccactggttgacacccacctccaacatctgaagtccccatcgcagggatctcccatccagtcttcagattag

SEQ ID NO: 17788 - DNA, 1281 bp, Artificial Sequence
  Description of Artificial Sequence: Synthetic coding sequence
atggaggccgctgttgccgcaccacggcctcggctgttactgctcgttctcgcggctgccgccgccgcggccgcagcccttctccctggcgcaactgccctgcaatgtttttgtcatctatgtacaaaggacaattttacgtgcgtgaccgatgggctgtgtttcgtatctgtgactgagactaccgataaagttatccataatagtatgtgcatcgccgaaattgacctgattcctagggacagaccattcgtctgcgcaccatcgtccaagactggaagtgttaccaccacgtactgctgcaaccaggatcactgcaataaaatcgagttacctactactggcctgccactactggttcagcgaacaatcgcccgcaccatcgttcttcaagagagcattgggaaggggcggtttggggaagtgtggaggggtaaatggaggggcgaagaggtagctgttaaaatcttctcatctcgagaggagagaagttggtttcgggaagccgaaatttaccaaaccgtgatgttgagacatgaaaacatcctgggatttattgcagcagacaacaaagataacggaacatggacacagctgtggttggtttccgattatcatgagcacggttccctcttcgactacttgaataggtatacagtaaccgttgaaggcatgattaaattggctctttctactgccagcgggcttgcccacctacacatggagatcgtgggcacccagggcaagccagccatagcacatagggacttgaaatcaaagaatattctggtcaagaagaatggaacctgttgtattgctgatcttgggctggctgtcaggcatgattcagccaccgatacaatagatattgcgcccaatcaccgggtgggaaccaaaagatatatggcccctgaggttctagatgattcgatcaatatgaaacactttgagtcattcaagcgtgccgacatttacgcgatgggtctagtcttctgggaaattgctcggcggtgttcgatcggcgggattcacgaggactaccagctcccttattatgacctcgtaccatctgatccaagcgtggaggaaatgcgcaaggtcgtctgcgaacaaaaattgcgcccaaatatccccaaccggtggcagagttgcgaggccctgcgggtgatggccaagatcatgagagaatgctggtacgctaatggcgctgctcgtttgaccgccctgcggatcaaaaagaccttgtcacaattatcgcagcaggaggggattaaaatgtag

SEQ ID NO: 17789 - DNA, 1512 bp, Artificial Sequence
  Description of Artificial Sequence: Synthetic coding sequence
atggaggccgcagtcgccgcgccaaggcctaggttgctcctgctcgtgctggccgcggctgcagccgccgctgctgctttgcttcccggtgccaccgcactgcagtgtttctgccacctgtgcacaaaggacaattttacctgcgtgactgacggcctttgctttgtgagcgtgacagaaactacagataaagtgatccataacagcatgtgcatagccgagatcgacctgatcccgcgcgatcgcccattcgtctgtgccccgtcctcaaaaaccggatcggtgaccaccacatattgctgcaaccaagaccattgtaataagattgagttaccaactaccgtcaagtcttctcccggcctcggcccagtcgagcttgctgccgttatcgcggggcccgtgtgctttgtgtgtatcagccttatgctgatggtctacatttgtcacaatcgtactgtgatccaccacagggtgcccaatgaggaagaccccagcctggacagaccattcatctccgagggcaccacccttaaggacctcatatacgacatgaccacttccggttccggatccgggctgcccttgctggtccagagaactatagcccgaacgatcgtcctgcaggagtccataggaaagggacgctttggtgaggtgtggcgtggaaaatggcgaggcgaagaggtggccgtcaagattttctcttcccgcgaggagcgcagttggttcagagaggcagagatttatcagacagtgatgcttaggcacgagaacatcttgggcttcatagctgcagacaacaaagataatgggacctggactcagctgtggctcgtgagcgattatcacgaacacggaagtctctttgactatttaaataggtacactgtgactgtagagggaatgattaagcttgcactctccactgccagcggcctcgcgcacctacacatggagatagtgggcacgcaaggaaaacccgcaatagctcacagagatctgaaatcaaaaaacattctcgtcaaaaagaacgggacatgctgcatcgcagatctgggcttggcagtgcgtcacgactctgctacagataccatcgacatcgcccccaatcacagggtgggcacaaagcgctacatggcaccagaggtgcttgatgacagtattaacatgaaacacttcgagtcattcaaacgcgcagatatctatgccatgggcttggtgttttgggagatcgccagaaggtgctcaattggaggcattcatgaggactaccagctgccatattacgatcttgtgccctccgatcccagcgttgaggaaatgcggaaagttgtgtgtgaacaaaagctccggcctaatataccaaacagatggcagtcatgtgaagccctccgagtgatggccaaaatcatgcgcgaatgttggtatgccaatggtgcggcacggttgacagccttgaggatcaaaaagacattgtctcagctcagccaacaggaggggatcaagatgtag

SEQ ID NO: 17790 - DNA, 1398 bp, Artificial Sequence
  Description of Artificial Sequence: Synthetic coding sequence
atggaggccgccgtcgcagcccccaggccacgtctgctgctcctggtgctggccgcagctgccgccgcagctgcagcgctgctaccaggggcaaccgctctgcagtgcttttgccatctctgcacaaaggacaacttcacctgcgtaactgacggtttgtgttttgtatctgtgaccgaaactacggacaaggtgattcataactcaatgtgcatcgctgagatcgacctcatccccagggataggcccttcgtctgcgccccctctagcaagactggatctgtgactaccacgtactgctgtaatcaggatcattgtaataagatagaactcccgactacggtgaaaagctccccgggtctgggcccagtggagttagccgccgtcattgcaggccccgtgtgttttgtgtgcatatctctgatgctgatggtttacatctgtcataaccggacggtcattcaccacagagtacctaacgaagaggacccttctcttgatcgaccctttatatcagagggcacaaccctgaaagacctgatttatgacatgactacaagcggatcaggctccggactgccattattggtccaaagaacgatcgccagaacaatcgtcctccaagagtccatcggaaagggaaggtttggagaagtgtggagaggcaaatggcgcggagaggaagtggccgtgaaaatattctcatctagggaggagcggagctggttcagggaggccgaaatttatcagaccgtcatgctgcgccatgagaacatcctagggttcatcgccgctgacaacaaggacaatgggacatggacccagctgtggttggtgagtgattatcatgagcacggaagcctattcgattatttaaatcggtatacagtcacggttgagggcatgattaagctagcactgtcaacagcctcggggctggcacacttacatatggaaatcgttggcactcagggcaagcctgctattgcaccaaaccaccgagtgggaaccaagcggtatatggcgcccgaggtcttggacgatagcattaatatgaagcacttcgaatcctttaaacgtgccgatatctatgcaatggggctggtgttttgggagatcgcaaggaggtgcagtatcgggggtatccatgaggactaccagcttccttattacgacttggtcccttctgatccaagtgtagaggagatgaggaaggtggtgtgcgagcagaagctgcgtcctaacatccctaatagatggcaaagctgcgaagcactgagagtcatggcaaagattatgcgcgaatgctggtacgccaatggtgccgcgcggctgacggcgctgaggatcaagaagacgctgagccaactgtcacagcaagagggtatcaaaatgtag

SEQ ID NO: 17791 - DNA, 216 bp, Artificial Sequence
  Description of Artificial Sequence: Synthetic coding sequence
atggaagccgctgtggctgcgcctcggccacgcctactgctcgcaagtacttcattgcaatgcttttgccacttatgcactaaggataactttacatgtgtgacggacggactttgtttcgtttcagtgacagagacgacagacaaggtcatacacaattctatgtgtatcgctgaaatagacttaatcccgcgggatagaccatttgtctgctag

SEQ ID NO: 17792 - DNA, 1305 bp, Artificial Sequence
  Description of Artificial Sequence: Synthetic coding sequence
atgtgcatagctgagatcgatcttataccaagagatagacccttcgtctgcgctccaagttcaaaaaccggttctgtaacaacgacttattgttgtaatcaggaccattgcaataaaatcgagctgccgacaactgttaagagtagtcctgggttaggtcctgttgagcttgccgccgtcattgccggcccagtgtgcttcgtttgcatttccctgatgctcatggtatatatatgccacaacagaactgtgatccaccaccgtgtgccgaacgaggaggatcccagtcttgatagaccttttattagcgaaggcacgacactaaaggatctgatctacgatatgacaacctcgggctcaggtagtgggctcccattgcttgttcagcggaccatcgcaagaactatcgtcctccaggaaagcatcggtaaaggccgcttcggcgaagtttggagggggaaatggagaggcgaggaggttgctgtgaaaatcttttcctcaagggaagagcgcagttggtttagggaagcagagatttaccagactgtcatgttgaggcacgaaaatatcctggggtttattgccgccgataacaaagataatggcacatggacacaactctggttagtgtccgactaccacgagcacggcagcttgttcgattatctcaaccgctacactgttacagtcgaaggaatgataaagctcgccttatctaccgcgtcagggttagcccatctccatatggagatcgtcgggacacagggaaagccagctattgctcacagagacttgaagagtaagaatattttggtgaagaaaaatggtacttgttgtatcgctgacttgggtctggctgttcggcatgattccgcaaccgacactatagacatagctccgaaccaccgagtgggcaccaaaaggtatatggcccctgaggtgttggatgactctattaacatgaagcactttgagtcattcaaaagagccgacatctatgcgatgggccttgtgttctgggaaattgcgcgaaggtgctcaatcgggggcatccacgaggattatcagctgccctattacgacctggtcccaagcgacccctctgtggaagagatgcgcaaggtagtgtgtgagcagaaactgcgcccaaatatacccaaccgctggcagagctgtgaagcactgcgcgttatggctaaaattatgcgggaatgctggtacgcgaatggagccgcacggctaacggccctgcgaatcaaaaagacattgtcacagttatcccagcaggaaggtatcaagatgtag

SEQ ID NO: 17793 - DNA, 411 bp, Artificial Sequence
  Description of Artificial Sequence: Synthetic coding sequence
atgaaagatagtaaccggtgctgctgcggccaattcacaaatcagcacataccccccctgcccagtgctacaccgtcgaagaacgaggaggagagtaaacaagttgaaacacaaccagagaaatggagtgttgcaaagcacactcagtcttatcccactgacagctatggtgtcttggaattccagggaggaggatactctaacaaggccatggtgaggaaggcgttccgccacggagcaactcgtataactgccttcatcgggggccagtctccttctcccaaactgcagatacctggcctgctccatggatgtgggtcaatttttcttgacatatcactgaaaaatcaggagatctacctgtgcacttggctcctggccatgcggctggggaactggacaccactttag

SEQ ID NO: 17794 - DNA, 4878 bp, Artificial Sequence
  Description of Artificial Sequence: Synthetic coding sequence
atgggacagaagtcatggattgaaaaaaccttctgcaagagggaatgcatattcgtgataccaagcatgaaagacagcaacaggtgctgctgtggccaattcaccaaccagcatatcccgccactgccttcagcgaccccatccaagaatgaggaagagtctaaacaggtggaaacacagcccgagaaatggtctgtcgccaaacatactcagagttaccctaccgattcgtatggagtcctggaatttcagggtgggggttactccaataaagccatgtatattcgcgtgtcatatgacactaagcctgattcacttctccaccttatggtgaaagattggcaactcgaattgccgaaactcctcatctccgtgcacggcggactgcagaatttcgaaatgcagcccaaattgaaacaggtattcggcaaggggctaattaaggctgcaatgacgacaggcgcctggatcttcacagggggggttagtaccggcgtaatctcacacgtcggggacgcccttaaggaccatagcagcaaatctagggggagggtctgcgcaatcggaattgcaccctggggcattgttgaaaacaaagaagatttagtgggcaaggatgtcaccagggtgtaccagactatgtcaaatccgctgtctaaactttcggtgcttaacaattcccacacacacttcatactggccgataacggcactctcggtaagtatggcgccgaggtaaaactgagaaggcttctcgaaaagcacataagcctccagaagatcaatacacgcctggggcagggagtgcccctggtcgggctggtcgtggaaggcggcccaaacgtggtgagcatcgttctggaatacctgcaggaagaaccccctatccccgtcgtaatatgcgacggctcagggcgtgcatctgatatcctttcttttgcacataagtactgcgaggagggtgggatcattaatgaaagcctgcgcgagcaacttcttgtaactattcagaaaacatttaattataataaggcccagtcccaccaattattcgctataatcatggagtgcatgaaaaagaaggagctggtcactgtcttccggatgggcagtgaggggcaacaggatattgaaatggcaattttgacggcgctgctgaagggcacaaatgtctccgcccctgaccagctcagtcttgccttagcctggaacagagtggacattgcccggtcacagatcttcgtcttcggaccccattggcctcctcttggatcactggcacctcccaccgatagtaaggccacggagaaggagaaaaagccgccaatggccacgacgaagggtggacgcgggaagggcaaaggcaagaaaaagggcaaagttaaggaagaggtcgaagaggaaactgacccccgtaaaatcgaactgctcaactgggtcaatgcccttgagcaggcaatgctcgacgccctggttctcgaccgtgtcgatttcgtcaagctactgatagaaaacggcgtgaatatgcagcactttctgacaattcctagactcgaggaactgtataatacaaggctgggcccacccaacacactgcacttgcttgtacgagatgtcaaaaaaagcaacctgcctcccgattaccacatttctttgatcgatatcgggctcgtgctggagtacctaatgggcggagcctaccggtgtaactacacaaggaaaaattttcggaccctgtataacaatctatttggacctaaaaggccaaaggccctgaagctgctggggatggaagacgacgagccaccagcgaagggcaaaaaaaaaaaaaaaaaaaagaaggaagaggagattgatatcgatgttgatgatccggctgtaagccggtttcaatacccttttcacgagctgatggtgtgggcagtgttgatgaagagacagaaaatggctgtgttcctgtggcagcggggcgaagaatctatggcgaaggccctggtggcctgcaaactgtataaagcaatggcacatgagagttcagagtcggacctggtggacgacatctctcaagacctcgataacaatagcaaagacttcggtcaactggcattagagctgttggatcagagctacaaacacgatgagcagatagccatgaagctcctgacgtacgagctgaaaaactggtctaacagtacgtgcctaaagcttgcggtggcagccaagcatagggacttcattgctcacacctgttctcagatgctcttaacagacatgtggatgggccgtttacgaatgcgtaagaaccccggactcaaagttatcatgggtattttgctccctcctactatcctcttcctagaattcagaacatacgacgacttctcctaccaaacgtcaaaggaaaacgaagatggaaaagaaaaggaggaggaaaataccgacgcaaacgctgacgcaggatcgcgcaaaggagacgaggagaacgagcacaaaaagcagaggtccattccaatcggcactaagatttgtgaattctataacgcccccatcgtgaagttctggttttatacaatcagttacctgggatatttactgcttttcaactatgtcatcctggtgaggatggatggctggccatcactccaggaatggatcgtgatcagttacatagtgtctttggcgctcgaaaaaatccgggaaatactcatgtccgaacctggaaagctgtcccaaaaaattaaagtttggctccaggaatattggaatatcacagatcttgtggcaattagtactttcatgattggcgctatcctgcgtctgcagaatcagccgtacatgggatatggtagggtgatttactgcgtcgacattatattttggtacataagggttctggatatctttggagtgaataaatatctcggtccttatgtgatgatgattgggaaaatgatgatagatatgctctacttcgtggtcattatgctggtcgtcctgatgagctttggcgtggcccgacaagcgatcctgcatcctgaagaaaagccatcttggaaactcgcaagaaatatcttctacatgccctattggatgatctatggcgaggtgttcgcggaccagatcgacctctacgcaatggagatcaacccgccctgtggcgaaaacctctatgatgaggagggcaaacgcctgccgccctgcattcctggggcatggctaactcctgccctcatggcctgctaccttttggtggcgaatattctgctcgtaaacctactgattgccgttttcaataatacattcttcgaagtaaagtctattagcaatcaggtgtggaaatttcagaggtaccagcttataatgactttccatgatagaccggtgctcccgccgccaatgatcatcctgtcacacatttacataatcattatgaggctgtcaggcagatgcagaaaaaagagagaaggggatcaggaggagagagataggggactgaagctgtttctgagcgacgaggagcttaagcgcctccacgagtttgaagaacaatgcgtgcaagaacacttcagggagaaagaagatgaacagcagtcttctagcgatgaacgcatccgcgtcaccagtgaaagggttgagaatatgtcgatgcggttggaggagataaacgaaagggagacatttatgaaaacctcgcttcagactgtagacctgaggctggcacagctggaggagttgagcaatcgcatggtcaatgcgctggagaacctcgcaggaattgaccggagcgatttaatccaggctaggagcagagcctcttctgaatgcgaggctacgtatcttctgcggcagagcagcattaatagcgcagatgggtatagcctgtacaggtatcatttcaacggtgaagagctgctcttcgaggacacctctctctccacttcaccaggcacgggcgttaggaaaaaaacatgtagcttcaggatcaaggaagaaaaggacgtaaagacacacttggtgccggagtgccagaattctctgcacctgtccctcggtacatcaaccagcgcaactcctgatggttcacacctggcagtggatgacctgaaaaatgctgaggaatcgaagctcgggcccgacatcggaattagcaaagaagacgatgaaaggcagacagacagcaagaaggaagagaccatcagcccgagcttgaacaaaaccgatgtgattcacgggcaggacaaatcggacgttcaaaacacacaactgaccgtggagacgaccaacatcgaaggcacaatcagctatcctctagaggagacaaaaatcactaggtactttccggacgaaacaataaacgcctgcaagacgatgaaatccagatcttttgtctactcaagggggagaaagcttgtaggcggggtgaatcaggatgttgagtactccagtatcacagaccagcaactcacaacagagtggcagtgtcaggtgcagaagattactagatcccattcaaccgacatcccttacatcgtaagtgaagctgctgtccaggctgagcataaggagcaattcgctgatatgcaggacgagcaccacgtagcagaggctatccccagaattcctcgactttccttgaccatcactgaccgtaatggaatggagaacctcctgtccgtcaaaccagaccaaactcttgggttcccgtcactgcggtctaagagcctccatgggcaccccagaaacgtaaaatccatccaagggaagttggacagatctgggcatgcaagcagtgtgtccagcctggtgatcgtgagtggaatgaccgccgaggagaagaaagtcaagaaggagaaagcctccaccgaaaccgaatgttag

SEQ ID NO: 17795 - DNA, 4812 bp, Artificial Sequence
  Description of Artificial Sequence: Synthetic coding sequence
atcaagactagcaaacgctgctgctgcgggcaattcaccaatcagcatatcccgcctctcccctccgccactccatcaaagaacgaagaggaaagcaaacaggtcgagactcagccagagaagtggtccgtggctaagcatactcagtcttatccgacagatagctacggggtacttgagttccagggtggaggctactcaaataaagctatgtacattcgggtcagctacgataccaagccagactctctgttacatctgatggtaaaggactggcagctagaacttcccaagctcctcatctccgtgcacggaggcctccagaacttcgaaatgcagcccaagctcaagcaggtgttcggcaaaggactcattaaggccgctatgacaacaggggcatggatctttaccgggggtgtgtccacaggcgtgatctctcacgtgggcgatgctctgaaagatcattccagtaagagccgcggcagagtgtgcgctatcggtatcgcaccctggggcatcgtggagaataaagaagatcttgttggcaaggacgtgacccgggtgtaccagacaatgtctaatcccctcagcaagttgtccgtgctgaataattcccacacccatttcatcttggccgataacggcaccctgggtaagtacggagctgaggtgaaactgcggaggcttctggaaaaacatatttccctccaaaagattaatacgaggctgggtcagggagtgcccttggtaggactggtagttgagggcggcccgaacgtagtatcgatagtcctggagtatctccaggaagagcctccaattcccgtggttatatgtgatggatccggccgtgcttctgacatcctctctttcgcccataagtactgcgaggaagggggaattatcaacgagagcctgcgggaacagctgctcgtgactattcagaaaacattcaattataacaaagcccagagccaccagctattcgcgatcatcatggaatgcatgaagaaaaaagaactggtgacagtgtttcggatgggctccgaaggccagcaggatattgagatggctatattgactgctctactgaaagggacaaacgtctccgcccccgaccaactctctctggcactggcatggaaccgcgtcgacatcgccagaagccagatctttgtgttcggcccccactggcctccactcggatcacttgcccctcctacagatagcaaggcgaccgaaaaggaaaagaagccaccaatggcaactactaaagggggtcggggtaagggcaagggcaaaaaaaaaggcaaggtcaaagaggaggtggaggaggaaacagatcccaggaaaatagagctgctgaattgggtgaacgcgcttgaacaggccatgctagatgcattggtactggacagagtggacttcgtaaagctgctgatcgaaaacggggtgaatatgcaacattttttaaccatccccaggctggaggagctgtacaacacgcggttaggtccgccgaacacactccatctcttggttagagatgtgaagaagagtaatctgccccccgattaccacatatcgcttattgatattggccttgtgcttgagtacctaatgggcggcgcatatcgctgtaattacacgcgcaagaactttcgaacgctctacaacaacttgttcgggcccaaaagacccaaggctttgaagctgttaggcatggaggatgatgagcctcccgccaaaggcaagaaaaaaaaaaagaagaagaaagaagaagagattgatattgacgttgatgaccccgcggtttcccgtttccagtatccgttccatgaattaatggtttgggcggtcttaatgaaaaggcagaaaatggcggtttttctctggcagaggggcgaggaatctatggccaaagcactcgtggcctgtaagctctacaaggccatggctcatgaaagttccgaaagcgatctggtcgatgatatcagtcaggatttggacaacaattccaaagatttcggtcagttggcactcgaactcctggaccagagctacaagcacgatgagcagattgcaatgaaacttctgacctatgagttaaagaattggagcaactcaacatgtctgaagttagctgtagccgctaaacatagagatttcattgcccacacttgtagccaaatgctcctaaccgacatgtggatgggcagacttcggatgaggaaaaatcccgggctcaaagtgattatgggtattttgttaccacccaccatcctattcttggaattccgcacctacgacgacttcagctaccagacttccaaggagaacgaagacgggaaggagaaggaggaagagaatactgacgcgaacgcagacgcaggtagtcgcaaaggcgacgaggagaacgagcacaagaaacagagatccatacccataggaaccaagatctgtgaattctacaacgccccgatagttaaattctggttctacaccatctcatacctgggctatctgctcttgttcaactatgtgattctggtgaggatggacgggtggcctagcctgcaagagtggatcgtgatcagctacatcgtcagcttggccctggagaaaatccgcgagattctcatgtctgagccgggtaaattgagtcagaaaattaaagtctggctgcaggaatattggaacatcaccgacctcgtggcaatcagtacatttatgattggtgccatcctgcgactgcagaatcagccgtacatgggctacgggagggtaatctattgtgtcgacataattttctggtatataagagtgttggatattttcggcgtgaacaagtatctggggccttacgttatgatgattggcaagatgatgatcgatatgctttactttgtggtcatcatgcttgtggtgcttatgtccttcggggtggccagacaggcaatcctgcaccccgaagagaagcccagttggaagctggcccgcaatattttttacatgccctattggatgatctatggagaggtttttgccgaccaaatagacttatatgcaatggagatcaatcctccttgtggagaaaatctatatgatgaggagggcaaaaggctccccccttgtattcccggcgcttggctcacccctgccctcatggcctgctatctactggtggccaacattcttttagtgaacctcctcattgccgttttcaacaataccttcttcgaggttaaaagcatatccaatcaggtctggaaatttcaaagatatcagctaatcatgacgttccacgaccgcccagtcctgccgcctcctatgatcatcctgtcccacatctacattatcattatgcgtctctctggtcggtgccgcaagaagagagagggcgaccaagaggaacgcgaccggggacttaaattgttcctgagcgacgaggagttaaagagacttcatgagtttgaggagcaatgtgtccaggagcacttccgcgaaaaggaggatgaacaacagtcctcatcagatgagagaatcagagtcaccagtgaaagagtggagaacatgtctatgagattggaggaaatcaacgagcgggaaacatttatgaaaacctctttacagacagtggacctgagacttgctcagctggaagaactgagcaataggatggttaacgccctcgagaacctggccgggatcgatcgctctgacctcatccaggcgcgatctcgcgcctcaagcgagtgcgaggccacatatctccttcgccagagcagcataaattccgctgacgggtattccttgtaccggtatcacttcaacggggaagaacttctgtttgaagatacttccctttcgacatccccgggcacgggcgtaaggaagaaaacatgctcttttcgaattaaagaagagaaggacgtgaagacccatcttgtgccagaatgtcagaattcccttcatctttccctcggaacaagtacttccgcgactccagatgggtcacacctcgctgtggatgatctgaagaatgccgaagaatcaaaactgggtcctgacattgggatctccaaagaggacgatgaacgccagacagactctaagaaggaagagaccattagcccaagccttaacaagaccgacgtcatccacggacaggacaaaagcgatgtacaaaatacccagctcaccgtggaaaccacgaacatcgagggcacaattagctacccattggaggagactaaaatcacaagatacttcccggacgagaccatcaatgcgtgcaagacaatgaaatctcggagctttgtttactctagagggaggaagttagtaggcggcgtaaaccaggacgtcgaatacagttcaataacagaccagcagctgaccactgagtggcagtgtcaggtgcagaaaatcacccgatcccactctaccgacatcccctacattgtgtctgaagctgccgtgcaagcggaacataaggagcagtttgccgatatgcaggacgaacaccatgtagcggaagcaatacctcgcatcccccgtctctctctgaccattactgatagaaatggaatggagaaccttctgtctgttaagcccgaccagactttgggattcccatctctgcgatcgaagtcactgcacggacacccccgtaatgtgaaatccattcagggaaaacttgatcgctccggccatgcgtcctccgtgagctcacttgtcattgtgtcaggaatgaccgccgaggagaaaaaagttaaaaaagagaaagcctcgacggagacagaatgttag

SEQ ID NO: 17796 - DNA, 4812 bp, Artificial Sequence
  Description of Artificial Sequence: Synthetic coding sequence
atgaaggacagcaatagatgctgctgcggacagttcaccaatcagcacattcctcccctcccatctgctacacccagtaagaacgaggaggagagtaagcaagtggaaacccagccggagaagtggagcgttgccaaacacacacagagctaccccactgacagctacggagttctagagttccagggtggtgggtactcaaacaaggctatgtacattcgtgtgtcttatgacaccaagccagatagcctgctgcatctcatggtcaaagactggcagctagaattgccgaaactgctgatcagcgtgcacgggggtctacaaaactttgaaatgcaacctaagcttaaacaggtatttggcaagggactgatcaaggctgccatgacaacgggagcttggatcttcaccggtggtgtgtccacaggagtgatctcgcatgttggcgatgccttgaaagatcattcctcgaaaagccgcggaagagtgtgcgccattgggatcgccccatggggcattgtggagaataaagaggatctggtgggaaaggatgtgacaagagtatatcagacaatgagcaatcccctaagcaagctctccgttctgaataactcccatacacactttatcctggcagataatggaactcttgggaaatacggagcagaagtgaaactgagaagattgctcgagaagcacatcagtctgcaaaagattaataccagactcggtcagggagtcccactggtgggactggtggtggaaggagggcctaatgttgtctcaatcgtgcttgaatacctgcaggaagagccacccatccccgtcgttatttgtgacggcagcgggcgggctagtgacattcttagtttcgcacacaaatactgcgaggaaggggggatcatcaacgagtccctacgcgagcagctcctcgttaccattcaaaagacattcaattacaacaaggcccagtcccaccagctttttgcaatcattatggagtgcatgaagaaaaaggagcttgtgacggtcttcagaatgggctccgagggacagcaggacattgagatggctattcttacagcgcttctgaagggcactaatgtttctgcacctgaccagctttccctggctctcgcctggaatcgggtagacatagcgcgcagccaaatttttgtattcggaccacactggcccccattgggatctctggcaccaccgactgacagtaaggccacagagaaagaaaagaaaccacctatggcgacaacaaaaggcggcagaggaaaagggaaggggaagaagaaaggtaaagttaaggaagaagtggaagaagaaactgacccccgcaaaatcgagctgctgaactgggtgaatgctctggaacaggcaatgcttgatgcgcttgttttagatcgagtcgacttcgtgaagctgttgattgagaacggcgtgaacatgcagcactttttgacaatcccacgcctggaagaactatataacacccggctcggcccacccaacacattgcatctgctggtaagagacgtcaaaaaatcgaacttgcctccagattatcacatttctttgatcgatatcggcctagttttggagtacctgatgggcggcgcttaccggtgtaactacacccgcaagaacttccggacactgtacaataatctgttcggacccaaaaggccaaaggctctgaagctgctgggaatggaggatgatgaacctcctgccaaaggaaagaaaaagaagaagaagaaaaaagaagaggagattgatattgatgtcgacgacccagctgtatcgcgtttccaatatccattccacgaattgatggtctgggccgtgctcatgaaacgtcagaagatggccgtgtttctgtggcagaggggggaggagagtatggccaaagcacttgtggcttgcaaactttataaagctatggcacatgaatcatctgagagcgatcttgttgatgacattagtcaagacctcgacaataattcaaaggactttggtcagctagccctggaacttctggaccagtcttataaacacgatgaacagatcgctatgaaactcttgacctacgagctgaagaattggtccaacagtacctgtctcaagctggccgtcgccgcaaagcatcgggacttcattgcacatacgtgctcccagatgctgctgacagatatgtggatgggccgtctccggatgcgaaagaacccagggctgaaggtaattatggggatccttctgccccctactatcctcttcctcgagttcaggacatacgatgacttcagttatcagacttctaaggaaaacgaggacggcaaggaaaaggaggaagagaacacagatgcaaacgcagatgcaggttcccggaaaggagacgaagaaaatgagcacaaaaaacaacgtagtatccccatcggaacgaagatttgcgagttctataacgctccgatagtcaagttctggttttatactatcagttacctaggttatctgttactttttaactatgtcattctggtgaggatggatggctggccgtcactgcaagagtggatcgtgatctcatatatcgtctccttagctcttgagaagataagagagatactgatgtctgaaccagggaaactatcccagaaaatcaaggtgtggctccaggaatactggaacatcaccgatctcgtagccatctcaactttcatgattggtgcgattctgagactgcagaatcaaccctacatgggctatggcagggtgatctactgtgtggatatcatcttttggtacataagggtcctggatatcttcggagttaataagtatctgggaccatacgtgatgatgatagggaagatgatgatagatatgttatacttcgtggtgattatgctggtagtgcttatgtctttcggggtggcccgccaggccatccttcatccggaggagaaaccaagctggaaactcgctaggaacattttttacatgccctactggatgatctatggcgaagtattcgctgatcagattgacttatatgcaatggagattaacccaccctgcggagaaaacctgtacgatgaagaagggaagcggctgcctccttgcattcccggagcctggctcacgcccgcgctcatggcctgctaccttttggtggcaaacatccttctcgtgaatctcttaattgccgtgtttaataatacgttttttgaagtgaaatccatttccaatcaggtttggaagttccagcgctaccaactgattatgactttccacgatcgtcccgttttgccccctccaatgattatcttatcccacatctacataattatcatgagactttcagggcgctgcagaaagaagagagagggagatcaggaggagcgcgaccggggactgaagttattcttgtccgatgaagaactcaaacggctgcatgagtttgaagagcaatgcgttcaagagcatttccgggagaaagaggacgagcagcagagtagcagcgacgaaaggattcgtgtaacgagcgagagagttgaaaacatgtcaatgcgcctggaagaaattaatgagcgggaaacgttcatgaagactagtctccagactgtcgacctgcgccttgcgcagctggaggagctgagcaatagaatggtgaatgctttggagaatctcgctggcattgatcgctctgatctgatccaggcccgctcccgtgcttccagtgaatgtgaggctacctacttgttaagacagtcttccattaattctgcagacggatattccttgtacaggtaccatttcaatggagaagagctgctgttcgaggacacctctctgagcactagccccgggactggggtacggaagaagacatgcagttttaggataaaagaggaaaaggacgtcaagacccatcttgtccctgagtgccagaacagccttcatctctctcttggtacaagcactagcgccaccccggacggcagccacctcgccgttgatgatctaaagaacgctgaggaatctaaattagggccagacattggcatctctaaagaggacgatgagcgccagacagactctaagaaggaggaaactatatcaccaagtctcaacaaaacagacgtgattcatggtcaggataagtccgacgtgcagaacacacagctgacggtggaaactacgaatattgagggaacaatttcttatcctctggaggagaccaaaatcacccggtactttccagacgaaaccatcaacgcctgtaaaaccatgaaaagcaggtcttttgtgtactccagaggcagaaagctggtcggaggggtgaatcaggacgtcgagtattcttctattacagaccaacagcttaccacagagtggcagtgtcaggtgcagaagattacccggtcccacagtaccgacattccttacattgtgagtgaggccgctgtccaggctgaacacaaggagcagtttgcagacatgcaagatgagcatcacgtcgccgaagccatcccaaggattccccgcttgagccttacaatcactgaccgcaacggaatggagaacttgcttagcgtaaagcctgatcagaccctcggttttcctagcttgaggtcaaagtcactgcatggacatccaaggaacgtgaaaagcatccagggaaagctggaccggtcagggcacgcttcctccgtgtcttctctcgtaatagtctcgggcatgacagcagaggaaaagaaggtgaagaaggagaaggcaagcacagagactgagtgttag

SEQ ID NO: 17797 - DNA, 4929 bp, Artificial Sequence
  Description of Artificial Sequence: Synthetic coding sequence
atgagcagcttcaagcggggctcattgaagagctcaaccagcggttcccagaaaggccagaagtcttggattgagaaaaccttttgcaagagggaatgtatctttgtgatccccagtatgaaggactctaataggtgctgctgcggacagtttaccaaccagcacatccccccactgcccagcgcaaccccttcgaagaatgaagaagagtccaagcaggtcgagacccagcctgagaaatggtcggtcgctaaacacactcaaagctatcctacagattcttacggagttttagagtttcaaggcggcggctattccaacaaggctatgtatattcgcgtgtcttatgatacaaagccagatagcctgctccatttgatggtgaaggattggcagttagagctgcctaagctgctgattagtgtccatggaggtctgcagaattttgaaatgcagcctaaactgaagcaagtgtttgggaaggggctgattaaggctgcaatgactacgggagcctggatattcacggggggggtctccactggtgtgataagccacgttggagatgcattgaaggaccatagtagcaaatcacggggccgggtgtgtgctattggcatagcaccctggggcattgtggagaacaaggaagacctcgtgggcaaggacgtgactagggtctatcagaccatgtctaatccgcttagtaaactgtctgtattgaacaattctcacacccatttcatcctcgccgacaatgggaccctgggcaagtatggcgccgaagtcaaattgaggcggctgctcgaaaagcatattagcctgcagaaaatcaatactcggctgggccagggtgtgcctttagtgggtctggtggtggagggcggtcctaatgtcgtgtcaattgtgctggagtacttgcaggaggaaccgccaattccagtcgtcatttgtgacggctctggtcgggcctccgacatcctgtccttcgcacacaaatactgcgaggaaggtggcatcattaacgagagcctgagggagcaattactggtgacaattcaaaagactttcaactacaacaaggcacagtctcaccaactcttcgccattatcatggagtgtatgaaaaagaaagagctcgtaacagtgtttcggatgggctccgaagggcagcaagacatagagatggccatcctcactgccttgcttaaaggcactaatgtttccgctcctgaccagttgagcctggcactcgcttggaatagggtagatatcgccaggtcacagatctttgtgttcgggcctcactggccccccttgggctctctcgctcccccaaccgactccaaggcaacagaaaaggagaagaaaccaccaatggcgacaacaaagggtggtcggggcaaaggtaagggcaagaagaaaggaaaggtgaaagaagaagtcgaagaagagacggatccacgtaagattgaactgctcaactgggtgaatgccctggagcaggccatgttggatgcactggtcctggacagagtggattttgttaagctgctcattgagaacggcgtcaacatgcagcacttcctgacgatcccgagactggaggaactgtacaatacgagactgggcccaccgaacaccttgcacctgctcgtgagagacgtgaaaaaaagcaacctgccgcccgattaccatatttctctcatcgacataggtctggttttggagtatcttatgggcggggcctataggtgtaactacactaggaagaattttaggacgctatacaataatttattcggaccaaaacgtcccaaggccctgaagctgctcggaatggaggacgatgaaccacctgccaagggcaagaaaaaaaagaagaagaagaaggaagaggagattgacatcgacgtggatgatccagccgtatcccgatttcagtacccttttcatgaactaatggtgtgggctgtgcttatgaagagacaaaaaatggccgttttcttgtggcagaggggagaggaaagtatggcaaaggcgttagtagcttgcaaactatataaagccatggctcacgaatctagcgagtcggacctcgtggacgatattagtcaggacctggacaataactccaaagatttcgggcaactcgccctagaactgttggaccagagctataaacatgatgagcagatcgctatgaagctgcttacttatgaattaaagaactggagcaactccacctgtctgaagttagcagtggctgccaaacacagagacttcattgcccatacatgttcccagatgctgttaaccgatatgtggatggggaggctcaggatgagaaagaatcccggattaaaggtgattatgggcattctgttgccgcccaccattctcttccttgagtttagaacgtacgacgatttttcttaccagacttccaaggagaatgaagatgggaaagagaaagaagaagaaaacaccgatgccaacgccgacgccggttctcgcaaaggtgatgaagaaaatgaacataagaaacagcgctcgattccaatcggcaccaaaatctgtgaattctacaatgcacccatcgtaaagttctggttttataccataagctacttgggatatctgctgttattcaactatgtcatcttggttaggatggatggatggccttctctccaggagtggatagttatttcctacattgttagcctggccctagagaagattcgcgaaattttgatgtccgagcccggtaaactgtctcaaaaaatcaaggtttggctccaggaatattggaatatcactgatctggttgccataagcaccttcatgatcggggccattctgcggctgcaaaaccagccttacatggggtacgggcgcgtcatctattgcgtcgatattattttttggtacatccgggtgctcgacatatttggggtgaataagtatctcgggccttatgtgatgatgattggaaagatgatgattgacatgctctactttgtagttatcatgctggtcgtgttgatgagcttcggggtcgcacggcaggctattctgcatccggaagaaaaaccgtcatggaagttagccagaaatatcttttacatgccctactggatgatctacggagaagttttcgccgaccagattgatttatacgctatggagatcaacccaccctgcggggagaatttgtatgacgaggaagggaagcgcctgccgccatgcatccccggggcttggttaaccccagccctgatggcttgttacctgttagtggccaatatcctgctcgtgaacttgctcatcgctgtttttaacaacaccttttttgaagtaaagtcaatctcgaatcaagtgtggaagtttcagcgttatcagttgatcatgacatttcacgatcgcccagtccttcctcccccgatgataatccttagccacatctacattatcatcatgcgcctgtccggccggtgtcggaagaaaagagaaggggaccaagaagagcgggatagggggctgaaactattcctgtctgatgaagagttaaaacgactgcatgagtttgaggagcaatgtgtgcaagaacacttcagggaaaaagaggacgaacagcagtccagctcagatgagaggatccgggttacatccgagcgcgtggaaaatatgtctatgaggctcgaggaaatcaacgagagagagacgttcatgaagacctctctccaaacagtcgacctccgattggcccagctggaagagctgtctaatcgtatggtcaacgccctcgaaaatctggcgggaatcgatcgcagcgacctgatccaggcacgttcacgcgcctcgagcgagtgcgaagccacatatctgttacgccagtcaagcattaattcggcggacggctattcactgtacaggtaccacttcaacggtgaagaactgctgtttgaagacacatccctttccacaagtccaggcactggggtgaggaaaaagacttgcagcttccggatcaaggaggaaaaggatgtaaaaacccacctggtgccagagtgccagaactctctgcacttatcactcgggacatcaacttctgctacccccgacggttcgcacctggcagtggatgatctgaaaaacgccgaggagagcaaactgggacccgacattggaatctccaaggaagatgacgagcggcagactgattcgaagaaggaagaaacgatttcaccaagcctgaacaagacggatgtcatacatggccaggataagtcagacgtccagaatactcaactcacggtcgaaaccaccaatatagagggcaccatctcttaccccctggaggagactaagatcacccggtatttccctgacgagacaatcaatgcttgtaagactatgaaaagtcggtcctttgtgtacagtaggggtcggaaactggtaggcggagtaaaccaggacgtcgaatattcctccatcacagaccaacagcttacaacggagtggcaatgccaggttcaaaaaatcacccgctcacactctacggatattccctatatagttagtgaggctgcggtccaagctgagcacaaggaacagttcgcggacatgcaggatgaacatcatgtcgccgaggccattcctcgtattcccagactgagcctcaccatcaccgacaggaatgggatggagaacttgctgtcagtgaagccagatcagacacttggttttcccagcctccgctccaaaagcctgcatggacatcctcgaaatgtaaagagtatacagggcaagctggaccggagcggccacgcttcttctgtctcctctctcgtgatagtgtctggaatgaccgccgaagaaaagaaggtgaaaaaggagaaggcgagtaccgaaacagaatgttag

SEQ ID NO: 17798 - DNA, 4173 bp, Artificial Sequence
  Description of Artificial Sequence: Synthetic coding sequence
atgaaagacagcaataggtgttgttgtggacagtttactaatcagcatattccaccactgcctagtgccacgccatctaaaaacgaagaagagagcaagcaggtagaaacccagcctgagaagtggtcagtcgcaaaacatacacagtcatatcccacagactcttacggggtcctggaatttcagggtggcggttactcaaacaaagctatgtacattcgagtcagttatgacacaaagccggattcactgctgcacctcatggtgaaagattggcagctggaactgccgaagctacttatcagtgtacacgggggactgcagaattttgaaatgcagccaaagctaaagcaggttttcggaaaggggttaatcaaggcagctatgactacaggggcgtggatttttactggcggcgtctctaccggtgttattagccacgttggcgatgctctgaaagatcacagctctaagtctcgtgggagggtgtgtgctatcgggatcgcgccctgggggatcgtcgaaaataaagaggacctggtgggaaaagatgtgacacgggtttatcaaactatgtccaatcctctcagcaagctgagcgtgctcaacaacagccacacacatttcatcctggctgataacgggaccctcggcaaatacggcgcggaagtaaaactgaggcggctcctcgagaagcacatcagtttacaaaagattaatacccggctaggccaaggcgtgcctctcgtcggtctggtggtagagggcgggccaaatgtggtctctattgtgctcgagtatctgcaggaagagccccccataccagtggttatttgcgacggctcggggagagcatccgacatactgtcgttcgcccataagtactgcgaggagggagggatcatcaatgagtcacttcgcgagcagcttcttgtgacaatccagaaaacgttcaactataataaagctcagtcacaccagctgtttgctatcattatggaatgcatgaagaagaaagaactggtgacagtatttcggatggggagtgaggggcagcaggacatcgagatggcgatactgactgccctgcttaaaggcaccaacgtgtctgcaccagatcaactgtcactcgcactagcttggaaccgggtcgatatcgccagaagtcaaatctttgtgtttggaccccactggccgcccctgggatctttggcaccccctacggattccaaggctacagagaaggagaagaagccgccgatggctacaaccaagggcggccgggggaaaggaaaagggaagaaaaagggcaaagtgaaagaggaagtcgaagaggagacagatcccagaaaaatagagttgctgaactgggtcaatgccttagaacaagcaatgttggatgctctcgtgcttgacagagttgacttcgtaaaactgctgattgagaacggtgttaacatgcagcacttcctgacgatcccccgccttgaagaactgtataatacccggctgggacccccaaatacgctgcacctcctcgtgcgggacgtgaagaagagcaaccttccccccgactatcatatcagcctcattgatatcgggctggtactggagtatttaatgggcggcgcctatagatgcaactacactcgcaagaactttaggaccctgtacaataatctcttcgggccaaaacgacccaaagcattgaaactgctggggatggaggacgacgaacctcccgctaagggcaagaaaaaaaaaaagaagaagaaagaggaggaaattgatatcgacgttgatgatcccgccgtgtctcgctttcagtacccattccatgagctcatggtctgggccgtgctcatgaagaggcagaaaatggctgtcttcctttggcaacgtggtgaggagtccatggcgaaggctctggtggcctgtaagctctacaaggccatggcccatgagagcagcgaatccgacctggttgatgacatcagccaggacctggacaacaacagcaaggattttggtcagctggccctggaactactggatcagtcctataaacatgacgagcagatagcaatgaagctgcttacatacgagcttaagaactggtccaactctacgtgtctaaagctagctgttgccgctaagcacagggattttatcgcccacacctgctctcagatgctattgaccgacatgtggatgggccgtctgcgcatgagaaaaaatcctgggttaaaggtgattatgggcatcctcctgccccctaccattttatttctggagtttagaacgtatgacgacttttcatatcagacatccaaagaaaacgaggacggtaaggagaaggaagaagagaacaccgacgccaatgccgatgccggctcccgaaagggagatgaagagaatgaacataagaaacagagatctatcccaattggaactaagatatgcgaattttacaatgcccctattgtgaaattctggttttatacgatatcttaccttggctatcttctcctcttcaattacgtgatcttggttagaatggatgggtggccctctctccaggagtggattgtgatttcatatattgttagtctagcactggagaagataagagagattctgatgtctgaacctggcaagctcagccagaaaattaaagtgtggttgcaggagtattggaacattactgacctagtcgcgatctcgacttttatgattggagccatccttcgcctccagaaccagccgtatatgggttacgggcgcgtgatttattgtgtggatatcatcttctggtatatacgggtgctggacatctttggcgtgaacaaataccttgggccttatgtgatgatgattggaaagatgatgattgacatgctgtattttgtcgtaattatgttagtggttctgatgtcgttcggagtagcccgtcaggctatcttacacccagaagagaaacccagctggaagctggctagaaacattttctatatgccatattggatgatctacggtgaagtgttcgctgaccagatcgatttgtacgccatggaaatcaaccccccatgcggcgaaaatctgtacgatgaggaggggaagaggcttcctccttgtattcccggagcttggctcacccccgcattaatggcttgctacctccttgttgcaaatatccttcttgtcaacctgctcattgctgtcttcaacaacactttctttgaggtcaagtcaataagtaaccaggtttggaaatttcagaggtaccagctcattatgacatttcacgatagacctgtcctgcctcctcctatgataatactgagccacatttacattatcatcatgagactaagtggccgatgtcggaaaaagcgtgagggtgatcaggaggaacgcgaccgcggtctgaaactcttcttatcagacgaggaattgaaacgcctgcacgagtttgaggagcaatgcgtgcaagagcactttcgggagaaagaggacgagcagcagtcatcttcggacgaaagaatccgggtaacgtccgaacgggtcgagaatatgtccatgcgtctggaagagatcaatgagagagagaccttcatgaaaacaagtcttcagaccgtagacctgcgcttagcccagctcgaagaattgtctaaccgtatggttaatgctctcgaaaacctggccggaatcgatcgcagcgacctgatacaagcacgtagccgggcatcctctgagtgtgaagctacctatctgctgaggcagtccagtattaattccgccgatggctactctttataccgctaccacttcaacggagaggagttgctatttgaggacacctccctgtccaccagccctgggaccggggtccggaaaaaaacctgttcctttagaatcaaggaagagaaagatgtgaagacgcacctcgtccctgagtgtcagaatagtttgcatttgagtcttggcacctctacgtcagcaacaccagatgggtcacaccttgcagtcgacgatctgaagaacgctgaggaaagcaagctggggcctgacattggaatatcaaaggaggacgacgaacgtcagaccgatagcaagaaagaggaaacgatctcgcctagtctcaataaaaccgatgtcatccacgggcaatag

SEQ ID NO: 17799 - DNA, 4584 bp, Artificial Sequence
  Description of Artificial Sequence: Synthetic coding sequence
atgtatatccgtgtgtcttatgacactaagcccgattctcttctgcacctgatggtgaaggactggcagctcgagctgcctaaattattaatctctgtccacggtgggctacaaaactttgagatgcaacctaaattaaagcaggtttttggaaaaggtctgattaaggcagcaatgacaacaggagcttggatctttactggcggcgtttctactggagttatttctcacgtcggcgacgccctgaaggaccactcttccaagagcagaggtagagtgtgcgctataggcatcgcaccttggggcattgtggagaataaagaagaccttgtggggaaagacgtgacccgagtctatcagactatgagtaatcccctctcaaaactcagcgttttaaacaacagccacacccattttatactcgctgacaatggcaccctgggcaaatacggcgccgaggtcaaattgaggcggctgctggaaaagcacatctctttgcagaagattaacactaggctcgggcagggtgtcccgttggtgggcctcgtcgttgagggcggacctaacgttgtctccattgtgcttgaatatctgcaggaggagcctcctattccagtggtgatctgtgacggctcagggagagcttctgatatcctctcttttgcccataagattatcaacgagtccttacgggagcaactcctcgtcactatccagaaaacttttaattacaacaaggcgcaaagccatcagttgttcgccattattatggaatgtatgaagaagaaggagttagtgaccgtatttcgaatgggctccgagggccagcaggacattgagatggctatccttactgccctgctgaaaggcaccaacgtgagcgcgcctgatcagctatccctcgcactcgcctggaatagagtggatatagcacgctcccagatctttgtgttcggtccccattggcccccactgggaagcttggcaccacccacagattcaaaagccaccgaaaaagagaaaaagccaccaatggcaactacaaaaggtgggcgtggaaaaggaaagggcaaaaaaaaaggcaaagtgaaggaagaggtagaggaagagacagatcctcggaagattgagctactgaattgggtcaacgccctggagcaggccatgctcgacgcgctcgtgctcgatagagtcgattttgtaaaactgcttattgaaaacggagtgaatatgcagcatttcttgaccatccctcggcttgaggaactgtataacacccggctgggtcctcccaacacgctccatctgctggtgagggatgtcaagaaatccaacctcccccctgattatcacatttccctgatcgacatcggactggtactagagtatctgatgggaggagcttatcggtgtaactacactcgcaagaactttcgtaccctctataataatcttttcggccccaagcgacctaaagccctcaaactcctgggcatggaggacgacgagccaccggcgaagggcaaaaagaaaaagaaaaagaagaaggaggaggagattgatatagacgttgacgatcctgccgtctccaggttccagtatcctttccacgagcttatggtgtgggctgttttgatgaagcggcagaaaatggctgtcttcctgtggcaaaggggtgaagagtcaatggccaaagctctggttgcttgcaaactgtacaaagcgatggcgcacgaaagctctgagagcgacctggttgacgatatctcacaggatctggataacaattctaaagacttcggtcagctggcactggaacttctagatcagtcctataaacatgatgagcaaatcgctatgaagctgcttacatacgaactgaagaactggagcaactcaacatgccttaaacttgcggtcgcggcaaagcacagagattttatcgcccatacatgctcccagatgctgctaactgacatgtggatgggccgactgcggatgcgaaagaatcctgggcttaaagtaatcatgggtatactgctgccccctaccattttgttcttagaatttcgaacatacgatgacttctcttaccagacctctaaagaaaatgaggatggtaaggagaaagaagaggaaaatactgacgcaaatgccgacgccggatcacggaaaggggatgaagaaaatgaacataagaagcagcggtcaattccaatcgggactaagatctgcgagttttacaatgccccaattgtcaagttttggttctacaccatcagctacctgggctacttgctcttgtttaattacgtcatacttgtgcggatggacgggtggccgagcctgcaggagtggatcgtgatttcatacatcgtgtctctcgccctggaaaagataagagagatcctgatgagtgagcccggaaaattgagccagaagatcaaagtctggctgcaggaatactggaatatcacagaccttgtggcaataagtaccttcatgatcggtgcaattctccgcctgcagaatcaaccgtacatggggtatggacgggttatctattgtgtcgacattatcttttggtacattagagtactggatatctttggagttaataagtatctgggcccttacgtgatgatgatcggaaagatgatgatcgacatgctgtattttgtggtcataatgcttgtggtcctgatgtccttcggagtggcgcgccaagccatactgcaccctgaggaaaaaccttcgtggaaattggccaggaacatattctatatgccctattggatgatctacggggaggtgtttgctgaccaaatcgacctctatgcaatggaaatcaaccctccttgtggcgaaaacctatacgatgaggagggtaaaagactgcccccctgcattccaggcgcctggctaacacctgccctgatggcctgctaccttttggtcgcaaacattctgcttgtcaacctgctcatcgccgtcttcaataatacgttctttgaggttaagtccattagtaatcaggtgtggaagtttcagcggtaccagctaatcatgacctttcacgacagacctgttctgcccccccctatgattatcctgtcccacatctatattattataatgagactgtccggaaggtgccgcaaaaagcgagaaggggaccaggaagagcgagatcgtggcctaaagctgttcctgtcagacgaagaacttaagaggctgcacgagttcgaggagcaatgcgtccaggaacatttccgcgaaaaagaagatgagcagcagagttcatccgacgagagaatccgcgtgacatcagagagggtcgaaaacatgagtatgcggttagaagaaatcaatgaacgggaaacgttcatgaaaacttcactacagacggtagaccttagactcgcacaactggaagaactgtccaatcgaatggttaatgccctggaaaatcttgctggtatagaccgcagtgacctgatacaggctcgatcccgagcatcttctgaatgtgaagccacctacctcttgaggcagtcatctattaactcagcagatgggtattctttgtacaggtaccactttaacggagaggaattactgttcgaagatacaagcctatcaacctctcccgggactggtgtgagaaagaagacatgttctttccggattaaagaggagaaggacgtcaaaacccacctggtacccgagtgccagaactcactccatctatccctggggacaagcactagtgccacccccgacgggagccacctggccgtggatgacctcaaaaatgctgaggagtctaaactcgggccagacattggaatatccaaggaggacgacgaacgccagacagatagcaagaaggaggagaccatctctcctagtctcaacaaaactgacgtgatccacggccaggataagtctgatgttcaaaatacccagctgactgtggagactacaaacatcgagggtaccatttcctatcctctcgaagagactaaaatcactcgctacttccctgatgaaacaattaatgcctgcaaaacaatgaagtctcgatctttcgtgtactctcgggggaggaaactcgtcgggggcgtgaaccaggacgtggagtactcttccatcaccgaccaacaacttaccaccgagtggcaatgccaggtccagaagattacccgctcccacagtacagatatcccatacattgtctctgaggccgccgtgcaggccgaacacaaagagcagtttgccgacatgcaggatgaacaccatgttgctgaggccatcccccggatccccaggttgtcccttaccattacggacaggaacggcatggaaaatctgctgtcagttaagcccgatcagaccctggggtttccctctcttcggagtaaaagcctgcacggacacccacgcaacgtcaagagcattcaagggaaacttgatcgctctggtcacgccagcagtgtgtcatctctggtgatcgtgagcggaatgaccgccgaagaaaaaaaagtgaagaaggagaaggcttcaacagagacagaatgctag

SEQ ID NO: 17800 - DNA, 1479 bp, Artificial Sequence
  Description of Artificial Sequence: Synthetic coding sequence
atggccctgaactccggtagcccaccagccatcggtccctactacgaaaaccatggctaccagccagagaacccttatccggcacagcccaccgtggtgccaactgtgtacgaagtgcatccggcacagtattatcctagtccagtccctcagtacgccccaagggtgctgacccaggcctcaaatcccgtcgtctgcacacaacccaagtctcctagcgggactgtgtgcacatctaaaacaaaaaaagcactctgtatcactctcaccctgggaaccttcttggtgggggccgccttggcggcgggcctgctgtggaagtttatgggatctaagtgttcaaattctggcatcgaatgcgactcatccggaacatgtattaacccttccaattggtgtgacggggtgtcacactgtcctggaggtgaggatgagaaccgatgtgtaagattgtatggacctaactttatcctgcaagtgtactctagtcaaaggaaaagctggcatcctgtatgtcaggacgattggaacgaaaactacggcagagccgcttgtagggatatggggtataagaataatttttactctagccagggcatcgtggatgattctggcagcacatcatttatgaagttaaatacctcggccggcaacgtcgacatctacaagaaactgtatcacagcgacgcctgcagcagcaaggccgtggtgagtctgcggtgtatcgcttgcggggtcaatcttaactcgtctaggcaatcccgcatcgtggggggagaatcagcgctgccaggagcttggccttggcaggtcagcctccacgtccagaacgttcacgtgtgtggaggaagtatcatcactcccgaatggatcgtgaccgccgcccattgcgtagagaaacccctcaataatccttggcattggactgctttcgcaggcatcctccggcaaagttttatgttttatggcgctggataccaggtggaaaaagtaattagccatcctaactacgactcaaaaacaaagaataacgacatcgccctcatgaaattacagaaacctctcacctttaatgatctcgtgaagcctgtatgtctgcctaacccagggatgatgctgcagcccgaacagttatgttggatctctggctggggagccacagaggagaaagggaaaacctcggaagttctgaacgccgcgaaggtccttttgatcgagacccagcgctgcaattcgaggtacgtgtacgataatctcattacacccgccatgatatgtgctggcttcctccaaggaaacgtggatagctgccagggggactcagggggccctctagtcacttcaaagaataacatttggtggctcatcggagatacaagctgggggtcaggatgcgcgaaggcctacaggcccggcgtgtatggtaacgtaatggtcttcactgactggatctatagacaaatgcgcgcagacggctag

SEQ ID NO: 17801 - DNA, 1590 bp, Artificial Sequence
  Description of Artificial Sequence: Synthetic coding sequence
atgcccccggcccccccagggggcgagagtggctgcgaggagaggggggccgctgggcatatcgagcactccaggtacctgtcactgctggacgccgtcgacaacagtaagatggcactgaattcaggctctccacccgccattggaccatattatgagaatcacggctaccagccagagaatccctatccagctcagcctacagtcgttcctaccgtctacgaggtacatcccgcacagtactaccccagccccgtcccgcagtatgcgcctcgggttctgacgcaagcatccaacccggtggtctgtactcaacccaaatctcccagcggcactgtatgcacgagcaagacaaagaaagccctttgtatcacactgaccctgggtaccttcctggtgggggcagcacttgccgcgggactgctgtggaagtttatgggcagcaagtgctcaaatagtgggatagagtgcgattcttctggaacatgtatcaatccgagcaattggtgcgacggggtttctcactgccctggtggagaggacgaaaaccgatgtgtgaggctgtacggaccaaattttatattgcaggtttatagttctcagcggaagtcctggcatccggtgtgccaggacgactggaatgaaaattatggaagagcagcctgtcgtgatatgggatataaaaataatttttattctagccagggaatcgtggacgattctggctcaacgtcctttatgaaactaaatacctcagctggcaacgtggacatatacaagaaactgtatcatagtgatgcttgtagctctaaagcagtggtgtccctcaggtgtatagcgtgtggagttaacctgaattcttctaggcaatctagaatcgtcggtggggaatcggcgttgcctggcgcttggccttggcaggtctctctgcatgtacagaatgtgcatgtgtgtggaggctccatcataacccctgagtggattgttactgcagcccattgcgtggagaaacccctgaataacccgtggcattggactgcttttgcggggattctgcggcagagctttatgttttacggtgccggttaccaagttgaaaaagtgatatctcaccccaattacgactcgaagacaaagaacaatgatatcgcactgatgaaacttcaaaaacccctcaccttcaacgaccttgtaaaacccgtatgcctcccgaatcctgggatgatgctccagcctgagcagctctgctggatttccgggtggggtgcaaccgaagaaaagggcaaaacatctgaggtcctgaacgctgccaaggtgctgctgattgagacacagagatgcaactctagatatgtctacgataatttaatcacacccgctatgatttgtgcaggttttctgcagggaaacgtggattcctgccagggagattcgggcggccctttggttacctctaaaaacaacatctggtggctcattggcgacaccagctggggatccggctgcgctaaagcctatcgccccggtgtgtacggaaatgtgatggtatttacagattggatttacagacagatgcgggctgatggatag

SEQ ID NO: 17802 - DNA, 1470 bp, Artificial Sequence
  Description of Artificial Sequence: Synthetic coding sequence
atggcccttaattctgggagcccccccgctatcggaccctactacgagaatcacggctaccaacccgaaaacccctaccccgcccaaccaacagttgtgccaacagtgtatgaggtgcaccctgcacagtattacccaagccccgtgcctcaatacgcgccgagggtcctgactcaggcttccaatcccgtcgtgtgcacccaaccaaagagcccatctggaacagtgtgcacctccaagaccaaaaaagccttatgcatcacactcaccctcggcacgtttctggttggggccgcattggccgccggcctgctctggaagtttatgggttctaagtgtagcaatagtggaattgaatgcgattcttccggcacatgtattaatccgtctaattggtgcgacggtgtgtctcattgccccgggggggaggatgagaatagatgcgtcaggctgtatggccccaactttattctgcaggtgtacagtagtcagagaaagagctggcacccagtgtgtcaggacgattggaatgagaactacggcagggccgcatgccgggatatgggatataaaaacaatttttattcttcccagggcatcgttgacgatagtggatcaacaagttttatgaaactgaatacttccgccggcaacgttgacatctataagaaattatatcattcagacgcttgttccagtaaagctgtggtgtcattgagatgtatcgcatgtggagttaatctaaactcaagccggcagtctagaatcgtggggggcgaatcagcgctgcccggagcctggccctggcaggtgtccctgcacgtgcagaacgtgcacgtgtgcgggggcagcatcatcacacccgagtggattgtgacggctgcccattgtgttgaaaaaccgcttaacaatccctggcactggactgcctttgccggtatcctgagacagtcttttatgttctacggggccggttaccaggtggagaaggtgattagtcatcccaactacgactccaaaacaaaaaataatgatatcgctctgatgaagctacagaaacctctgaccttcaacgatctggtgaaacctgtttgtctgccgaacccaggcatgatgctgcaaccagaacagctctgctggattagtggctggggcgctactgaggaaaaaggcaagacgagcgaagtactcaatgctgccaaggtgcttctgattgagactcagcgatgcaactctagatatgtgtatgacaatctcatcacgcctgcgatgatttgtgctggtttcctgcaaggaaatgtggatagctgccagggggacagcgggggccctctcgtgaccagtaagaacaacatctggtggctgatcggggatactagttggggctcagggtgtgcaaaagcctacaggccaggagtctacggaaacgtgatggtgtttaccgattggatctataggcagatgagatag

SEQ ID NO: 17803 - DNA, 240 bp, Artificial Sequence
  Description of Artificial Sequence: Synthetic coding sequence
atggccctcaattctggctctcctcccgcgattggcccttactatgagaaccacgggtaccagcccgagaatccttatcccgcccagcccaccgtggtcccgacagtgtacgaggtccaccccgcacaatactatccctctccagtgccacaatacgcacccagagtccttacacaagccagcaaccccgtagtgtgtacccagcctaagtctccgtccgggaccgtctgtactagctag

SEQ ID NO: 17804 - DNA, 1479 bp, Artificial Sequence
  Description of Artificial Sequence: Synthetic coding sequence
atggctttaaacagtggtagcccccctgccatcggcccatattacgagaaccacggttatcagcccgagaacccctaccccgctcagccaactgtagtgcccactgtgtatgaggtccaccccgcccagtattacccctctcctgttccgcagtatgccccgcgggtcctgacccaggcttctaatcctgtagtctgcacgcagccgaagtctccctccggcactgtatgtacctccaagacgaaaaaggcattgtgcataaccctcaccctcggcacctttctggtgggcgccgctctggctgccgggctgctgtggaaatttatgggatcaaagtgttcaaattctggcatcgagtgcgacagtagcggtacttgtataaaccccagcaactggtgcgatggcgttagccattgccccggcggcgaggatgagaatcgatgcgttcgtttgtacgggcctaatttcattttgcaggtctatagctcccaacggaagagctggcaccccgtgtgccaggatgattggaacgagaactacgggagggccgcgtgtcgcgatatgggatacaagaacaatttttattcctcccaaggcatcgttgatgattctggttctacctcctttatgaaactcaataccagtgctggcaatgtggacatctacaagaagctgtatcattctgatgcgtgtagctctaaagcagtggtctcgctcagatgtattgcttgcggcgtaaatttaaatagttctcgtcagagccggatcgtaggtggagagagcgcgctgccgggcgcatggccatggcaggtcagtctgcacgtgcagaacgtacacgtgtgcggcggcagcataattaccccagagtggatagtgactgccgctcactgtgttgaaaaaccactgaataacccctggcactggacggcctttgccggaatcctgagacagagcttcatgttttatggcgccggttaccaggtggagaaggtgatcagccatcccaattatgatagcaaaaccaagaacaatgatatcgccttgatgaagctccaaaagcccctgacattcaacgatcttgtgaaacctgtgtgcctccccaaccctggcatgatgctgcagccagaacaattgtgctggatttcaggttggggtgccactgaagagaagggtaaaacgtctgaagttctgaacgcagcgaaagtgctgcttatcgaaacccagagatgtaacagcaggtatgtttatgacaacctgatcacaccagctatgatatgcgccggattcctgcagggaaatgttgattcctgtcaaggagatagcggtggcccattagtgaccagcaaaaacaatatctggtggcttatcggcgacacgtcatggggcagcggttgcgctaaagcataccgccctggcgtctatggcaacgttatggtgttcactgattggatctatagacagatgcgtgccgacgggtag

SEQ ID NO: 17805 - DNA, 717 bp, Artificial Sequence
  Description of Artificial Sequence: Synthetic coding sequence
atgtacgcccctggaggcgcagggttgcccggagggagacgccggcgatcacccggcggatccgccctgccaaagcagcccgaaaggtccctggcctcagcactacctggcgctctgtcaatcaccgcactgtgtacagctttggcggaaccggcctggctgcatatccatgggggtacttgctcgagacaggagttgggtgtgagcgacgtgctgggttatgtgcatcctgacctgctgaaagacttctgcatgaacccgcaaaccgtcctgctcctgcgagtgatcgcagccttctgtttcctgggaattttgtgcagcctgtccgcattcctgctggatgtcttcggtcccaaacacccagccctcaagattacccgtaggtacgccttcgcacacatcttaactgtcctgcagtgcgcaaccgttattggcttctcttattgggcaagcgaacttatcttagctcaacagcaacaacataagaaataccatgggtctcaggtctatgttacgtttgccgtgtcattctatctggtggctggcgctgggggagcctctatattggccactgctgcgaatctgttaagacactacccaacagaagaagaagagcaggcgctggagcttttgagtgagatggaggaaaacgaaccttatccggccgagtacgaggtgatcaaccaatttcagccaccgccagcttatacaccatag

SEQ ID NO: 17806 - DNA, 717 bp, Artificial Sequence
  Description of Artificial Sequence: Synthetic coding sequence
atgtatgcccctggaggtgccggtctgccaggcggtcgacggcgacgaagtcctgggggctcggcactccccaagcaaccggagaggtccctggccagcgccctcccgggggcactcagtatcacagcactgtgtaccgcactagcggaaccagcctggctacatatccatggcggtacatgttctaggcaggaactgggagttagtgatgttctgggctacgtccatccagacttgctgaaagacttctgcatgaaccctcaaaccgtactccttctgcgggtaatcgctgccttttgctttcttggcatactgtgtagcctgagtgcctttctgttggacgtttttggacctaagcatccggcactcaagatcacacgtcgttatgcctttgctcacattttgactgtcctgcagtgcgcaacagtcataggcttttcatattgggcttctgagctgatcctcgctcagcagcagcaacataaaaagtatcacggaagccaagtgtatgtcacatttgctgtgtccttctatcttgtggccggggctggtggagcctctatcctcgcaactgccgccaatctgctgcggcattaccccaccgaggaggaagaacaagccctcgagttactgagcgaaatggaggagaatgaaccctatccagcagaatatgaggtcattaaccagttccagccgccacccgcctacaccccttag

SEQ ID NO: 17807 - DNA, 3075 bp, Artificial Sequence
  Description of Artificial Sequence: Synthetic coding sequence
atgtgtgccaggatggcgggcaggacaacagccgcaccccggggaccttatggcccgtggctttgccttctggtcgccttggcacttgacgttgtcagggtagactgcggccaggcaccgttagatccggtgtatttgccggctgctctggaattattagatgcacctgagcattttcgcgtccaacaggttggccattacccacccgctaacagctccctttccagtcggtctgaaacttttctccttttgcaaccttggcctcgtgcgcagcctctacttcgagccagttacccaccttttgcgacccaacaagttgtgcctcccagggtcaccgaaccccaccaacgccccgtaccttgggacgttcgtgcagtgtccgttgaagctgccgtgacccctgccgagccctatgcccgggttctgttccacttgaagggacaagactggccccctggcagcgggtcactcccatgcgcgaggctccatgccacacacccagcaggaactgcacaccaggcctgccgcttccagccatcgctcggagcctgtgtcgtggagctggagcttccctctcattggttctctcaggctagcacgactcgggccgagctggcatacacgttggaacccgctgccgagggaccggggggctgcgggtccggcgaagagaacgacccgggcgagcaggcactgcctgtgggaggagttgagttacgccccgccgacccgccccagtaccaggaggtgccactggatgaggctgtgactctcagagtcccagatatgccagtacgccctggccagcttttctcagccaccctcttgttgaggcataatttcactgcctcacttctcactctgaggataaaagttaagaaaggtttgcacgttacggcagccaggccagcccagccaaccttgtggactgctaagcttgatcggttcaaggggtcccgccaccataccactctgatcacctgccaccgcgctggactgaccgagccagactcctctagcccgcttgaactgagcgagtttctgtgggtagattttgttgttgaaaatagcaccgggggtggagtggctgtgactcggcctgtgacctggcagctggaataccccggccaagccccagaggcggagaaggacaagatggtgtgggaaatcctcgtcagcgaacgagatatcagagcactcatacccctggctaaggcagaagaactggtcaataccgcccctcttacaggcgttccacagcacgtgcctgtgcgcttggtcaccgttgacggtggtggcgccctagtcgaggtgactgagcacgtgggctgtgagtccgcgaatacacaggttttgcaggtcagtgaagcatgcgatgcagtctttgtagcaggcaaggagagcaggggtgcccgaggggtccgagttgacttttggtggcgcagactcagggcaagcctgaggctgaccgtttgggcccctcttttaccactacgtatcgagctgaccgatacaacactagagcaagtcagaggttggagggtccctggccccgcagagggaccggcagaaccggccgctgaagcgtccgacgaagcggagcggcgcgctaggggttgtcacttgcaatatcagagagctggagtccgtttcctcgccccattcgccgctcacccactggatggcggtcgccggctcacacacctgctgggacccgattggttgctggatgtgtcccatcttgtcgcccctcacgccagagtcctcgacagtagagtcgcaagcttggagggaggccgggttgtcgtgggtagggagcccggcgttacctccatcgaggtgcgctctcccctgagtgactctattctaggtgagcaggccctggccgtgacggacgacaaggtcagtgtgttagaactccgggtacagccagtcatgggcattagcttaacactgagtcgcggaacagctcacccaggagaggtgacggccacttgctgggcacaaagcgctttacctgcacctaagcaggaggtggctctcagcctgtggctgtcctttagtgaccacacggtagccccggcggaactgtacgaccggcgagacttgggcctttcggtgtccgctgaagagcccggggctatcctccctgcggaggaacagggggcgcaattgggcgtggttgtctcaggtgcgggtgccgaagggctgcccctacacgtggctctccatcctcctgaaccttgccgcaggggtcggcacagagtgcctctcgccagcgggaccgcttggttgggtctgcccccggcaagcaccccagcccccgctctcccatcaagcccggcttggagtcctccagccactgaggccaccatgggcggcaaacgacaggttgcaggttcagtgggtgggaacacaggggtgcgtggcaagttcgagagggcagaggaagaagccagaaaagaagagactgaagccagggaagaggaggaagaggaagaggaggagatggttcctgcgcctcagcacgtcaccgaactggagcttggcatgtatgccctgttgggagtgttctgcgtcgcaatattcatctttttagtaaatggcgttgtatttgtcttgagataccagcgcaaggagcctcccgattccgcaacggaccctacctctccccagccacacaattgggtgtggttgggtaccgaccaagaagaactcagtcggcagcttgatcgacagagtccggggccccccaaaggggagggaagttgtccttgtgaatcggggggcgggggggaggcaccgactctagctccaggccctccaggcggaactacgagctcctcctccaccctagcccggaaggaggccggagggagacgtaagagagtggagtttgtcactttcgcgcctgcgccgcctgcccaatcaccagaagagccagttggagcccctgcggttcagtcgatcctggtggctggtgaagaggatatccgctgggtgtgtgaagacatggggttaaaggaccctgaggaactgcgcaattacatggagcgaatccgcgggtcgagttag

SEQ ID NO: 17808 - DNA, 3072 bp, Artificial Sequence
  Description of Artificial Sequence: Synthetic coding sequence
atgtgcgccaggatggccggtagaacaaccgccgcaccacgggggccctacgggccatggctgtgtctgctggttgccctggccctggacgtggtgcgtgtggactgcggccaggctccgctggaccctgtctacctgcctgccgcgcttgagcttttggatgcgccggagcactttcgtgtgcaacaggtgggacattatcctcctgctaactccagtctgagcagcaggtctgagacatttcttctgctgcaaccctggcccagggcccagcccttgctacgggcgagctacccaccattcgctactcagcaggtggtgcccccccgcgtgactgagccacatcaaaggcccgtgccatgggacgtgcgagctgtgtctgtcgaagcggcagtaaccccggccgagccttacgctagggtgctctttcatttgaagggacaggattggccccccggttcagggagccttccttgcgctcggttacatgcaacacaccctgccggaacagcacatcaggcatgtcgctttcagccatccctaggcgcctgcgttgtggagctggaactccccagccactggttctctcaagcctccacaactagggcagagctcgcttacactctcgaaccggctgccgaaggccctggcggttgcggatcaggtgaggaaaacgaccccggtgagcaagctttgcccgtcgggggcgtcgaactgcgtccagccgacccaccccagtatcaggaagtgccattggacgaggctgtcactttacgggtgcctgatatgcctgtgcgccctggccagttattctccgccacattgctcttacgtcataacttcacagctagtctcctgacattgaggatcaaagtaaagaaaggtctgcatgtcacagcggctagaccggctcaaccaaccttgtggaccgctaaactggatagatttaaggggtccagacaccataccacactgattacgtgccaccgcgccggcctgaccgagccggatagttctccactggagctgagtgaattcctgtgggtggatttcgttgtcgagaactctactggcggtggggtcgctgtaacgcgcccggtgacctggcaattagaataccccggtcaggctccagaggctgaaaaggacaagatggtctgggaaatccttgtctccgagcgtgacatcagggcactcattcccttagctaaggccgaggaactcgtaaacacagcgcccctcacaggggtccctcagcacgtacctgtgcgccttgttaccgtcgatggaggcggagctctcgtggaagtcactgagcatgtggggtgtgaaagcgcgaacacccaagttctccaggtatccgaagcctgtgatgcagtgtttgtcgccggaaaagagtctagaggcgcccgaggcgttagggtggacttctggtggcgtaggctccgtgcttccttgcgccttacagtgtgggcaccactgcttccgctacgcattgagctaacagacaccacactggaacaggtgcgcgggtggagagtgcctggcccggccgaggggccggcagaacccgccgccgaggcgtccgatgaggccgaacgccgagccaggggatgtcacctgcaatatcagagagcgggcgtgagattccttgctccatttgctgcccatcctctggacggaggtaggcgtttgacccatctccttgggccagactggctgctggacgtctcccacctggttgcaccacatgcgcgggttctcgacagccgcgtcgcgtctttagagggcggccgtgtcgtggttggtcgtgagccaggcgttacctctattgaagtgagatcccccctgagtgactccatcctcggcgagcaggccttggctgtgactgacgataaggtgagcgttttggagcttagggtccaacccgtcatgggcatctcattgactttgagcagaggcacagcccaccccggcgaagtgaccgcaacatgctgggctcagagcgccttgccagccccgaagcaagaggtagcgctgagtctgtggctcagtttctccgatcacaccgtggcgccagccgaattgtacgatagacgggatttgggactcagcgtctccgcagaggaacccggggcaatcctgcccgcggaagaacagggtgcccaactgggcgtggtggtatccggggccggtgcggaaggtcttcctctccacgtcgcgttgcaccctcctgagccctgtcggcgaggccgtcatcgggtccccttggcatccggtacggcctggctgggtcttccacctgcttctacgccggctccagcactgccctcgagccccgcttggagcccacccgcgaccgaggcaacaatgggcggcaagagacaggtcgccggaagtgttggcggaaatactggcgtgcgcggtaagtttgaacgcgctgaggaagaggcccgtaaagaggagacagaggcccgagaagaagaagaagaggaggaagaggagatggttcccgcaccacagcatgtcactgagctagaactgggaatgtatgcattgttgggggtcttttgtgtggccattttcattttcctggtgaacggtgttgtgtttgtcttaagataccaaaggaaggagccacctgacagcgcgacggatccaacgtctccacaaccacataactgggtatggctgggcaccgatcaggaggagctgtcaagacagcttgatcgtcagtcccccggcccaccaaaaggtgaagggagctgcccttgcgaaagtggggggggaggggaggcaccgactctcgcccccggaccacccggcggaactacctcatcatcctctaccctggctcggaaagaggcaggagggcgcaggaagcgcgtcgagtttgttacttttgctcctgctccccccgcccagagccctgaggaaccagttggagctcccgcagtgcagtccattttagtcgccggagaggaggacatcagatgggtttgtgaagatatggggctgaaggatcctgaggagttgcgtaattatatggaaaggatccgggggtctagctag

SEQ ID NO: 17809 - DNA, 1026 bp, Artificial Sequence
  Description of Artificial Sequence: Synthetic coding sequence
atgctgccggaacagctctacttccttcagtctcctcccgaggaggagcccgagtatcacccagacgcatctgcccaggaattgaatgtgcgagagtctgatgtgcgggtctgcgatgaatcgtcatgtaagtacggcggtgtctgtaaggaggatggagacggcctgaagtgcgcatgtcagttccagtgccatactaactacattccggtatgtggtagtaacggcgatacataccagaatgagtgctttttgaggcgcgccgcttgtaagcatcagaaagagattaccgttattgccagagggccctgttattcagataacggatccggtagcggtgagggtgaagaagaagggtctggtgcagaggttcaccgcaaacactctaagtgcggcccctgtaagtataaggccgaatgcgacgaggacgcggagaacgttggttgtgtgtgcaacatcgactgctccgggtattccttcaatccagtgtgtgcgtccgacggcagcagctataacaacccatgcttcgtgcgtgaagcatcctgtatcaagcaagagcagatcgacatccgtcacctgggacattgcactgataccgatgatacatctctgttgggtaaaaaagatgacgggctgcagtatcgacctgatgtgaaggacgcgagcgatcagagggaggacgtgtacatcggcaatcatatgccttgcccagagaacctgaacggttactgcatccatgggaaatgcgagtttatctattccacccagaaggcgtcatgtagatgcgaaagtggatacacaggacagcattgtgaaaagaccgacttctcaattctgtatgtcgtgccttcccgccagaagctgactcacgtgctgattgcggccattatcggcgcagttcagatcgcaataattgtggcaattgttatgtgcatcacccgtaagtgtcccaagaacaaccgaggcagacgccagaaacagaacttaggacactttacctccgataccagctctaggatggtttag

SEQ ID NO: 17810 - DNA, 1143 bp, Artificial Sequence
  Description of Artificial Sequence: Synthetic coding sequence
atgggggctgccgcggctgaggcacccctgcgccttcctgccgctccgcccctggcattttgctgctacaccagcgtccttcttttgttcgcattctcattaccgggatctagagcctctaatcaaccccctggagggggaggagggtccggtggcgattgcccaggcggtaaaggaaagagtatcaactgttcagaactgaatgtaagagagtctgacgtgcgtgtgtgtgacgaatcaagttgtaagtatggcggcgtgtgcaaggaggacggcgacggcctgaaatgcgcgtgtcagtttcagtgtcataccaattatattcctgtgtgcggatctaacggagacacttatcagaacgagtgcttcttgagaagggctgcttgcaaacatcagaaagagattacagttatcgcgcggggcccttgctactcagataacgggagtggcagtggcgagggggaagaggagggaagcggcgctgaggtgcaccgcaaacacagcaagtgtggaccatgcaaatacaaagctgaatgcgatgaggatgcagaaaatgttggatgcgtctgcaacattgactgtagcgggtattcattcaatcccgtctgcgcaagcgacggctcatcatacaataatccatgttttgtgagagaagcatcctgtataaaacaggaacagatagacattaggcacttgggccattgtacagatactgatgatacttccctgctggggaagaaggacgacgggctgcaataccgtcccgacgtgaaggacgctagcgatcaacgggaggatgtgtatatcggcaatcacatgccttgccccgagaacttaaatggatactgtatccacggaaaatgcgaatttatatactcaacccagaaggctagctgccggtgcgagagtgggtacaccggccaacattgtgaaaaaacagactttagcatcctgtacgtcgtgccatcacggcaaaagctgacgcatgtgctaatagccgccattatcggcgctgtgcagatagcaattattgtagccatagtcatgtgtatcactagaaagtgccccaagaacaacaggggccgacgacagaagcagaacctggggcactttacctcagatacttcttctagaatggtgtag

SEQ ID NO: 17811 - DNA, 393 bp, Artificial Sequence
  Description of Artificial Sequence: Synthetic coding sequence
atgcaagaacggacgggcgcggctacagcccggagggagtctctgcctcaggccaacaacccggaacagctgtgtaagcagcggtgtattaacgaggccagctggactatgaaaagggtcctctcttgtgtgccagagccaacggttgtcatggcagctagggctctgtgcatgttgggactggtgctggccttgctatcctctagctcggcggaggagtacgtgggactttcggcaaaccagtgcgcagtgcctgctaaagacagggtggactgcggctacccacatgttacaccgaaggagtgtaacaatcgcgggtgttgttttgatagtcgaattccaggagtgccctggtgttttaaacccctgcaggaagctgagtgcacattctag

SEQ ID NO: 17812 - DNA, 285 bp, Artificial Sequence
  Description of Artificial Sequence: Synthetic coding sequence
atgaagcgtgtgctctcctgcgtccccgagccaacggtggtaatggcggccagagcactgtgcatgctcggtctcgtgctcgctctcttgtcaagttcctctgctgaagagtacgttggtctctcagccaaccagtgtgctgttccagcaaaagaccgggtggactgcggttatccccacgtgaccccaaaagagtgtaacaaccggggttgttgtttcgattcccgtatcccaggggtgccttggtgtttcaagccactccaggaggccgagtgcactttttag

SEQ ID NO: 17813 - DNA, 1497 bp, Artificial Sequence
  Description of Artificial Sequence: Synthetic coding sequence
atggcactgccaaccctccccagttattggtgctcccagcagcgcctgaatcaacagctggcccggcagcgggagcaggaggcaaggttaaggcagcagtgggaacagaatagtcgttatttcaggatgtctgatatctgctcctcaaaacaggccgagtggtcatcaaagacatcctaccagcgttcaatgcacgcctaccagcgcgaaaagatgaaggaagagaagcgcaggtccctggaggcacgtagggaaaagctcaggcaattaatgcaggaggaacaggatctgctggccagggagttggaggagctccgccttagcatgaacttgcaagagcgaagaatccgcgagcagcacggcaagcttaagagcgcaaaagaagagcagaggaaactgattgcggagcagttactgtacgagcactggaagaaaaataaccccaagctgcgagagatggagctagacttacatcagaagcacgttgttaattcctgggaaatgcagaaagaggagaagaagcagcaggaagcaactgcagagcaggagaacaagcggtatgaaaatgagtacgagcgcgctcgaagggaagcactcgaaagaatgaaagccgaagaggagagacggcagctggaggacaaacttcaggccgaggccctgctccagcagatggaagaactgaagctgaaagaagtggaagcgaccaaactaaaaaaagaacaggagaatctgttaaagcagcggtgggagttggagcgccttgaggaagaaaggaaacagatggaagcttttcggcagaaagccgagctggggcgctttctgcgacaccagtataatgcccagttgtcacggaggacccagcagattcaggaggagctagaggccgataggcgcatcttacaagctctgttagagaaagaggacgaatcccagaggttgcacttagcaaggagagaacaggtcatggccgacgtggcatggatgaagcaggccatcgaagagcagctacaactggaaagggctcgagaagccgagcttcagatgttgctgcgtgaggaggctaaagagatgtgggagaagagggaagcggaatgggcgcgcgagcgcagtgctcgcgaccgcctgatgtctgaagtactcacaggcagacagcaacagatccaagagaaaatcgagcagaacagacgcgcccaggaggagtctctgaagcatcgggagcaactcattaggaatttggaagaagtcagagaactagcgagacgcgaaaaggaagaatctgaaaaattaaaaagcgccagaaagcaagagctcgaagcccaagtggctgagcgaaggttacaggcgtgggaggctgatcagcaggaggaagaggaagaagaagaggcacggcgcgtggaacagctgtccgacgccctgttacagcaagaggcggagaccatggctgaacaaggatatagaccaaaaccctacggccatccaaaaattgcctggaattag

SEQ ID NO: 17814 - DNA, 1497 bp, Artificial Sequence
  Description of Artificial Sequence: Synthetic coding sequence
atggcactgcccactctgccttcctactggtgctcccagcagcgactcaaccagcagctcgctagacaacgggaacaggaggcacgcctgcggcagcagtgggagcagaactcacgctattttagaatgtcggatatatgttcatccaaacaagccgagtggtcctctaagacttcctaccagcgctctatgcacgcatatcaaagagagaaaatgaaggaagaaaaaaggcgttctcttgaagccagaagagagaaactccgccagctcatgcaggaggaacaggacctgttggctagggagctggaggaactcaggctgagtatgaatctccaggaaaggagaatccgcgagcaacacggcaaattgaaatccgctaaagaggaacaaaggaaactgattgccgaacaactgctgtacgagcactggaaaaagaacaaccctaagctgcgggaaatggaactggatctgcatcagaagcacgtggtgaatagttgggagatgcaaaaggaggagaaaaagcagcaggaagcaacagccgagcaggagaacaagcgctacgagaacgagtacgaacgggcaagaagggaagctttagaacggatgaaggcggaagaggagcggcgacagcttgaggataaactgcaagcggaggcgttgctgcagcaaatggaggagctcaaattaaaggaagtggaagctactaagctcaaaaaagaacaagagaatctccttaaacagaggtgggagttggaacggctggaagaggagcgcaagcaaatggaagccttccggcagaaggcagagctgggcaggttcctcagacaccagtacaacgctcagctgtccagacggacacagcaaatccaggaggaactggaagctgatagacgcatcctacaggccctgctggaaaaagaggatgagtctcagaggctgcacctggctcgcagggagcaggtcatggccgacgtggcatggatgaagcaagccattgaagaacaactccagcttgaacgggcccgtgaggcggaactccagatgcttctgagggaagaggccaaagagatgtgggaaaagcgggaggctgagtgggccagagaaagatccgctcgagaccgactcatgagcgaggtcctgacaggacgacagcagcagattcaggagaagatcgaacagaacaggcgtgcacaggaagagagtctaaaacatcgcgagcaactgattagaaacctggaagaagttcgggagttggccagacgcgagaaagaagagtccgaaaaattgaagtctgccagaaagcaggagctggaggcacaggtggctgaacggcgtctgcaggcctgggaggctgaccagcaagaagaggaagaggaagaagaagcacgtagagtagagcagctgtccgatgcactcctgcagcaggaggccgaaacaatggccgagcagggctataggcctaaaccatacgggcacccaaaaatagcttggaattag

SEQ ID NO: 17815 - DNA, 525 bp, Artificial Sequence
  Description of Artificial Sequence: Synthetic coding sequence
atggcactgcctacactgccctcctattggtgttctcaacagcggttgaaccagcaacttgctaggcagcgtgaacaggaggcacgactgaggcaacaatgggaacagaattcccggtattttaggatgtctgacatatgcagctcaaagcaagcagaatggtcatccaaaaccagctatcagcgcagcatgcacgcataccagcgggaaaagatgaaggaggagaagcggcgatccctcgaggcgagaagagagaagttgagacagttgatgcaagaggagcaggacctccttgctcgtgagttggaggaactgcggctttcaatgaacctccaggagagaaggatacgagagcagcatggaaagctgaaaagcgccaaagaagagcagagaaagctgatcgcagagcagctgctctatgaacactggaaaaaaaacaatcccaaactccgcgaaatggagctggacctccaccaaaaacatgtcgtgaattcgtgggagatgcaaaaagaggagaaaaaatag

SEQ ID NO: 17816 - DNA, 663 bp, Artificial Sequence
  Description of Artificial Sequence: Synthetic coding sequence
atggcactcccaacgcttcctagctattggtgttcccaacaacgccttaatcagcagctcgcacggcagcgagaacaggaagcccggctcagacaacagtgggaacagaactcgaggtactttagaatgagtgatatctgcagttccaagcaggcagaatggagctccaaaacgtcataccaacgatcaatgcacgcttatcagcgcgagaagatgaaagaggagaaaaggaggtcgctcgaagcccgcagagaaaagcttcgacaactgatgcaggaggaacaggatttacttgcaagagaactggaggagctcaggctatctatgaatctccaggagagaaggatacgggagcagcacggaaagctgaagagcgccaaggaagaacagcggaaattgatcgcggagcagctcctgtatgagcactggaaaaaaaataacccgaagttacgcgaaatggaactggatctgcaccaaaagcacgtggtgaattcatgggagatgcagaaggaagaaaaaaagcagcaagaggctacagcagagcaggagaacaagaggtacgagaacgagtacgagcgcgcccgccgcgaagctctggaacgcatgaaggccgaggaggagagaagactgtcacggaccgatggccacaagagaaatccatag

SEQ ID NO: 17817 - DNA, 1497 bp, Artificial Sequence
  Description of Artificial Sequence: Synthetic coding sequence
atggcactcccaacattaccttcctattggtgcagccaacaacgattaaaccaacaactggccagacagagggaacaggaagctagattgcggcagcaatgggagcagaacagcagatacttccgtatgtcagacatctgctccagcaagcaggcagaatggagttcaaaaacctcataccagcgcagcatgcacgcctatcaaagggaaaagatgaaagaagaaaaacggagaagcctggaagctaggcgagaaaaactaaggcaactgatgcaagaggagcaggacctattagctcgggagttggaagagctgcgtctgagtatgaacctgcaggaaagacgcatcagagaacaacacggaaagctcaagtctgcaaaggaagagcagcggaagctcatagccgaacaattattatatgaacattggaagaaaaacaaccccaaactcagagagatggaactggatctccaccagaaacatgtagtgaactcttgggagatgcagaaagaggagaaaaagcagcaggaggctaccgctgaacaggagaataaaagatatgaaaacgagtacgagagggccaggcgagaagcattagaacgcatgaaggccgaggaagagcgaagacagttggaagacaagttgcaggccgaggcactgttgcagcagatggaagagcttaagctgaaagaagtggaagccacaaagctcaagaaggagcaggagaatctattgaagcagaggtgggaactcgagcgtcttgaagaggagcgtaaacagatggaagcctttcggcagaaggctgagctggggagattccttcgccatcaatacaatgctcagctatcacggcggactcagcaaattcaagaagaattggaggcagaccgtcgcatcctgcaagctttgttggaaaaagaggacgaaagccaaaggctgcacctcgctagaagagagcaggtgatggccgatgtggcctggatgaagcaagccatagaagagcagttacaactagagcgggcaagggaagctgagttgcagatgttactccgtgaagaagccaaggagatgtgggagaagcgcgaagctgagtgggcacgggagcggagcgcccgcgataggttgatgagcgaggtgctgactggacggcaacagcaaattcaggagaaaatcgagcaaaaccgccgtgcccaggaagaaagtctcaagcaccgggaacagctgattaggaatctggaagaggtgcgggaactcgcacgacgcgagaaagaagaatccgagaagctcaaatctgccagaaagcaggaactcgaagctcaggttgcggagagacggcttcaggcttgggaagcggaccagcaggaagaagaggaggaagaggaagccaggcgcgttgagcagctgtcagacgcactacttcaacaggaagcagaaacaatggcggaacaaggatacagacctaagccatacggacacccaaagatcgcatggaattag

SEQ ID NO: 17818 - DNA, 3090 bp, Artificial Sequence
  Description of Artificial Sequence: Synthetic coding sequence
atgcagactaatgaaggagaggtcagtgaggagagctcttccaaggtggaacaggaggacttcgtcatggaagggcacggcaagaccccgcctcccggcgaggagagtaagcaggagaaggaacaggagagagaagagcagctgatggaggataagaaacggaaaaaagaagataaaaagaaaaaagaggctactcagaaagttacggagcagaaaactaaagttcccgaggtcactaagccaagtcttagtcaacctaccgccgcaagccccatcggttcctccccctctccccccgtgaatggcgggaacaacgccaagagggtagctgttcctaatggtcagcctccttccgcggcccgatacatgcccagagaggtacccccccgctttcgctgccagcaggaccacaaagtgctgctgaagcggggtcagcctccacctccatcctgcatgctgcttggggggggcgctggacctccaccttgtaccgcccccggcgctaaccctaataacgcacaagtcactggagcgctgctgcagagtgagtctggtacggctcccgtctggtccaaatctaccccccccgcaccagacaacgggacttccgcctggggagagccgaacgaatcaagtcccggctggggggaaatggacgacacaggagcctctactaccggctggggtaataccccggccaatgcgcccaacgcaatgaaacccaattccaaatccatgcaggatgggtggggggagtccgacggaccagtcacaggcgccagacatccaagttgggaagaggaagaagacgggggagtgtggaacactacgggttctcaaggaagcgcctcatcacataactcagctagctgggggcagggcgggaagaagcagatgaagtgttccctcaaaggcggtaacaacgattcctggatgaacccgctggctaagcagttttctaatatgggcctgctcagccagaccgaggacaatccatccagcaagatggatctcagcgtgggctcattgtcagacaagaagtttgacgtcgataagagggcaatgaacctgggagattttaacgatataatgcgaaaggatcggtccgggtttcgcccccctaactccaaggatatgggcactacggacagcggtccgtatttcgagaaaggcgggagtcatggcctgttcggtaatagcacagcccagtctcgaggcctgcatacacccgtccaacctctcaattcgtctccctccctgcgggcccaggtgccgccgcagtttatctcaccccaagtcagcgccagtatgctgaagcaattccctaattctggattgtctcccggtttgtttaatgtggggccgcagctttctccgcagcagattgctatgctgtcccaactgccccaaatccctcagtttcagctggcatgccagctgttgttacagcagcagcagcagcaacagctgctgcaaaaccagaggaaaatctcccaggctgtgagacaacagcaagaacagcaactcgcaagaatggtctccgctctgcagcagcaacagcaacagcagcaaagacagccaggaatgaaacactcaccttcacatccagtgggtcctaaacctcacctggataacatggtccctaatgcactgaacgtgggactgcctgatctacagaccaaggggccaattcccggatatgggtctggattctcctcaggtggcatggattatggcatggtcggtggaaaagaggccggcaccgagtcccgctttaagcagtggacttcaatgatggaaggcctcccttctgtggcaactcaagaggctaacatgcataagaacggggctattgtggctcctggaaaaacgagggggggttcaccgtataaccagtttgatattatccctggagacactcttgggggacacactggcccagctggtgattcttggctgccagccaaaagcccccccaccaataaaatcggctcaaagtcatcaaacgcctcctggccccctgagttccagcctggagttccttggaagggcatccagaatattgaccccgaaagcgacccatacgtgacccctggctcagtgctcggcggcactgccacgtcccctattgtcgacaccgatcaccagctactgagagacaacactaccggctctaactcatccctgaatacgtccctgccatctccaggagcctggccttattcggcaagcgacaacagctttaccaacgttcactctacgtctgctaaatttcccgattacaagtctacctggtcgccggatccaatcggccataatcccactcacctttcaaataagatgtggaagaatcatataagcagtcgcaacactacacctttgccccgccctccaccaggattgactaatcccaagccctctagcccttggtctagcactgctcccaggagcgtgcgcggttggggcacccaagattcccgattggcctccgctagtacgtggtccgacggcggaagcgtcagaccctcgtactggttggtattgcacaatttgacaccacagatcgacggctccacactgcgtaccatctgtatgcagcacggccctctgctgacattccacttgaatttgacacagggaacggccctcatccgatattcaactaagcaggaagcagctaaagcacaaacagccttgcatatgtgcgtattaggaaacaccacaattcttgctgaatttgccaccgatgatgaggtctcccgttttctggcacaagcccagccgccgacacccgccgctacaccatccgcccctgccgccggatggcagtcactcgagaccggacagaaccaatctgaccctgtagggccagccctaaatttatttggcggatctaccggcctgggccagtggagctcctccgctgggggcagcagtggagcggatctggcaggggcctccctgtgggggcctcccaattattcttcctccctgtggggcgtccccactgtcgaagacccacacaggatgggatcgcctgctcccctcttaccaggagatttgctgggtggaggcagcgattctatatag

SEQ ID NO: 17819 - DNA, 5172 bp, Artificial Sequence
  Description of Artificial Sequence: Synthetic coding sequence
atgcgagagaaagagcaggaaagggaagagcagttaatggaggacaagaaaagaaaaaaagaggacaagaaaaaaaaagaggcaacacagaaggtgacagagcaaaagacaaaggtgcccgaggtcaccaagccaagcttgtcccagcccaccgctgcttctccaattggcagctctccatccccacctgttaatgggggcaataacgccaaaagggtcgccgtcccaaacggtcagcctcctagtgctgctcggtatatgccccgcgaggtacctccgcggtttcggtgtcagcaagaccacaaagtgctgttaaagcgcggacagccgccacctccgtcatgtatgctgttgggtggcggagccggaccccctccctgtacagcccccggagctaatcctaacaacgcccaagtaaccggagcattacttcaatctgaatcaggcactgcaccagactctacgcttggtggcgctgccgcttcgaattatgccaattctacatgggggagcggcgcctccagcaataatgggacctcaccaaatcctattcatatatgggataaagtgattgtcgatgggagcgacatggaagaatggccatgcattgcatctaaagatacagaatcctcatccgaaaacaccacggacaacaattccgctagtaacccaggatcagagaagagtacgctgccgggttcaacgacctccaacaagggcaagggatcgcaatgccaaagtgcctcttctggaaacgagtgcaacttgggcgtatggaaatcagatcctaaagccaaaagtgtccaatctagtaactccaccaccgagaataacaatggcttgggcaactggaggaacgtcagtggccaggacaggattggtccaggctcagggttcagcaattttaatccaaattcaaatcctagtgcttggcccgcattggtgcaggaaggaacttcccgcaagggagccctagagaccgataacagcaactcttccgcgcaggtaagcactgtgggccagacctctcgggagcaacagagcaaaatggagaacgcgggcgtcaacttcgtggtaagcggacgggaacaagcccagatccataataccgatggcccaaagaatgggaacaccaactcccttaacctgagctcccctaatcccatggagaacaaaggcatgccattcggcatgggcttagggaacacatcgaggtcgacggatgcaccaagccaatctactggagaccgcaagactggaagcgtggggtcttggggagcggctcgaggaccgagcgggacagacacagtttctggccagtccaacagcggcaataatggcaacaacggaaaagagagggaggactcatggaagggagcatccgtgcagaaatcaacgggctctaagaacgattcctgggataacaacaatcgctctactggaggctcgtggaactttggccctcaggacagcaacgacaataagtggggcgaaggcaataagatgacttccggggtttcccagggcgagtggaagcagccaactggaagcgacgagctgaaaatcggcgagtggtccggaccgaatcagccaaattcctccacaggggcctgggataatcagaaaggccaccctttgcccgaaaaccaaggcaatgctcaggccccgtgctggggaagaagcagctcatctaccggctccgaagtgggcggccagtcaaccggcagcaaccacaaggcagggtctagcgacagccataactcgggccggagatcttatagaccgacccatcccgattgccaggccgttctgcagaccctcctttcacgaacagacctggacccccgggttctgtcaaatactggctggggccagacccaaatcaagcaggatactgtttgggatatagaagaagttccacgtccagagggcaagtctgataagggtacagaaggctgggaaagtgccgcaactcaaaccaaaaattctgggggctggggtgatgccccgtcccagtcgaatcagatgaaatcgggctggggcgaattatccgcttcgacagaatggaaagacccaaagaatactggaggttggaatgattacaagaataacaatagctccaactggggaggcggccggcctgatgaaaagaccccatccagctggaacgaaaatccatctaaagatcaagggtggggcggcggcagacagcccaaccagggctggagtagtggaaaaaacggctggggagaagaggtggaccagaccaaaaatagtaactgggagtcctcggcctccaagcctgtgtcaggctggggagaggggggccagaacgagatcggaacatggggaaacggtggcaatgcatccctcgccagcaaaggcggctgggaggactgcaaacggagccctgcttggaacgagaccggtaggcagcctaattcctggaacaagcagcatcagcagcaacagccccctcagcaacctccaccaccgcagccggaggcttcaggatcctggggcgggccacctccaccgccccccggtaacgtacggcctagtaatagctcctggtcctctggcccccagcctgccacccctaaggacgaagagccgtctggttgggaagagccttccccgcaatctattagccgaaagatggatattgatgacggaacatccgcctggggtgatccaaattcttataattataaaaatgttaatctctgggacaagaatagccaagggggaccagccccgcgagagccaaatctgcccacacccatgacatccaagtctgccagcgattccaagtccatgcaggatggttggggcgagagcgacgggccagtgaccggagcgcgacatcctagctgggaggaagaagaggatggcggtgtatggaataccaccggctcccaaggcagtgccagttcccataacagcgcaagctggggccagggcggcaagaagcagatgaaatgtagcctgaagggcggcaacaatgattcttggatgaaccctctggctaaacagttctccaatatgggccttttaagccaaactgaggataacccttcgtctaaaatggacctgagtgtgggatctctttccgataaaaaatttgatgtcgataagcgagctatgaacctaggcgatttcaatgatattatgcggaaggacaggagcggctttaggcctccaaattcaaaggacatgggcaccaccgatagtggaccttatttcgagaagggcggttcacacggactctttggcaacagtaccgcgcagtcacggggacttcacactccggtgcaaccactgaattcgtccccaagcctccgtgctcaggtacccccacaatttataagcccccaggtgtcagcctctatgctcaagcagtttccaaattctggtctcagtcctggactttttaacgtgggcccacagttgtcaccccaacaaattgcaatgctgtcccagctcccccagatccctcagttccagctcgcctgccagctgttgctgcagcagcagcaacagcagcagcttctgcaaaatcagcgcaagatttcccaggccgtcagacagcagcaggagcagcagctggctcgtatggtctccgctctacaacagcaacagcagcagcaacaacgacagccaggtatgaaacacagcccatctcatccggttggccctaaacctcacctggataacatggtgccgaacgcgctcaatgttgggctgcctgatttgcagacaaagggtcctattccaggctatggctcaggtttctcctctggaggaatggactacggcatggtgggcgggaaagaggccgggaccgagtctcgatttaaacagtggaccagcatgatggagggcctgcccagcgtggccacgcaggaggccaacatgcacaagaatggggctatagtggccccgggcaaaactaggggaggatctccttataaccaatttgatatcatccctggggatactcttggcgggcacacggggccagctggcgacagttggttgcccgctaaatccccgcctacaaacaaaattggatccaaaagttctaatgcttcctggccacctgagttccagcctggcgtgccgtggaaaggaatccagaatatagaccctgaaagcgacccctatgtgactccaggtagcgtactcggaggcaccgctacatccccaattgtagacacagatcatcaactccttcgggacaatacgactggctcaaatagttctctgaatactagcctcccgtcacccggggcttggccgtactccgcctccgataattcattcacaaatgtgcacagtacatccgctaagtttccagactataagagcacctggtcgccggacccaattggacacaaccccacccatctgagcaataagatgtggaaaaatcacatctctagccggaataccacccccctgccacgcccgcctcccgggttgacaaatcccaaaccatcgagcccttggagtagcaccgccccccgttcagtgagaggttggggaactcaggattcacgcctggcaagcgcctcaacttggagtgacggggggtccgtgcgccctagctactggcttgtgttgcataatctaacaccccagatcgatgggtctactctgcgcacaatctgcatgcagcacgggcctctgttaactttccatctgaacctgacacaggggactgccctgatcaggtattcaaccaaacaggaggcagccaaagcacagaccgcccttcatatgtgtgtcctgggaaacacgactattctggctgaatttgccactgatgatgaggtaagtagatttttggcacaggcgcagccgcccacccctgccgcaacgccttctgccccagccgcgggctggcagtccctggagacgggccagaatcagagcgacccggtcggccctgccctgaatctattcggcggatccaccggcctgggccagtggtcctcctcagcgggtggctcctctggcgctgatttggcaggcgctagcctgtggggccctcccaattattctagctcgctttggggagtgccaactgtcgaggacccccaccgtatgggcagcccagctccgttgctgccgggagatctgctcgggggcggttccgactctatatag

SEQ ID NO: 17820 - DNA, 5172 bp, Artificial Sequence
  Description of Artificial Sequence: Synthetic coding sequence
atgagggagaaagagcaggaaagagaggaacaactgatggaggataaaaaaagaaaaaaagaagacaagaagaaaaaagaggccactcagaagcattcaaatcaaaagactgctatgcctgaggtgaccaagcccagcctgagtcagcctactgccgctagtcccatcggctcttcaccgtccccgccggtcaatggaggaaacaacgctaagcgggttgccgtgcctaacggccaaccccccagcgctgcacggtacatgccaagggaggtgcccccccgctttcgatgccagcaggaccacaaggtgctgttgaaacggggtcagccaccccctccatcctgtatgcttctcggaggaggggccggcccacccccctgcactgcccccggcgctaaccctaacaatgcccaagtcacgggcgccttactccagtctgaaagcggcactgcaccagattctacactggggggtgccgccgcgagcaactacgccaattccacctggggctctggagcctcatctaataacggcactagccctaaccccatccatatctgggacaaggtcatcgtggatgggagcgatatggaggagtggccctgtattgcaagtaaggacaccgagtcaagcagtgaaaacactacggataacaattctgcctccaatcccggttcagagaagtctacactgccgggatctactactagtaataaaggaaaaggctcccagtgtcagtctgcaagctctggcaacgaatgtaatctgggagtgtggaagtctgaccctaaagctaaatccgtacaatctagcaactccacaaccgaaaacaacaacggtctgggcaactggcggaacgtgtccgggcaggaccggatagggcccgggtcaggcttctcaaatttcaacccgaatagcaatccctctgcatggccagcactcgtgcaggagggcacgtcccgtaagggcgccctagaaacagataactctaattcctcagctcaggtgtctacagttgggcagacgtctcgcgagcagcagtctaagatggagaacgcgggagtgaactttgtggtgtcagggagagaacaggcccagattcacaataccgacggaccgaaaaacggcaacaccaactccctcaatctctctagtccgaatccaatggagaataaagggatgcctttcggaatgggccttggaaacacctctagatcgacggatgcgcctagtcaaagcacaggggatcgtaaaacaggttctgtgggaagctggggtgcggctagaggaccctccggaactgacactgtgtcaggacaaagcaattccggcaacaacggcaacaacggcaaagagagggaagattcttggaaaggcgcttcagttcagaagtccacgggctctaaaaatgacagctgggataacaacaaccgatctacgggtggctcttggaactttggaccacaagactctaacgataataaatggggcgaaggaaacaagatgacctctggggtgagtcaaggcgagtggaaacagcctacaggatccgacgagctaaaaataggagagtggtcggggcctaatcagccgaattccagcaccggtgcctgggataaccagaaagggcacccactaccagaaaaccagggtaatgctcaggctccatgctggggccgctccagtagctccacagggtcagaggtgggcgggcagtctacaggcagtaatcacaaagctggttcttcagattcccataactccggacgcagaagctaccgaccaactcaccctgactgccaggcagttcttcagacactcttgagccgtaccgatctggatccacgtgtgctcagcaacaccggttggggacagacacaaattaagcaagataccgtgtgggacatcgaagaagttcctaggccggagggcaaatctgataagggtaccgagggctgggaaagtgctgccacacagacaaaaaacagcggcggctggggagacgcaccatcccagtctaaccagatgaaatcaggctggggcgagctgtctgcctccaccgaatggaaggatcccaagaacactggtgggtggaatgattacaagaacaataactcatcgaattgggggggggggcggcctgatgagaaaacccccagcagttggaacgaaaatccctctaaggatcaaggctggggcggcggaagacagcctaaccaagggtggagttccgggaagaacgggtggggtgaagaggttgaccaaacaaagaattctaactgggaaagttcagcatcaaagcccgtttccggatggggggagggagggcagaatgaaattggaacgtggggaaatggcgggaacgctagtctggcctcaaagggcgggtgggaggactgcaaacggtcacccgcctggaacgagactggacggcagcccaatagttggaataaacaacatcagcaacagcagcctccccagcagcctccacctcctcagcccgaagcctccggaagctggggcggcccaccacctcccccacctggcaatgtaaggccatccaattcaagctggtcctctggacctcagcctgctactccaaaggatgaggaaccttctggctgggaagaaccatcccctcaaagcatctcaagaaaaatggacatcgacgacggaaccagcgcgtggggcgaccccaattcgtacaactacaaaaatgtcaacctctgggataaaaattcccagggcggtccagcccccagggaaccgaaccttcctacgccaatgacgtccaagagtgccagcgattcaaaatccatgcaggatggctggggggagagtgatggacctgtaaccggggctaggcacccatcgtgggaagaggaagaggatgggggggtttggaatacaaccggttcccaggggtctgcctctagccataatagcgccagttggggacagggaggaaagaagcaaatgaaatgttccttgaaagggggaaataatgactcctggatgaatccgctcgcaaagcagttcagcaacatggggttgctgtctcaaaccgaggacaaccccagttccaaaatggacctttctgttggatccctgagcgacaagaaattcgatgttgacaaaagggccatgaacctgggagattttaacgacatcatgcggaaggacagatctggatttagaccaccgaacagtaaagatatgggcactacagactcggggccttattttgagaaagggggctctcatgggttattcggcaactccaccgcacagtccagaggtctgcacacccctgtgcaacccttaaacagctcacctagtctgcgggctcaggtgccgcctcaattcatcagcccccaggtatcggccagtatgctgaaacagttccccaactctggtctaagcccaggcctgtttaacgtgggaccgcaattgagccctcagcaaattgccatgctcagtcagctcccccagattccccaattccagctagcttgtcagcttctcctgcagcagcagcagcagcagcagcttctccagaaccagaggaagatcagccaggccgtaagacagcaacaggagcagcagctggctcggatggtgtctgcactgcaacagcagcagcagcagcagcagcggcaaccggggatgaagcactcccctagtcaccccgtggggccgaaaccccacctggataacatggttccaaacgcactcaacgtgggtttacctgatctgcagactaagggcccaatccccgggtatggcagtggcttctcctcaggggggatggattacggtatggtcggcggcaaggaggcagggactgaaagtcgttttaaacaatggacttcaatgatggagggactgccttccgttgccacacaggaggctaatatgcacaagaacggggctattgtggcccctggaaaaacacgtggcgggtcgccttataatcagttcgacatcattccaggcgatacacttgggggccacacgggccccgcaggagactcttggctcccggccaaatctcccccaaccaacaaaataggttccaagagtagcaatgctagttggcctcccgagtttcagccaggagtcccgtggaaaggaatccagaacattgaccccgaatccgatccatacgtgacgcccggaagtgtcctgggagggactgccacttcacccattgttgacactgatcaccagcttctgcgggataacacaactgggagtaactcatcactaaatacttctctgccaagtcccggcgcgtggccgtactccgcctctgacaacagttttaccaacgtacacagcacttcagccaagttcccagactacaaatctacatggtcgcccgatccgatcgggcacaacccgactcatctgagcaataagatgtggaagaaccacatctcgtccagaaacactacccctcttcctcggccaccacccggactgaccaaccccaaaccatcgagcccatggtcttccaccgccccacgctctgtgaggggatggggcactcaggattctcgtctagcctccgcctctacttggagcgacggcggctcggtacgaccttcctactggctggtgcttcacaatctcactccacagatcgatggatctacactgcgcactatctgcatgcagcatggcccacttctgacctttcacttgaatctgacccaggggactgcactgatccgttactccacaaagcaggaagctgcaaaagcgcagaccgccctgcatatgtgtgtcctgggcaatacaacaattctggcagaattcgcgacagacgacgaagtctcaaggttcctggcccaggcccagcccccaacaccggctgcaaccccctccgcaccagcagccgggtggcagtctttggagacagggcagaaccagagcgaccccgtggggcctgccttgaatctgttcggcggttccactggcctgggtcagtggagcagctcagccggaggttcctccggggctgacctagcaggtgcttccctttgggggccaccgaactactcgtctagcctctggggagtgccaactgtggaagatcctcaccgaatgggcagtccggcccctttactgcccggggacctgttaggcggcggaagcgatagtatttag

SEQ ID NO: 17821 - DNA, 3090 bp, Artificial Sequence
  Description of Artificial Sequence: Synthetic coding sequence
atgcagaccaatgagggcgaggtatctgaagagtctagtagcaaagtggaacaggaggacttcgtgatggaggggcacggaaagacaccccccccaggcgaggagagcaaacaggagaaggaacaggagagagaggagcagttgatggaggacaagaaacggaaaaaggaggataagaagaagaaagaagccactcaaaaggtcaccgaacagaagacgaaggtgcctgaagtgacgaagccatctctgtcgcagccaactgcagcaagcccgatcggttctagtcctagcccgccagtcaatggggggaacaacgcgaagagggtggctgttcctaatgggcagccaccaagtgctgcccgttacatgcccagagaagtgccgcctcggtttagatgtcagcaggaccataaggtccttctgaagcgcggccagcctcctcctcccagttgcatgttactcggtggtggagcaggtccccccccctgcacggcgccgggtgcaaacccaaacaacgctcaggtgacaggcgctcttttgcagagcgaatcaggaacagcaccggtctggagcaaaagcaccccacctgcccctgacaacggtacctccgcttggggcgagcccaacgagtcttccccgggatggggggagatggacgacactggcgccagcactacagggtggggcaataccccagccaatgcacccaacgccatgaaacccaacagcaaaagcatgcaggatggctggggagaatctgacggtccagttacgggggcccggcatccttcttgggaggaagaggaagatggtggagtctggaatactaccgggtctcagggttctgcatcatctcataacagtgccagctgggggcagggtggaaaaaagcagatgaagtgctctttaaaaggcgggaacaacgactcatggatgaacccgctcgccaagcagttctctaacatgggcctgctttcccaaaccgaggataatccatcctcaaagatggatctctcagtcgggagcctctcggataaaaaattcgacgtggacaagcgagcaatgaaccttggcgattttaatgacatcatgcgtaaagataggtcaggctttaggccacctaactcaaaggatatgggaactactgactccggtccgtactttgagaagggaggatcgcacgggctgttcggcaatagcacagcccaatctaggggtctccacactcccgtgcaaccgctcaatagtagccccagcctgagggctcaagtgccaccgcaatttatcagtcctcaggtaagcgcatccatgctgaagcagtttcctaattcgggtctgtcaccaggattgtttaatgtgggcccccagctctcacctcagcagatcgcgatgctgtcccagctccctcagatcccacaattccagttggcctgccaactgttgctgcagcagcagcagcagcagcagctgttgcagaaccaaaggaagataagccaggctgtgcgccagcagcaggaacaacagctggcgcgtatggtgtctgcactgcagcagcagcagcagcagcagcagcgccagcccgggatgaagcatagccccagccaccctgtgggacccaaacctcacctcgacaatatggttccaaacgcactaaacgtgggcctcccagatttgcaaaccaagggacccattccagggtatggctcaggcttctccagcggcggtatggattacggcatggtaggtgggaaagaggctggaactgagagtaggtttaagcagtggactagcatgatggaaggactgccaagcgtcgctacccaggaggcaaatatgcacaaaaatggtgctatcgttgccccgggcaaaacacgggggggtagcccctacaaccagttcgatataatacccggtgatacacttgggggtcacacaggcccagcaggagattcctggctcccggcgaagtcccctcctaccaataagataggttccaaaagttctaatgctagctggccaccagagttccagcctggagtcccatggaagggtattcagaacatagaccctgagtccgatccatacgtgacacctgggtcagtgctgggtggaacggccacttcccctatagtcgacacggaccaccagctcctgcgggataacaccaccggctccaattcgtcactgaacaccagccttccctccccaggagcctggccctacagcgcaagtgataactcttttacgaacgtgcatagcacatccgcaaagttccctgactacaagtccacatggagccctgatcctatcggtcataatccgacccatctgtctaacaagatgtggaagaatcatatctctagcaggaatactactcccttgccccggccaccacccggacttaccaatccaaagccaagctcaccgtggagcagcaccgcaccgcgctcagtgcggggatggggcactcaggatagtcgactagcaagcgcctctacctggagtgatggcgggagtgtaagaccatcatactggctagtgctgcataacctcacaccgcagatagatggttcgacgctccgaaccatatgtatgcagcacggcccattactcaccttccacctcaaccttacccagggcaccgcgttgatccgatacagtacaaaacaagaggctgccaaggcacagactgccctgcacatgtgcgttcttggcaatactacgatcctggccgagttcgctacagatgacgaagtttctagatttctagcccaggcacagccacctacccctgcagccacccctagcgcccctgccgccgggtggcaatctctcgagactgggcagaaccaatcagatcctgtgggccccgcactcaacctgtttggaggctcaacaggactgggccagtggtctagcagcgctggcggttcatccggagctgacctggctggcgcctcgctgtggggaccccccaattattctagtagtctgtggggcgtgcctactgttgaagacccgcaccgtatggggtcacccgctccactgttgcccggcgacctgctaggcggcggcagcgactctatttag

SEQ ID NO: 17822 - DNA, 114 bp, Artificial Sequence
  Description of Artificial Sequence: Synthetic coding sequence
atgcagacaaacgagggggaggtctctgaggagtcatcatccaaggtggagcaagaggatttcgttatggagggtcacggaaagactcctccaccgggcgaagagtctaagtag

SEQ ID NO: 17823 - DNA, 5502 bp, Artificial Sequence
  Description of Artificial Sequence: Synthetic coding sequence
atgagagagaaggagcaagagcgagaggagcagctcatggaggataaaaaacgcaaaaaagaagacaagaaaaaaaaggaagcaactcagaaagtgactgagcagaaaactaaggttcccgaagtcaccaaacccagtctgagccaaccgacagccgcatcaccaatcggatcatctccgagtccgccagtgaatggcgggaacaacgccaaaagggtggccgtgcctaacgggcagcccccttcggccgcgaggtacatgccaagagaggtgcccccccgcttccggtgccaacaggatcataaagtgctcttgaagcgcgggcagccgcccccgcccagctgtatgttactgggggggggggccggtccgcctccttgtacggctcctggggctaatcccaataatgcacaggtgaccggtgccctgttgcaaagcgaatcaggaactgcccccgatagtacactgggaggagctgccgcgagcaattatgccaacagtacctggggcagtggagcttcgtccaacaatggcactagtccgaaccccatacacatttgggataaagtgatcgtggatggttctgatatggaggagtggccttgtatcgcgtcgaaggataccgagtcctccagtgagaacacaaccgataataattctgccagtaaccctggaagtgagaagtcaacactgccggggtccaccacctctaataagggaaaagggtctcagtgtcaatcagccagctcaggaaatgaatgcaaccttggcgtttggaagagcgaccccaaagccaagtccgtgcagagcagcaactccactacagagaacaataacgggttgggtaattggcggaatgtgtctgggcaggacagaattggccctggcagcggcttctccaatttcaaccctaattccaacccttcagcctggccagctctcgtgcaagagggcacgagcagaaaaggggctcttgagacagacaactcaaatagttccgctcaagtcagtaccgtggggcagacctctcgggagcagcagtcgaagatggagaatgcgggagtgaatttcgtggtgtcaggccgcgaacaggcacagatccacaataccgacgggcctaagaacggaaacaccaactccctgaacctcagttctcctaacccaatggagaacaagggcatgccctttggaatggggttgggtaacacatccagaagcaccgacgcaccatctcagtctacaggcgaccgaaagacaggctccgtaggaagctggggcgcggcgagagggccctccggaaccgataccgtgtccggacaatccaactccggcaataacgggaataacgggaaggagcgcgaagactcttggaagggcgcatctgtacaaaagtccacggggtccaaaaacgattcctgggacaacaacaaccgctctactggtggttcatggaattttggccctcaggacagtaatgacaacaaatggggggagggcaacaagatgacctcaggcgtgtcccagggtgaatggaaacagccgactggttctgatgaattgaagatcggggaatggagtggacctaatcaaccgaatagtagtactggagcatgggataaccagaagggccaccccctgccagaaaatcaaggcaacgcccaagcgccctgctggggcaggagcagtagctcaactggcagtgaggtaggggggcagtctaccggctctaaccacaaagccggctcctctgatagccacaactctgggaggagatcttatagacccactcaccccgactgccaggccgtcttacagactttgctgagccgcacggacctggatcctagagtcctgtctaacacaggctgggggcagactcaaataaagcaggacaccgtttgggacatcgaagaggtgcctcgccctgagggaaaaagcgataagggaactgagggttgggagtccgcggcaacccagactaaaaactcgggcggctggggtgacgccccatcccagtccaatcagatgaagtcaggctggggcgaattgtctgcctccactgagtggaaggatcccaaaaataccggcggatggaacgattacaaaaataataactcatctaattgggggggcggccggcctgatgaaaaaacgccttcctcatggaatgaaaatccgagcaaagaccagggttggggggggggccggcagccgaaccagggctggtctagcggtaagaacggctggggcgaagaagtagatcagacaaagaattcaaattgggagagctcagcctcaaaaccagtaagcgggtggggcgaaggcgggcagaacgagattggcacctggggaaacggcggcaacgctagcctcgcttctaaaggcgggtgggaggattgtaagaggagcccagcttggaacgaaactgggcgccagccaaacagttggaataaacagcaccagcagcagcagccacctcagcagcccccacccccacagccagaagcctccggatcttggggtggccctccacctccccctccaggtaacgttcgaccatctaactcttcttggtcctcaggcccacagcccgccaccccaaaagacgaggagccgagcggatgggaggaaccttcaccccagtcaatatcaagaaaaatggacatcgatgacggaacttcagcctggggcgatccaaattcctacaactacaaaaatgtaaacctgtgggacaaaaattcccaggggggcccagccccacgcgagcccaatctcccaacacctatgacgtcaaaatctgcatccgtctggtcgaagtctaccccacctgcaccagataatggaacctccgcctggggcgaacctaatgagtcatcacccggatggggcgagatggatgatacaggggcatcgaccacaggatgggggaatactcccgcgaacgctcctaacgccatgaagccaaatagtaagtccatgcaggacgggtggggggagagcgatggtcctgtgaccggggctcgccacccttcctgggaggaagaggaagatggcggcgtgtggaacaccaccgggagtcagggcagcgctagctcccataactctgcctcttggggtcaagggggcaaaaaacagatgaagtgtagcctgaaggggggcaataacgacagttggatgaaccctctggcgaaacagttcagcaacatgggattattatcccaaacagaggacaatccctctagcaaaatggatttgtcagtaggctccctgtctgataagaagttcgacgtcgataagagagccatgaatctgggagacttcaacgatatcatgcgcaaagacaggtctgggtttcgcccgccaaactcaaaggacatggggaccactgatagcgggccgtactttgagaaactgaccctgccattctcgaatcaggacgggtgtttgggtgatgaagccccctgttccccattcagccctagcccatcttacaaattgagccccagcgggagcaccctgcccaacgtgtccctgggcgcaatcggaacaggtctcaatcctcagaactttgccgctagacaaggtggctcccacggcctatttggaaattccaccgcccagtctcgcggcttacataccccagtgcagcctctgaactccagcccctctctcagggcacaggtccccccacagttcatttcgccacaggtctcagcctcaatgcttaaacagttccctaattccgggttgagccctggtctcttcaacgtaggccctcaactgtcgccacagcagatcgccatgctcagccagttgccccagattccacagtttcagctggcctgtcaactcctgctgcagcagcagcagcagcagcagctactgcaaaaccagcgaaagatttcccaggctgtgcggcagcagcaggagcaacagttggctcgcatggtttctgccctccagcagcaacagcagcaacagcaacggcaacctggcatgaaacacagcccttcgcaccccgtcggacctaagccccatctcgacaatatggtgccaaacgcgctgaacgtgggcctcccagatctgcagacgaaaggacccatcccaggctacggaagtggctttagctctggggggatggattacgggatggttggcggaaaagaagcaggaactgaaagccgattcaaacagtggacatcgatgatggaagggcttccctctgtggctacccaggaagccaacatgcacaaaaacggagctatcgtagcccctggaaaaacccgcgggggctccccctataatcagtttgatattattcccggagacaccttgggcggccatactggtcccgctggtgactcatggctcccagctaaaagcccaccgaccaacaaaattggcagcaaaagtagcaacgctagctggcctccggaattccaaccgggcgttccctggaagggaatccagaacatagaccctgaatccgacccatacgttacccctggctccgtgctcggcgggaccgccacttctccaattgtggacaccgaccatcagctgctgagagataacactactgggtcaaactcctctctaaatacatctttacctagtccgggcgcctggccttactccgcctctgacaattctttcacaaacgtccatagcaccagcgcaaaattccctgattacaagtcaacatggtcacctgatcccatcggccacaatccgacacacctttcaaataaaatgtggaaaaaccacatttcttcacggaatacgacccctttgcctagaccaccacccggtttgacaaacccaaagcccagtagtccgtggtcaagtactgccccacgctccgtgagaggatggggtactcaagattcaaggttagcgagcgctagcacctggagcgatggaggatctgtgcggccaagctattggcttgttctccataaccttacccctcagatcgatgggtcaaccctgaggaccatctgcatgcagcacggccctttactcaccttccacctgaacctcacacaggggaccgctctaatccgctacagcactaaacaggaggccgccaaggcccagacggccctccacatgtgcgtcctgggtaatacaactatcctggccgagtttgcaacggacgatgaggtgtcaagatttcttgcgcaagctcagcccccaacccccgcggcaaccccctcagctcctgccgctggatggcagagcctggaaacaggtcagaatcaatccgaccctgtgggtcctgccttgaacttgtttggcggctcgaccgggctgggccagtggtcttcaagtgctggaggcagcagcggcgcggatctggccggagcctcactgtggggcccccctaactacagctcttctttatggggggttcccaccgttgaagatccgcacaggatgggaagccctgcaccactccttccaggggatttgctcggcggtggctcggactcgatctag

SEQ ID NO: 17824 - DNA, 3153 bp, Artificial Sequence
  Description of Artificial Sequence: Synthetic coding sequence
atggaagtcgcagtcgagaaggccgttgcagccgccgccgccgcgtctgctgcggctagcggaggtccaagtgcagcaccatctggggagaacgaggccgaatcccggcaaggaccagactccgagcgaggtggagaggcggccagactgaatctattagacacgtgcgccgtatgtcaccagaacatccagtccagggcccccaagttactgccctgtttacactcattctgtcagagatgtctcccggccccacagcggtacttgatgttgcctgcccctatgctcggatcagctgaaacacccccccccgtgcccgcacctgggagccctgtatctggtagtagcccattcgcaactcaagtgggagtgatcaggtgcccagtttgctcgcaggaatgtgctgagcgccacattattgacaactttttcgtaaaagacactacagaggtgccctcctccacggtggaaaagagtaatcaggtgtgtacgtcgtgtgaggataacgccgaagccaatggcttctgcgtggagtgtgtagagtggctgtgtaagacttgcattcgcgctcatcagcgggtgaaattcactaaagatcacacagtgcgccagaaagaggaagtgagccctgaggccgttggtgtaacaagtcaacggcctgtgttctgtccattccacaaaaaggagcaactgaagctgtactgcgagacatgcgataagctgacttgtagagactgccagctgttggaacataaggaacatagataccaattcatcgaagaggcctttcaaaaccaaaaggtcattatcgatacgctcatcacaaagcttatggagaagactaagtacattaaatttaccggcaaccagatccaaaacaggattattgaagtcaaccagaatcagaagcaggtcgaacaggacataaaagttgcaatttttaccttgatggtggaaattaataaaaagggtaaggccctgttacaccagctagagagtctggccaaggaccatcgaatgaagctgatgcagcagcagcaggaggtggcggggctcagtaaacagctggaacacgtaatgcacttttctaaatgggctgtcagcagcggaagcagcacagctctgctgtactccaaaagactgatcacgtaccgcctgaggcaccttctgagagcaaggtgcgatgccagccctgtaaccaacaacaccatccaatttcactgtgatccatcattttgggctcagaatattataaatcttggaagtttagtcatcgaggataaagagtcccagcctcaaatgcccaagcagaacccagttgttgagcagaacagccagccgccatcaggactgtccagtaatcagctgagtaaattcccgacacagatttctctggctcagctccgcctgcagcacatgcagcagcaagtcatggcacagcgccagcaggtgcagagacgccctgctcctgtgggactgcccaatcccaggatgcaggggcctattcaacaaccatctatttcccatcaacagccccctccccggctgatcaattttcaaaatcattctccgaagccgaacggaccagtgctgcctccgcaccctcaacagctgcgctaccctccaaaccaaaatatccccagacaggcaattaagcctaacccactgcagatggcgtttctggcacaacaggctatcaagcaatggcagatctcttcaggccagggaaccccttcaacaaccaatagtacttcttccacccccagttctcccactattacatccgcagctgggtacgatggaaaagcctttggaagtcccatgatcgatcttagcagcccagttggaggttcctacaatcttcctagcttgcccgacatcgactgttcatccactatcatgttagacaatatagtccggaaggataccaacattgaccacggccaaccccgacccccatcaaatcggacagtgcagtcacctaactcttctgtgcctagccctgggttggctggaccagtgactatgacttccgtacatccaccgatcaggtccccttctgcctctagtgtggggagccgtggatcgagcggaagcagcagcaagcctgccggggccgactcaactcacaaagtccctgtagtgatgctcgagccaattcggattaagcaagaaaattcaggcccccctgaaaattatgatttcccagtcgtaatagtgaagcaagagtcagatgaggagtctagaccccaaaacgctaactaccctagatccattcttacttcactgctactcaatagttcccagtcgtccacctcagaagaaacggttttgaggtctgacgccccagattctaccggagaccagccaggacttcatcaggacaacagttccaatggaaagagtgaatggctcgatccaagccagaagtccccacttcacgtgggtgagaccagaaaggaagacgatccgaatgaggattggtgtgccgtgtgtcagaacggtggcgaattactgtgctgcgagaaatgtccaaaagtgttccacctcagctgtcatgtgcctaccctcactaattttccctccggtgagtggatctgcaccttttgccgggatctgagtaaacccgaagtggaatacgactgcgacgcaccaagccataatagcgagaagaaaaagactgaaggtcttgtaaagctgactcctatagacaagcgcaaatgtgaacgcttgctgctgttcctctactgtcacgagatgtccctggccttccaggatcctgtgccacttactgtacccgactattataaaataattaagaaccctatggatttgtcaacaattaagaaacgacttcaggaagactattccatgtactctaaaccggaggattttgtggcagacttccgactgatttttcaaaattgcgctgagttcaacgagccagatagtgaagtagccaatgcaggaatcaaactcgaaaactactttgaggaattgctcaagaacctttacccagagaagcgattccccaaaccagagttcagaaacgaatcagaagataataaattttccgacgattcagacgatgacttcgtgcagccacgaaagaagaggctcaaaagcatcgaggaacggcaactacttaagtag

SEQ ID NO: 17825 - DNA, 1650 bp, Artificial Sequence
  Description of Artificial Sequence: Synthetic coding sequence
atggaaggaccacgatccgctgcctgcagggcgaggcccgcaacgtcaccgggggcagtcgatcttacagctccgccacctcccccacttttacggattctgaattctagggccgctccagcaacccgaaccttcgctgatctctgtagaagtctactgcagcccgagtctcgggtactctgcagactccagcccgtaaattgctatccccccgcggcttccactaagctctgccctgtgggagtgattcggtgtccagtctgtagtcaggaatgtgcggagcgacatattatagacaactttttcgtgaaggatacaactgaggtgccaagctccaccgtggaaaagagcaaccaggtgtgtaccagttgtgaggacaacgctgaggccaacggcttctgtgtcgaatgcgtggagtggctgtgcaagacatgtatccgtgcccatcaacgcgtgaagttcaccaaagatcacactgtgcggcagaaggaggaggtttctccagaagctgtgggcgtgactagccaacggcctgttttttgccccttccacaaaaaggaacagctcaagctgtactgcgaaacatgtgacaaactaacatgccgggactgccagctcctggaacataaagagcataggtatcagtttattgaagaagccttccagaatcagaaagtgattatcgatactctcataaccaagctgatggagaagacaaagtacattaagttcacaggtaatcagattcagaataggatcattgaagtgaaccaaaaccagaaacaggtggaacaagacatcaaagtggccatctttacactgatggtggaaatcaacaaaaaaggcaaggcactcttacaccagctggaatcgctggcaaaagatcatcggatgaaacttatgcagcagcagcaggaagtggcgggactgagcaagcagctggaacatgtgatgcatttctctaagtgggccgtaagcagtgggtcctccaccgccctactctattctaaaaggttgatcacctacaggctcaggcacctgcttcgcgcgaggtgcgatgctagtcccgtaaccaataacacaatccagtttcattgcgacccaagtttctgggcacagaacatcatcaacctcgggagcctggtaatcgaagataaggagtcacagccccagatgccgaagcagaaccccgtggtagaacagaatagccaacctccctctggcctaagcagtaaccagctgagcaaattccctactcagatcagtctggcccagctcaggctgcagcacatgcagcagcagcagccaccacctcggctgattaattttcaaaatcatagcccgaaacccaacggaccagtcttgccaccccacccccagcagctccgatacccgcctaaccaaaacattccaagacaggcaataaagccgaacccgttgcagatggccttcctggcgcaacaggctattaagcagtggcagatttcctccggtcagggaacccccagtacaacccagaacataaacaccgccgcctgcacagtcttcgacgtccgggtactacatcacatcccctattgggctctgaacatcagctcctctgaaagggatagtttcttatggttttcatctgtgtacaatctggagtag

SEQ ID NO: 17826 - DNA, 3051 bp, Artificial Sequence
  Description of Artificial Sequence: Synthetic coding sequence
atggaggtcgccgtggaaaaagctgtggccgccgccgcggccgcctcagccgctgcctcaggaggaccatcagccgccccgtcaggcgaaaacgaagctgaatcacgccaggggcccgacagcgaacggggaggagaggctgcccgtctcaacctactggacacctgcgccgtgtgccatcagaacattcagtcaagagccccaaaactgttaccctgtctacactcgttctgccagcggtgtcttcccgcgcctcagaggtacttgatgctcccagctccaatgctcgggtccgcagaaacccccccaccagtgcctgcacctgggagtcctgtcagcggctcctcaccgttcgccactcaggtgggcgtgattagatgtccagtatgtagccaggaatgcgcagagcggcacattatcgacaatttcttcgtgaaggataccaccgaggttccgagttcaacagtagagaaaagtaatcaagtgtgtacttcgtgcgaggacaacgcggaagccaatggcttctgcgttgagtgtgtcgagtggctgtgcaaaacatgtatccgagcgcatcagcgagttaaattcacaaaagatcacactgtacgccagaaggaggaggtcagccctgaagctgtgggagttacatcccagcgaccagtcttctgccctttccacaagaaagagcaactgaagctgtactgcgaaacgtgtgataaactgacctgtagagactgccagttgctggaacacaaggagcacaggtatcagttcatagaagaggcgtttcagaatcagaaggtgatcatagacacccttataacgaaactaatggagaagactaaatacatcaagttcaccggcaatcagattcaaaaccgtatcatcgaagtcaatcagaaccaaaagcaggtcgagcaggacataaaggtcgccatctttacgctgatggtggaaatcaacaaaaagggtaaagctcttttgcatcagctggaatctctggctaaggatcaccggatgaagcttatgcaacaacagcaggaagtggcaggactttccaaacagctcgaacatgtgatgcactttagcaaatgggctgtgagcagcggttcaagtactgctctcctgtattccaaacggttgattacgtacagactgaggcacctgctgcgggctcgctgtgacgcttcaccggttactaacaatacaatccagttccactgtgatcccagtttctgggcccaaaacattataaatctgggaagtcttgttatcgaggacaaggaatcacagccacagatgcccaagcaaaaccctgttgtcgaacaaaatagccagcctccctcaggcctgagttccaaccagctgtccaaattccccacacaaatctctctggcacagctgcgattgcagcacatgcagcagcagcaaccgcccccccgccttatcaactttcaaaaccactcccccaaacccaacggccctgtcctacccccacatccacaacagcttaggtacccacccaaccagaacatcccccgacaggccatcaagccaaatcccctccagatggcctttctagctcaacaggccatcaagcaatggcagatctcctccggccagggaacaccctccacaacaaactccacctcgagcaccccctccagtcccaccataacatcagctgcagggtatgatggaaaggccttcggatcccctatgattgacctcagttctcctgttgggggttcatacaacctgccaagtctgccagatatagattgcagttccactataatgctcgataacattgttaggaaagatactaacattgatcacggtcagccaagaccaccttcgaatcgcaccgttcaaagcccaaattcttccgtgccgagccctggtctggcgggacccgttacaatgacatctgtgcatcctcccatcagatctcctagcgcttcgtctgtgggttcccgcggttcaagcggatctagctccaagccagcgggggccgactcaacccataaagtgcccgttgtcatgcttgagcctattaggatcaaacaggaaaactcaggcccccccgagaactatgattttcctgtcgtgattgtaaagcaggagagcgatgaagagtcacggccccaaaacgctaactatcctcgcagtatactgacgagcttgctgctgaactcgtcacagtcctcaactagcgaggaaacagtcctgagaagcgacgccccagactcaacaggggatcagcctgggctgcaccaggataatagcagtaatgggaaatctgaatggctcgatcctagccagaaatctccccttcatgttggggaaacccggaaggaggacgaccctaacgaggattggtgtgcagtgtgccagaatggcggtgaactgctgtgttgtgagaaatgtccgaaggtgttccacttatcgtgccacgtgcctactctgacgaattttccatctggagaatggatctgtactttttgtagagatctgtcaaaaccggaggtcgagtacgattgtgatgccccttcccacaacagcgaaaagaagaaaacggaaggtctcgtaaaactgaccccgattgacaagaggaaatgtgaacgtttactattattcttgtactgccacgagatgtccctggcgtttcaggaccctgtaccattgaccgtgccagactattataagattataaaaaaccccatggatctgtcaactattaagaaacggctccaggaggactattctatgtatagcaagccagaggatttcgtggcagacttccgcttgatttttcagaactgtgcagaatttaatgagccagacagcgaagttgccaacgccggtatcaagctggagaactactttgaggagctccttaagaacctttacccagagaagcgctttcctaaacccgagtttcgtaacgaaagcgaggacaataaattcagcgatgattcagacgatgattttgtccaaccgcggaaaaagcggctgaaatcaatcgaagagcggcaattacttaaatag

SEQ ID NO: 17827 - DNA, 2886 bp, Artificial Sequence
  Description of Artificial Sequence: Synthetic coding sequence
atgctaccagcccccatgctggggagtgccgagacccccccaccagtgcctgcccctggctctccagtctcgggctctagtcccttcgccacccaggtgggcgtgatcagatgcccagtgtgcagccaagagtgtgccgaacgccacatcatcgataatttcttcgtgaaagatacaaccgaagtcccatctagtaccgtcgagaagagtaatcaggtatgcacctcctgcgaagataacgccgaagcaaatgggttctgcgtggagtgtgtggaatggctctgtaagacctgtataagggcgcaccaacgagtgaagttcactaaagaccataccgtcagacagaaagaagaggttagtccagaagcagtgggagtgacgagccagagacctgtgttttgccccttccacaagaaagagcaactaaaactgtattgtgagacctgtgacaaattaacctgccgagactgtcaactgctagaacataaagaacatcgctatcaatttatagaggaggcgttccagaaccagaaagtgattatcgacaccttgattacgaagttgatggaaaagaccaagtacattaaatttactgggaaccagattcagaatcggattattgaggtcaaccaaaaccagaagcaggttgagcaggatatcaaagtggcaatctttactctcatggtcgaaataaacaaaaagggcaaggcgttactgcatcaactagagagccttgcaaaagaccaccgaatgaagctgatgcaacagcagcaggaggtggctggccttagtaagcagttagaacatgtgatgcacttcagcaagtgggcggtcagctctggttctagtacagccctgctgtattcaaagcgtttaatcacgtacagacttaggcacctactgagggcccgatgcgatgcctctccagttaccaacaacactatccagtttcactgtgaccctagcttctgggcccagaatatcatcaatcttggatccctagtgattgaggacaaggagtcacaaccccaaatgccaaagcagaaccctgtggtggagcagaattcacagccaccttccggccttagctccaaccaattgtcaaaatttccaacccagatttcgcttgcccaattgaggctacagcatatgcagcaacaggttatggctcaacgccagcaggtccaacggcgaccagctcccgtgggactgcccaatccgaggatgcagggaccaatccaacaaccttccatatcacatcagcagcctccaccgcggttgatcaatttccaaaatcattcaccaaaacctaatggacctgtgttgccccctcacccacagcagcttcgatacccccctaaccagaatatcccacggcaggcgataaaacccaatcccctgcagatggccttcctggcacagcaagccatcaaacagtggcagatctcttccgggcaggggactccttctactaccaactctactagctcgacacccagttctcccaccatcaccagtgccgctggatacgatgggaaggcttttggctctccaatgattgatctgtcttcacctgtgggtggttcttacaatctcccatccctgcccgacatcgattgttcttcaaccattatgttggacaatattgtgcgtaaggacactaatatcgatcacggccagcctaggcctccctccaacaggacagttcagagtccaaactcttcagtgccctcccccggtctggctggcccagtcaccatgactagcgtgcatccacccatccggagcccgagcgcttcatccgttgggtcccgtggatcgagcgggtcatcctcgaaacctgccggggccgactctacgcacaaggtgcctgtggtaatgctggagcccattcgaataaaacaggaaaatagcggacctccggaaaattacgatttccccgttgtcatcgtgaaacaggagtctgacgaggagtccagaccccagaacgctaattatccccgctcgatccttacctcacttctcctgaactctagccaaagtagtaccagcgaggaaacagtgctgcggagcgatgcacccgattctacaggggatcagcccggattgcaccaggataactcgagcaatggtaaatccgaatggcttgacccatcccagaagtcacctctccacgtaggagagactcgtaaggaggatgacccaaacgaggactggtgcgctgtctgccagaatggtggtgagttgctgtgctgcgagaagtgtccgaaggttttccatcttagctgccatgtgcccaccctgactaattttccctcaggtgaatggatctgcactttttgcagagacctgagcaaacccgaagttgaatatgattgcgatgccccatcgcacaactccgaaaaaaagaagaccgaggggcttgtaaagctgacacccatcgataagcgcaagtgtgaacgtctgcttttattcctatactgccacgaaatgagccttgcatttcaggaccctgtgccattgacagtgccggactattacaaaatcattaaaaaccccatggatcttagcaccattaagaagcgattgcaggaagactactctatgtactcgaaacctgaggactttgtggcagacttcaggctaatctttcagaactgcgccgaattcaacgagccagactccgaagttgctaacgcgggcatcaagctcgagaattattttgaagagttgttgaaaaatctttatcccgaaaagcggtttcctaagccagaattccgtaatgaatcggaagacaataagttttctgacgacagcgacgacgattttgtgcagcctaggaagaaacgtttgaagagtatcgaagagaggcagctcctgaaatag

SEQ ID NO: 17828 - DNA, 1692 bp, Artificial Sequence
  Description of Artificial Sequence: Synthetic coding sequence
atgggcctccaggcatgcctgctgggactcttcgcgctgattctgagtggcaagtgttcctattcaccggaacccgatcagcggcggacattaccgccaggctgggtgtcactcggaagagctgatccagaagaagaactctcactgacgtttgcgcttcgacaacagaacgttgagaggctttccgaactcgtccaagcagtttccgacccaagcagtcctcagtatgggaaatacctgaccctagaaaacgtggccgacctggtgcggccaagcccactgacactgcataccgtgcagaagtggctcctagccgctggtgcgcagaaatgtcattcagtgataacccaggattttctgacatgctggctgtccatccgccaggctgagcttctgctgccgggtgccgaattccatcactatgtcggcgggcccacggagactcatgtggttagatctcctcatccttaccaactgccccaggctctggcccctcacgtcgattttgtagggggcctgcacaggtttccccctaccagctccctcaggcagagacccgagcctcaagtcaccgggactgtgggactgcacctgggggtcactccttctgtaatcaggaaacgttacaacttaacctcacaagacgtggggtcaggaacaagcaacaatagtcaggcttgcgcccaatttctcgagcaatacttccacgatagcgacctagcccagtttatgagattgttcggcgggaactttgcgcatcaagcttcggtggcacgggttgttggtcagcagggtcgtggtagggccggcattgaggcctccctggacgtgcaatacctcatgagcgcaggcgcaaatatcagcacgtgggtatattcaagccccggacgacatgaaggacaggagccatttctccaatggctaatgctattgagcaacgagtccgccctgccccacgtccacaccgtcagttatggggacgatgaggactcactgagttccgcatatatacagagagtaaatactgagctcatgaaagcagcggccaggggccttactctgctctttgcgagcggagattcgggcgccggttgttggtccgttagcggacggcatcagttccgtccaactttcccagctagcagcccttatgtcacaacagtcggtgggacctctttccaggagccctttcttatcaccaacgaaattgtggattacatttctggcggaggcttttcaaatgtctttccacgcccatcttaccaggaagaagctgtgactaaatttctgagcagctcccctcacctcccaccttcaagttactttaatgcaagtggaagagcttaccctgatgtggccgccctctccgacggttattgggtggttagtaaccgggtgcctattccatgggtcagcgggacatccgccagcacccctgttttcgggggaattctgtccttgatcaatgagcaccggatactttcagggcgtcctccgctcggcttcctcaaccctaggctgtaccagcagcatggggctggtctcttcgacgtgacgagaggctgtcatgagtcctgtctcgatgaggaggttgagggtcaaggcttctgttcaggaccaggatgggatccagtcactggttgggggactcccaacttccctgcccttttgaaaacactgctcaacccttag

SEQ ID NO: 17829 - DNA, 1041 bp, Artificial Sequence
  Description of Artificial Sequence: Synthetic coding sequence
atgggcctacaggcttgtttgctgggactgtttgccttgatcctgtctggcaagtgcagctacagtccagagcctgatcagaggcgaacactccctcctggatgggtgtcgttggggagggcagacccagaggaggaactgtcattgacgttcgctctgaggcaacaaaacgttgaacgcctgtccgaacttgttcaggctgtgtccgatccttcatcccctcaatatggaaaatatctcaccctcgaaaatgttgctgatctggtaaggccaagcccactgaccctgcacacagtccagaagtggttactagccgccggcgctcaaaagtgccactctgtaattacccaggactttctgacatgctggctgagtattcggcaagctgaacttctgctgcccggagccgagtttcaccattatgtaggtgggcccaccgaaactcacgtcgtcaggagcccccacccctaccagctgccccacatcttagaggttccctacgtcaccacggtggggggtaccagctttcaggaaccctttctgattaccaatgagatagtcgactacatcagcggggggggcttttctaatgtgtttcctcgacccagttaccaagaagaggccgtgaccaaattcttatctagctccccacacctgccccctagtagctactttaacgcttcagggagagcgtaccccgatgtcgccgctttgagcgacggatactgggtggtgagtaatcgggttcctattccttgggtatctggtacatcggcctcaacaccggtgttcggtggtatcctgtcgctgatcaatgaacataggatcctttcaggccgccccccactagggttcctaaacccaagattataccaacagcatggtgccgggttgtttgacgttacccgtggctgtcacgagtcttgtctcgatgaggaggttgaaggacaaggtttttgttccggtcccggatgggaccctgtgaccggctggggtacccctaatttccctgccttgctcaagacactgctgaatccatag

SEQ ID NO: 17830 - DNA, 3495 bp, Artificial Sequence
  Description of Artificial Sequence: Synthetic coding sequence
atggctcagcaggcaaatgtcggagaattgttggctatgttggattctcccatgcttggcgtgcgagatgatgtcactgcagtatttaaggaaaacctaaattctgatcgcggccctatgctcgtgaacactttagtggactactacctggaaacgtcaagccagccagcgcttcatatcctgacaaccctgcaggaaccgcatgacaagcatctgcttgacaggataaatgaatacgtcgggaaggccgctacgaggctgtccatcttgtcccttcttgggcacgtgatacggctccagccttcttggaaacacaagctgagccaggcccccctgctaccttcactgctgaagtgtttgaaaatggacacggacgtggtcgtgttgacaaccggagttttagtcttaattactatgttaccaatgatccctcagtccgggaagcagcatctcttggatttcttcgatatctttggccgtctcagctcctggtgcctcaaaaagcccggacacgtagcagaagtgtatctcgtgcaccttcatgctagcgtatacgctcttttccatagactgtacgggatgtacccctgcaactttgtgtcatttttgagatcacactactctatgaaagagaatttggaaacattcgaggaagtggtcaagcctatgatggagcatgtcagaattcaccctgaactcgtcaccggatccaaagatcacgaactggatccccggagatggaagcgactggagacgcacgacgtggtcattgagtgtgctaaaatcagccttgatccaacggaagcgtcttatgaagacgggtatagcgtgagccaccagatctcagctcggtttcctcaccgttctgctgatgtaactacctccccttacgcagatacacagaacagctatggatgtgcaacatcaacaccctattcaacatcacggttaatgctactgaacatgcctgggcaacttcctcaaacactatccagtccctccactcggcttatcaccgaacctccccaagctaccctttggagccccagcatggtttgtgggatgaccacgccccccacaagccccggcaacgttccacccgatctctcccacccctatagcaaggtgttcgggaccactgctggtggcaaaggcacaccactgggaacaccagctactagccctccccctgccccactgtgccactccgatgattatgttcacataagcctgccacaggcgacagtgactccccccaggaaggaggagcgcatggactctgcccgaccatgccttcatcgccaacaccatctcttgaacgatcggggatcagaggagccacccggttctaaagggagtgttacactctcggatctacccggcttccttggcgacctcgcatctgaggaagactctatcgagaaggacaaagaggaggccgcaatctccagggaactgtcagagatcacgactgctgaggctgaacccgtcgtgcctcgtggggggttcgatagtccattctatagggactccctgccaggctcccaacgtaagacccacagcgccgcctcgagcagccagggagcgtcagttaatcccgagccactgcacagcagcctggacaaactaggtcctgatactccaaaacaggcgttcacccccatcgaccttccctgtggttccgctgatgagtctccagctggcgatcgcgaatgccagacctcattggagacatcaatatttaccccatccccttgcaaaattcctccacccaccagagtcggcttcgggagtggccagccgccaccttatgaccatctcttcgaagtggccctgcctaaaacagcccaccactttgtgattcgcaaaaccgaagagcttcttaaaaaagctaagggcaacactgaagaggatggagtgccctctacatcccccatggaggtcctcgatcgcctcatacagcagggagccgatgctcacagtaaggagctcaacaagctgccacttccaagcaaatctgtggattggacccactttggtggcagtcctcccagtgacgaaatcaggacactcagagatcagctgctgctgctgcacaatcagctcctctatgaacggtttaagcgccagcagcacgccctgcggaatcggcgactcttgcgcaaggtcattaaggccgccgcactagaagagcacaacgccgccatgaaagaccagttgaaactccaggagaaggacattcagatgtggaaagtgagtctgcaaaaggagcaggctagatataaccagctgcaagagcagcgggacaccatggtaaccaaattgcattctcagattcggcaactgcaacatgaccgggaagaattctacaaccagtcccaagaactgcagacaaaacttgaagactgtcgaaacatgatagccgagcttagaattgaactgaagaaagcaaacaataaagtatgccatacagagctcctactctcccaggtgagccaaaaactgtctaattcagagagcgtccagcagcagatggaattcttgaacagacagctcctcgtgcttggcgaagtgaatgagctttatctcgaacaactacagaacaagcacagcgacaccaccaaggaggtagagatgatgaaagcagcatatcgaaaggagctggaaaagaacagaagccatgtgctgcagcagactcagcgattggacacatcccaaaagcgcatcctggagctcgaaagtcacctcgctaagaaagatcatctgttactggagcagaagaagtatctcgaagatgtcaaactgcaggcaaggggccagctccaggccgctgagagcagatacgaggcacagaagagaatcacccaggtcttcgaactcgagatcctggatctctacggtcgtctagaaaaggatggactgctgaaaaagttggaggaggagaaggccgaggccgctgaagccgctgaagaaaggctggactgctgcaacgatggttgttctgacagtatggtaggccacaatgaggaagcctctggccataatggcgaaaccaaaacaccaaggccaagtagcgcccgggggtcctcgggatcccgtgggggcgggggatcatcaagttcatcctcggaattgtccactcccgagaaaccaccccatcaaagagctgggcccttttctagcaggtgggagaccactatgggggaagcatcagccagcatccccactacggtaggaagtcttccctcgtcaaagtcattcctgggaatgaaggctcgagagctctttagaaacaagtccgagtcacagtgtgacgaggatggcatgacctcttcgctctccgagtcccttaaaaccgaactgggcaaggatttgggtgtagaagctaaaatccctctcaacctggatgggcctcatccctcgcctcctacgcctgacagcgtaggacagctgcacattatggactataatgaaacgcaccacgagcactcatag

SEQ ID NO: 17831 - DNA, 1101 bp, Artificial Sequence
  Description of Artificial Sequence: Synthetic coding sequence
atggcacagcaggccaatgtcggggaactgctggcgatgttggactcgccaatgttaggtgttagggatgacgttacggccgtgtttaaggaaaacctcaactctgacagagggccgatgctggtcaatactctggtggactactatttggagactagtagccagcccgctcttcacatcttgactaccctccaggaaccacatgataagcatctgcttgaccgaatcaatgagtacgtgggcaaggcggcaaccagactgtcaatcctgtccttgctggggcatgtcattcggctgcaacctagctggaagcataagctttctcaggctcctttgcttccctcactcctaaagtgcctcaagatggacacagacgtcgtggtactgaccacgggggtgctggtgttgatcaccatgttgcccatgatccctcagagcggcaaacaacacctactggacttcttcgatattttcggcagactgagctcatggtgcctcaaaaaaccaggtcatgtggctgaggtgtatctcgtgcatctccacgccagtgtgtacgccctatttcacagactctatggcatgtacccctgcaactttgtatcatttctgaggtctcattactcaatgaaggagaatcttgaaactttcgaagaagtggtgaagccgatgatggagcatgtcaggattcaccccgagctggtgaccggcagtaaggaccatgaactcgatccccgtcggtggaagcggctggagacccatgatgtggtcatcgagtgtgccaaaatctcccttgatccaactgaagcatcctatgaggacggatattccgtgagccaccagatctccgcccggtttccgcacaggtcggctgatgtgacgacatctccttacgccgatacacagaactcatacggatgcgcaacctccactccttactctacgtccagactgatgcttctgaacatgcccggtcagttaccccaaacgctttctagtcccagtacacgtttgattaccgaacccccacaggtctggtgccaactggtctgcctgctgtcccctttgttgagtggagaagctgacccccttgggcaaatttag

SEQ ID NO: 17832 - DNA, 954 bp, Artificial Sequence
  Description of Artificial Sequence: Synthetic coding sequence
atggataccgacgtcgtcgtgcttactactggtgtcctggtcctaattaccatgctgcccatgattccacagtcggggaaacagcacttgctggacttcttcgacatctttgggcgcctctcgagctggtgcttaaagaaaccaggccacgttgccgaggtctacctcgtccatcttcacgctagcgtgtacgcactcttccatcgtctgtacggcatgtacccttgcaatttcgtttcattcttgagaagccattactccatgaaggaaaatctcgaaacgtttgaggaagtggtcaagcccatgatggaacacgtgagaattcatcctgaactcgttaccggtagcaaagatcacgaactggatcccagacgctggaagaggctcgagactcacgatgtagtgattgaatgtgctaagatcagtctggaccctaccgaagccagctatgaagatggctactctgtatcccatcagatttcagctaggttccctcatagaagtgcagatgttaccacaagcccctacgccgatacacaaaattcctacgggtgtgccacatcaaccccatactcaacgtcacgcttaatgctccttaacatgccaggacaattaccccagaccctctcctcaccaagcactcgactgatcaccgagcccccacaggccacgctctggtctccttccatggtgtgcggtatgacaactcctcccacctctcccggaaacgtgccgcccgacttgagtcatccttattctaaggtgttcggaaccacagcagggggaaagggaactcccctgggcacccctgcaacatctccaccaccagccccttccgtgattcgaatgaccacatgcactttccactctccgcggccgcagtcacacccacctgggcgcaagcgggagtggattctccaagatcatgtgtatacagataatacgatcttctag

SEQ ID NO: 17833 - DNA, 3495 bp, Artificial Sequence
  Description of Artificial Sequence: Synthetic coding sequence
atggcccagcaagctaacgttggggaactgctagcaatgctggactcccctatgctgggcgtgcgtgacgatgtgacggcagtgttcaaagaaaatctgaactctgaccgagggcccatgctcgtgaatactctcgtagactattatctcgaaacttcgtcccagcctgctctgcacatcctcaccaccctccaggagcctcacgataagcacctgctggatcgcataaatgaatatgtgggtaaagcagccacccgcctctcaatcttatccctcctgggacacgtgatccggcttcagccaagctggaaacacaagttgagccaggccccactgcttccctccttgctgaagtgcttaaaaatggacactgacgttgtcgtgctgaccactggcgttctcgtcctcatcacaatgctgccaatgataccacagtcagggaaacagcatctattagacttcttcgacatattcggcaggctgagctcttggtgtcttaagaaaccggggcacgtggccgaagtctaccttgtacatcttcatgcctcggtttacgcactgtttcataggctatatggaatgtacccatgcaatttcgtgtccttcctgagatcccactacagcatgaaagagaatctcgagacattcgaggaggttgtgaagcccatgatggaacacgtcagaatccaccccgaattagtcacaggatcaaaggatcatgagctcgacccaagacggtggaaacggctggaaacccacgacgtagtgatcgagtgcgccaaaatctccttggacccaacagaagccagttacgaggatggttactccgttagtcaccagattagcgccaggtttcctcaccgttccgcagacgttactacgagcccttacgccgatacccagaactcatacggctgcgccacgagtaccccatacagcacctcccgcttgatgctgttgaatatgccggggcagctgccacaaaccctctctagccctagtactcgtcttattaccgaaccacctcaagccacattatggagcccttcaatggtatgcggcatgacaaccccccccacaagtcctgggaacgtcccaccagacctttcccatccatacagcaaggtgttcggcacaacagccggagggaaagggacccccctgggcactcccgccacatctcccccgccagctcctctgtgccatagtgatgactacgtccacatatctctcccacaggctaccgtgaccccgcccaggaaggaggagcggatggacagtgcccgcccatgcctgcaccgccagcaccatctactgaatgacagagggagcgaagaacctcccgggtcaaaaggtagcgtgacactgtctgatctgccagggtttttgggcgatctcgcctccgaagaagatagcatagagaaggacaaggaggaggcggcgatttccagggaactgagtgaaatcaccacagctgaagccgaacccgtcgttcctcgcggaggatttgacagccccttctatagagatagtctgccaggctcgcaaagaaagacccatagtgctgcctcgtcttcacagggcgcaagcgtgaacccggagcctcttcactcctcactcgataagttgggcccagacacacccaaacaagccttcactcccattgatctcccatgtggcagtgccgatgaaagccctgctggggaccgcgaatgtcagacgtcactcgagacgagcatttttacgccctcaccgtgcaagatcccgccccctacgcgggtgggtttcgggagcggacagccccctccatatgatcacttgtttgaagtggcattgcctaagaccgctcaccactttgtcattcgtaagaccgaggaactcctgaaaaaagccaagggtaataccgaagaagacggcgtgcccagcacatcacctatggaagtgctggatagactgatacagcagggcgctgacgcccatagtaaggaactcaacaaacttccgcttccttcgaagagcgtcgactggacacatttcggcggatctcccccatcagacgagattagaacactgcgcgatcagttactactactgcacaatcagctactgtacgaacggtttaaaaggcagcaacacgctttgaggaatcgcagactgctgcgcaaagttatcaaagccgccgccctcgaggagcacaacgctgccatgaaggatcagctgaagctccaggagaaagacatccagatgtggaaggtgtctctgcagaaggagcaggcacgatataatcagctgcaggaacagagagacacaatggtaacgaaacttcattctcagatccgccagctccagcatgatagagaggaattctacaatcagtcacaggaactgcaaactaaacttgaggactgtcgcaacatgatcgccgagctaaggatcgagttgaaaaaggctaacaataaggtttgccacaccgaacttctattatcccaggtgagccagaagctgtccaactcagaatcagtgcagcagcaaatggaattcctgaataggcagctgctggttctcggggaggtgaatgagctctatctggaacaacttcagaacaagcacagtgataccacgaaagaagtggagatgatgaaggccgcatacaggaaggagttggaaaaaaataggtcccatgtcctgcagcaaacacagcgccttgatacctcccagaagcgtatcctggagctggagtcacatctcgctaagaaggatcacttactccttgagcagaagaaatatctggaggatgtcaaacttcaggccaggggtcaattacaggctgcggaatcccgatacgaggcacagaagcgaattactcaggttttcgaattagagattctggacctctacggacgtctggagaaggacggccttttaaaaaagctggaggaggagaaggcagaggccgctgaagctgcagaagagcggttagactgctgcaacgacggatgtagcgactccatggtggggcacaatgaggaggcatctgggcataatggcgaaacaaagaccccacggcctagttctgcaagggggagttcggggagcaggggaggcggcggatcttcgtcctccagttctgaactgagcacccctgagaaacccccacaccagcgcgccggcccattttcttcccgatgggaaacaaccatgggtgaggcctctgcctccattcctactaccgtcggtagtctgcccagttccaagagctttctgggcatgaaagcaagagaattgttccgcaacaagagtgagtcgcagtgcgacgaggatgggatgacctcctcattgagtgagagtcttaaaacagagcttggtaaagatctcggggttgaggctaaaatacccttgaacctggatgggccacacccttctccgcccacgcccgactcagttggtcagttacatattatggactacaacgaaacgcaccacgagcatagctag

SEQ ID NO: 17834 - DNA, 849 bp, Artificial Sequence
  Description of Artificial Sequence: Synthetic coding sequence
atggatactgatgtggtggtgttgaccacgggcgtcctggtcttgatcacaatgttgccaatgattccgcagtcaggcaagcagcacctgctggactttttcgacattttcgggaggctaagctcttggtgcctgaaaaaaccgggccacgtcgccgaggtctacctagttcacctacatgcgtccgtgtatgccctgtttcataggttatacggcatgtacccatgtaactttgtgtcattcctgagatctcattactctatgaaagagaatctggagacatttgaggaggtggtcaagccaatgatggaacacgtgagaatacatcccgagctggtcacagggtcaaaagaccacgagcttgacccaagaagatggaaacggctggaaacacacgacgtagtgattgaatgcgctaagatctcactagaccctactgaggccagctacgaggatggatattcagtcagccaccagatatctgctcgcttccctcacagatcggccgatgtgaccacaagtccttacgccgatacccagaatagctatggctgcgccacctccacaccctacagcacctcaagattaatgttgttgaatatgcccggtcacttggcaacaaccgtgcgccctaggccccccgggcctgcagcccccggcgctgtggtggaggctgaggttgtggaggctgcagccgcagcagctgcatccttccttcctcagaggaatccccacactcggggtcaggctcacagcgccgttggggggcggagactgtgggagaagcgccttcccgccagccctccattatgggctcacttccccgtccagaaagcctcatgggtctag

SEQ ID NO: 17835 - DNA, 3342 bp, Artificial Sequence
  Description of Artificial Sequence: Synthetic coding sequence
atggcccagcaggcgaacgtgggtgagctgttggcgatgttggattcccctatgctgggagtgcgagatgacgtcacagcagttttcaaagagaacctgaacagcgacagaggacctatgctggtaaacacactagtggactactacctcgagacaagctcccagccagccttgcatattctcaccacactacaggagccgcacgataaaatggacactgacgtggtggtactgaccacgggggtactggtactgataacaatgctgcccatgattccacagagtggcaagcagcatctcctggatttcttcgacatctttgggaggcttagctcatggtgcctaaagaagcccggccacgttgcagaagtgtatctggtgcacctgcatgccagcgtctacgcactgtttcaccggctctacggaatgtacccgtgtaatttcgtcagctttttacgttctcattattctatgaaggaaaatctggaaaccttcgaagaagtagtgaaacccatgatggaacacgtgcgaattcacccggagctggtcaccggttccaaggaccacgaactcgacccccgaagatggaaacggctggagactcatgacgtcgttattgagtgtgcaaaaatcagcctcgatccaacagaggcctcttatgaggatggatattctgtcagtcaccagatctctgcccggtttccgcataggtccgcagatgttacgacatccccatatgcggacacccaaaattcttacggctgtgctacctcaacaccttacagcaccagccgattaatgttgttgaacatgcccgggcaacttcctcagaccctgtcatctccttcaacaaggttgatcacagagccgccacaggccacactctggtcaccttcaatggtctgtggcatgaccacacctccaacttcaccaggtaacgtcccccccgacctgtcccatccgtattcaaaggtgtttggtaccactgccggcgggaaaggcacacctctggggacccccgctacaagcccccctcctgctcctctgtgccattcagatgattacgtgcacatttccctccctcaagccaccgtcactccacctagaaaggaggaacggatggattccgcgcggccatgtctacaccgccaacaccatctcctgaacgacagaggaagtgaggaaccccctgggtccaagggctctgtaacactgtcagacttgcctggctttctcggtgatttagcctctgaggaagattccattgaaaaggacaaggaggaggcagccatcagccgggagctgagcgaaataactaccgctgaggccgaacctgtagtgcctagagggggatttgatagcccattttaccgggattcgctgcccgggagccagaggaagacccactctgcagcctcttcaagccaaggggcctccgtgaaccccgaaccactacactctagcttagataaactcgggccagataccccaaaacaggccttcacacctattgatttgccatgtgggtccgccgacgagtcgcccgcaggcgaccgcgagtgtcaaactagtctggagaccagcatcttcacgccctctccctgtaagatcccgccacctaccagggtggggttcggcagtggacagcctccaccttatgaccacctttttgaagttgctctgccaaaaacggctcaccatttcgtgatacgcaagacggaagaattgttgaagaaggcgaaaggaaatacggaggaagacggcgtcccaagcacatcccctatggaggtgctggatcggttgattcagcagggcgcggacgctcatagtaaggagctcaataagttacctctgccaagtaaatccgtcgactggacccactttgggggttccccgcctagcgatgagatcaggacactcagagaccaactgctgttacttcacaaccagttgctctacgaacgtttcaaaagacaacaacacgcccttcgcaatcgccgcctcctcagaaaggtaattaaagcagccgcgctggaagagcacaatgcggcaatgaaggatcaattgaaattgcaggaaaaggatattcagatgtggaaagtctcactccagaaggaacaggctcgatacaaccagctccaggaacaaagagacacaatggttaccaaacttcatagtcaaatcaggcagctgcaacacgatcgcgaggagttttacaatcaatcccaagagctgcaaacaaaacttgaggattgtagaaatatgattgccgaattgagaattgagttaaagaaagctaataataaggtgtgccacaccgagctgctgctcagtcaggtgagccagaaattatcaaatagcgagtcggtgcaacagcagatggaatttctcaataggcaactgcttgttctgggtgaggtgaacgagctttatttggagcagctacaaaataagcactcagacacgacaaaggaggtggagatgatgaaggctgcttatcgtaaggagctcgagaaaaaccggtcccatgtccttcagcaaacgcagaggctggataccagtcagaagcgaattttggaactcgaaagccatctggctaaaaaagaccaccttctgcttgagcagaagaagtatctggaggatgtgaagctgcaggccagggggcagctgcaggcagcagagtcgagatatgaggcccagaaacgtatcactcaggttttcgagcttgaaattcttgacttatatggcaggctggaaaaggacgggctgctgaaaaagcttgaagaagagaaggccgaggctgcagaagcagccgaagagcgattggactgttgtaacgatggatgcagcgacagtatggtcggccataatgaggaggctagcgggcacaacggggagaccaaaactccaagaccgtcaagcgccaggggtagttctggatcaagaggtggaggtggatctagtagttcgagtagtgaacttagcaccccagaaaaaccgcctcaccagcgagccggcccgttctcctcaaggtgggaaacaacaatgggagaggcctcggcctccatccctacaactgtgggttcccttccgtcttcaaaatcatttctgggaatgaaggctagggagttatttcgaaacaagtctgagagccaatgcgatgaagatggcatgacctcctctctgtcagaatctcttaagacagagcttggtaaggacctgggcgtggaagccaagatccctcttaatctggatgggcctcacccctcccctcctactcctgatagtgtcggccaactgcatatcatggattacaacgaaacccaccatgagcactcttag

SEQ ID NO: 17836 - DNA, 2397 bp, Artificial Sequence
  Description of Artificial Sequence: Synthetic coding sequence
atggcactgcacagtccgcagtatatttttggagacttttcacctgacgaatttaatcagttctttgtcaccccgcggtcatccgtggagctgccaccttactctggcaccgttttgtgcggaacccaggccgtcgacaagttgcctgatggccaggagtatcagcggattgaatttggggtcgatgaagtgatcgaaccctctgacacgcttcccagaacgccgagctactcgattagtagcacactcaaccctcaagctcctgagttcattctggggtgcactgccagcaaaataactcctgacggcatcacaaaagaagcctcgtacggaagtatcgactgccaatatcctggtagcgctctggccctggacggttcatctaatgtcgaggccgaggtgctcgagaacgatggggtttctggggggttaggacagagggagcggaaaaaaaagaagaagaggccccctggatactattcatatctgaaagacgggggagacgattctatctcaactgaggctctggtgaatggacatgctaactccgctgtccctaatagtgtgagcgcagaagacgccgagttcatgggggacatgcccccgtccgttaccccaaggacgtgtaattccccgcagaatagcactgattcggtctcggatattgtccccgacagtcctttccctggcgccttgggttcagacaccagaaccgctgggcaaccggaaggcgggccaggggccgattttggtcaaagttgttttccggctgaagccgggagggacactctttctagaaccgcaggggctcagccctgcgtcggaaccgacaccacagaaaatcttggtgtagcgaatggccagatccttgagtccagcggcgagggaacagctaccaacggtgttgagttgcacaccaccgagagcatcgacttggaccctactaagccagagtcagcctcccctccagccgacgggacaggcagcgccagtggaacgctacctgtctcacagcctaaaagctgggcatctttgttccacgactctaagccatcgagcagtagccccgtggcatatgtggaaactaagtacagcccccccgccatctccccccttgtgtctgaaaaacaagtggaggtgaaggagggtctggtgccagtgagcgaggacccagtggcaatcaagattgccgagttgctagaaaatgttactctgattcacaaaccggtgagcctgcagcctcgaggattgatcaataagggcaattggtgctacatcaacgctacactgcaggccctggtggcctgccctcccatgtatcatcttatgaaatttatacctctctactcgaaggtacagaggccctgtacaagtaccccaatgatcgactcttttgtacggctcatgaacgagttcaccaacatgcctgtacctcctaagcctcgccaagcccttggcgataaaatcgtccgcgacatccggcccggggccgcttttgaacccacatacatctatagactgctgacggttaataaaagctccctctctgaaaaaggccgtcaagaagacgcagaggagtatctgggcttcattctgaacggcctgcatgaggagatgctcaatcttaagaaattactgtcaccttcaaacgagaaactgacgatcagtaatgggcctaagaatcattccgtgaatgaagaagagcaggaggaacagggtgaggggagcgaagatgagtgggagcaggtgggaccgagaaacaaaacatctgtgacccggcaggccgacttcgtccagactcccattaccgggatattcggaggccacatccgctccgtcgtctatcagcagtcgagcaaagagtctgctacacttcaacctttctttacactacagctcgacatacagagtgataagatccgtaccgttcaggatgccttagaaagcctggtggcccgggaatcagtgcagggctacactaccaaaaccaaacaggaggtcgaaatttcacggcgagtcacactcgagaaactgccgcccgtcctggtattacacctcaagcggtttgtctacgagaaaactgggggatgtcagaagctgattaaaaacattgagtaccctgtcgatctggagatatccaaagagcttctgtctcctggcgtgaaaaacaagaactttaagtgccacagaacatacaggctgttcgccgtggtttatcaccacgggaactccgccactggtggtcactacactaccgacgtcttccagattggtctcaatgggtggctgcggatcgacgaccagactgttaaggttatcaaccaatatcaggtggtcaagccaacagcagagaggaccgcatacttactgtactaccggcgggtggacctgctctag

SEQ ID NO: 17837 - DNA, 5355 bp, Artificial Sequence
  Description of Artificial Sequence: Synthetic coding sequence
atggccaagcccacctctaaagactccggactgaaagagaaattcaagatactcctgggtcttggcacccctagacctaatcccagatccgccgagggcaagcagaccgagtttataatcaccgctgaaatcctgcgcgaacttagtatggaatgtggcctgaataacaggatccgaatgatcgggcaaatctgcgaggtggccaagactaagaaatttgaggaacatgccgtcgaagccttgtggaaggccgtcgccgacctcctgcagcccgagagacccctggaggcacgacatgctgtgttggccctgctgaaggcaatcgttcaaggccagggcgagcgactaggcgtactgagggcattattctttaaggtgattaaggactaccctagcaacgaagatttacatgaacgcctcgaggtttttaaggcgcttaccgacaacggccgtcacatcacgtaccttgaagaggaactggctgattttgtcttgcaatggatggacgtgggactgtcgagcgaatttctactggtcctggttaatctcgtgaaatttaactcctgttacttggacgagtatatcgcacgcatggtgcagatgatctgtcttctgtgcgtccgaaccgcatcttccgtagatattgaggtttcactgcaggtactcgatgccgttgtttgttataattgcctgccagcagagagtctgccactgtttatcgtcacactgtgccgcaccattaacgtgaaggagctgtgtgaaccgtgctggaaattaatgcgcaacttgctgggcacgcacttgggccatagcgctatctacaacatgtgccatctaatggaagacagggcctacatggaggatgcgccactcctcaggggagccgtcttctttgtcggtatggccctctggggcgcacaccgactatactctttacggaacagccccacgagtgtgttgcccagcttttaccaggcaatggcttgccccaatgaagtcgtctcctacgagattgtgctaagcatcaccagactgattaagaaatacagaaaggagttgcaggtcgtcgcatgggatattctcctgaatatcatcgagcggttgctacagcagctgcagacgctggactccccggagctgagaactattgtgcacgatcttctgaccaccgtagaggagttgtgcgatcagaatgagttccacggttcccaggaacgctattttgaactggtggaacgctgtgccgatcagcgccctgaaagcagccttctcaacctcataagttacagggcccagtcaatccatccggcaaaagatggatggattcaaaacctgcaggccttgatggaacgtttttttcgtagcgagtccagaggcgctgtgagaatcaaagtgctcgatgtcctgagctttgttctcctcatcaatagacagttctatgaggaagagctaatcaactccgtagtgattagtcagctgagccacattcctgaggataaggaccatcaggtacgcaaactcgcaacacaactgctggtggatctggccgagggctgccacacacatcactttaatagccttctggacattatcgagaaagttatggcaaggtctctttcgccaccacctgaactggaggagcgtgatgtggcggcatacagcgcatcactcgaggacgtaaagacggccgtgctgggtttattagttatcttacagaccaagttgtacaccctccctgcgtcacacgcaacccgggtgtacgaaatgctcgtgtctcatatccagctccattataagcactcttacactctccccatcgccagttctataagactgcaggcttttgacttcctgctacttttgcgagctgactccttacataggcttgggttgcccaacaaagatggagtggtgagattcagcccatactgtgtttgtgactacatggagccagagaggggttcagagaaaaaaacaagcgggccgttatcgcccccaactggccccccagggcccgccccagcaggaccagcggtgagactgggctcagtgccgtattctctgctatttcgagtgctcctccagtgcctgaaacaagaaagtgactggaaagtcctaaagttagttctcggtaggctacccgaatcccttaggtacaaagttctgatctttaccagcccctgtagtgtcgatcaactctgtagcgccctctgttccatgctgagcggtcctaagactctagagcggcttcgcggtgccccagagggctttagtagaactgatcttcacctggctgtcgtacctgtgctgaccgcccttatttcctatcataactacctggacaaaactaaacagcgcgaaatggtgtactgcctggagcaggggttgatccacaggtgtgccagccagtgtgtcgtagccctttctatttgtagcgtcgagatgccagatatcatcatcaaggccttacctgtgctggtcgtgaaattaacccacatttcagcaacggcttccatggcggtcccgcttctagaattcctttccacgctggcccggctcccccacctgtataggaacttcgccgccgagcagtacgccagcgtgttcgccatctcattaccctatacaaatcccagcaaatttaaccaatatatcgtgtgtttagcccaccatgttatagccatgtggttcatcaggtgtcggcttcctttccgaaaggacttcgttccgtttatcacgaagggcctcaggtctaatgttctgttatcgttcgatgataccccagagaaagactcttttcgcgcgcggtctacctccctgaatgaacgccccaagtccctgaggattgctaggccccccaagcaggggcttaataatagcccacctgtgaaggagttcaaagagagctccgcagcagaagctttcaggtgtagatccatctccgtatccgagcatgtcgtccgtagccggattcaaaccagtctgacttccgcatctttaggatccgccgacgaaaatagtgtggctcaggctgacgattcactcaagaacctgcaccttgaacttactgaaacctgcctggatatgatggcgcggtatgttttttccaattttacagccgtccctaagagatcgcccgtgggggaattcctcctggcaggcggcaggacaaagacctggctggtcggaaataagctggtgacggtcaccacttctgtgggcacgggtacgcgcagcctcctcggccttgacagcggggaacttcaatccggccccgagtcatcaagcagccccggtgtgcatgttcgccaaaccaaggaagcaccggctaagctagaatcacaggctggccaacaggtgtccagaggcgctcgggatagagtgcgcagcatgtccggcgggcacggactgagggtaggcgccctcgacgtaccagcctcacagtttctcggctcagccactagtccgggacccagaacggctcccgccgccaagcctgaaaaggcctccgccggtacacgagtacctgtccaggaaaagactaatttagcagcatatgtgccccttctcacacagggttgggctgagatcctggtgcgtcggccaaccggaaatacatcctggctcatgagtctcgaaaacccgctgtcccccttttcttcagacataaataatatgcctcttcaggagctgagtaacgctctaatggcggcggagaggtttaaagagcaccgcgacacagcgttatataagtcactgtcggtgccagcagcgtccacagctaaacccccccctctaccgaggtctaatacagatagcgccgtggtgatggaagagggaagcccaggggaggtcccagtgctggtcgagccccctggtctggaggatgtcgaagccgccctcggaatggacagaagaacggatgcttacagccgcagctcctctgtatccagccaagaggagaagagccttcatgcagaggagctcgtgggccgcgggatcccgatcgagagagtcgtttccagtgagggagggcgcccatctgtggacctgagctttcagcctagccagccactgagtaaatcctccagttccccagaattacagactttacaagatattttgggggatccaggggacaaggctgatgtaggacgtcttagcccagaagtgaaggcgaggtctcaatcaggtaccctggatggggagtcagcagcctggagtgcctccggggaggatagcagaggtcagcccgaggggcctctgccttcatcatcaccacgatctccatctggactacgcccccggggctacacaatctctgattcagccccttcccggcgtggaaaaagagtggagagagacgcactgaagagtagagccacagcatccaatgcggagaaagtgcccggtatcaaccccagcttcgtgttcctccagctgtatcactctcctttcttcggagacgagtcaaataaacccatactgctccccaacgaatcccagtcctttgagaggtcagtacagctgctcgatcagatcccttcatacgacacccacaagattgcggtgctctacgtgggagagggtcaaagcaactcagagctggccatcttgagcaatgaacacggctcttaccgctacactgagtttctgaccgggcttggcaggttgatagagctgaaggattgccagccggacaaagtgtatctcggcggcctcgatgtatgcggggaagatggtcaattcacgtattgctggcacgacgatatcatgcaggcagtgtttcacattgctaccctgatgcctactaaagacgtcgataagcaccgatgcgataagaaacgacatttggggaatgactttgtttccatcgtgtacaatgactcaggagaagactttaagctgggaacgataaaaggccaattcaatttcgtgcacgtgatcgtgacacccctcgactatgaatgtaatctggtgagtctccaatgcagaaaagacatggagggcctcgttgacacttcggttgccaaaatcgtcagtgatcggaacctcccctttgtggctaggcagatggcgttgcacgctaatatggcctcacaagttcaccatagtcggtccaatcccactgacatctatcctagtaaatggatagcccgcctgcggcatattaagcgtcttagacagcgaatctgtgaagaggcagcgtactcgaacccttccctgcccctcgtgcaccctccgagccattccaaggcccccgcccagacacctgccgagccaacgcccggctacgaagtaggccagcgaaagaggctgattagtagcgttgaggatttcacagaattcgtgtag

SEQ ID NO: 17838 - DNA, 5295 bp, Artificial Sequence
  Description of Artificial Sequence: Synthetic coding sequence
atggccaaaccaactagtaaggattccggccttaaggagaaatttaaaattttattagggttgggaactccccgtcccaaccctaggtctgccgaggggaaacaaactgagttcattatcacagcagagattctgagagagctctctatggaatgtggtctcaacaataggattaggatgattggacagatctgcgaggttgctaaaacgaagaagtttgaagagcacgccgttgaggcgttgtggaaagccgtcgctgacctgctgcagccagaacggccactcgaggcacggcatgccgttctggcattgctgaaagccatcgtccaaggccagggagagcggctcggagtgctgcgggctctcttctttaaggtgatcaaagactatcccagcaacgaagatttacatgaaagacttgaggtgttcaaggcgctaaccgataacggcaggcatattacttaccttgaagaagaacttgctgattttgtgctgcagtggatggacgtgggactgtcctcagaatttttgctggtgctcgtcaacctggttaaattcaactcttgttacttagacgagtatatcgcacgtatggttcaaatgatctgcctcttatgtgttagaacagctagcagcgtggatatcgaagtgagtttgcaggttctagacgccgttgtgtgttataactgtctcccggcagaaagcctccctctgttcattgtgacgttgtgccggactataaatgtgaaagaattatgtgagccatgctggaagttgatgcgaaatctcctcggcacacatctcggccacagtgccatctataacatgtgtcaccttatggaagacagggcgtatatggaggacgccccactactgaggggagccgttttttttgtcggaatggccctatggggtgctcatagactgtattctctgagaaactcaccaacatccgtcctgccctcattttatcaggccatggcatgccctaacgaggtggtcagctatgagatcgtgctgagtatcaccagactaatcaaaaagtatcgcaaggaattacaggtcgtggcctgggacatcctccttaacatcattgaacggctgctacagcaactccaaaccctggactcccccgaactgaggacaatagtgcacgacctgctgaccactgtggaagagctatgtgatcagaacgaattccatggaagtcaagagaggtatttcgaattggtggagaggtgtgccgatcagagacccgagagtagcctgctcaatctgataagttacagagcacagagcatccacccagcgaaagatggatggatacagaatctgcaggcgctcatggagagattctttagaagcgaaagtaggggcgctgttcggatcaaagtcctggacgtgctgtccttcgtccttctgattaatcggcaattctatgaggaggaactgatcaatagcgtggtgatctctcagcttagccacatccctgaggacaaagatcatcaggtaaggaagttggctacccagcttctggtggatcttgccgagggatgccacacacaccatttcaactcgttgcttgacatcatcgagaaggttatggcccgaagcctttctccacccccagaactcgaggagcgcgatgtggcagcgtactccgcatccctcgaggatgtgaagacagcagttctaggactactggtgatcctccagaccaagctttatactttacctgccagccatgccaccagggtgtatgagatgctagtgtcccatattcagctccactacaagcatagttacaccttgccaattgccagctccattagactgcaggccttcgactttcttctcctccttcgcgccgactcattacacagacttgggctacctaacaaggacggagtcgtccgtttctctccatactgtgtttgtgactacatggaaccggagcgtggcagtgagaaaaaaacaagtgggccattgtctccccccacgggccctccggggcctgccccggccggaccggcggtgagactgggcagcgtaccctattctctgctgtttcgagtactgttgcagtgcctgaagcaggagagcgattggaaggttctgaaattggtgttaggtaggcttccggaaagcctgcggtataaggtgctgatttttacatctccgtgcagtgtggatcagctgtgttcagctctgtgctccatgctgagtggtccgaagaccttagagcgactgaggggcgctccggagggcttttctaggactgatctgcatctagccgtggtgccggtcttgaccgcccttatctcctatcacaattacctagataagactaagcaaagagaaatggtctactgtcttgagcaagggttgatacaccgctgcgcatcccagtgtgtggtggcactgtcaatctgttcagtagagatgcccgacatcatcattaaggccctccctgttctggtggtaaagctgactcatatatctgctacagcctccatggccgtgcccctgcttgagttcctcagcactctagcaaggcttccccatctctatcggaacttcgccgctgagcagtatgcctctgtcttcgccatctcactgccatataccaaccccagtaaattcaatcagtacatcgtgtgcctagcccatcacgtcatcgcaatgtggtttatacgatgtagactgccctttcgaaaagattttgtaccctttattactaaaggattgaggagcaacgtgctactctcatttgacgataccccggagaaagactcattccgcgctcgatcaacctctcttaacgagcggcccaaatcccgtattcaaacctcattgacttctgccagtctgggcagcgccgatgagaattcagtggcacaagccgatgatagtctcaaaaacctgcatctggagctgaccgagacctgtctggatatgatggcccgctacgtcttctccaacttcacagccgtgccaaagcgctctcctgtaggagaattcctcctggctggagggcggaccaagacctggctcgtgggcaataagctggtgacggtgactacatccgttgggaccggaactaggagtttgctgggactcgactccggggaactgcagtctggccctgaatccagctccagcccaggagtacacgtcaggcagacaaaggaagcccctgcgaagctggagtctcaggccgggcagcaagtgagccgcggtgcccgagatcgtgtgcgcagtatgagtgggggacacggtctgcgagtaggcgcacttgatgtccccgcctcacagtttctcgggtccgctaccagccccgggcctaggaccgcccctgctgccaaacctgaaaaagcctccgccggaacccgagtgcccgttcaggaaaaaaccaacctagccgcctacgttccactgcttacccagggttgggcggagatcttagtgcggaggcccaccggcaacacatcctggttaatgtccctggagaaccctctaagcccctttagtagtgacattaataatatgccactgcaggagctctccaatgccctcatggcagcggagagattcaaagagcaccgggacaccgccctctacaagtccctgagcgtccctgcggcgtccacggccaagcctccgcctctaccgcgcagcaacacggttgcctctttctcctccctgtaccagagcagctgtcagggccagctgcatcgtagcgttagttgggccgactccgccgtcgtgatggaggagggttctcccggagaggtaccagtgctggtggagccacccgggctggaagatgtcgaggcagcactcggcatggatcgccgaaccgacgcctattctcggtcttcaagtgtctcatcccaggaagagaaaagcctgcacgccgaggaactggtggggcgcggcatcccaatcgagcgggtggtttcgagcgagggcggaagaccgtctgtcgacttaagctttcagcctagtcagcccctgtctaagtcaagtagtagtcctgagcttcagacacttcaagatatcctgggcgacccgggcgacaaagccgacgtgggccgcctgtcccctgaagtgaaggccaggtcgcaatctggtaccttagacggtgagagcgccgcttggtccgcctccggagaagattctaggggccagccagagggaccattgcccagcagcagccctaggagtcccagcggactgcgcccccgcggttatacaatctccgactctgctccttctcgcaggggaaagcgagtcgagagggacgctctgaaatctagagcaacagcatctaatgcagaaaaggtacccggcataaaccccagtttcgtgttcctgcagctgtaccatagccctttcttcggagacgagagtaataaacccatacttctcccaaacgagagccagagttttgagaggtccgttcagctcttggaccaaatacctagctacgatacccacaaaattgctgtgctttacgtaggggagggtcagtctaatagcgagttggccattctgagcaacgaacacggaagctatagatacacagagttcctgaccggactgggacgcctgatcgagctcaaggactgccagcctgataaagtgtacttgggaggactggatgtatgtggggaagacggacagttcacctattgctggcatgatgatattatgcaggccgtctttcacattgctacgctgatgcctacaaaagacgtggataagcacaggtgtgacaagaaacgccacctcggaaacgactttgtctcaattgtctacaacgacagtggcgaggacttcaagctaggaactataaaagggcagtttaacttcgtccatgttattgtgacaccactggattatgaatgcaacctggtttctctgcagtgcagaaaggacatggaaggattggtcgacacgtctgtcgccaagattgtgtccgatagaaacttgcccttcgtagcacgacagatggctctgcatgcaaatatggcctctcaggtgcaccatagtcggtccaatccaacggatatttaccccagtaagtggatcgctaggcttagacacatcaagagactgagacagcgcatatgcgaggaggcggcttactcaaaccctagtttgccactggtgcatccgccctcacacagtaaagcccctgctcagacccctgccgaacctacacccggatatgaagtaggccaaaggaagaggttaatatcgtccgttgaggattttacagaatttgtgtag

SEQ ID NO: 17839 - DNA, 5079 bp, Artificial Sequence
  Description of Artificial Sequence: Synthetic coding sequence
atggagtgcgggttaaacaatcgaattagaatgatagggcagatctgtgaggtggccaagaccaagaagtttgaggagcacgcagtcgaggctctctggaaggccgttgcagacctgctccagccggaacgcccattggaagcccggcatgccgttctggcgttacttaaggcaattgttcaaggacagggtgagcggttgggcgtcctccgggccctgttcttcaaagtaattaaagactatccatccaatgaggatctgcatgaacgactggaagtgtttaaagccctgaccgacaacggacgccacattacttaccttgaggaagagctggccgacttcgtcttacagtggatggatgtcggcctgagctccgagtttttgctcgttcttgtcaacctggtgaaatttaacagctgctaccttgatgagtacattgctcgcatggttcagatgatctgcctcctatgtgtcaggacggccagctcagtcgatattgaggtatctcttcaggtactagatgctgtagtgtgctacaactgtctgcccgcggagtccctccccctcttcatcgttacgctgtgcagaacgatcaatgtaaaggaactgtgtgaaccatgctggaagctgatgcgcaatctgctcggcactcatctggggcattctgccatttataacatgtgccatctaatggaagatcgggcctacatggaagacgctccactgcttcggggggccgtttttttcgtgggcatggcactgtggggtgcccaccgactctattcactcaggaattccccaacttcagtgctcccatcattttaccaagctatggcttgccccaacgaggtggtgagttacgagatcgtgttgagcataacgaggctgatcaagaaatatagaaaggagctgcaggtggttgcttgggatatcttgctgaatataatcgaacgattgctgcagcaacttcagaccttggattcccctgaactgagaaccatcgttcacgatttactgaccacagtggaggagttgtgtgatcagaatgagtttcacggttctcaggaaaggtattttgagcttgtcgaaagatgcgcagatcagcgacccgagtctagtttacttaacttaatctcttatagggcgcagtcgatccaccccgcgaaagatggttggattcagaacctacaggctctgatggaacgcttttttcgcagcgaaagtcggggtgctgtgcgtattaaagtccttgacgtgctttcgtttgtgctactgattaatcggcaattttacgaggaggaactcattaattctgtggtgatttcacagttatcacacatccccgaggacaaagaccaccaggtacgcaaactagccacacaactattggtcgaccttgcagaaggatgtcacacacatcactttaactcactgctggacatcatcgaaaaagttatggctaggtccctcagtcctccacctgagttggaagaacgggatgtggctgcttactcagcctcattagaggacgtcaagactgccgttctcgggctcctcgtgatcctgcagacgaagctgtacactttacctgcatctcacgcaactagagtatacgagatgctggtaagccatatacaactgcactacaagcacagctatacactgccaattgcatcctctattcgcctacaggcgttcgattttctcctcctgctgcgagctgatagcctgcacaggttgggtctccccaacaaggacggcgtagtgcgcttttctccttattgtgtgtgtgattacatggagcctgaacggggctccgaaaaaaagacaagtggacctctgagtccacctaccggtcctcccgggcccgccccagcaggacctgctgtgagactcggttctgtgccttacagccttctgtttcgtgtgctccttcagtgcctgaagcaggagtcggactggaaagtgctcaagctcgttctcggacggctgcccgaatctttgcgttacaaggtgctgattttcacaagcccctgttcagtagatcaactctgctccgcactctgcagcatgcttagcggccccaaaacactggaacgattgcgcggcgcacccgagggttttagcagaactgacctgcatttagcagtggtccccgtcctgaccgccttgattagttaccacaactatctggacaagacgaagcagcgggagatggtatactgcctggaacagggacttatccacaggtgcgcctcacagtgcgtcgttgcactgagcatttgctcggtggaaatgccggacatcatcattaaggcactccctgtgctggtggtaaagcttacacacattagtgccacagcatctatggctgtacccctgctggaattccttagcacacttgcccggctgccacacttgtataggaacttcgcagcagaacagtacgcgtctgtctttgcaatcagcctgccgtatacaaacccatccaagtttaatcaatacatcgtttgcctcgcacatcacgttattgctatgtggttcataaggtgtagattgccttttcgcaaggacttcgtgccgttcattacaaaagggctgaggagtaatgtgttattgagctttgatgatacccctgagaaggatagcttcagggccaggagcacttcacttaacgaacggccgaagtccagaatccagacttcactgactagtgctagcttagggagcgccgatgagaatagtgttgcacaggctgacgactcactgaagaacctccatctggaactgactgaaacttgcttagacatgatggcacggtacgttttttcaaactttaccgcagtaccaaagcgcagcccagtcggcgaatttctgttggccggcggcaggacgaaaacttggctggtcggaaacaagctggttacagtcaccacatccgtgggcaccgggactcggagcctgctcgggttagacagtggagagctccagtccgggccagagagcagtagtagtccgggcgtgcacgttcgccaaactaaagaagctcccgctaagctcgaatcacaagccggacagcaagtttcccgcggcgcccgagatcgcgtccggagcatgtccggcggccatggcctgcgggtaggagccctggatgtccctgcatcccagttcttaggctcagcaacgagtccgggacctaggacagcccctgctgcgaagcccgaaaaggcgagcgccggaacaagggtgcccgtgcaggaaaagaccaacctggctgcttatgttcctcttctgactcagggctgggcagagatattagttaggcgcccaactggtaatacatcttggcttatgtccctggagaacccattgagccccttctcttctgacatcaataatatgcccctgcaagaactaagcaacgccctaatggctgcggagcgttttaaggagcatcgcgacactgctttatataaatccttatccgtgccggcggcttcgaccgcaaagcccccacccctcccacgtagtaatacagacagtgctgtggtaatggaggaaggatccccaggagaagttcccgtgcttgttgagcccccgggcttagaagatgtagaagccgcccttggaatggaccgtcgcaccgatgcctatagccgaagctcctcagtgagtagtcaggaggaaaagtctctgcacgccgaagaactagtgggcagaggaatccccatcgaacgggtagtcagctcagagggaggcagaccttctgtggatctctcatttcagccaagccagccactgtccaagtcgtcatccagtcctgagctacagactctgcaggatatactgggtgatcccggcgacaaggccgatgtgggtagactgtcccctgaggtgaaggcccgaagtcagagtgggactcttgatggagaaagtgccgcttggtctgcatctggggaagattcacgtggtcagcccgaagggcccctgccctcatcatctccacgcagcccctcagggctgcgaccccgcggctacacaatctctgattcagccccttcgaggcggggtaaacgcgttgaaagagacgctctgaagtccagagctactgcgagcaatgctgaaaaagtacctgggatcaatccgagctttgtgttcttgcagctgtaccattcccccttctttggagatgaatccaataaaccaatactacttcctaatgagtcccagagtttcgagcggagcgtgcaactattggaccagattccatcttatgacacacacaagattgccgtgctatatgtgggcgaaggacaaagtaattcagagctggccattttgagcaacgagcacggctcctatcggtataccgagtttcttacaggactgggacgcctcattgagctgaaggactgtcaacccgacaaagtgtatctggggggtttagatgtatgtggcgaagatggccagtttacctattgttggcacgatgatattatgcaggccgtttttcatattgcaactctcatgcctactaaggacgtcgacaaacacagatgcgacaagaagcggcatttaggaaacgactttgtgagtattgtgtacaacgacagcggtgaggacttcaaacttggcaccatcaagggccagttcaatttcgttcatgtcattgttacaccgctggactatgaatgtaacctggtatcgctgcagtgtagaaaggacatggaagggttagtggacacttccgtcgctaaaatcgtatcagatcgaaatctaccgttcgttgcaaggcagatggctctgcatgctaatatggcgagccaagttcaccattcccgctccaatccaaccgacatctacccaagtaaatggattgcaaggctcagacatattaaacggctaaggcaacggatctgtgaggaagccgcctacagtaaccccagtttgcctctggtgcatcctccatcccacagtaaggctcctgcgcagacacctgctgaacccaccccagggtacgaggtcggccaacgtaaacggcttatctcaagcgtggaagactttacggaattcgtgtag

SEQ ID NO: 17840 - DNA, 5226 bp, Artificial Sequence
  Description of Artificial Sequence: Synthetic coding sequence
atggccaaaccaacgtccaaggactcaggcttaaaggagaagtttaaaatcctgctcgggctggggacacctagacccaaccctagatcagccgaaggcaagcaaactgagtttattataacagccgagatcttgagagagttatctatggaatgcggactgaataatcgcattcgtatgattggccagatttgtgaggtagcaaagactaaaaaatttgaagagcatgctgtggaagctctgtggaaagccgtcgccgatctgcttcagcctgagcgacccctagaagccagacacgcggtcctcgctctactgaaagccattgtccaggggcagggcgaaaggctgggagtcttgcgcgccctgttcttcaaagtcattaaggactacccttctaatgaagatctacacgagcggctggaagtcttcaaggcgctgactgataacggaagacacattacatacctagaagaggagctcgccgatttcgtgctccagtggatggacgtgggcctgagcagtgagttcctgctcgtgctggtgaatctagttaagttcaactcctgttatctggacgagtacatcgcccgcatggtgcagatgatctgtttattatgcgtaagaaccgcgtctagtgtggatattgaggtctctctgcaagtcctggatgctgttgtgtgctacaactgcttgcccgctgaaagcctacccctcttcatagtaacattgtgccgcacgattaatgtcaaggaattgtgcgaaccctgttggaagcttatgcgcaatctgctcggcactcacttggggcacagcgctatttacaacatgtgtcatttaatggaggaccgagcctatatggaagatgcaccactcctgcggggtgcggtcttttttgttggaatggccttgtggggggcgcacaggctttattcattaagaaacagcccgacttctgtgttgccttcattctaccaggccatggcgtgcccaaatgaggtggtcagctacgaaatcgtactgtccattacgagactcatcaagaagtaccggaaggaactgcaggtagttgcctgggacatactcctcaatattattgaacgcctcctccaacagctccagaccctggactccccagaactaaggacgattgtacacgatttactgacgaccgtggaagaactgtgtgatcaaaatgagtttcatggatcccaggagcggtatttcgaactggttgaacgctgcgccgaccagcggccagaatcgtcactactgaacctgatctcatatagagcacagtctatccacccagctaaagacggttggattcagaaccttcaggcactgatggaacgattttttcggtccgaatcgaggggggctgtaagaataaaagtacttgatgtcttgtcttttgtgttgttgattaacaggcagttttacgaagaagagctgatcaattctgtggttattagccagctctcacatattcccgaagataaggatcatcaggtgcgcaagctcgcgacacagctgcttgtcgacttagccgagggctgccacactcatcatttcaactcccttctggacatcatcgagaaagtgatggctaggtccctgtctccgcccccagagttagaagagcgtgacgtggcggcatactctgctagtctggaggacgtcaagacggccgttctgggccttctcgtgatcttgcaaacaaaactgtacacactgcctgccagtcacgccactagggtgtacgagatgctggtgtcccacattcaactgcactacaaacatagctatacgttgcccatcgcatcgtccattcggttgcaggcatttgacttcttactcctgcttagagcagactctctacaccgcctgggcttacccaacaaggatggcgtggtgagatttagcccatattgcgtttgcgattacatggagccagagagaggtagtgaaaagaagacctcagggcctctctctccccctaccggtcccccgggacccgccccggccggaccagcagtgaggttgggatccgtgccttattcattattgtttagagtgctgctccagtgtcttaaacaggagtcagattggaaggtgctgaaactggttctgggacgcctgcccgagtccctccggtacaaggtgctgatttttacaagtccctgctccgtggaccagttgtgcagcgccttgtgcagcatgcttagtggcccaaaaactctagaacgtttgcggggggcgcccgaaggctttagcagaaccgacctgcacctagcagttgtccccgtgctgactgccttaatctcgtatcacaactatctggacaagactaaacagagagagatggtgtattgcctcgagcagggcctcatacatcgctgtgcatcacagtgtgtggtcgccctttctatctgttctgtagagatgccagacatcattattaaggcgttgcccgtgctggtagtgaaattgacgcatatttccgccaccgccagcatggcggtccccctgctcgaatttctcagcaccctggctaggctgccccatctgtatcggaattttgccgccgaacagtatgccagcgtgttcgcaatttccttaccctatactaatccatctaagtttaatcaatatatcgtttgcctagcgcaccatgtgatcgcaatgtggtttatcaggtgccgcctccccttcagaaaagatttcgtgccatttattaccaagggcctccggtcaaacgtgcttcttagcttcgatgatacccctgagaaagatagctttcgagctcggtctacctccttaaatgagcgccctaagtcacgaattcaaacttcgttaacaagcgcatctctgggaagcgcagacgagaattcagtcgcacaggcagacgattccctcaagaatctgcatctcgaactgaccgaaacatgtcttgacatgatggctcggtatgttttcagcaacttcaccgccgttcccaagcgttcacctgtaggcgagtttttgctggcaggcggccggacaaagacgtggctggtgggcaataaactggttaccgtcacaacttcagtcggcactggaacccgctctctgttagggctggacagcggcgagcttcagagcgggcccgagagttcgtcttctccaggtgttcacgtgaggcagactaaggaggccccagctaaactcgaatcgcaggctggacagcaggtctcgaggggagcccgagacagggtcagatccatgtccggcggccacggactgagagtcggcgcccttgacgtccccgctagccagttcctcgggtcagccactagccctggaccccggaccgcaccagccgctaaacccgaaaaggcatccgccggaacaagggttcctgttcaggagaagacaaacttagcagcatatgtgccgctcctcacacaggggtgggccgagatactggttcgcaggcctaccggcaacaccagttggttgatgagtctcgagaatcccttgagtcctttctccagtgacataaataacatgccccttcaggaactgagcaacgccctgatggccgccgagaggttcaaggaacatagagacactgctctgtataaatcgttatctgtaccagccgcctccacggctaagccgccccccctgcctcggagtaataccgacagcgccgtggtaatggaagaagggtcccctggggaagtcccagtactggttgagcccccaggattggaagacgttgaagccgccctgggaatggaccgtaggacggacgcctactccagatcctcttcagtgtcgtcccaggaggaaaaatccctacacgcggaggaactggtgggtcgtggcatccccatcgagcgggtcgtgtcttccgagggaggccgtccctctgtggatctctccttccagccttcccagccacttagtaaaagtagctccagccctgaactacagactctccaagacattctcggtgacccaggagataaggcggacgttggaaggctgtctccagaggtcaaagccagaagtcagagcggcacgctcgacggcgagtccgcggcgtggtcagcctccggcgaggatagtagaggtcaacccgaagggccacttccatcatcttccccacggtcacctagtggccttaggcccaggggttacacgattagtgactctgctcctagtcgacgcggaaagagagtggagagagatgcccttaaatcacgggcaaccgcctctaacgccgaaaaggtgcctgggattaatccatcattcgtttttctacaactataccacagccccttttttggggatgagagtaataaacctattctgctgccaaatgagagtcagtcctttgaacgcagcgtccagctgttagaccagataccaagctatgacacacataaaatcgcagtactatacgtcggggaaggccagtccaatagcgaactcgcgatcctgagtaacgagcatggatcttacagatataccgagttcttaaccggcctaggcaggctgatcgaactcaaggactgccagcctgataaagtgtacctggggggacttgacgtgtgtggtgaggatgggcagtttacctattgctggcatgatgacataatgcaggcagtgttccacattgcaaccttgatgccaacgaaggacgtcgacaaacacagatgtgacaagaaacgccacctgggcaacgactttgtgtctatagtatataacgattcaggagaggacttcaaactgggaaccattaagggccagtttaatttcgtacatgttatcgtcacacctctcgattatgagtgtaacctggtaagtctccaatgtcgaaaggatatggagggccttgtggacacaagcgtcgcaaagatcgtgtctgaccgaaatctgcccttcgtggctcgtcagatggcacttcatgcaaacatggcaagccaggtccaccacagcagaagtaaccctactgacatatacccgtccaaatggatcgctaggcttcgccacattaaaagattaaggcaacggatttgtgaggaagcggcatattcaaatcccagtttaccattggtacaccctcctagccactccaaagcccctgcacagactcctgccgaacccactccaggatatgaggtcggccaaaggaaacgtttgatcagctctgtcgaggattttactgagttcgtttag

SEQ ID NO: 17841 - DNA, 5115 bp, Artificial Sequence
  Description of Artificial Sequence: Synthetic coding sequence
atggctaaaccgacttccaaagacagtggcttgaaggaaaagtttaagatattactgggtcttggaaccccacgaccaaacccccggagtgctgaaggaaagcaaacagaatttattatcaccgcagaaattcttagagaacttagcatggaatgcggactgaataatcgcatacggatgataggacagatttgcgaggtggccaagactaaaaaatttgaagagggcgagcgcctgggagttttgagggcgttgttctttaaggttatcaaagactacccttccaacgaggacctgcacgaacgacttgaagttttcaaagccttaaccgacaacgggcggcacattacatacctcgaagaggagctggcagattttgtccttcagtggatggatgtaggcttatcttccgagttcctcttggttctggtcaaccttgtgaagtttaacagctgctatctagacgaatacatcgctcgcatggtgcagatgatctgcctcctgtgtgttcgcaccgcgtcatccgttgatattgaggtgtcgcttcaggtcctcgatgccgtggtttgctataattgtttgccggccgagtcattgcccttattcatcgttaccttatgccggaccattaacgttaaagagctgtgcgaaccgtgctggaaactcatgcgcaatcttttagggacccacctggggcactccgccatttataatatgtgtcatctgatggaagatagggcctatatggaagacgctcccctgctgagaggcgcggtgtttttcgtaggaatggccctgtggggggctcaccgtctttacagcctgagaaattcacctacatctgtcctgcccagtttctaccaggccatggcatgtcccaatgaggtggtgtcatatgagatcgtgctgtccatcacacgcctcatcaagaagtaccggaaagagttacaggtggtcgcttgggatattctcttgaacataattgagcggcttctccagcagctacagacactagatagccccgagctgcgcactattgtgcacgacttgctgacaaccgtggaggaactttgcgaccagaatgagtttcatggatcacaggagcgatatttcgagctagtggagagatgtgccgatcagcgccccgagagcagcctcctcaatctcatcagctatcgcgcgcagagtatccaccctgccaaggatgggtggatccaaaatctgcaggctctaatggaaagatttttcaggtctgagtcaagaggcgccgtgcgcatcaaagttctagatgtgttatcatttgtcctcctaatcaatagacagttctatgaagaggaactcattaactccgtggtgatcagtcaattatcccacattcccgaagacaaggatcaccaggtaagaaagctggcaacacagctgctcgtagacctcgccgagggatgccacacgcatcattttaactcgttgctggacatcatagagaaagtcatggcccggtctttgagccctccacctgagcttgaagaacgagatgtggccgcatacagtgccagtctggaagacgtgaaaactgctgtcctaggactcctggtcatactccaaacgaagctttacaccttaccagcctcccatgcaacccgggtctacgagatgctggtgagccacatccagctccactacaagcacagttacaccttacctatcgccagtagcattaggctccaagcattcgactttttgctgctcctcagagcagacagtctccacaggttggggctgcctaacaaggatggagtggtcagatttagcccctactgtgtctgtgactacatggagccagaaagaggtagtgaaaagaagacttcaggtccattgtctcctcccaccgggccacccggccccgccccagctgggccagccgtgcggttgggaagcgttccctattctttgctcttcagagtgctactccagtgccttaaacaagagtcagactggaaagtgctgaaattagtactgggcagactgcctgagagcctgcgttataaggtcttaatcttcacaagcccatgttctgttgatcagttgtgctctgccctatgttctatgctatcgggccccaaaactcttgagcgtctgcgtggtgcgcctgaggggttctctaggaccgacctgcatctcgctgtagtgccagtactaactgcacttattagctatcataattacctggataagaccaagcagcgagagatggtttattgcctcgaacaaggtctgatccaccgatgcgcatctcagtgcgtggtggcactgtccatctgcagtgtggagatgcccgatattattattaaggctctccccgtactggtggtcaaacttacccacatatccgccaccgctagtatggcagtgcccctcctggagttcctgagcactttggcaagattgcctcatctctataggaattttgccgcggagcagtatgcctcagtgttcgccatcagcctgccatacactaacccgtccaaattcaatcagtacatcgtgtgcctggcccaccacgtcatcgctatgtggtttattcggtgccgattgccttttaggaaggattttgttccgttcatcactaaggggctgcggagtaacgtgttattgtcctttgatgacacaccagagaaggactcatttcgagcccgatcaacctccctgaacgagagacctaagtcccgtatccaaacatcactaacgtctgcaagtctggggagtgccgacgaaaactccgtggcgcaagccgatgatagcctcaaaaatctccatcttgagctgaccgaaacctgtttggatatgatggctagatatgtgttttcaaacttcacagcagtccccaaacgatccccagtaggtgagttcttgctggccgggggtcggacaaagacttggctagtcggcaataagctggtaaccgtgacgacttctgttggaacgggcaccaggtccctgctaggattagattctggggaactgcaatcaggacctgagagctcttcttcccccggtgttcatgttcgtcaaactaaggaggctcctgctaaactggagtcccaagcggggcagcaggtctcacgtggggcaagggatcgtgttaggtctatgtcgggagggcatggcttgcgcgttggggcactagatgtaccagcaagtcaattcctcggtagcgctaccagccctggtccacggaccgccccggccgcaaagcctgagaaagcgtccgctggaacccgcgtgcccgtgcaggagaagacaaacctggccgcatatgtgcctctgctgacgcaggggtgggccgaaatattggtcagacgtcctacagggaacaccagctggctcatgagtctggaaaatccattgtcaccattttcaagcgatataaataacatgcccctccaggaacttagcaacgccctaatggccgcggaacggtttaaagagcacagggatacagcactttacaagtcgctgtctgtcccagccgcgagcaccgctaaaccacctcccctccctcggtctaatacggattccgctgtggtcatggaagaagggagccccggcgaggtacccgttctggttgaaccccccggcctggaggacgtggaggcagcactgggaatggatcggcgcacagatgcatactcccgatcgtcctctgtgtcttcacaggaagagaaatccctgcacgctgaagaactcgtgggtcggggcatcccgatcgagcgggtagtctccagcgagggcggaagaccctctgtggatttgtccttccagccttcacagccactgagcaaatcaagtagcagtcccgagctgcaaacactccaggacatcctcggggaccccggcgacaaggcagatgttggacggctctcccctgaagtcaaggctagatctcaaagcggaactcttgacggagagagcgccgcctggtccgcgtcgggtgaagacagccgcgggcagccagagggtcctctccccagttcgtccccgaggagccccagcggtttgaggcctcggggatacacgattagcgacagcgccccttctcgcaggggtaaaagagttgaacgcgatgctctgaaaagtagagccacggcatctaatgccgagaaggtacccgggatcaacccttctttcgtgttcctgcagctgtatcatagccctttcttcggagacgagtccaacaagcccatcctgctccccaacgaaagtcagtcctttgaaagaagcgttcagctgctggaccagatcccctcatatgatacacataagattgccgtactgtacgtcggcgaagggcaatctaactcagagttagcgattctcagcaacgagcatggttcatatcgctatacagaattcctcaccggcctgggcagactgatcgaactgaaggactgtcagcctgacaaggtctacctgggcggacttgatgtctgtggtgaggacggacaatttacctactgttggcacgatgacatcatgcaagccgtctttcatatagcaactttgatgccaacgaaagatgtggataagcaccgatgtgacaagaagaggcacttgggaaacgattttgtttctattgtctataacgactccggcgaggacttcaaactaggaacaatcaaggggcagttcaatttcgtccacgtgattgtgacacctttggattatgagtgcaacctggtctctcttcagtgcagaaaggatatggagggactcgtagatacctccgttgcgaagatcgtatccgataggaacctgcctttcgtggccaggcaaatggccctgcatgccaatatggcttcgcaggtgcaccattcccgctcaaatcccacagatatctatccatccaaatggatcgcccggctgcggcatattaaaagactgcggcagaggatttgtgaggaggctgcctattccaacccaagcttacccctggtccacccccccagccactccaaagcgcctgctcagaccccagccgagcccacaccgggatatgaggtgggccagaggaagagattgattagttctgtggaggacttcactgaattcgtgtag

SEQ ID NO: 17842 - DNA, 516 bp, Artificial Sequence
  Description of Artificial Sequence: Synthetic coding sequence
ttccctagagacttgtcgctgataagtcctcttgcacaagctgttcggagttcatccaggactccctctgataagcctgtagctcatgttgtggcaaatccacaggccgagggccagctgcaatggctgaacaggagagcgaatgcgttgttggccaatggagtggagcttcgcgacaaccaactggtcgtgccttctgagggcctgtacctgatctattcacaggtgctcttcaagggccaaggatgtccttccactcatgtccttctgacccacaccatatctaggattgcggtgagctaccagaccaaggtgaatttattgtctgccattaagtctccttgccagagagagacacctgaaggtgccgaggcgaaaccctggtacgaacctatatacttgggaggtgtattccagcttgagaagggcgaccgcttgtccgccgaaatcaacaggcctgattacctggactttgctgaatccggtcaggtttacttcgggattatagccctctag

SEQ ID NO: 17843 - DNA, 306 bp, Artificial Sequence
  Description of Artificial Sequence: Synthetic coding sequence
atggcaatgatggaggttcaagggggcccttcgctcggtcaaacgtgcgtactcattgtgattttcacagttttgcttcagtctctgtgtgtggctgtgacctacgtgtattttacaaacgagctcaaacagatgcaagataaatatagcaagtccggaatagcctgcttcctgaaggaggatgacagctattgggatccaaatgatgaggagagtatgaatagcccctgttggcaagtgaagtggcagctgaggcagctggtccggaaaactcctagaatgaagcgactgtgggcagctaaatag

SEQ ID NO: 17844 - DNA, 846 bp, Artificial Sequence
  Description of Artificial Sequence: Synthetic coding sequence
atggctatgatggaggttcagggtgggcccagcctgggccagacctgcgtcctcatcgtgatctttacagttctgctccagagcctgtgtgtcgcggtgacctacgtgtatttcaccaatgagctgaagcagatgcaggacaagtatagtaaaagcggaattgcatgtttcctgaaggaagatgactcctactgggaccccaacgacgaggaatccatgaattcaccttgctggcaggttaaatggcagctgcggcagctggtacggaagatgattttgagaacctccgaggaaacgatttccaccgtgcaagagaagcagcagaacattagcccgctggttagagagcgaggtccgcagagagtggccgcccatattaccgggacccgcggccggagtaatactctttcctctccaaacagcaaaaacgaaaaggcattgggtcggaagatcaactcgtgggagtcatcccggtcagggcattctttcctgtctaaccttcatctcagaaatggggaacttgtgatacatgagaaggggttttattatatatattctcaaacctatttcaggttccaggaggaaatcaaggagaacaccaaaaacgacaagcagatggtgcagtacatttacaaatacacctcttatccagatccaatcctcctaatgaaaagtgcacgtaacagctgctggtcgaaagatgcagagtacggcctttatagcatctaccagggcggcatcttcgagcttaaggaaaatgatcgcatattcgtctcggtcacgaatgaacacctcatcgacatggatcacgaagcttcttttttcggcgccttcctcgtgggctag

SEQ ID NO: 17845 - DNA, 858 bp, Artificial Sequence
  Description of Artificial Sequence: Synthetic coding sequence
atggatgatagtactgaaagagagcagtcccggctgacctcctgtttgaaaaagagagaagaaatgaaactgaaagaatgcgtctccatcttaccaagaaaagaatccccatccgtcaggtctagcaaggatggcaaattgctggctgcaacactcctgctggccctgctctcatgttgcctgactgtggtgtcgttttaccaggtggcagcactacaaggcgaccttgcatcactgcgcgcagaactccaggggcaccatgctgaaaaattgcccgcaggcgccggcgcccctaaagcaggcctcgaggaggcccctgccgtgactgccggattaaaaatcttcgaaccgccggctcccggcgagggcaattcaagccagaactctagaaacaagcgggccgtccagggcccagaagagacagtgacacaggattgtctgcagctaatcgcagactctgagacacctacaattcagaaggggagttacacattcgtgccctggttgctgtctttcaaaagaggcagcgccctcgaggagaaagagaacaaaatcttggtgaaggagactggttacttcttcatttatggacaggtactatacacagacaagacctacgccatgggtcatctcatccagaggaagaaggtgcatgttttcggagacgagcttagccttgtgacccttttccgatgtatccaaaatatgccagagacactgcctaacaactcttgttactcagctggcatcgccaaactcgaagaaggggatgagttacagctggccattccgcgagaaaacgctcagatttccttagacggcgacgtgacattttttggggcacttaaactgctgtag

SEQ ID NO: 17846 - DNA, 801 bp, Artificial Sequence
  Description of Artificial Sequence: Synthetic coding sequence
atggatgacagtaccgaaagagagcaaagtcgactgacgtcgtgtctgaagaagcgggaggagatgaagctgaaagagtgcgtgagcattctacctaggaaggagtccccatcagtccggagctccaaagacggcaaattgctcgccgcaacactcctgctcgcactcctctcctgctgtttgactgtggtgtcattttatcaggtggccgcattgcaaggggacctcgcttctctcagggccgaactgcagggtcatcacgccgaaaagctaccagcaggagctggggcccccaaagccggtctagaggaggcacctgccgttactgcgggtcttaaaatttttgaaccccccgcacctggggagggcaattctagtcagaatagccgaaacaaacgcgcagtacagggacctgaggaaaccgggagttatactttcgtgccatggctccttagttttaagaggggatccgctctcgaggagaaagaaaacaagatccttgtcaaagagaccggctacttcttcatctacggtcaagtgttgtacactgacaaaacttacgccatgggccaccttatacagcgcaagaaagttcacgtcttcggggatgagctgtctcttgtaaccctgttcaggtgcattcagaatatgccagagaccctccctaacaatagctgttattctgccggcatcgcaaagcttgaagagggagatgagctgcagctggctatcccacgagagaatgcacaaatatctctagacggtgatgtcacgttctttggggcccttaagctgctctag

SEQ ID NO: 17847 - DNA, 495 bp, Artificial Sequence
  Description of Artificial Sequence: Synthetic coding sequence
atggatgattccactgagcgggagcagagcaggctgacatcctgcctaaagaaacgagaggagatgaagttgaaggagtgtgtctccattcttcctagaaaagaaagcccctcagttcggtcctccaaggacgggaaacttctcgctgccactctgctgctagccctactctcctgctgtcttacagtggtgagtttctatcaggtggccgcattacagggggatttggccagcctgcgcgctgagctgcaaggacaccacgctgaaaaactgcccgccggtgctggcgctcctaaggcaggcttagaagaggctccggccgtaactgccggcttgaagatcttcgagcctcccgctccaggcgagggcaattctagccagaactctcggaacaaacgcgctgtgcagggacctgaggaaaccgtcacccaagattgtctgcagctgatcgctgattctgagacccctaccatccagaagggctttatctactag

SEQ ID NO: 17848 - DNA, 2700 bp, Artificial Sequence
  Description of Artificial Sequence: Synthetic coding sequence
atgcctactctgggctggctgccagaaaaccgagatatttccgaagaccagtccagcgctgaacagactcaggccctcgcttcacaggctagccaatttctagcaaaggtagagagctttgaaaggctaattcaggctgggcgactgatgcctcaggatcaggtgaagggttttcaaagattgaaggcagcccacgctgccctggaggaggagtacttaaaggcctgtagggaacagcacccagcacagcccctcgcgggcagtaagggcacgcctggcagatttgatccccgaagggagctggaagctgagatttaccgtctcggctcctgcctggaggagctgaaggagcacatagatcagactcagcaggaaccagaacctccaggcagcgattccgccctcgattctaccccagctctgccatgcttgcaccagccaactcacctccctgccccgtcgggccaggcgcctatgcctgcaattaagacttcatgcccagagcccgccaccaccacggccgctgcttcaactggcccttgcccgctgcatgtgaatgtggaagtgtctagcgggaattccgaggttgaggataggccccaggatcccctggccaggttgaggcataaagaacttcagatggagcaggtttatcatggtcttatggagcgctacctaagcgttaaaagtctgcccgaggccatgcggatggaagaggaggaggaaggggaggaggaggaggaagaggaaggtggaggggactccctcgaggtcgacggcgtggccgccactccaggcaaagccgaggcaacacgggtcttgccgcgccagtgccccgtgcaggctgaaaagtctcatggtgcccctctggaagaagccacggagaagatggtctccatgaagccccccggcttccaagccagtctggcgcgcgatggtcacatgtcgggtttaggaaaggcagaggccgcacccccaggacccggtgtaccaccccacccaccaggtacgaagtccgcagcctcccaccagtcatctatgaccagcttggaaggtagcggcatctcggagcgactgccacagaagccattgcacaggggcggaggcccacatcttgaggagacttggatggcctcccccgagaccgacagcgggttcgtggggagcgagaccagtcgcgtttctccactaacccagacaccagagcaccgcctgtctcacatttccactgccggtactctcgcacagcctttcgctgcctccgttccacgggacggcgctagctatccaaaagctcgggggagcctaattcctagacgggcaacggagccgtcaacaccccggtcccaggcccagcgctatctgtctagccccagtgggcccctacggcagagagcccctaacttcagtttggagagaacactggccgctgagatggcagtgccaggctctgaatttgaaggacacaaaagaatctccgaacagccgctcccaaacaaaacaatctctccaccaccagccccagctcccgctgccgcccccttgccatgtggacccactgagacaatcccttcgttccttctaactagggcaggacgtgatcaagcaatatgcgagctgcaggaagaggtgtctcgtctgcgactcagactcgaggattccctacaccagccactccaaggaagcccaaccagaccggctagcgcctttgacagacccgcaagaacgcggggccggcccgctgacagtcctgcaacatgggggtctcactatggatcgaagagtaccgaacgcctcccaggcgagccgcgcggcgaagagcagattgtacctcccggtcggcagcgagcccgctctagtagtgtgccgagagaggtactgaggcttagcctcagcagtgaatccgaactgcccagcctgccattgttctctgaaaagtctaaaactacaaaggactcgcctcaggccgcgagggacggcaagagaggcgtggggtcagctgggtggccagaccgcgtaacgtttagaggacaatacacagggcatgagtaccacgtattgagtcccaaggccgttcccaaaggaaacggaacagtgagctgcccacattgtcgaccgatccgaacccaagacgctgggggagccgttactggggatccattgggacctcccccagccgacactttgcagtgtcctctctgcggccaggtggggtcaccacctgaagccgacggccctgggagcgccacaagtggggcggagaaagccactactagacggaaggccagtagtaccccatctcccaagcagagatcgaaacaggctgggtcttcaccaaggcctcctcctggcctgtggtatctggccacagcgcctccggctcccgcccctcccgcatttgcttacatctcctcagttcctatcatgccctatcctcccgccgccgtgtattatgctccagcaggacctacatcagctcagccagccgctaaatggcctccaactgcatccccccccccggcacgccggcaccggcactctatccagctcgacctgggtgacctggaagagttgaataaagccctgagtcgggccgttcaggcagccgaatccgtgcgcagtaccacccgccagatgcgaagcagcctgtcagccgatttaagacaggcccattcccttcgggggagctgcttgttttag

SEQ ID NO: 17849 - DNA, 1569 bp, Artificial Sequence
  Description of Artificial Sequence: Synthetic coding sequence
atggctctcctcccccgagcactatcagccggtgccggacctagctggcggcgcgcagcccgggctttccgcgggttcctgttgcttctccccgagcccgcagctctgacaagagcactctccagggccatggcctgtcgacaggaacctcagccacagggtcctcctcccgccgctggggcggtggcttcgtacgattacctcgtgatcggaggcggcagcggagggctcgcctcagcgaggcgtgccgccgagctgggcgcccgtgcagctgtcgtagagagtcataagctcggtgggacatgtgtgaacgtggggtgtgtccctaaaaaggtgatgtggaataccgccgtgcactctgagtttatgcatgatcatgccgattacggctttccttcctgcgaaggaaagtttaactggcgggtgatcaaggaaaagcgggatgcgtacgtcagccgcctcaacgccatctaccagaataatcttactaaatcccatattgaaatcatcagaggtcatgctgcatttacgtctgatcccaagccaactatcgaggttagcggaaagaagtacacggctccacacattctgatcgcgactggggggatgccaagcaccccacatgaaagccagatcccgggagcttctcttggaatcacatccgacggctttttccagctcgaagaacttcccggtaggtctgtgattgtgggggccggttacatagctgtggaaatggctggtatacttagcgctctggggtccaaaaccagcctcatgatcagacatgacaaggtcctccgaagttttgattccatgattagtaccaactgtacagaagaactggagaacgccggcgtggaagtgttgaagttctcacaagtcaaggaggtgaagaaaaccctatcagggctcgaggtgagtatggtgacggctgttcccggtagactgcccgtgatgaccatgatccctgacgtggattgcctgctgtgggccattggacgcgtcccgaacaccaaagacctgtcgctgaacaagctaggaatccagactgacgataaaggccatatcattgtggatgagttccagaataccaatgtcaaaggaatttatgccgtaggcgacgtgtgcggaaaggctttgctgaccccagtggccatagctgccggtaggaagttagcccacaggttgtttgagtataaagaggactcaaaactggactacaacaatattcctactgttgtcttcagccatccacctatcggcacagttggactgacagaagatgaagctatccataaatatggcatcgagaacgttaagacctactcaacttcttttacaccaatgtaccacgctgtcaccaaaaggaagacaaaatgcgtaatgaagatggtctgcgctaacaaggaggagaaggtcgtcggcattcatatgcagggcctgggctgcgacgaaatgctgcaaggcttcgctgtcgccgtaaagatgggagcgactaaagccgacttcgataacactgtggccatacaccccacatccagcgaggagcttgtgacgctgcggtag

SEQ ID NO: 17850 - DNA, 1323 bp, Artificial Sequence
  Description of Artificial Sequence: Synthetic coding sequence
atggaacagagaggccaaaacgcccctgctgcatcgggcgctcgaaaacggcatggccctggaccaagggaggcgcggggggcacgccctggtccacgtgttcccaagaccttggtcctcgtggtggctgcagtgcttctcttggtatctgccgagagtgcccttattacccagcaggatctggctccccagcaacgcgctgccccccagcaaaaacggtcttcaccctcggaaggactttgtccccctggccaccacatctccgaggacgggcgcgattgcatttcatgcaagtatggacaggactactccactcactggaatgacctgctcttttgccttaggtgtacccggtgtgattctggtgaagtcgagttaagcccctgtacaaccacgagaaacacggtatgtcagtgcgaagagggaacttttcgcgaagaagatagccccgagatgtgtcggaagtgtcggactggatgtcctcgcggcatggttaaagttggggactgcaccccatggagcgacatagagtgtgtccacaaggaatctgggactaagcacagcggagaggtgcctgccgtggaggagaccgtcacgtcttctcctggcacccctgccagcccgtgctccctctctgggattattatcggtgtcaccgtggccgctgtcgtcctgattgtcgctgtgtttgtgtgtaagtcccttctctggaagaaggtgttgccgtacctgaagggcatctgttcaggtggcggcggagatcctgaaagagtggatagatccagccagcgcccaggggccgaggataacgtgcttaacgaaatcgtgagcattctgcagcccacacaggtgccagagcaagaaatggaggtccaggagccagctgaacccaccggtgtgaacatgttgtcccccggtgaaagcgagcatctgctcgaacccgccgaggccgagcgctcacagcggagaagactccttgtgcccgctaatgagggggaccctacagagaccttgcggcaatgttttgatgatttcgccgacctggtgccatttgattcttgggaacctctgatgagaaagttaggcctaatggacaatgagattaaagtcgccaaagcagaagctgcaggccatcgagatacgctgtacacaatgctgataaaatgggtgaacaaaaccggcagggacgccagtgttcacaccttgctggatgccttggagaccctgggggaacgcctggccaagcagaagatcgaagatcacctgctgtctagcggcaaattcatgtatcttgaagggaacgctgatagcgctatgtcttag

SEQ ID NO: 17851 - DNA, 1236 bp, Artificial Sequence
  Description of Artificial Sequence: Synthetic coding sequence
atggagcagcgaggccagaacgccccagccgcaagcggtgctaggaaacgacatggtccgggtccgcgggaggctcgtggcgcaaggccgggcccccgagtgcccaagacactcgtactagtcgttgccgcagtgctgctgctggtgtccgccgaatcagcattgataacacagcaggatctggcccctcaacagcgcgctgctccacaacagaagcgcagttctccttctgaggggctgtgccctccaggccaccacatctctgaggatgggagggattgcatttcctgtaaatatggtcaggattattccactcattggaacgacctgctgttctgcctgcgctgcacgcgttgcgattctggcgaggtggaactgtctccctgcacaacaacacggaataccgtgtgtcagtgtgaagaagggacgtttagagaggaagactcccccgaaatgtgtaggaagtgcagaactggctgtccccgcggaatggttaaagttggggattgcactccctggagcgatattgagtgtgtacataaagagagtggtatcatcattggagtgacagttgcggccgtggtcctcattgtggctgtatttgtgtgcaaatcactgctttggaaaaaggtgctgccatacctgaagggaatctgcagtggaggaggcggagatcctgagcgggtcgaccggtcgtctcaacgtccaggcgccgaggataacgtgctgaacgagatcgtgtcaattcttcagcccactcaggtcccagaacaagaaatggaggtgcaggagcccgccgagcccaccggagtcaacatgctgtcccctggggagtctgagcatctgttggaacccgctgaagctgagcgctcacagagacgtagactgttggtgccagctaacgagggcgacccaaccgagacactgcgtcagtgtttcgacgatttcgctgaccttgtcccttttgactcgtgggagccgctgatgagaaaactgggacttatggacaacgaaatcaaagtcgcgaaggccgaggctgccggtcatcgcgatacactgtacactatgctgatcaagtgggtgaacaaaactggcagggatgcctctgtccacacactgctggacgctcttgagacactcggcgagcggctggccaagcagaagatagaggatcacctcttgtctagcggaaagttcatgtacttggaggggaatgctgacagcgccatgtcttag

SEQ ID NO: 17852 - DNA, 783 bp, Artificial Sequence
  Description of Artificial Sequence: Synthetic coding sequence
atgtgtcgcaagtgtcgcaccggctgccccagggggatggtgaaagtaggcgactgcacaccctggtccgacattgaatgcgtccacaaggagagcggtattataattggggttacagtcgccgccgtcgtgctcatagtggcagtgttcgtgtgtaaatcccttttatggaaaaaggtcctgccttacctgaaaggcatctgctccggaggaggtggggacccggagagggtggatcgctcaagccagcggccaggagccgaggacaatgtcctgaacgagatcgtttccattctgcagcccactcaggtcccagagcaggaaatggaggtgcaggaaccagcagaacccaccggagtcaacatgctttccccgggcgaatccgagcacctgctagagcctgctgaagccgaaagaagtcagagacggcggctcttggtacccgctaacgagggggatccaaccgagacacttcgacaatgctttgatgacttcgcggatcttgtgccatttgactcttgggagccattaatgcgcaaactgggactgatggataatgagattaaagtcgcaaaagccgaagccgccggacaccgcgacactctgtacactatgttaattaagtgggtgaataagaccggtagggacgcgtcagtacatactctcttggatgccttagaaactctgggagagcgattagctaaacaaaaaattgaggatcacctattgtcatctggcaagttcatgtacctggaaggcaacgctgactctgctatgagctag

SEQ ID NO: 17853 - DNA, 1161 bp, Artificial Sequence
  Description of Artificial Sequence: Synthetic coding sequence
atggggctgtggggtcaatcagtgcctaccgctagtagtgcaagggctggacggtatcctggagcccgaacagctagcggtactcgtccatggttgctggaccctaagatcctcaagtttgtggtgtttatagtggctgttcttctgccggtgagagttgactctgctactatcccgaggcaggacgaggtaccacagcagaccgtcgccccacaacagcagaggcgcagcctcaaagaggaagaatgccctgccggttcgcaccgtagtgagtatactggcgcctgtaatccatgtacagagggcgttgactacacaatcgcttctaacaatctgccctcctgcctcctttgtactgtttgtaaatcaggccagacaaataagtcttcttgcaccactactagagatactgtctgccagtgtgaaaaagggtcttttcaagacaagaactctccagagatgtgccgcacctgccgcactggctgcccgagggggatggtcaaagtatcaaactgtacccccagatccgatatcaagtgtaagaacgagagtgctgccagcagtacagggaaaacccccgccgccgaagagactgttacgacgatattgggaatgttagcgagcccataccactacctaataatcatagtcgtattagttatcatactggctgtagtggtggtggggttctcatgtcggaaaaagttcatctcttacctcaaaggaatctgtagtggaggcggcggagggcctgagcgcgtgcatagggttctcttcagacgacggtcgtgtccaagtcgtgtccccggagctgaagataatgcccggaatgaaaccttgtcaaaccgttacttacagcctacacaggtgtctgaacaggagatccaaggacaggagctggctgagctgaccggagtgacagtcgagctcccagaagagccccagcgtttgttggagcaggcggaggcggaggggtgtcaaagacgccggctcctggtgccagtcaatgatgctgattctgcggacatctccacgctgctcgacgcaagcgcgacgctagaggaaggccatgccaaggaaacgatacaagatcagttggtggggagtgaaaagttgttttatgaggaggacgaggccggctccgccacatcatgtctctag

SEQ ID NO: 17854 - DNA, 1368 bp, Artificial Sequence
  Description of Artificial Sequence: Synthetic coding sequence
atgggcctgtcaaccgttccagatctgctgttgccactcgttctccttgagctccttgttggcatttaccctagcggggtgatagggctggtgccccacctgggcgacagggaaaaacgggacagtgtatgtccgcagggcaagtacatccacccccagaataattccatttgctgtaccaaatgccataaaggcacctatctgtacaatgactgtccaggtcccggacaggataccgattgtagagagtgcgagagtggatcatttacagcctcagaaaatcacctgaggcactgtctctcctgcagcaagtgcagaaaagagatggggcaggtggagatatcttcatgtacagttgatagagacacagtatgtggctgccgcaagaatcagtacaggcactactggagcgagaatttgttccaatgtttcaactgctccctatgtcttaatggaacggttcatttgagttgccaggagaaacagaacaccgtctgcacctgccacgctggctttttccttagagagaatgaatgcgtgagctgtagtaactgtaagaagagcctggaatgtactaagttgtgtctgcctcagatcgagaacgtgaagggcacggaagacagcggaacgaccgtcctcctccctttagtcattttcttcgggctctgtttactttcgttgctcttcatcggactgatgtaccgatatcagcgctggaaatcaaagctttactccattgtatgcggcaagtctacaccagaaaaggaaggtgaactcgagggaaccaccacaaagcccctggctccgaaccctagcttcagcccaacaccaggattcactccaaccttagggttcagccccgtgccttcatcaacctttacctcctcatctacatacactcctggagattgtccaaacttcgccgctccccggagagaagtggccccaccctaccagggcgctgacccaatcctggcaaccgccctggcttcagaccccattcccaacccactgcagaaatgggaagacagcgcccacaagcctcaatctctcgacaccgacgaccccgctaccctgtacgcagtcgttgaaaacgtgccacctctccggtggaaggaatttgtacgtaggcttggactgtctgatcatgagatagatcggcttgagctacagaacggccgctgccttagggaggcccaatacagtatgctggccacttggcgaagacggaccccccgcagagaggccaccttggaacttctgggacgggttctgcgcgacatggacttgttagggtgcctggaggatatcgaagaagctctttgcggcccagctgcactgcctccagctccttcacttttaagatag

SEQ ID NO: 17855 - DNA, 657 bp, Artificial Sequence
  Description of Artificial Sequence: Synthetic coding sequence
atggggttaagtaccgtcccagacttgctgttgcctttagtgctcctagagctgttggtgggcatctatccgtccggagttatcgggttggtgccacaccttggagaccgagaaaagcgcgattccgtgtgtccccagggcaagtatattcatccccagaataactctatttgttgtaccaagtgtcacaagggtacatacttgtataacgactgtccggggcctggtcaggacaccgactgtcgagaatgtgagtcaggatcattcactgcatcggagaatcatctgcgtcattgtctgtcgtgttcaaagtgcagaaaggagatgggccaggtggagatttcgagctgtaccgtggacagagacaccgtctgtgggtgccgaaaaaatcagtacaggcactactggagcgagaatctctttcagtgcttcaattgtagcctttgtctgaatggcactgtacatttatcgtgtcaggaaaaacaaaacacagtttgtacctgtcacgctggtttctttctgcgcgaaaatgaatgtgtcagctgctcaaaagtgctgctgtgcagacctggctggaatgctgtcgcccgatccagacttaccgccacctctgcatcccagatccaggctatattgcttcttcagccacccaaatag

SEQ ID NO: 17856 - DNA, 1386 bp, Artificial Sequence
  Description of Artificial Sequence: Synthetic coding sequence
atggctcccgtagcagtctgggctgcgctggccgtcggattagagctgtgggccgcagcacacgctctgcctgcccaagttgcattcacaccgtatgccccggaacctggcagtacttgtcgactgagggagtactatgaccagacggcacagatgtgttgtagcaaatgttctccagggcaacatgccaaagtcttctgtacgaagacttccgacaccgtatgtgatagctgcgaggatagcacatatacccagctgtggaactgggtcccagaatgcctgagctgtggcagtcggtgcagctcggatcaggtggaaacccaggcttgtacccgtgaacagaatcgcatttgtacgtgtcgaccaggctggtactgcgcactcagcaagcaggaagggtgtaggctgtgcgcacccttgcggaagtgcagacccggatttggcgtcgcacggccaggcacagaaacctctgacgtcgtttgcaagccttgcgctcccggcactttcagtaacacaacctcttcgactgatatatgtcgcccacatcagatttgcaacgtggtcgccattcccgggaatgcttccatggatgcagtgtgcacctccaccagtcctacacgatctatggcaccaggggcagtccatctgcctcaacccgtctccacacgttctcagcacacgcagcccacccctgagccatccaccgccccctctacatcatttttacttcctatgggaccaagtccaccagctgaaggcagcactggcgactttgcactgcctgtgggtctcatagtaggagttacagctctgggactcctcatcattggagtggtgaactgcgttatcatgacacaggtcaagaagaagcctctttgtttacaaagggaggctaaggtgccacacctgcccgcggacaaagcaagaggtacacaggggccagaacagcagcatctactgataactgctccaagctcctcaagttcaagtctggaatctagtgcttctgctctggaccggagggcaccaacacgcaaccagcctcaggcaccaggcgttgaagcctcgggcgccggtgaggcacgagcgtcaacggggagttctgatagcagccctggaggccatggaacgcaggtgaacgtgacatgcatagtgaatgtgtgttcctctagtgatcattccagccagtgttcttcccaggcgtccagcacaatgggagataccgactcatcaccttccgagtccccaaaggatgagcaagtacccttctccaaagaagagtgtgctttccgctctcagttagagaccccagagaccttgcttggctcgaccgaagagaaacctctccctcttggcgtacccgacgcaggtatgaaaccatcctag

SEQ ID NO: 17857 - DNA, 807 bp, Artificial Sequence
  Description of Artificial Sequence: Synthetic coding sequence
atggcaccagtggccgtgtgggccgccttggcggtgggattagaattatgggctgcggcacacgctctccctgcacaagttgccttcaccccttatgcgcccgagcctggcagtacctgtcggctgcgggagtactacgaccagaccgctcagatgtgctgttccaaatgtagtcctggccagcacgcaaaggtgttttgtactaagacgtccgatacagtctgcgactcctgtgaagatagcacgtacactcagctgtggaattgggtgcctgaatgcctgagctgtgggtccaggtgctcgtcagaccaggtggagactcaggcgtgtaccagggagcagaatagaatttgcacatgtagacccggatggtactgcgccttgtctaaacaggagggatgcaggctttgcgcacccctgcggaaatgtcggccgggttttggcgtagccaggcccgggactgaaacgtcagatgtggtttgcaagccttgtgcaccgggtactttttctaataccacctcatctacagacatctgtcgccctcatcagatatgtaacgtggttgcgattccaggcaatgccagcatggacgctgtgtgcacgagcacctcacctacgagatctatggccccgggcgctgtgcaccttcctcagccagtgtctacacggtcccagcatacccagcccactcctgaacctagcactgctccgagtactagctttctcctccctatgggcccatccccacctgcagagggcagtaccggcgactttgctcttccagtggtcagcctaagcagtagttag

SEQ ID NO: 17858 - DNA, 468 bp, Artificial Sequence
  Description of Artificial Sequence: Synthetic coding sequence
atggctccagtcgccgtgtgggccgctttagctgtgggcttagaactgtgggcagcagcccacgctctgcccgcccaagtggccttcacgccttacgctcctgagcctggatctacttgcaggctgcgcgagtactatgaccaaactgcgcagatgtgttgttctaaatgttcaccggggcagcacgcgaaggtcttttgcaccaagacatctgacaccgtttgcgattcatgcgaggattcaacgtatacacagttgtggaattgggttccagaatgcctctcctgcgggtccaggtgtagctcagaccaggtggaaacgcaagcctgcacccgagagcagaacagaatatgtacttgtaggcccgggtggtactgtgctcttagtaagcaggaggggtgtcggctctgtgcccctctccggaaatgtagaccaggctttggtgtcgcccggcctgacctgagctag

SEQ ID NO: 17859 - DNA, 114 bp, Artificial Sequence
  Description of Artificial Sequence: Synthetic coding sequence
atggccccggtggcagtttgggcagcgctggcggtcggactggagctgtgggctgccgctcacgccttacctgctcaggtcgatcccgggcccctgtttcctcacccaggctag

SEQ ID NO: 17860 - DNA, 1968 bp, Artificial Sequence
  Description of Artificial Sequence: Synthetic coding sequence
atgggcaccagcccctcctcttcaaccgctctggcctcatgttcacgcattgccaggcgggctaccgcaacaatgatcgcagggtcgctcctgctgctgggctttctgtcaacgactaccgcccagccagaacagaaagcaagtaacttaatcggtacatatcgccatgtcgatcgggcaactggccaggtgttgacttgcgacaaatgtccagcaggaacatacgttagcgaacactgcaccaacacatctctgcgcgtctgctccagctgccccgtcgggacttttactcgacacgagaacggcatcgagaagtgccacgactgtagtcagccatgtccctggccaatgattgagaagttaccctgtgcagcccttaccgatagagagtgtacttgtccacccggcatgttccagtccaatgccacttgcgctccccacactgtctgtcctgtgggttggggagtccggaagaaggggaccgagacagaggatgttcgctgtaagcagtgcgcacggggcacattcagcgatgtcccctcttctgtaatgaagtgcaaagcctacacggactgccttagccagaacctggtagtgatcaagcctggtaccaaggagaccgataatgtgtgtggtacacttccttcctttagctcctctacctccccaagtcccgggactgcaattttcccccggccagaacatatggagacacacgaggtgcctagtagtacatacgtgcccaagggcatgaatagcacagaatcaaattccagtgcatctgtgagaccaaaggttttaagctcaatacaggaagggaccgtgcctgataacaccagttctgcacggggcaaggaggacgtgaacaagaccttgcctaatctccaggtggtcaaccatcagcaggggccgcaccataggcacatcttgaagctgctgccttcaatggaagccaccggcggcgagaagtcatcaacacccatcaaggggccaaagaggggccatccccgacagaatcttcacaaacatttcgacatcaatgagcacctcccctggatgattgtcctattcctgctgttggttctcgtggtcatcgtggtctgttccatccgcaaatcttcacgtacccttaaaaaaggcccccggcaggatccctccgctattgtggagaaggccgggctgaagaaaagcatgactccaacccagaaccgggagaaatggatctactactgcaatggtcatgggatcgatatcctgaaactggttgctgctcaggtgggcagccaatggaaagatatctatcaatttttgtgtaatgcctctgagcgcgaagtggccgccttctctaatggatacactgctgatcacgaacgcgcatatgcagcgcttcaacactggaccatccgaggaccggaagcctcgctcgcccagctgattagcgccctgagacagcaccggcgcaatgacgtggtggagaaaatcaggggcttgatggaggacacgacacagttggaaactgacaaactcgctttgccgatgtcaccatctcctctgtcaccgtcccccatcccctccccgaatgccaaactcgaaaactcagccttacttaccgtggaaccaagccctcaggataaaaataaagggttcttcgtggacgagtctgagcccttattgagatgcgacagcacatcttctggctcttccgccctgagtcgcaatggcagctttatcactaaagaaaagaaggacacagtgttgaggcaagtccgcctggatccttgtgacctgcagcccattttcgacgatatgctgcatttcttaaaccctgaggagttacgtgtcattgaggaaatccctcaggcagaagacaaactcgaccgactcttcgaaattattggggtgaaatcccaggaggcttcacaaaccctacttgactcagtatactctcacctccccgacttactgtag

SEQ ID NO: 17861 - DNA, 1035 bp, Artificial Sequence
  Description of Artificial Sequence: Synthetic coding sequence
tcgtgttgtagaccatggcggcccctcggagctcggtcccccgcacgcccttccagaccaaaaaggggacaccccagacagaacctgcataagcactttgatattaatgagcatctaccctggatgatcgtgctctttctgctcctggtactggttgtgatcgttgtgtgctccattcgcaaatcatcaaggaccctgaaaaagggtccccgccaagatccctccgcgattgtcgagaaggccggcctgaagaaatccatgacacccacccaaaaccgagagaaatggatctactattgcaacggtcatggaatcgacatcttgaagctagttgctgctcaggttggttcgcagtggaaagacatttaccagtttctgtgtaacgcttccgaacgggaggttgccgctttcagcaacggatatacagccgaccatgagcgagcttacgccgccttacagcactggactatcaggggaccagaagcctcactggcacagctgatttcagccctaagacaacaccggaggaacgacgtggtggaaaaaatacgcggcctcatggaggataccacacaactggagactgacaaactggctctgcccatgagcccctcccccctgtccccgagtcccatcccatcccccaatgcgaagttagaaaactccgcattgttaaccgtcgaaccgtccccacaggacaagaataaagggtttttcgttgacgagagtgagcctctcctgagatgtgacagtaccagctctgggagttcagccctttctaggaatgggtcattcatcacgaaggagaaaaaggataccgtcctgaggcaggtgcgactagacccgtgtgatctgcagcccatattcgacgatatgctgcacttcctcaatccagaagagctgagggttattgaagagatcccgcaggctgaggataaactggatcggctattcgagattatcggcgtgaaaagccaggaggcttctcagaccctcctcgattctgtgtactcccacctcccagacttgctgtag

SEQ ID NO: 17862 - DNA, 1119 bp, Artificial Sequence
  Description of Artificial Sequence: Synthetic coding sequence
atggagcagcgcccacgcggatgtgctgctgtcgctgcggccctcctgctagtgctgctgggcgcacgagctcagggagggacacggtctcctcggtgcgactgcgctggagatttccataagaaaatcggactcttctgttgccggggttgcccagccgctagccaggtcgctctcgagaactgtagtgccgtggcagacactcgatgcggctgcaagccaggttggttcgtggagtgtcaggtttcccagtgtgtgtcatccagtcctttctactgtcagccatgcctggactgcggcgctttgcaccggcatacaaggcttctatgctcacgccgggataccgactgtggcacctgccttcctgggttttatgaacacggcgatggttgcgttagctgtccaaccagtaccttaggtagctgcccagagaggtgcgccgccgtgtgcggatggcggcaaatgttttgggtgcaggtgctactggctggactggtggtgcccctgctgctgggcgcaacactgacatacacatatcgccactgctggccacataaaccactggtcacggccgacgaggccggcatggaggctctgactcctccacctgctacgcatctgtcgcctttagattccgcacacactcttctggccccgcctgactctagcgagaagatctgcacagttcaattggtgggcaattcttggactcctgggtacccagagacacaagaggctctttgtccccaggtcacatggtcctgggaccagctcccctcacgagcattaggcccagccgctgcaccaactctcagcccagaatccccggccggctccccagccatgatgcttcaacctggtccccagctttacgacgtgatggacgctgtgccagcaaggcgatggaaggagttcgtgagaacattaggcctacgggaggcagagatcgaggctgtggaagtcgaaattggtcgctttcgggaccaacaatatgaaatgctcaagcggtggagacagcaacagccggctggcctgggtgcagtttatgcagccctcgaaaggatgggtctagacggttgtgttgaggacctgagatctcgtctgcaacgaggaccttag

SEQ ID NO: 17863 - DNA, 705 bp, Artificial Sequence
  Description of Artificial Sequence: Synthetic coding sequence
atggaacaacgaccacgcgggtgcgccgctgtggctgcggctctcttactcgtcctactgggagcacgggctcagggggggacgcggagtcctcgctgtgattgtgctggggacttccataagaagattggtctgttttgttgtcgcggctgcccggccgacgaagccggtatggaggctttaacaccacctccagccactcatttgtccccactggattccgcccacaccttactggctccacctgatagttctgaaaagatctgtactgtgcagttagtcgggaacagctggacaccgggttatccggaaacccaagaggctctgtgcccacaagtgacttggtcctgggatcagttgccaagtcgcgccttaggaccagcagccgcaccgaccttgtcaccagaaagccctgccggtagtccagccatgatgctgcagcctgggccgcagctgtacgatgtgatggacgcagtcccggccagacggtggaaggagtttgtcaggacccttggtctcagagaagcagaaattgaagctgtggaagtggaaattggccgctttcgcgaccagcaatatgaaatgttgaagcggtggaggcagcaacagccagcgggcctgggggctgtgtacgcggctctggaaagaatgggtctggacggctgcgtcgaagatctgcggagccggctccagcgcggaccctag

SEQ ID NO: 17864 - DNA, 1143 bp, Artificial Sequence
  Description of Artificial Sequence: Synthetic coding sequence
atggaacaacgccctcgcgggtgcgccgctgtggccgctgcccttctgctggttttactcggcgcccgagcgcaaggaggtacacggagcccccgttgtgactgtgccggagactttcacaagaaaattggcctgttctgttgccgcggatgcccggctggacattaccttaaggccccttgtacagagccttgcggaaatagtacttgtctcgtgtgcccccaggatacattcttggcgtgggaaaaccaccacaactcagaatgcgctaggtgtcaggcctgcgatgagcaagctagccaggtcgctctagagaactgcagtgccgttgccgataccaggtgtgggtgtaaacctggctggttcgtggagtgtcaggtgtcccagtgcgtgagctcgtcaccattttactgtcagccctgccttgactgtggggccctccatagacatacccgactgctgtgttccagaagggatacagactgtgggacttgtttacctggcttttatgagcatggagacggttgcgtgagttgtcctacgagcactttgggttcatgtcctgagcgatgcgcggccgtgtgtggctggcgtcaaaacgaggcaggcatggaggcactgacccctccacccgccactcacttgtctccactggatagtgcccatacacttctggctccccccgacagcagcgaaaaaatttgtacagttcagcttgtcgggaacagctggactcctggatacccagagacacaagaagccctttgtccacaggttacctggagctgggaccaactgccaagtcgcgccttgggacccgctgccgctccaactctgtctcccgagagtccagcgggtagcccagccatgatgttgcagcccgggcctcagctgtatgacgtgatggacgctgtgcccgcgcggagatggaaggaattcgtgaggacgctgggactccgggaggctgagatcgaagccgtagaggtcgaaatcggcaggtttcgcgatcagcaatacgagatgcttaagcgttggcgacagcagcaacctgcaggactgggtgctgtgtacgctgccttggaaagaatgggactcgacgggtgcgtggaagatctgagaagccgcctccagaggggtccatag

SEQ ID NO: 17865 - DNA, 1254 bp, Artificial Sequence
  Description of Artificial Sequence: Synthetic coding sequence
atggaacaacgcccacgcgggtgcgcagccgtcgccgccgcacttctactggtgctcctgggagcccgcgcccagggcgggacccggtcacctcgttgcgattgcgctggcgacttccacaagaaaataggtctcttttgctgcaggggctgtccagctggccactatctaaaggccccgtgcacggaaccctgcggcaattccacatgcttggtctgccctcaggatacatttctggcgtgggagaaccatcacaatagcgaatgtgcaaggtgccaggcttgcgacgagcaagccagccaggtcgctctggagaactgctctgcagtagccgacacccgctgtggatgtaagcctgggtggttcgtggagtgtcaggtctcacagtgtgtcagcagtagtcctttttactgccaaccgtgcctcgattgcggtgccctccacaggcataccagactattatgctccagaagggacaccgactgtgggacttgtttgccaggcttctatgagcacggcgatgggtgtgtctcctgccctactagcacgctaggaagttgccccgaacggtgtgccgctgtgtgtggttggagacaaatgttttgggttcaagtcctcctggctggtttggtggttccccttctcttgggcgcaaccctgacctacacctatcggcattgttggccccacaagcctctggtgactgccgacgaagccggcatggaagccttaactcccccgcctgccacgcatttgagtccactcgattccgcccacacactccttgctcccccagattcctctgaaaaaatttgtacggttcagttagtaggtaattcctggacccctgggtaccctgagactcaggaagctttgtgtcctcaggtgacatggtcttgggatcagctcccttcccgcgcattggggcctgccgccgcccctaccctcagcccagagagccccgccggtagtcccgccatgatgttacagccaggtccacaactttatgatgtcatggatgctgtgccagcaaggcggtggaaggaatttgtgcgaacgctgggactgcgggaagccgaaatcgaggccgtggaggtggagatcgggagattccgggatcagcagtatgagatgcttaaaagatggcgccagcagcagccggctggcttaggcgccgtgtacgccgcactcgaacgaatggggctggacgggtgtgttgaagacctccgctctaggctacagcgcgggccctag

SEQ ID NO: 17866 - DNA, 1281 bp, Artificial Sequence
  Description of Artificial Sequence: Synthetic coding sequence
atggagcagcggcctagagggtgcgccgccgtggctgccgccctgctcctcgtcctactgggcgccagggctcagggcggaactagaagcccccgctgcgactgcgccggcgacttccataagaagattggactgttctgctgccgcggctgccccgccggacattaccttaaggccccttgcaccgagccctgtggaaattccacctgcctcgtatgtccacaagacacatttctggcttgggaaaaccaccataatagcgagtgcgcccgatgccaggcttgcgacgagcaagcctctcaggtggctctcgagaactgctctgctgtcgcggacactaggtgcgggtgcaagccggggtggtttgtcgaatgtcaggtaagtcagtgcgtgagttcctctcctttttactgtcagccgtgtcttgattgtggcgccctccacagacatacgcgcttgttatgtagccgtagggacaccgactgcggtacctgtctgccagggttctatgagcacggagacggatgcgtcagttgcccaaccccccccccatctctggccggagcaccatggggagccgtacagtctgcagtcccactgagcgtggccggggggcgagttggcgtcttttgggtacaggttctactggcaggactggtggttcctttactgctgggggccacactgacttatacgtatagacattgttggccacacaagcctttagtgaccgcagatgaggccggtatggaagcattgactcccccgcctgccactcacctgtcacccttggatagcgcccacacattgctggcaccacctgatagttcagaaaagatatgtacagtccaactcgttggaaattcttggactccgggatatcccgaaacccaagaggccctatgcccccaggttacttggagctgggatcagctacccagtcgagctctgggtcctgctgcagcacctaccctgagccctgaatccccggctggctctccggccatgatgttacagccaggtcctcagctgtacgatgtgatggacgcggtgccggcacgacggtggaaagaatttgttagaacactcggacttagggaggccgagattgaagccgttgaggttgaaatcggaaggtttagagaccagcaatatgaaatgttgaagcgatggaggcagcagcagcctgccggccttggagctgtgtacgctgccctcgagcgcatggggctggatggatgtgtggaagacctaaggtctagactgcagcgcgggccctag

SEQ ID NO: 17867 - DNA, 768 bp, Artificial Sequence
  Description of Artificial Sequence: Synthetic coding sequence
atggggaactcttgttataacatcgttgccactttgctcctggtgcttaactttgagcgtacacgaagcttacaggatccttgcagtaactgtcccgctggtaccttctgtgataataacaggaatcagatatgtagtccctgtccgccaaattccttttcatctgctggaggccaacgaacgtgtgacatctgtagacagtgtaagggcgtatttagaacccgcaaggaatgttcatccacctctaacgcagaatgcgactgtacccccggattccattgcctgggagccgggtgcagcatgtgcgaacaggactgcaaacagggtcaggaattaactaaaaagggttgcaaggattgttgtttcggaacattcaatgaccaaaagaggggcatctgcaggccctggacaaactgttccctggacgggaagtccgtgctcgtgaacggcaccaaagaaagagacgtggtgtgtgggccttcacctgctgatctgtcacctggcgcctcttcagtgaccccacccgctcctgcacgagagcccggccattccccacaaattatatcctttttcctggccctgacgtccactgcccttctctttctgctcttcttcctgacgctcaggtttagcgtggttaagaggggccggaagaagcttctgtatatctttaagcagccattcatgcgacccgtccagaccacccaagaagaagacggatgctcatgccggtttcccgaggaagaggaagggggatgtgagctttag

SEQ ID NO: 17868 - DNA, 5919 bp, Artificial Sequence
  Description of Artificial Sequence: Synthetic coding sequence
atggatccaacaggcagccagttggatagcgacttttctcaacaagacaccccttgcctgatcattgaggattcccagcccgaaagccaggtgctggaagatgattccgggtctcactttagtatgttatctaggcacctccccaatcttcagacccacaaagaaaatcccgtgctcgacgtggtgagtaatcctgagcaaacagccggagaggaacgtggcgatggtaactcagggtttaacgaacacctgaaagaaaacaaggtcgctgatccggtggactcttccaacctggatacctgtggatcaatctcacaggtgatcgagcagttaccacagcccaaccgtaccagctctgtgctcgggatgtctgtggagtcagccccagccgtcgaggaggaaaagggtgaggagctggaacagaaagagaaggaaaaagaggaagatacgtccggtaatacgacgcactcgctgggcgccgaggatactgcaagtagtcaactgggattcggggttttggagctgtcacagagtcaagatgtcgaggagaacacagtcccatacgaggttgacaaagagcagcttcagtccgttactaccaacagcggctacacgaggctgtctgacgtggacgccaataccgccatcaaacacgaggagcagtcaaacgaggacatccccatcgccgagcaaagctccaaagatattcccgtgactgcccaaccctcgaaagacgttcacgtcgtgaaagagcagaacccgcctcctgctcgatctgaagatatgccgttttctcctaaggccagtgtggccgccatggaggcaaaggagcagctctcggcccaggagctgatggagtccggcttacaaatccagaagtccccagagccagaggttctgtccacccaggaagacttgtttgaccaaagcaataagaccgtatcgtccgacggctgctccacaccatccagggaggaagggggatgctctctggcctctaccccagccaccacccttcacctcctgcagctctctgggcagcgatctttggtacaggattcactgtcaaccaactcatcagatttagtagcaccctcacccgacgcattccggagcactcccttcattgtgccatctagtccgaccgaacaggaagggaggcaagataaacccatggacacaagtgtactgtccgaggagggcggagagccatttcagaagaagctgcagtcaggagaacctgtcgaactggagaacccaccactgctgcccgaatcaactgtgagccctcaagcctctacacccatatcccagtcgaccccagtatttcctccagggagcctgcccatcccctcccagcctcagtttagccacgatatctttatcccctccccgtccctagaagaacagtccaatgacggcaaaaaagatggggacatgcactcttcctctctgaccgtagaatgttcaaagacgtccgagattgagcctaagaattcacctgaagatctggggctgtccctgacaggagattcctgtaaattaatgctgtctacctctgagtattcccagtcccccaaaatggaatccctgagctctcacaggatagatgaagacggcgagaatacccagatcgaggatactgagcccatgagcccagtgttgaactcaaaatttgtgccagcggagaacgactcgattctgatgaaccccgcccaggatggggaggtgcagctgagtcagaatgacgacaaaaccaaaggagatgatacggacacccgtgatgacatctccattctggccaccggttgtaagggtcgtgaggaaaccgtcgccgaagacgtgtgtatagatctcacctgcgattccggctcgcaggcagttcctagccctgcgactcgcagcgaggcactcagctcggtattggaccaggaggaagcaatggagattaaagagcaccatccagaggagggaagttccggctccgaagttgaggagattccagaaactccatgcgaatcccaaggcgaggagctgaaagaagagaacatggaatcggtcccactgcatctgtcattaacggaaactcaaagtcagggcctgtgtctacaaaaagagatgcccaagaaggagtgtagcgaggcgatggaagtagagacgtccgtcatttccatagattctccccagaagctggcaattcttgaccaggagcttgaacacaaggaacaagaagcatgggaagaagccacatccgaggatagttcagtggtcattgtcgacgtgaaagaaccgagccccagagtggatgtcagctgcgagccgctcgaaggcgtggaaaagtgctcggattcacaatcctgggaagatattgctcctgagatcgagccttgtgctgaaaaccggctggacactaaggaagaaaagtcagtggaatacgagggtgatctgaagagcgggactgcagaaacagagcctgtggagcaagattcttctcagccttcgttaccgctggtccgtgcagacgatcccctcaggctggatcaggaacttcaacagccacagacgcaggaaaagacctccaattcactcactgaagattccaagatggctaatgccaagcagctgtctagcgatgccgaggcgcagaaactgggtaaaccaagtgctcacgcaagccaaagcttttgcgagagttccagcgaaacccctttccacttcacgctgccaaaggaaggcgacattattccacccctaaccggagccacccctccgctcatcggccacctgaaactggaacccaagcgacactcaactccaatcggcatctcgaactaccctgaatccacgatcgcaactagcgacgtgatgtcggaaagcatggtggaaacacatgatccgatccttggctctggcaagggcgactcaggggctgcgcctgatgtggatgacaagctttgtcttaggatgaagctggtctcacccgagactgaggcatcagaggagagcctgcagttcaacctggaaaagcccgcaacaggggaacgaaagaatgggagcaccgctgtggcagagtccgtggcaagcccacagaagacaatgagtgttctgtcctgcatttgtgaggccaggcaggagaacgaagccaggtctgaggacccccctaccaccccgatacgaggcaacctgctgcactttccatcctctcagggggaagaggaaaaagagaaactggagggggatcacaccatccgccagagccagcagcccatgaagcctatttctcccgtgaaggaccccgtgtctccggcgtcacaaaaaatggtcattcaaggaccatcttccccccagggagaagctatggtgactgatgtattggaggaccaaaaggagggccgctccactaataaggagaacccctcaaaggcactgattgaacggccaagccagaacaatatcggaatccagacaatggagtgctcgctgagggtccctgagacagtgtccgccgctacccagacaattaaaaacgtgtgtgagcagggcacatctacggtggatcagaattttggtaagcaggacgctaccgtccagaccgagaggggctctggcgagaagcccgtctctgcccccggtgacgatacagagagcctgcattcacaaggcgaggaagagttcgacatgcctcagccgcctcacggccacgtcttgcacagacatatgagaaccattagggaggttaggactttagtcacaagggtgatcacagacgtatattacgtggacgggaccgaggtggagcggaaggtgaccgaggaaactgaggaacctatcgtcgagtgccaggaatgcgagacggaggtgagtccatcccagactggcggttctagtggcgacctgggggacatctcctctttcagttcaaaggcctctagccttcaccgcacctctagcgggacatctctgagcgctatgcacagctcaggctctagcggcaaaggggccggtcccttgcgtggtaaaactagcggaaccgagcctgccgatttcgcactgccatcatccaggggagggccaggtaagctcagcccacgcaaaggggtgagccagacagggacccccgtttgtgaggaagacggggacgccggactggggatcaggcagggcggaaaggcgccagtaacaccgagaggccgcgggcgcagagggcgccccccatcccgtactacgggcactcgcgagacagctgtgccggggcccttgggcattgaggatatttcccctaatctgtcaccggacgataagtccttcagccgcgtcgtcccccgtgtcccagacagcacaaggcgtactgacgtgggggctggcgcactccgccggtccgatagccctgaaataccctttcaagccgctgccggaccaagcgatgggttagatgcttcatctcctgggaattcctttgtcggattgagggtggttgcgaaatggagctccaatggctacttctattcaggcaagattacgcgcgatgttggggcaggcaaatacaagcttctcttcgatgatggctatgaatgcgatgtgctgggaaaggacattttgttgtgtgacccaattcctctggacactgaagttaccgccctgtctgaagatgagtatttcagtgccggcgtggtgaagggccatcggaaggagtctggtgaactatactacagcatagagaaggagggccaacgcaagtggtataagaggatggctgtcatcttgtccctggaacaagggaatcgccttcgcgaacagtacggactggggccatacgaggctgtcacgcctttaactaaagctgccgacatcagtctggataacttagttgaaggaaaaaggaagaggcgttccaatgtgtccagccccgctacaccaacagccagcagctcatcgtcaacgacaccgacccggaagatcaccgaatctccccgcgcgagcatgggagtgctctccggaaaaagaaagttaatcaccagtgaggaggaaaggtcacccgcgaagagaggccgcaaatccgccaccgtcaagcctggtgcggtgggtgccggagagtttgtttccccatgcgaaagcggcgataacactggcgagcctagcgcactggaagagcagcggggccccctgccactaaataaaactctttttttgggttacgctttcttgctgacgatggctactacctctgataagctggccagtaggagtaaactccctgatggacctaccgggtcttctgaagaagaagaggagttcctggagatccctccatttaacaagcaatacaccgagtcccagctgcgggcaggggctggttatatcctggaggacttcaatgaggcacaatgcaatacagcctaccagtgcctgctcattgctgaccagcattgtaggactaggaagtactttctttgcctggcttctggaattccctgtgtttcacacgtttgggtccacgactcttgtcacgcaaaccaactgcagaactatagaaattatttgttgccagccggctattcccttgaggagcagcgcatcttagactggcaacctcgggaaaaccccttccaaaatcttaaggtgctcttggtgagcgaccaacagcagaatttcctcgaactatggagtgaaattcttatgaccggcggagcagcttcagttaaacagcaccacagctccgcacataacaaggatattgccctcggcgtgtttgacgttgtggtcaccgacccaagctgcccagccagcgtgctgaaatgtgcagaagctctgcagctccccgtggtgtcgcaagaatgggtcatccagtgcctgatcgtgggcgagagaataggcttcaagcaacacccaaaatacaagcacgactacgtctctcactag

SEQ ID NO: 17869 - DNA, 5784 bp, Artificial Sequence
  Description of Artificial Sequence: Synthetic coding sequence
atgcctggcgagcagatggatcctactggctcccagctggacagtgattttagtcaacaggatacaccatgcctgattatagaggattcacagcctgagtcgcaggttctggaggacgattccggctctcattttagcatgctatctcggcacttgccgaacttgcagacgcataaagaaaacccggttctagacgtggtgagcaatccagaacagacagccggagaagaacggggcgacgggaacagcgggtttaatgagcacctgaaggagaacaaagtggccgaccctgtcgacagcagcaatctcgatacatgcgggtccatctctcaggtgattgaacagctgccacagcccaacagaaccagctccgtccttggaatgagtgtcgagtctgcccccgctgtggaagaagagaaaggagaagagttagaacagaaagagaaggaaaaggaagaagacacaagcggcaataccacccatagcctgggggctgaggacacggcctcatctcagctgggctttggcgtgctggagctgagccagtctcaggacgtagaagaaaacactgtgccatatgaggtggataaggaacagctacaaagcgtgactactaattccgggtatacacggctgtctgacgtggatgccaacaccgccatcaaacatgaagaacagtctaacgaggatattccgatcgcagaacagagtagcaaagacatcccagtgacagcccaaccatcgaaggacgtgcacgtggtcaaggaacagaatcccccaccagccagatccgaagatatgccctttagcccgaaagcctcggtggccgccatggaggccaaagaacagctgtcggcacaggaattaatggagagcggactgcaaatacagaaaagtccggagccggaagtattgagcactcaagaagacttgttcgatcagagcaataaaacagtaagcagcgatgggtgctcaactccgagcagggaagagggtgggtgttctcttgcctccactcccgccaccaccctccaccttctacaattaagtggccagagaagtctggtgcaggacagcttgagtactaactcttccgacctcgtagccccaagtccagatgcgttcaggtcaactccattcatcgtccctagctcccctaccgagcaggagggaaggcaagacaagccaatggatactagtgtgctgtctgaggaagggggcgagccattccagaagaagctgcagtccggcgaaccggtggagctggaaaacccccctttgctgccagagagcactgtctctccgcaggcgagtacccctataagccagtctactccagtattcccccccgggagccttcccatcccatcccaaccacagttttctcatgacatcttcatcccgagcccatcccttgaagagcagtctaacgatgggaagaaagatggggacatgcacagtagcagcctcaccgttgagtgttcaaaaacaagtgaaatcgagccaaaaaattctcctgaggatcttgggctgagtctgacaggggactcttgtaaactgatgctgtcaactagcgagtattctcaatcacctaaaatggagtctctgtcttcccacagaattgatgaggacggagaaaatacacaaattgaagacacggaaccaatgagccccgtccttaattcaaaattcgtgcctgctgaaaacgactctattctcatgaatccagcgcaggacggtgaagtgcagctatcccaaaacgatgataagaccaagggggacgatactgacactcgcgacgatatatccattttagccacgggctgcaaagggagggaagagactgtcgctgaggacgtgtgtatcgacctcacctgtgacagtgggtcgcaggcagtgccaagcccagccacgcgcagcgaggccctatcctccgtgctggaccaggaagaggccatggaaatcaaggagcaccaccccgaggaaggcagtagcggctctgaagtggaggagatacccgagactccttgcgaatcacagggggaagagctgaaggaagagaatatggagagtgtccccctccacttaagtctgactgaaacccagtctcaggggctctgtctgcagaaagagatgccaaagaaggaatgctctgaggctatggaggtggagacttctgtgataagcattgactcccctcagaagctggcaatcctggaccaggaactggagcacaaggaacaggaagcgtgggaagaggctacatccgaagattccagtgtcgtcatcgttgacgtgaaggagcctagcccaagagttgacgttagctgtgagcccctggagggagtggaaaagtgttccgactcacaaagctgggaggatattgcgcctgagatcgaaccatgcgcggaaaacaggctggataccaaggaagaaaagtctgtagagtacgagggggatctgaagtcaggaacggccgaaactgaacctgttgagcaagactccagtcagcccagtctgcctctagtgcgcgcggatgatcctctcagactggaccaggaattacagcagccccagactcaggagaaaacctccaatagcttgaccgaagacagtaagatggctaacgccaaacagctgtcgtccgacgcagaagcccaaaaacttggtaagccttcagcccacgcgtcacagtccttttgtgagagctcatccgagactccattccacttcaccctaccgaaggagggtgatattattcctccattaaccggtgcaaccccgcctttgatcggccacttgaaactggagcccaagagacactcaacaccaatcggcatatcaaactatccagagtctacgatcgccaccagcgatgttatgagtgagagcatggtggagacacacgaccccatcttgggaagcggaaagggcgattctggagcagcaccagacgtggacgacaaactgtgtttgcgcatgaagctggtatctcccgaaacggaagcaagcgaggagagcctgcagtttaacctcgaaaagccagcgacgggagaacggaaaaatggcagtacagcagttgccgaatccgtggcatccccacagaaaaccatgagcgtgcttagttgtatctgtgaagcacgccaagaaaatgaggccaggtctgaggatcccccgacaaccccgatacgtggaaacctcctgcatttcccttcgtcccagggagaggaagaaaaggagaaattagaaggcgaccatacaatccgtcagagtcagcaacccatgaagcccatttcacccgtgaaggatcccgtcagtcccgcaagccagaaaatggtgattcagggccctagctccccccagggcgaggccatggtgaccgacgttttagaagatcagaaggaaggccgctctacgaataaagagaacccttccaaagctctcatagagcggccttcccagaataacattggcatccagaccatggagtgcagtcttagggtcccggagaccgtcagtgcagccacgcagaccattaaaaacgtttgtgagcagggcacatctacagtggatcagaactttggcaagcaggatgccacagtgcagacggaacgcggctctggcgagaagcctgtctccgcccccggtgacgatactgaatccctacactctcagggcgaggaagaattcgacatgccccagccgccccacggacacgttctacataggcatatgagaacaatacgtgaggttaggacactggtgacccgagtgataacggacgtatattacgtggatggtactgaagttgagcgaaaagtcactgaggagacagaggagcctattgtagaatgccaggaatgcgaaactgaggtgagtccaagccagaccgggggcagcagtggcgatttaggcgacatcagctccttctcatcgaaagccagctcattgcataggacaagctccggcacatctctgagtgccatgcacagctccgggtcttccggaaaaggcgcgggaccattaagaggcaaaactagcggcacagaaccagctgattttgccctcccgtcttccagggggggcccagggaagttgagggagaccgcagttcccggccctctcggcatagaggatatctcccctaatttgtcgcctgatgataagagctttagtcgggtggtgccccgtgtgcctgacagcacccgaagaactgacgtgggagcaggcgcattgaggagatctgatagccctgagatcccttttcaggcagcggccgggccatcagatggtctggacgcctcttcacccggcaacagctttgtggggctgagagtagtcgcaaagtggtcatctaacgggtacttctatagcggaaagataacacgggacgtcggggccggaaaatataagctgcttttcgacgacgggtacgagtgtgatgttctgggcaaggatatcctactttgtgatcccatccctttagacaccgaggtgaccgcactttccgaggatgaatacttttcggctggagtcgtgaaggggcacagaaaagagtccggcgagctgtattattctatcgagaaagagggccagcggaaatggtataagaggatggccgtgattttgtcactcgagcagggaaatagacttcgcgagcaatacggcctgggaccctatgaggccgttactcctttgacaaaggcagcagatatttctctggacaacctggtcgaaggtaagagaaagagaagatccaatgtgagcagtccagctacccccaccgccagcagcagctcctcgactactcctacacgcaaaattacggagtcgccccgcgccagcatgggagtgctgtccgggaagaggaagttgatcacgtccgaggaggagagatcaccagcaaaaagaggtagaaagagtgccacggtgaaacctggggcggtgggagctggcgaatttgtttctccctgtgagtcgggggacaatactggcgagccttctgcactggaggaacagcggggcccgctgccactgaacaagacactgttcctgggttacgcttttttacttacaatggccacaacctcagacaaactcgcctcccgcagcaagctccctgatggccccacaggctcttctgaagaagaggaggaattcctggagattcccccctttaataaacagtacactgaatctcaattacgcgcgggagcaggatacatactggaggacttcaacgaggcccagtgtaatacagcctaccagtgcctgctcattgctgatcagcattgcagaactagaaagtactttctttgtttggcatctgggataccatgcgtatctcatgtctgggtgcatgatagttgccacgcaaatcagctgcagaattatcggaattacctcttacccgccggatacagcctggaggagcagaggatcttagattggcaaccacgggagaatcctttccaaaatctgaaagtgctcttagtctccgatcaacagcagaattttcttgaattatggagtgagattcttatgaccggcggcgctgcctctgtgaaacaacaccattcttccgctcacaataaggatatcgccctgggcgtcttcgatgtagttgttaccgatcccagctgccccgcttccgtattgaagtgcgccgaggccctgcaattgccagtggtgtcccaggaatgggttatacagtgtctgattgtgggagagcgcattgggtttaaacagcatccgaagtacaagcacgattacgtgtctcactag

SEQ ID NO: 17870 - DNA, 5934 bp, Artificial Sequence
  Description of Artificial Sequence: Synthetic coding sequence
atgccgggtgagcagatggacccaactgggtcacagcttgactctgactttagtcaacaggatactccatgccttatcatcgaagacagccaaccagagagccaggtgctcgaggacgacagtggctcacatttttcaatgctttcccggcatctgccgaatttgcagacacataaagagaacccagtcctggacgtggtctcaaatcctgagcaaacggccggcgaggagaggggtgatggcaactcgggcttcaatgagcacctgaaagaaaacaaagtggcagaccctgtcgatagctccaatctggacacctgtggatccatttcccaagtgattgagcaattacctcagcccaatcgcacttcctcagtgctgggcatgtcggttgagtccgctcctgccgtggaggaggaaaagggcgaagagctggagcagaaagaaaaggaaaaagaggaggataccagcggaaacacaacacatagtctgggggctgaggatacggccagctcgcagctcggcttcggcgttctggaactatcgcaatctcaggatgtcgaggagaatacggtgccttacgaggttgataaagagcaactccagtcagtcacaaccaacagtggctacactcgcttatccgacgtagacgccaacactgcaattaaacacgaggagcagtcaaacgaagatattcccattgcggagcagagcagtaaagatatcccagtgactgctcaaccatctaaagatgtacacgtggtaaaggaacagaacccaccacctgccagatccgaagatatgccattcagtccaaaagcctctgttgccgccatggaagccaaggagcaactgagcgcacaggagcttatggagtctggcctgcaaatccaaaaatccccggagcctgaggtactctctacacaggaggatctctttgatcagagcaacaagacagtgagttccgacggatgctccaccccctcccgggaggagggaggctgttctcttgcttctaccccagcaactaccctccatttgctgcagctatctggccagaggtccttggtgcaggatagtctaagcacaaactccagtgatctggtggccccttcacctgatgccttcagatcaacaccttttattgtaccttctagtcctaccgaacaggagggcaggcaagataaacccatggatacttctgttctgtcggaagaggggggcgaaccttttcagaagaaattgcagagtggagagcctgtggaacttgaaaatccaccgctgctgccagagtccactgtgtctccgcaggccagtactcccatcagtcaatccactcctgtatttccccctgggtcactcccgatcccctcacagccccagttttctcacgatatatttataccctctccttctctggaggagcagagcaacgacgggaaaaaagatggagacatgcactcaagcagcctgacagtggaatgtagcaagaccagtgaaattgagcccaagaatagccccgaagacctgggtctgtcccttacaggcgattcctgtaagctgatgctgtcaacctcggagtatagccagtcccctaagatggagtctctgagctctcacaggattgatgaggacggcgagaatactcagatcgaagacacagaacccatgtcaccagtgcttaattcaaagttcgtccctgcggaaaatgattctatactgatgaaccctgcccaggacggagaggtgcagctctctcagaacgacgataagacaaagggagatgacacagacaccagagatgatatcagtattctagccacaggttgcaaagggagagaggagaccgtcgctgaagatgtttgtattgacctaacatgcgactctggctctcaggcagtgcccagcccagcaactcggagtgaagccctgagctcagtcttagatcaggaagaggccatggaaatcaaggagcaccacccggaagaaggatcgagcggatcagaggtcgaagagattccagagacaccatgtgaatcccagggggaagagctgaaggaggagaacatggaatcagtaccactgcatctgagccttaccgagactcagtcccagggcctctgtcttcagaaggagatgccaaagaaggagtgctcggaggctatggaagtggaaacttcagtgattagcatcgactcacctcaaaagttggctattctggatcaggagttagagcataaggagcaggaagcgtgggaggaagccacaagtgaggacagcagtgtagtaatcgtagacgtaaaggaaccctccccacgggtagacgtctcatgtgagccacttgagggagtggaaaaatgctcagactcgcagagctgggaggacattgcaccggagatcgagccgtgtgcagaaaataggctggataccaaggaggaaaaatcagtcgagtatgaaggcgatctgaagtcagggactgcggaaaccgagcctgtcgaacaggatagttcccagccatcccttcccctggtaagagctgatgatcccctgaggttagaccaagaactgcagcagcctcagactcaggaaaagacgagcaacagtctgaccgaagattctaagatggccaatgctaagcagctctcgtcagacgcggaggcacagaagctaggaaaacctagcgcacatgcatcccagtccttctgcgagagctcttccgaaaccccattccacttcacactgccaaaagagggcgatatcattccccccctcaccggggccacgccacctctgattgggcacctgaagctcgagcccaaaagacactcaacccctatcggcatttccaactatcccgagagtacaatagctacgagcgatgtaatgagtgaaagtatggtagagacccacgaccctattctgggctcaggcaaaggggatagcggggccgcaccggacgtagatgacaagctgtgtctgaggatgaaattagtgtccccagaaacagaggcgagcgaggaatccttgcaatttaacctcgaaaagcccgctaccggcgaaaggaagaatggtagtacagctgtggccgagtccgtggcttcccctcagaaaaccatgtccgttttaagttgcatctgcgaagcccggcaagagaacgaagccagatcggaagatccccctacgacacctatcagaggaaatttactccactttccttcctcccagggtgaggaggaaaaggagaagttagagggggaccacactataagacagagccagcaaccgatgaaacccatctctcccgttaaagaccccgtctcaccggcaagccaaaaaatggtcattcagggaccttcatcccctcagggggaggcaatggtaactgacgtgctggaagatcagaaagagggtcgcagcacaaataaggaaaacccgagcaaggcgctaatcgagaggccgtcccagaataacatcggcatccagacaatggaatgttcccttcgcgtgcccgaaacggtgtctgctgctacacagaccataaagaatgtgtgcgaacagggaacttccactgttgaccagaattttggtaaacaggatgcaacagtccaaaccgagagaggaagcggtgaaaaaccagtgtcagctcctggggacgatactgagagccttcactcccagggggaagaggaattcgacatgccccaaccaccccacggtcatgttctgcacaggcacatgcgcactattcgggaggtccgaaccctggttactcgggtcataaccgatgtctattatgtcgacggtactgaagtggagcgcaaagtgacggaggaaaccgaagaacccatcgtagagtgtcaagagtgtgaaaccgaagtgagcccctctcagaccggtggttcatcaggcgacctaggagatatctcttccttttcctccaaggctagtagcttgcaccggacctcttcaggaacttccctctccgccatgcatagctctggcagttccggaaagggcgccggcccactccggggtaagacctctggcaccgaacctgctgattttgccctgccgagcagtcgaggtggccccggaaaacttagtcctcgcaaaggcgtgtcccagaccgggacccccgtttgtgaagaggatggcgatgccggactggggatcagacaaggaggcaaggcgcctgtcaccccccgcggccgaggacggcgtggccggcccccgagtaggacaaccgggacgcgcgaaacagctgtacctggaccccttggcattgaggatatatctcccaatctgagtccagatgataaatcattttctagggttgtgccacgcgttcctgactcaactcggcggaccgacgtgggtgcgggagctctcaggcgatctgactcaccagaaattccctttcaggctgcagccggcccttccgatgggctggatgcatcgagtcctggcaacagcttcgtcggactgagagttgtcgctaagtggagctcgaatggctatttctactctggcaaaatcacaagagatgtcggcgccgggaagtacaaactactgtttgatgacggctacgaatgcgacgtcttgggcaaagatatcctcctttgcgatcctattccactggacaccgaagtgacagccctctctgaagacgagtacttctctgcgggcgtcgtgaagggccatcgtaaggagagcggagagctgtactacagcatcgagaaagagggccagcgtaagtggtacaagaggatggcagtaatcctttcccttgagcaaggaaaccggttgagggagcagtatgggcttggaccatacgaggcagtgacccctctgactaaagcggcagatatttcactggataatctggtcgaaggaaaaaggaagcgaagaagcaacgtgagttcccccgctacacccacagcgtcctctagttcctccaccacccctacaaggaaaatcaccgaatctccccgggctagtatgggtgttttaagcggaaagcgaaagctgattacgtcggaggaggaaagatcgccagccaagaggggacgcaagtccgccaccgtcaaaccaggagccgtgggcgctggcgaatttgtcagcccctgcgaatccggggacaatacaggtgaaccttcagccctggaggagcagaggggtccactgccacttaataagacgctctttctcgggtacgcctttctgctcaccatggccacgaccagtgataaactggcatccaggagtaagctacccgatgggcctacaggctcctctgaggaggaggaggaattcctagagatcccaccctttaataaacagtacaccgagtcacaactcagggctggcgctggctatattctggaggactttaatgaagcacaatgtaataccgcatatcagtgtctactcatcgctgaccagcactgtaggacaaggaagtactttctgtgcctcgcatctggcattccttgcgtcagccatgtgtgggtacacgactcatgccacgctaatcagctgcaaaattacaggaactatctgctgcctgctggctattcactggaggaacagcggatactagattggcaaccccgcgagaaccctttccaaaatctcaaggtgcttcttgtgtccgatcagcagcagaactttttggaactctggtctgaaatcctcatgacagggggtgcggcttcagtgaaacagcaccacagcagtgcacacaataaggacatcgcgctgggtgttttcgatgtggtggtcactgacccctcctgcccggcatccgtgctcaagtgtgcagaagccctccagcttcccgtcgtgtctcaggagtgggtgatccagtgtcttattgtaggcgaaagaatcggctttaaacagcatcctaaatacaagcacgactacgtctcccattag

SEQ ID NO: 17871 - DNA, 5928 bp, Artificial Sequence
  Description of Artificial Sequence: Synthetic coding sequence
atgcccggcgaacagatggatcctacagggtcccagttggacagcgactttagccagcaagatactccttgtctgatcattgaagacagtcaacctgagtcccaggtgcttgaggacgactccggaagccacttttctatgttgtcgcggcatcttccaaacttacagactcacaaggaaaaccccgtgctggacgtggtgtccaatcccgagcaaaccgcaggtgaggagaggggtgatgggaatagcggattcaatgagcatttgaaggagaataaggtcgcagatcctgtcgacagctctaatttagacacgtgcggctccatcagccaggtgattgaacaacttccgcagcccaacagaaccagtagcgtccttgggatgagcgtggaatcagcccccgccgttgaggaagagaagggggaagagctagagcagaaggagaaggagaaagaggaggacacatctggcaacaccacgcactctctgggtgccgaagacactgcttctagccagttgggatttggcgtcttagaattgtcgcagtctcaggacgtggaggaaaatacagtcccctacgaggtagataaggagcaactgcaaagcgttactacaaattccgggtatacgcggctgagtgacgtcgatgccaatacagcaataaagcatgaggaacagtcaaacgaggacattccaatcgccgagcagtcctcgaaggacatcccagtcaccgctcagcccagtaaggacgtgcatgtggtgaaagagcaaaaccctccacctgcacggtccgaggacatgcccttcagccctaaagcgtccgtagcagccatggaggctaaagagcagctttccgcacaggaactgatggagtccgggctgcagattcagaaaagtcctgaaccagaagtgctgagtactcaggaggacttgtttgatcagtccaataagacggtttctagtgacgggtgctccacacccagtcgcgaggagggcggttgctctttggcttctacacctgcgacaaccctccatttgctgcagttgagcgggcaacgcagtttggtccaagactccttgtcaacgaattcctcagatcttgtcgcaccaagtcccgacgccttccggtctactcccttcattgtcccatcgtcccctactgaacaagaaggtcgccaggacaagccaatggacacctctgtcctgagcgaggagggaggcgagccatttcagaagaagctgcagtcaggcgaacctgttgaacttgagaacccaccactcctgcccgaaagtactgtgtctccccaggctagcacgcccattagtcaatccaccccagtattccctcctggctctctgcccatcccttcacaaccacagttctcgcatgacattttcatcccgagcccctctttggaagaacaatctaatgatggcaaaaaggatggagatatgcacagctctagtcttacagtggagtgttctaagaccagcgagatcgaacctaagaacagtcctgaggatctggggctgagtttgaccggagatagttgtaagctgatgctttcaacaagcgagtactcccagagtcccaaaatggaatctctgtccagccacaggattgacgaggacggcgagaacactcaaatcgaagacacagagcctatgtctcctgtgctcaacagtaagtttgtgccggcagaaaacgattcgatccttatgaatcccgcacaggacggggaggtgcagttaagccagaatgatgataagactaaaggagacgataccgacaccagggatgatatcagcatcttggccacgggatgtaagggtcgcgaagaaacagtggctgaggatgtttgtatcgatctgacatgtgacagtgggtctcaggccgtgccatcccccgctacaagaagcgaggccctgtctagcgtgctggatcaagaggaagccatggagataaaggagcaccatcctgaggagggtagctcgggctcagaggtggaagagattccagagactccatgcgagtctcagggagaagagctaaaagaagagaatatggagagcgttccactgcacttatctctgaccgaaactcagtcccaaggcttgtgccttcagaaggagatgcccaaaaaggaatgttctgaggcaatggaagtggagacttctgtaatctccatcgattcaccacagaaactagcgatcctagatcaggaactggagcataaggagcaggaagcctgggaggaagctactagtgaagactcctccgtggtcattgtggatgttaaagaaccaagcccgcgtgtggacgtctcatgcgagccccttgagggggtagagaaatgtagcgatagccagagttgggaggacattgcacccgagattgaaccttgtgccgagaatcggctcgacacaaaagaggagaagagcgttgagtacgagggagacctgaaaagtggcaccgctgaaacagaacctgtggaacaggattcatcacaaccctccctgcccctggtacgcgccgatgatcccctgaggctagatcaagaactgcaacagcctcagactcaggagaaaacctctaactcactgaccgaggatagcaaaatggcaaacgccaagcagctgtcatccgacgcagaggcccaaaaactgggaaaaccaagtgcacacgccagccagagtttctgcgagtcctcgagcgagacacccttccacttcacccttcccaaagagggcgatataatacctcctctgaccggcgccacgccacccctgattggacacttaaagcttgaacctaagcgccattccacaccaattggaatcagcaattacccagaatctaccattgccacatcagatgtcatgtcagagtctatggtagaaacgcacgaccccatcttggggagtggcaaaggcgattctggtgccgcccccgacgtcgacgataagctctgtctgaggatgaagttggtgagtccagagaccgaggctagcgaggaatccctgcaattcaatcttgagaagcctgcaacgggagaacgtaagaatggttccaccgccgtcgcagagagcgtggcgtctccacagaagacgatgagcgtgctaagttgcatctgtgaagccaggcaggagaacgaagctagatctgaggatcccccgaccacacccattaggggcaatttgctgcactttccatccagccagggagaagaggaaaaggaaaaacttgagggagatcacacaatccgccaatctcagcagcctatgaagccgatcagtccggtgaaggacccggtgagtccggcttcacaaaaaatggtgatccaagggccaagcagcccccaaggggaggccatggttaccgacgtcctggaggatcagaaggagggacgtagtactaacaaggagaacccatccaaagccctcattgagcgcccttcacaaaataatatcggcattcaaacaatggaatgctctctgagagtgcccgagaccgtgagtgccgcaacgcagaccattaaaaacgtgtgtgaacaagggacctccacagtcgatcaaaacttcgggaaacaagacgcaactgttcaaactgaaagaggctctggcgaaaaacctgtgagcgcccctggggatgatacggagagcctgcattcacagggcgaagaagaatttgacatgccgcaacccccacatggccacgtccttcaccggcacatgcgcactattagggaggttaggactctggtaactagggtaatcacagacgtgtactatgttgatggtactgaggtcgaacgcaaggtaacggaggagacggaggagcccatcgttgaatgccaagagtgtgaaacagaggtgagcccctcacagaccgggggctcttctggcgatctgggagatatctcttctttctcgtcgaaggctagctcccttcatcgtaccagctcaggtacgtctctgagtgcgatgcatagctcaggctcatctggaaagggggccggtccgctcagaggcaagacctccgggacagaacccgcggacttcgccctcccttcttcccggggaggccctggtaagctgtccccccgcaagggcgttagccagacaggtacacctgtttgcgaagaagatggtgatgcaggactgggtatcaggcaggggggcaaagcccctgtcactcctcgcggtcgtggaaggcggggtagacctccatcacgcaccacgggaacacgcgaaaccgcagtaccgggtcctctagggattgaagacatttccccgaatctatccccagatgacaagtccttcagccgtgtcgtccctcgcgtccccgacagtaccagaagaacagatgtgggcgccggtgcgctacggcggagcgactcccccgagataccattccaagctgcagccggcccatcggacggtctggacgcgagcagccccggaaattcatttgtgggcttaagggtggttgccaagtggtcgagtaacggctatttttactccggaaaaattacccgagacgttggcgccggtaaatataagctcctgtttgacgatggctacgagtgcgacgtcttaggaaaggatatcctgctctgtgatcctattccgttggatactgaagtgacagccctgtccgaggatgaatacttctccgccggggtggtcaaaggacatcggaaagaaagcggggaactgtattactccattgagaaagaaggacagcgcaaatggtataaacggatggcagtgatcctttccctggaacaaggaaaccggcttcgcgagcagtacgggctcgggccttatgaagccgtgacgccattgactaaggccgccgacatcagcctcgataacctagtagaaggaaagcgcaagagaagaagtaatgtgtcctctcctgccacccctaccgcaagctcaagtagtagtacgacacctacccgaaagattaccgaaagccctagagcttctatgggcgtcctctcaggtaagcgaaagctgatcaccagcgaggaggagcggtcccctgccaaacgggggcgcaagtccgccaccgtgaagcccgtgggggctggtgagtttgtgtctccatgtgaatctggtgacaacactggcgagccaagcgcattagaagaacagcgtggcccactgccattaaataagaccctgttcctgggctacgctttcctgttaacgatggcgaccactagcgacaagttggcgagccgcagtaagttacctgacggtcccacagggagctctgaagaggaggaggagtttttagagatcccaccatttaacaaacagtacaccgagagccaacttagagccggagctggctacatcctcgaagacttcaatgaggcccaatgtaatactgcctaccaatgtttgctgatcgcagaccagcattgcaggactagaaagtactttctatgcttggcgtctggcataccttgcgtgagccacgtgtgggtgcatgactcttgccacgcgaaccagttacagaattacaggaactacctactgccagcggggtactccctggaggagcagaggatcctggattggcagcctcgcgaaaatccttttcaaaatctcaaggtgctattagtctcggatcagcagcagaatttcctggagctttggagtgagattctcatgaccggaggagcagccagcgtgaagcagcaccacagttccgctcataacaaagacatcgcacttggagtctttgatgttgtggttacggacccttcctgccccgcttccgtactgaaatgtgctgaggctctccagctgccagttgtgtctcaggaatgggtcatccaatgcttaattgtgggggaaaggattggctttaagcagcatcctaagtacaagcatgactacgtgtcacactag

SEQ ID NO: 17872 - DNA, 1623 bp, Artificial Sequence
  Description of Artificial Sequence: Synthetic coding sequence
atggcccagtcgaccgccacgtcaccagatggcgggaccacgttcgaacacctttggagttctttggagcccgattctacgtacttcgacctgccacagtcttctagaggcaataatgaagtggtcggcgggacagacagcagcatggacgtcttccacctggaagggatgacgacatccgtgatggcccaatttaacctgctgagcagcaccatggatcagatgagcagtcgtgccgcatcagcttctccttatactccagaacatgcggccagcgtgccgacccattcaccatacgcccaaccttccagcaccttcgacacaatgagcccagcccccgtcattccgtcaaatacagactacccagggccccatcacttcgaagtgacttttcaacaaagtagcacggcaaagagcgccacctggacttattctcccctattaaaaaaattgtactgccaaatagccaagacatgtcccattcagattaaagtgtcaacaccaccccccccagggaccgcaattagagctatgcccgtgtataagaaggctgaacacgtcaccgatgtggtgaagagatgcccaaatcatgagctgggtcgcgactttaacgaaggccagtcggcccccgcctcccacttgatccgagttgagggcaacaacctttcccagtacgtcgacgatcccgtgacaggtagacagtctgtcgtggttccctacgagccaccgcaagtggggacggagttcacaacaattctgtacaactttatgtgcaactcaagctgcgtgggaggaatgaatcgtcggcccatccttattattatcactcttgagatgagagacggccaggtgctggggaggcgtagtttcgaggggcggatttgtgcctgtcctggcagggaccgaaaggctgacgaggatcattatcgggagcaacaggcactaaatgaaagctccgccaaaaatggagctgccagtaagcgggccttcaagcagtcgcccccagctgtgccagcattgggtgccggagtgaaaaaacggcggcacggagacgaagatacttactacctccaagtccgcggtagggagaattttgagattctaatgaaactcaaagaatcattagagctgatggaattggtccctcaaccgctagttgactcctataggcagcaacaacagctgcttcaaagacccttccttactggccttggatgccctaattgtatcgagtattttaccagccaggggctgcagagcatttaccacctccagaatctgaccatcgaggacctgggggcactcaaaatccctgaacagtaccgcatgacgatttggaggggcctgcaagacctaaaacaaggacatgattacagcaccgcccagcagctgctgcggagttctaacgccgctaccattagcatcggaggcagcggtgagctccagcggcagagagtgatggaagcggtgcattttcgcgtgcgacacacgataactatcccaaaccgtggaggcccagggggaggccctgacgagtgggctgactttggtttcgaccttccagactgcaaagcacgcaagcagcctatcaaagaggaatttactgaggccgaaatccactag

SEQ ID NO: 17873 - DNA, 1500 bp, Artificial Sequence
  Description of Artificial Sequence: Synthetic coding sequence
atggctcaaagcactgccacctctcctgatggaggcacaaccttcgaacatttgtggagcagcttggaaccggattccacttattttgacctgccacagtcgtcgcgaggcaacaacgaagttgtgggcggaaccgattcctccatggacgtgttccacctcgaaggaatgactacttctgtcatggcacaattcaacttgctgagctcaaccatggatcagatgtcttcccgcgccgcgtctgcgagtccttatacaccagagcatgccgcaagtgtgccgacacactccccgtacgctcagccctcctccactttcgacactatgtcacccgctcctgtgataccgtcaaataccgattaccctggcccccaccacttcgaagtgacatttcaacaaagctcgacggccaaaagcgctacatggacctattcccccctgttgaaaaagctctactgccaaatcgcgaaaacttgtcctattcagatcaaggttagcacaccgccaccaccaggcacagccatacgtgctatgcctgtgtacaagaaagccgagcacgtcactgatgtggtcaagcgctgtcctaaccatgagttagggcgggatttcaatgaaggccagagcgcccctgcctcacacctgatccgtgtggagggtaacaacctgtcacagtacgtggacgacccagtgaccggcaggcagagcgttgtggtaccctatgaacctccccaagtggggaccgagtttactaccattctgtacaacttcatgtgcaatagctcgtgtgtgggcgggatgaaccggcggcctatactcatcataatcacccttgagatgcgagatggacaagtcctcgggcggcgatcattcgagggacggatatgtgcatgtccagggcgggatagaaaggctgacgaagaccactatagagagcagcaagcattaaacgaatcttccgcaaaaaacggcgcagccagtaaaagggctttcaaacagtcccccccagccgtgcctgcgctgggcgctggggtgaagaaacgtcgccacggtgatgaagatacctactacttgcaggtgcgcggaagggagaatttcgagattttgatgaagctgaaggaaagcttagagctgatggagctggtccctcagccattagtcgatagttaccggcagcagcagcagttgcttcagcgccctagccatctccagccccctagctatggtccagttttatcacccatgaataaggtgcatggaggcatgaacaagttgcccagtgtcaaccagttagtcgggcagccacctcctcactcaagcgcagccacccctaatctgggacctgtcggtccagggatgttgaataaccatggccacgccgtgccagctaatggcgagatgagctcctcgcattctgcacagtctatggtgagtggaagccactgtactccaccgccaccataccacgccgatccgtcactggtaagaacgtggggcccatag

SEQ ID NO: 17874 - DNA, 1668 bp, Artificial Sequence
  Description of Artificial Sequence: Synthetic coding sequence
atggcccagagcacagcaacgagcccggacggcgggactacctttgagcatctgtggagttcactggaacctgactcgacctatttcgacttaccacagagttcgaggggcaacaacgaggttgtcgggggaactgactcatccatggacgtgtttcacctggaaggaatgaccaccagcgtgatggcccagtttaatctgctcagttccaccatggatcaaatgtcttctagagcagcaagcgccagtccttacacgccagaacatgctgcttctgtgccaactcatagtccatatgctcagccatcgagcacttttgatactatgtcacccgccccagtgattccatcaaacacggactacccggggcctcatcatttcgaggtcacctttcaacagtcctcaaccgccaaatctgccacttggacctattcgcctctactgaagaaactgtattgccaaatcgccaaaacttgccctattcagatcaaggtgtctactcctcccccccccgggaccgccatacgagcgatgccagtgtacaaaaaggctgagcacgtaacagatgttgtcaaacggtgccccaatcatgagctcggaagggactttaacgaaggacagagcgccccagcttcccacttgataagagtggaagggaacaacctgagtcagtacgtcgatgacccagttactggccggcaatctgtggttgtcccctatgaaccaccacaggtgggcaccgagttcaccacgattttatacaatttcatgtgtaatagctcctgcgtaggcgggatgaacagaaggccgatcctgatcattattacattagagatgcgagatggccaggttctgggtaggcgatcatttgaggggaggatctgtgcctgccctggaagagacagaaaggccgacgaggaccattacagagagcagcaagcactgaacgagtccagtgctaagaatggcgcagccagtaaaagggctttcaagcagtccccgcccgcagtaccagcgctgggcgccggcgtgaagaaacgcaggcatggcgacgaggatacatactatctgcaggtgagagggcgggagaattttgagattctcatgaaactcaaagagagcttagagcttatggaactcgtcccgcaaccattagtcgactcctaccgccaacagcaacagttgctccagcgcccaccccgcgatgcccagcagccttggccaagatcagcctctcagcgccgggacgaacagcagccacagcgtcctgtgcacggcctaggggtgccccttcacagcgcaactccactgccacgaaggccccagcctaggcaggatttgggggccctgaaaatacctgagcaatatagaatgaccatatggaggggcctccaagatctgaagcagggtcacgattacagcacagcacagcaattacttcgatcctcaaacgcagccaccatttctatcggcggctccggggagctacagagacagcgagtgatggaagctgtgcacttcagggtacgccacacaatcaccatccccaatcgcggggggcccggcgggggtccagacgagtgggcagattttgggttcgatctgcctgattgcaaagcgcgcaagcaaccaattaaagaggaattcaccgaggccgaaatacactag

SEQ ID NO: 17875 - DNA, 1281 bp, Artificial Sequence
  Description of Artificial Sequence: Synthetic coding sequence
atgctgtacgtcggagaccccgcccgtcacttggcaacggcccagtttaacctgttatcctccaccatggatcagatgagctcaagagcagcttccgcgtctccgtatactcctgagcacgccgcctctgtcccaacacattcaccctacgcccagccttcctcgacattcgataccatgagtccagcacctgtgattccctctaatacagactatcccggcccccaccactttgaggtaaccttccagcagtcctcaacagccaaaagcgccacatggacatatagcccgctgctgaaaaagctgtactgccagatcgctaagacatgtcccatacagatcaaagtctctacaccgccccctcctggaacagcgattcgagctatgcccgtttataagaaagccgaacatgtaaccgatgtcgtgaagagatgtcccaatcacgaactcggtagagacttcaatgaaggccagagcgccccagcctcccatttgattagggtggaaggaaataacctttcgcaatacgtggacgatcccgttacaggccgccaatccgtggttgtgccatacgagcctcctcaggtgggtaccgaatttaccaccattctgtacaacttcatgtgcaactctagctgcgttggtgggatgaaccgtcgcccaatcctcattattatcacactggaaatgagggacggacaagtgcttggccgacgtagctttgagggccgcatctgcgcctgccctggccgcgaccgcaaagccgacgaggatcattaccgagaacagcaggccctgaacgagtcttcagcaaagaatggagctgctagtaagcgggccttcaaacagtcccccccagcagtgcctgctcttggagcaggcgttaagaaacgccgacacggagacgaggatacttactacctccaagtccggggacgggagaattttgagatcttgatgaagttgaaagaaagccttgagctcatggagctcgttccgcagccgctggttgattcttaccggcagcagcagcaacttttacaaaggcctccgcgggacgcccagcagccttggcccaggtcggccagccagcgccgagacgaacaacaacctcaacgtccggtccacgggttgggagtccccctacatagcgctacaccactgcctcgccggccacagcccagacaattctttaaccgaattggagtgagcaaactgcatagggtgtttcatctgccccgtgtgactgagcatttgccgcctgcagaaccagaccattag

SEQ ID NO: 17876 - DNA, 1353 bp, Artificial Sequence
  Description of Artificial Sequence: Synthetic coding sequence
atgctttatgtcggtgacccggcacggcacctggctaccgcacagttcaaccttctgtcatccacaatggatcagatgtcttcaagggccgcatcagcttctccttatacccctgagcatgcggcatcggtacctacgcattctccatacgcccagccgtcttccacattcgataccatgtcacccgcccctgtgatcccttccaacaccgattaccctgggcctcatcatttcgaggtgacttttcagcagagctcgacagccaaatcggctacctggacatatagcccgctactgaagaagctctactgtcaaattgcaaaaacttgtccaatccagatcaaggtctcaacacctccccctccggggactgctattagagccatgcctgtatacaagaaggcagaacacgtcactgacgtggtgaaacgttgcccaaaccatgagctaggccgggacttcaatgaaggccagtctgccccagccagtcatttaatcagagtggagggtaacaacctgagtcagtacgttgatgatcccgttacaggcaggcagtccgtggtggttccatacgaacctccccaggtgggaaccgaattcaccaccatcctatacaatttcatgtgcaattcttcatgcgtgggtgggatgaaccggaggcccattcttataattatcacattagaaatgcgagacggccaggttctgggcagacgtagcttcgagggccgcatctgcgcctgccccggccgggatcgcaaagccgacgaagatcactatcgagaacagcaggccctcaacgaaagcagcgccaagaacggagccgcgagcaagcgtgcctttaaacagtcccctcctgccgtccctgcgctgggcgctggtgtgaagaaaaggagacacggagatgaagatacctattacctccaggtccggggccgcgaaaattttgagattttgatgaagctcaaggaatcgctggagttaatggagttggtccctcagccgctggtggactcttaccgtcaacagcagcagcttctgcagcggccaagccacttgcagcctccgagctacggtccagtcctgagcccaatgaacaaagtccacggcggcatgaataaactgcccagcgttaaccagctcgtggggcagccccccccccactctagcgccgccacccctaatcttggcccagtgggcccaggcatgttgaacaaccacgggcatgcggtgcccgctaatggggaaatgtcttcctcgcactccgcacaaagcatggttagcgggtcgcactgtacaccgcctcctccctatcacgcagacccttccctggtcagaacctggggcccctag

SEQ ID NO: 17877 - DNA, 1764 bp, Artificial Sequence
  Description of Artificial Sequence: Synthetic coding sequence
atgttatacgtgggcgaccccgcgcgccatctggctacagcacagttcaacctgctgtcctctactatggatcagatgagtagtagggcggctagtgcctcaccttacactccagaacacgctgcaagtgttcctactcacagtccctacgcccagccctctagcactttcgacacaatgtccccggcgcccgtgatccccagtaataccgactacccgggaccacatcacttcgaggtgacttttcaacagagtagtacagccaagtctgccacctggacatattcccccttgctgaaaaagttatactgtcaaatcgcaaaaacctgtccaattcagattaaagttagcacccctccaccacccggcaccgccatcagggccatgccggtctacaaaaaggctgagcacgtcacagacgtggtgaagagatgcccaaaccatgagcttggtcgagatttcaacgagggacagtcagccccagcctcccaccttatcagagtggaagggaataatctttcccagtacgtagatgacccagtcacaggccgacagagcgtcgtggtgccttacgagccgcctcaggtgggcactgaatttacaaccatcctttacaactttatgtgtaatagcagctgcgtaggcggcatgaatcgccggcctattctgatcatcatcacactggaaatgagagatggccaggtgctcggacgccgctctttcgaagggagaatctgcgcttgtcccggtcgggacagaaaagcagatgaagatcactaccgggaacagcaggccctgaacgagtcctcagccaagaacggcgctgccagtaagcgggctttcaagcagtcgccaccagctgtgcctgctctgggtgctggcgttaagaaacgccggcatggtgacgaagacacctattatctgcaggtgcgtggacgggagaattttgagattctgatgaaactgaaagagtctttggagttgatggaacttgtgccacagccacttgtggactcataccggcagcagcagcaactgcttcagcgcccaagtcaccttcagccccccagctacggccctgtgctgtcacccatgaataaagtgcatggaggcatgaataagctgccctccgtgaatcagttggtcggacaacctccccctcactcatctgctgcaacgcccaacctgggcccagttgggccaggaatgctcaacaaccatggccacgccgtgccagcaaatggggaaatgagcagtagtcactctgcccagtccatggtgtcaggcagtcattgtacaccccccccaccctatcacgcagatccttctctcgtcagcttcctgacaggcctgggctgccccaattgcatagaatacttcacgtcccaggggctgcagagcatctaccatctccagaaccttacaatcgaggatttgggagcattaaaaattccagagcagtaccggatgacaatctggcgtggactgcaagacttgaaacaaggtcatgactatagcacagcacaacagttgctgcggagtagcaacgctgccacaatctccattggcgggtctggcgagttacagcgacaacgcgtgatggaggcagtgcacttcagagtgaggcatactatcacaattcctaatcgaggcgggcccggggggggaccagatgaatgggccgatttcggctttgatctgcccgactgtaaggcgcgcaagcagcccatcaaggaggagttcaccgaagctgagatacattag

SEQ ID NO: 17878 - DNA, 1698 bp, Artificial Sequence
  Description of Artificial Sequence: Synthetic coding sequence
atggaccaaatgagttcaagagccgcctcagccagcccctacactcctgagcatgcagcgtcggtccccacccacagcccatacgctcagcccagcagtactttcgacaccatgtctcctgcgccggtgatcccgtcaaacaccgactatcccggccctcaccatttcgaggtaacctttcagcaaagtagcacagctaagagcgcgacatggacatactcaccgttgttgaagaagctatattgccagatcgctaagacttgccccatacagataaaggtgtctacaccaccccctcctggaaccgccatccgggccatgcccgtctacaagaaagccgaacatgtgacagacgtggtaaagaggtgcccgaaccatgaacttggcagagattttaatgaggggcagtcagcccccgcctcacacttaatccgggtcgaggggaacaaccttagtcagtatgtggatgacccagtgactggtagacagtctgtggtggtgccatatgaaccgcctcaagtgggcactgagtttaccacaatcctctataatttcatgtgcaattcctcgtgtgttggcggcatgaatcgtcgacctattcttatcatcattacactggagatgcgcgacgggcaggtcctgggtcgcaggtctttcgagggacggatctgcgcatgtcctggacgcgatcgcaaagctgatgaggaccactatcgggagcagcaagcgctgaacgagtcgtctgcgaagaacggcgccgcttcaaaacgcgctttcaaacagtccccccccgcggtcccggccctgggagcaggagtgaagaaacgacggcatggagacgaggacacttactacttacaggtgaggggccgcgagaacttcgagattttaatgaagttaaaagaatcccttgaactcatggagctggtcccgcaaccacttgttgacagctacagacaacagcaacaattgttgcagaggccatcacatctgcaaccgccaagctacggccctgtcctcagtccaatgaataaagttcacggcggaatgaacaaattgccgagcgtgaatcaactggttggccaaccccccccacatagttcggctgccacccccaatcttgggcccgtgggacccggcatgttgaataaccatggacacgccgtccccgcaaatggggagatgtcctcctcacatagcgcgcagtccatggtctccggaagtcactgtacaccaccaccaccatatcacgccgaccctagtctggtgtcgttcctgaccggcttggggtgcccgaactgcattgagtacttcacctcacagggtctgcagtctatctaccaccttcagaacctgaccatcgaggatctgggcgccttgaaaatccccgagcagtaccgtatgacgatttggcggggtctgcaagacctgaaacagggtcatgactacagcaccgctcaacagcttctgagaagttcaaatgccgcaacaatctctatcggtggttccggagagctccaaaggcagagggtgatggaagccgtgcatttcagagttcgccacaccatcactatacccaatagaggaggccccggtggcggccccgatgaatgggcagattttggcttcgacctgcccgattgcaaagcccgtaagcagcccataaaagaagaatttactgaagcagagattcattag

SEQ ID NO: 17879 - DNA, 1911 bp, Artificial Sequence
  Description of Artificial Sequence: Synthetic coding sequence
atggcccagagtactgccacatctcctgatgggggtactacgttcgagcatctatggtcttcgctcgagcctgattccacttatttcgatctgccgcagtcttctcggggcaataacgaggtcgtgggcggaactgatagtagcatggatgtcttccacctggaaggaatgacaacctccgtgatggcacagttcaacctcttgtcatctaccatggaccagatgagcagtcgtgcagcatctgcatcaccttataccccagaacacgcagctagcgtgccgacacactctccttacgcacaaccttcgtctacctttgataccatgagccctgccccagtaataccatctaacacagattatccaggaccccaccatttcgaagttacctttcaacagtcgagtacagccaagagcgcgacatggacctatagtcctctgctgaagaagttgtactgtcagatagccaagacttgccccatccagattaaagtgagcacaccccccccccccggcacagccatccgcgctatgccagtgtataaaaaggctgagcacgtcacagatgtggtgaagcgatgccccaatcacgagcttgggagagacttcaacgagggccagagcgctcctgcctcacatctaattcgggtggaagggaataatttatctcagtacgtggatgaccctgtaactggccgacagagtgttgtcgtgccgtatgaaccccctcaggtcgggactgagttcaccacgatcctgtacaattttatgtgcaactccagttgcgttggaggcatgaaccgccgtcccattttgatcattattaccctggagatgagagacggacaggtgctcggtcggcgtagcttcgaggggagaatctgtgcctgtcctggacgcgatcgcaaagccgacgaggaccactacagggaacagcaggcgctcaacgagagcagtgccaagaatggtgctgcttcaaaacgggccttcaaacagagccccccggcggtccccgcactaggggctggggtgaaaaagcgccggcacggggatgaggacacatattatctgcaagtgcggggacgcgagaacttcgagatcctgatgaaactcaaggagtctcttgaactgatggagctggtgcctcagcctctggtcgactcatacaggcagcagcagcagctcctgcagaggccctctcacctccagccacccagctacggccccgttctcagtcctatgaacaaagtgcatggcggcatgaataagttgccgtctgtgaaccagctcgtgggtcagcccccccctcacagctctgctgctacaccaaatctgggtcctgtcggccctggaatgctgaacaaccacgggcatgctgttcccgcaaatggggagatgtcaagcagtcacagcgctcaatccatggtctccggctctcattgcacaccccctcctccatatcatgccgacccctctctggtaagtttcctcaccggcctgggatgtcctaattgtatcgaatacttcacctcacagggcttgcaatctatttatcacctgcagaacctgaccattgaggatcttggggccctgaagatcccagagcagtacagaatgaccatctggcggggattgcaagacttgaaacagggtcatgattacagcacggcacaacagttgctgcgttctagtaatgccgctaccatctcaatcgggggcagtggcgagctccaaagacagcgggtgatggaggccgtgcattttcgggttcggcatacaatcacaatcccgaacaggggggggcctggagggggcccagacgaatgggctgacttcggattcgatctgcccgattgcaaggcacgcaagcagccgattaaggaggagtttacagaggcagagatccattag

SEQ ID NO: 17880 - DNA, 1053 bp, Artificial Sequence
  Description of Artificial Sequence: Synthetic coding sequence
atgggagctggcgcatcagctgaggaaaagcacagcagagaattagaaaagaagctgaaagaggacgccgaaaaggacgcacgcactgtgaaacttctgctgctgggtgctggcgaatctggcaagtctaccatcgtgaaacagatgaaaatcattcaccaggatggatatagtctggaagaatgccttgagttcattgccataatttatggcaatacccttcagagtattttagctatagtgagggctatgacgactttgaatatccagtatggggatagcgcacgacaggatgacgccaggaagcttatgcacatggctgacaccatagaggaggggactatgccaaaggagatgtcagatatcattcagcgactttggaaggacagcggcatccaagcttgcttcgagcgggccagcgaataccagctgaatgatagtgccgggtactatttatcagacctagaaagacttgtgacacctggatacgtgcctacagagcaggacgtcctcagatcaagagtgaagactaccggtataatagagacacagttcagcttcaaggacttgaatttcaggatgttcgacgttgggggacaacgctcagagcggaagaagtggattcactgcttcgagggcgttacctgcatcatcttcattgcagctctctccgcatatgacatggtgctcgtggaagatgatgaagtaaaccgcatgcatgagtcattacacctcttcaacagcatctgtaatcacaggtattttgcgacaacatctatcgtcctttttctgaataagaaggacgtgttcttcgaaaaaatcaagaaggcacatctttcaatttgtttccccgactacgacggcccgaatacctacgaggatgctggcaattacatcaaagtacagttcctggagttaaatatgcgacgcgacgttaaagagatctattcccacatgacatgtgcaactgacacccagaatgtgaaatttgttttcgatgcagttacagatattatcattaaggagaacctgaaggattgcggcctcttttag

SEQ ID NO: 17881 - DNA, 609 bp, Artificial Sequence
  Description of Artificial Sequence: Synthetic coding sequence
atgatgcaagatgtgagtagctctccggtgtccccggccgacgattctcttagcaactccgaggaagagcccgatcgccaacagccaccatccggaaagcggggcgggagaaagagacgatcaagccgtcgctccgcgggaggaggcgctggaccgggcggcgctgcgggaggcggtgtaggtggtggtgacgagcccggctcaccagcgcaggggaaaagaggcaagaaaagcgctgggtgcggtgggggaggcggagctggtggcggaggaggctcttctagtggtgggggctcccctcagagttacgaggaactgcagactcagcgtgtgatggccaacgtccgcgagagacagagaactcaatcattgaacgaggcctttgcagcattgcggaaaattatcccgaccctgccctcagataaactctctaagatccagactctgaaattagcggcaagatatatagatttcctgtatcaggtgctccagtcagacgagctggattccaagatggcctcctgttcctacgtggcccacgagcggctcagctacgctttctcggtctggcgtatggagggagcatggagcatgagtgcgagtcattag

SEQ ID NO: 17882 - DNA, 741 bp, Artificial Sequence
  Description of Artificial Sequence: Synthetic coding sequence
atgggcgatcgcgaacagctgttgcagagggctcggcttgccgagcaggcagagcgctatgacgatatggcaagcgccatgaaagccgtgactgagctcaatgagcctctcagtaacgaagatagaaacctgctgtccgtggcttacaagaatgttgtgggtgcacgccgtagtagctggcgggtgatctcgtccatcgagcagaaaactatggcagatggaaacgaaaagaagctggagaaagtgaaggcctacagggaaaagatcgagaaagaactggagacggtgtgcaatgacgtcctttcattactggacaagttcctcatcaagaattgcaatgacttccagtacgaatcaaaagtgttctacctgaagatgaagggagactattaccggtatctagccgaggtagcatccggggagaagaagaacagtgtcgtggaggcctctgaggctgcatacaaagaggcttttgaaatatcaaaggagcagatgcagccaacacatccgataaggctcgggctcgcactcaatttctctgtgttttactatgaaattcaaaacgcaccagaacaggcatgtctgctagctaagcaggctttcgatgacgccatagctgaactggatacactgaacgaagacagctataaagacagcacgctcattatgcagttattgcgggacaatttgacactgtggactagcgatcagcaggatgaggaggccggcgaaggcaattag

SEQ ID NO: 17883 - DNA, 1626 bp, Artificial Sequence
  Description of Artificial Sequence: Synthetic coding sequence
atggtgtggcgtgttcccccattcctgctgcctattctgttcctggggacacattaccagctggatgtgcagctgtaccactgtaccctgcttggtcctgctagccctcccgcccatgtcctccttcccccttcaggtcctcccgccccccgccatctgcatgcccaagcacttagcgattccgagatccagctgacctggaaacatccagaagccctgcctggtcctattagtaaatatgtggtggaagtgcaagtggcaggtggcgcaggggatcctctgtggatagacgtcgaccgccccgaggaaacttccactatcatcagggggctcaatgcaagcacccgctacctgtttaggatgagggcctccatacaaggattgggagactggtccaatactgttgaagagagcaccctcggtaacgggcttcaggccgagggcccagttcaggagagcagagccgccgaggagggcctagatcagcagctcatcctggccgtggtggggtctgtgagcgctacatgcctcactattttagctgctcttctgaccctcgtctgtattcgcaggtcgtgcctccataggagacgcactttcacttatcagtctggatccggagaagagacgattttgcagttttccagcgggacactgacgctgaccaggaggcccaaactacagcccgagcccctgtcttatcctgtcttagagtgggaagacatcacattcgaagacctgataggtgaaggcaacttcggtcaggtcatccgagctatgattaagaaagacggtttgaagatgaacgccgccatcaagatgctcaaagagtacgccagtgagaacgaccaccgcgatttcgccggggaacttgaggtgttgtgcaaactcggccaccaccccaacatcatcaatctgttgggagcctgcaagaataggggctacctctacattgccattgagtatgctccttacggcaatctactggatttcctgaggaaatctagggtcctcgaaacggatcccgcattcgccagggagcacggaaccgcaagtaccttaagctccagacagcttcttcggttcgctagcgatgcggccaacggcatgcaatacctgtcggaaaagcaatttattcaccgggaccttgctgccaggaacgtgctggtgggtgagaacctggcttccaagattgctgattttggcctgtctcgcggcgaagaggtctacgtaaagaagacgatgggaagactccctgtaagatggatggcgatcgaatccttaaattacagtgtctacaccaccaaaagcgatgtctggagcttcggcgtgctgctgtgggagattgtgtctctcggggggacaccttattgcggaatgacgtgcgctgagctctacgaaaaactcccccagggctatcggatggaacaaccacggaattgcgacgacgaagtctacgagttgatgagacagtgctggagggacagaccttacgagcggcctccttttgcacaaattgccctgcagctcggcagaatgctcgaggcccggaaagcatacgtgaacatgagcctttttgagaacttcacctacgcaggcatcgacgctacggctgaggaggcttag

SEQ ID NO: 17884 - DNA, 3417 bp, Artificial Sequence
  Description of Artificial Sequence: Synthetic coding sequence
atggtctggcgagttcctccatttttgttacctatactgttcctagccagccacgtgggggcagccgtggatctgactctgctggccaacctcaggctcacagaccctcagaggttctttctgacttgcgtctcgggggaggcaggagccgggagaggctccgacgcctggggaccgcccctgctgctggagaaagacgaccggatcgtgcgcacacctcctgggccgcccctcaggctggcaaggaatggctcccaccaggtgactctgagaggtttcagtaaacccagtgatctggttggcgtgttctcatgcgtcggtggggccggggctagacgcacccgcgttatctacgtgcataactctccaggagcccacctgctgccggacaaagtgacacataccgtgaataagggggatactgctgtgctctcagcaagagtgcataaagagaaacaaaccgatgtgatttggaaatccaatggctcctacttttacacccttgactggcatgaggcgcaagatggtagatttttgcttcagctgcctaatgttcagcccccctcctccggaatctacagtgccacctacctggaagctagcccccttgggtccgctttcttcaggctaatcgtgagaggctgcggggcaggcagatggggccctggatgcacgaaagagtgcccgggttgcttgcatggaggtgtgtgccatgatcacgatggcgaatgcgtctgcccgcctggcttcaccggcaccagatgcgagcaggcatgtcgggaggggcgatttggccagtcctgccaggagcagtgtccaggcattagtggttgccggggtctcaccttttgcctgccggatccttacggatgctcctgcggaagcggttggcggggtagccagtgccaggaggcttgtgctcctggacactttggggccgattgcagactgcaatgtcagtgccaaaacggaggtacatgcgaccgatttagcggttgcgtgtgtccttcagggtggcacggagttcactgtgaaaagagcgataggattcctcagattctgaacatggcatcagagctggagttcaacctcgagaccatgccaaggataaattgcgccgccgcagggaacccgttccctgtaagaggatcaatcgaactgcgcaaaccagacggcactgttctgctgtctactaaggccatcgtcgaacccgagaaaacaacagctgagttcgaggtgccacgacttgttctagcagattccggtttttgggagtgccgcgtgagcactagcggcggacaagattctcggagatttaaggtgaacgtcaaggtccctccagtgcccctggccgcaccccggctattaactaagcaatcccgccagctcgtggtatctcctttggtgtccttttcaggagacggaccaatttccacagtgaggttgcactacaggccacaggatagcaccatggattggtccaccatcgttgtagatccttccgaaaacgtgactctgatgaacctccgcccgaagacaggctattccgtaagagtgcagctgagtaggccgggcgagggtggtgaaggggcatggggcccccccactcttatgactactgattgcccagagccgctgttacagccatggctggaaggatggcacgtagaaggtaccgacagactgagggtttcttggagcttgcctcttgtacccgggcctcttgtcggggatggcttcttgctgcgactgtgggatggcaccagggggcaggagagaagagagaacgtgagtagtcctcaagcccgaacagcccttcttactggattaacgcccggtacccactaccagctggatgtgcagctgtatcattgcaccctgctgggtccagccagtccccctgcccacgtgctgctcccgcctagcggacctcccgctccaagacatctccacgcccaagcattaagcgactctgagatccagctgacatggaagcacccggaggcactgcctggccctatttccaagtacgtcgtcgaagtccaggtagccggaggagccggcgacccactgtggattgatgtggatcggcccgaagaaaccagcacaatcattcggggactgaacgcctctactagatacctcttccgaatgagggcctccattcagggactgggagactggtcaaacactgtagaagaaagtacactgggaaacggtcttcaggcagaggggccagtccaggaatcacgagccgcggaagaaggcctcgaccagcagctaatcttggccgtggtaggatctgtgtcggctacgtgtctaacgattctagccgcgttactgactttggtgtgcatccgaagatcttgcttgcaccgcagacgcacgtttacttaccaatcagggagcggcgaggaaaccattttacagttcagttccgggactctcactctgaccagacggccgaagttgcaacctgaaccattaagttacccagtcctggaatgggaggatatcactttcgaggacctcatcggcgagggaaactttggccaggtaatacgcgctatgatcaaaaaagatgggctgaaaatgaatgctgctattaagatgctcaaagagtacgcgagcgagaacgatcacagagacttcgcaggcgagctggaagtgctgtgtaagctgggacaccaccctaacatcatcaacttactgggagcttgtaaaaatagggggtatctgtatattgctatcgagtacgcaccttatggcaatcttctggattttcttcgaaaaagtcgagtcttggaaacagaccccgcctttgctcgggaacacggaacagcatcaacattatctagccgacagctgctccgcttcgccagtgacgccgccaatgggatgcagtatctgtcagagaaacagttcattcatagggatttagccgctcgcaacgtgctagtcggtgaaaacctggcctcaaaaatcgcagattttggcttgagtaggggtgaggaggtgtacgtgaaaaaaacaatgggccgacttccagttcgctggatggccatagaatcgctgaattactccgtgtataccacaaaaagtgacgtgtggagctttggagtcttactctgggagattgtatctctgggtggtaccccttactgtggaatgacatgcgccgaactgtacgaaaaattgcctcagggctacagaatggaacaaccccggaactgcgacgatgaagtgtatgagctgatgcgccagtgctggcgggacaggccttatgaaagaccccccttcgcccagatcgcccttcagcttggcaggatgctcgaagctcggaaggcttacgtgaacatgtctctgtttgagaactttacttacgccggcatagatgcaaccgccgaggaagcctag

SEQ ID NO: 17885 - DNA, 2352 bp, Artificial Sequence
  Description of Artificial Sequence: Synthetic coding sequence
atggccagcgaattagaattcaaccttgagactatgccccgtataaactgcgccgccgccgggaacccatttcccgtgcgagggtcaatcgaattacgaaagcccgacgggacagttctgctatctactaaagcaatcgtggagcccgagaaaacaaccgccgagttcgaggtgccgaggctcgtgctggctgacagtggattctgggaatgtagggtcagtaccagcggtggtcaggatagtcggaggtttaaagtcaatgttaaagtgccaccggtgccactcgcagcgcctagacttctgaccaaacagagccgtcagcttgtggtgagtcctctcgtaagcttcagcggtgacggccctatctccacagtgaggctccattaccgcccacaagattctaccatggattggagcaccatcgtagtagacccttccgagaatgtgactctgatgaatctgcgaccaaaaactggctacagcgtgagggtacagctgtctcggcccggggaagggggggagggcgcttggggcccacccactctgatgacaactgactgtcctgagccactgctgcagccgtggctcgaaggctggcacgtcgagggcacagaccggctgagagtgtcctggagcctgccgttggtccctgggcccctggtgggtgacgggttcttgttgagattatgggacggaaccagaggacaggagaggagagagaacgtgtcctctccacaggctaggacagccctccttaccggactgaccccaggaacccattaccagcttgacgttcaactgtatcactgtaccctactcggtccggcctcaccaccagctcatgttctgctgcctcccagcggtcctcccgctccacgccatctgcacgcacaggccctgtccgactccgaaattcaacttacatggaaacacccagaggccctgcctggacccatttcaaaatacgttgtggaagtgcaagtagccggcggcgcaggtgaccctctgtggatagacgttgaccggcctgaggagacaagcacgattatacgaggtctcaatgcatccaccagatatctatttcgcatgagggcttctatacagggacttggggactggtccaacaccgtagaggagtccacgttaggcaatggtctgcaagcagagggaccagtacaggagagtagagcagccgaagagggtcttgaccagcagttgatcctggctgtagtgggaagcgtgtcagccacctgcttgacgattctagctgcattactgactcttgtgtgcatcagacgaagttgtctgcaccgacggcgaactttcacttaccagtccggaagcggcgaagaaaccatcctccagttttccagcggcactctcaccctcacgcggcggcccaagctgcaacccgaaccactcagctatcctgtgctggagtgggaggacatcacttttgaagaccttatcggagaaggcaattttggccaggtcattcgcgccatgattaaaaaagacggcttaaaaatgaatgcggctataaaaatgctcaaggagtacgcgtccgagaacgaccatagagactttgctggtgagcttgaggtgctgtgcaagctcggccaccatcctaacattatcaatctgctcggcgcctgcaagaaccgaggatatctatacatcgccatcgaatatgctccctatgggaacttgttggactttctacgcaaaagtagggtgctggaaactgaccctgctttcgcccgtgaacacggcaccgcatccaccctttcctcccggcagttactgaggtttgccagcgatgcagccaacggaatgcaatacctttctgagaagcaatttatccatagagatcttgccgcgcgaaacgtcttggtcggggagaatctggctagcaaaattgccgactttggactctcacgtggagaagaggtttatgtcaagaagactatggggcgattgccggtacgctggatggccatcgagtcactgaattattcagtgtatacaactaaatccgacgtgtggtcgtttggggtactgctgtgggagatcgtcagcctggggggaacaccctactgcggcatgacctgcgccgagctctatgaaaagctcccacagggttatcggatggaacaacccaggaactgcgatgacgaggtgtacgagctgatgcgtcaatgctggagagaccggccctatgaacgtcctcccttcgcacagatagctctacagttgggtagaatgctggaggcgcgtaaagcctatgtcaacatgtccttgttcgaaaacttcacatacgccgggatcgacgctactgcggaagaagcgtag

SEQ ID NO: 17886 - DNA, 954 bp, Artificial Sequence
  Description of Artificial Sequence: Synthetic coding sequence
atggtgtggagggtgccgcctttccttctgcccatactctttcttgcttcccatgtcggggctgcagtggatttgaccctgctagctaacttgaggctcacagacccccaacgcttttttctgacctgcgtttcaggggaggccggggctgggcgcgggtctgatgcatggggacccccacttctgcttgagaaagacgaccgcatcgtcagaacaccccccgggccacccttgagactggctaggaatggttcgcatcaggtgactctgaggggattcagcaagccgtccgacctggttggagtgttttcatgcgtaggaggagccggagctagacggaccagagtgatatacgttcataatagtcccggcgcacacctgctgcccgataaagtgacacatacggtcaacaagggcgatacagcagtcctcagcgccagagttcataaggaaaaacagaccgacgtcatctggaagtctaatgggtcctatttctatacattggattggcatgaggcccaagacggcagatttctgctacagcttccaaatgtgcagcctcccagcagcggcatctacagcgcaacctatctggaggcatcacccctcgggtccgctttcttccgcctgatcgtgaggggctgcggtgccggacggtggggacctgggtgtacaaaggagtgcccagggtgtcttcacgggggagtgtgtcatgaccacgacggcgagtgcgtctgtccccccgggttcactggaacccggtgtgaacaagcgtgccgggaggggcgattcgggcagtcctgtcaggagcagtgccccgggatctccggttgtcgcgggctgactttctgtctgcccgacccctacgggtgcagctgtggaagtggatggcggggcagccaatgccaggaagtacaccagggtcactgtggcgctagggaagaccacagttag

SEQ ID NO: 17887 - DNA, 1266 bp, Artificial Sequence
  Description of Artificial Sequence: Synthetic coding sequence
atgagggcctcaattcagggcctgggagattggtcaaacaccgtagaggagtctacccttgggaacggactgcaggcggagggacccgtgcaagagagtcgcgccgccgaagagggtctggaccagcaactcatactcgcggtcgtcggaagcgtttcggctacctgcctaacaattctggcggccctccttaccctggtgtgcatcagaaggtcatgtctccaccgtcgccgtacttttacgtaccagtccgggtccggagaggagactatactgcaattctcatctggaactctcacgctcactcgccgcccaaagctgcaacctgagcctttatcctacccagttctggagtgggaggacattacatttgaagaccttataggagagggaaactttggacaggtcataagggctatgataaaaaaggatggtctgaagatgaacgccgctataaaaatgttgaaagagtacgcatctgaaaatgaccaccgtgacttcgcaggcgaactggaggtgctgtgtaaactcggccaccatcccaacattattaacctgctgggagcctgcaaaaaccggggatacctttatatcgccattgaatacgcaccatatgggaatctattggattttcttagaaagtcacgtgtactggaaacggatccggcctttgcgcgtgagcacggcacagccagtactttaagtagtagacaactactgcggtttgcaagtgacgcagccaatggtatgcagtacctgtctgagaagcagttcattcatagagatctggctgctcgcaacgtcctggtgggagagaatttagcaagcaaaattgcggattttgggctcagcaggggcgaggaagtttatgtgaaaaagactatgggtcgcctgcctgtaagatggatggcgatcgaatccttgaattactcagtttataccactaagagcgatgtgtggagtttcggcgtcctcttatgggagatagtgagcctaggggggactccctactgtggtatgacctgtgctgaactgtatgagaagctgccccagggctatcgcatggagcagcctcggaactgcgatgatgaagtgtacgaattaatgaggcagtgttggagagataggccctacgagcgacctccatttgcacagattgccctgcagctaggcaggatgctggaggctaggaaagcctacgtgaatatgagtctctttgagaacttcacgtacgcaggtatcgatgccacagccgaagaagcgtag

SEQ ID NO: 17888 - DNA, 1140 bp, Artificial Sequence
  Description of Artificial Sequence: Synthetic coding sequence
atggtgtggagggtgccacccttcttgctcccaatccttttcctggcctctcacgtgggggctgccgtagatctcaccctgctcgctaacttgagacttaccgacccccaaagattttttctgacctgtgtcagtggcgaggctggggccggtcgcggctcggacgcctgggggccccctctcctcctagaaaaagatgaccggattgtgaggacgccacctggccctcccctgcggctggctaggaacgggtcacatcaagtaacgctgcgaggcttttccaaaccatctgacttggtgggagtcttcagctgtgttggcggcgcaggtgcccgcagaacccgtgtgatttatgtacacaacagcccaggggcacacctgttaccagacaaagttacccacactgtcaacaaaggagacacggccgtgctgagtgctagggtgcataaagagaaacagaccgacgtgatatggaagtctaatggctcttacttctataccctagactggcatgaggcacaggacggccgtttcctcctacagcttcccaacgtgcaacccccatctagcggtatctatagcgccacataccttgaggcctccccattgggctctgcattctttaggctgattgtgagggggtgtggagccggccggtggggcccagggtgcaccaaagaatgtccgggctgcctccacggaggagtttgccatgaccacgacggtgagtgtgtgtgtccaccagggtttaccggcacacggtgcgagcaggcatgccgggagggtaggttcggacagagctgccaggagcagtgtcccgggattagtggatgccgcggcctgacattctgcttaccggatccatatggctgcagttgcggtagcgggtggagggggagccagtgtcaagaggcctgcgcaccagggcatttcggagccgattgtaggttgcaatgtcagtgtcagaacggggggacatgtgatagattttctggctgcgtgtgcccttccgggtggcatggggtgcactgcgaaaagagtggatggcgggattgggtcgacacgtccactgagaaacagaacaccgatgagggaaggtttggtgggcacgtcagcgcacccgttggcgccccaggatag

SEQ ID NO: 17889 - DNA, 819 bp, Artificial Sequence
  Description of Artificial Sequence: Synthetic coding sequence
atggccctgttagttcgcgtactgagaaatcaaacttcgatatcacaatgggttcccgtgtgtagccgtctcatccccgtgtcccctacgcagggccagggagatagagccttaagccgcacttctcagtggccacagatgtctcagtcgagagcctgcggtgggtccgagcagattcctgggattgacatccagctgaataggaagtaccataccacaagaaaactgtctaccacgaaggattcccctcagcccgtcgaggagaaggtgggtgcttttactaagattatagaggccatggggtttaccggccccttgaaatacagatgtcaaatgccagatacctttaatagctggttcctgattacactgttgcatgtgtggatgtgtttagtaagaatgaaacaggaaggacggtctgggaaatacatgtgcaggattatagtgcactttatgtgggaggacgtccagcagcgcggacgagttatgggggtgaacccttatatcctgaagaagaacatgattctcatgaccaatcatttttacgccgccattctcggatatgacgaggggatcttgagcgacgatcacgggctggcagcggcactgtggagaacattcttcaatcggaagtgcgaggacccccggcacctggagctcctggtggaatatgttcgcaagcaaattcagtatctggattcgatgaacggtgaggacttgctactaacgggcgaagtcagctggcgcccgctggtcgaaaaaaatccgcagagcatcctcaaaccacattcgcccacatacaacgatgaggggctgtag

SEQ ID NO: 17890 - DNA, 564 bp, Artificial Sequence
  Description of Artificial Sequence: Synthetic coding sequence
atgcagcccatcgacacatgcgtgagttacccccgcaccgggggtcaagggtcagtttctcattttccaggctgccagatgcccgacacctttaactcctggttcctcatcaccctactccacgtgtggatgtgtttagtgcgcatgaagcaggaaggccgttctggtaaatacatgtgccggatcattgttcacttcatgtgggaagatgtgcagcaacgaggtcgggtgatgggggttaacccctacattctcaaaaagaacatgatcttgatgacaaatcatttctacgctgccatcctaggctacgatgagggaattctttccgatgatcacggactggcagcagctctttggagaacattcttcaacagaaagtgcgaggacccccgacacctggagctgctcgtggagtacgtgcgaaagcaaatacagtatttggactcaatgaatggtgaagacctgctccttacgggggaggtgtcatggagaccccttgtcgagaagaatccccagagcattttaaaacctcactcccccacctacaatgacgaaggcctgtag

SEQ ID NO: 17891 - DNA, 696 bp, Artificial Sequence
  Description of Artificial Sequence: Synthetic coding sequence
atggccttactcgtccgcgtcttgagaaaccaaaccagcatttcccaatgggtacctgtgtgtagccggctcatacctgtgtcgcctacacaaggtcagggagaccgcgctttgtctagaacctcacaaaagattaaaatagcggctcttagaatgtacacaagttgtgttgagaagacagattttgaagagtttttccttaggtgtcagatgcctgatacttttaacagctggttcttaattactctgctacatgtttggatgtgccttgtgcgtatgaaacaggagggcagaagcggtaagtatatgtgccggattatcgtgcacttcatgtgggaggatgtacagcagcgaggtagagtcatgggtgtcaacccatatattctgaaaaaaaacatgatacttatgaccaatcatttctacgccgctatcttgggatatgatgagggcattctttcagatgaccacggattggcggctgccttatggagaacatttttcaacagaaagtgcgaagaccccagacatttagaattactggtcgagtatgtgaggaagcaaatccagtatttggacagtatgaacggggaggatctgttactgactggggaggtttcatggagacccctggttgaaaaaaacccccaatccatccttaaaccccactctcctacatacaacgacgaagggctatag

SEQ ID NO: 17892 - DNA, 822 bp, Artificial Sequence
  Description of Artificial Sequence: Synthetic coding sequence
atggctctgttggtacgcgtgctgcggaatcaaacaagcatctcccagtgggtacctgtctgctcccggctgatccccgtgagccccacgcaggggcagggcgaccgcgccttaagtcgaacttcacagtggcctcagatgagccagtccagggcttgcggtggttccgagcagatccccgggattgacatacaactcaacagaaagtaccacacaactagaaaactttccactacgaaagacagccctcaacctgtggaggaaaaggtgggggcttttacaaaaattatcgaggcaatggggttcaccggtcctcttaaatactccaagtggaagatcaaaatcgccgctctgcgaatgtacacctcttgcgttgaaaagaccgacttcgaggaatttttcctccggtgtcagatgcctgatacattcaactcttggtttctgatcaccttgctccatgtatggatgtgcttggtacggatgaagcaagaagggagaagcgggaagtatatgtgccgcattatagttcactttatgtgggaggacgtgcaacaacgtggcagagtgatgggaggcatcctttccgacgaccatggcctggctgcagccctatggcggaccttcttcaacagaaagtgtgaggatccacggcacttagaattgctcgtggagtacgtgcggaagcaaatccagtatctagattctatgaatggtgaggacttgctactgacaggagaggtctcctggcgtccactggtagaaaagaacccccagagcattctaaagccccattctccaacctacaacgatgagggcctgtag

SEQ ID NO: 17893 - DNA, 900 bp, Artificial Sequence
  Description of Artificial Sequence: Synthetic coding sequence
atggctctgctcgttcgagtcctgcgtaatcagacgtcgatcagccagtgggtgcccgtgtgctccagactgattcctgtctctcccacccagggccaaggagaccgcgccctgtcaagaacgagtcaatggccgcagatgagccaatcccgtgcctgcgggggttctgagcaaattccaggcatcgacatccagctaaaccgcaagtaccacacaactcgtaagctttccaccaccaaagactctccccagccagtggaggaaaaggtgggagccttcacaaaaatcatagaggctatgggctttactgggcccctgaaatactcaaaatggaaaatcaagatcgcagcactgaggatgtacacaagttgtgtggaaaaaacggacttcgaggaatttttcctgcggtgtcagatgccggacacctttaactcctggtttttgattacattactgcacgtatggatgtgcttggtgagaatgaaacaggaaggaagatcaggcaaatacatgtgccggataatcgtgcactttatgtgggaggatgttcaacagcgcgggagagtgatgggcgtcaatccgtatatactaaagaaaaatatgattctgatgactaatcatttctacgctgctatcctgggctacgacgaagggatattgtccgacgatcacggcctggccgcagccttgtggcggaccttctttaatcgaaaatgcgaggaccctcgccatctggaactgctggttgagtatgtgcggaagcagatacagtatctagactcaatgaatggagaggacctacttttgaccggagaggtgagttggcgccccttggtggaaaaaaatcctcaatctattctgaaaccacatagtccaacctacaacgacgaaggcctttag

SEQ ID NO: 17894 - DNA, 603 bp, Artificial Sequence
  Description of Artificial Sequence: Synthetic coding sequence
atgggttttacgggccctttgaaatactctaagtggaagattaaaatagcagccctacggatgtacacctcttgcgtggaaaagaccgacttcgaagaatttttcttacggtgccagatgccagacacatttaacagttggtttctgattacactgttgcatgtgtggatgtgtcttgtgagaatgaaacaagaaggtagatccggaaaatatatgtgtcgcatcatagttcactttatgtgggaggatgttcagcaacgggggcgggtaatgggagtgaatccctatattctgaaaaaaaacatgattcttatgacaaaccacttctacgcggctatcctgggatacgacgaggggatcctgagcgacgaccacggactggccgctgcattgtggagaaccttctttaatcgcaaatgtgaggacccaagacacctggagttactggttgaatatgtgagaaagcaaattcaatatctggactcaatgaatggagaagacctgctgctgaccggtgaggtgtcatggcgacccctggtggagaagaatccacagtctattctcaagccacatagcccaacgtacaatgacgagggactatag

SEQ ID NO: 17895 - DNA, 489 bp, Artificial Sequence
  Description of Artificial Sequence: Synthetic coding sequence
atggcactactggtgcgtgtcctgcgaaaccagacttcaatttcccagtgggtgcccgtctgcagtagattgataccggtttccccgactcaaggacagggtgaccgggccctcagtagaacctcacagtggccacagatgagtcaatcccgagcctgcggggggagtgaacaaatcccagggatcgatatccagctgaacaggaagtatcacacgacacccatattaggttacgatgaaggcattctaagcgacgaccacggccttgccgcggcgctgtggaggaccttttttaatcgtaagtgcgaagacccgagacacctcgagctcctggtggaatacgtgcgcaagcagatccagtaccttgactctatgaacggagaagacctgctactgaccggcgaagttagctggcggccactggtggaaaagaaccctcagagcattcttaaaccccacagtcctacttacaacgatgaggggctttag

SEQ ID NO: 17896 - DNA, 435 bp, Artificial Sequence
  Description of Artificial Sequence: Synthetic coding sequence
atgtgtctggttcggatgaagcaggagggcaggtccggcaagtatatgtgcaggatcattgtacacttcatgtgggaagatgtgcaacagcggggccgcgtaatgggagtgaatccatatatactaaaaaaaaatatgatccttatgacgaatcatttctacgctgcgatcctcggttacgatgaagggatcctgtctgatgatcatgggttggccgcagctctgtggcgaacgtttttcaaccgtaagtgcgaggatcctcgccacctggagttactggtggagtatgttcggaagcagattcagtatctggatagcatgaacggtgaagaccttctccttacaggggaagtgtcctggagacccctcgtggaaaagaatcctcagtccatcctgaaaccacactcaccgacgtacaatgatgagggcctgtag

SEQ ID NO: 17897 - DNA, 447 bp, Artificial Sequence
  Description of Artificial Sequence: Synthetic coding sequence
atggcactgctagtgcgggttctccggaatcagaccagcatcagccagtgggtaccagtctgctcacggctcattccggtgtcacctacccagggacagggtgacagagccctaagccggaccagtcagtggccacaaatgtcacagtctcgcgcctgtggaggctccgagcagatcccggggatcgatatacagctgaaccgtaagtatcatacgaccagaaagctgagcacaacaaaagattcaccacagccggtcgaggagaaggtgggcgcctttaccaaaatcatcgaggcgatgggtttcacgggaccacttaaatatagcaagtgggacgtgtcatctcctaatgaagctggcagaccagagtgggaggtccacgtgagttaccatagtagtttctacgtgggtggctgctccgccgctaggcagtcacatggcggatag

SEQ ID NO: 17898 - DNA, 825 bp, Artificial Sequence
  Description of Artificial Sequence: Synthetic coding sequence
atgttatctgttgcaagtcgctcagggcccttcgccccagtgctgtcagctaccagtcgcggggttgccggagccttacggcctctcgtacaagctacagtgccagctactcctgagcagcccgtgctggacctgaagagaccgtttctttccagagaatctctgtcaggacaggctgtgcggaggcccctcgtcgcatccgtgggcctcaatgtcccggcgagcgtctgctatagtcataccgatatcaaagtgcccgactttagcgagtacagacgcttggaagtcttggattcaactaaaagctcacgggagagttcagaggcccggaaaggattctcctatctcgtgaccggtgttacaactgtgggcgtcgcttacgccgcaaagaacgctgtaactcagttcgtgagctccatgtccgcctctgccgatgttctggcactcgcgaaaatcgaaattaaactaagcgacatccccgaaggaaagaacatggctttcaagtggagaggcaaacctctgtttgtccgtcatagaacacagaaagaaatcgagcaggaagcagcggtggagctctcccaactgagggacccacagcatgatctggatcgtgtgaaaaagcctgaatgggtgattctgattggcgtgtgcactcaccttggctgtgtccccattgcaaatgccggagatttcggtgggtattactgtccttgccatggcagtcattacgacgcctccggtcgcatccggctagggccggcccctttaaacctggaagtgcccacatatgaattcacttccgacgatatggtgatcgtgggatag

SEQ ID NO: 17899 - DNA, 1221 bp, Artificial Sequence
  Description of Artificial Sequence: Synthetic coding sequence
atggcggcaggcgctggggccggaagcgcacctagatggctgcgagctctctccgagccgctgtccgctgctcagcttaggcgcttggaggaacaccgctactcagccgctggggtttctctgctggagccccctctccagctctactggacatggctgcttcagtggatccctctctggatggccccaaattctataacactgctggggctggccgtgaatgttgtgactaccctggtgcttatatcttattgtcccacagcgacagaagaagcaccatattggacttacctgctatgcgccttagggctattcatatatcagtcactagacgcaatcgatggaaagcaggcccgccgaaccaattcctgtagtcccctcggagagctattcgatcatggatgcgacagcctgtcgacagtgttcatggctgtgggcgcgagtattgccgcgcggctgggcacatatccagactggttcttcttctgttctttcatcgggatgtttgtgttctactgcgcgcattggcagacatatgtctcagggatgctgagatttggcaaggttgatgttactgaaattcagatcgcactcgttattgttttcgttttatcagcattcggcggggccaccatgtgggactacactatccccatcctcgagatcaagctgaagatcctgcctgtattagggttcttgggcggcgtcatttttagctgttcaaattactttcacgttatcctgcatggtggcgtcgggaaaaatggcagcaccatcgccgggaccagcgtcctcagccctggcttgcatattggtctgatcatcatcctggccataatgatttacaagaaaagtgccactgacgtattcgagaagcacccatgcttgtacattctgatgttcggatgcgtgtttgccaaggtgtctcaaaagctggtggtggcccatatgaccaaatcagagttatacctacaggataccgttttcctgggacccgggctactgttccttgaccaatactttaacaactttatagacgaatacgtggtgctgtggatggccatggtgatttcttccttcgatatggtgatctacttctctgcactctgtctccagattagccgccatctgcacctgaatatattcaaaaccgcttgccaccaagccccagaacaagtgcaggtcctgagctcaaaatcccaccagaataacatggactag

SEQ ID NO: 17900 - DNA, 2508 bp, Artificial Sequence
  Description of Artificial Sequence: Synthetic coding sequence
atggccgagttaagcgaagaggcgttgctgtccgttttgccaaccatccgtgtccccaaagctggcgatagggtacataaagatgagtgtgcctttagcttcgacacacctgagagcgaaggaggcctgtacatatgcatgaacacattcctcgggtttggtaaacaatacgtggaacggcattttaacaagaccggacaacgagtctacctgcacctgaggagaacaaggcggccaaaggaggaggatcccgccacaggtactggggacccaccacggaaaaagcctaccaggctcgccattggtgttgaaggaggattcgatcttagcgaagaaaagttcgagctcgatgaagacgtgaaaatcgtcatcttgccggattacttggagatcgccagagatggtctcggggggctacccgacatagttagagatagagtgacatctgcagtggaggctctgctgtccgcggacagtgcgtctaggaaacaagaagtgcaggcttgggatggcgaagtccggcaggtgtctaagcatgccttcagtcttaaacagctcgataaccccgctcgaattccaccttgcgggtggaagtgttccaaatgcgatatgcgcgaaaacttatggttaaacctaaccgatggatcgatcttgtgtgggaggagatattttgacgggagcggcggaaacaaccacgctgtggagcattacagagagaccggctaccctttggcagtaaaacttggtacaatcactccagacggcgctgacgtttactcatacgacgaagatgacatggtgctggatcctagcctggccgagcatttaagtcatttcgggatagacatgctgaaaatgcagaaaaccgacaagaccatgactgagttggagattgacatgaatcagagaattggtgaatgggagcttattcaagaatcaggagttcccctgaagccactgtttggaccaggttacacaggcattcgaaatctgggcaatagctgctatctgaacagcgttgtgcaggttctcttctctataccagactttcagaggaagtatgtcgataagctggaaaaaattttccaaaacgcacccacagacccgactcaggacttcagtacacaggttgcgaaactgggccacggtctcctgagcggtgaatactccaagccagtgcccgaaagtggcgatggagaacgggtgcctgagcagaaggaggtacaggatgggatcgcacctcgtatgttcaaggccttaataggcaaggggcacccagaattttcaacaaaccggcaacaggacgcccaggagttctttttgcatctgataaatatggtcgagcggaattgccgcagctctgagaatcctaatgaagtgttccggttcttagtggaggagaagattaagtgtctggcaacagaaaaggttaagtacacacagagagtggactacattatgcagctgccagttccaatggatgccgccctgaataaggaggagctgctggagtatgaggagaagaaaaggcaggccgaagaggagaagatggcactccccgaactagtccgcgcccaagtgccattctctagttgccttgaggcatacggcgccccagagcaggttgatgacttctggtcaacagccctccaagctaaaagcgtggctgtgaaaactacaagattcgcttccttccctgattatctggtgatccagatcaaaaaattcacctttggcctcgactgggttccaaaaaaactggatgtgtccatagagatgcctgaagaactcgatatctctcagctgcgggggaccggcttgcagcctggggaggaggagcttccagatattgcaccccccctggtaactcccgacgagccaaaggctccaatgttagatgagagtgtgattattcagctcgttgagatgggcttccccatggacgcttgcagaaaggccgtgtattacactggaaattcaggagccgaagcggccatgaattgggtgatgtcacatatggatgatcccgacttcgctaatccattgatcctgcccgggtcttcgggtccggggtccacttcagcggccgccgatcccccccccgaagactgcgtgaccactatagtatctatgggattcagtcgcgaccaagcgctcaaggctctaagagctactaataactcattagagcgggcggtggattggattttcagtcacattgacgatctcgatgctgaagccgccatggacattagcgagggacggtcagccgcagacagcattagcgaatccgtgcccgtgggtccaaaggtgcgggacggcccaggtaaataccaactgtttgcttttatatcacatatggggacatcaaccatgtgcggccactatgtgtgtcacatcaagaaagagggtagatgggttatctataacgaccagaaagtgtgtgcatccgaaaaaccacctaaggatctgggctatatctacttttaccagcgagttgctagttag

SEQ ID NO: 17901 - DNA, 2385 bp, Artificial Sequence
  Description of Artificial Sequence: Synthetic coding sequence
atggctgacgcctgggaggagatcagaagactggcagccgactttcagcgggcacagtttgccgaggctactcaaaggctgtcagagagaaattgcatagaaatcgtcaataagctgattgcccagaagcaactggaagtcgtccatacccttgacggcaaggaatacatcactccagcacaaatatctaaggagatgcgcgacgaactccacgtgcgcggtggacgggtgaatatagtggacctccagcaggtgattaatgtcgatctgattcatattgagaatagaatcggagacataatcaaaagcgaaaaacatgtgcagctagtcctcggtcagctgatagacgagaactacctcgacaggcttgccgaagaagtgaacgataagctgcaggagtcggggcaagtaactatttctgagctatgcaagacatatgacttaccgggaaatttcctgacccaggcccttacccagcgcctcggacggatcatcagtggtcatatcgatctggataaccgcggagtgatcttcacggaggcattcgttgcaagacacaaggcgcgcatccgcggcctgttcagtgcgatcactaggccaactgcagtgaattctctgatttcaaagtacggtttccaggagcagttgctttattctgtgctcgaagaattagtcaacagcggtcgcctccgcggtacagttgttggggggaggcaggacaaggctgtctttgttccagacatctacagccggacccaaagtacctgggttgattctttctttcgccagaatggttacctcgagtttgacgctctaagccgtctgggtatccccgacgcagtgtcttatatcaagaagagatataagacaacgcagctgctgttcctgaaagctgcatgcgtgggacagggtctggtagatcaggtggaagcatctgtggaagaagcaatctcatccggaacctgggtggatatcgcaccactgctgcccacttcattgtcagtggaggacgcagccatcctgctgcagcaggtcatgagggcattcagtaaacaggcgtccactgtggttttcagcgacacggtcgtggttagtgaaaagtttatcaacgattgtaccgagctgttccgggagctgatgcaccagaaggccgaaaaggagatgaagaataacccagtccacctaattacagaggaggatctgaaacagatttcaacccttgagtccgtgtccacatctaaaaaggataaaaaagatgaaaggcgccggaaggctacagagggaagcgggagtatgagagggggggggggaggcaacgctagagagtacaagatcaagaaagtcaaaaaaaaggggagaaaagatgacgacagcgatgacgaatcacaatcctctcatacagggaagaaaaaaccggagatttcctttatgttccaagacgagattgaagactttttgaggaagcacatccaagatgcacctgaggagttcattagcgaactcgccgagtatttgattaaaccgctgaataaaacgtacctggaggttgtccgttccgtgttcatgtcttctaccactagcgctagtgggacgggcagaaagcggaccatcaaggacttgcaggaagaggtatcaaatctttataacaatattaggctattcgaaaaggggatgaaattctttgccgatgacactcaagctgcactgactaaacacttgctaaaatctgtgtgtactgatattaccaacctgatcttcaatttcctcgcatctgatttaatgatggccgtggacgatccagcagccattacctccgagataagaaagaagattctctctaaactgtcagaagaaacaaaggtggctctgacaaagctgcacaactccctgaatgaaaagagtattgaggacttcatttcttgtcttgattcggcagccgaagcctgtgacatcatggtgaagcgcggcgataaaaaacgtgaacggcagatactcttccagcatcgacaagcacttgcagagcagctgaaggttactgaagaccctgcacttattctccacttgactagcgttctgctctttcagttttctacccatagcatgcttcatgctcctggacggtgtgtaccccaaatcatcgcgttcctgaattccaagatccccgaggatcagcacgcgctcctggttaagtatcagggcctggtcgtaaaacagctggtaagtcagtcaaaaaaaacaggtcagggggattatccactgaataatgaattagacaaggaacaggaggatgttgcctcaaccactcgcaaggagttgcaggagctgtctagctccataaaggacctagtgcttaagtcgagaaagagttcggtcacagaggagtag

SEQ ID NO: 17902 - DNA, 942 bp, Artificial Sequence
  Description of Artificial Sequence: Synthetic coding sequence
atgatcgggcaaaagactctctatagcttcttcagcccttccccagcgaggaagcggcacgcgccatccccagagcccgctgttcagggaaccggggtcgcaggtgtccccgaagagagcggtgacgccgccgcgatccccgcaaaaaaggcccccgccgggcaggaagaaccaggtacccctccctcctccccgctgagcgctgagcagctggataggatccagcggaataaggcggcagccctgcttaggctggcagctagaaatgtgccggttggatttggagagagctggaagaagcacctgtcgggggaatttggaaaaccatatttcattaaattaatgggattcgtggctgaagaaagaaaacactataccgtgtatccccctccccatcaggtgttcacctggacccagatgtgcgacatcaaagatgtgaaggtggtcattctgggtcaggatccctaccacggacccaaccaagcacacgggttatgtttcagtgttcaacggcctgttccacccccccctagcctggaaaacatatataaggaattatccaccgacatcgaagactttgtgcaccctggtcacggtgacctgagcggttgggccaaacagggagttcttcttttgaacgctgtcctgaccgtgagggctcaccaggcgaatagccataaagagcggggctgggagcaattcaccgatgctgtcgtttcgtggctgaaccaaaattctaacggactggtattcctgctgtggggctcttatgcacagaaaaagggtagcgccattgaccgaaaacggcaccacgttctgcagacggctcacccttcacctctgtccgtgtatcgaggattcttcggctgtagacacttctctaagacgaatgagttgctacagaagagcgggaaaaaaccaattgattggaaggagctctag

SEQ ID NO: 17903 - DNA, 915 bp, Artificial Sequence
  Description of Artificial Sequence: Synthetic coding sequence
atgggcgtgttctgcttaggtccttggggcctcggacgtaaacttcgaactcccggtaaaggtcctctccagcttctgtcaagactgtgcggggaccacttacaagcaatcccagccaaaaaagccccagcaggacaggaggagccagggactcccccatcgtccccattgtcagccgaacaactggataggatacagagaaacaaggccgcggctttattaaggctggccgccaggaacgttcctgtcgggtttggggagtcttggaagaagcatctttctggggagttcggcaagccttactttattaagcttatgggttttgtggctgaagagcgaaaacattacaccgtttatccgcccccacatcaggtcttcacttggacacagatgtgcgacataaaagacgtgaaagtggtcattcttggccaagacccatatcacgggccaaaccaggcacacggtctgtgctttagcgtgcagcgccccgtgcctccccccccctcactggaaaatatctataaggagctgagtactgatatagaggacttcgtgcaccccggccacggggatctctcaggctgggccaaacaaggcgtcttgctgttgaacgccgtcctgacagtgagggcacaccaggccaatagtcacaaggagaggggctgggaacagtttacagacgccgttgtgtcttggcttaatcaaaattctaacggattggtgtttctactctggggatcctacgcccagaagaagggatctgccatcgaccgcaagaggcatcacgtcctgcaaactgcccacccgagtcctctgtcagtgtacaggggcttctttggttgtcgccacttctccaagactaacgagcttctacagaaatcaggtaaaaaacccattgactggaaggagttatag

SEQ ID NO: 17904 - DNA, 813 bp, Artificial Sequence
  Description of Artificial Sequence: Synthetic coding sequence
atgggggtgttctgtcttggcccatggggactagggaggaagctgcggactcccggcaaaggcccgctcagcgcggagcagcttgatagaatacaacgcaacaaggccgctgccctcttgcgccttgccgccagaaacgtcccggttggttttggcgagagctggaaaaaacatttgagtggcgaatttggaaagccttattttattaagctaatggggttcgttgctgaggagaggaagcattacactgtgtatcctcctccccatcaggttttcacttggacccagatgtgcgacatcaaggatgtcaaggtggtgatcctgggccaggacccttatcatggcccaaatcaagctcacgggctgtgcttctctgtgcaaagaccagtgcccccccccccctctctcgagaacatttataaagaactgtcaaccgatatcgaggatttcgtccatccaggacacggtgacctgtcaggttgggccaagcagggggtgctcctactgaatgccgtcctgactgtgagagcccatcaggccaattcacacaaagaacgggggtgggaacagtttacagacgcagtggtgtcatggctgaatcaaaactcaaatgggctcgtgttcctgctgtggggttcctatgcccagaaaaaaggtagcgctatagatagaaaacgtcaccatgtgctgcagaccgcccaccccagtccactgtcagtttaccgcggatttttcggatgtcgccacttctctaagacaaatgaattgctccaaaagtcaggaaaaaaacctattgactggaaagagctgtag

SEQ ID NO: 17905 - DNA, 9288 bp, Artificial Sequence
  Description of Artificial Sequence: Synthetic coding sequence
atggtttttgagtcagtcgtggtggacgtactaaacagattccttggcgattacgtagttgacctagatacatcacaactgagtctgggaatctggaagggcgcagtggcactgaagaacctccaaataaaggagaacgcgttatcgcagctcgatgtgccttttaaagtgaaagtgggccacatcggtaaccttaagttgatcattccatggaaaaatctctacacccagcctgtggaggctgtgctcgaggagatctacctgctgatcgtgccaagtagccggataaagtacgaccctctgaaagaagagaagcagctaatggaagccaagcagcaggaactcaaacgtatagaggaggccaaacagaaggtagttgaccaggagcagcacctgccagagaaacaagacaccttcgcagagaaactggtgacacaaataataaaaaacctgcaagtgaagatttctagcatccacatcagatatgaagacgatatcacgaacagggacaaacctctaagcttcgggatttccctccagaatctgagcatgcagaccacagaccaatattgggtcccgtgcttgcatgacgagacggagaaactagtgcgcaagttgattagacttgacaacctatttgcttactggaacgtaaaatcccagatgttctacctcagcgattacgacaattcgctggatgacctaaagaatggaatcgttaatgaaaatatcgtgccagagggctatgactttgtgttccgaccaattagcgccaatgcgaagctcgtgatgaatcggaggtctgacttcgacttctccgctcccaagataaacttggagatagagcttcacaacatcgcaattgaatttaataagccccagtacttctccattatggaactgctggaaagcgtggacatgatggcacagaacctgccttaccgaaaatttaaacccgacgttccgttgcaccaccatgctagagaatggtgggcttatgcgatccacggggtgctggaggttaatgtatgtccccgtctgtggatgtggtcatggaaacacatacggaaacatcgccagaaagttaagcaatacaaagagctgtataagaagaaattaactagcaaaaaaccccctggggagcttctcgtgtccctggaagaactcgagaagacactggacgtgttcaatattacaatcgcaagacaaacagcagaggtggaggtcaagaaggccgggtacaagatttacaaagaaggggtaaaagacccagaggacaacaaggggtggttcagttggctgtggtcgtggtcggagcaaaacacaaacgaacagcagcctgacgtgcagcccgagacactggaggaaatgctgacgcccgaggaaaaggctctcctgtatgaggcaatcggctacagtgagacagctgttgatcccactctcctgaagacctttgaggccctaaaattcttcgtacacctgaaatccatgtccatagtcctgagagagaatcaccagaagcctgagctcgtggatatcgtcattgaggaattctctacacttatagtgcagcggccaggtgctcaagcaatcaagttcgagactaagatcgactcattccacatcactggtttgcctgacaactctgaaaaaccacgcctacttagttcactcgacgatgccatgtcccttttccaaatcacattcgagatcaaccctctcgatgaaacggtcagccagagatgtatcatcgaggccgagcctctcgagatcatttacgacgcccgcaccgtcaacagtatcgtcgagttttttagaccgccaaaagaggttcatctggcccagctgacggccgcaacactcaccaagttggaagagttcagatccaagacagcaacaggcctattatacattattgaaacgcagaaagtgctggaccttaaaatcaatctgaaagcttcctatatcatcgtgcctcaagatggaattttttccccaacctctaatctacttttgctcgacttgggccacttaaaggtgacatccaagtcaaggtcagaactgcccgacgtcaagcagggggaagcaaacttgaaggaaataatggaccgggcgtatgactctttcgatatccagctaacctcggtgcagctgctgtacagcagagtcggggataactggcgagaagcacggaaactgagtgtgagcacccagcatattctggtgcccatgcactttaacctggagcttagtaaagcaatggtttttatggatgtgcggatgccaaaatttaaaatctacggcaaactgcctctcatatcattgcgaatcagcgacaaaaagttacagggcataatggaactgatagaatcaatccccaaacccgagcccgtgactgaggtatccgcgccagtgaaatccttccagatccagacctcaacatctctgggtacatcacagatctcacagaaaatcattcctttgttagaactgccctccgtgtcagaggacgattcggaggaagaattttttgacgccccatgctctcccctcgaggaacccttgcagttcccaactggagttaagagcattcgaacacgaaaactccaaaagcaggattgtagcgtgaacatgacaacattcaagattcgattcgaggtccctaaggtgctgatcgaattctaccatttagtcggggactgcgagctttctgtggtggagatacttgtgctgggtctaggggcagaaatcgagattcgtacttacgatctgaaggcaaacgccttccttaaggagttctgcctgaaatgtccagagtatctagacgagaacaagaagcctgtgtacttggtgacaacactcgacaacactatggaggacctgctcacgcttgagtatgtaaaagcggaaaagaacgtccctgacttaaaaagcacttataataacgttctccaactgatcaaagtgaactttagctcgctggatattcatctgcacaccgaggctctacttaacacaattaactacctgcacaatatactgccccagtccgaagaaaaatccgctcccgtatctacgaccgagaccgaggacaaaggagatgttatcaagaaactcgctctgaagctgtcgaccaacgaagacattataacccttcagatcttggccgaactgagctgtctgcaaatcttcatccaggaccagaaatgtaacatcagtgaaattaagatcgaaggtctcgatagtgaaatgatcatgaggcccagcgagaccgaaatcaatgctaaactaagaaacatcattgttctggattctgacataactgctatttataagaaagccgtgtacatcacagggaaagaggtgttcagctttaaaatggtgtcatacatggacgcaactgccggctctgcatatactgatatgaatgtcgttgatattcaagtgaatctaattgtgggttgcatcgaggttgtattcgtcacaaaattcctttatagcattctggcctttatcgataattttcaggctgcgaaacaagctctcgcggaggccaccgttcaggcagcagggatggccgcaacaggggtgaaggaattagcacagcggagcagtagaatggccctggacattaacatcaaggcgccagtggtcgtgattcctcagtctcctgtgagcgagaacgtctttgttgctgattttggtctcatcacaatgacgaacacgtttcatatgattactgaaagccagagctcgcctcctcctgtgatcgacctgatcactataaagctctctgaaatgagactgtacagaagcaggttcataaacgacgcatatcaggaagtgctggacttactcctccctcttaatctggaagtagtggtggagcggaacttatgttgggaatggtatcaggaagtaccttgttttaacgttaacgcccagctgaagcctatggaatttattctcagccaggaggatattacgacgatttttaaaactctgcacggcaacatatggtatgagaaggacggcagcgcttccccagccgttacaaaggatcagtactcagctactagtggcgtcaccacaaatgcaagccaccacagcgggggagcgactgtggtgactgctgctgttgtcgaggtccactcacgcgctcttctagttaagaccactttgaatatcagtttcaaaacagatgacctgaccatggtgctgtactctcctggacccaagcaggcatcattcacagatgtgcgagacccatccctaaaattggcggaatttaagttggaaaacataattagtacccttaagatgtacacagatggctccacattctccagcttttctctgaagaactgtattctcgatgacaagcgtccccatgtcaagaaggccacacctcgcatgatcggcctcacagtaggatttgataagaaggacatgatggacattaaataccgcaaggtccgagacgggtgcgtgaccgacgccgtcttccaagagatgtacatctgcgcatcagtcgagttcctgcagactgttgccaatgtgttcctcgaggcatacaccactggaaccgctgtggagacgtcagtccagacttggaccgcgaaagaagaagtgcccactcaagagtccgtcaagtgggaaatcaacgtcattattaagaaccctgagatcgttttcgtggcagacatgactaaaaatgacgcgcccgcactggtaattacaactcaatgcgaaatctgttacaagggcaatctcgaaaatagcacgatgacggccgccataaaagatctccaggtaagagcttgccccttcctgccggtaaagcgcaagggcaaaatcacaaccgtcctgcagccttgtgaccttttctaccaaacgacccagaagggcactgacccccaggttatcgatatgagtgtaaagtctctcacgctaaaggtctcacccgtcatcattaataccatgatcacaatcacgagcgccttgtataccacaaaagagaccataccagaggaaacagctagttctaccgcccatctgtgggagaaaaaagacacaaagacactcaagatgtggttcctcgaagagagcaatgagactgagaagatcgccccaacgaccgaactcgtgccaaagggcgaaatgatcaaaatgaacatcgactcgatctttattgtgttggaagcaggaatcggccaccgaacggtgcccatgttactagctaaatcccggtttagcggggagggcaaaaattggtcgagtctcatcaacttgcactgccagttggaactcgaggtacattattacaatgaaatgtttggagtttgggagcccctgctcgaaccacttgagattgatcagaccgaagactttcgaccatggaatctgggaatcaaaatgaagaagaaggcgaagatggctatagtggagagtgaccctgaggaggagaattacaaggtgcctgagtataagactgtgattagctttcactcgaaggatcagcttaacattactctgtccaagtgcggcttggtcatgctaaataatctggtcaaagccttcactgaagccgcaacagggtccagtgctgatttcgtcaaggatctagcgccgttcatgattctgaatagccttggactgaccatttcggtcagcccaagcgattctttttctgtgttaaacatcccaatggcaaagtcctacgtgctcaagaacggagagagcctgagcatggactatatacgtacaaaggacaacgatcacttcaacgctatgacatccttgtcatccaagctgttctttatcctgctgacccccgtcaaccatagtaccgcggacaaaatccccctgacgaaagtcggtcggcgtctatatacagtccgacaccgcgagtcaggagtggagaggagcattgtttgccagatcgacactgtggaagggtcaaaaaaggtcactatccggagccctgttcagatccgtaaccatttcagcgtgcccctttcagtatatgaaggagacaccctactggggaccgccagccctgaaaacgagttcaatatccccttgggcagctatcggtccttcatttttttgaagccagaggatgagaactatcagatgtgcgaaggcattgactttgaagaaatcattaaaaatgatggggcactgcttaagaaaaaatgccgaagtaagaacccatcaaaagagtccttccttattaatatcgtgcctgaaaaagacaacctgacctccctgtctgtctattcggaggacggttgggatctgccctatattatgcacctttggccccccatacttcttagaaatttgctgccctataagattgcctactacatagagggcatcgagaactccgtttttaccctgtcagaggggcactctgctcagatctgtactgctcagttgggaaaggcccgcttgcatctcaaactgttagactatctgaaccatgactggaagagtgagtaccatatcaaaccaaatcagcaggacatatcgttcgtaagttttacgtgtgtgacagaaatggagaagactgacctcgacatcgcggtccatatgacatataatacaggtcagacggtcgttgccttccacagtccgtactggatggtgaacaagactggtaggatgctgcagtacaaagctgacggcatccaccgaaagcatcccccaaattacaagaaaccagtattattctcctttcagcccaatcatttcttcaataacaacaaagtgcagctgatggtcacagattcagaactttccaaccagtttagcattgatacagtaggttcacacggcgcggtgaaatgcaaggggctcaagatggattaccaggtaggagtcacaatcgatttaagtagtttcaacatcaccagaattgtcacttttacgcccttttacatgatcaagaacaaatcaaagtaccatatctcggtcgcggaagagggcaacgacaagtggctgagccttgacctggaacagtgcattccattctggcccgagtatgcctcgtcaaagctgctgatacaggtggaaagaagcgaggacccccctaagcgcatctacttcaataaacaggaaaactgtattttgcttcgccttgacaatgaattaggcggcataattgcagaggtgaacctagctgagcacagtacggtgataactttcttagactaccatgatggggctgcaacattcctgctcatcaaccatactaagaacgagctggttcaatataaccagtcgtcactcagcgagattgaggatagcttgccaccggggaaagccgttttttacacctgggccgatcctgttggaagcaggcggctgaagtggcgatgtcgaaaatcccacggtgaagtgactcagaaagacgatatgatgatgccgattgacctgggagaaaaaaccatctacttagtctcattcttcgaggggctgcaaaggattatcctgtttacggaagatccacgggtgttcaaggtgacctacgagtccgaaaaagcggagttggcagaacaagagatcgcagtcgcacttcaagatgtaggaatctctctcgtcaataattacactaagcaggaggtcgcatacatcggcataacgagtagtgatgtcgtttgggagactaagcccaaaaagaaggctcgctggaagcccatgagtgtgaagcacacggagaagctagagagagagtttaaggagtatacagagagctccccttctgaggataaggtgattcaactggacaccaacgtgcccgtgcggttgacacctaccggccacaatatgaagattctgcagccacacgtgattgctctcaggagaaactacttaccagcactaaaggttgaatacaatactagcgcccaccagtctagcttccgcatccagatttaccgtattcagattcagaatcagatacacggtgctgtctttccatttgtcttctatcctgtcaagcctcctaaaagtgttacaatggacagtgctcccaagcctttcactgacgtgagtattgttatgcggtccgccggccactcccagatttctcgaatcaaatacttcaaagtcctaattcaggagatggatctaagactcgacctcggattcatttacgctctcacggacctcatgacagaagcagaagtcaccgaaaacacagaggttgagttattccataaggatattgaggccttcaaagaggaatacaagactgcttcactcgtggaccagagccaagtttccttgtacgagtattttcatatcagtcctataaagttgcatctttcagtttcgctgtcctccggtagagaggaggcgaaagatagcaagcagaacggcgggttaattcctgttcatagtctcaatctgctgctcaaaagtatcggagccacacttactgatgtgcaggatgtggttttcaagctggccttcttcgaactaaattaccagttccacaccaccagcgatttgcaatctgaagtgattagacactattcaaaacaggcgatcaagcagatgtatgtccttatcctgggactggacgtactcggcaacccattcggtcttattagggaattcagtgaaggcgtggaggcctttttctatgagccttaccagggcgccattcaggggcccgaggaattcgtggaaggcatggccctcgggctgaaagctttagtagggggcgccgttggtggcctggctggcgcagcatcaaagatcactggggccatggcaaaaggtgtcgccgcaatgactatggatgaggattaccagcagaaacgtagagaagctatgaacaagcagccagcaggattcagggagggaatcacacgcggcgggaaagggctggtgagtggctttgtgtcggggattaccggaatagtcaccaaaccaatcaagggcgctcagaaaggtggcgcggccggattttttaagggagtcggcaagggattagtgggagctgtggcgaggccgacgggaggcatcatagacatggcaagctccacgtttcaggggatcaaaagagccactgagacctctgaagtagagagcctgcgcccacccagatttttcaatgaggacggggtcatccgcccctatcggttgagggacgggaccggaaatcagatgctccagaaaattcagttttatcgggagtggatcatgacacactcttcaagctccgatgacgacgatgacgacgatgacgatgacgaatccgacctgaatcattag

SEQ ID NO: 17906 - DNA, 9525 bp, Artificial Sequence
  Description of Artificial Sequence: Synthetic coding sequence
atggtgtttgaatcagttgtggtagatgtgcttaacagatttctaggggattatgtcgtggacctggacacgtcgcagctgagtctgggcatctggaagggagctgtggccctcaagaatctgcagattaaagagaacgccttgtcccagctggacgtgcctttcaaagttaaagttgggcacatcgggaacctgaaactcatcataccctggaagaacttgtatacacagccagtcgaggccgtgctggaggaaatctacctcctcattgttccatcaagcaggataaaatacgacccactgaaggaggagaaacagctgatggaagcaaagcaacaggagctcaaacggatcgaagaagccaagcagaaagtcgtcgatcaggaacagcatttacccgaaaagcaggacacctttgcagaaaagctcgtgacacagattattaagaacctccaggttaaaatttcaagtattcacatccggtatgaagatgatataaccaatagggacaagccgctgtccttcggcatcagcctacagaatctgtccatgcagacaaccgaccaatactgggtcccttgtcttcatgacgagactgaaaaacttgtgcgaaagctcatccgcttagataacctcttcgcctattggaacgtgaaaagtcaaatgttttatctctccgactatgacaatagcctagatgatctgaagaatggaatcgtcaacgagaatatcgtcccagagggatatgatttcgtgtttcggcctataagcgccaatgcaaaacttgtaatgaataggagaagcgactttgacttctcagcccccaagattaacctcgagattgaactccataatattgccattgagttcaacaaaccacagtacttctcgattatggagctgcttgagagtgttgatatgatggcccagaacttgccatacaggaaattcaaacccgatgtgccattgcatcaccacgccagagagtggtgggcgtacgctatccacggagtacttgaggtgaacgtgtgccctcgtttatggatgtggtcctggaaacacataaggaaacatagacagaaagtcaagcagtataaggaactgtacaagaagaagctgacctcaaagaaacctccaggtgagctgctagtgtctctcgaggaattggagaaaacactggacgtgtttaatataacaatcgcccgccagacggcagaggtggaagtcaagaaagcaggctataaaatttataaagaaggcgtgaaggaccccgaggacaataaaggatggttcagctggctttggtcttggagcgaacagaacactaacgagcagcagcccgatgtgcaaccggaaacattagaagaaatgctgaccccagaggagaaagccctgctttacgaagctattggatactctgagactgctgttgatcccacattgctgaaaaccttcgaagctctgaagttcttcgttcacctgaagtccatgagcatagtcctacgcgaaaatcaccagaagccggagctagtggacattgtgatcgaggagttcagtactctcattgtgcagcggcctggcgctcaagccatcaaatttgagaccaaaattgactcgtttcatataactggactgcctgataactctgagaaaccccggttattatcctccctcgatgatgccatgagtctgttccaaattaccttcgagatcaatccactggatgaaacggtgtctcagcgctgcatcatcgaagctgagccattggagattatctacgatgcccggactgtcaactccatcgtggaattcttcagaccacctaaggaagtccatctcgcgcagttgaccgccgccactctgacaaagttggaggaatttagaagcaagaccgcgacagggctgctgtatataattgaaactcagaaagtgctggaccttaagataaacctcaaggccagctacatcatcgttcctcaggacggcatcttctcacccacctctaacttattgcttttagacctggggcacctgaaagtcacgtccaagtctcgaagcgagctcccagatgtcaaacaaggtgaggctaatctcaaagagatcatggatagagcgtatgactcttttgacatccagctgacttccgtccagttgctgtactctcgcgtcggcgacaattggagggaggccaggaagctgtcagtgtctacccagcacatactagtcccaatgcattttaacttggagctcagcaaggccatggtctttatggatgtgcgtatgcccaagtttaagatatacggtaagctcccactaattagtctcaggataagcgataaaaaacttcagggcattatggagctgatcgagtccattcctaagcccgaacctgtcacagaggtaagcgcccctgtaaagagctttcaaattcagactagcacgtctctgggcacatcgcagatcagccagaaaattataccacttttagaactgccatccgtttctgaagatgattccgaggaagagttctttgacgccccctgctctcccctggaagagccactccaattccctaccggagtgaaaagcattagaactcgcaagctgcagaagcaggactgttcggtgaacatgacaaccttcaagatccggtttgaggtgcccaaggtcttaatcgagttttaccacctcgtcggggattgcgagttgtcagtggttgagattctggttctcggcttgggagccgagattgaaatccgtacatatgatctcaaagccaacgctttcctgaaagagttctgcttaaagtgccccgaatatttagacgagaataagaaacctgtgtatctggtgactaccttggacaacacgatggaggacctgctaacccttgagtatgttaaagcagaaaagaacgtgcccgatcttaaaagcacctacaataatgtcctgcaactgatcaaggtgaacttcagttccctggatatccatctgcatactgaggcgttgctaaacacaattaactaccttcacaacattctgcctcagagtgaggagaaaagtgctcccgtctccactaccgagaccgaagataaaggggatgtcattaaaaagctcgcactgaagctatccacaaatgaagacatcatcacccttcagatcttggctgaactgtcctgtctgcagatatttatacaagaccagaaatgtaatatatcggagatcaagatcgaaggcttagattctgaaatgatcatgaggccgagcgagaccgaaatcaacgccaagttgcggaatattattgtgcttgattccgatattacagccatctacaaaaaggccgtgtatattaccgggaaggaagtgttcagtttcaagatggtgagttacatggatgctacagccggtagcgcctatactgatatgaacgtggttgacatccaggtgaacctgatcgtgggctgtatcgaggtggtgttcgtcaccaaattcttgtacagtatactcgcattcatcgacaacttccaggccgccaaacaggctctggctgaagccaccgtgcaagcagcaggtatggccgcaaccggcgtgaaggagctggctcagaggtcaagccggatggccctggatatcaatatcaaagcccctgtagtggtcattccccagagtccagtgtctgagaacgttttcgtcgctgactttgggctgataacgatgactaataccttccacatgataaccgaatcccagtccagtccaccccccgtgatcgatttaatcactatcaagctgtctgagatgagactttatagatcaagatttatcaacgacgcttaccaagaggttctggaccttttgctacccctcaacctggaggtggtggtagaacgtaacttgtgctgggaatggtatcaagaggtgccctgcttcaacgttaacgcccaactgaagccaatggaatttattctctctcaggaggatatcaccacaatttttaagaccttgcacgggaacatttggtacgagaaggatggctctgcctctcccgcagtgactaaagaccagtactccgcaaccagcggtgtcactaccaatgcctctcaccatagcgggggagcgacagtggtgaccgcagcagtagtggaagtgcactcaagggccctcctggtaaaaacaactctcaatatttccttcaaaactgatgaccttaccatggtcctatactcccctggccccaaacaggcctcgttcacagatgttagagatcctagcctgaagctggctgagtttaagctggaaaacatcattagcacgctaaaaatgtacaccgacgggagcacgttctccagtttttccttgaaaaactgcatcctggatgataagaggccccacgtaaaaaaggcgacgcctcgcatgatcgggctgaccgtcggtttcgacaagaaagacatgatggacattaaatacaggaaggttcgagacgggtgcgtgacggacgccgttttccaggagatgtatatctgcgcaagtgtagaatttctgcaaacagttgccaatgtgtttcttgaggcttacacgacgggtacggccgtggagacctccgttcagacttggacagccaaagaggaggtcccaacacaagagtcagtcaagtgggaaataaatgtgatcattaaaaacccagaaatcgtgtttgtggctgacatgactaaaaatgatgcacccgctctggttattactacacagtgtgaaatctgctataaggggaacttagaaaattctaccatgaccgctgcaatcaaggatttgcaggtgcgcgcatgcccctttctccccgtgaagcgcaaaggtaaaattacaacggtcttacagccctgtgacttgttttaccagacaacacaaaaagggacggacccacaggtcatagatatgagcgtcaagtccctcaccttgaaggtttctcctgttatcattaacacaatgataacgattacatccgccctgtacactacaaaggagacaatccccgaggaaaccgcgtcttcaaccgcccacctgtgggaaaagaaagacactaagacattgaagatgtggttcttggaggaatcaaatgagacagagaaaattgctcccaccacagagctggttccaaagggagagatgataaagatgaatattgacagcatcttcatcgtgctggaagctggaattggccatagaacagtgccaatgctactggctaagagcagattcagcggcgagggcaaaaactggagttccttgatcaacctgcactgtcaactggagctggaagtacactattataacgaaatgtttggtgtatgggagccactgctggaaccactggagatcgaccagacagaggactttcgaccctggaacctggggataaagatgaagaagaaagccaaaatggccatcgtcgagtcagaccccgaggaggagaattataaagtgcccgagtataagacagttatctcatttcattcaaaagaccagcttaatatcactctttccaagtgcggtttggtgatgctgaacaacctcgtcaaggctttcacagaggctgcgacaggatcttcggcagactttgtgaaagacctagccccgtttatgatcctgaactctctggggctgacgatctctgtgagtccaagtgacagcttctccgtcctcaatatcccaatggcaaaatcctacgttcttaagaatggcgaaagcctgtctatggactacataaggacgaaggacaatgaccactttaacgcaatgacgtcactgagctcaaaacttttctttatcctcctgactccggtaaatcactccactgctgataagatcccactgactaaggttgggcggaggttgtataccgtgcgacatagagagtcaggagtcgagagatcaattgtgtgccagatcgatacggtggaaggctcaaaaaaggtgaccatccgctcacctgtgcaaatcaggaatcactttagcgtccctctcagtgtgtatgagggtgacactctcctcgggaccgcttcccctgaaaatgagttcaacatccccctgggaagttatagaagttttatttttctgaaacctgaggatgagaattaccagatgtgcgaaggcatcgactttgaagagataataaaaaacgatggcgcactgctcaaaaaaaagtgtaggagtaaaaatccctcaaaagaatcctttctgattaacatagtcccagaaaaagacaacttgacttcactctccgtttactcagaagatggttgggatcttccctacatcatgcacctctggccgcctatcttattgaggaacctgctaccttacaagattgcatactatattgaaggcatcgagaactccgtgttcactctgtctgaaggacactcagcccagatctgtactgcccagctcggaaaagcaagattacatcttaaactacttgattacttaaatcatgactggaagtctgagtaccacattaagcccaaccagcaagatatttcattcgtgtcattcacttgtgtgactgagatggaaaaaactgacttagacatagccgtgcacatgacatacaataccggacagacagtcgtggcattccattctccctattggatggtgaataaaaccgggcgcatgctgcagtataaggcagatgggattcaccggaagcatccccctaactataagaaacccgtgctcttttcattccagcctaatcactttttcaataataacaaggtgcagttgatggttacagattccgagttaagcaaccagtttagcatcgacaccgtcggaagccatggtgctgtgaaatgcaagggcctgaaaatggattatcaggtcggcgtgacaatcgatctcagttctttcaacattactcgtattgtgacattcactcctttctacatgatcaagaataagtcaaagtatcacatctcagtagcggaggagggaaatgacaaatggctgtccttggatctcgagcagtgcatacccttttggccagagtatgcatcttccaagctgctgatccaggtggagcgatccgaagatccccccaagcgcatatacttcaacaagcaggaaaattgtatcctgctgaggttggataacgaacttggcggtataattgctgaggtcaacctagccgaacattccaccgttatcacttttctggactaccacgacggagcggcgacgttcctgctgattaatcatacaaaaaacgagcttgtgcagtataaccagagctccctgtccgagatcgaagactcattgccaccaggtaaagctgtgttttatacttgggccgacccggtgggctcccgtcgactgaaatggcggtgtcgtaaatctcacggggaagtgacacagaaggacgacatgatgatgccaatcgacttgggagagaaaaccatctatctcgtttccttctttgagggactccagcgtatcatcttatttactgaagaccctcgggtgtttaaagttacgtatgagtctgagaaggccgagttagctgagcaggaaattgctgtggcgcttcaggacgtcggaatttccttagtcaataattacacgaaacaagaggtggcatacatagggatcacaagttccgacgtggtgtgggagactaaacccaaaaagaaggccaggtggaaacccatgagcgtgaagcataccgagaagttagagagggagtttaaagagtataccgagagctctcctagcgaagacaaagtcattcaattagatacaaatgtgccagtgagattgaccccaacgggccataatatgaaaattcttcagccgcacgtaatcgcgctcaggcgaaactatctccccgcgcttaaggtggaatataatacttccgcccaccaatcgagcttccggattcagatctatagaatacagatccagaatcaaatccacggcgccgtgttccctttcgttttctatcccgtcaagcctcccaaaagcgtgactatggattctgcgcccaaaccattcacagacgtgtctatcgtcatgcgcagcgcaggtcacagccagatcagtcgtataaaatactttaaggttcttattcaggagatggacctacgcttggatttgggcttcatttacgccctaacagacttgatgaccgaggccgaagttacagagaataccgaggtggagctctttcacaaggatatcgaggccttcaaggaagaatataaaactgcaagccttgtggaccaatcacaggtgagcctgtacgagtacttccacatttcacccattaaacttcatctcagcgtgtcgttgagttccgggagggaggaagcaaaggacagcaaacagaatgggggtcttatcccagttcatagcttgaacctgctgttgaagagcattggcgccacactgacagacgtgcaagatgtcgtttttaaactggccttttttgagctgaattaccagtttcacacaacgtcagacctgcagtctgaagtcataagacactactctaagcaggcgattaagcagatgtacgttctcatcttgggtcttgatgttctgggaaaccctttcggtctcatccgggaattttccgaaggcgtcgaagcctttttttatgagccctatcagggcgccatccagggccccgaggagtttgtcgagggaatggctttgggcctgaaagccctggtcgggggggcagtgggcggattggctggtgcggcgtctaaaataaccggtgctatggcgaaaggggttgccgccatgacaatggatgaggactatcagcagaagagacgggaagccatgaataagcagcctgccggatttagggaagggatcacacgcggaggaaaaggcctggtgtcaggcttcgtgtccggcatcactggcatcgttactaagccaataaagggtgcccagaaaggaggggccgccgggttctttaagggtgttggcaaaggattggtgggcgccgtagcccgccctacgggcggaatcatagacatggcttcgtctacttttcagggcatcaagagagcaacggaaacttccgaggtcgagagcctgaggcctccacgattttttaacgaggatggtgtaatccgcccataccgacttcgtgacgggacaggcaaccagatgctgcaagtaatggaaaacggaagatttgctaaatacaagtactttacacatgtgatgatcaataaaacagacatgcttatgatcactagaagaggagtgctgttcgtcacaaagggaaccttcggtcaactcacgtgtgaatggcagtattccttcgacgaattcactaaggagcctttcattgtgcatggccgaaggctgcggatcgaggctaaggagcgcgtaaaatcagtttttcacgcgcgcgaattcggtaagatcattaactttaaaactccagaagacgcccgctggatcctgactaagttgcaggaggcaagagagccatcccccagtttatag

SEQ ID NO: 17907 - DNA, 9210 bp, Artificial Sequence
  Description of Artificial Sequence: Synthetic coding sequence
atggtgttcgaatcagttgtggtagatgtgctaaacagattccttggggattacgtggtagatttggacacgtctcagctgtctcttggaatctggaaaggggccgtggctctgaaaaatctgcagataaaagagaacgccctgtctcagcttgacgttccctttaaggtgaaagttggacacataggcaatctcaagctcattattccatggaaaaacctgtatacacagccagtggaggcagtactggaagagatatacctactgatcgtcccgtctagccggatcaagtacgatcccctcaaagaggaaaagcagctgatggaagctaagcaacaggagttaaagcggatcgaagaggctaagcagaaggttgttgaccaggagcagcacttgccagagaagcaagacaccttcgcggagaaactcgtgactcaaataatcaaaaacctgcaggttaaaatttctagcatccacatccgctacgaggatgacataaccaatcgtgacaaacccctgagctttggaattagtctgcagaatctatccatgcaaacaaccgatcaatattgggttccgtgcctgcatgacgaaaccgagaaactcgtgaggaaactcattagattggataacctgttcgcctactggaacgtcaaatcccagatgttttacttatcagactatgataacagcttggacgacctaaagaacggaatagttaacgagaatatcgtgcccgagggctacgactttgtgtttcgccctattagcgccaacgcgaagctagtgatgaatcggcgatctgatttcgatttttccgcacccaagataaacttggaaatcgagcttcataatatcgccatcgaatttaacaagccacagtacttttctatcatggagctgttggagagtgtcgatatgatggctcagaatcttccgtataggaaatttaaacccgacgtgcctctgcatcaccacgccagggaatggtgggcatatgccatccacggagttctcgaagtgaatgtatgtccccgtctgtggatgtggtcctggaaacacatccgaaaacaccgccaaaaggtcaagcaatacaaagaactttataaaaagaagctaactagtaagaagccgcctggagagctgctggtcagcctcgaagaattggagaagacactggatgtttttaacatcaccatcgcccgccaaacagccgaagtcgaagtgaaaaaagcggggtacaaaatttacaaggaaggtgtgaaagatcctgaagataacaagggctggttctcatggctgtggtcctggtcagaacagaacacaaacgaacagcagcctgatgtgcagcccgaaactctggaagagatgctgaccccagaggagaaagcgcttctgtacgaggccattggctattcggaaactgcagtggatcctaccttgcttaagacttttgaggccctgaagttcttcgtgcacctcaaatcgatgagtatcgtgctgcgagaaaaccaccagaaacctgagctggtggacatagttattgaagagttttcaacactaattgtgcagcgccccggggctcaggctataaaatttgagacgaaaattgattcctttcacatcaccggccttcccgacaactccgagaaaccccggctgctatccagtctggacgatgccatgagtttatttcagattacctttgaaataaaccctctagatgaaaccgtctcacagcgatgtattattgaagcggaaccgttggaaatcatttatgatgcaagaaccgtgaactccatcgtagagttctttcgccccccaaaagaagtccatctggcacagctcaccgcagcaaccttgacaaagcttgaggagtttcggtcaaagactgctacgggtctgctgtacatcattgagacccagaaggtgttggacttgaaaatcaatctgaaggcctcctacataatcgtaccgcaggacggcatcttctcccccacaagcaatctactactgctcgaccttggccatctgaaggtaactagtaaatcgcggagcgagttgcctgatgtcaaacagggagaagccaatctgaaagaaataatggatcgcgcttatgactcattcgacattcaattgacaagcgtccagctgctgtattcccgggtgggcgataattggcgggaggctagaaagctgtcggtcagcacgcagcatattcttgtccctatgcacttcaaccttgaactgtcaaaagcgatggttttcatggatgtgcggatgcccaagtttaaaatttacggaaaactgcccctcatcagcttgcggatctccgacaaaaagctccaggggatcatggagctgatcgagagtattcccaagcccgaacccgtcacggaggtgagtgctcccgtgaagagtttccagattcagacatccacctctctgggaacaagccagatcagccaaaagattattccgctgctggagctgccctcagttagcgaagatgattcagaggaggaattcttcgatgcaccgtgctctcccttagaagagcccctgcagttcccaaccggtgtgaagtccatacggacgagaaaacttcagaagcaggattgtagcgtcaatatgaccactttcaaaattagattcgaggtgcccaaagtgttgattgagttctaccatctggtaggtgactgtgagcttagtgtcgtcgaaatattggtgctcggccttggagcagagatcgagatacgcacctacgaccttaaggccaatgcctttctcaaagagttttgccttaagtgccctgagtatctcgacgaaaacaagaagcctgtatatctcgtgacaaccttggataatacaatggaagacttactcacactggaatacgtgaaagcggagaaaaatgtgccagacctgaagtcaacctacaataatgttctgcaactgataaaagtgaatttctcttcccttgacatccatcttcacacggaggcactcctgaataccatcaactacctccataatatactgccccaatcagaggagaagagtgcccccgtatccacgaccgaaaccgaagacaaaggagatgtgattaaaaagttggcgttgaagctcagtactaatgaagatatcataaccctacaaattctggccgagctatcctgtctccagatcttcatccaggatcaaaagtgtaacatctctgagataaaaattgaaggtctcgattctgaaatgatcatgaggccaagcgaaacagagattaacgccaagttgagaaatatcattgtgctggatagcgacatcaccgccatatacaaaaaggccgtgtacatcacggggaaagaagtgttctccttcaagatggttagctatatggacgccaccgcaggcagcgcgtacacggatatgaatgtcgtcgatatccaagttaacttgatcgtaggctgtatcgaagtggtgttcgtcacaaagtttttgtatagcattcttgccttcatagataacttccaagcagccaaacaggctctcgctgaagcaaccgtccaagccgctgggatggcagcgactggggtgaaagaactcgcccagagatcaagtcgcatggctctcgatatcaacataaaagctccggtggtggtgatcccccagagccctgtctctgagaatgtctttgtggctgattttggccttatcacaatgaccaacacattccacatgatcacagagtcccagtcttccccgccacccgtgatcgacctcatcacaatcaagctctctgagatgcgcttataccggtctcgtttcatcaatgacgcttatcaagaagttctcgacctacttttgccacttaacctggaagtggttgtggagcgaaatctgtgttgggaatggtaccaagaggttccatgtttcaatgtcaatgctcaactaaagcccatggaatttattctgtctcaggaagacataacaaccatcttcaaaaccctgcatggaaacatctggtacgagaaggatggaagcgccagccctgccgtaaccaaggaccagtacagtgccaccagtggcgtgacaaccaacgcctcacatcattcgggaggcgccactgtggtgacggccgctgttgttgaggtgcacagccgcgccttacttgtcaagaccaccttgaatatctcctttaaaactgacgacctgacaatggtgctctacagcccaggccccaaacaggcctcttttactgatgtgcgcgacccatctctgaagcttgctgaattcaagttggaaaatatcatttctacattaaagatgtatacggatgggtctaccttcagtagcttctccctaaaaaattgcatactggatgacaagaggccacatgtgaagaaggctaccccccgcatgattggcctgacagtagggtttgataagaaggatatgatggatatcaagtaccggaaagtgcgtgatggctgcgtgacagatgccgtgtttcaagaaatgtacatttgcgcttctgtggagtttttgcagaccgtggctaatgtgttcttagaggcgtatacgaccggaaccgcagtggaaacaagcgtccagacttggacagcaaaagaggaggtgcctactcaggaatcagtgaaatgggagatcaacgtgatcattaaaaaccctgaaatcgtattcgttgctgacatgacaaaaaatgacgcaccagctctggtgatcaccacccagtgtgagatctgttataagggtaacctggagaatagtaccatgacagcagccatcaaagacctccaggttcgggcctgtccttttctgcctgtaaaaagaaaaggcaagatcaccacagtcctgcaaccgtgcgacctgttttaccaaaccacacagaaggggaccgatccccaggtcatcgatatgtctgtaaagtctctcactctcaaggtgagtccagtcattatcaacacaatgattaccataacatcagctctctatacaaccaaggagacaatccctgaggagactgcctctagcacggcgcacctttgggagaaaaaggacaccaagaccctcaagatgtggttcctcgaggagtccaatgaaactgagaagatcgcgccaaccaccgaactcgtgcccaagggcgagatgattaaaatgaatatcgactcaatattcatcgtgttagaagccggaatcggacaccggactgttcccatgctcctcgcgaagtctcggttcagtggtgaagggaagaattggtccagcctgatcaacctgcattgtcagcttgagttggaggttcattactacaacgaaatgtttggcgtttgggagccattgctggaacctctggagatagaccagacagaagatttcagaccatggaacctgggcatcaagatgaaaaagaaagccaagatggccatagttgaaagcgacccagaggaagagaactataaagtccctgaatataagacagtgatcagtttccactcgaaagatcaactgaacattaccctttcaaaatgcggtttagttatgcttaacaacctcgtgaaagcgtttacagaggccgctacaggatcatccgccgatttcgtcaaggatttggcgccctttatgattctgaattcacttggccttactatttccgtgtcacctagcgacagtttcagtgtactcaatattcccatggcgaagagttatgtgcttaagaatggcgaatctctgagtatggactacatccggactaaggataacgatcactttaacgcaatgacttctttgagcagcaagctgttcttcattctgttaactccagtgaaccacagtaccgcagataaaatcccactcactaaagttgggagacgtctgtacaccgtgcggcacagagaaagcggcgtcgagagatccatagtatgtcagattgacactgtggaagggtctaaaaaggtcaccatccggtctccagtccagatccgaaaccacttcagcgtacctctgagtgtctacgagggtgacacacttttaggtacggcaagcccagaaaatgagtttaacataccactcggctcatataggtcttttatattccttaaacccgaagacgaaaattatcaaatgtgtgaaggcatcgacttcgaggagatcatcaagaatgatggtgccttgctgaagaagaagtgtagatctaaaaacccaagcaaggagtcctttctcattaacatcgttcctgagaaagataacttaacctcccttagtgtgtacagcgaggacggctgggaccttccatacatcatgcacctttggcccccaatcctgctccgcaatctcctcccctacaaaatcgcatactatattgaagggattgagaattccgtgttcacactttccgaaggccacagcgcccaaatatgtacagcacagctcggcaaggcgcggctacacttaaagttgcttgattatctgaaccacgactggaagtcagaatatcatataaagccgaaccagcaagatatcagcttcgtaagttttacatgcgttactgaaatggagaagaccgacttggatatcgccgtgcatatgacctataatacggggcagaccgtggtggcctttcactctccctattggatggtgaacaagaccggaagaatgctccagtataaggccgacggaatccaccggaaacatccacctaattataaaaagcctgtattattttcatttcaaccaaaccacttttttaataataacaaagtacagctgatggtgacagattcggaactgagcaaccagttctctatcgatactgtgggctcccatggcgcagttaagtgcaaaggcctcaagatggattatcaagttggtgtcactatcgacctttcttcctttaacattacgcgcatcgtgacgttcaccccattctatatgattaagaacaagagcaagtaccacatcagtgtggccgaagagggaaacgataaatggttatctctggatctcgaacagtgcattccattctggcccgagtacgccagcagcaaactgctgatccaggtcgaaagaagtgaagacccgccaaaacgcatatacttcaacaaacaggaaaactgcatccttctcaggctggacaatgagttggggggaataatcgctgaggtaaacctcgcagagcatagtacagtgatcacctttctggattaccatgatggtgcagctacattcctcctcatcaatcacaccaagaacgagctcgtgcaatacaatcagagcagtcttagtgagatcgaggactcactgcccccgggaaaggccgtgttttatacatgggccgatcccgttggtagtagacgtctgaagtggcgatgccgtaagtcccatggggaagttacacagaaagacgacatgatgatgcccatcgacctgggcgaaaagactatctatttggtgtctttctttgaggggctccaaaggattattctttttacagaagatcctcgagtgtttaaggtgacctatgagtctgaaaaagctgaactcgccgaacaggagatcgccgtagcccttcaggacgtgggcattagtctggtcaacaactatacaaagcaggaggtggcctacatcgggatcacctctagcgacgtagtgtgggagacaaaacccaagaaaaaagcacggtggaaacctatgagcgtaaagcataccgagaagttggagagagaatttaaggagtatactgaatccagcccctctgaagacaaggttattcagctggacactaatgtccctgtgcgtcttacccccactggtcacaatatgaagatcttacagccacacgtgatagccttgaggcggaactacctgccggctctgaaggtcgaatacaacacaagcgcacaccagtcctccttcagaatccagatctaccgtatccagatccagaatcagatccatggcgctgttttcccctttgtgttctaccccgtcaaacctcctaagtccgttaccatggatagtgcgcccaagccctttacagacgttagcatcgtcatgaggagtgctgggcattcccaaatcagcaggataaagtattttaaagtgcttattcaggagatggaccttagactggatcttggcttcatctatgccttgaccgacctaatgacagaggccgaagttacggagaatacagaagtggagctttttcataaggatattgaagcttttaaagaggagtacaagaccgcctctctggttgaccagtctcaggtgtctctgtacgagtatttccatatctcacccatcaaactgcacctttcggtctcgctttcttctggaagagaggaggcaaaggactctaagcagaacggcggcctgattcctgtgcattcattaaatcttttactgaaaagcatcggggccacgctcacagatgtccaggacgtggttttcaaattggcttttttcgagctcaattaccagttccacacgacttcagaccttcagagcgaagttattcggcattacagcaagcaggctattaagcagatgtacgttctcatcctcgggctggacgttttgggcaatccatttggacttatccgcgagttttccgagggggtggaggcatttttttacgagccttatcagggtgcaatccagggccctgaggagtttgtggagggtatggctctgggtctgaaggctctggtgggaggggcagtggggggtcttgctggcgctgcatcaaagattaccggcgccatggcaaagggagttgcggcgatgacaatggacgaggattaccagcagaaaaggcgcgaagcaatgaacaagcagccagccggttttagggagggcattactcggggcggcaagggcctcgtaagtggcttcgtctcaggtatcaccggtatcgtgacaaaaccaattaaaggagcccagaaagggggcgcagcaggttttttcaaaggggtaggaaagggtctggtgggagctgttgcaaggcccacggggggaataatcgatatggcctccagtacatttcagggcatcaaacgggccacagagaccagcgaggtggagtcattgaggccaccgcggttcttcaacgaggacggagtgattcgaccttacagactgcgagatgggaccggcaaccagatgctccaggcctctaagtccctcatttag

SEQ ID NO: 17908 - DNA, 9408 bp, Artificial Sequence
  Description of Artificial Sequence: Synthetic coding sequence
atggtgttcgagagtgtggttgttgacgttctaaacaggtttctgggagactacgtagttgatttggatacttcccagctgtcactgggaatttggaaaggtgccgtggctctgaagaatctgcagatcaaggaaaatgccctcagccagctggacgtgccctttaaagtcaaagtggggcacatcggcaatttgaaactcatcataccctggaaaaacctgtacacccaaccagtcgaggcagtcctggaagagatctatctcttgatcgtgccgtcaagtcgtattaagtacgatcctctgaaggaagaaaaacagctgatggaggctaagcagcaggagctaaagcgaattgaagaagcgaaacagaaggtcgtcgatcaggagcagcacctccccgagaaacaggacacctttgctgagaagcttgttacccagatcatcaagaacctgcaggtaaaaatttcctccatacatatccgctacgaggatgatattaccaatcgtgataaacctctcagcttcggtatcagcttacaaaacctgagtatgcagacgaccgatcaatactgggtgccatgtctacatgacgaaaccgagaagctggtgaggaaactaatccgcttagacaacctgttcgcctattggaacgtcaaatcccagatgttttacctctctgattatgataacagtctggacgatttgaagaacggaatagtgaacgagaatatcgtccccgaagggtacgactttgtgtttaggccgatttctgctaatgcgaagctggttatgaacagaaggtctgattttgacttctcagccccaaagatcaacctggaaatcgaattacataatattgccattgagtttaacaagccccagtacttttcaatcatggagctgttggaaagcgttgatatgatggctcaaaatctgccctatcggaaattcaagccagatgtccccctgcatcaccatgcccgtgagtggtgggcctatgcaatacacggtgtcctggaggtcaatgtatgtcctcgtctgtggatgtggagctggaagcacatccggaagcatcgccagaaggtaaagcagtacaaggagctatataagaaaaagctaacatcgaagaagcctcccggagaactgctcgtctctttagaggagctggagaagactctggacgtgttcaatattacgatcgctcgacagacagccgaggtggaagtgaaaaaagcagggtataaaatttacaaggaaggcgtcaaagacccggaagataacaaagggtggttctcttggttgtggtcatggagtgagcagaacacaaatgagcagcaacccgacgttcagcctgagaccttggaagaaatgctgacacccgaggaaaaggcgctgctgtacgaggctattgggtattctgagactgctgtcgaccctaccctgctgaaaacttttgaagcattgaaattttttgtccacctcaaatctatgagcattgtgctgagagaaaaccaccaaaagcccgagctggtagacatagttattgaggaattttcgaccttaatcgttcagaggcctggcgcccaagccataaaattcgagacaaaaatcgactcatttcatatcacaggtctgccagataattccgaaaagccgcgtttgctgagttctctggacgacgcaatgtcactgttccagataacctttgaaatcaacccccttgatgagaccgtgtctcagcgatgtatcatagaggccgaacccctcgaaatcatctatgatgctagaaccgttaatagcatcgtggagttcttcagacctccaaaagaggtccatcttgcgcagttgaccgctgcaactttaacaaagctcgaagaatttcgatccaagaccgctacaggcctgctttatatcatagaaacccagaaagtccttgacttgaaaattaacctgaaggcttcttacatcatagtgcctcaagatgggattttcagtcctactagcaacctcctgctgttagacctgggccatttgaaggtcacgtctaagagccggtcagagttacctgatgtgaaacagggagaggcgaaccttaaagaaattatggacagggcatatgatagtttcgatattcagctgacctccgtacagttgctctactccagagtgggtgataattggcgagaagcccgaaagctctcggtttccacgcagcacatcctcgtcccaatgcacttcaacctcgagcttagcaaggccatggtcttcatggacgttaggatgccgaaatttaaaatttacggaaagctgccactgattagcttacggatttctgacaagaagctgcagggcattatggagctgatcgaatccatcccgaaaccagagccagttacagaagtgagcgcccctgtaaaatcctttcagatacagacttccacatcattaggtactagccagatatcccagaagataattcccttgctggagctgccttctgtttcagaagatgactctgaagaagaatttttcgatgccccatgttctcccttggaggagcccctgcagttcccaacaggtgttaagtctattcgcacacggaagctgcaaaagcaggattgctcggtcaacatgacaacattcaagatccggtttgaggttccaaaagtgctcatcgaattttatcaccttgtcggcgactgcgagctcagtgtggttgagattctggtgcttggacttggtgctgagatcgaaatcagaacatacgacctgaaagctaacgcttttctgaaagagttctgccttaaatgtcctgagtacctggacgaaaataagaaacctgtttatctggtgaccacattagataataccatggaagatctgctgacactcgagtatgttaaagccgaaaaaaacgtgccggatttgaagtctacatacaataatgtgttacagttaatcaaggtgaatttttcttctctcgacattcacctgcatactgaagccttactgaataccatcaattacctccataacattttaccacagagtgaggaaaagtccgcacccgtatccaccactgagaccgaggataaaggtgacgtgattaaaaagcttggcctggacagcgaaatgattatgcggccatccgagactgaaataaacgccaaactacgaaatattatagtccttgacagcgacattacagccatttataaaaaggccgtctatatcacgggcaaggaagtcttctccttcaagatggtgagttatatggacgctacggccggctcagcatacacggacatgaatgtggtggatatccaggttaatctaattgttggatgtattgaggttgtattcgtgactaagttcttatactctatactggcattcattgataacttccaggccgccaagcaggccctggcagaagccacagtccaggcagcaggaatggctgccaccggcgtcaaggagctggcccagaggtcctcaagaatggctcttgatatcaacatcaaggctccggtagtagtgatacctcagtctccagttagcgagaatgtgtttgtggccgactttggcctgatcacgatgacgaatacttttcacatgattactgagagccagtccagtcctccaccggtgatcgaccttattacaataaaattaagcgaaatgcgactttaccggagtcgatttattaatgatgcctaccaagaagtcttggatttactccttcctttgaatcttgaagtcgtggtggagagaaatctgtgctgggaatggtaccaagaggttccgtgtttcaatgtgaatgcacagttaaaaccgatggagtttatactatctcaggaggacatcactacaattttcaagacattacacggaaacatttggtacgagaaggatggctccgcctctcctgcagtgacaaaagaccagtatagcgccacttcaggggtgacaaccaatgcctctcatcactctggcggagccactgtcgtcaccgcagctgtcgtcgaagtgcattcccgagcactcctggttaagactaccctaaatatctctttcaagactgacgatctgactatggttttgtattcgcctggccccaagcaggctagcttcacagatgtacgggatccttccttaaaattagccgagtttaaactggaaaacatcataagcaccctgaaaatgtacactgacggaagtacattcagttctttttcccttaagaactgtatcctcgacgacaagcgcccccacgttaagaaggctacgcctaggatgattggactgaccgtcggctttgacaagaaggacatgatggatataaagtataggaaagtccgcgatgggtgtgtgacagacgcagtatttcaagaaatgtacatttgcgctagtgtcgaattcctgcagactgtggctaatgtttttctggaagcctacacaaccggtacggccgtggaaacgagcgtacagacttggactgctaaagaggaggtaccaacccaagaatcagtgaaatgggagataaatgttattattaagaacccagagatagtctttgtagctgacatgaccaagaacgacgcgcctgctttagtcatcactactcaatgtgagatttgttataaggggaatcttgagaatagcaccatgacagctgctataaaagacttacaggtcagagcctgtccctttctgcctgttaagcgtaaagggaagatcaccactgtcttgcagccatgtgatcttttttatcaaactacccagaaggggacggatcctcaggttattgatatgagtgttaagtcgctgacattaaaagtttcccctgtgattatcaataccatgataaccataacctcagcattgtataccaccaaagagacaattccagaagaaaccgccagcagtacagctcatctgtgggagaagaaagatactaaaactctgaaaatgtggttcttggaggaaagcaatgaaacggagaagattgccccgaccacggaactagtgcctaagggagaaatgataaagatgaacatagacagtatctttattgtgctcgaggccggaattggtcacaggacagtccctatgcttttggcaaagtccaggttcagtggcgagggaaagaattggagcagcttgattaacctccattgtcagctggagctggaggtgcattattacaatgaaatgtttggcgtgtgggagccccttctggaaccactcgagattgatcagaccgaggactttcgcccatggaacttaggtatcaagatgaaaaagaaggcaaagatggccattgtcgaatccgatcctgaagaagagaactacaaggttcctgagtataagaccgtcatatcattccattcaaaggatcaactgaacattactctgtctaaatgtggcttggttatgctaaataatctggttaaagcttttactgaggcagccacagggagcagcgcagacttcgtgaaggacctcgctccttttatgatcctcaattccttgggccttaccattagcgtctcaccttctgacagcttctccgtgctgaacatcccgatggccaaatcttatgtgctgaaaaacggggagtctttgtccatggattacattaggactaaagacaacgatcacttcaacgcaatgaccagtttaagctcaaaactgttcttcattctattgactccagtgaaccactccacagccgataagattcccctgaccaaagtaggcagacgcctatacaccgtgcggcatcgcgagtccggtgtggagcggtctattgtttgtcaaattgataccgtggaaggatcaaagaaggtgacaatccggagccctgtgcaaataagaaatcacttttcagtgccactctctgtgtatgaaggggacacgcttttggggaccgccagtcccgaaaatgagttcaatataccactgggatcttatcggagctttatctttcttaagccagaagacgaaaactatcagatgtgtgaagggatagactttgaggagattatcaagaacgatggggctctcctcaaaaagaaatgccggtcaaaaaacccatctaaggagtctttcttgataaacattgttccggagaaggacaacctgacctccctttcagtatacagtgaggatgggtgggacctcccctacatcatgcatctttggccgccaatccttctgagaaaccttctgccttacaagattgcctactacatcgaagggatcgagaatagcgtgttcactttgtcagagggtcattccgcccagatctgcaccgctcaactgggtaaagcccgcctccacttgaagctgctagattatctcaatcatgattggaagtccgaataccacatcaaaccaaaccagcaggacatctcatttgtgtcttttacttgtgtgactgagatggaaaagacggacctggatatcgctgtccacatgacctacaacacaggccagaccgtagtcgccttccatagcccttactggatggtaaacaagactggacggatgcttcagtacaaagcggacggaatccaccggaagcatccccctaactataagaaacctgtgctgttctctttccagcctaatcactttttcaacaataataaagtgcaactgatggttacggacagcgaacttagtaatcaattttcgattgacactgtggggtcacatggcgctgtaaaatgtaagggtctgaagatggactaccaggtgggtgtgacgattgatcttagttccttcaacattacgcggatcgtcactttcacacccttctatatgataaagaataagagcaaataccatatttcagtggccgaagaggggaacgacaaatggttgagcctggacctcgaacaatgcattcctttctggcccgaatacgcatcctctaagctgctgatccaagtggagagaagtgaagacccacctaagagaatttacttcaataaacaggaaaactgcatcctcctgcgactggataatgaactggggggcatcatagcagaggttaacctggcagaacattctactgtcattaccttcctggactaccacgatggggccgcgacttttctgctgattaaccatactaagaatgaactcgtccagtacaaccagtcatctttgagcgagatcgaagactcattacctccgggcaaggcagttttttatacttgggccgatccagttgggtctcgcaggctgaagtggcgatgtcgcaagtcccacggcgaggtgactcagaaagacgatatgatgatgcccatcgacctgggcgaaaagaccatttatttagtgagcttctttgaaggcctgcagagaatcatcctgtttactgaggacccacgcgtctttaaggtaacctacgagagcgagaaagccgagttggctgagcaggaaatcgccgtagccttacaggacgttggaatcagccttgtcaacaactataccaaacaagaagtggcttatatcggcattaccagctcggatgttgtatgggagacgaagcctaagaagaaagcgaggtggaagccaatgtcagtcaagcacaccgagaaactggagcgtgagtttaaggagtacactgagtctagcccgtccgaagacaaagttatacagctggatactaatgtacccgtccggcttacccccacaggccacaacatgaaaatcctgcagccacacgtgattgcgttgcggcgcaactatctgcctgccctcaaggtcgaatacaatacaagcgcgcatcagagctcattccgaatccagatttatcggattcagattcagaatcagattcatggggctgtgttcccctttgtgttttacccggtaaaacctccaaaatcagtgacgatggactccgcccccaagccgttcactgatgtttccattgtaatgaggagtgccggacactcacagattagtagaattaagtattttaaagtgttgattcaggagatggatttgagactcgatctcggctttatttacgccctgacagacctcatgacagaggcggaagtgacagaaaacacagaggtagagctctttcacaaggatatcgaggcattcaaagaggagtataagactgcctccttggtggatcaatcccaggtgagtctttacgaatatttccacattagcccaatcaagttgcacctaagcgtgagtttgtcaagtggccgcgaggaagccaaagatagcaagcagaacggcggcttgatccccgtgcatagccttaacctgcttctgaagtccatcggcgcaaccctgaccgacgttcaggatgtggtctttaagttagctttcttcgaacttaactatcaatttcacactacctctgatctccagtctgaagttattcggcactactctaaacaggccatcaagcagatgtacgtgctaatcctggggctggacgtcctggggaaccccttcggattaattcgcgagttcagcgaaggggtggaagcgtttttttacgaaccatatcaaggtgcaatacagggcccagaagaatttgtcgagggcatggcattggggctaaaggcactagtgggcggcgccgtgggcggccttgcaggtgcagcctccaaaatcaccggggccatggctaagggggtcgcggccatgactatggacgaggattaccaacaaaaacgacgggaggcgatgaacaagcagcctgccgggttccgagagggaattacccgggggggcaaagggctggtgagcggcttcgtctcaggaattaccggcatcgtgaccaagccgatcaaaggcgctcaaaaagggggagctgctggattctttaaaggcgtgggtaagggcctcgtgggggctgtcgcacgcccaaccggcggcatcatagacatggctagttccacattccaggggatcaaacgggcaaccgagacaagcgaggtggagtcacttagacccccgcgcttctttaacgaagatggggtcatcagaccttatcgtctgcgagatggtactggcaatcagatgctgcaggtgatggagaacggcagatttgctaaatacaagtacttcactcacgtaatgataaacaagaccgacatgttgatgattaccagacggggtgtgctgttcgttactaaaggcacatttggccagctgacatgtgagtggcagtattccttcgacgaattcacaaaagagccctttatcgttcatggtcgacggctgcggatcgaggcaaaggagcgcgtgaaatctgttttccacgctcgagagttcggaaagattatcaactttaagacaccagaagatgctcgatggattctgaccaagctgcaagaagcccgcgagcccagcccctccctctag

SEQ ID NO: 17909 - DNA, 1317 bp, Artificial Sequence
  Description of Artificial Sequence: Synthetic coding sequence
atgaacgaagtgtccgtgatcaaagagggctggctgcataaacgcggcgagtatatcaagacatggcgccccaggtacttcttgcttaagtcggatgggtcttttattggatacaaggaacgtcctgaagcccctgaccagactctgccccctctgaataatttttccgtcgctgaatgtcaactgatgaaaaccgaacgcccccgaccgaatacttttgtgatacggtgtctgcaatggacaacagttatagagcggacatttcacgtggactcacccgatgaaagggaggagtggatgcgagccatccaaatggtggccaacagcttgaagcagagagctcctggtgaggacccgatggattataaatgtggttcccccagtgattcatctacaaccgaagagatggaggtcgccgtgtctaaagcccgggcaaaggtaaccatgaatgattttgattatcttaaacttctgggtaaaggcactttcgggaaggtaatcctggtccgggagaaggctaccggtaggtattacgcaatgaagattcttcgcaaggaagtgatcatcgccaaagacgaggtagcgcacacagtgaccgaatccagggttctccagaatacacgccatccctttctgactgccctgaagtatgcctttcagacacatgatagattgtgctttgtcatggagtacgccaatggaggcgagctcttcttccatctgagtagggaacgggttttcaccgaggaacgagctcgcttttacggcgcggaaatcgtgagcgcactggagtacttgcattctagggatgtggtttatagagacataaaggtgctagaggataacgattatggaagagcggttgactggtggggtctcggtgtagtgatgtatgagatgatgtgcggccgcctgcctttctacaaccaggaccacgagcgcctgttcgaactgatccttatggaggaaattagatttccaaggaccctctcccccgaggctaagagcttactggctgggcttttgaaaaaggaccctaagcaacgtctggggggtgggccgagcgacgccaaagaagtcatggaacatagattcttccttagcatcaactggcaggacgtggtgcaaaagaagttgctacccccttttaagccccaggtcacctccgaggttgacacccgctactttgacgatgagttcactgcacagagtattacgatcacacccccagaccgctacgactccctcggccttctggaattggaccaacgtacccattttccccaattttcctatagcgccagtatcagagaatag

SEQ ID NO: 17910 - DNA, 444 bp, Artificial Sequence
  Description of Artificial Sequence: Synthetic coding sequence
atgcgctgtctgtcatccaagaaagctggttcaaccagcgtggtgaaatatatcaaaacctggagaccacggtacttccttcttaaaagtgatgggtccttcattggttacaaagagcgacccgaagcacctgaccagacacttcccccactaaacaactttagtgtggcagagtgccagctgatgaagacggaacgaccacgaccaaacactttcgttataaggtgcctgcaatggacgactgtgatcgaacgcacctttcatgtggattccccagatgaaagggaagagtggatgcgcgctattcagatggttgcaaactcactccagccacatctgtgcgctcaaacacggatctggaaaaccccccctccagcccaggcctgggcagtaggcaggctggagatccaagtcctaatccacacatctccttctgagggatag

SEQ ID NO: 17911 - DNA, 1149 bp, Artificial Sequence
  Description of Artificial Sequence: Synthetic coding sequence
atgagagccatccagatggtcgctaattcattaaaacagcgcgctcctggggaggaccctatggattataaatgcggatcacccagcgactcttcgaccaccgaggagatggaggtcgccgtctctaaggctcgggccaaagtcaccatgaacgattttgactacctcaagctgctggggaagggtactttcggaaaagtgattcttgtgagagagaaagccaccgggcgctactacgccatgaagattttacgaaaggaagtgattatcgcaaaagacgaggtggcccacaccgtgaccgaaagccgcgttcttcaaaacacacgtcatccatttcttacagcccttaagtacgctttccagacacatgatagactctgttttgtgatggaatacgccaatgggggtgaactgttctttcatctgtcacgggaaagagtctttactgaagaacgcgctagattttacggcgctgaaatcgttagcgccttggagtacctccactccagagacgttgtctaccgcgacattaagcttgagaaccttatgttggacaaggatgggcacatcaaaattacagatttcggtctgtgtaaggagggcatttccgatggcgctactatgaagaccttctgcggtacaccagaatatctagcgcctgaggtgctggaggacaatgattatgggcgggcagtggactggtggggcctgggagtggtaatgtatgagatgatgtgcggccgacttcccttttacaatcaggaccacgaaaggttgtttgaactcatcctaatggaggaaattcgatttcctcgtaccctctcaccagaagcgaagtcattgttggcgggcttgctcaaaaaagaccccaagcagcgattaggcggcggaccctctgatgccaaggaggtgatggagcaccggttctttctgtctattaactggcaggacgtcgtccagaaaaaactactgccgcctttcaaaccacaggtaaccagtgaggtggacactaggtactttgacgatgaattcactgcccaaagcatcactatcacgccccccgaccgctatgactcacttggcttattagagttagaccagcgaacccactttccccaattctcatattccgcgtcgataagagaatag

SEQ ID NO: 17912 - DNA, 402 bp, Artificial Sequence
  Description of Artificial Sequence: Synthetic coding sequence
atgaatgaggtttctgtgatcaaagaggggtggctccacaaacgcggggaatatattaagacctggcgaccgcgttactttttgttaaaaagtgacgggtcttttatcggctataaggagagacccgaggcacctgatcagacccttccgccgctgaataacttttctgttgcagaatgccagttaatgaagactgagcggccccgaccgaatactttcgtaatccgatgcctgcagtggactacagtcatcgagcgaacctttcatgtggatagcccagacgagcgcgaggagtggatgcgcgctatccaaatggtggctaactcactgaagcagagggctcctggggaggatcctatggactataaatgcggaagtccgtcagacagcagcacgacctag

SEQ ID NO: 17913 - DNA, 1446 bp, Artificial Sequence
  Description of Artificial Sequence: Synthetic coding sequence
atgaacgaggttagcgtaatcaaagaaggatggctgcacaaacgcggcgaatacataaaaacctggcgaccacggtacttcttgctgaaatcggatgggtcattcatcggatataaggaacgacctgaggccccggatcagactctgcccccattgaataatttctcggtcgccgagtgtcagctgatgaaaaccgagcgcccccgacccaacacttttgttattcggtgcctgcagtggactactgtcatcgagcgaaccttccacgttgattcgcccgacgagagagaggaatggatgcgcgcaatacagatggtcgccaactctctgaaacagagagctccaggggaggaccccatggactacaagtgcgggagtccttcggactcgagcacgacagaagagatggaggtggcagtcagtaaagcgagggcaaaagtgaccatgaatgattttgattacctgaagctactgggaaaaggaacttttgggaaggtgatactagtccgcgaaaaagctaccggacgctattacgcaatgaaaattcttagaaaagaggtgattattgctaaggacgaagtggcccacacagtgacagaatccagggttctgcagaatacccggcacccattcctcacggccttaaagtacgctttccaaactcacgacagactgtgttttgtgatggaatatgccaacggcggagaattgttttttcatctgagtagggagcgggtgtttactgaggaacgggcgagattttatggcgcggaaattgtgtccgcactggagtatctgcattccagggacgtagtgtacagggatatcaagttggagaatttaatgctggataaagatggccatattaaaattacggactttggactctgcaaggagggaatatctgacggtgcaaccatgaaaaccttttgtggcactcccgagtacctggctccagaggttctggaggataatgactatggacgagctgttgattggtgggggctcggagtggtaatgtacgaaatgatgtgtggtcggttgcctttttacaatcaggaccacgagcgcctcttcgaactcatactcatggaggaaattcgattcccccggaccctgagcccagaggcgaaaagcctgctggccggacttcttaagaaggaccctaagcagcgactcggcggcggcccgtctgatgccaaggaagtgatggaacatcgcttcttcctgagcataaattggcaagatgttgttcagaaaaagctgctgccaccttttaagccccaagtaacttccgaggtcgacaccaggtactttgatgacgagttcaccgcccagtcgatcacgattacgcctcccgaccgttacgatagtctcggcctgctggaacttgaccagcggactcactttcctcaattctcctattcagcctctatcagagagtag

SEQ ID NO: 17914 - DNA, 402 bp, Artificial Sequence
  Description of Artificial Sequence: Synthetic coding sequence
atgaatgaggtctccgtcataaaggagggctggctgcacaaacggggggaatacataaagacctggagaccccgctattttttgctgaaaagtgacggctcatttatcggctataaggaacgcccagaggctccggaccagacattgccccccctgaacaacttcagcgttgcagaatgccagctcatgaaaacagaaaggcccaggcccaacacttttgtgattcggtgtcttcagtggacgactgtgatcgagcgcacattccacgtcgatagtccagatgagagggaggagtggatgagagcaatccagatggttgcgaatagcctaaagcaaagagctcctggtgaggatccgatggattacaaatgtggctcccccagcgattcttctaccacctag

SEQ ID NO: 17915 - DNA, 291 bp, Artificial Sequence
  Description of Artificial Sequence: Synthetic coding sequence
atgaatgaggtgtcagtgattaaggaagggtggctgcacaaaaggggggaatatatcaagacctggagaccaagatattttctcctgaagtcggatggctcgttcataggctacaaagaacgtccagaagccccggaccagaccctcccacccctcaacaattttagcgtggccgagtgtcagcttatgaagacagagaggcccaggcccaacacattcgtgattagatgcctgcaatggacaacagtgattgaaaggaccttccatgtagacagccccgacgaaagatag

SEQ ID NO: 17916 - DNA, 360 bp, Artificial Sequence
  Description of Artificial Sequence: Synthetic coding sequence
atgaatgaggtgagcgtgatcaaagagggctggctgcacaaacggggtgaatacataaagacttggagaccgcggtatttcctgttaaagtccgacggcagctttataggttacaaggaaaggcccgaggcaccagatcagacactgcctccacttaacaacttttcagtggcagagtgtcaactgatgaaaacagagcggccccgacctaataccttcgtcatcaggtgcctccagtggactaccgtgatagagcgcacgttccacgttgatagtccagacgagcgggaggagtggatgcgcgccatccagatggtggcaaactcattgaagcagagggcccctggcgaagacccgtag

SEQ ID NO: 17917 - DNA, 1446 bp, Artificial Sequence
  Description of Artificial Sequence: Synthetic coding sequence
atgaatgaggtgtccgtgatcaaagaaggttggctacacaagcgcggggagtatatcaaaacttggcggccaaggtacttccttctgaaatctgatggtagtttcattgggtacaaggagaggcccgaggcccccgatcagactctgcctccgctcaataacttctctgtcgccgaatgtcagctcatgaagaccgaacggcctcgcccgaatactttcgttatccgttgtctacaatggaccactgtgattgagcggacgttccatgtagactcacccgatgagcgcgaagagtggatgagagccatccaaatggtcgccaatagtctgaaacagcgagcacctggcgaagatcctatggactataagtgcggatccccctccgatagcagcaccactgaggaaatggaggttgccgtcagcaaagctagggcaaaggtcaccatgaatgatttcgattatctaaagctgcttggaaagggaacattcggtaaagtgatcttagtccgggagaaggcaacaggcagatattatgctatgaagatccttaggaaagaggtgattatcgccaaggatgaagttgcccacacagtgacagaaagtagggtactgcagaacactcgacatccgttcctcaccgccttgaagtacgctttccagactcatgaccggctttgctttgtgatggagtacgcgaacggaggcgaacttttcttccacctgtctcgcgagcgggtgttcactgaggagagagccaggttctacggagcggaaatcgttagcgcactggagtatttacacagcagggatgtggtttacagagatatcaaactggagaatcttatgttagataaagatggccatatcaagatcacggactttgggctctgcaaagaaggcatatctgatggcgccacaatgaaaactttctgtggtacgcctgaatatttagcgcccgaagtgctcgaggacaacgattacgggagagccgtggactggtggggcctcggcgtggtcatgtacgaaatgatgtgcggacgtctccccttctataaccaggatcacgagagactgtttgaacttatactaatggaagagattcgctttccgaggacactctccccagaggccaaatccctccttgctggactgctgaaaaaggaccccaaacaaaggttaggtggaggcccctcagacgcaaaagaggttatggagcacaggttcttcctgtcaattaattggcaggacgtggtccagaagaaactcttgccaccctttaaaccccaggtgaccagcgaggtggatacacgatacttcgacgacgagtttacggctcagagcatcacgattactcccccagacagatacgacagccttgggcttttagagctcgaccagaggacacacttccctcagttcagctacagtgcttctataagggagtag

SEQ ID NO: 17918 - DNA, 204 bp, Artificial Sequence
  Description of Artificial Sequence: Synthetic coding sequence
atgaacgaggtatctgtcatcaaggaaggctggctgcataaacgaggggagtatatcaagacgtggcgcccaaggtatttcctgctgaagagtgatgggagtttcatcggatacaaggaaagacctgaagctcccgatcagacgctcccaccattgaacaactttagtgtagccgaatgccagttaatgaagaccgagcgctag

SEQ ID NO: 17919 - DNA, 144 bp, Artificial Sequence
  Description of Artificial Sequence: Synthetic coding sequence
atgaatgaggtatctgtcattaaagaagggtggctccacaaaagaggggagtatattaagacctggcgtcctagatattttctcctcaaatcagatggctcatttataggatacaaggaaagacctgaagcacccgaccagtag

SEQ ID NO: 17920 - DNA, 405 bp, Artificial Sequence
  Description of Artificial Sequence: Synthetic coding sequence
atgaacgaggtctctgtgattaaagaaggatggctccataagagaggcgagtacattaaaacttggagacccaggtacttcctcctgaaaagcgacggcagtttcattggatacaaggagagacctgaagccccagatcaaacactgccaccgctcaataacttcagtgtcgctgaatgccagctgatgaagacagaaagaccaagacctaacacctttgtcattaggtgcctccaatggaccaccgtgatcgaacgcacatttcacgtggactcgcccgatgagcgcgaggaatggatgcgagctatccaaatggttgccaactcactcaagcagagggcacctggagaggaccccatggactacaaatgcgggtcgccatctgacagttccactactgaatag

SEQ ID NO: 17921 - DNA, 324 bp, Artificial Sequence
  Description of Artificial Sequence: Synthetic coding sequence
atgaatgaggtgtccgtaatcaaggagggctggctgcacaaaaggggagagtacataaagacatggaggcccagatatttcctgctcaagagcgacggctcctttataggatataaagaacggcccgaggcccctgaccagactctcccaccattgaacaacttctccgtggcggagtgccagctcatgaagaccgagaggccaagacccaacacatttgtgattcgttgcttacagtggacaacagtcatcgagcgcacattccacgtagattccccagacgagagagaggagtggatgagggcaatccaaatggttgcttag

SEQ ID NO: 17922 - DNA, 867 bp, Artificial Sequence
  Description of Artificial Sequence: Synthetic coding sequence
atgaacgaagtaagtgtcatcaaggaaggctggctgcacaagagaggtgaatacatcaagacctggagacctcggtactttctgttgaaaagtgatggcagtttcataggttacaaggaacggcccgaagctccagatcagactctaccacctctgaataacttcagcgtagctgagtgccaactcatgaaaaccgaacgccctcgcccaaacacgtttgtgatacggtgcctgcagtggaccaccgtgatcgagagaaccttccatgtggattctccggacgaacgcgaggaatggatgagagcaattcagatggtcgccaacagtcttaaacaaagggcacccggggaagaccctatggattataagtgcggaagtccttcagacagctccaccacagaagagatggaagttgcagtctcaaaggctcgcgccaaggttacgatgaacgatttcgactatctcaaattactgggtaaaggcacatttggtaaagtaatcctggttagagagaaagccaccggccggtactatgccatgaagatactgcgcaaggaagtcattatcgcgaaagacgaggttgcccacactgtcacggagtcccgggtacttcaaaacacacgtcatcccttcctcacggtaagttgtccccccctaccccgccaatgcgaagcttccctgtggaccgaactgcgggagcgggctctcatcttctggtataaagcccagtcgtggggccgccccggcgggcagggcaaggtactccttagaccggctaaaagtagcgaaccacgccacgtggtaggggtgtcccgactgggggagtgggaaggagattcattcttcatcgacggagggtttatgtag

SEQ ID NO: 17923 - DNA, 1440 bp, Artificial Sequence
  Description of Artificial Sequence: Synthetic coding sequence
atgagcgatgttacaattgtaaaggaaggctgggtacagaaaagaggcgagtacatcaagaattggcggccacgttattttctgctgaaaacagacggatcattcattgggtacaaggaaaaacctcaggacgtggacctgccctatcccctgaataacttttcagtggcaaagtgccagcttatgaaaactgaaagacctaaacccaacacctttatcattcgctgcctccaatggaccacagtgatcgagcgcacttttcatgttgatacaccggaagaaagggaggaatggaccgaggccattcaggctgtggcagaccgattgcagcgccaggaggaagagagaatgaattgctccccgactagccagattgataatataggcgaggaggaaatggatgcgtctactacacaccacaagagaaaaaccatgaatgacttcgattacctaaaacttcttggcaaaggcacatttggcaaggtgatccttgtgcgcgagaaggcctctgggaagtattacgctatgaaaattctgaagaaggaagttataatagctaaagatgaagtcgctcacactctgaccgaatccagggttcttaagaatacaaggcacccttttttgaccagcctcaagtactcattccaaactaaagatagactctgcttcgttatggaatatgtgaatggcggagaactatttttccacctctcaagggagcgcgtctttagcgaagataggaccaggttttatggggccgagatcgtgtcggcgttggattatctccactctgggaaaatagtgtacagggacctgaagctggagaacctgatgctggacaaagatgggcacattaagatcactgacttcggcctctgtaaagaagggatcaccgatgcagccactatgaaaaccttctgtggaacgcctgaatatttagccccggaggtgctggaagataacgactatggcagggctgtagactggtggggactgggcgtagtgatgtatgaaatgatgtgcgggagactgcctttctacaatcaagaccacgagaaattattcgaactgattctgatggaagacattaaattccctagaactctgagctcagacgccaagagtctgctgagcggattactgataaaagatcctaataagcgcctgggcggcggccctgatgacgctaaagaaattatgcggcattccttcttttccggcgtgaattggcaggacgtttatgacaagaagttggtgcctcctttcaagcctcaggtgaccagtgaaactgacacgcgctacttcgatgaagaatttacagctcagacaattacaatcacaccaccagaaaagtacgatgaggacggaatggactgcatggataacgaaagacggccgcatttcccccagttttcttacagtgcctcaggcagagagtag

SEQ ID NO: 17924 - DNA, 1398 bp, Artificial Sequence
  Description of Artificial Sequence: Synthetic coding sequence
atgtccgatgtgacaatcgtaaaggaggggtgggtgcagaaacgcggggagtacataaaaaactggagacctcgatattttttgctgaagactgacggatcatttattggatacaaagagaaaccccaggacgtcgatctgccttatccccttaacaattttagcgttgccaaatgccaacttatgaagaccgagcgcccgaaacccaacacttttattattcggtgtctccagtggaccacggtgatagagagaacattccatgtcgacacgcctgaggagcgggaggagtggacagaagccatccaggctgtagcggatcgcctgcagagacaagaagaagagcgtatgaactgtagtccaacttctcaaattgacaatattggggaagaggaaatggatgcatcgaccacgcatcataagcggaagacaatgaatgattttgactatcttaagcttctggggaagggcactttcgggaaagtgattttggtccgagaaaaagcatccggaaaatattatgcaatgaagatcctaaagaaagaagtgattatcgccaaggacgaagttgctcacacactgacagaatcacgggtgctgaaaaacacccgccaccccttcttgacatctcttaaatactctttccagacaaaggataggttgtgctttgttatggagtatgtcaacggaggagagctgttctttcacctgtcaagggaaagagtcttcagtgaggacagaacacgtttttacggcgcagagatcgtcagtgcactggattacctgcactctggaaagattgtgtatcgggatttgaagttagaaaacctgatgctggacaaggatgggcatataaagatcaccgacttcggcttatgtaaggagggcataactgatgcagccacaatgaagacgttctgcggaacaccggagtaccttgcacctgaggtgcttgaggataacgattatgggcgggctgtagattggtggggcctgggggtcgtgatgtacgaaatgatgtgcggaagactgccattttacaatcaggatcacgagaaactgttcgagttaatcctcatggaggacatcaagttccctcggacactcagtagcgacgccaaatcgctgctgagtggactgttgatcaaggaccccaataaacgcctgggcggcggacccgacgacgccaaagagattatgcggcactccttttttagcggagttaactggcaggacgtatacgataaaaagctggtgcctccctttaagccacaggtgaccagtgaaactgatacaaggtactttgacgaggagttcactgcccagacaatcaccatcactccccctgaaaaatgtcagcagagcgattgcgggatgctcggcaactggaaaaaatag

SEQ ID NO: 17925 - DNA, 1440 bp, Artificial Sequence
  Description of Artificial Sequence: Synthetic coding sequence
atgagcgacgttacgatcgtgaaggagggatgggttcaaaaacggggagagtacatcaagaattggcggcctcgatactttctgctgaaaactgacggctctttcatcggttacaaagagaaacctcaggatgtcgaccttccttatccactgaataactttagcgtggccaagtgtcagctgatgaagaccgagcgcccgaaaccgaatacctttattatcaggtgtctgcagtggaccacagtgatcgagagaacgtttcacgtagacaccccggaagagagagaggaatggaccgaagctatacaggccgtcgccgatagactgcaaaggcaggaggaggaacggatgaactgctccccgacttctcagatcgataatataggcgaagaggaaatggacgccagtaccactcaccacaagcgcaaaaccatgaacgacttcgattacctgaaactgttgggaaagggcacatttggcaaggtcattctcgttcgggaaaaggccagcggcaaatattacgcaatgaaaatcttgaaaaaggaagttatcatagcgaaagatgaagtcgctcatactctgacggagtctagggtgttgaaaaacaccaggcacccttttttgacatccttaaagtactccttccagacgaaggatcggctctgttttgtgatggagtatgtgaacggcggcgaactgtttttccatctgagtcgggaacgtgtgttctcggaagatagaacgcgtttctacggggcagaaattgtctccgcactggactacttacattccggtaaaatcgtgtaccgcgatctgaagttggaaaacttgatgctggataaagatggccacatcaagattactgacttcggactgtgtaaagaaggtatcaccgacgccgccactatgaagacgttctgcgggacaccagaatacctcgctcctgaggtgctggaggataatgactatggcagagctgttgactggtggggattaggtgtcgtgatgtatgagatgatgtgtgggagacttcctttctacaatcaggatcatgaaaagctctttgaactcatactgatggaagatattaagtttccgagaacattgagcagcgacgcaaagtctttattatctgggttattgatcaaagatcctaataaaaggctgggaggcggacccgatgacgctaaggagatcatgagacactcctttttcagtggagtgaattggcaggacgtctacgacaagaaattagttccacccttcaagccacaggtgacttcagagacggatactcggtatttcgatgaggaattcaccgcacaaacaatcacaatcactccccctgagaagtacgatgaggatgggatggactgcatggataacgaaaggagaccgcactttccccagttctcgtacagtgcatcgggaagggagtag

SEQ ID NO: 17926 - DNA, 1398 bp, Artificial Sequence
  Description of Artificial Sequence: Synthetic coding sequence
atgagcgacgtcacaatcgtcaaagagggctgggttcagaagagaggggaatatattaaaaactggaggcctagatacttcctgctcaagactgatggctcctttatcggatacaaggaaaaaccacaggacgtggatttgccctatccactgaacaactttagcgtagccaaatgccaattaatgaagacggaaagaccaaaacccaacaccttcatcattagatgtctccaatggactaccgtgatcgagagaaccttccacgtggacacacccgaggagagggaggagtggacggaggccatccaggccgtcgccgaccgtttgcagcggcaagaggaggaaagaatgaactgctcccctacgtcccagattgataatattggggaggaagagatggacgccagcactacacaccataagaggaagaccatgaacgacttcgattacctgaagttgctgggaaaggggaccttcggtaaggtgatcctggtaagagaaaaggcgagcggtaagtactacgccatgaagatactcaaaaaagaggtgatcatcgcaaaagacgaagtggctcacacgttgactgagagccgagtcctcaaaaacactaggcacccatttttgacgagtctgaaatactcgtttcagacaaaagaccgactctgctttgtaatggagtacgtaaacggcggtgagttgttcttccatcttagccgtgaacgcgtgttcagtgaggaccgaactaggttctacggtgcagagattgtttctgccctggattacttgcatagcggaaagatcgtctatagggacctcaagctggaaaacctgatgctcgataaggatggtcatattaagataaccgactttggactgtgcaaggagggcatcactgatgcagccactatgaaaaccttttgcggaacccccgagtacctagctccggaggtcctagaggacaatgactacggcagggccgtggactggtggggtctgggcgtggtgatgtatgaaatgatgtgcggaaggctgccattctacaatcaggaccatgagaagctgtttgagcttatcctgatggaggatatcaaattcccccgcacacttagctcagacgctaagtccctcctcagtggcctgcttatcaaggatcccaacaaacgcctgggaggcggccccgacgacgcaaaagaaatcatgcgccacagcttctttagtggagtgaattggcaggacgtgtatgacaaaaaactggttccaccgttcaaaccgcaagttaccagtgaaacagatacacgctatttcgacgaggaattcaccgcacagaccatcactataacgccccccgagaagtgccaacagagcgattgcgggatgttggggaattggaaaaaatag

SEQ ID NO: 17927 - DNA, 420 bp, Artificial Sequence
  Description of Artificial Sequence: Synthetic coding sequence
atgtctgatgtgaccattgtgaaggaaggatgggtccagaagcggggcgaatatatcaagaattggcgtcccaggtacttcctgctcaaaaccgacggctcctttatcggctacaaagaaaaaccccaggacgtggacttgccttaccctctaaacaactttagcgtggctaagtgccagttaatgaagactgagaggccgaaacccaatacgtttatcattagatgcctgcagtggaccacagtcatcgagcgcaccttccacgtagacactcctgaagagcgggaggagtggactgaagcaatccaggctgtggccgaccgccttcaacgccaggaggaagagcggatgaattgctccccaactagtcaaatcgacaatattggagaagaagagatggatgcttccaccactcactag

SEQ ID NO: 17928 - DNA, 624 bp, Artificial Sequence
  Description of Artificial Sequence: Synthetic coding sequence
atgtcaccattgcttcggcggctgctgctggccgcacttctgcaactggcgcctgcccaagccccggtttctcaacccgatgcgccaggacaccaaaggaaggtggtgtcttggattgacgtctatacccgggctacctgtcaaccacgggaggttgttgtgcccctgaccgtggaacttatgggaactgtggcaaagcagttagttccttcctgtgttactgtccaacggtgcggcggctgctgccctgacgatggcttggagtgtgttccaactggtcaacaccaggttaggatgcagatattgatgattaggtaccctagttctcagcttggagagatgagcttggaagagcactctcagtgtgagtgcagacctaaaaagaaggatagcgcagttaagcctgacagggccgccacacctcaccatcgaccacaaccgagatctgttcccggctgggattctgcacccggtgccccttccccagccgacatcacccatcccacgcctgcccccggtcccagtgcacacgcagctccttccaccaccagcgctctcacacccgggccagcggcggcagccgccgacgctgccgcttcttccgtggctaagggcggcgcgtag

SEQ ID NO: 17929 - DNA, 567 bp, Artificial Sequence
  Description of Artificial Sequence: Synthetic coding sequence
atgagcccattgttacgccggttactccttgcggcccttcttcagctggctccggcccaggctccggtatcacagcctgacgccccaggccaccaaaggaaggtagtctcgtggattgacgtttacactcgcgccacttgccagcctcgcgaagtggttgtccctctgacagtcgagcttatgggaacagtcgccaaacagctggtcccttcctgcgtgactgtacagagatgcggtggctgctgtcctgacgacggacttgaatgtgtccctacagggcaacatcaggttagaatgcagattctcatgattagatatccctcttctcaattgggcgagatgagcctggaggagcactcacagtgtgagtgtaggccaaaaaagaaggattctgcggtgaagcctgatagccccaggccgctgtgtccccgctgcacacagcaccaccagcgccccgatcccaggacctgtagatgccgatgtcgacggcgcagcttcctgagatgccaaggtagggggctggaactgaatccggacacttgcagatgccggaaactgcgcagatag

SEQ ID NO: 17930 - DNA, 1143 bp, Artificial Sequence
  Description of Artificial Sequence: Synthetic coding sequence
atgtccgaaacagtaatctgctcatcccgggctacagttatgttatacgacgatggtaataagagatggcttcccgctgggacaggaccacaggccttctctagggtacagatctaccataaccccacagcaaactctttcagagtagtgggcaggaaaatgcagcccgaccagcaagtggttatcaactgcgccatcgtgaggggtgttaaatataaccaggcaaccccaaactttcaccagtggcgcgacgccagacaggtgtggggtctcaacttcgggtctaaggaagatgccgctcaattcgccgccggtatggctagtgcactggaggccctcgaagggggagggcccccccctcctccggccttaccaacctggagcgtccctaacgggccttcccccgaggaggtggaacagcagaagagacagcagcctgggccaagtgagcacatagagcggagggtgagcaacgcaggcggccctccagcaccaccggctggagggcctcccccaccaccaggtcctccccccccaccaggacccccccctccgccaggcctgcccccttcaggcgtgcctgccgcggcccatggtgctggtgggggccccccgcccgctccacccttacccgctgctcagggccctggaggaggcggcgccggcgctcctggactagccgcagctatcgccggagcaaaactgagaaaagttagtaagcaggaggaagctagcggcgggcctaccgcacctaaggctgaatccggtcggagcggaggaggcgggctaatggaagagatgaacgccatgctggctcgtcgtcggaaagctacacaggtaggtgagaaaacccccaaagatgaatcagccaaccaagaggaacctgaggcacgagtccctgctcagagcgagtcagtacgaaggccttgggagaaaaactccaccaccctgccccgcatgaagtccagctcttccgtgactacttcagagacccagccttgcacgcccagctcatccgactacagcgacctccagcgcgtcaagcaggaactgctcgaagaggttaagaaagagctgcaaaaggtaaaagaggagatcattgaggccttcgtgcaagagctgaggaagcgggggtcaccttag

SEQ ID NO: 17931 - DNA, 915 bp, Artificial Sequence
  Description of Artificial Sequence: Synthetic coding sequence
atggccggcaacttcgatagcgaggagaggtcatcctggtactgggggaggctctccaggcaagaggccgtcgcattactgcaaggccagaggcacggcgtgttccttgtgagggactcctccactagtccaggcgattacgtgttatctgtgtcagagaacagcagagtgagccactacataataaattcatctggaccccggcctcctgtgcctccaagcccggcgcagccaccacctggggtctccccctccaggctgcggataggtgatcaggaatttgatagtctgcccgcactgctcgaattttataagattcactacctagacaccactacgcttatagagcccgtgtctaggagccgacagggatccggcgtcatcctgcggcaagaggaggctgaatatgtcagagcccttttcgacttcaatggaaatgacgaggaggacctgccattcaagaagggagatatcctgcggatccgggacaagcctgaggagcaatggtggaacgcagaagattccgaggggaaacgcggcatgatccccgtgccatatgtagagaaataccgtcccgcaagtgcctctgtgtccgccctgataggaggaaaccaggagggctcacacccgcagcccctggggggaccagagccagggccttatgcccagccaagcgtgaatacacccctaccaaacctgcagaatggccctatttatgccagggtgatccaaaagcgggtcccaaatgcgtatgataagacagctcttgcgttagaggtaggcgaactcgttaaagtgactaaaattaacgttagcgggcagtgggagggcgaatgtaacggtaagagaggacatttcccattcactcatgttcgcctgttggatcagcaaaaccctgacgaggattttagctag

SEQ ID NO: 17932 - DNA, 615 bp, Artificial Sequence
  Description of Artificial Sequence: Synthetic coding sequence
atggccggtaactttgactctgaagagagaagctcgtggtactgggggcgtctgagcagacaggaggctgttgcgctactgcaggggcagaggcatggcgtattcttagttcgggacagttccacatcacccggagactacgttctatctgtgtccgaaaactcacgggtgagtcattacattatcaacagcagcggtcctcgtccgcctgtccctccctcaccagctcagccgccacccggggtgtccccttcaagactgagaatcggcgatcaggaattcgattctctacccgcactgctggaattttataagatccattatcttgataccacaacccttatcgagccagttagtcggtcccggcaaggctctggcgtgattctacggcaggaggaggctgagtacgtgcgcgcactgttcgattttaacggcaatgacgaagaggacttgccctttaagaagggcgatattcttcgcatacgagacaagccggaggaacaatggtggaatgccgaagattccgaaggcaaacgcggcatgattcctgtcccctatgtcgagaaatatcggccagccagcgcttccgtgagcgccctcattgggggtcgatag

SEQ ID NO: 17933 - DNA, 2196 bp, Artificial Sequence
  Description of Artificial Sequence: Synthetic coding sequence
tgaaagcctgctacaggactctgggtgtgggtcagtctgctagtcgctgccggcactgtgcagccctccgattcacagtccgtctgtgccggaaccgagaacaagttaagctctctttctgatctcgagcaacaataccgtgctttacgcaagtactatgagaattgtgaagtcgtgatgggtaatctggaaatcacatctattgagcacaatcgcgaccttagctttctgcgctctgtgcgcgaagtgacaggttatgttctagtggcactgaaccaattccgttacctgccgctggagaacctgaggattattaggggcacgaaactgtacgaagaccgttacgccttagcaatttttttgaattatcgcaaggatggtaatttcggcctccaggagttaggcctcaaaaacctcaccgagatactgaatggtggtgtttacgtcgaccaaaacaagttcctgtgctatgccgataccatacactggcaggatattgtgcgaaatccatggcccagtaatctcaccctggtctccaccaatggatctagtggatgtgggaggtgtcacaagagttgcacaggacggtgttggggccctaccgaaaaccactgccaaaccctgactcggactgtctgcgcagagcagtgcgatggccgctgttacggcccttacgtttctgattgctgccatcgggagtgcgctggcggttgtagcgggcccaaggacaccgactgctttgcctgtatgaatttcaacgattcgggtgcctgcgttacacaatgtccgcagacgtttgtttataaccccacgacatttcagctagagcacaactttaacgccaaatacacctatggggccttctgtgttaagaaatgtccgcataacttcgtggtggattcaagcagctgcgtgagagcctgccctagctcaaaaatggaggtggaggagaatgggatcaaaatgtgtaagccttgtactgacatatgtcccaaggcatgcgatggtatcggcactggatcgctgatgtcagcccaaacagttgattcctcaaatattgacaagttcataaattgtactaagattaatgggaatttgatttttcttgtgacaggaatccatggggacccatacaacgccatagaggcgattgaccccgagaagctgaatgtgttccggacagtacgggagataaccggatttcttaatattcagagttggccaccaaatatgactgacttctccgtcttcagcaacctggtaacaatcggtggacgcgtcttatattcggggctgagtctcttgatcctgaaacagcaggggatcacatcgctgcagttccaatctcttaaggaaatttctgctgggaatatctacatcaccgacaacagcaatctgtgctattatcacacaattaactggacaactcttttctccaccatcaatcagagaatcgtgatccgggataacagaaaggcagagaattgtacagcggaaggaatggtttgtaatcacctgtgctcctcagacggatgctggggcccaggacccgatcagtgcctgagctgccgacgcttctcaaggggccgcatatgcatagagtcatgcaacctgtatgatggtgaatttcgggagtttgaaaatgggagcatctgtgtcgagtgtgacccacagtgtgagaaaatggaagatggactgttgacatgccacggtcccggccccgataattgcactaaatgttctcatttcaaagatgggcctaactgtgtggaaaagtgccccgatggattgcagggggccaattcttttatctttaaatacgccgacccagatagggagtgtcacccctgccatccaaattgtacccagggatgtatcggcagctccatcgaggattgtatcgggctgatggacaggacgccattgatcgctgctggcgtgatagggggcctgttcatcctggtgattgtcggtctcaccttcgccgtgtacgttaggaggaaatctatcaaaaaaaagcgagctctgcgacggttccttgagaccgagctggtggaacctctgaccccctcagggactgctccaaatcaggcgcagctgcgaatcttgaaggagactgagctaaagagggttaaggtgctaggcagcggggcgttcggcactgtgtacaaaggcatctgggtcccagagggctag

SEQ ID NO: 17934 - DNA, 3927 bp, Artificial Sequence
  Description of Artificial Sequence: Synthetic coding sequence
atgaagcccgccaccggtctgtgggtgtgggttagcttactggttgctgctggcaccgtccagccatctgacagccagagcgtgtgcgccggcacagaaaataagctttcgagcctgtccgaccttgaacaacagtatcgtgcactccgaaagtattatgaaaattgcgaggttgtaatggggaatctcgaaattacgtccattgagcataatagggatctttccttcctgcgtagcgtgcgggaagtaacgggttatgtgctggtcgccttgaaccagtttcgttacctacccctggagaatttgcggatcatcagaggaaccaagttatacgaggacagatatgcattggcgatcttcctgaactatcgcaaggacggaaacttcgggctgcaagagttgggtctcaaaaatctgactgaaatcttaaatggtggcgtttatgttgaccaaaataagttcttatgctatgccgataccattcattggcaggatatagttaggaacccctggccttccaatctgaccctggtctccaccaacggaagttctgggtgcggacgctgtcacaagtcatgtaccggaaggtgctgggggcctaccgaaaatcattgccaaaccctcacgcgaaccgtttgtgctgagcagtgtgacggtcgttgttacgggccatatgtctcagactgttgtcatagagagtgcgctggcggatgctcaggccccaaggatacagactgtttcgcctgcatgaatttcaatgactctggggcttgcgtcactcagtgtccccaaactttcgtgtataacccaacgacctttcagctcgagcacaatttcaacgccaagtacacgtacggagctttctgcgtcaagaaatgccctcacaatttcgtcgtggacagctccagctgcgtgcgtgcctgtccctcctcaaagatggaggtggaggagaatggaatcaaaatgtgtaaaccatgtactgatatctgtcctaaggcctgcgatggaatcgggaccggctctctcatgtcagcacagactgtcgacagcagcaatatcgataaattcattaattgtacgaaaattaatggaaatttaattttcctggtgaccggtatccacggagacccatacaatgccatagaggctattgacccagagaagctgaatgtgttccgcactgtgagggagatcacagggtttctgaacatccagtcgtggcccccaaatatgacagatttctcagtgttctccaatctggtaacaatcggaggtagggtactctacagcggcctcagcctgttgattctgaaacagcagggcatcacctctcttcaatttcaatcactaaaagagatcagtgcagggaatatttatatcactgacaacagcaacctatgctactatcatactatcaactggaccactctgttctccacaatcaatcagcgtatcgtaattcgagataaccgcaaagcagagaactgcacagccgagggcatggtctgcaatcacctgtgctcatcggacggctgctgggggcccggcccggatcaatgcttgagctgtcgcaggttttcaaggggcagaatctgtatcgagtcttgcaatctgtacgatggagagttcagagagttcgagaatgggtcaatttgtgtcgagtgcgacccccagtgcgagaagatggaggacggtctgctgacatgtcacggccccggccctgacaattgtactaaatgtagccactttaaagacggacccaattgtgtggagaagtgtcccgacggattgcaaggcgcgaatagctttatctttaaatacgccgacccggatagggagtgtcacccttgtcatccgaactgtacccaaggctgtaacggtcccacctcgcatgactgcatttattacccctggacaggacactcaacccttccccagcacgcccgaacaccactcatcgcggctggcgtcatcggagggctgttcatcctggtcatcgtgggactgacctttgccgtctacgtccggcgaaaatctatcaaaaaaaaacgcgccctgcgacgcttcctagaaaccgaactagtggagcccctgaccccctcaggcacagccccgaaccaggctcagctcagaattctgaaagaaaccgaactgaagagagtcaaggtcctggggtccggcgcttttgggacagtgtacaaaggaatctgggtccctgaaggcgaaactgtaaaaatcccagtcgctatcaagatcctgaacgagacaaccggccctaaggcaaatgtggagtttatggatgaggcgctgatcatggcttcaatggaccacccgcacctcgtcagattgttgggcgtttgcttatcccccaccatccaactcgtcacacagctcatgccccacggctgcctgctggaatacgtccacgaacataaagacaatataggatcccagctacttttaaattggtgcgtgcaaattgccaagggcatgatgtatctggaagagcgcagactggtccacagggacttagccgcccgtaatgtgcttgtgaaaagcccgaaccatgtgaaaataaccgattttggcttggccagactcctggagggagacgagaaagaatacaatgctgacggcgggaagatgcctatcaaatggatggcgctcgaatgcatccattacagaaagtttactcatcagtcagacgtgtggagttacggcgtcaccatatgggagctcatgacctttgggggaaagccgtatgacgggatcccaacccgcgagattcctgacctgctggagaaaggtgagcgcttaccacaacctcctatctgtacgatcgatgtgtacatggtgatggtaaaatgttggatgattgatgccgattctagaccaaagttcaaggaacttgccgccgagtttagtcggatggccagagacccacagcggtacctagttattcagggtgatgaccggatgaagcttccatcacctaatgactctaagttttttcagaatctgctggatgaagaggacctggaggacatgatggacgccgaggaatacttggttccccaggcctttaacatccctccccccatctataccagtagggctaggatcgacagcaatcgttccgaaatcgggcactctcctcctccagcctatacacctatgtccgggaatcagttcgtttaccgtgacggcggatttgccgcggaacagggcgtgagtgtcccttatagggcacctacaagcacgattcccgaggcacccgtggcgcagggagctaccgctgagatctttgatgattcatgctgcaatggaaccctgagaaagccagtggctccccacgttcaggaagattcatcaacacagcggtacagtgccgatcccacggtattcgccccagagcggtctccacggggcgagctggatgaggaagggtacatgacccccatgcgtgataagccaaagcaggaatatctgaaccccgtcgaagagaacccattcgtgtcaagacggaagaatggcgacctccaggcgctcgataaccccgaatatcacaatgcgagtaacggcccaccaaaggccgaagacgaatacgtgaacgagccactgtatttgaataccttcgcaaatactctaggtaaggccgagtacttaaagaataacatcctgagcatgcccgaaaaggctaaaaaggcttttgataatcctgattattggaaccattcgttgcccccacggtccactctacagcatcctgattatctccaggaatacagcacaaaatacttctataagcagaacggccgcatccgacctatcgtggctgaaaaccccgagtatttgtccgaattctctttaaagcctggtacagtccttcctccaccgccttatagacacagaaataccgtggtgtag

SEQ ID NO: 17935 - DNA, 3897 bp, Artificial Sequence
  Description of Artificial Sequence: Synthetic coding sequence
atgaagcctgcaaccggcctgtgggtgtgggtgtccctgctggtggctgcaggcactgtgcagcccagcgattcccaaagcgtttgcgcaggtaccgaaaataagctaagttctttgtccgatctggaacaacaataccgagcactccgtaagtattacgagaactgcgaggtggtcatgggcaacctagaaataacatctatcgagcataatcgggacctgagttttttaagatctgtacgggaggtgaccggatacgtgctagtggcactaaaccagtttcgctatcttcccctggaaaacttgcggattatccggggaacaaaactgtacgaagatcgctacgccctggcaatcttccttaattacagaaaggacggaaacttcggtctgcaggagttaggcttaaagaatctgacagagatcttaaacggcggagtttatgtggaccaaaacaagtttctgtgttacgctgacactattcattggcaagatatcgtgcggaatccctggccgtcgaacctgacattggtgagtaccaacgggagcagtggatgtggcaggtgccataagtcatgcacggggcggtgttggggaccaacagagaatcactgtcaaaccttgacaagaacggtctgtgccgaacagtgtgatggccggtgctacggtccctatgtttctgactgttgtcatcgggagtgcgccggcggctgcagtggccccaaagacactgactgtttcgcttgtatgaacttcaacgactcaggagcatgcgtcacacaatgtcctcaaacgtttgtatataatcccacaactttccagctggagcacaacttcaacgccaaatatacatacggagccttctgtgtgaagaaatgcccccacaatttcgtggtcgacagtagctcctgcgtgagagcctgtccctcaagtaaaatggaggtggaggagaacggaatcaagatgtgcaagccctgcacggacatctgtccaaaggcttgcgacggaattggaacaggcagcctcatgtctgcacaaacagttgactcatctaatattgataagttcattaattgtacgaaaatcaacggcaacctcatctttctggtgacgggaattcatggcgatccatataacgcaattgaggccatagatccggagaagctcaatgtatttagaacagttagggagatcacaggcttcctcaatattcagagctggccccccaatatgactgacttctctgtcttttcaaatctcgtgacaatcggggggagggtgttgtatagcggactgtctctgctgatactgaagcagcagggtattacgagtctccaattccagtccctcaaggaaatctccgccggtaacatttatatcactgataactcaaatctgtgctactaccacactatcaattggaccacactcttctccacaattaatcaaaggatcgtcattagagataatcgaaaggccgagaactgtacggccgagggcatggtttgcaatcacctatgctcatcagacggctgctggggaccagggcccgatcagtgcctctcttgtcgaagattttcccgggggcggatttgcatcgagagctgtaacctgtatgatggcgaattccgggagttcgagaacggcagcatctgtgttgagtgtgatccgcaatgtgagaagatggaggacgggctgcttacctgccatgggcctggacccgataactgtaccaaatgttcacattttaaagatggaccaaattgcgtcgaaaaatgtccagacggcctgcagggggcaaacagttttattttcaaatacgccgatccagatcgcgaatgccacccctgccatcctaactgtacccaaggctgcataggcagcagcatcgaagactgcatcggactcatggatcgtacgcccttgatagcagcaggcgtgatcggtggactctttattctggttatagtcgggctcaccttcgccgtgtacgtcagaaggaagagtattaaaaagaaaagagccctgagacgcttcctagaaaccgagctggtagagccgctgaccccatccggaaccgcacccaatcaggcccagcttcgcatcttgaaggagactgaacttaagagagtcaaggtcctcgggtcaggagctttcggtactgtctacaaaggcatctgggtgccggagggcgagactgtcaagatcccagtggcaattaaaatcttgaacgagacaacgggtccaaaagccaacgtggaattcatggatgaggcgcttattatggcatcgatggatcatcctcacctggttcgccttctgggcgtgtgtctctccccgaccatccagctggtaactcagctcatgcctcacggctgtctgctcgagtatgtccatgaacacaaagataacattggaagccagctactactgaattggtgcgtccagattgccaagggaatgatgtacctggaagagagacgattggtgcatagggatctcgcagcaaggaacgttttggttaaatctcccaatcacgtgaaaattaccgacttcggcctcgctcgactgctggagggcgacgaaaaagagtacaatgccgacggaggtaagatgcccatcaaatggatggctctggaatgtatccactacagaaagtttacacaccagtccgatgtgtggtcctacggcgtgaccatatgggaacttatgacctttggaggcaagccttacgacggaatacccacaagggagatcccagatcttttggagaaaggggaaagacttccacagccccccatctgcacgattgacgtatacatggttatggtgaagtgctggatgatcgacgccgatagcagacctaagtttaaggaacttgcagcggaatttagccggatggctcgggaccctcagcgatatttggttatacaaggcgatgatcggatgaaactgccttcaccaaacgatagcaagttcttccagaaccttctcgatgaagaagatcttgaagacatgatggacgcagaggagtacctcgtgccccaagcatttaatattcctccccccatttacacctctagagctcgcattgacagcaaccggagcgagattggacattctcctcctccagcatatactcctatgtcggggaaccaattcgtgtatagggacggaggctttgccgccgagcaaggcgtctctgtgccctatcgagccccaacgtcaacaatccctgaggcacccgtggcccagggtgcaacagctgagattttcgatgacagttgttgcaatggaaccctgcggaaacctgtcgcaccccatgtccaggaggacagcagcacacagcgatatagcgccgatcctaccgttttcgcccctgagcgctccccacgtggtgagctggatgaggaaggctatatgacacccatgagagataaacccaaacaggagtatttaaacccagtggaggagaaccccttcgtcagcagacgtaaaaatggagacctgcaggccctagacaaccctgagtaccataacgccagcaatggtccacctaaagccgaagacgagtacgtgaatgagccactgtacctgaatacatttgccaacactctcggcaaggccgagtatctcaagaacaacatcctgtccatgccagagaaggccaaaaaggcatttgacaatcccgattattggaaccattctctaccacctcgctctacacttcagcatccagattatctccaggaatacagcacaaagtatttttacaaacaaaacggacggattcgacccatcgtggctgagaatccggaatatctttccgagttctcactgaagccaggcacggtgttacccccgccgccctatcgtcatcgcaatacagtcgtgtag

SEQ ID NO: 17936 - DNA, 387 bp, Artificial Sequence
  Description of Artificial Sequence: Synthetic coding sequence
atgggaaatctcgaaattaccagcatcgaacacaaccgggacctcagctttcttagatctgttagggaagtcacaggatacgttcttgttgcgttgaatcagttcagatatcttccgctggaaaacctgagaataatcagggggacaaagctgtatgaggaccgctatgcacttgccatttttctcaattatcgtaaagatggcaatttcgggctgcaggaactgggtctaaaaaacctcacagaaattttgaatgggggcgtctatgtcgatcaaaacaagtttctctgttatgccgacaccatccactggcaggacattgtaaggaatccttggccttcaaacctgacgttagtcagcaccaacggcagcagtggatgcgggtag

SEQ ID NO: 17937 - DNA, 3879 bp, Artificial Sequence
  Description of Artificial Sequence: Synthetic coding sequence
atgaaacccgccaccgggctttgggtctgggtgagcctgcttgtggccgccggcacagttcagcctagtgatagtcagtccgtttgcgccgggaccgagaacaagctgtcttctcttagcgacctggagcaacagtatagggctctgagaaagtactatgagaattgtgaggtcgttatgggtaatctcgagattacgtcaatcgagcataaccgggatctctcgttcctgcgctcagttcgggaagtcactggctatgtgctggtagctctcaaccagttccgttatctcccactggaaaacctgagaattatcaggggaactaagctctatgaggaccggtacgctctggctatatttctgaactaccgaaaagacggcaatttcggactgcaggaactcggactgaaaaacctgactgagattttgaatgggggcgtgtatgtggatcagaacaagtttctgtgttacgcagatacaatccattggcaggatattgtgcgtaacccttggccttccaatctgacacttgtctcaaccaatggatcttcaggatgtggaaggtgtcacaaatcatgcacaggaagatgctggggccccactgagaatcattgccagacgctcaccaggactgtatgtgctgagcagtgcgacggacggtgttacggtccgtatgtaagcgactgttgtcatagagagtgtgctggcggctgtagcggaccaaaggataccgattgcttcgcatgcatgaatttcaatgattctggagcgtgcgtgactcagtgccctcagactttcgtgtacaatccaacaactttccagctggagcacaacttcaatgcgaagtatacttatggggccttttgcgtgaaaaagtgcccccacaactttgttgtcgactcatccagttgcgtccgggcttgccccagttcaaaaatggaagtagaagagaacgggattaagatgtgtaaaccatgcacagatatttgcccaaaagcatgtgacggaatcggaacaggcagtttaatgagtgctcagacggttgatagttccaacatcgataaatttattaattgcactaaaattaacggcaacctgatcttcctggtcactggcatccacggagacccctataatgcaatcgaggcaattgatccagagaaacttaacgtattcaggactgttcgtgagattacaggattcctaaatattcagtcctggccgcccaacatgacggacttctcggtgttcagcaatctggtcacaataggcgggagggtattgtattcgggactcagccttctcatcttgaaacagcagggcattaccagcttacagttccagtccctgaaagaaatctcagccgggaatatctacatcactgataattccaatctttgctattaccatacaattaattggactactctattttctaccataaatcagagaatcgtaatacgcgacaaccggaaggccgaaaactgcacagctgaaggtatggtatgtaaccatctgtgctcatccgacggttgctggggccctggtcctgaccagtgtctttcttgccggcggttcagccgggggcgtatctgcatcgaaagctgcaacctgtacgacggggaattccgggaattcgaaaacggctctatctgcgtggagtgcgacccccaatgcgagaagatggaggacggcctcttgacttgccacggcccagggcctgataactgtaccaagtgctcccacttcaaagatggacctaactgcgtcgagaaatgcccagatggcttgcagggggccaacagtttcatttttaagtacgccgatcctgatagagagtgccatccatgccacccaaattgcacacagggctgtaatggtcctaccagccatgactgcatttattacccctggaccggtcactctaccctaccacagcatgccaggaccccattgattgcagctggcgtgatcggtggcctctttattctagtaatcgtggggctgacttttgctgtgtacgtccggaggaaatccatcaaaaaaaaaagagccttgaggagatttctcgaaacggagttagtggaacccctcacaccatccggaaccgctccaaatcaggcccagctgagaattctcaaggagaccgagctgaagagggttaaggtgctcgggtccggagctttcggcacagtatacaaggggatttgggtccctgagggagagaccgtgaaaatccccgttgcgataaaaatcttgaatgaaacaacgggtcctaaagcgaacgtggagtttatggatgaagccctcataatggctagtatggaccatcctcacctggtgcgtctcctcggtgtgtgtctcagtcctacaattcagcttgtgactcagctgatgccccacgggtgtttgcttgaatacgtacatgaacacaaggataatatcggctctcagttactcctcaattggtgtgtgcaaatcgcaaagggcatgatgtacctcgaggagcggcgcctggtgcacagagatctggctgccagaaatgttctggtaaaatctcccaatcacgtgaagataaccgacttcggtctggccaggctgcttgaaggcgatgagaaagaatacaacgctgacggaggcaaaatgccaattaagtggatggcgctggagtgcatccactaccgtaagttcactcaccagtctgacgtgtggtcctatggcgtcactatttgggaactgatgacttttggagggaaaccatacgatgggatcccaacacgcgagattccagatctgctggagaaaggggagcggcttccacaacctcctatttgtactatcgacgtctacatggtgatggttaagtgctggatgatcgatgcagactcacggcccaagtttaaggaacttgctgccgagttctcacgcatggcccgggatccacagagatacctcgtgatccagggggacgatcgtatgaaattgccgtcacccaacgactcaaaattcttccagaacttgctcgatgaagaagatctggaagacatgatggatgccgaggagtacctagtgccacaggcctttaacataccgcccccaatctataccagccgtgcccgaatcgacagcaacagaaatcagttcgtctatagggatggcggcttcgccgccgagcagggagtatctgtgccatatcgagccccgacatccactatacccgaggctcccgtggcgcaaggagcaaccgcagagatcttcgatgattcctgctgtaacgggactttacggaaaccggtggctccacacgtgcaggaagatagctctactcagcgctacagcgctgacccaaccgtatttgcacctgagcggtccccccgtggggagcttgatgaggaggggtacatgactcctatgagggacaagccaaaacaggaatacctgaatcctgtagaggaaaatccgttcgtttctaggcggaaaaacggggatctacaagcgttggataatccagaataccacaacgcctcaaacggaccccccaaggccgaggatgagtatgtcaacgagccactgtatctgaacactttcgctaatactctgggcaaggccgaatatctgaagaacaacattcttagcatgcctgagaaagcaaaaaaagcatttgataatcccgactactggaaccacagccttccaccacggagcacactgcagcaccccgattacctgcaagagtacagtacaaagtacttctataagcagaacggaaggatccgacccatcgtcgctgaaaatcctgagtacctttctgaattcagcctgaaacctggtactgtactgcctccccccccctacagacacaggaacacagtggtatag

SEQ ID NO: 17938 - DNA, 4029 bp, Artificial Sequence
  Description of Artificial Sequence: Synthetic coding sequence
atgagggccaacgatgccctccaggtccttgggcttcttttttctcttgccaggggctcagaggtcgggaattcacaggccgtttgcccaggaaccctgaacgggttgtccgtgacgggagacgccgagaaccagtatcagactctatacaaactttacgaaaggtgtgaagttgtgatgggaaacctggagatcgtgctgaccgggcataatgctgacttgtccttcctgcagtggattcgggaggtcactgggtacgtactggttgctatgaacgaattctccacactaccgcttccgaacctgagagtcgtacgggggactcaggtttacgacggtaaatttgcaatcttcgtgatgctgaactataatactaacagcagtcatgcgctgaggcaattgcggctgacccagctgacggagattctttctggcggagtgtacatcgagaaaaatgacaagctatgccacatggatactattgactggagggatattgtgagggaccgtgatgcagagattgtggtgaaagacaacggcaggtcttgccccccttgtcacgaggtctgcaaggggagatgttggggcccgggctccgaagactgtcagactttgacaaaaaccatatgtgcaccacaatgcaacggtcattgcttcggccccaaccctaaccagtgttgccacgacgaatgcgctggtggctgctctgggcctcaagataccgactgctttgcctgccgccactttaatgactcaggcgcgtgtgtgcctaggtgtccccagccccttgtgtacaacaagttgacttttcaacttgaacccaatcctcacacaaaataccagtacgggggagtgtgcgtggcttcttgtcctcacaacttcgtggtagatcaaacttcctgcgtacgcgcctgcccccctgacaagatggaggtggataagaacggattgaaaatgtgtgaaccctgcgggggtctctgccccaaggcgtgcgaagggacggggtccgggtccagattccaaacagtagattcctccaatatcgacggattcgttaactgcaccaagatcctgggcaacttagactttctcatcaccgggttaaatggggatccctggcacaaaatccccgccctagaccccgagaagctgaacgtgtttcggacggtccgggagatcaccggttacttgaacatccagtcttggcccccccatatgcacaacttctcagtcttctctaacctaaccaccatcggtggccggagcctttacaatcgagggttttccttgcttattatgaaaaacctgaatgttacatctctggggttccggagcctgaaagaaatcagcgccgggagaatctatattagtgctaaccggcaattgtgctaccatcactcgctgaactggacaaaggtgctgagggggcctacggaagagcgattagatatcaagcacaatcgaccacggagggactgtgtagcagaaggaaaggtgtgtgatcctctgtgttcctcaggcgggtgttggggaccaggacctggccagtgcttgagttgtcggaactatagccggggtggggtgtgtgtgacacactgcaactttctgaatggggaaccaagagagtttgctcacgaagccgagtgcttttcctgccacccagagtgtcaaccgatggaagggactgccacttgcaatggtagtggcagcgatacttgcgcacagtgcgcacacttccgagatggtccacactgcgtgtcctcttgcccccatggagtgttgggcgctaaggggcccatttataagtaccccgacgtccagaatgagtgccgtccatgtcacgagaattgtacgcagggctgcaagggacctgagctccaggactgtcttggtcagaccctggtcctgattggcaagacccacttgaccatggctctcaccgttattgccgggctggtggtaatattcatgatgctcggcggtaccttcctgtattggcgaggacgccgcatacagaataaaagggccatgcgccggtatttggagcgcggcgagtccatcgaacctctcgatcccagtgagaaggctaataaggtactagcccggattttcaaagagacagagctgaggaagttgaaagttcttggatccggcgttttcgggacagttcacaaaggcgtttggatccccgaaggcgaatctataaagattccggtgtgtattaaagtcatagaggacaagagcggtcgccagtcttttcaagccgtcaccgatcacatgctcgcaatagggtctctggatcatgctcacatcgttcgtctgctgggattgtgccctggctccagtctccagctggtgactcagtacttacccctcggctccctactggaccacgtgcgacagcaccgcggcgcactggggccccagcttctgttgaattggggcgtgcagatcgccaagggcatgtattatctcgaagaacatgggatggttcacaggaatctggctgcgaggaatgtgctgttaaagtcaccgagtcaggtccaggtggctgacttcggcgtcgccgatctgttaccacccgacgataaacagctcctgtactcagaagcgaagacgccaatcaagtggatggctcttgaatctatccattttggaaaatacacgcatcagagcgacgtgtggtcctacggtgtcactgtatgggagcttatgacatttggagctgagccgtacgccggcttgaggctggctgaggtccccgatctgctggaaaagggagaacggctggcccagccacagatctgcactatcgacgtctacatggtgatggtaaagtgctggatgatcgacgagaacataagacctactttcaaggaactggcaaacgagttcacaaggatggccagggatcctccacggtatctcgttatcaaacgcgaaagcggacccggtatagccccaggccctgaaccgcatggcctcactaataagaagctggaggaagttgaactggaacctgaactggacctggacctcgatttagaagctgaagaagataacctggccacgaccacgctcggctccgctctgtccctgccagtcgggacactgaataggccacgcggttcacagagtcttctcagcccctcttctgggtacatgccgatgaaccagggtaacctcggcgaatcttgtcaggagtctgcagtgtctggatcatccgagcggtgtcctcggccagtgtcattgcacccaatgccaagagggtgcctggcaagcgagagctctgagggccacgtgactgggtccgaagcagagctccaagaaaaggtgagtatgtgtcgctcacgatctaggagtaggagccccagaccccgcggggacagcgcttaccatagtcaaagacactctctgctgacacctgtcacacctttgtctcctcctggtctggaagaggaagacgtgaatggttatgtcatgcccgatacccacctcaaggggactccatctagccgggaaggaactctgtcctccgtgggcctgagcagcgtgctgggcaccgaggaagaagacgaggacgaagagtacgagtatatgaatcgacgtcgacgccatagtcccccccatcctccgcgcccatcaagcttagaagaacttggttatgagtatatggatgttggatctgacctgagtgcgagcttaggaagtacacagagttgccccctacatccagtgccaatcatgccaaccgcaggtaccactcctgacgaagattatgaatatatgaacaggcagcgcgatggagggggccccggaggagactatgctgcgatgggggcatgccctgccagtgaacagggatacgaggaaatgagggcgttccaaggccccggccaccaggctccccacgtgcactacgccaggcttaaaactttgaggagccttgaagcaaccgattctgctttcgacaatcctgattattggcactctagattatttcccaaagccaacgctcagcgtacttag

SEQ ID NO: 17939 - DNA, 996 bp, Artificial Sequence
  Description of Artificial Sequence: Synthetic coding sequence
atgcgcgctaacgacgccctccaggtccttggcttgctattctccttagcccgcggtagtgaggtgggcaacagccaggctgtatgcccggggaccctcaatggactgtccgtgaccggagatgccgagaatcaatatcagaccttatacaagttatacgaacgttgtgaagtggtgatggggaatctggagattgttctgacaggtcacaatgcagacctttcttttctgcagtggattagggaggtgactggttacgtgctggtggccatgaatgagttctccacactgccactgccgaatctgagagtggtacgcggaacgcaggtgtatgatggcaagttcgctatcttcgtcatgctaaattataataccaattcttcacacgccctgcgacagctccgcctcacccagctgactgaaattctgtctggcggagtgtatatcgaaaagaatgataaactgtgccatatggataccattgattggagagatatcgtgcgtgaccgggacgccgaaattgtggtcaaggacaacggccggtcgtgtccaccatgtcatgaggtgtgcaagggtcgatgctgggggcctggtagcgaagattgtcagactctgaccaaaactatatgcgcgccgcagtgcaacggacactgttttggtcctaatccaaaccagtgctgccacgacgaatgtgcaggagggtgtagcgggccacaggatacagactgtttcgcatgtaggcactttaacgactctggggcgtgtgtccccagatgcccgcagcccctcgtctataataaactcacattccagcttgaacctaatccacataccaaataccagtacggtggagtgtgcgtcgcgtcctgcccccataattttgtggtcgatcaaacgtcttgcgtgcgcgcttgtccacccgacaagatggaggttgacaaaaacgggcttaaaatgtgcgagccctgcggtgggctttgccccaaggttttctag

SEQ ID NO: 17940 - DNA, 552 bp, Artificial Sequence
  Description of Artificial Sequence: Synthetic coding sequence
atgcgggccaacgacgcactgcaggtgctcgggctgctgtttagcttggccagggggagtgaagtggggaatagtcaagccgtgtgccccggaaccctgaacggcctttcagtgaccggtgatgcagaaaaccagtaccagaccctttacaaactctatgagcggtgcgaggttgtcatgggtaatctggagatcgtcttgacaggtcataacgcagacctcagttttctgcagtggatccgggaagtgaccggctacgtactcgtggccatgaatgagttctccactctcccactgccaaatctgagggttgtcaggggaacccaggtgtatgacgggaaattcgccatcttcgtgatgctgaattataatacaaactcatcgcacgcactcagacagcttagactcacacagttgacgggccaattcccaatggttccttcaggcctgactcctcagccagcccaggactggtatctgcttgatgatgacccgcgcttattaactctgtctgcttcaagcaaagttccagtaacactggccgccgtgtag

SEQ ID NO: 17941 - DNA, 3852 bp, Artificial Sequence
  Description of Artificial Sequence: Synthetic coding sequence
atgggcaatctggagatcgtgctcacaggacacaatgccgacctgagctttctgcagtggatcagagaggtaactggatacgtactcgtcgctatgaacgaatttagtacactccccttacctaatctgcgagtagttaggggcactcaggtatacgacggaaaatttgcaatttttgtcatgctaaattataataccaactcaagccacgctctgcgacagctgcgcttaacccagcttacagaaattctgtccggcggtgtgtacattgagaaaaacgacaaattatgtcacatggacacaatcgactggcgcgacattgtcagggacagggatgctgagatcgttgttaaagataatggccgaagttgtccgccgtgccacgaagtgtgtaagggcaggtgttggggtcccggttctgaggattgccagaccctgacaaagacaatttgcgccccacagtgcaatgggcactgctttggccctaatcccaaccagtgctgtcacgatgagtgcgccggtggctgttccggcccccaggacacggattgcttcgcctgtagacacttcaatgacagcggcgcctgcgtaccacgatgcccacagcccctggtctataataagctcacctttcaactggaacctaaccctcatactaagtatcaatacgggggggtttgtgtggcatcttgcccccataacttcgtggtggaccagacttcatgtgttcgggcttgtccgcctgataagatggaagtggacaaaaatggcctcaagatgtgcgagccttgtgggggactgtgtcccaaagcctgtgaagggacgggctctggctccagatttcagactgtggacagcagtaacatagacggctttgtcaactgtactaagattttggggaatttggactttttgatcaccggcctcaacggagatccgtggcataaaattcccgcactggatcccgaaaaattaaatgtttttcgaacagtgagggagatcactggttatcttaatatccaatcctggccacctcatatgcacaacttttcagtcttttctaatctgacgaccattggtgggaggtcgctgtacaatagggggttcagcctgctgattatgaaaaatctcaacgtcactagcctgggatttagatctctcaaggagataagcgccggacggatctacattagcgcgaaccgacagttgtgttatcaccattctttgaattggacgaaggtgcttcgaggtccaacggaagaacgtctcgacatcaaacacaatcgaccacgccgcgactgtgtagccgaaggcaaagtctgtgaccctctgtgttcttctggcgggtgctggggacccggtcccgggcagtgcttaagttgtaggaactactcgagaggcggggtgtgcgtgacccattgtaactttcttaacggagagcctagggaatttgcacacgaggcagagtgtttctcttgccatcccgagtgccaacctatggaaggcacagcgacttgcaacggttccggctcggatacctgcgcccagtgcgcgcatttccgggacggtcctcactgtgtgtcctcttgtccacacggagtgctcggtgcaaaaggacccatttataaataccccgacgtgcagaatgagtgtcggccctgccacgagaattgcacacaggggtgcaaggggccggaactccaggactgtctgggacagactttggtgttgataggtaagacccacctcacaatggccttgactgttatcgctggattggtggtgatctttatgatgctaggagggacgttcttatactggcgtgggcgccgcatccaaaacaagcgtgccatgcggcgctatctagaaagaggggagtctattgagcctctggatccttccgagaaggctaacaaagtgttggcgagaatctttaaagagaccgagcttaggaagctaaaggttcttggttccggggtgtttggtaccgtgcacaaaggggtctggattcccgagggcgagtctatcaagatccccgtgtgcatcaaggtgatcgaagacaagtcgggtaggcagtcatttcaggcggtgaccgaccatatgctggccatagggtcattggaccacgcgcatattgtaaggttgttaggcctgtgccctggttccagcctacagctagttactcagtatctgccactgggaagtctcctggatcatgtacgccagcaccgcggagctcttggacctcagctgcttctaaattggggcgtacagattgcgaaggggatgtactatttggaggagcatggaatggtacatcggaacctcgcagccaggaatgtgctgctaaaatccccttctcaagtacaagtggcggacttcggggttgcagacctgttgccgcctgacgacaagcagttgctgtatagcgaggcaaagacgccgatcaagtggatggccttggaatccatacacttcgggaagtacacgcatcaaagcgacgtgtggtcctacggggtcaccgtttgggaacttatgactttcggggctgaaccttatgccggcctgcgactcgctgaagtcccagatctgctggagaagggagaacgtctagctcagccccagatttgcactatcgacgtctacatggtgatggtgaagtgttggatgattgacgaaaatattagacctacctttaaggaactcgctaacgagttcacacggatggcgcgggatcccccccggtacttagtgataaaaagggagagtggaccaggcatagctccagggcctgagccacacggactcactaacaagaagctggaagaagtggaactggagcccgaactggacctagatctcgacttggaggccgaagaggacaacctcgctactacgacactgggatcagccctgtctctgcctgttggtacgctgaaccgaccgagggggtcgcagagtctcctgtcaccctcaagtggctatatgcccatgaaccagggcaacctgggcgagtcttgccaggagtccgcggtctccggatctagcgagcgctgtccaaggccagtgtcccttcaccccatgccgagaggttgtctagccagcgagagcagcgagggccacgtgaccgggagcgaggcagagctccaggagaaggtcagcatgtgcagaagcagaagtcgatcccggtccccaaggcccagaggcgattccgcatatcattcccagaggcactcactgttgacgcctgtcacaccgctgtcccctcccggcttggaggaggaggatgttaatggctacgtcatgccagacacccacctcaagggcaccccaagctccagggagggcactctctcttcagtgggactgagtagtgttctaggtaccgaggaggaggacgaagatgaagagtacgaatacatgaacagacgaagacgccattccccaccacatcctccaaggccaagctctctggaagaacttggatatgagtatatggacgtaggcagtgacctctctgccagcttgggaagcacccaatcctgccctctgcaccctgtgcccataatgcccaccgcggggaccacgcctgacgaagattacgaatatatgaacaggcagcgcgacgggggaggcccggggggagattatgctgcaatgggtgcatgccctgctagcgagcagggttacgaggaaatgcgagcctttcagggaccagggcatcaggctcctcacgttcactacgctcggctgaagacactacgatcactggaggccacagatagcgcttttgataaccccgattactggcattctcgcctcttcccaaaagcaaacgcccaacgtacctag

SEQ ID NO: 17942 - DNA, 2100 bp, Artificial Sequence
  Description of Artificial Sequence: Synthetic coding sequence
atggcactgacagtcatcgccggcctggtggtgatattcatgatgttgggcgggaccttcttgtactggcgtggaaggcggattcagaacaagcgcgccatgagacggtatttagaacggggcgagtcaattgaaccactggacccttcggagaaggccaacaaggtactagcaagaatttttaaagaaacagagctgcggaagctgaaggtcctgggatcaggagttttcggcaccgtgcacaaaggggtgtggataccagagggggagtccattaagatcccagtatgtataaaggttatcgaggacaaatcaggtcgtcaatctttccaggccgtgaccgatcacatgttggctattggtagtttagaccacgctcatattgtgcggcttctgggcctttgcccgggctcctcattacagctcgttacccaatacctcccactaggtagcctgttggaccatgttagacagcaccgcggggccctgggaccacagctcctccttaattggggcgtgcagatcgcaaaaggcatgtactatcttgaggagcatgggatggtgcatcggaatctggcggcaagaaacgtcctgcttaaatcccccagtcaggtgcaggtagcagattttggcgtggccgatttactgcctcctgacgataagcaattgctgtattctgaagcaaaaacgcccataaaatggatggccttagagtcaatccactttgggaaatacacccatcagtctgatgtgtggagctatggcgtcacggtttgggagctgatgacctttggcgctgaaccctatgcaggactccgtctggccgaggtacctgacctcctcgaaaaaggcgagagactcgctcaaccacagatttgcacaattgacgtctacatggtcatggtaaaatgttggatgatcgatgagaatattagacctacctttaaggagttggctaacgagtttacccgcatggcacgggatcccccgcggtacctcgtgataaaaagggagtccgggccagggattgcccctggaccagagccccatggcctgactaataaaaagctcgaagaagtcgaactggagccggaactcgatctcgatctggatcttgaagcggaggaggacaacctggcaaccactaccctcggctccgccctatctttgcccgtcggaaccctgaataggccccgagggtcgcagagccttcttagcccatcatctggctatatgcctatgaatcaggggaacctcggagagtcatgccaggagagtgcggtgtccggtagctctgaacgctgcccacgccccgttagcctgcacccaatgccaagaggatgcctcgcaagcgagtcctctgagggacacgtgacggggtcagaagctgagctgcaggagaaagtctctatgtgcaggtcaaggagtcgcagcaggagtccccggcctagaggagacagcgcttaccacagccagcgccacagtctcttgacaccagtgactcccctgagcccccccggactagaggaagaggacgtgaatgggtatgtgatgccagatacgcacctcaaggggaccccctctagtagagaaggcactctgagctccgtgggtctctccagtgtactaggaacagaagaagaggacgaggacgaggaatacgagtatatgaaccgccgcagaaggcactctccacctcatccacctagaccctctagcctggaggagctggggtatgagtacatggacgtggggtctgatctgtctgcctccttgggcagtacgcaatcgtgtcccctccatccagtgcccattatgcccactgccggcactacgcctgatgaagattacgagtacatgaatcgacagcgggacggcggcgggccaggaggagactatgccgctatgggagcatgcccagcctcggagcaaggctatgaggagatgcgtgcctttcagggtccagggcatcaagctccccacgtgcattacgcgcggttaaaaacattgaggagccttgaggcaaccgacagcgcttttgataatcccgattattggcacagccgactctttccaaaggccaacgctcagaggacttag

SEQ ID NO: 17943 - DNA, 381 bp, Artificial Sequence
  Description of Artificial Sequence: Synthetic coding sequence
atgcgggcaaatgacgcattgcaggttctgggtctactcttcagcctcgcacgcgggtctgaagtgggcaacagtcaggccgtgtgtcctgggacgctaaatggccttagtgtgaccggggacgccgagaatcagtaccagacgctttacaaactctacgaaagatgtgaagtcgtgatgggcaacctggagatagttctgacaggccataacgcagacctgagcttcctccagtggatcagagaagtgactggctacgttttggtggcaatgaatgaattcagcacactgcccctgcctaacctgagggtggtgaggggcacccaggtctatgacggaaaattcgccatctttgtgatgttgaattacaacacaaactag

SEQ ID NO: 17944 - DNA, 2766 bp, Artificial Sequence
  Description of Artificial Sequence: Synthetic coding sequence
atgcgagctaatgatgccctccaggtgctcggcctcctgttctctctggctcgaggctccgaagtgggcaactcccaggcagtctgccctggcacccttaatgggttgagcgtcaccggagatgccgagaatcaataccagaccctttacaaactatatgagaggtgcgaggtggtgatgggtaacctggagattgtccttactggacacaatgctgatctgtcctttctccagtggattcgcgaagtgaccggatatgtcctcgtagccatgaatgaattctctaccctacccctgcctaatttacgcgtggtgcggggcacccaggtgtatgacgggaaattcgcaatctttgtgatgctgaactataacacaaacagtagccatgccctccgtcaacttcggttgacacagctcaccgaaattctgtcgggtggcgtgtacatcgagaaaaatgataaactgtgtcacatggacactattgattggcgcgacattgtccgcgacagagacgccgagatcgtggttaaagacaacggacgtagctgccctccatgccatgaggtgtgtaagggaagatgctgggggcccggatccgaggactgccagacactcacaaaaactatttgcgcaccacagtgtaacggccactgctttgggcccaatcctaatcagtgttgccatgatgagtgtgccggagggtgctctggccctcaggacacagactgcttcgcgtgccggcacttcaacgatagcggggcctgtgtaccccggtgcccccagccattggtttacaataagcttacctttcagctcgaaccaaatccccacacaaaataccaatatggaggcgtttgtgtggctagttgtccccataatttcgtagtggatcagacctcctgtgtgagagcatgcccacctgataaaatggaagtcgataagaatgggcttaaaatgtgtgaaccctgcgggggcctctgtccgaaggcatgcgaggggactgggtcaggatcccgttttcaaacagtcgacagcagtaatatcgacggcttcgtaaactgcactaagatccttggaaatctcgactttctgataaccggactcaacggagacccttggcacaagatcccagccttagatcccgagaaactgaacgtatttaggactgtaagggaaataacaggttatctgaatatacagtcctggcccccacatatgcacaacttttcagttttcagtaatcttactacaattggaggccggtccctgtacaaccgcggattctctttgctgattatgaagaacctgaacgtgactagtctggggtttagatctctgaaagagatcagtgccggccgcatatacatctccgccaatagacagctctgctaccaccattccctcaactggaccaaggtgcttaggggcccaaccgaagaaagactcgatattaagcacaacaggccccgccgcgactgtgtggcagagggaaaggtgtgtgatcccctttgctccagcggcggttgctggggtccagggcccggacagtgcctgagttgtcgcaactacagtagaggcggagtgtgcgtgactcattgcaactttcttaatggcgaaccgcgcgaatttgcccatgaagctgagtgcttttcttgccatcctgagtgtcaacctatggaagggaccgccacctgtaacggatcaggcagcgatacctgcgcccagtgcgcacacttcagggacggtcctcattgtgtgagctcgtgtcctcacggagtcttgggtgcaaaagggcctatctacaagtacccagacgtgcaaaatgaatgcagaccctgtcatgagaattgtacgcaggggtgcaaggggccagaacttcaggattgtctcggacaaacgctggtgctcattggtaagacgcacttgaccatggccctgaccgtaattgcaggcttggtggtaatctttatgatgctgggcggcacattcctgtattggagaggaagacgaatccagaacaagcgcgctatgaggcggtacctggagaggggagaatccattgagccactggacccctcagagaaagcaaacaaggtcctcgctaggatattcaaggagactgagctgagaaagttgaaagtgcttggcagcggagtcttcggcaccgtgcacaaaggggtttggatacctgaaggtgagtcaatcaagattcctgtttgtattaaggtgattgaggacaagtctgggagacagtccttccaggcggtgacggatcacatgctagcaataggatctctggaccacgctcatattgtgaggctattaggactgtgtcccggctcaagtctccaactggtaactcagtacttgcctttggggtcccttttggaccatgttagacagcaccgcggcgctctggggccacagctccttctgaactggggtgtgcaaatcgctaagggcatgtattatctggaggagcacgggatggttcatcgcaacttggcggcgcgtaacgtcctcctgaaaagcccaagtcaggttcaggttgccgattttggggtcgctgatctgctccccccagacgacaaacaactgctgtacagcgaggccaaaactcccataaaatggatggccctggagtccatccacttcggaaaatatacccatcagtcagacgtgtggagctacggccaatgtatctggatgccatcgttgcccagcttggcccccgtttcaaatctgccttttgagactccttcatag

SEQ ID NO: 17945 - DNA, 10191 bp, Artificial Sequence
  Description of Artificial Sequence: Synthetic coding sequence
atgtttatcaacattaaaagcatcctgtggatgtgctcaacacttatcgtaacccacgcattacacaaagtcaaagtcggcaaaagcccccccgtgagaggaagcctgtctggtaaggtatcgctgccctgccacttcagcacaatgcccacattgccacccagttacaacacttcagaatttctccgaatcaagtggtccaaaatcgaagtggacaaaaatgggaaagatcttaaggagaccacggtcctcgtggctcagaatggtaatattaagattggccaagactacaaaggcagagtgagtgttcctacccacccagaggcagtcggcgacgcctctctgacggtcgtgaaactgctggcctctgacgcgggcctgtataggtgcgacgtcatgtatgggatcgaagatacacaggacaccgtcagcctaactgtcgatggagtcgtgtttcattatagggccgctacatcaagatacaccctgaacttcgaggccgctcaaaaagcttgcctggacgtgggggccgtcatagccactcccgagcagttattcgccgcctacgaagacgggttcgagcagtgtgatgctggttggctggccgatcagacagtgaggtacccaatccgagcccctcgcgtcggatgctacggagacaaaatgggtaaagccggagtgcgcacttatggcttcaggagtccccaggagacctacgacgtttactgctatgtcgatcatcttgacggtgacgtcttccacctgaccgttccctctaaatttaccttcgaggaggccgcaaaagagtgcgagaaccaggacgccagactcgccacggttggggagttgcaggccgcctggagaaatggatttgatcagtgcgattatggatggctctctgatgctagcgtgagacaccctgtcacagtagcaagagcccagtgcggcggcgggttgcttggagtgagaacactgtacaggtttgagaatcaaacagggtttccaccacctgattccagattcgatgcttattgttttaagccgaaggaagccactacaatcgatctatccatcctagccgagacagcgtccccgtcactgtctaaggaacctcagatggtatcagacaggactacacctatcattccactagtggatgagctgccggtcattcctacagaatttccaccagtggggaacattgtttcctttgagcagaaagccacagtgcagcctcaggcaattacagatagtctcgctactaagctgcccactcctaccggatcaactaagaaaccgtgggacatggacgattatagtccaagcgccagtggacctctggggaagttagatatctccgagatcaaagaggaggtgctgcagtcgaccaccggcgtaagccattacgctactgactcatgggacggagtggtggaagacaaacagactcaggagtccgtgacacaaatcgagcagatcgaggtgggaccactcgtcacttccatggagattctgaaacatatcccgtcaaaagagttccctgtgacagaaacgcccctggtgactgctcgcatgatcctggaatctaaaacggagaaaaagatggtctcgaccgtctcagaactggtgactacaggccattatggattcacgctgggagaagaggacgacgaggataggacgctgacggtggggtctgacgagtctacactgatatttgatcagatcccagaagtcatcaccgttagcaagacgtcagaagacacgatccacacccacctcgaggatctggaaagcgtgtcagcctctactaccgtgtcacccctcattatgcctgacaataacgggtcctctatggatgattgggaagagcgccagacctcggggcgcatcacagaggagtttctggggaagtacttgagcaccactcccttcccttcacagcaccgcacggaaatcgagttattcccttactcaggagacaagatcctggtcgaggggataagcactgtgatatatccttccctccagaccgaaatgacacaccggcgggagaggacagaaacacttatccccgagatgagaacagacacgtatactgacgagatccaggaagagatcaccaaatcgccatttatgggtaagacagaagaggaagtgttcagtggcatgaaactttccacgagcctgtccgagcccatccacgtgactgagtccagcgtggaaatgacaaagagttttgatttcccaacactgatcacaaaactttctgcagagcccacagaggtgcgggatatggaggaagactttaccgcgacaccaggaaccactaagtacgacgagaacattacaactgtgctgcttgcccatgggactctgagtgtggaagcagccaccgttagcaagtggtcttgggatgaagataatacaacttctaaacccctggagtccaccgagccctctgcaagcagcaagctaccccccgccttgcttaccaccgttggaatgaacggaaaggacaaggatattccctcctttaccgaggacggtgccgatgagtttacgctcattcccgactcaacacagaaacaactggaggaagttacagacgaagacatcgcggcgcatggaaaatttactatcagatttcagcccactaccagcaccggaatagcggaaaagtccaccctccgagacagcacaactgaagagaaagttcctcccatcaccagtacggagggtcaggtttacgctacaatggagggctctgctctaggcgaggtagaagacgtggatctgagcaagccagtgagtacagtgccacagttcgctcatacctcagaggtggaaggactggcctttgtgtcatattcttcaacacaggagcccacaacgtacgtggactcaagtcacactattccgctctcagttatccccaaaactgactggggagtccttgtgccaagtgtcccaagcgaggatgaagttttaggagaaccctctcaggacatcttggtgatcgatcagacacgccttgaggcaaccattagccctgaaaccatgcgaactactaaaattaccgagggcacgacccaagaggagttcccttggaaggaacagaccgcagaaaagcccgtgccggcactgagttccactgcctggacgcccaaagaggctgtgaccccgctcgatgagcaggagggcgatggctcagcctatacggtcagcgaggacgagctcttgaccggtagcgaaagggttcccgtgttagagaccacaccagtcggcaaaatcgatcattctgttagttacccaccgggagcagtaacagaacacaaggtcaagaccgatgaggtggtgacgctcacacctaggatcggcccaaaggtttccctctcacctgggcccgagcagaaatacgagacggaggggtcctctaccacaggattcaccagttcattgagcccgtttagcacccacattacccagctcatggaggaaacaacaacggagaagacttccctagaggacatagatctggggagcggcctttttgaaaagcctaaggccactgaactgatcgaattttcaaccattaaagtcaccgtaccaagtgacatcacaacagctttctcttctgttgatcggctgcacactactagcgcatttaagcctagctcggctattacaaagaaaccccctctcatcgacagagaacccggtgaagaaaccacttctgacatggtgattattggagagtccacatcccatgtgccaccaaccactttggaggacattgtggccaaggaaaccgagactgacatagacagggagtactttacaacatcatcccctcctgcaacacaacccactcggccgcccacagtggaagataaggaagcctttggtccccaagccctaagtaccccacagcctcctgcctctacaaagttccaccccgacattaatgtttacattatcgaggtgcgcgaaaacaagactggaaggatgtccgatttgtccgtgatcggacatcccattgacagcgagagcaaggaagatgagccgtgtagcgaggagaccgaccctgtccatgatctcatggccgagattctcccggaattccccgacattattgagattgatctgtaccactctgaagaaaacgaggaggaggaggaggaatgcgcaaacgcaaccgacgtgacaacaaccccatctgtgcagtacattaatggtaaacacctggttaccactgtgcctaaggatcctgaggccgcggaggcgcgacggggccaatttgaatctgtagcaccttctcagaatttttctgactcatccgagagcgacacccacccatttgtcattgccaaaactgaactttcaactgccgtgcaacccaatgaatcgactgagaccaccgagagcctggaagttacatggaagccagaaacctaccctgagactagtgagcattttagtggtggggagcccgacgtcttccccacagtgcccttccatgaggagtttgaatccggcaccgcaaagaaaggtgcggagagtgtgacggaaagggacaccgaagttggacaccaggcccatgagcacactgagcctgtgtccctgttccccgaagaatcatccggggaaatagcaatcgatcaggagagccagaaaatagctttcgctcgtgccaccgaagtcacatttggcgaagaagttgagaagagcacttccgtcacctatacgcctacgatcgtgccctccagtgcctcagcgtacgtgtcagaggaggaggctgtgacactgatagggaatccatggcccgatgaccttctttccaccaaagagtcatgggtggaggctaccccacgccaagtggtagaattaagcggcagctccagtatacccatcaccgagggaagcggagaagcggaggaggacgaagatacgatgttcacgatggttactgacctaagccagcggaacacaaccgatacactcattacactcgacacatctcgaattataaccgaaagctttttcgaggtgcccgccacaacgatctacccagtatctgaacagccgtccgcgaaggtcgtgcctacaaagttcgtctcagagactgacacttcggagtggatatcttccaccactgtagaagagaagaaacgaaaggaggaagaaggaacaactgggacagcgtcgacatttgaggtgtacagtagcacgcagcgttctgatcagctgattctgcctttcgaattagagtcaccaaacgtcgccaccagttccgatagcggtacccggaagtcgttcatgagtcttacaacccccacccagtctgaacgtgaaatgaccgactctacacccgtgttcactgaaactaataccttagaaaatctgggcgcccaaacaaccgaacatagttcaatccatcagccgggcgtgcaggaagggctgactactcttccgaggtccccggcctccgtgttcatggagcagggcagtggcgaagcagctgcagaccctgaaaccactactgtctctagttttagcctgaatgtggagtacgccatccaggctgaaaaagaagtcgccggaacactgtccccccacgtagagaccactttttccaccgaacctacggggttggtgctgtctactgtgatggaccgagtcgttgccgaaaacatcacccagacatctcgggaaattgtgatcagtgagaggttgggagagccaaattatggcgccgagatacgcggattctcaacagggttccctttggaagaggatttttcgggggacttccgtgagtactcaacagtgagccaccccatagccaaggaagagaccgttatgatggaagggagcggagacgcagcctttagagatacacaaacctccccgtccacggttccgacctcagtgcacatttcacatattagtgactccgagggcccaagctctaccatggtgtccacaagtgctttcccttgggaagagtttacctcatcggcggagggatctggggagcaactggtcacggtaagtagctcagtcgtcccggtactgcccagcgcagtccagaaattcagcgggactgctagttccataattgatgaagggctgggagaagtgggcacagttaatgaaattgataggcggtcaacaatcctacctacagcggaggtagaggggaccaaagcccccgtggagaaagaggaggtgaaggtgtcagggaccgtctcaaccaactttccgcagactattgagccagccaaactgtggtctaggcaggaggtgaaccccgtgcgacaggaaatcgagtcagaaacaacgtcagaggagcagatccaggaggaaaaatcgtttgagtcccctcaaaattcccctgccaccgaacaaaccatatttgattctcagacctttacggagaccgagctgaaaaccactgactatagtgtgctcacaactaaaaagacttacagcgatgataaagagatgaaagaagaggatacatcactcgtgaacatgtccacgccagaccctgacgcgaacggattggagtcttatactaccctgccagaggccactgagaaaagccattttttcctggctacagcacttgtaacggagtcaatacccgccgagcatgttgtgacagattccccgatcaagaaggaagagtcaaccaagcacttcccaaaaggcatgagacctaccatacaggagagtgacactgaacttttatttagcgggttgggatcaggagaggaggttttacctactctgccgactgaatcggttaacttcaccgaggttgagcagataaacaatactctctaccctcacaccagccaggtcgaaagcacatccagtgacaaaattgaggacttcaaccggatggaaaacgtggccaaggaagtcggacccttggtgagccagacagatattttcgaaggcagcggctcagtgacctccaccactctgattgaaatcttgagcgacactggggcagaagggccaaccgtcgcacccctgcccttcagcactgatattggacatccgcagaatcagactgtgcgctgggcagaagagatccaaacatcccgccctcaaaccatcacggagcaggattccaataaaaattctagcacagcagagatcaatgagacaacaacgtccagtacagattttctcgcgagggcatatggtttcgagatggcaaaagaattcgtaacttctgcccccaaaccttctgacctgtactatgagccatctggggagggcagtggtgaagtggacatagtggactctttccatacttctgccactacccaggccacccgacaagagagcagtaccacattcgtaagcgacggatcactcgaaaaacatcccgaggtgccatctgccaaagccgtgaccgccgacggcttccctactgtcagcgtgatgcttcccctgcactcagagcagaataaaagttcacccgaccccacctccacgttatcgaatacagtgagttacgagaggagcacagacggctcctttcaggaccgctttagagagttcgaagactccaccctgaaaccaaaccggaagaagcctaccgaaaatataatcatcgacctcgacaaggaggacaaagacttgattctgactataacagaatcaacaatccttgaaatattgccagagctcacatccgacaagaacaccatcatcgatatcgatcacaccaagcccgtatacgaagacatcctggggatgcaaactgatatcgacactgaggtgccgagcgaaccacatgacagtaatgacgaaagcaacgatgacagtacacaagttcaggaaatctacgaagcggctgtcaacctatctctcactgaggagaccttcgaggggtctgctgatgtgcttgccagctatacccaggcaacacatgatgagtccatgacgtacgaagacagaagtcagttagaccatatgggatttcactttacaactgggatccccgccccctctactgaaaccgaactggatgtgcttctacctacagcgacctcgctccccatacctcgcaaatcggccaccgtaattcctgagatagagggcatcaaggccgaggccaaggccttggacgacatgtttgagtcctcgactctgtctgatggtcaggcaatcgccgatcaatcggagattattccgaccctgggtcagttcgagcgcacacaggaggaatatgaagacaagaagcatgctgggccatcttttcagcccgaatttagctccggcgcagaggaagcacttgtggaccacacaccgtacctctcaatcgctaccacccatctgatggatcaaagcgtgaccgaggtccctgacgttatggaagggagcaacccgccgtactacactgacacaaccttggcggtgagcaccttcgcaaagctgtcatcacagacaccaagttcaccgctgactatctactctggctccgaggcctccggacataccgaaatacctcaacctagcgctctccccggtattgacgtcggctccagtgtgatgtccccacaggactctttcaaagagatccacgttaacattgaggccacctttaagccctctagcgaagagtatttgcacatcactgagccaccttctctgagtccagacacgaagctggaaccaagtgaagatgatggaaagcccgaattactggaagagatggaagctagccccactgaactgatcgccgtggagggcaccgagattctccaggatttccaaaataagaccgacggtcaggtgtccggcgaggctataaagatgttcccaaccatcaagaccccggaggcaggaaccgtgattaccacggcggacgaaatcgagttggaaggtgcaacccaatggccacactctactagtgcttccgccacatatggcgtcgaagccggggtcgtgccgtggctttctcctcaaacctctgaaagaccaaccctgagctctagtcctgagatcaaccccgagacccaggcagctctgataaggggccaggacagcacaatcgccgcgagcgaacagcaagttgccgcacgaattctcgactccaatgaccaggcaaccgtgaacccagttgagttcaacactgaggtggccacacccccgttcagccttctggagactagcaatgagactgactttctcatagggataaacgaagagagtgtcgagggtacggccatctacctgccgggacccgacagatgtaagatgaacccgtgtttgaatgggggcacctgctaccccaccgagacatcatatgtatgcacctgtgtgcctggctactctggcgatcagtgcgagctcgattttgatgagtgccactccaatccttgtcgaaacggagccacatgtgtcgacgggttcaacaccttccgctgtctttgtctccctagttatgtgggcgcactgtgtgaacaagacactgagacatgcgattacggctggcacaagtttcagggccagtgttacaagtacttcgctcacagacgtacttgggacgcagccgaaagagaatgccggctacagggagcacatcttacctccattctttcccacgaagagcagatgttcgtcaacagggtggggcatgattaccaatggatcggactgaacgataaaatgttcgaacatgatttcagatggacagacggctccaccctccagtacgaaaactggcggcccaatcagccagatagtttttttagcgccggagaggactgcgtggtcataatttggcacgaaaacgggcagtggaacgatgtgccctgtaattaccacttaacatacacttgtaagaaaggaaccgtcgcctgcggccaaccacccgtcgtggagaatgctaagaccttcggaaagatgaaaccccgctacgagatcaactccctcattcgatatcattgcaaagatggcttcatccaaagacatctgcccacaataagatgcttgggaaacggtagatgggccattcccaaaataacttgcatgaatccatccgcctatcaacgcacatattctatgaaatatttcaagaacagtagcagtgccaaggacaacagcattaatacctcgaaacacgatcaccgatggtctcggagatggcaggagagtagacgctag

SEQ ID NO: 17946 - DNA, 4929 bp, Artificial Sequence
  Description of Artificial Sequence: Synthetic coding sequence
atgttcattaatatcaagtctatcctctggatgtgcagcacgttgatagttacccacgcactccacaaagtgaaagtcggcaaatccccacctgtgaggggctccttaagtggaaaggtgtcgctcccttgtcatttttctacgatgcccaccctccctcccagttacaatacctcagaatttttgaggatcaagtggtctaaaatcgaagtagataagaacggaaaagaccttaaagaaactacggtgctggtcgctcagaatgggaatatcaaaattgggcaggattacaagggtagggtgagcgtgcccacacatcctgaggcggtcggggacgcgtctctgaccgtggtgaagcttctcgcttctgacgcaggcttgtaccggtgcgacgtcatgtatggtattgaggacacacaagacactgtcagcttgaccgtggatggagttgtgttccactatcgcgcggcgacatctcgttacactttgaacttcgaggccgcccagaaagcgtgtttagatgtgggcgcagtcatcgccacccccgagcagcttttcgctgcctacgaagatgggtttgagcagtgcgacgccggatggttggctgaccaaacagtccggtacccaatacgggcccccagggtgggttgttacggggacaaaatgggcaaggccggggtcagaacctatggtttccgttctccccaagaaacctacgacgtttactgctatgtggaccacttagatggtgatgtttttcatctgaccgtgcctagcaagttcaccttcgaagaggccgcaaaggaatgcgaaaatcaggatgcgcgactggcaacagtgggtgagctccaagccgcctggcgtaatggttttgatcagtgcgactatggctggcttagtgatgcctcggtgagacaccccgtcacagttgcaagagctcagtgtggtggcggcctgcttggcgttaggaccctttatagattcgagaaccagaccggcttcccaccacctgacagtaggttcgacgcatactgtttcaaacctaaagaggcgacgaccatcgatctctcaatcctggccgagacagctagtccctccctatctaaggaacctcagatggtttcagaccgtacaacgcccattattcccctcgtggacgagctccccgttattcctaccgagttccccccagtaggcaacattgtttcgttcgagcagaaagctactgtacagccacaggccatcaccgactcgctcgcaacgaagctacctacaccaacaggatctaccaaaaagccttgggacatggatgactactccccttccgctagcggcccgctgggcaagctggatatttctgagattaaagaggaagtattacagagcacgacgggggtctcacactatgccaccgacagttgggacggtgtggtagaggacaagcagacacaggagtcggtcacacagatcgagcagatagaagttggacccttagtcacaagtatggagattctgaagcacattcccagcaaagaattccctgtgacagagaccccccttgtgactgcccggatgatcctggaatccaagactgagaaaaagatggtttcaactgtgtcagagctcgtcacgacaggccactacggcttcacgctgggagaagaagatgatgaggatagaacgctaacagttggttcagatgagagcacgctaatctttgaccagatcccagaggttataacagtgtctaaaacgtccgaagacacaattcacactcatctcgaagacctggaaagcgtgtctgcatctactactgtctctccacttattatgcctgacaataatggctcgagcatggacgattgggaggaaagacagacctctggtcgcattacagaggagttcctgggcaaatacctgtccaccaccccttttcccagccagcaccgtaccgagatcgaactttttccctactccggtgataaaatcctcgttgagggtatttccacagttatttatccttccctccagactgagatgacccatcgtagggaacggacagagactctcatccctgaaatgcggactgatacctacaccgacgagatacaggaggaaattactaagagtccgttcatgggaaaaaccgaagaggaagtgtttagcgggatgaagctatccacgagcctatcagaaccaattcatgtcaccgaatcctccgtggagatgaccaagtctttcgacttcccaactctgattaccaaactcagtgccgaacccactgaggttcgggatatggaagaagacttcacagccacacctggtacaaccaagtacgatgagaatattactacggttctgctggctcacggcactctgagtgtggaagccgcaactgtgagcaagtggtcatgggatgaagacaatactacctccaagcccctcgagtccaccgaaccatctgccagctctaagcttccacctgccctgctgaccacagttgggatgaatggcaaagacaaggatattcccagctttacggaggacggagcagacgagttcacccttataccagactctacacagaagcagctggaggaggttaccgatgaggacatagctgcccatggcaaattcaccatcaggtttcaaccgaccacttccaccggtatcgccgagaaatctaccctccgtgactctacaaccgaggagaaagttcccccgattacatctacagaggggcaggtctacgcaaccatggaaggatctgctctcggcgaggtggaggacgtggacttgtcgaagcctgtatccactgtgccccagttcgctcatacttctgaggtggaaggactggctttcgtgtcttattcaagcacacaggagccaacaacctatgtagacagcagtcacaccattcctctcagtgtgatacctaaaaccgactggggagtgcttgtgccgtccgtaccaagtgaagacgaggttcttggggagcccagtcaagatatacttgtcatcgatcagacccgactggaagccactataagtcccgagaccatgagaactactaaaattaccgagggtacaacgcaggaggagtttccgtggaaagagcaaacggcggagaagccagtacctgcccttagctctaccgcctggactcccaaggaggctgtgacacctctggatgaacaggagggcgacgggtcagcctacaccgtgtccgaagacgagctgctcaccggatctgagcgagtgcctgtgctggaaaccaccccagtcgggaaaatcgatcacagtgttagctatcctcccggtgccgtcaccgagcacaaggtcaagaccgatgaggtggtgactttgacacctcgcatcggccccaaggtgtctttgagccccggtcccgagcagaagtatgagacggaaggaagtagcacaacaggctttactagcagtctctcgcctttcagcacacacataacccagcttatggaagaaaccacgactgagaagacctccctggaagatattgacctggggtcaggcctctttgagaagccaaaggccacagaactgatcgagttttccaccatcaaggtcacagtgcctagtgacataacaactgcattcagctctgtcgatagacttcacaccacgtccgccttcaaaccatcatcagctatcaccaagaaaccgccgttaatagaccgggagccaggcgaagagaccacctcggacatggtgataataggcgaatccactagccatgtcccccctaccaccttggaagacatagtggcaaaggaaaccgagaccgacatcgacagagaatactttaccacaagtagccccccagctacacagcccaccagaccccccaccgtcgaggacaaggaagcatttgggcctcaggcgctgagcactccccaaccccctgcctctacaaagttccacccggatatcaatgtgtacattatcgaggtgcgcgaaaacaagaccggaccagaccggtgtaaaatgaacccttgccttaatggaggcacatgctaccccacagagacctcctatgtctgcacttgcgtgcctggatattccggtgatcagtgcgagcttgattttgatgagtgccactctaacccctgtcgaaacggtgctacctgtgtagatgggttcaatactttcagatgcctttgcctgcctagttatgtaggagctctgtgtgaacaggacaccgaaacctgtgattatggatggcacaaatttcaaggccaatgctacaaatacttcgcacacagacggacctgggacgcagcagagcgagagtgtcgcctgcagggagcccacttaacatccatcctgtcacacgaagaacaaatgtttgtcaacagggtgggccacgattaccagtggattggcctcaacgataagatgtttgaacacgacttcaggtggaccgacgggagtaccctgcagtatgagaattggagaccaaaccagcccgactctttctttagtgcaggcgaagactgcgtggtgatcatctggcacgagaatgggcaatggaatgatgtgccctgtaattaccatctgacatacacctgcaagaagggcacagttgcttgtgggcagccccccgtcgtggagaatgcaaaaacattcggcaagatgaagcctagatacgagattaattctctgatccgatatcattgtaaagacggttttattcaaagacatcttcctacaattcggtgtctcggcaatggccgatgggcaattcctaaaatcacctgtatgaaccctagtgcttaccaaaggacctactccatgaaatattttaagaactctagttccgcgaaggacaattccattaatacaagtaaacatgatcatcggtggtcacggaggtggcaagagtcccgccgttag

SEQ ID NO: 17947 - DNA, 7230 bp, Artificial Sequence
  Description of Artificial Sequence: Synthetic coding sequence
atgttcatcaacatcaaatctattctttggatgtgtagcaccctgatcgtgacccatgccctgcataaagtgaaggtgggaaagtccccacccgtccgtgggtctctcagcggaaaggtgtccctaccttgtcacttttctacaatgcccacactgccaccatcatataatacttcggagtttctgcggatcaaatggagcaagatcgaggtggacaagaatgggaaagacttgaaagaaactacggtgctcgttgcccagaatggcaacatcaaaatcggacaagattacaaggggcgcgtctcggtgcccactcaccctgaggccgtgggcgacgccagtttaaccgtggtcaaattgctggccagcgatgcgggcctgtacagatgtgatgtcatgtacggtatcgaggatacccaggacaccgtgagcttgaccgtcgacggggtagtgttccactatagggctgctacatccagatacaccctgaacttcgaagccgcacagaaagcctgtttagacgtgggggctgtgattgctacacctgagcagctctttgcagcgtacgaggacggttttgagcagtgtgatgctggctggctggctgatcagacggtacgataccccatcagagctcccagggtcggctgttatggcgacaagatgggtaaagccggtgtccgaacttatggattccgctccccccaagaaacatacgatgtttactgctatgtggatcacctggatggggatgttttccacctgacggttccgagtaagtttacctttgaggaagccgccaaggaatgcgaaaaccaagatgccaggctggccacagtcggcgaactccaggccgcctggaggaacggcttcgatcagtgtgactatggatggctgagcgatgcctctgtgcgccatcctgtcacagtggcccgcgctcaatgtgggggcgggctgctgggagtgcgtactctctaccggttcgagaatcagacaggctttcctccacccgatagtaggttcgatgcctattgtttcaaacgccgcatgagcgacctttccgtcatcgggcacccgattgattcagagagtaaagaggacgaaccatgctctgaggagaccgacccggttcacgacctcatggccgaaattttgcctgagtttccggatatcattgagatcgatctgtatcacagcgaagaaaacgaggaggaggaagaggaatgcgccaacgcaaccgacgtgaccactactccatccgtgcagtacattaacggtaagcacctggtgacaacagttccgaaagatccggaggccgcagaggcccgcaggggacagtttgagagtgtggcccctagccagaacttttctgattccagtgaatctgacactcacccattcgtaatcgccaaaacagaactgtcgactgcagtgcagcctaacgagtcgactgagaccacagaatcattggaggtgacctggaaaccagagacttaccctgaaacttctgagcacttctcagggggcgagcccgacgtgttcccaactgtcccattccacgaagaatttgaatcggggacagctaagaaaggtgcagaatcggtgaccgaaagggacactgaggtgggacaccaggcccacgaacacactgaaccggtttccctgttccctgaagagagttcaggcgagatagctatagatcaggaaagtcagaagatcgccttcgcccgagccactgaggttacttttggcgaagaagtggaaaagtcaacctccgtcacctatacacccactattgtccctagtagcgcaagtgcatacgtaagcgaggaggaggcagtaacactgattggaaatccatggccagacgacctcctgtccaccaaagaatcttgggtggaggccacaccccggcaggtggtggagctgtcaggcagttccagtattccgatcacagaaggctccggagaagccgaggaggacgaggatacaatgttcacaatggtgacggacctgtctcagcgcaatactacagatacccttatcaccctggacacctcccgcatcattaccgagagcttcttcgaagtgcccgctactaccatatatccagtgtctgaacagcctagcgctaaggtggtccctaccaagtttgtgtccgagaccgataccagcgaatggataagcagcaccactgttgaggagaaaaagcgtaaggaggaagagggaactaccggaacagcatctactttcgaagtttactcttctacgcagcgttcggatcagctgattctccccttcgagttggaatcgccaaatgtagcaactagttccgactccgggactcgcaagtctttcatgagtctgacgacccctactcagagtgaacgcgaaatgacagattccaccccggtgttcacggagaccaatacactggagaaccttggagcacagacaacggaacacagttcaatccaccagccaggcgtccaggaggggctaactaccttgcccaggtctccagcatcagtgttcatggaacaggggtccggtgaagcggcagccgatccagaaaccactactgtgagcagtttcagcctgaacgttgagtacgctatccaggcagagaaagaggttgcaggcactctgtcaccccacgtagagacaactttttccaccgagccaaccggactcgtgctgtccaccgtcatggacagggtcgttgcagaaaatatcacacagactagcagagaaatagtaatcagtgagagactgggtgagcccaactacggagctgagatccgcggattttccacgggctttcccttggaagaagacttctctggcgacttcagagagtactcaactgtttcacacccaattgcaaaagaagagaccgtgatgatggagggctcaggcgatgcggcattccgggacacacagaccagtccaagcactgtccctaccagcgtgcatattagccacattagcgactctgagggccctagcagtaccatggtatccaccagtgcctttccatgggaagaatttacatccagcgcagagggatctggagagcagctggtgacagtatccagtagcgtagtgcccgtgctgccatccgccgttcagaagtttagtggcacagcctcttctatcatcgacgagggattaggcgaagtggggactgtgaatgagatcgatcgtcgtagtacaatcctgcccacagcagaggttgagggcacaaaagcccccgtggagaaggaggaagtgaaagtgagcgggaccgttagcactaactttcctcagacgatcgaacccgctaagctgtggtcgcggcaggaggtgaaccctgtgcggcaggagattgaatctgagaccacttcggaggaacagatccaggaggaaaagagttttgaatcaccgcagaactcgcccgcaacggagcagacaatctttgacagccagacctttactgaaaccgagctgaaaaccactgattatagcgtccttactacaaaaaaaacatactccgatgacaaggagatgaaggaggaggatacatctctcgttaatatgtcaactcctgatccagatgccaatggactcgagtcatacactactctaccagaggctaccgagaagagccacttctttctcgcaactgctctggtgaccgagagtattccagcagagcacgtcgtcaccgattcaccgattaagaaagaggagtcgaccaaacatttccctaaggggatgcgccccacaattcaagaatcagacaccgaactgcttttcagtggtctgggctcaggagaagaggttctacccaccctcccaacagagtcagtgaatttcacagaagtggagcagatcaacaacactctctacccacacacaagccaggtggaatccacctcctctgacaagatcgaggattttaatcgcatggagaatgttgccaaggaagtgggaccgctagtctcacaaaccgatatatttgaagggtccggcagcgtaacctctacgacgcttatagagatcctgtctgacaccggcgcagagggacctacggtagcccctttgcctttctccaccgatataggccatccccaaaaccagacagtgcggtgggctgaagagatccaaacatcccgaccccagaccatcaccgagcaagactcaaataagaattcgtcaacagcagaaattaacgagactacaacgagttcaaccgatttcctagcaagagcatacggcttcgaaatggccaaggagttcgtgactagtgccccaaagccatcagatctgtattatgagcccagcggtgaagggagcggagaggtggacatcgtggattcatttcatacaagtgctaccactcaggcaacgagacaggagagttcaactacatttgtgtccgatggtagcttagagaaacaccccgaggtgcctagcgctaaggccgtgactgccgacggatttcccacagtgtcagtaatgttgcccttacacagtgaacagaataagtcctcgccagatcctacatcaaccctctctaataccgtgtcctacgaaaggagcactgacggtagctttcaggataggtttcgtgagtttgaagacagtaccttgaagcccaaccgaaaaaagccgacagagaatatcatcatcgacctggataaggaggataaagatctgattctgactatcactgaatcgactattctggagatcctaccagagctgacatccgacaaaaacactatcatcgacattgaccacaccaagccagtttatgaggatatccttggaatgcaaactgacatcgacacagaagtccctagtgagccccatgattctaatgatgaatccaacgacgactcaacccaagtgcaggagatctatgaggctgctgtgaatctgtcccttaccgaagagaccttcgagggctccgcagatgtgctggcatcatatacccaggccacccacgacgagagtatgacctatgaggacaggtcgcaactcgaccacatgggttttcattttaccaccggtatacccgctccttctacagagactgagctagacgttcttctaccaacggccacatcattaccaatacctcgcaagagcgccacagtgatccctgagattgagggtatcaaggctgaggcgaaggcccttgacgacatgttcgagtcctctaccctgagtgacggccaagccattgccgaccagagcgaaatcatccccacgctcggccaattcgagagaacccaggaggaatatgaggacaaaaaacacgccggtccatcattccagcctgaattttccagcggcgcagaggaggcactggttgatcataccccatacctgtcaatagccacaacacacctaatggatcagagtgttaccgaagtgcccgatgttatggagggatcaaatccaccttactacacagataccaccctagcagtttccactttcgctaagcttagttcacagacaccctcaagtcctctcacgatttatagtggaagcgaagcttcaggccacactgagatccctcagccctccgcactgccagggatagacgtgggaagttctgtgatgagccctcaggattcttttaaggagattcatgtaaacatcgaggcgacatttaagcccagctctgaagaatatcttcacataaccgagcctcccagcctatctcctgacactaaactcgagccctccgaagacgacgggaaacctgaactgctcgaagagatggaggcttcccctacggagctcatagccgtggagggaactgagatcctccaggactttcagaataaaacggatggccaagtgtccggcgaagcaatcaaaatgtttcctaccatcaaaactccagaggctggcacagtgatcacaactgccgacgagattgagctggagggcgctacccaatggccccactccaccagtgccagcgcaacttatggagtcgaggcgggggtggttccttggttaagccctcaaacctccgaaagacccacactgtcttcttcacccgagattaatccggagacccaggccgccttgattagagggcaggattccacaatagctgccagcgagcaacaggtcgctgcacgcatactggatagtaacgatcaggccacggttaaccccgtcgaattcaataccgaagttgctacaccccccttctctctattagaaacgtcaaacgaaacagacttcctgataggaatcaacgaagagagtgtggaagggaccgcaatatatttgcctggccccgacaggtgtaagatgaacccctgcctaaatgggggaacatgctaccctacagaaacatcatacgtgtgcacttgcgttcctggatatagcggggaccagtgtgagctcgatttcgatgaatgtcattctaatccatgtagaaatggggcgacctgtgtcgatgggttcaatacgttcagatgtctgtgcctgccgtcatacgtgggcgccctttgcgaacaggacacggaaacatgcgattacggttggcataaatttcaagggcagtgctacaaatattttgcccaccgccgaacttgggacgctgccgagcgagaatgccgacttcaaggggcacacctcacctcaatcctgtctcacgaggaacagatgtttgttaaccgggtggggcatgactatcagtggattggactgaatgataaaatgttcgagcacgatttccgttggaccgatggctcaacactccagtacgagaattggcgccccaaccagccagattcttttttctctgcgggcgaagattgtgtggtgatcatttggcacgagaatggacaatggaatgacgtgccctgcaattatcacctcacctatacttgcaagaagggaaccgtggcatgcggacagccacccgttgtggagaacgcaaagacgtttggcaagatgaagccgcgatacgagatcaactccctgatacggtatcactgcaaagatggcttcatccaaaggcatctgcccaccattagatgtctgggcaacgggcgttgggctattccaaagatcacctgcatgaacccctctgcttatcagcgaacttactccatgaaatacttcaagaattcaagcagtgccaaggacaattccataaatacctctaaacacgatcacaggtggtctcggaggtggcaggagagtagaagatag

SEQ ID NO: 17948 - DNA, 4785 bp, Artificial Sequence
  Description of Artificial Sequence: Synthetic coding sequence
atgccgaccttacctccttcgtacaacactagtgagtttctgcgcattaaatggtccaagatcgaagttgacaagaacggcaaggatctaaaagagactaccgtgttggtggcccagaatggtaacataaaaatcggtcaggactataaagggcgggttagtgtgcctacccatccggaggcggtcggcgatgccagcctgaccgtggttaaactgcttgccagtgacgcaggtctgtatcgctgtgatgtgatgtatggaatcgaggacacccaagacactgtcagtctgaccgtggatggggtggtattccactatcgggctgcaacatctcgatataccttgaattttgaggccgcccaaaaggcatgtttggatgttggcgcagtgatcgcaacaccagagcagctcttcgccgcgtatgaagatggtttcgagcaatgtgacgctggctggctagctgatcagactgttagatacccaataagggcccctcgcgtaggttgttatggcgacaagatggggaaggctggtgttagaacttacggctttaggtcaccccaggagacctatgacgtatattgttacgtggaccatctggacggggacgtgttccacctgacagtgcccagtaagttcacttttgaggaagctgcaaaagaatgcgagaaccaggacgctaggctcgccaccgtgggtgagctgcaggctgcatggagaaacgggtttgatcagtgcgactacggatggttgtccgacgcttcagtgcgacaccccgtgacagtggcaagggcacagtgcggtggcgggctactgggcgtgcgtaccctgtacagatttgaaaatcaaacaggctttccccccccagatagccggtttgacgcttactgtttcaaacctaaggaagccacaaccattgatctgagtattctcgccgagactgccagcccgtcactgagcaaagaacctcagatggtgtccgaccgaacgactccaatcatccctctggtcgacgagctacccgttattcccactgaattccctccggtggggaacatagtatcatttgagcagaaggctaccgttcagccacaggctatcacagattccctggcaactaagttgccaactcctaccggttctactaaaaaaccgtgggacatggacgattattctccatctgcctccggcccgctagggaaattagacatatctgagattaaggaggaggttctgcaatctacgacaggagtatcccactatgcaacggactcctgggacggcgtcgtggaggacaagcagacacaagagagcgtcactcagatcgaacagattgaggtggggcctctggtgacatccatggagatccttaaacacatcccttcaaaggagttccctgtgaccgaaaccccgcttgtaacggctcggatgatactcgagtccaaaaccgagaaaaagatggtgtctacggtgtctgagctcgtcacaacggggcactatggatttaccctcggtgaggaggacgacgaggatagaactctcaccgtcggttccgacgaatccacattgatcttcgaccagatccctgaggtgatcacagtgtccaagacgagtgaagacacaatccatactcatctggaggatctggaatccgtttcagcatctaccaccgtgtcacccttgatcatgcctgataacaacgggtcttcaatggatgactgggaagaacgacaaacttctgggagaattactgaagagtttctaggcaagtacctgagcacaaccccctttccctcccaacacaggactgagattgagcttttcccctattccggagacaaaattctggtggaaggtatcagcacagtgatctacccttcgttgcagaccgagatgactcaccgccgtgaacgcacagagacattgatccccgagatgcgaaccgacacatacacagatgagattcaggaagagattactaaatcgcccttcatgggaaagaccgaagaggaggtattctccgggatgaagctgtcgacctccctgtccgaaccaatccacgtgacagagtcctccgtggagatgactaagtcgtttgatttccctacgctgattaccaaactgtcagccgagcccacagaagtgagggacatggaagaagattttaccgcaacccctggaactacgaaatacgatgaaaacattaccacagtgctactagcacatggcaccctgagcgtcgaggcagctaccgtgagtaaatggagttgggatgaggacaacactacgagcaagccgctcgagtccacagagccgagcgctagcagcaagttgcctccagccctcttgacaactgtcggaatgaatggaaaagataaagacattccttcattcaccgaggacggcgcagatgaatttactcttatcccagattccacccagaagcagctggaagaggtcaccgacgaggatatcgccgcgcatggaaaatttacaatccgtttccaaccaacgacttcaacgggcatagcagagaagagcaccctgagagactcgactaccgaggagaaagtgccgccgattacaagcaccgagggccaggtgtacgccaccatggaaggttccgccttgggggaagtcgaagatgtagacctgagtaaacctgtttccactgtgccgcagtttgcacatacaagtgaagtagaggggttagcttttgtctcttactcttctacccaggagccaaccacttatgtagacagctcacacaccatccccctgtcagttatacccaaaactgactggggagtgctggtgccttccgtgccttcagaggacgaagtacttggagagccaagccaggatattctggtcatcgaccagacgcgcctggaggctacaattagcccagagaccatgagaactacaaagatcactgaaggcacgacccaagaagaatttccatggaaggagcaaacagccgaaaaaccggttcccgccctgtcttctaccgcctggaccccaaaggaagcggttacacctctggacgagcaggagggcgacggctcggcctacaccgtaagtgaggacgaactcctcacagggtcagagagggtgcctgtactcgaaaccactccagtgggaaaaattgatcacagcgtgtcataccctccaggcgccgtgacagagcacaaagttaaaactgatgaagttgtcacgctgacccctcgcattggtcccaaagtctcactgtcacccggaccagaacagaaatacgaaaccgagggcagctccactacaggcttcacttcctctttgagccccttctccacacacatcacgcagctcatggaggagactacgactgaaaagacttccctcgaggacatcgacctggggagcggattatttgaaaagcctaaggcgacggagctaatagagttctccaccattaaggttacggtgccctctgatatcactaccgcattcagttctgtggaccggctgcatactaccagcgcctttaagccatcttctgcaattacgaagaagccccctctgattgaccgggagccaggagaagagacaacctccgacatggtgataatcggcgagagcacatctcacgtcccccctaccactctggaggacatcgtggccaaagaaacggagactgatattgatcgggagtactttacaacctccagcccacctgctacgcagcctacccgcccccctaccgtggaggataaggaagccttcggtccccaggccctgtccacgcctcagccacctgctagcaccaagttccaccctgatattaacgtctacatcattgaggtgcgcgaaaataagacaggcccggatagatgtaaaatgaatccttgcctgaatggtggcacttgctaccccaccgaaacctcttacgtttgcacgtgcgttcccggctattccggtgatcaatgcgagctcgatttcgatgaatgccactctaatccatgtaggaatggtgccacgtgtgtcgatggcttcaacacattcagatgtctgtgtctcccatcctatgtgggggctctgtgtgagcaggacaccgagacttgcgactacggatggcataagtttcagggccaatgttacaaatacttcgctcatcggcgcacgtgggacgctgctgaacgagagtgccgccttcaaggcgcgcacttaacctccatcttgtcccacgaagaacagatgttcgtaaacagagtgggccatgattaccagtggattggcctgaatgacaagatgttcgaacatgatttcagatggacagatggatccactctgcagtacgagaactggcgtccaaatcagcccgactcgttttttagcgcaggtgaggactgcgttgtgatcatttggcacgagaacggccagtggaacgacgtgccctgcaattaccatttaacttatacatgcaagaagggcactgtggcttgtggacagccccccgtagtcgagaacgccaagacatttggaaagatgaagccccggtatgaaatcaatagcctgattcgctatcattgcaaagacggctttatccaaaggcatttgcccacgattcggtgccttggaaacggaagatgggccatccctaaaataacttgtatgaatccctcagcttatcaacgaacatactcgatgaaatatttcaagaacagttcatcagctaaggataactcgattaatacctccaagcacgaccaccggtggtcgcggcgctggcaggagtcccgtaggtag

SEQ ID NO: 17949 - DNA, 1968 bp, Artificial Sequence
  Description of Artificial Sequence: Synthetic coding sequence
atgttcatcaacatcaaatccatcctgtggatgtgcagcacacttatcgttacccatgcactgcataaggtaaaagtgggcaagagccctcctgtcaggggctccttgagcgggaaagtctccttgccttgccacttttctaccatgcctaccctacctccttcctacaatacaagtgaattcctcagaattaagtggtccaagattgaagttgacaagaatggaaaagatttgaaggagactacagtacttgtggcacaaaatggaaacataaagatcggtcaggactacaaaggcagggtgagcgtccctacgcatcctgaggcggtcggcgacgctagcctcaccgtagtgaagttacttgcgtcggacgctggactgtatcgatgtgacgtgatgtatggcatcgaggacacgcaagacacggtgtcattgacagttgatggggtggtgttccattatagggcagccacatcaaggtacacccttaatttcgaagctgcgcaaaaagcctgcttagacgtaggagccgtgattgcgacaccagagcagctgttcgctgcttatgaggacggattcgagcagtgcgacgccggatggctggcggaccagactgtaaggtatccgatccgggcccctagggtggggtgttatggcgataaaatgggcaaggctggggttcgtacttatgggtttcgatcacctcaagaaacctatgatgtctattgctacgtggaccatttagatggcgatgtgtttcatctgaccgttccgtcgaagtttactttcgaggaggcggccaaggaatgcgaaaaccaggatgcccgccttgccactgtcggggaactgcaagcagcctggcgaaacggttttgatcaatgtgactatggatggctgtccgacgcttccgtccgacatcctgtgaccgtggccagagcccaatgtggaggaggactgttgggagttcgtacactgtatcgcttcgagaaccaaaccgggttccccccgccagacagtaggtttgacgcctactgttttaagcggccggatcgttgcaagatgaacccatgcctgaatggaggaacctgctacccaacagagaccagctatgtgtgcacttgcgttccaggctatagcggtgatcaatgtgaattggactttgacgagtgtcactccaatccatgtcgaaatggcgccacttgcgtcgacggattcaacacatttaggtgtctgtgtttaccgagctacgtgggagcgttgtgcgaacaggacacagaaacctgtgactatggctggcacaagttccaaggccagtgttacaaatactttgctcacaggcgtacttgggacgctgctgagagagaatgtagactgcagggcgcccacctcactagcatactttcccacgaggagcagatgttcgtcaaccgcgtgggtcacgactaccaatggatcggactcaacgataaaatgtttgaacatgatttccggtggaccgacggatccacccttcagtatgaaaattggaggcccaaccaacccgatagtttcttcagtgccggcgaggactgtgtggtgatcatctggcatgagaacggccagtggaacgacgtcccatgcaattaccatctgacatacacgtgcaaaaagggcacagttgcctgcggacaaccacctgtcgtggaaaatgctaagactttcggcaagatgaagccccgctatgagattaactccttaattcgataccactgcaaggacggcttcattcagaggcatctgccaactatacggtgtctaggtaacggcagatgggcgatccccaaaataacatgtatgaatcccagtgcttatcagcgaacctactccatgaaatatttcaagaactcctcaagcgcaaaggacaattcaattaatacatcaaagcacgatcatcgttggtccaggcgctggcaggaatcccgtcggtag

SEQ ID NO: 17950 - DNA, 1440 bp, Artificial Sequence
  Description of Artificial Sequence: Synthetic coding sequence
atggcctcaacaataaaggaggccctctcagtggtgtccgaggatcagtccctcttcgagtgcgcttacgggacaccccacctagctaagactgaaatgaccgctagttcctcatcagactacggccagacttcaaagatgtcccccagggtcccccagcaggattggctgagccagcctcctgctagagtaaccatcaaaatggagtgcaatcctagtcaggtcaatggctctaggaatagcccggatgagtgctccgtggctaagggtggaaagatggtggggagtcctgataccgtgggtatgaactacgggtcctacatggaagaaaagcacatgcccccccccaatatgacaacgaacgagcgacgggtcattgtcccagccgacccaactctctggtccacagatcacgtccgacagtggctggaatgggccgtgaaggagtatggcttgccggatgtaaatatactgctattccagaacattgacggaaaggaactctgtaagatgaccaaggatgactttcagcggttgaccccatcctacaacgccgacatcttactctcccatctgcattacctaagggagaccccactgccccaccttactagcgatgacgtggacaaggctctgcagaacagtccacggttgatgcacgccagaaacactgggggcgcagcgttcatttttccaaatacatctgtctaccccgaggctacccaaagaattacgacccggccagatctgccttacgagccaccacggaggtccgcttggaccgggcacggtcaccccacccctcagagcaaggccgcccagccctccccatcaacagttcctaaaactgaagatcagaggcctcaactggacccctaccagatactcggccccacctcctccagactagctaacccgggatctgggcagatccagctgtggcagttcctcctggaactgctgagcgacagcagtaactcctcctgcatcacatgggaggggaccaatggcgagtttaaaatgacagacccagatgaggtcgctcgcaggtggggagagcgaaaatccaaaccaaacatgaattacgacaaattatctcgagcactccgatactactatgataagaacatcatgaccaaagtacatggcaagagatatgcgtacaagttcgattttcacggtatcgcgcaggcattgcaacctcacccaccagagtcatcattgtacaagtacccatcggatttaccctacatggggtcctaccatgcccatcctcagaagatgaattttgttgcaccccatccccccgctctccccgtgacgagctcgtcatttttcgccgcacccaacccatattggaacagtcctactggtggcatatacccaaacactcggctgcccacaagccatatgccatctcatcttggcacctattactag

SEQ ID NO: 17951 - DNA, 1092 bp, Artificial Sequence
  Description of Artificial Sequence: Synthetic coding sequence
atggtgggttccccagataccgtgggcatgaattatggctcttatatggaagaaaaacacatgccgcctcccaatatgactacgaacgaacggagggtgatcgtgcctgctgatcccacgctgtggtcaactgaccacgtacgacagtggctcgagtgggcagtgaaggagtacggcctgcctgatgtaaatatcctactttttcagaatatagacggaaaagagctctgtaaaatgactaaggatgatttccagaggctcacccctagttacaacgctgacattttactgtcccacctgcattatttaagagaaacgccacttccacatttgacgagtgacgacgtggacaaagccctgcaaaactcacctcggctcatgcatgcccggaatactgacctcccctacgaacctcccaggagatcagcctggaccggccacggacaccctacgccccaatcaaaagctgcccaacccagccctagtactgtacctaagaccgaggatcaaagacctcagctcgatccgtaccagatcctcggcccaacttccagcaggctggcaaaccctgggagcggtcaaatccaactgtggcaattcctgttagaactgctgagtgattcttctaactcctcttgcatcacgtgggagggcaccaatggggaattcaagatgactgaccctgacgaggtagcgagacgctggggcgagcggaagagcaaaccaaacatgaactatgacaagctttctagggcccttcgatactactacgacaaaaacatcatgaccaaagttcacggaaaacggtacgcatacaagttcgacttccacggcattgcccaggcactacagccgcacccgcccgagtcttccttgtacaagtacccttccgatttgccttacatggggtcttaccatgcccacccccaaaagatgaactttgttgccccccacccaccagctcttccagttacttcctcatcattttttgccgcccctaatccctactggaattcccccactggaggcatttatccgaatacacgcctgcctacatctcacatgccctcgcatcttggtacctactattag

SEQ ID NO: 17952 - DNA, 1389 bp, Artificial Sequence
  Description of Artificial Sequence: Synthetic coding sequence
atgatccagacagtccctgatcccgccgcgcacatcaaggaagccctgagcgttgtgtccgaagatcagagcctgtttgagtgtgcctatggcacaccacacctggccaaaaccgagatgactgcgtctagctcttccgactatggccagacatctaagatgagccctagagtccctcagcaagattggctgagccagcccccagctagagtgaccattaagatggaatgtaacccctcccaggtgaacggatctagaaattccccagatgaatgctctgtcgccaaaggagggaaaatggttggaagcccagacacagtcgggatgaattatgggagctatatggaagagaagcatatgcctccccccaatatgacgacaaacgaaagacgtgtgatcgtgcctgcagatcctacgctgtggtctaccgaccacgtccgacaatggttagaatgggctgtgaaagaatatggcctccccgatgtgaacatactcttgttccagaatatcgacggtaaggaactgtgcaagatgaccaaagatgactttcagaggctcaccccatcatacaacgccgacattttgctgagccacttacactatctgcgcgaaacaccactcccacacctcacatctgacgacgttgataaggcattacagaactcgccaaggttgatgcatgcacgcaatactgatctgccttatgagcctccccgccggagtgcatggactggacacgggcacccaaccccacagagcaaagcggcccagcccagtccttccacagtgcctaaaacggaggatcagcgacctcaactcgacccataccagatcctgggccctacaagtagccgtctagccaatcccggcagcggacagattcagctatggcagttcctgctggaacttctgagcgattcttccaactcctcttgtataacctgggagggaactaatggagaattcaagatgactgatccggacgaagttgctcgccgatggggcgagcggaagtccaaaccgaacatgaactacgacaaactttcacgggccttacgctattattatgacaaaaacattatgaccaaagtccacggcaagcggtacgcctacaaatttgacttccacggcatcgcccaagccctgcaacctcatccccccgaaagctccctgtataagtatccatcagacctgccttatatgggcagctaccacgctcatccacaaaagatgaatttcgtggcaccccacccacccgcattgcctgtaacatcttcaagcttttttgctgctcccaatccatactggaactccccgactggaggcatctacccaaacactagactgccgacttctcatatgccatcccatctgggtacttactactag

SEQ ID NO: 17953 - DNA, 1461 bp, Artificial Sequence
  Description of Artificial Sequence: Synthetic coding sequence
atgatccagactgttcccgatcctgccgcccacattaaagaggccctttcagtggtgtctgaggatcagagtctgttcgaatgtgcctatggaactcctcatctggctaagacggaaatgacagcaagctctagtagtgactacgggcagaccagcaaaatgtcgcctagagtgcctcagcaggactggctgtctcaaccccctgcccgggtcaccatcaaaatggaatgcaacccgtcccaggtgaacgggtccagaaatagtccagacgagtgttctgtcgctaaaggtggtaagatggtcgggtctccagacactgtggggatgaattacggcagttacatggaggagaaacacatgcctcccccaaacatgacaacaaacgaacgcagggtcattgtaccagccgacccaacactttggtctaccgatcatgtgagacagtggctggaatgggctgtgaaggaatatggattgccagacgttaatatcttactgttccagaatatagacggcaaagagttgtgtaagatgaccaaggacgacttccagagactgacccccagctacaatgccgatatcctcttaagccacctgcattatttacgggagaccccgctccctcacctcacttctgatgatgtggataaggctctgcagaactcccccaggctgatgcacgctcggaacaccgggggcgctgcattcattttccctaatactagcgtgtaccccgaagctacacagcggatcactacccggccagatctcccatacgagccgccaaggcgtagcgcttggacaggacatggccaccccaccccacagtccaaagcagcccagccttctcctagcactgtgcccaaaacagaagaccaaagaccccagcttgatccgtaccagatcttaggtccgactagtagtcgacttgcaaaccccggcagcggacagatccagctgtggcagttcctgctcgaactgctgagtgacagctcaaatagctcatgtataacatgggaggggacaaacggtgaattcaagatgaccgatcccgacgaagtggctagaaggtggggggaacgtaagtcaaaacctaatatgaattacgataagctctcaagagcgctgcgttactactacgataagaacatcatgactaaggtgcatgggaagcggtatgcctacaaattcgactttcacggtatcgcccaggctctacagccacatccccctgagtcatccctctacaagtatccatccgatctcccctacatgggttcctatcacgcgcacccgcaaaagatgaacttcgtggcccctcacccaccagctctgcccgtgaccagcagcagcttctttgccgctccaaatccttactggaattcaccaaccggtggcatctacccaaacacgagactaccaacgagccacatgccgtcccacctgggtacctactattag

SEQ ID NO: 17954 - DNA, 1461 bp, Artificial Sequence
  Description of Artificial Sequence: Synthetic coding sequence
atgatccagacagtaccagatcctgcagctcatattaaggaagccctgagcgtcgtgagcgaggatcaaagtctgttcgaatgcgcatacggcaccccacacttagctaagactgagatgacagcatcatcatccagtgattacggccagacgtctaagatgagccccagagtgccccagcaggattggctaagccagcccccagccagagtaaccatcaagatggagtgcaatccaagccaggtgaatgggagccgcaattcacccgacgaatgttcagttgctaaaggaggtaaaatggtaggatccccagacacagtgggaatgaactatggttcctatatggaagagaaacacatgccgccacctaatatgactacaaacgagcgcagagtcatcgttcccgcagacccaactctatggtccacagatcacgttcgacagtggctggagtgggccgttaaggaatacggcctgccagatgtgaacatcttgctttttcagaacattgacggtaaggaactgtgcaagatgaccaaggacgactttcaacgactgacgccgtcttataacgccgacatcttgctgtcccatctacactacctccgcgagactcccttgccccatctgaccagtgatgacgtggacaaggctctgcaaaattcgcctcgtctaatgcatgctaggaacaccggaggcgccgcttttattttcccaaatacaagcgtctatccagaagccacacagcgcattactactcgtccagaccttccttatgaaccaccccgtagaagcgcttggactggccacgggcaccctactccacagtcaaaagcagctcagccttccccttccaccgtcccgaaaaccgaagatcagcggccccaattggatccataccagatcctgggcccaactagcagcagacttgccaaccccggcagcggacaaatacagctttggcagtttctccttgaattactgtctgactctagcaacagttcatgcatcacctgggagggcactaatggcgagtttaaaatgacggaccccgacgaagtcgctaggaggtggggggagagaaaatccaagcccaacatgaactatgacaaactctctagggcattacggtactactatgacaaaaacattatgactaaagtgcatggtaaacgatatgcatataagttcgactttcacggcatcgcccaggccctccagccccacccgcctgagtccagtctttacaagtacccatctgatctaccttatatgggatcctatcacgcgcacccgcagaagatgaactttgtagcacctcacccgcctgcactgccagttacctcctcctcatttttcgctgcccctaacccgtactggaactcccctaccggtggaatttaccccaacacccgactccccacatcacacatgccaagtcatctgggcacgtattattag

SEQ ID NO: 17955 - DNA, 516 bp, Artificial Sequence
  Description of Artificial Sequence: Synthetic coding sequence
atggcgtctacaatcaaagaagccctgtccgtggtaagcgaagatcagtctctctttgagtgcgcctacgggaccccgcacctagcaaaaactgagatgactgctagctcgtccagcgactacggacagacaagcaagatgagcccccgtgtgcctcagcaggactggttgagccagccccctgcgcgggtgactatcaaaatggaatgcaatccatctcaggtaaacggcagtcgcaattcaccggacgagtgttcagtcgccaagggtggcaagatggtgggatctcccgacacagtgggcatgaattatggatcctacatggaggagaagcacatgcccccaccgaacatgaccacaaacgaaaggagggtgattgtccctgctgatctgccctatgaacctcctaggaggtctgcttggacaggccatggccaccccactccccagagcaaggggacggtcttggctcctatgacgttgtcgtttatgtctcaggctgtggacgattgttag

SEQ ID NO: 17956 - DNA, 1389 bp, Artificial Sequence
  Description of Artificial Sequence: Synthetic coding sequence
atgattcagaccgtccctgacccagccgcccacattaaggaggccctgtccgtcgtgtcagaagatcagagtctctttgagtgtgcatacggcaccccccatttggcaaagacagaaatgacagctagttcttcgtccgattacggccagacaagcaagatgagtcctagggtgccacagcaggattggttgtctcagccccccgctcgggttactatcaaaatggaatgcaaccccagtcaggtgaatggctctcgcaacagcccagatgaatgctctgttgcgaaggggggcaagatggtgggaagccccgacacagtgggcatgaactatggatcctacatggaggagaaacacatgcctccaccaaacatgacgacgaacgaacgtcgcgtgatcgtgccggcagaccccaccctttggtcaactgaccacgtgaggcaatggttagagtgggccgtgaaagaatacggactgccggacgtcaacattctcctcttccagaatatcgatgggaaagagttgtgtaagatgactaaagacgacttccagcgcttaacacctagttacaatgcagacattctgttaagccatcttcactacttacgagaaacgcctctgccacacctgacgagtgatgatgtggacaaggcactgcagaacagccctcgcttgatgcacgcaaggaatacagatcttccgtacgagccccctcgtcggagcgcatggaccgggcacggtcaccctacaccccagagtaaggctgctcagccgtccccttcaacagtaccgaagaccgaagatcagaggcctcaactagatccttaccagattctggggcccaccagctctcgcttagccaaccctggcagtggccagattcagctttggcagtttcttctggagctgctgagtgactcctctaactcaagttgtataacgtgggaagggacaaacggcgagttcaagatgacagacccggacgaggtagcccggcggtggggcgagaggaaaagtaagccgaatatgaactacgacaagctgagcagagcgctgcgctactactatgacaaaaatatcatgacaaaggttcacggtaagcggtacgcatacaaattcgattttcacggaattgcccaagcgctgcagcctcaccccccggaatccagtctctataagtatccctcagatttaccctatatgggttcataccacgcccatccccagaagatgaactttgtcgcaccccacccccctgcgctgccggtgactagctctagcttttttgccgcgccaaatccatattggaactccccaaccggcggcatctatccaaacacgaggctgcccaccagccatatgccttcccatctgggcacctactactag

SEQ ID NO: 17957 - DNA, 1164 bp, Artificial Sequence
  Description of Artificial Sequence: Synthetic coding sequence
atggtcggcagcccagataccgtcggcatgaattacggaagctacatggaagaaaaacatatgccccctccaaatatgacgaccaacgagcggagggtaattgtcccagcagatcccaccctgtggtcaacggaccatgtgagacaatggctcgagtgggccgtaaaagagtatggcctgcccgacgtgaatatcctcctctttcagaatatcgatgggaaagagctgtgcaagatgacaaaggacgacttccagagactgacgcctagttataatgctgatatactcttgagtcatcttcactatctcagggaaactcccctgcctcacctgacatctgacgatgtagacaaggcactacaaaactcacctagactaatgcacgcccgcaatactggtggcgcggcctttatattccctaatacgtctgtgtaccccgaagccacccagaggataacaactcggccggacttaccgtacgagcccccaagaagaagcgcttggactggacacgggcaccctactccacagagcaaggccgcccagcccagcccctcaaccgttcctaagactgaagatcagcggcctcagctcgacccctatcaaatcctggggcctacaagttcccggctggcgaaccccgggtcgggccaaatacagctgtggcagttcctgctggaactgttgtcagactcttcaaactcatcctgtataacatgggagggaacaaacggtgagtttaaaatgactgatcccgacgaagtggcgagaaggtggggggagagaaaatcaaaaccaaacatgaattacgacaagttaagccgagccctccggtattattatgacaaaaacattatgactaaggtccacggtaagcgttacgcttacaagtttgactttcatggcattgctcaggcactgcagcctcatccccccgagtcttctctttacaagtatccttcagatctcccctatatggggtcatatcacgcccacccccagaagatgaattttgtggcgccccacccccctgccttacctgtcacatcttcaagcttctttgcagcccctaacccctactggaatagtcccacaggaggcatctaccccaacacccgcttgccaactagtcatatgccaagtcatctggggacatattactag

SEQ ID NO: 17958 - DNA, 1410 bp, Artificial Sequence
  Description of Artificial Sequence: Synthetic coding sequence
atgaatgatttcgggattaaaaatatggatcaggtggcgcctgtggcgaattcttataggggaaccctgaagcggcaacctgcatttgatacttttgacgggagcctgtttgctgtgttcccatctctcaacgaagagcaaacgctccaggaggtgcccacaggacttgacagcatctcccacgacagcgccaattgtgaattaccattgttaacgccttgttcaaaggctgtgatgtcccaggctcttaaagctacctttagcggcttcaagaaggagcagagacgcctggggattccaaagaatccatggctgtggagcgagcagcaagtctgccagtggctcctgtgggccaccaatgaattctctctggttaatgtaaatctgcagcgctttggtatgaatggacaaatgctgtgtaatctgggaaaagaaaggtttcttgagctggcacccgacttcgttggagacattctctgggagcatctggagcaaatgatcaaagagaatcaggaaaaaaccgaggatcagtacgaggagaactctcatttgacttcagtgccgcactggattaatagcaatacacttgggttcggcacagaacaggccccttacgggatgcagacgcagaattaccctaagggcgggctccttgacagcatgtgcccagcgtccacaccaagtgtcctcagtagtgagcaggagttccaaatgtttcctaagtcccggctgtccagcgtgtcagtaacatactgctctgtgagtcaggacttccccgggagcaatttgaacctgctgaccaataactccggaactccaaaagatcatgatagtccagagaatggcgcggattcttttgagagctctgactccctactccaaagctggaatagtcagagctccctattagacgttcaacgagtgcccagctttgaatcttttgaagacgattgctctcagtcgctgtgcttaaacaaacctaccatgtcattcaaggattatattcaggagaggtcagaccctgtggaacaggggaagcctgtcatccccgccgccgtattggcagggttcacaggtagcggtcccatacagttgtggcaatttctgttagagttgctgagcgacaaatcatgccaaagttttatatcatggaccggcgatggatgggagttcaaattggctgacccagatgaggtagcacgtaggtggggaaaacgaaagaacaagccaaaaatgaactacgagaagttaagccgggggctgagatattactacgataaaaatatcatccataaaacatccggtaaaagatatgtctatcgatttgtttgcgacctgcagaatctcctgggctttactcctgaagagctgcacgctatcttgggggtccagcctgacacggaggattag

SEQ ID NO: 17959 - DNA, 1410 bp, Artificial Sequence
  Description of Artificial Sequence: Synthetic coding sequence
atgaatgactttggcatcaaaaacatggatcaagtggcacctgttgcgaatagctatagggggaccctgaagaggcaacccgctttcgacacctttgacggcagtctgtttgccgttttcccttctctgaacgaggaacagacactgcaggaggtgcccaccggtctggactccatctctcacgactccgccaactgtgagctgccattgttgaccccctgcagcaaagccgtgatgtctcaggcactcaaggccactttcagtggattcaagaaagaacagcggcgcctggggatcccaaaaaacccatggctctggtccgagcaacaggtgtgccaatggctactgtgggccaccaacgagttttctctggtgaacgtcaatctccagcgctttgggatgaatggccagatgctgtgtaatttgggcaaggagcgctttctggaactcgcccccgatttcgtgggcgatatcctttgggagcacttagagcagatgatcaaggagaaccaggagaagactgaggatcagtacgaggaaaacagtcaccttacttcagttcctcattggattaatagcaacactcttgggtttgggacggaacaggccccgtacggcatgcaaacgcagaattatccgaaagggggtttgctggattccatgtgtcctgccagcacaccctccgtcctctcttccgaacaggagttccagatgttcccaaagagccgactgtccagtgtgagcgtcacatattgcagcgtatctcaagattttcccggcagtaacttaaacctgttgactaataactctggaacacccaaagaccatgattcaccagagaatggagccgacagctttgaaagttccgactctctgcttcagtcatggaacagccagtcctctttgttggacgttcagcgcgtgcccagtttcgagtcatttgaggatgactgcagccagagcctgtgtctgaataagccgacaatgagtttcaaagattacattcaggagcgcagcgatcctgttgaacagggcaagcccgttatcccagccgccgtgcttgctggatttactggatctggcccgattcagctgtggcagtttcttctggaactcttgagcgacaagtcctgccaaagttttatctcttggactggcgatggctgggagtttaagctcgccgaccctgatgaggtggcccggagatgggggaagcgcaaaaacaaacctaaaatgaactacgagaaactttcacgtggactccgttattactatgataaaaatatcatccataagacgtccggaaaaaggtacgtgtataggtttgtctgcgatctgcagaatctcctcgggttcacaccagaagagctgcatgctattctgggggttcagcccgacaccgaagactag

SEQ ID NO: 17960 - DNA, 507 bp, Artificial Sequence
  Description of Artificial Sequence: Synthetic coding sequence
atgaatgatttcggtatcaaaaatatggatcaggtggcaccagtggcaaattcttaccggggcactttaaagaggcaacctgcctttgacaccttcgatggctcactgtttgccgtgttcccgtccctgaatgaagagcagactctgcaggaagtccccaccggtctcgactcgattagccatgattccgctaattgcgaattgccgctgctaaccccttgctctaaagcagtgatgagccaggctctcaaggcaaccttctcgggcttcaaaaaggagcagcggaggctcggcatccccaaaaacccgtggctgtggtctgagcaacaggtctgccagtggctgctctgggctacgaatgagttttcccttgtaaatgtaaacctacaacgtttcgggatgaacggacagatgctgtgtaacttggggaaagaacgtttcctcgagctagctcccgatttcgtgggtgacattttgtgggagcatctcgaacagatgatcaagtag

SEQ ID NO: 17961 - DNA, 813 bp, Artificial Sequence
  Description of Artificial Sequence: Synthetic coding sequence
atgaatgatttcggcatcaagaacatggaccaggtggctcccgtcgctaattcttatagaggaactctgaagagacagcccgcattcgatacatttgatgggagcttattcgcagtgtttcccagcctgaacgaggagcagactttgcaggaagtgccaacaggcttggatagtatctcacacgacagtgccaactgcgagttaccattactcactccatgcagcaaggctgtcatgtcccaggcactcaaagccaccttcagcgggttcaagaaggagcagcgaaggctgggcattcctaagaacccttggctctggagtgagcagcaggtgtgtcagtggcttttgtgggctacaaacgaattcagtttggtgaatgtgaacctccagagatttgggatgaacggccagatgttatgtaacctgggaaaggagcggtttctagaactggcacccgacttcgtcggtgacatcttgtgggaacacctggaacagatgataaaagagaatcaggaaaaaaccgaggatcaatatgaggagaattcgcacctgacatccgtcccacattggattaactctaacaccctaggctttggaaccgagcaggccccctacggaatgcagacgcagaattatccgaaagggggcctgttggactctatgtgtccagccagtacccccagcgtgctgtcatctgagcaggagtttcagatgttccccaagagcaggttgtcttcagtctctgtcacctactgctccgttagccaggatttccccggcagcaacctgaatctccttaccaacaactcctag

SEQ ID NO: 17962 - DNA, 570 bp, Artificial Sequence
  Description of Artificial Sequence: Synthetic coding sequence
atgacagagtacaaacttgtagtcgtcggagctggcggcgtcggcaagtccgccctgacaatacaacttatccagaatcacttcgtagacgaatacgaccctacaatagaggactcctacagaaagcaagtggttattgacggggagacttgcctgctggatatcttagacacagcagggcaagaagagtactctgccatgcgcgaccaatacatgcggacaggagaaggtttcctttgtgtgtttgcgatcaacaatacgaagagttttgaagacatacaccaatatcgcgaacaaataaagagggtaaaggatagcgatgatgtccctatggtgttggtggggaacaaatgcgatctcgctgcccgcaccgtcgagtctcggcaagcgcaggatctggcccggagctacggcattccatacattgagacctcagctaaaaccagacagggggtggaagatgccttttataccctggtgagggagatccgtcaacataaattacgaaagctcaacccccctgatgaatcaggcccaggctgtatgtcttgcaagtgtgtcctgagctag

SEQ ID NO: 17963 - DNA, 513 bp, Artificial Sequence
  Description of Artificial Sequence: Synthetic coding sequence
atgaccgagtacaaacttgtcgtcgtcggggcagggggagttgggaagtccgctttgaccattcaactgattcagaatcacttcgtggacgagtacgatcccaccatcgaggactcttaccgcaaacaagtggtaattgacggggagacctgtctcctggatattctggataccgctgggcaggaggagtactcagcaatgcgcgatcagtatatgaggacaggagagggatttctctgtgtcttcgctataaataatacaaaatcttttgaggatattcatcagtaccgcgagcaaatcaaacgcgtgaaggattcggacgatgtgcccatggtgctggtcggtaataaatgtgatctcgcagcgcgaaccgttgaatctaggcaagctcaggacctggcgcgatcatatgggattccatacatcgaaacctctgccaaaacacggcaaggatcccgctcagggtcaagctcctccagtggtacactgtgggacccgcctggacctatgtag

SEQ ID NO: 17964 - DNA, 570 bp, Artificial Sequence
  Description of Artificial Sequence: Synthetic coding sequence
atgaccgaatacaagctggttgtggtgggtgctgggggtgtgggaaagagcgctctcactattcagctcatacagaaccatttcgttgacgagtacgatccaaccattgaagacagctatcgcaaacaggtcgtgatcgatggagagacttgcctgctagatatattggacacagctggacaggaagagtactccgcaatgagggatcagtacatgcgcactggggagggctttctctgtgtttttgccataaacaataccaagtccttcgaagacattcatcagtatagggagcagatcaagagagtcaaagactccgacgacgtgcctatggttcttgtgggaaataaatgtgacctcgcagcgagaaccgtagaatcccggcaggcccaggacctggctcgttcttacggcataccgtacatagaaacgtcggctaaaaccagacagggagttgaggacgccttttataccctggttcgcgaaatcaggcagcacaaactaaggaagctcaaccctccagacgagagcggccccggttgcatgagttgtaagtgcgtcttgtcctag

SEQ ID NO: 17965 - DNA, 513 bp, Artificial Sequence
  Description of Artificial Sequence: Synthetic coding sequence
atgactgaatacaaattagtggtggtgggggcaggcggggtgggtaagtccgccctcaccattcagctgattcagaaccactttgtggacgagtatgaccccaccattgaagactcctatagaaaacaagttgtcatcgacggcgagacctgccttttggatatcctcgatactgccgggcaagaagaatatagcgcaatgcgagaccagtacatgcgaaccggcgagggcttcctctgcgtatttgcaatcaacaatacaaagagtttcgaagatatacaccagtaccgagagcagatcaagcgggtgaaggattctgacgacgtccccatggttctcgtcggaaacaagtgcgatctcgcagcccggactgtggagagcaggcaagctcaagacctggcgcggagctatggaatcccctatatcgaaacctccgctaagactagacaggggtctcgtagcggatcatcttccagttcaggaacactctgggatcctcctggcccaatgtag

SEQ ID NO: 17966 - DNA, 570 bp, Artificial Sequence
  Description of Artificial Sequence: Synthetic coding sequence
atgacagagtataaactggttgtagtcggggcgggcggagtgggtaaatcagccctaacaattcaactcattcagaaccacttcgtggacgagtacgatccaaccatcgaagactcataccgaaaacaggtggtgattgacggggagacctgccttctggatatcctggacactgcaggccaggaagaatacagcgctatgcgcgatcagtatatgagaacgggcgagggttttctgtgtgttttcgctatcaataacacaaaatcctttgaggatatccaccaataccgtgaacagataaagagggtgaaggattctgatgacgttcccatggtcctagtgggaaataaatgtgatctggccgcccggacagtggaatctcgccaggcacaggacctggccagatcctacggcatcccatacattgaaacttccgccaaaactcggcagggagtcgaggatgccttctataccctcgtaagggagataagacagcacaaactccgcaagctcaatccccctgacgaaagtggccccgggtgcatgtcttgtaaatgcgttctatcttag

SEQ ID NO: 17967 - DNA, 513 bp, Artificial Sequence
  Description of Artificial Sequence: Synthetic coding sequence
atgactgaatacaaactcgtggtggtcggcgctggtggagtggggaagtctgcactaacaattcagctcattcagaaccactttgtggatgaatacgatcccaccatcgaggattcatatagaaagcaggtagtcattgacggggaaacctgtttgctggatattctcgatactgccgggcaggaagaatacagtgccatgcgggatcagtacatgcgcaccggagaaggtttcctgtgtgtgttcgcaattaataacacgaagagctttgaggacattcatcagtatagggagcagattaagagagtgaaagactcggacgacgtgccaatggtactggtggggaacaaatgcgatcttgcggcgagaacagtggagagccgtcaagctcaagacctggcgaggagctacggtatcccttacattgagacctccgcaaagacacggcaagggtctagatcaggtagtagttcctcaagtggaaccttgtgggatccccccggacctatgtag

SEQ ID NO: 17968 - DNA, 609 bp, Artificial Sequence
  Description of Artificial Sequence: Synthetic coding sequence
atgttgcccccgggcactgctacactcctgacactgcttctggcagcgggcagcctaggccagaaaccccaacgaccacggcgcccagcttcacctatcagtaccatacaacccaaagccaattttgacgcccagcagtttgccgggacttggctgttggtggcagttggtagtgcctgtagatttctccaggaacaagggcacagggctgaggctactacattgcatgtggctccacagggtactgcgatggccgtctccaccttcaggaagttggacggaatttgctggcaggtccgccagctctatggggatacaggcgttctgggccggtttttactccaggcccgggatgcgcgcggtgcagtgcacgtggtcgttgctgaaacagactatcagtcgttcgcggtgctctacctcgagagagcggggcagctgagcgtaaaactgtacgctagatccctgcccgtcagtgatagcgttttatctggtttcgagcagcgagtccaggaggcccatctgactgaggaccaaatattctacttcccaaaatacggtttttgtgaagccgccgatcagtttcatgtcctcgacgaggtccgcagatag

SEQ ID NO: 17969 - DNA, 522 bp, Artificial Sequence
  Description of Artificial Sequence: Synthetic coding sequence
ggattcctcgttccgctgtggctgatgaggaattgtttcagacttcaagaagaaatgttacagagagaagaggctgagaatacgttacagagcttccgccaagacgtggataacgcatccctcgccaggctggacttagaaaggaaggtcgagtccttacaggaagagatcgcgttcctgaagaagttgcacgaggaagagattcaggaactccaagctcagattcaggaacagcacgtccaaatcgatgtggatgttagcaaacccgatttaactgcggcattgcgcgacgtgaggcagcaatatgagtccgtggcagccaagaatcttcaagaggccgaggaatggtacaagtccaaattcgccgacctctccgaggcagccaatcgtaataacgacgccctcagacaagcgaaacaggaaagtaccgagtatcgccgacaagtgcagagcttgacctgcgaagttgacgcccttaagggcacagtcagcaccaatccagccgttaaagagggaaagtag

SEQ ID NO: 17970 - DNA, 687 bp, Artificial Sequence
  Description of Artificial Sequence: Synthetic coding sequence
atgcgaaactgttttaggctgcaggaggagatgctgcagcgggaagaggcggagaacaccctccagagctttaggcaggacgttgataatgcctccctcgccaggttggatctggaacggaaggttgaaagcctccaggaagagatagcgttcctgaaaaagttgcacgaggaagagatacaagaactccaagctcagatccaggagcaacatgtacagatcgatgtcgacgtgtccaagccagatttgaccgcagcgctgcgggacgtccgtcaacagtatgaatcggtcgcagccaaaaatttgcaggaggccgaggagtggtataagagcaagtttgccgacctaagcgaagcagccaacaggaacaacgacgctctgaggcaggcaaagcaggagtcaactgagtaccggcggcaggtgcagtcccttacttgcgaagttgacgcccttaaaggaactaacgagagcctggaacgccagatgagagagatggaagaaaatttcgccgtggaagccgctaattatcaggataccatcgggagattgcaggatgagatccaaaatatgaaggaggagatggcacgacatctgagggaataccaggatctcctgaacgtaaaaatggcgctcgatatcgaaattgctacataccgcaagctgctggaaggggaggaatcccggtag

SEQ ID NO: 17971 - DNA, 1296 bp, Artificial Sequence
  Description of Artificial Sequence: Synthetic coding sequence
atgagcacgcgcagcgtgagtagctccagttatcgacgtatgttcggtgggccagggaccgccagcagaccttcctcttctaggtcgtacgttacaacaagcacacgcacatattccttgggttccgctctgaggccatctaccagtaggagcctctacgccagtagtccagggggcgtctatgcaacccgttcttctgcagtgagactgagaagttctgtcccgggcgtgagactgctgcaggacagcgtggattttagtttggcggacgccatcaatacggaatttaaaaacactagaactaacgagaaggtcgagctgcaagaactgaatgaccgcttcgctaactacattgataaagtaagatttctcgagcagcagaataaaatactccttgctgagcttgagcagcttaaagggcagggaaaatctcgtttgggcgacttatatgaggaggagatgagagagcttaggaggcaagtggaccaactcacaaatgacaaggcccgggttgaagtggagcgggacaacctggctgaagatataatgcgtctacgcgaaaagctgcaggaggaaatgctccagagggaggaggccgaaaacacgctacaatctttcagacaggacgtggataatgcctcactggcccgcttggacctggagcggaaggtggagagtctgcaagaagaaatcgcatttctcaaaaagctgcatgaagaagaaatccaggagctgcaggctcaaatccaggaacagcatgtgcagattgatgtggatgtctctaagcccgacctgacagctgcacttagagatgtgcgtcagcagtatgaaagcgttgcagcaaaaaatctccaggaagccgaggagtggtacaaatcgaagttcgctgacctatccgaggcagctaatagaaataatgacgcgctaagacaggcgaagcaggagagtacagagtacagaagacaggtgcagtcgctgacgtgtgaagtagatgcactgaaaggtacaaacgagagtctagaacgccagatgcgggagatggaggagaatttcgctgtggaggccgcaaattaccaggacacaatcgggaggcttcaggacgaaatccagaatatgaaggaggagatggccagacacctgagagagtatcaagacttactcaacgttaaaatggccctggacatcgaaattgccacttaccgaaagttgctggagggcgaggagagccgtatctcccttcccctgcctaacttcagttcactgaatcttagaggcaaacactttatcagcttatag

SEQ ID NO: 17972 - DNA, 1401 bp, Artificial Sequence
  Description of Artificial Sequence: Synthetic coding sequence
atgtccactagatccgtgtctagctcttcatacagaagaatgttcggaggcccaggtaccgcatctagacctagtagctcacggtcttatgttaccactagcacaaggacgtactccctgggtagcgccttgagaccctctacctccagatcactctatgcgtcatcccccggaggagtttacgctactcggtcctccgccgtgagactgagatcatccgtcccaggagtccggctgcttcaggacagcgtggactttagcctggccgacgctatcaatactgaatttaagaacacccgcacgaacgagaaggtagagttacaagaactgaatgatcgcttcgcgaactatattgacaaggtccgttttctggaacagcagaacaaaatcctcctggccgagctggaacaacttaaaggccaggggaagtcaaggctgggagacctttacgaggaggagatgagggagctgcgcaggcaggtggaccagctcacaaatgacaaagcacgagttgaagtggaacgggataatctggcggaggatatcatgcggctgagagagaagctgcaagaggagatgctccagcgggaagaagccgagaacaccctccagagctttcggcaggatgtcgataatgccagtcttgctcgactggacctggagcgaaaggtcgagtctcttcaggaggagattgcttttcttaaaaaattgcacgaggaagagattcaggaactacaggctcagatccaggagcagcatgtccagattgacgttgatgtgtctaaacctgatctcacagctgctctgcgcgacgtgaggcagcaatatgaaagtgtagcagccaagaacttgcaagaggccgaggaatggtacaaatcaaaattcgcagatctctccgaagctgcaaaccgtaacaatgacgccttgcgccaggcgaagcaggagtctacagagtatcggcgccaggttcagtcgctgacctgcgaggttgatgctctgaaaggcaccaatgagtctctcgagcgacagatgcgagagatggaagaaaacttcgccgtcgaagccgccaactaccaagatacgatcggaagacttcaggacgagatacaaaatatgaaagaagagatggcccgtcatctgcgagagtaccaagacttattaaatgtcaaaatggctctggatattgaaattgcaacctaccggaagttgctggagggggaggaaagtagaatttcattgcccttaccaaacttctctagcctgaatctgcgtgagacaaatttggactcactgcccctggttgatacccacagcaaaaggacgctgctgatcaagacggtggaaacacgggatggccaggtgatcaacgagactagccagcaccatgatgacttggaatag

SEQ ID NO: 17973 - DNA, 1224 bp, Artificial Sequence
  Description of Artificial Sequence: Synthetic coding sequence
atgttcggagggccaggtactgcttcacgacctagctcttccaggtcctacgtgaccaccagcacaaggacatattctcttggaagtgctctccggccatcaacttctcgatcattatatgcgtcgtcaccgggaggagtctacgccacgcgttcatctgcggtacgattgcgttcctccgttccaggcgtgcggctgcttcaggattccgtggacttttccttggccgatgccattaatacagaattcaaaaacactcgcactaacgaaaaggtggagctgcaggagctaaacgaccgatttgccaattatatagataaggttcggtttctggaacaacaaaacaagattctgttggctgaattggaacagctgaaaggccagggcaagagcaggctaggcgacctttatgaggaggaaatgcgggagctgcggagacaggtcgaccaactaacgaatgataaagctagagtggaggtggaacgagacaatctcgccgaagatattatgcggctcagagaaaagttgcaggaagaaatgctccagagggaagaagctgagaataccctgcaatccttcagacaggatgtggataatgcgtccttggcccggctagacctagagcgcaaggttgagtcgctccaggaagagatagcctttttaaaaaagctccacgaagaggaaatccaggagctgcaggcccagatacaagagcaacatgtccaaattgatgtggatgtaagtaaaccagatctgacagcggctttacgggacgtaagacagcagtatgagtccgtggcagcgaagaatctccaagaagcagaagaatggtataagtcaaagttcgcggacctatccgaggccgccaataggaataatgacgccctccgccaggcaaagcaggaaagcaccgagtatcgaagacaggtgcagtcgctgacatgtgaggtggatgcattgaaaggcaccaatgagtctctagaacgccagatgagagagatggaagaaaactttgctgtggaggccgctaattatcaagatactatcggccgcctgcaggacgagatccagaacatgaaggaggaaatggcacggcacttaagggagtaccaggatctccttaacgtgaagatggctttagatattgagattgccacataccgcaagctgctcgaaggtgaagagagtcgaatcttgtgtctgttccagaccttcccaccttag

SEQ ID NO: 17974 - DNA, 2256 bp, Artificial Sequence
  Description of Artificial Sequence: Synthetic coding sequence
atggaagatctgtcctcaccagatagcacacttctgcagggcgggcacaacctgttgtcatcggcctccttccaagaagccgtgacttttaaagatgtgattgtcgacttcactcaagaggagtggaaacagttggaccctgggcagagggatttgttcagggacgtaactcttgagaactacacgcatctggtctcgataggactgcaagtgagcaagccagatgttatttcgcagttggagcagggaactgaaccctggattatggagccctctatacctgtaggcacttgcgccgactgggaaactagactggaaaacagcgtttccgcccccgaacccgatattagtgaggaggagctgtcacccgaagtcatagttgaaaagcacaaacgggatgattcctggagctccaatctgctggagagctgggaatatgagggctccctagagcggcagcaggctaaccagcagacactccccaaagagatcaaagtaaccgagaaaacaattccctcctgggagaaaggcccggtaaacaacgagtttggtaagtcagtcaatgtatcctccaatcttgtaactcaggagccaagtcctgaagaaacctccacaaagcgatccattaaacaaaacagtaatcccgtgaaaaaagaaaaatcctgtaagtgtaatgagtgcggaaaggccttcagctactgtagtgccctgataaggcaccaaagaactcatacaggggagaaaccatacaaatgcaacgagtgcgagaaagcattttcccgaagcgagaatctgataaaccaccaacgcatacacactggcgacaaaccctacaaatgtgaccagtgtggaaaggggtttatcgaaggcccatctcttacccagcatcaacgaatacacacaggggaaaagccttataagtgtgatgagtgcgggaaggctttcagccagaggacgcacctggttcaacatcagcgcatacatactggcgaaaaaccatatacctgcaatgagtgtggtaaggccttttcccagcgggggcatttcatggaacatcagaagattcacacaggtgagaagcccttcaagtgtgacgagtgcgacaaaacctttacgcgctcaacccatctcactcagcaccagaaaatacatacaggagaaaaaacatacaagtgcaacgagtgcggtaaagctttcaatgggccctcaaccttcattaggcatcacatgatccatacaggggagaagccctacgagtgtaacgagtgtggaaaagccttttcacaacactcaaatttgacgcagcatcagaagacacacacgggcgaaaaaccgtatgattgtgccgagtgtggtaagtccttttcctactggtccagtctcgcgcagcacctcaagattcacaccggagagaagccctataagtgcaacgaatgtggtaaggctttttcttattgttcgtccctgactcagcaccgccggatccacacccgggagaagccatttgaatgttctgagtgtggaaaggcattttcttacctgtctaaccttaatcaacatcaaaagactcatactcaggagaaggcatacgagtgcaaggagtgcggaaaagcttttattagaagtagctcgctggcaaaacacgaacggattcacacaggagagaagccataccagtgccatgaatgcgggaaaactttcagttacggcagcagcctgatccaacaccggaagatccacaccggcgagcgcccgtataaatgcaacgaatgcggcagggccttcaaccagaacatccatcttactcaacacaagaggatccacacaggggctaagccgtacgaatgtgcagaatgtggtaaggcttttagacactgttcatccctagctcaacatcaaaagacccatacagaagagaagccttatcagtgtaataaatgcgaaaaaactttttctcaaagctcacacctcacccagcaccagagaattcacactggcgaaaaaccctataagtgcaatgaatgtgacaaggccttctcccggagtacccatctgaccgaacaccagaacacccacaccggcgaaaaaccatataactgtaacgagtgcagaaaaacctttagccagtccacatacttgatccagcaccagcgcatccatagtggagaaaagccattcggctgcaacgactgcgggaaatcctttagataccgtagtgctctgaacaaacatcaaagactacaccctggaatctag

SEQ ID NO: 17975 - DNA, 3201 bp, Artificial Sequence
  Description of Artificial Sequence: Synthetic coding sequence
atgccagtgtttcacaccagaaccatagaatctatcttggaacccgtggctcagcaaataagtcatcttgttataatgcacgaggagggcgaagtggacggaaaggctattccagatctgactgcaccggtggccgccgttcaggccgccgtgagcaatctcgtcagagttggaaaggagaccgtgcagactacggaagatcaaatcctgaaaagagacatgcctccggctttcatcaaagtagagaacgcctgtaccaagctcgtgcaggccgctcaaatgctacaatcggacccttacagtgttccggcccgcgactacctcatagatggcagcagaggcattttgagcgggacgtccgatttacttttgaccttcgacgaggccgaagtgcggaaaattattagggtctgtaaaggaattcttgaatacttaacagttgccgaagtcgttgagactatggaagatctggtgacatatacgaaaaaccttgggcctggaatgacgaagatggcaaaaatgattgacgagagacagcaggagctgacgcatcaggagcatagagtgatgcttgtgaattctatgaatacagtgaaagagctgctgcctgttttaatttcagccatgaaaatcttcgtcacaaccaaaaactccaagaatcaggggattgaggaggccttgaaaaaccggaactttaccgtcgaaaaaatgagcgctgaaatcaacgaaatcatccgcgtgctccagctgacatcctgggatgaggacgcatgggccagcaaagatacggaggctatgaaaagggccttggctagcattgactctaagttaaaccaagccaagggctggctgagagatccgtccgcttcaccgggtgacgcaggcgagcaggccattcgccagatccttgacgaagccgggaaggtaggcgagctctgcgccgggaaagaaaggagggagatactgggcacgtgtaagatgttagggcaaatgacagatcaggttgccgatctgcgagccagaggtcaggggtcctctccggtggccatgcagaaggcacagcaagtgtcacaggggctcgatgtcctgactgcgaaggttgagaatgcagcgaggaaactggaagccatgaccaatagcaagcagtcaatcgcgaaaaagatcgatgccgcacagaactggttggcagatcctaatgggggccccgagggagaagaacagatcagaggcgccctggctgaagctcgcaagatagcggagctgtgtgacgaccccaaggagcgcgacgatatcctcagaagcttgggggaaatcagtgctttaacctctaagctggccgaccttcggcgtcagggaaagggcgattcacccgaagctagggccctagccaagcaagttgccactgcactgcagaacttgcagactaaaaccaaccgcgcggtcgctaattcccgcccagctaaggctgcggtgcatctggagggaaagatcgagcaagctcagagatggatagacaaccctacagtggatgacagaggcgtgggacaggcggctataagaggactcgtggctgaaggacacaggctggctaacgtgatgatgggtccctacaggcaggacttgttggccaagtgcgaccgggtggatcagttgacagcccagcttgcagacctggctgctagaggagagggagagtcacctcaggcaagagccctggcctcacagctccaggattctcttaaggacctaaaggcccgaatgcaggaagcgatgacccaagaggttagcgacgtgtttagcgatacgaccaccccaataaagttactcgcagtggccgccactgctccccccgacgctcccaacagggaggaggtcttcgatgaaagggccgccaacttcgagaatcatagtgggaagctcggtgctacagcagaaaaggcggcggccgttggaactgccaataaatctaccgtggagggtatacaggcttcagtcaagactgcccgcgagctcaccccacaagtggtcagtgccgccagaattttgctccgtaacccaggcaatcaggcggcatatgaacattttgaaactatgaaaaaccagtggatagacaatgtggaaaaaatgacaggactagttgatgaggcaatcgatactaagagtctgttagacgcgagtgaagaggcaattaaaaaggatctcgataaatgtaaggttgccatggcaaatattcagcctcagatgttggtggctggagctacttctattgctcgaagagcaaaccgcatccttctcgtggccaagcgagaggtggaaaacagcgaggatcccaagttccgggaggccgtaaaggctgccagtgatgaactgagcaagaccatttcaccaatggtgatggatgccaaggccgttgcaggcaacatttcggacccaggactgcagaagtctttcttggacagcggatatcgcatcctgggggccgtcgcaaaagtgcgggaggcattccagccccaggagccggacttcccccccccacctcctgacctagagcagctgaggttgaccgatgaattagcccctcccaagcctccacttccagagggggaagtaccacctccaaggcctcctccccctgaagaaaaagacgaggagttcccagagcaaaaggctggtgaggtcatcaatcagcctatgatgatggcggcacgccaactgcacgacgaagcccgaaaatggagcagtaaaggcaacgatataatcgcggcggctaaacgcatggccctgttgatggcagaaatgagcaggctcgtacgggggggatcaggcacaaaacgggcgctgatccagtgtgcgaaagacattgctaaggcctctgatgaggttaccagattagccaaggaagtggccaagcagtgcaccgataaacggattcgcacaaatctgctgcaggtgtgcgagcgtattccaaccatcagtacgcagttgaagatcctatcaaccgtgaaagccaccatgctgggccgaacaaacattagcgacgaggagagtgaacaagcaactgaaatgctggttcacaatgcacaaaacttgatgcagagtgtgaaagaaacagtcagggaggcagaggcagcaagcattaagatccgcactgatgccggttttacactgcgatgggtccgcaagacaccctggtatcagtag

SEQ ID NO: 17976 - DNA, 2784 bp, Artificial Sequence
  Description of Artificial Sequence: Synthetic coding sequence
atgttgcaatctgatccatacagtgtgcctgctagggattatttgatcgatggatcacgagggatcctgtctggaacctctgacctattgctgacattcgacgaggccgaggtgcgcaagataattagggtatgtaaggggatcctcgagtaccttaccgtcgccgaagtggtggaaactatggaggacctcgtgacgtatacaaaaaacctgggccctggaatgacgaaaatggcaaagatgatcgatgagcgtcagcaggagcttacccatcaggagcatcgcgtgatgctggtaaactccatgaataccgttaaggagctgttgccggttttaatttcagcgatgaagattttcgtgacgactaaaaactctaaaaaccagggtatcgaggaagctttgaaaaataggaattttaccgtggagaagatgtccgcagagatcaatgagatcattagagtcctccagcttacaagctgggatgaggacgcgtgggctagtaaggacacagaagcgatgaagagagctctcgcctccatcgattccaaactgaatcaagcaaaaggctggctacgggacccgtctgctagcccgggcgacgccggtgagcaggctatcaggcagatcctggatgaggcaggtaaagtgggagagttgtgtgctggtaaggaaagaagagaaattctcggaacctgtaagatgctcggccagatgaccgaccaagtcgcagacctgcgagctcgagggcagggatcctccccagtcgccatgcaaaaggctcagcaggtttcccaggggttagacgtgttaacagccaaggtcgaaaatgcagcacgaaagctggaggccatgactaactccaagcagtccatcgcaaagaagatcgatgccgctcagaattggctggccgaccccaacggtgggcctgaaggggaagagcagatcagaggtgcactcgcggaagctcggaaaatagctgagctgtgcgacgaccccaaagagagagatgatatcctccggtccctgggtgaaataagtgctctcacctccaaactcgccgacttgcgccgccagggaaaaggcgactctcctgaagcccgtgccttggcgaagcaggtggcaaccgccctgcaaaatcttcagacaaagacgaaccgcgcagtcgccaacagcaggcctgcgaaagctgccgtgcatctcgaagggaagattgaacaggctcagcgctggattgacaaccctaccgtggatgatagaggtgtcggccaggccgccattagagggttagttgccgaggggcatagactggcaaacgtcatgatgggcccatatcgtcaggatttactggccaaatgcgatcgcgtggaccagctgactgcgcagctggcagatctcgccgcccggggcgagggagaatcccctcaggcccgggccctggcaagtcagttgcaagacagcctgaaagaccttaaagcaaggatgcaagaggccatgactcaagaggttagcgatgtgttctccgacacaacaacaccgattaagctgctcgccgtcgcggccaccgcaccaccggatgcccccaaccgggaggaagtatttgacgaacgggccgctaactttgagaatcacagcggaaaacttggcgctactgctgaaaaagctgccgcggtgggtaccgccaacaagagcaccgtcgagggcattcaagctagcgtcaagaccgccagagagctcactccccaagttgtgagcgccgcacgcattctgttacgaaacccgggcaatcaggcggcatacgaacatttcgaaactatgaaaaatcagtggattgataatgtggagaagatgactggattggtggacgaagccattgacactaaatccctcttggacgcctctgaagaagccattaaaaaagatctggacaagtgtaaggttgcaatggcgaacatacagccccagatgctggtggcaggcgccacctcaatcgctaggagggccaacaggatactcctggtggcaaagcgggaggtcgagaatagcgaagaccctaaatttcgtgaggccgttaaggccgccagcgacgaattaagcaagacaatctccccaatggtcatggacgctaaggccgtggcgggcaatatttcggaccccgggttgcagaagagttttctggacagcggatatcgaatcctgggggcggttgccaaggtcagagaagctttccagccgcaggagcccgacttccctccacctccccccgacctcgagcaattacggttaacagatgaactggcaccccctaaaccaccccttcctgagggagaggttccacctccccgaccacccccacccgaggagaaggacgaggagtttccagaacaaaaggccggtgaagttattaaccagcctatgatgatggctgctcgccagctgcacgacgaggcacggaagtggagttcgaaacccgggatccccgctgctgaagtcggtatcggcgtcgtcgcagaggctgatgccgcggacgcagcagggtttcccgtgcctcccgacatggaagatgactacgaaccagaactcctgctgatgccatcaaatcaaccggtgaatcagccaattctggcagccgcacagtccttgcaccgagaagctacaaagtggtcaagcaaaggaaacgacataatcgccgctgctaagcggatggccttactgatggctgagatgtcccgtctcgtaaggggcggatcagtacccaggacttctcccagaccgcagatgaggtag

SEQ ID NO: 17977 - DNA, 984 bp, Artificial Sequence
  Description of Artificial Sequence: Synthetic coding sequence
atgccagtgtttcatacacgcaccatcgagagcatcctagaacccgtggcacagcaaatcagtcacttggtgattatgcatgaggaaggagaggtggatggaaaagcaattcctgacctgacggcccccgtggcagccgtgcaagcggcagtatccaacctcgtgcgagttggcaaggagaccgtacagacgacagaggatcagattctaaagcgtgacatgcctcccgcctttatcaaggtggagaatgcgtgcactaagctggtgcaagcagcacagatgctgcaaagtgatccctatagtgtacccgccagagactacttgatcgatggttctcgcggcattctatccgggacctccgacctgctcttgacctttgacgaggcagaggtgcctccacccaggccacccccgcctgaggagaaagatgaagagttcccagagcaaaaggccggggaagtgatcaatcagcccatgatgatggccgccagacagctacacgatgaggctcggaagtggtcctccaaaggcaacgatataatagctgccgcaaagagaatggccctcctcatggccgagatgagccggctggtgagaggaggctctggtactaaacgggccttaatccaatgtgccaaagatatcgcaaaagcatctgatgaggttactagactggcaaaggaggtggctaagcagtgtaccgacaagaggatcaggaccaatctgctacaagtctgtgagagaattcccaccatctctacccagcttaaaatcctctccactgtaaaggcgacaatgctggggcggacgaatatcagcgatgaggagtctgaacaggcaacagaaatgttagtccacaacgctcagaacttaatgcaaagtgttaaggagaccgttcgcgaggcggaagccgctagcattaaaatccgaacagatgccggttttactttgcggtgggtccgcaaaaccccctggtaccagtag

SEQ ID NO: 17978 - DNA, 2421 bp, Artificial Sequence
  Description of Artificial Sequence: Synthetic coding sequence
gggcagatgaccgatcaggtggccgacttgagagcaagaggacagggctcaagtcctgttgccatgcagaaggcacagcaggtttcccaggggctcgacgttttgaccgctaaggtggagaatgccgcacggaagctggaagccatgacgaattcaaagcagagtatcgcaaagaagattgacgccgcccagaattggttagctgatccaaacgggggccccgagggtgaggagcagataaggggggccctagcagaggcccgaaagattgctgaactgtgtgacgatcccaaagaacgggacgatatcctaagatccctgggcgaaattagtgcacttacaagcaaactggccgatctccgacggcagggcaagggcgatagcccagaggcacgtgctctggcaaagcaggtggccaccgcactgcagaacctccagaccaagacaaaccgggccgtagccaattctcgacctgcaaaagccgctgtgcacctcgagggcaagatcgaacaggcgcagaggtggattgacaaccctacagtggacgaccgcggggtcgggcaagccgccatccggggcttggttgccgaagggcatcgcctggcaaacgttatgatgggtccataccggcaagacttactcgcaaagtgtgatcgggtggatcagcttactgcacagctggccgaccttgcagctcgaggggagggagagtccccccaagccagagctctggcctcacagttgcaggactcattaaaagatttgaaggccagaatgcaggaagcaatgactcaggaggtgtcagacgttttctccgacacaaccacccctattaaactccttgcggtcgccgcaacagctccgccagacgcccccaaccgagaagaagttttcgacgaacgcgccgctaactttgagaaccacagtgggaaactgggcgctaccgctgagaaggcagctgctgtcggcactgccaacaagagtacagtcgaaggtatacaggcctccgtgaaaacagcccgcgagctgaccccacaggtagttagcgcagctcgaattcttttgagaaacccagggaaccaggcagcctatgagcactttgaaacgatgaaaaaccaatggattgacaatgtggagaagatgacaggactggtggatgaggctatagataccaagagcctcctggacgcttccgaagaagccattaaaaaggacctcgataagtgtaaagttgccatggccaacattcagccccagatgctagtggcaggggccacatctatcgcccggcgggccaataggattctactcgttgctaaacgagaggtcgagaatagtgaggatccaaaatttagagaggcagtcaaggcggccagcgatgagctctcgaaaacaatttctcctatggttatggacgccaaagcagtggcaggaaatatctctgacccaggccttcaaaaatccttcctggattctgggtatagaattctcggcgccgtggctaaagtgcgggaagcgtttcagccccaggagcctgattttccgcctcctccacctgatttggaacagttgcggctgaccgacgagctggccccccctaaaccgcccttgcccgaaggcgaggttcctccccctcgtccccccccaccagaagagaaggacgaggagttccccgaacaaaaggcaggtgaagtgattaatcagcccatgatgatggctgcccgtcagctccacgatgaggcaagaaagtggtcaagcaagccagggatcccggcagcagaagtgggaatcggagtcgttgcggaggctgatgctgcggacgccgcaggttttccagtgcccccagacatggaggatgactatgaaccagagctccttttgatgccatcaaatcagcctgtgaaccagcctattttggccgcagcccagtctcttcatcgggaggcgacaaagtggtccagcaagggcaatgacataatagcagcagccaagcggatggccctgctcatggctgagatgtctcggctggtacgaggcggatccggcaccaaaagagccttaatccagtgcgccaaagacattgctaaggccagtgacgaggtgacaaggctggctaaggaggtcgctaagcagtgtacggacaaacggatacgaacaaacttgctgcaggtatgcgagagaattcccacaatttctacgcagctgaagatactctctacagttaaagccacaatgctcgggaggacgaacatttctgatgaagagtcagaacaggctacagagatgttagttcacaacgcacagaatttgatgcagagcgtgaaagaaaccgtgcgggaggccgaagccgcaagcattaagatacgcacggacgcagggttcaccctgcggtgggtccgcaaaacaccatggtaccagtag

SEQ ID NO: 17979 - DNA, 3021 bp, Artificial Sequence
  Description of Artificial Sequence: Synthetic coding sequence
atgccaccagccttcatcaaggtcgagaatgcatgcacgaagcttgttcaggccgcccaaatgcttcagagtgacccatacagcgtgccagcccgggactatcttattgacgggtctcgggggattttatccggtacatccgatcttcttctgactttcgacgaggcagaagtgcgaaagataattagagtctgcaaaggcattctggagtatctgacggtagcagaggttgtggagactatggaagacttggttacctacacaaagaatctcgggccgggaatgacaaagatggcaaaaatgattgatgagagacagcaagaactgactcaccaagaacatagggtgatgctggtgaactccatgaataccgtgaaagagctcctgccagtactgatatccgccatgaaaatttttgtgacaaccaaaaattcaaagaatcagggaatcgaagaggcactgaaaaatagaaacttcaccgttgaaaagatgagcgcggagataaacgaaattatcagggtattgcaactgacctcctgggacgaagacgcctgggcgtcaaaagataccgaggcgatgaagagagctctcgcatctattgatagcaaactgaatcaggccaagggctggttgcgggatcctagtgcctctcccggggatgcaggtgaacaggcaatccgccagattttggacgaggcgggaaaggttggggagctgtgcgccggaaaggaaaggcgtgaaattttgggcacatgtaaaatgttggggcagatgaccgatcaggttgcagacctgcgcgcaaggggccaggggtcatctcccgtggcaatgcaaaaggctcagcaggtgtctcagggcttagacgtgctgactgctaaagttgagaacgctgcaaggaaactggaagccatgacaaattcaaagcagagtattgctaagaaaatcgatgcggcccaaaattggctggccgaccccaacggtggacccgaaggtgaggagcagatacgcggcgctctggccgaagcacgcaaaatcgcggagttatgcgatgacccaaaagaacgggatgatatcctgcgttctctaggcgaaattagcgccctgacatctaagctcgccgatctcagacggcagggaaagggagattcgccggaagcccgggcactggccaagcaggtggccaccgccctgcagaacctgcagaccaagacaaatcgggccgtagcaaacagccggcccgctaaggctgctgttcaccttgaaggaaaaatcgaacaggcgcagcggtggatcgacaatcctacagtggacgataggggcgtggggcaagctgccatacgcggcctggtggccgaagggcatcgcttagcaaatgtgatgatgggcccatataggcaagatctactcgccaagtgcgacagagtggatcagctcactgcccagttggccgacttagcagcacggggtgagggcgaatcaccgcaagccagggctctagccagccaactgcaggatagcctgaaagatctaaaagcgcggatgcaagaggcaatgacgcaagaggttagcgatgtattttctgacacaactactcccattaagctgctggcggtagctgcgacagccccaccggacgccccaaatcgggaggaagtgtttgacgagagggcggcaaatttcgaaaatcactctggaaaactgggcgcaacagcggagaaggcagccgctgtgggaacggctaacaagagtactgtagagggtatccaggccagcgttaagaccgccagggagctcactccacaggtagtcagcgcggcccgcatccttttacgcaatcctggcaatcaggctgcctacgagcacttcgaaaccatgaaaaaccagtggatcgataacgttgagaagatgactgggctggttgacgaggccatcgacaccaagtcattgctggacgcttccgaggaggctatcaaaaaagatctcgacaagtgtaaagtcgcaatggctaatatacagccacagatgttggtggcaggtgctacatccattgcacgtcgtgctaacaggattctgttagtggccaaacgcgaggttgaaaacagcgaggaccccaagttccgggaagcggtgaaagctgcttcggatgaactcagcaagaccatcagccctatggtgatggacgcgaaggccgtcgcagggaatatctctgatcccggcctgcagaagtcattcctcgacagcggttaccggattctgggcgccgtggccaaagtgagggaagcctttcaaccccaggagcctgacttccctccacctccccccgatcttgagcagctgcgcctcacggacgaactagcaccgccgaaaccacctctgcctgagggcgaagttccacccccacggccaccgcctcctgaagagaaggacgaggagtttcctgagcagaaagctggcgaggtgataaatcagccaatgatgatggcagctcggcaactgcatgatgaggcaaggaagtggtcttccaagggcaacgatataatcgccgctgcaaaaaggatggctctactaatggctgaaatgtcccgattggtccgcgggggctcaggcactaagagagccctgatccaatgtgctaaagacattgctaaagctagcgatgaggtaacgcgtcttgcaaaggaagtcgcaaagcagtgtacagacaagcgtatccggactaacctgctccaagtttgtgagagaattccaacgataagtacacagttaaaaatcctgagtacggtcaaggccaccatgttagggcgcaccaacatctctgatgaagagtcagaacaagccacagaaatgctcgttcataacgcacagaatctgatgcagtcagtcaaggagacagtgagagagctgaagctgctccagagcaaattcgaacagatgctggatctacactgtgcgggcctcgagaggcttccaggcactagtcgacacctggcggaacccggttggcaccgaaatctgtactag

SEQ ID NO: 17980 - DNA, 570 bp, Artificial Sequence
  Description of Artificial Sequence: Synthetic coding sequence
atgacagagtataaactcgtggtcgtcggtgcaggaggcgtcggcaaatctgccctcaccatacagctgatacaaaatcattttgtcgatgagtatgaccctaccatagaggattcttaccgaaagcaggtcgttatcgacggggaaacctgtctgctagatatcctggatacagctggacaggaggagtacagcgcgatgagggaccaatacatgcggacgggcgagggctttctctgcgtgttcgcgatcaacaacactaagagcttcgaagatatccatcactacagagaacaaatcaagcgggtcaaagactcggaggacgtaccgatggtgttggtgggtaataagtgtgacttaccttcccggacggtggatacaaagcaggctcaggatcttgccagaagctacggcattccatttattgagaccagtgccaaaacacggcagcgcgtggaagacgctttttacacactggtgagggagattagacagtatcgtcttaagaaaatttccaaagaagaaaagacccccggctgcgtcaagattaagaagtgcataataatgtag

SEQ ID NO: 17981 - DNA, 567 bp, Artificial Sequence
  Description of Artificial Sequence: Synthetic coding sequence
atgactgaatacaaacttgtcgtcgtgggtgccggcggggtcggcaagagtgccctgactattcagctgatccagaatcactttgtggatgagtatgatcccacaatcgaggattcttaccggaagcaagtggtgattgacggagagacatgcctgctggacatcctcgatacagctggccaggaagagtactcagctatgcgggaccagtacatgcgaacaggtgaagggtttctctgcgtgttcgcgatcaataacacaaaatcttttgaggatattcaccactatcgagaacagattaagcgggtgaaggacagtgaagatgtcccaatggtactggtgggaaacaagtgtgatctgccatcacgcacggtggataccaagcaagcccaggatctcgccaggtcatatgggattccctttattgaaactagtgccaagactaggcagggagtagatgatgctttctataccttggtccgcgaaataagaaaacacaaggagaaaatgtctaaggacggcaagaagaagaaaaaaaagtctaagactaaatgcgtgattatgtag

SEQ ID NO: 17982 - DNA, 228 bp, Artificial Sequence
  Description of Artificial Sequence: Synthetic coding sequence
atgaccgagtacaagctcgtagtggtgggagccggcggcgtggggaagtcagcgctcacaatacagttgatacagaatcattttgtggatgagtacgatcccaccattgaaggggttgacgacgccttttatacgttggtgcgcgagatccggaaacacaaggagaagatgtcgaaggatgggaagaagaagaaaaagaagtcaaagactaaatgtgtgatcatgtag

SEQ ID NO: 17983 - DNA, 2931 bp, Artificial Sequence
  Description of Artificial Sequence: Synthetic coding sequence
atgaggggtgcccggggcgcctgggacttcctgtgcgttctgttattgttactgcgcgtgcaaaccggatccagtcaaccgtctgtgtcccctggggagccctcacctcctagtatccacccaggtaaaagcgatcttatcgtccgcgtcggcgacgagatcaggctcttgtgtactgatcctggcttcgtcaagtggacctttgaaatactggatgagacgaacgaaaataagcagaacgagtggattacagaaaaggccgaggccacaaataccggtaagtatacatgtactaacaaacatgggctgtccaactctatctacgttttcgttcgcgatcccgcaaaactgttcctggtcgatcgatctctctacgggaaagaggataacgatactcttgtgagatgtccactgacagatcctgaggtgactaactactccctgaagggatgtcaggggaagccgctgccaaaagatttaaggttcatccccgaccccaaggctggcatcatgatcaaaagtgtgaagcgggcataccatagattgtgcctacactgctctgttgaccaggagggcaagtccgtcctaagcgagaagttcattctgaaggtgcgaccggctttcaaggcagtccccgtcgtatccgtttccaaagccagctaccttctgcgcgagggagaagaatttacagtgacatgcaccatcaaggacgtgagttcttccgtttacagtacttggaaacgcgaaaattcgcagaccaagctgcaagaaaagtacaactcttggcatcacggggacttcaactatgagcgacaggccacattgaccatttcaagcgcccgtgttaacgactccggggtattcatgtgctatgcaaacaatacatttggatcggccaatgtgaccactaccctcgaagtggttgataaaggcttcattaatatctttccaatgataaatacaacagtgttcgttaatgacggcgagaatgtggacctgatcgtggagtacgaggctttccccaaacctgagcatcaacagtggatttatatgaatcgtaccttcaccgataagtgggaggactatcctaagagtgaaaacgagtctaatattaggtacgtgagcgagttgcacctgacccgtttgaagggtacagaaggagggacttatactttcctcgtctctaatagcgacgtcaacgcagccattgccttcaacgtgtatgtaaatacaaaacccgagattctgacctacgaccggttggtgaatggaatgcttcagtgtgttgcggctggcttccccgaaccaactatcgattggtacttttgccccggcacagagcagagatgctccgctagcgttttgccagttgatgtgcagacgctgaattctagtggtcctcccttcggaaagctggttgtgcaatctagtattgatagctccgctttcaaacataacggcacagttgaatgtaaggcgtataatgacgtaggaaaaacaagcgcttatttcaatttcgccttcaaaggcaacaacaaagaacagatacacccgcacaccctgttcaccccactgctcattgggtttgttatcgtcgccggaatgatgtgcattatcgtaatgatattgacatacaaatacctccagaagcctatgtatgaggtgcaatggaaagtggtggaagagattaacggtaataattatgtatatattgaccccacacaactgccctacgatcacaagtgggagttccctcggaatagactttctttcgggaagaccctcggtgccggtgcctttggcaaggtggttgaggccaccgcttatgggttaattaaaagtgacgccgccatgaccgtggctgttaaaatgcttaaaccgtcagcccatctgacggagcgcgaggccctaatgtcagaactgaaggtgctgagttacttggggaaccacatgaacattgttaaccttctgggcgcatgcacaattggcggtcctacgcttgtcatcaccgagtactgttgctatggagacttgctcaactttttacggagaaagagagatagcttcatctgctccaagcaagaggatcacgctgaagctgccttgtacaaaaacctcttacactcgaaagagtcctcatgctcagactctactaatgagtatatggacatgaaacccggagtgtcctatgtggtgcccacaaaggctgacaaacgacgtagtgtccgtatcggatcttatatagaacgggacgtcacccctgccataatggaggacgacgaattggccctggatctggaagatcttctgtcattttcctatcaggtggcaaaaggtatggctttcctcgcaagcaaaaactgcatccatcgagacctggcggctcggaacatcttactgactcacggccggatcactaagatatgcgactttggcctggcacgagacataaaaaacgattctaactatgtagtgaaaggaaatgctcgcctgccagtgaagtggatggcgcccgaatcaatctttaactgtgtttacacatttgagagcgatgtgtggtcttacgggatattcctctgggagttgttctcactggggagctcgccatatccaggaatgcctgtggactcaaaattctataaaatgattaaagagggttttcgcatgctgtcccccgagcatgcgcctgcagagatgtacgacatcatgaagacttgctgggatgccgaccccctaaaaagacccacattcaaacaaatagttcagctcatagaaaagcagatttccgaaagcacaaaccatatttactctaacttagcgaattgttccccaaaccgtcagaaacccgttgtcgatcacagtgttcgcatcaactcagtggggtctaccgcctcgtcctctcagcccctgctggtgcatgacgacgtttag

SEQ ID NO: 17984 - DNA, 2919 bp, Artificial Sequence
  Description of Artificial Sequence: Synthetic coding sequence
atgcgtggcgcacgcggagcctgggattttctgtgtgttcttcttcttctgctgagagtgcagactggaagctcccagcccagcgtgtcccccggtgagcccagccctccatcgattcatcctggaaaatccgacctcatcgtgagagtcggcgatgaaatcagactgctctgcacagaccccgggttcgtgaaatggacttttgaaattctcgatgaaacaaacgagaataagcagaacgaatggattaccgagaaggctgaggccaccaacaccggcaaatatacctgtactaataaacatggcctctctaactccatatacgtgtttgttcgcgatcccgccaagctatttctagtggaccgttccctgtatgggaaggaggataatgacacattagttcgctgccccctgaccgatcccgaggtgactaactattcactgaaaggatgccagggaaaacccctccctaaagacctgcgtttcattcccgatcccaaagctggaataatgattaaatctgtgaagcgtgcctaccaccgactgtgcctgcactgcagtgtcgaccaggaaggaaagagcgtgttaagtgagaagtttatcctcaaggtgcgcccagcattcaaagcggtgcctgtggtgtctgtgtctaaagccagttacctgttgagggagggtgaagagttcaccgtgacttgtactatcaaagacgtttcctcatcggtgtactcaacatggaagcgagaaaattcccagacaaagctccaggagaagtataattcttggcatcacggagacttcaactacgagcggcaagctaccctgacaatcagtagcgctcgtgtaaatgatagcggcgtattcatgtgctacgccaacaataccttcggatccgcgaacgtgaccacaacacttgaggtggttgataagggcttcattaatattttcccaatgatcaataccaccgtgttcgtgaatgacggtgaaaacgtcgatctgattgtggaatacgaagcatttccaaagcctgaacaccagcagtggatttacatgaacagaacatttacagataaatgggaggactaccctaagtcggagaacgaaagtaacataagatacgtgagcgaactgcatctcaccagacttaagggcactgaaggtgggacctatacctttttggtgagtaattccgatgtcaacgcagccatcgctttcaacgtgtacgtcaacacgaaaccagaaattctcacttatgatcgattagtgaacgggatgctccagtgcgtggcggcaggttttcctgaaccaaccatagactggtacttttgccccggtactgagcaacggtgctcagccagcgtacttccagtggacgtgcagacactgaacagcagcggccccccattcggcaagctggtcgtgcaaagtagtatcgacagctcggcctttaaacacaatggcactgtggaatgtaaagcctataacgatgtcggcaaaacctcagcctacttcaacttcgcatttaaggagcagattcaccctcacaccctgttcacccccctgctcatcgggttcgtaattgtggccggcatgatgtgcattatcgtgatgattttgacctataaatatctgcagaaacctatgtatgaagtgcagtggaaagtagtcgaagagattaatggcaataattacgtatacattgacccgactcagcttccttatgatcacaagtgggagtttccccggaatcgattgagttttggaaaaactctgggggccggtgcttttggaaaggttgtggaggctaccgcttatggcctaatcaaatcggacgcagccatgaccgtggcagtgaagatgctcaaaccgtcggcccatctcactgaaagagaagctctgatgagcgaattgaaggtgttgtcttacctggggaaccacatgaatatcgtgaacttactcggtgcatgtacgatcggcgggccaacccttgtgatcactgagtattgctgttatggagatctactgaacttcctcaggaggaaacgtgactccttcatctgctccaaacaagaggatcacgcggaagcagccctttataaaaatctactgcactccaaggagtccagctgttctgattccacaaatgaatacatggatatgaagcccggagtttcatatgtggttcccaccaaggctgacaaacgaagatccgtccgaatcgggtcatatatcgagagagacgtgacacccgcaataatggaagacgacgagctggcactcgatctcgaagacctgctctcattctcctaccaggttgctaagggcatggccttcttggcttctaagaattgtatccaccgagacttggctgctaggaacattttgctcacccacggtagaatcactaagatctgcgactttggcctggctcgcgacataaaaaatgactccaactacgtggtgaaaggcaatgcacgactacccgtgaagtggatggcgcctgagtccatttttaattgtgtctacacctttgagagcgacgtgtggagctacggaatatttttgtgggagctcttcagtctcggatcgtcgccctaccccggtatgcccgtcgacagcaaattttacaagatgatcaaggaagggttcaggatgctgagtccagagcacgcgcctgcagaaatgtacgacataatgaaaacgtgttgggacgcggatcccttaaagaggcctacattcaagcaaatagtgcagctgatcgagaaacaaatcagcgagagtactaatcacatttactcgaacttggctaattgcagccctaataggcagaagcccgtggttgaccacagtgttaggatcaactctgtgggatcaacagcctcaagctcccagcccctgctggtacatgatgacgtttag

SEQ ID NO: 17985 - DNA, 1242 bp, Artificial Sequence
  Description of Artificial Sequence: Synthetic coding sequence
atgcgaggagcacggggagcctgggattttctatgcgtattgctcttactgctccgcgtgcaaactggcagtagccagccatccgtgagcccaggagagcctagccctcctagtatccatcctggcaaaagtgatctcatcgttcgcgtgggagatgagattcggctgctgtgtacagaccctggattcgtcaaatggacatttgagatcttagacgagactaacgagaacaagcagaacgaatggattacagagaaagcagaggcaacaaataccggcaagtacacatgcactaacaagcacggcctctccaattcaatttacgtattcgtaagagaccccgcaaagctgttcctggtagatagatcgctgtatgggaaggaggacaatgacacactggtaaggtgccctctgactgaccctgaagtgacgaactattctctcaaaggatgccaaggcaaaccgctgcccaaagacctgcgttttatccccgacccaaaggccgggataatgataaagtccgtgaagcgcgcataccaccgcctatgcctgcactgctccgtggaccaggaaggaaagtctgtgctgtccgaaaagtttatcctcaaggtgaggccggcctttaaggccgtacccgtggttagcgtgagcaaggcgtcgtatctcctgagagaaggtgaggaattcaccgtgacttgtacaatcaaagatgtttcctcctcagtttattccacctggaaaagggagaactcgcagactaaactgcaggagaaatacaattcctggcaccacggcgacttcaactacgaaaggcaggcaacgctgaccatctcatctgcccgtgttaacgacagcggggttttcatgtgctatgccaataacacgttcgggagtgcgaacgtgaccaccaccctcgaggtggtggataagggattcattaacatatttccaatgattaacaccaccgtatttgttaacgatggggagaacgtggacctcatcgtggagtacgaagccttccccaaaccagagcaccaacagtggatttacatgaatagaacttttaccgataagtgggaagattatccaaagtccgaaaatgaaagtaacatcagatatgtgagcgaactccatctcactcgccttaaaggaaccgagggaggcacatacaccttcctggtatcaaactcagacgtgaacgcagctatagctttcaatgtctatgttaactctaagctgtag

SEQ ID NO: 17986 - DNA, 1212 bp, Artificial Sequence
  Description of Artificial Sequence: Synthetic coding sequence
atggcatcggaactggctatgagtaattctgatcttcccactagcccactcgccatggagtacgttaacgacttcgatctgatgaaatttgaagtcaaaaaagaaccggtggagaccgataggatcatcagccaatgtggaaggctgatcgctggaggttccctatcctccacgccaatgagcacgccctgtagcagtgtgcctccgtctccttctttctcagccccgtcgccagggtcaggctccgagcagaaagcacatcttgaggactactattggatgactggctatccacagcagttaaatccagaagccttagggttctctccagaggatgcggttgaggctctgatttccaattctcaccagctgcagggcgggttcgacggctatgccagaggagcacaacagctggctgctgccgcgggagctggtgctggggctagtctgggcggaagcggcgaggaaatggggcctgcagcagcggtcgtaagcgcggtcatagctgccgcagccgcgcagtcaggggccggaccgcattaccatcaccatcatcaccatgctgccggacaccaccaccaccctactgccggggcccctggggccgctggcagcgctgccgccagcgcaggcggcgccggtggggctgggggtggcggccccgcatctgcgggtggagggggcgggggaggcggcggggggggtggtggtggtgccgcaggcgccggtggtgctcttcatccacaccatgccgcgggcggactgcactttgacgatagattcagcgatgagcagctagtgaccatgtccgtgagggaattgaataggcaactgaggggggtgagcaaagaagaagttattagactgaaacagaagcgccgtactcttaagaaccgaggctacgcacaaagttgcaggttcaagcgagttcagcagcgccacgtcctggaatcagagaagaatcagctgttgcagcaagtggatcatctgaaacaggagatttctagactagtacgcgagagagacgcctataaagaaaagtacgagaagctggtgtcttccggattcagggagaacggcagttcatccgacaacccgagctcgccagagtttttcatcactgagccaacaagaaaactcgagccatctgtgggatacgcaacattctggaagccgcagcaccgagtgctaacttccgtcttcaccaagtag

SEQ ID NO: 17987 - DNA, 1122 bp, Artificial Sequence
  Description of Artificial Sequence: Synthetic coding sequence
atggcttctgaactggccatgagtaattccgacttacccacctcacctttagctatggaatacgttaacgactttgatctgatgaaattcgaagttaagaaagagccggtagaaaccgatcgcattatttctcagtgtggtaggcttatagcaggtggcagtctatcaagcacaccgatgtctactccatgttcctcggttcccccaagccccagcttcagtgctccctccccaggctctggatccgaacaaaaggcccacctcgaggattactattggatgaccggctatcctcagcagttgaaccctgaggccctgggattttccccggaggatgccgtggaggcgcttatctctaacagtcatcaactgcaggggggatttgatggatatgcacgaggagcacaacaacttgccgctgctgccggagcaggcgccggggcatccctagggggcagcggggaagaaatggggcctgccgccgccgttgtgtccgcggtcatcgctgccgccgcagcccagtccggcgccggtccgcattatcaccaccatcatcaccatgccgctggccaccatcaccatcctaccgccggagcccctggggcagctggctcagcagcagcatcagccggaggcgctggcggtgccggtgggggggggcccgcatctgctggagggggagggggcgggggagggggaggaggaggcggaggtgcagctggcgcggggggagctcttcacccacaccacgccgcgggcggcctccattttgacgaccgtttttcagatgagcagctggtgacaatgagtgtcagagagctgaataggcagttgaggggggtgagcaaggaggaggtcattagactaaagcaaaagagacgaactctgaaaaaccgaggctatgcacagtcctgccggtttaagcgggtgcagcagaggcacgtgctggagtctgaaaagaaccagctgctgcagcaggtagaccacttgaaacaggagatttctcggcttgtaagggagagggatgcttacaaagagaagtacgaaaaactcgtcagcagcgggtttagagaaaatgggtccagttccgacaacccatccagcccagagttcttcatgtag

SEQ ID NO: 17988 - DNA, 1062 bp, Artificial Sequence
  Description of Artificial Sequence: Synthetic coding sequence
atggcggcagaattggcgatgggtgcagagctgcctagtagccccctcgcaattgaatacgtgaatgatttcgacttgatgaagtttgaggtgaaaaaagagccaccagaagctgaacggttctgccaccgcttgccaccaggtagcctgtcaagtacaccactatcgaccccctgtagttcggtcccttcatccccctccttctgcgcaccctctcccggcacagggggggggggaggagctggcggaggcggcggaagttctcaggccggcggtgcaccaggacctcctagcggggggccaggcgccgtgggcggaacttctggcaagcctgcactggaggacttgtactggatgtccgggtatcagcatcacctgaaccccgaggctctgaacctgacgcctgaagatgcggtggaggcactgatcggatccgggcaccatggagctcatcatggcgcacaccatcctgcagccgccgccgcatatgaagccttccggggccccggtttcgcaggaggaggaggagctgacgacatgggcgccggacaccatcacggcgcccatcatgccgctcaccatcaccatgccgctcaccatcaccatcatcaccaccaccatcatggcggagccgggcacgggggcggcgccggccaccacgttaggctggaagagcgcttcagtgatgatcaactcgtttccatgtctgtccgggagctgaaccgacagctgaggggattttccaaggaggaggtaattaggctcaaacagaaacgacggaccctcaaaaatcggggatacgcacagtcatgccgattcaagcgagtgcagcagagacacattttagaatcagagaaatgccaattacagtcccaggtagagcagctcaaattagaagtgggtcgtctcgccaaagagcgagatttgtacaaggaaaaatacgagaaactggctggtagagggggccctggcagcgccggcggcgccggcttcccaagagagccatctcctcctcaggctgggccagggggggccaagggaaccgccgacttttttctgtag

SEQ ID NO: 17989 - DNA, 972 bp, Artificial Sequence
  Description of Artificial Sequence: Synthetic coding sequence
atggctgccgagttgagcatgggtcctgagctgcccacctcacctcttgctatggagtatgttaatgacttcgacttgctgaaattcgacgtgaaaaaggaacctttgggaagagccgaaagacctgggcgcccatgtactagattgcagccggccgggagtgtttcatcgaccccgctgagcaccccttgcagttcggtgccctctagcccgtccttctctcccacagagcagaaaacccacttggaagacttatactggatggccagcaactaccagcagatgaatccggaggccctaaaccttaccccagaggatgcagtggaagcacttatcggttctcacccggtgccccaacctctgcagagctttgactcctttagaggcgcacatcatcatcatcaccatcaccacccccatccacaccatgcctacccgggtgctggcgtggcccatgacgaactgggcccacatgcacatccacatcaccaccatcaccaccaggcaagtccccctccatcttctgctgctagtccagcccagcagctgccaacaagtcaccccggacccggcccccatgcgaccgcgtcagctactgcagcaggtggcaatgggagtgtggaggaccgcttctctgatgaccaactggtgtctatgagcgtccgggagttaaaccgtcatctcaggggtttcacgaaggacgaagtaattagactgaagcaaaagaggcgcactcttaagaaccgtgggtacgcccagtcctgtaggtacaagagggtccagcaaaagcaccaccttgagaatgagaaaactcagctgatccagcaggtggaacagctcaagcaggaagtgtctagattggccagggaaagggatgcttataaggtgaaatgcgagaaactggccaattctggcttccgggaagcggggtctactagcgatagcccaagttcgcccgagttctttctgtag

SEQ ID NO: 17990 - DNA, 972 bp, Artificial Sequence
  Description of Artificial Sequence: Synthetic coding sequence
atggctgcagaactgtcgatgggacccgagctgccaacgtcaccactggcaatggaatatgtgaatgacttcgatctgctgaaatttgacgtcaaaaaggagcccttagggagagctgagagaccagggcggccttgcaccaggttgcaaccagcagggtcggtgtcatccacccccctgtcaactccctgctctagcgtaccctcttccccttcatttagtcccaccgaacagaaaacgcaccttgaagacctgtactggatggcatctaattatcaacagatgaatcctgaggccctgaacctgacgcccgaggatgccgtcgaggctctcatcggatctcaccccgtgccccagccccttcaaagttttgacagctttcgcggggcacaccatcaccatcatcatcaccaccctcatccccatcacgcgtacccaggggctggagtggcacacgacgagctcggaccacatgcccatccccaccaccatcaccaccatcaggcctcacccccgccatcaagcgcagcctcaccagctcaacaactcccaacttcccatccaggtcctggcccacacgccactgctagcgcaacagctgccgggggaaatgggagcgtggaggatagattttcagatgatcagctcgtctcaatgagcgtgagggagctgaataggcatctccgggggtttaccaaggacgaggtgattcgcctgaaacagaaaaggagaacgctgaagaatcggggatatgcgcagtcttgtcggtataaaagagttcagcagaagcatcatctggaaaacgagaaaacgcagctaatccagcaggtcgagcagttgaagcaggaggtttctcggctcgccagagaacgagacgcatataaggttaaatgcgaaaagttggcgaattctggatttagagaggccggatccacatccgactcaccctcatcacccgagtttttcctgtag

SEQ ID NO: 17991 - DNA, 1233 bp, Artificial Sequence
  Description of Artificial Sequence: Synthetic coding sequence
atggcgaaacgatctcgcagcgaggatgaagatgatgacctacaatacgcggatcacgattatgaggtcccccagcaaaagggtctgaagaagctctggaatagggtcaagtggactcgtgacgaggatgacaagctcaaaaagctcgtcgaacagcatgggacagatgattggacactgatagcctcacatttgcaaaaccggtcggacttccagtgccaacatcgttggcagaaggttttgaaccccgaattgatcaagggcccttggaccaaggaggaggatcagagggtcatcgaacttgttcagaagtatggaaaaaaacgcaagatgcgcgtggggcacagcccagggtcagaactgagggatgggagcctgaatgatggaggcaatatggcgctgaaacacactccgctcaaaacattaccctttagtccctcccagttttttaatacgtgcccaggaaacgagcagctgaacattgaaaatccaagctttacctccacaccaatatgcggccaaaaggccctaatcaccaccccccttcacaaagagacaacgccaaaggaccagaaggagaacgtaggttttcggacacctacaatccggaggagcattcttggcactaccccacgcacacccactccttttaaaaatgcgttggccgcccaagagaaaaagtacggaccccttaagatagtaagtcagccacttgcattcctggaagaagacatccgtgaagtgctgaaggaagagacagggacagatctgtttctgaaagaagaggacgagccagcttacaagtcctgtaaacaagagaacacagcgtccggtaagaaggtgcgaaagagcttggtgctggacaattgggagaaagaagagtctggcacacagctgctgactgaagatatctccgatatgcagagcgagaaccgcttcactacctcactgctgatgatcccccttctggaaatccacgacaatcgttgtaatctgatccccgagaagcaggacattaattcgaccaataaaacctacaccctcacaaagaaaaaaccgaacccaaatacctccaaagtggttaaactcgagaagaacctgcagtcaaactgcgaatgggagaccgtggtttacggaaaaacagaggaccagctcattatgacggaacaagccaggcgttatcttagtacatacaccgcgaccagcagcaccagccgagcgcttatcctgtag

SEQ ID NO: 17992 - DNA, 2259 bp, Artificial Sequence
  Description of Artificial Sequence: Synthetic coding sequence
atggccaagcgtagcagatcggaagacgaggacgacgacctccagtatgcggatcatgactacgaagtaccccagcaaaagggtctcaagaagctctggaacagagttaaatggactagagatgaggacgataaactgaaaaaactggttgagcagcacggaaccgatgattggacactcatcgctagccacctgcagaacagaagtgattttcagtgtcagcaccgctggcagaaggtgctcaatcctgagttgattaaaggtccttggactaaagaggaggaccagcgtgtcatcgagctagttcagaaatatggaccaaagaggtggtccctgattgccaagcatcttaaaggtagaatcgggaaacagtgtagagagaggtggcataatcatctgaaccctgaggtaaaaaagtcaagctggactgaggaggaggacagaattatttacgaagcccacaaacgcctggggaaccgatgggccgagatcgctaaacttctcccaggacggacggataattccattaaaaaccattggaatagcaccatgaggcgaaaggtggaacaagagggttatctgcaagacggtatcaagagtgagcgaagttcctcgaagttacagcataagccctgtgccgctatggatcacatgcagacacagaatcagttttacattccagttcagattccgggctaccagtacgtgagtccagaagggaattgtatcgaacacgtgcaaccgacgtccgctttcatccagcagccttttatcgacgaagaccccgacaaggaaaaaaagattaaagagctagaaatgttgctcatgtctgctgaaaacgaggtgagacggaagcggattccatcccagcctggctcatttagcagctggagcggatctttcttaatggatgataacatgagcaacaccttgaactccctggatgaacacactagcgagttctattctatggatgagaatcaacctgtgagcgcacagcagaacagccccacaaagttcctggctgtggaagcgaacgcagttctctcgagtctgcaaactataccagagtttgccgaaacattagaactaatcgagtcagaccctgtggcctggagcgatgttacaagcttcgacataagcgacgcggccgcatcccccattaagagcacacccgttaaactgatgagaatccagcacaatgagggcgctatggagtgtcagttcaacgtgtccctcgtgcttgaagggaagaaaaatacctgtaacggaggaaactctgaggcagtaccgctgacttcacccaatatcgccaaattttcaacaccgcctgcaattcttcgcaagaagaggaagatgcgggtgggacactctccaggatctgaattgcgagatggaagtcttaacgacggcggcaacatggcgctgaaacacacgccgctgaagactctgcccttcagcccgtcacagttttttaacacatgtccgggcaacgaacagctgaacattgaaaaccccagtttcacatccacaccgatttgcggccagaaagcactgattaccactccgctccataaagagacgaccccaaaggaccagaaagaaaacgtcggatttaggacccccactattagacgaagtatactgggcacaaccccgcgcactcctacccccttcaaaaatgccttggcagcccaagagaagaagtatggaccactgaagatcgtgtctcaacccctggctttccttgaagaagatatacgagaagtgctgaaagaggaaactggcacagatctctttctgaaggaagaagacgagcctgcatacaagtcatgtaaacaggaaaacactgcttctggaaaaaaggtgagaaaatctttagtactggataattgggaaaaggaggaaagtggaacccagttgctaactgaggacatatcagatatgcaaagcgaaaaccggtttaccactagcctgctcatgattcccctgctcgagattcatgataatcgctgcaatcttatccctgagaagcaggatatcaactctacaaacaagacctacactctcaccaagaagaaacctaatcccaacacgtccaaagtggttaagcttgaaaagaatctgcagtcgaattgtgaatgggagacggtagtttatggcaagaccgaggaccagctcatcatgaccgagcaggctaggagatacctttctacctacacagctacaagttccacaagccgggccttaatcctgtag

SEQ ID NO: 17993 - DNA, 2079 bp, Artificial Sequence
  Description of Artificial Sequence: Synthetic coding sequence
atggccaagcgatcccggtcagaggacgaggatgacgatctgcaatatgcggatcatgattacgaggttcctcagcaaaaaggactcaagaagctgtggaatcgggtgaaatggacgagagatgaggatgataaactcaaaaaactagttgaacagcacggaaccgatgactggactcttatcgcctcacatctgcaaaatcggagcgattttcagtgccagcatcggtggcagaaggtgctcaaccccgaattgatcaaagggccatggactaaggaagaagaccagcgtgtgattgaactggtgcagaaatatgggccaaaaagatggagcctgatcgcaaaacacctgaagggaaggataggtaagcaatgcagagaaaggtggcacaaccatctcaatccagaggttaaaaagtcaagttggaccgaagaagaagataggataatttatgaagcccataagaggttagggaacaggtgggccgagatcgccaaactcttacccggcagaacagataacagcatcaagaaccattggaacagtaccatgcgaagaaaggtggaacaggaaggctaccttcaggacggcataaaatcagaaaggtcttccagcaaactgcagcataaaccgtgcgcagccatggaccacatgcaaacacagaatcagttttacatcccagtgcagatccctgggtaccaatatgtttccccggaagggaattgtatcgagcatgtccagcccacttccgccttcattcagcagccatttatcgacgaggaccccgacaaagagaagaaaatcaaagaattagagatgctgctcatgagcgcagagaacgaggttagacggaagaggatcccctctcagccagggagtttttcttcatggagcgggtccttcctgatggacgataacatgtctaacactctgaacagcctggatgaacatacgagcgagttctactccatggatgagaatcaacctgtttccgcacagcagaacagccctaccaaattcctcgctgtggaggcgaacgctgtgctgtcgtcgctgcaaactatcccagagttcgcagaaacattagagctgattgagagcgaccccgttgcatggagcgatgtgacaagctttgatatttctgacgccgccgccagccccataaagagcactcccgttaagttgatgcgcatacagcataacgagggcgcaatggaatgccagttcaatgtgagcctggtgcttgagggtaaaaagaatacatgtaacggcgggaatagcgaggctgttccgctgacatctcctaacatcgcaaagttctccaccccaccagccattctaaggaaaaaaagaaagatgcgcgtggggcactcaccaggcagcgaactgcgtgatggctctttgaacgacggcggcaatatggccctgaagcatactcccctaaagacacttcctttctctccaagtcagttctttaacacttgtcccggtaacgagcagcttaatatcgagaacccatcctttacaagtacacctatctgcggccagaaagctctgatcacaacccccctccataaggaaactacaccaaaggatcagaaggaaaatgtcggttttcgaacaccaaccatccgaagaagcattcttggcaccactccaagaactccaactccattcaaaaacgccttagctgcacaggagaagaaatacggaccccttaagattgtttcgcaacctctcgcattcctcgaggaggacatacgcgaggtcttgaaggaagagaccggcaccgatttgtttctcaaagaggaggatgaaccagcctataagtcctgcaaacaagaaaacaccgcctcgggaaaaaaggtgcggaagtctctggtgttagataattgggagaaggaggaatccggtacccaacttttgacagaggatattagcgatatgcagtcgaattgcgaatgggagactgtggtctacggcaaaactgaagatcagctgatcatgactgaacaggcgcgccgctatttgtctacttacaccgctacctcatcaactagtagagccctgattctgtag

SEQ ID NO: 17994 - DNA, 711 bp, Artificial Sequence
  Description of Artificial Sequence: Synthetic coding sequence
atgtgcgtgtgcgcgggctgtcgcgccgctccttcacgcaggggcgctggacctttgcaagtcgcgggcggatggagcgagggcgcagatatggattacgattcatatcaacattacttctacgactacgactgtggggaggacttctaccgttcaaccgctccctctgaggacatttggaaaaaattcgagctggttcctagtccgcctacgtccccgccctggggcctcggccccggggccggcgatcctgcacctggaattggccctcctgagccatggccgggaggatgcaccggcgacgaggccgagtctaggggccattctaaaggttggggacgtaactatgctagcataatccgtagagactgcatgtggtctgggtttagcgcccgggaaagactggagcgagccgtgtccgatcggttagccccaggagccccgcgcgggaacccacccaaagcctctgccgcccccgattgtaccccctcactggaggccggaaacccagcccccgctgccccgtgccctctgggcgagccgaaaacccaggcctgtagcggtagcgagtctccgtctgatagcggaaaggatctgcccgagcctagtaagcggggacctccccatgggtggccgaagctgtgtccttgtctccgctctgggatcggctcgtctcaggcactgggtccatccccaccactgttcggatag

SEQ ID NO: 17995 - DNA, 1095 bp, Artificial Sequence
  Description of Artificial Sequence: Synthetic coding sequence
atggactatgactcatatcaacattacttttatgattacgattgcggggaggatttctacaggagtacagcaccctcggaagacatttggaaaaagttcgaattagtcccaagcccacctacatctccaccatggggacttggacctggagctggcgaccccgcaccgggcatcggtcccccagagccctggcccggaggttgtaccggagatgaggctgagagccgcgggcactccaagggctggggccggaattatgcttccattatcaggcgggactgcatgtggtccggcttttcagcccgagagcgcctagagcgagccgtctcagacagattggcccctggggcccctcgcggcaatccgccaaaggccagcgccgctccagattgcacccccagcctggaagcgggcaatcctgcccctgctgccccctgcccattgggggaacctaaaacacaggcgtgttccggatctgagagtccctccgatagcgaaaatgaggaaattgacgtagtaacagtcgaaaagcgccagtcactggggatcagaaagccggtgactatcactgtacgcgcggaccccctcgacccatgcatgaagcatttccatatctctattcaccagcaacaacacaattatgccgcccggtttccccctgagagctgctcgcaggaggaggcaagtgagcgtgggcctcaagaagaagtgttggagagagacgcagcaggggagaaggaagacgaggaggacgaagagatcgtctcacccccacccgtggaatcagaagccgctcagtcctgccacccgaagccagtctccagcgacacggaggatgtaacgaagaggaagaaccacaacttcctggagaggaagagacgcaacgatttacggtcaagatttctcgctctgagagaccaagtgcccactttagccagttgcagtaaggccccaaaagtagtgatcctgagcaaggcccttgaatacctgcaggcattagtaggggctgaaaaacggatggcaaccgaaaaacgccaattgagatgtcgccagcagcagctgcagaagcggatcgcatacctgactggatactag

SEQ ID NO: 17996 - DNA, 1185 bp, Artificial Sequence
  Description of Artificial Sequence: Synthetic coding sequence
atgtgtgtgtgcgcggggtgccgagccgcaccttctagaagaggcgcaggtcctctgcaggttgccggaggctggtctgaaggggcagacatggattatgacagctatcagcactacttctatgattacgactgtggagaggatttttaccgatcgaccgcaccatcagaagatatttggaaaaagtttgagctggtgccttctcctcccacttcaccgccctgggggctcggcccaggcgctggtgaccccgcacccggaattggtcctcccgaaccctggcccgggggatgtaccggtgacgaagcggaaagtcgggggcacagtaaggggtggggcaggaactacgctagcatcatcagacgggactgcatgtggagtggcttcagcgcgcgcgagcgcctcgagagagcagttagcgacaggctggcccctggtgccccccgcggaaacccccctaaggcatcggcagctcctgactgtactccctccttggaagcaggaaatcccgctccagccgccccctgcccgttaggcgaacctaaaacgcaggcatgcagtggttccgaatcccctagcgattccgagaacgaagagattgatgttgttactgtggagaagcgccagagccttgggattcgcaaaccggtgactatcactgttcgcgctgaccctctggatccctgtatgaagcatttccacatctctatccatcagcaacagcataattatgcggcgcgctttccacctgagtcctgttctcaggaggaggcctcagagcggggaccccaagaggaggtgctagagcgcgacgctgcgggggagaaagaagatgaggaggatgaggagatagtgtcacctccaccagtggaatccgaggcagcccagagttgtcatcccaagcccgtaagcagcgataccgaagatgtgaccaaaaggaaaaaccataattttttagaaaggaagcggcggaacgatctcagaagccgcttcctggcgctccgggatcaggtgccgactctagcgtcctgctcgaaggctcccaaggtggtgatcctcagtaaagctctggagtacttgcaggctcttgtgggggccgaaaagcgtatggccacagaaaagcgccagctccgctgtcgccagcaacagctgcagaaaagaattgcatatctcacaggctattag

SEQ ID NO: 17997 - DNA, 621 bp, Artificial Sequence
  Description of Artificial Sequence: Synthetic coding sequence
atggattatgacagttaccaacactacttttatgactacgattgcggggaggacttctacagaagtactgccccctctgaggacatttggaagaaattcgagttagtgcccagtcctcccacttccccgccctggggtctcggccccggagccggggaccccgcccccggaatcggtccacctgaaccatggccgggaggctgtacaggggatgaggcggaatctcgcggccactccaaaggctggggccggaactacgcgagcattatacgcagagactgtatgtggagcggtttttccgcacgcgaacgcttggaaagagcagtgagtgataggctggcgccgggagccccacgaggaaacccccccaaagcttccgctgcccctgactgtacaccttccctagaggctggcaaccctgcgcccgcagctccctgccctctcggcgagccaaaaacccaggcatgctctgggtccgagtcgcctagcgacagcggcaaagacctgcccgaaccctctaaacgcgggccacctcacggttggcctaagctctgcccatgtctgcggagcggaattggttcaagccaggcattgggcccatcgccccccctatttgggtag

SEQ ID NO: 17998 - DNA, 303 bp, Artificial Sequence
  Description of Artificial Sequence: Synthetic coding sequence
atggattatgactcctaccagcactatttttacgattatgattgtggggaagatttctaccgttctaccgcgccttccgaggatatatggaaaaagttcgagctggtgccgtcgccacccactagccccccctggggactgggaccaggcgcgggggacccagcgcctggcattggtccccctgagccatggccaggcggctgcaccggtgacgaggctgagagtagggggcactccaaggggtggggcagaaactatgcgagcataattaggcgcgattgcatgtggtcaggtttcagctag

SEQ ID NO: 17999 - DNA, 642 bp, Artificial Sequence
  Description of Artificial Sequence: Synthetic coding sequence
atgccaaggcgcgccgagaattgggatgaggcggaagtaggtgctgaggaggccggtgtggaagagtacggacccgaggaagatggaggcgaagagtctggtgcggaggagagcggcccagaagagtcgggccccgaagagctgggggccgaggaggagatggaggcgggccggcctcgtccagtcctgcggtccgttaattctcgggaaccatcccaggtgatattctgcaaccgaagtccaagagtcgtcctgcccgtctggctgaatttcgatggcgagcctcagccctatcccaccttaccccccgggacgggcaggcggatacactcttacaggggccatttatggctgttccgagacgctggcacccacgacggcctgctggtcaaccagaccgagctgttcgtcccctcattgaatgtagacggccagcccatctttgctaacattacacttccagtctacaccctgaaagagcgctgcctgcaggtggtgaggagcctagtcaagccagagaattatcgccgactggacatcgttaggtccctgtatgaagacctagaggaccaccccaacgtgcagaaggatctggagagactcacacaggaacgaattgctcaccagcggatgggggattag

SEQ ID NO: 18000 - DNA, 519 bp, Artificial Sequence
  Description of Artificial Sequence: Synthetic coding sequence
atgcctcgacgcgccgaaaactgggacgaggctgaggtcggggcagaagaggccggagtggaagagtatggccctgaggaggacggcggcgaggagagcggagccgaggaatctggccccgaagaatcaggccctgaagagctaggcgctgaggaagaaatggaagccggcaggccccggccggttttgcggagtgtgaactcccgggaaccatcccaggttattttctgtaataggtctcctcgagtggtactccccgtgtggctgaactttgatggagagcctcagccttaccctaccctgccgcccggtacaggtcgtcgaatccactcctaccgcgtgtacaccctgaaggagaggtgcttgcaagtagttagaagcctggtcaagcccgaaaactatagaagattagacattgtgaggtcgctatacgaggatctggaagaccatcctaacgttcagaaagacctcgagagattgactcaagagcgcatcgctcatcagaggatgggtgattag

SEQ ID NO: 18001 - DNA, 396 bp, Artificial Sequence
  Description of Artificial Sequence: Synthetic coding sequence
atgcccagaagagcggagaattgggacgaggctgaggtcggagccgaggaggctggggttgaggaatatggcccagaggaggactcctatcgggggcacttatggctgttccgtgacgccgggacacatgatggactccttgttaatcagacggaacttttcgtgccatctctcaatgtcgacggccagcctatatttgccaacatcaccctgcccgtttacacactcaaagaaagatgtcttcaggtagtgcgaagccttgtcaaacctgaaaattatcggagactcgatattgtgcggtcactgtacgaagaccttgaagatcatcctaacgtgcagaaggatctagagaggctcacccaagagaggattgcacatcaaagaatgggagattag

SEQ ID NO: 18002 - DNA, 1281 bp, Artificial Sequence
  Description of Artificial Sequence: Synthetic coding sequence
atggtgcacttttgtgggctgttgacactgcaccgggagcccgtgccactcaaatccataagtgtttcagttaatatctatgaatttgtggcaggcgtgtcggccacccttaactacgaaaatgaggagaaggtgcccctggaagcttttttcgtattccccatggatgaagacagcgccgtgtacagtttcgaagcccttgtagatgggaaaaaaattgtggcggagcttcaagataaaatgaaagctcggacgaactacgaaaaggccatttcccagggacaccaggctttcctgcttgaaggtgattcatcatctcgggatgtgttcagttgtaacgtgggcaatcttcagcctggatcaaaggccgcggtgaccctgaagtatgtgcaggagctgcctcttgaggctgacggagccctgcgattcgtgctgcctgccgtgttaaatccccggtaccagttctcaggatcgtccaaagactcatgcttgaacgtcaaaacccccatagtacccgttgaggatttgccctacaccctcagcatggtcgccacgatcgactcacagcacggcattgagaaagtccagtctaactgtcctctttcgcctacagaatatctcggcgaggataaaactagcgctcaggtctccttggctgccggtcacaaatttgaccgagatgttgaactcctgatctactataacgaagtccacacccccagcgtcgtgctagaaatgggaatgccaaatatgaagccaggccacctaatgggggacccttccgcgatggtgagcttctatcccaacatccccgaggaccagcccagtaacacctgcggagagtttatttttctgatggatcgcagtgggtcaatgcagagtccaatgtcctcccaggatacaagccagctgagaattcaagccgccaaggaaactttgatattgttgctcaagtcattaccaataggctgttacttcaacatctatggctttggctccagttatgaagcatgcttccctgaaagcgtcaagtacacacagcagactatggaggaagctttggggagagtcaaacttatgcaggctgacctgggagggactgagattctcgcgccactgcagaatatttatcgtgggccttccatccctgggcaccctctgcaagtattcgagcggccctacactcttaccgtgcttctcctgcacctgtccccggagggaaacctctgcgtcattcgaccacggcactccagatggacaattaccgtctccgtggggtag

SEQ ID NO: 18003 - DNA, 2361 bp, Artificial Sequence
  Description of Artificial Sequence: Synthetic coding sequence
atggtgcacttttgcggtctactgaccctacatcgcgagcctgtcccgctcaagtccatttcggtgtccgtcaacatatatgaatttgtggcaggtgtaagtgcaacgcttaactacgagaatgaggaaaaggtgcctctggaagccttctttgtgtttcctatggacgaggactctgccgtgtattcctttgaggccctggtggatggaaaaaagattgtcgctgaattgcaggataagatgaaagcgcgaaccaactacgagaaagcgatatctcaaggtcaccaggccttccttctggaaggagatagctcttcaagggacgtgttttcctgtaatgtcgggaacctgcagcccggatcaaaggccgcggtgacactgaagtacgttcaggaattacccctggaggcagatggcgcgttgagattcgtgcttccggcagttctcaatccgcggtatcagtttagcggcagcagcaaggatagttgtctcaatgtcaaaacaccaatcgtgcccgtcgaggatttgccatacactctgtcaatggtggcaacaatcgatagtcagcatggcatagagaaagtgcaatcaaattgtccactgagccctacagagtacctgggcgaggataaaaccagtgcacaggtaagcctcgctgctggacataaattcgatagagacgtggagttacttatatactataacgaggtccatacccctagcgttgtgctggagatgggcatgccaaacatgaagcccgggcacctaatgggggacccttcagccatggtgagtttttatccaaatattccagaggatcagcccagtaacacctgcggtgaattcatctttctcatggataggagcggatccatgcaatccccaatgagcagccaggacacaagtcaacttaggattcaggcagcaaaggaaacgctgattctcctgctgaaaagcttgcctataggatgttacttcaacatctacggctttgggtctagctacgaagcctgctttcctgaatccgttaagtacacacaacaaaccatggaggaagctctggggcgagtgaagctgatgcaagccgacctcggtggaaccgagattctggccccgctgcagaacatctaccgagggccctcgataccgggccaccccttacaattgttcgtcttcactgacggcgaggtaactgacacatttagcgtgataaaggaggtacgcatcaaccgacagaagcacagatgcttttctttcggcatcggagaaggcacctctacatccctcataaaaggtattgcacgggcgagcgggggtaccagcgaatttatcaccggcaaggacagaatgcaatctaaggctctccgaaccctgaaaaggagtctgcagcctgtggttgaggacgtgtccttatcttggcatcttcctccagggctaagcgcaaagatgctctctcccgagcagacggtcatatttagaggccagagacttatatcttatgctcagcttacaggtaggatgcccgctgctgagaccactggggaggtgtgcctgaaatatacattacaggggaaaacttttgaggataaggttacattccctttacagcccaagcctgacgtgaacctgactatccaccggctggccgccaaaagcttgctccagaccaaagatatgggactcagagagacccctgccagcgacaagaaagacgccttgaacctgtctctagaaagcggtgttattagctctttcacagcattcattgctatcaataaggagctgaacaagccagtgcaggggccactggcccaccgcgacgtccctaggcccatcctgttaggcgcctccgccccccttaaaatcaaatgccaatccggattccgaaaggccctgcacagtgacagacccccctctgcttcccagccgaggggggagctgatgtgctacaaagcaaaaacatttcagatggatgactatagcctctgtggcttgatctctcacaaagaccagcattcccctgggttcggggagaaccaccttgtgcagctaatctatcaccagaatgcaaatggctcatgggatctcaacgaggatttggccaagatcctgggaatgtctcttgaggagatcatggccgcgcaaccagctgaattggtggactcctcaggttgggcaacaatcctcgccgttatttggttacatagtaacggtaaggatcttaagtgcgaatgggagctgctggagaggaaggcggttgcgtggatgagagcgcacgccggctccactatgccgtccgtcgtgaaggccgccataacgtttctgaaatccagtgttgaccctgcaattttcgctttttag

SEQ ID NO: 18004 - DNA, 1248 bp, Artificial Sequence
  Description of Artificial Sequence: Synthetic coding sequence
atggttcacttctgtggccttctgacattgcaccgcgagccggtcccgctaaagagcatctccgtttcagtgaacatctacgagttcgtagcgggggtgagtgccacactgaactatgagaatgaagaaaaagtccctcttgaggctttttttgtcttcccaatggacgaggactcagccgtgtactcttttgaggctctcgtggatggtaaaaaaatcgtggccgagctgcaggacaaaatgaaggcacggactaactatgagaaagccattagccaaggacaccaagcatttctgctggagggcgactctagtagtagggacgtttttagctgcaatgtgggtaacctacagccggggagtaaagccgccgttaccctaaagtacgtccaagagttgccactagaggctgatggcgccctcagatttgtgcttcccgccgtactgaaccctaggtatcagttcagtggtagctccaaggactcatgtctcaacgtcaagacaccaatcgtgccggtcgaggacctgccgtatacactgagtatggtcgccaccattgacagtcagcatggcatcgagaaggtgcagagcaactgtccgctttcacctaccgagtatctcggggaggataagactagcgcgcaagtgtcacttgctgccggtcacaagtttgaccgcgacgtggagctcctgatttactacaatgaagtccatacaccatctgttgtgttagagatggggatgcctaacatgaagcccggtcacctcatgggtgaccctagcgcaatggtctccttttacccaaacatccctgaggatcagccctcaaacacctgcggagagttcatcttccttatggacaggagtggtagcatgcagtcacctatgagcagtcaggatacatcccaactgcgcatacaggccgccaaggagacccttattctgctgctcaaatcccttccgatcggctgctactttaacatatacggcttcggtagcagttacgaggcgtgctttcccgagagtgtgaaatacactcagcagacaatggaggaagcactgggcagagtgaagttaatgcaggccgatctgggaggtacggaaatccttgcccctctgcagaacatctaccgggggccaagtataccaggacaccctctgcagttatttgtcttcactgatggggaagtaaccgatacgtttagcgtgataaaggaggtgcgtatcaatagacaaaagcaccggtag

SEQ ID NO: 18005 - DNA, 2361 bp, Artificial Sequence
  Description of Artificial Sequence: Synthetic coding sequence
atggtgcacttctgcggcctgttgaccctgcatcgggagcccgtgcctctaaagtcgatcagcgtgtcagtgaatatttacgaattcgtggctggcgtgagcgctacgcttaactatgagaatgaagaaaaagtgccactagaagccttcttcgttttccccatggacgaagacagtgcagtgtattccttcgaagctttagtggacggtaagaagattgttgcagagctgcaggacaaaatgaaggcaagaacaaattacgaaaaagctatttctcaaggccaccaggcttttctgctggaaggagactccagttctagggacgtattcagttgtaatgtcggtaatctgcagcctggatccaaggctgcagtgactctcaaatacgtgcaagaactccccctggaagcggatggggctttgcggtttgtactcccagctgtcctgaaccctcgatatcaattttctggttcatctaaagacagttgtctaaacgtcaagactcctattgtcccagttgaggatctgccctacaccctatctatggtggcgacaatagacagccagcacggtattgaaaaagtacaatctaattgtcctttgtctcctactgagtaccttggggaagacaagactagtgctcaggttagcctggcggccggccacaaatttgatcgggatgtggaactgcttatctattataacgaagtccacacgccatcggttgtccttgagatgggaatgccaaacatgaagcccggtcacttgatgggagacccatcagctatggtgtcattttaccctaatatacccgaagatcaaccatcaaacacttgcggagagtttatctttctgatggacaggagcggttctatgcagagccccatgagctctcaggatacttctcagctgaggatacaggctgccaaggaaacccttatcttactattaaagtccctgcccattggctgttacttcaatatatatggcttcggttcaagctacgaggcctgcttcccggagtccgtgaagtatacacaacagacaatggaagaagccttggggagggtcaagctgatgcaagccgacctgggaggaacagaaatcctggctcctctgcagaacatctaccggggcccaagcattcccggtcaccctctgcagctgttcgttttcacggatggcgaggtgacagatactttcagtgtcatcaaggaggtcaggatcaatagacagaagcaccgatgctttagcttcggcataggagaaggtacttccacaagcctgataaagggcattgcccgggcgagtggcggaacctccgaatttatcacaggtaaagaccgcatgcagagcaaagcactccggacactgaagcgctctcttcaaccggttgtcgaagatgtctcactgtcatggcacctgccacctgggctttctgcaaagatgctgagccccgagcagactgttatcttcagagggcaaagactaatatcctatgcccagctgacggggcgcatgcccgctgctgagactactggcgaggtttgcctgaaatacacactgcaaggtaagacgttcgaggacaaagtcacctttccgttgcagcccaagcctgacgtcaaccttaccatacatcggttggccgccaagagtcttcttcagacaaaggacatgggtctcagggaaacaccagcatccgataaaaaggatgctcttaatctgtcccttgagtccggggtcatttcctcatttacagccttcattgcaatcaacaaagagctgaataaaccagtccaggggcctcttgcacacagagacgtacctcggcccatactactcggcgcatcagccccacttaagatcaaatgtcagtctgggtttaggaaggccctccactcagatcgaccaccttctgccagccagccgcgtggtgagctgatgtgctataaagccaaaacatttcagatggatgattatagcttgtgcgggttaatatctcacaaagaccagcactctccaggctttggtgagaaccacctcgttcagctgatctaccatcagaacgccaacggatcttgggatttgaacgaagacctggcgaaaattcttggcatgagtctggaggagattatggctgcccaaccggccgaactggtggatagcagcggttgggcaactatcctcgcggtgatctggctgcattccaacggtaaggacctgaaatgtgagtgggagttgctggagcgcaaagctgttgcttggatgcgcgcccatgctggctcaacgatgccatccgtggtgaaggccgccatcacttttttgaaatcctccgtggatccggcgatctttgctttttag

SEQ ID NO: 18006 - DNA, 1248 bp, Artificial Sequence
  Description of Artificial Sequence: Synthetic coding sequence
atggtgcatttctgtgggctcttaacccttcaccgcgaaccagtgccgctaaagagcatctccgtgtcagtgaatatttatgaatttgtcgccggcgtttcggccactctgaactacgagaacgaagaaaaggttccattggaggccttctttgtgttcccaatggatgaggactcagccgtgtactctttcgaagcacttgtggatggtaagaagatcgtggctgagttgcaggacaaaatgaaggctagaaccaattacgagaaggccatttcacaggggcaccaagcttttctactggagggcgatagctcatctcgggatgtgttttcctgtaacgttgggaatttgcaaccggggagtaaggctgccgtcacgttgaagtatgtccaagaacttccattggaggctgacggggctctgcgatttgttctgcctgctgtactgaatcccagataccagttctcggggagcagcaaggactcttgcctgaacgttaagacccccatcgttccagttgaggatcttccatacaccttaagtatggtggcaacaatcgactctcagcatggcatcgaaaaagtacagagtaattgtcctctgagcccaacggagtacctcggcgaggacaaaacatccgcccaggtctccttagctgcaggccacaaattcgatagagatgtcgagctgctgatttattacaatgaggtgcataccccatctgtggtgcttgagatgggaatgcctaatatgaagccaggccatttaatgggggacccaagtgcaatggtgtctttttatcctaacatacccgaggaccaaccatcaaatacgtgcggtgagttcattttcctcatggaccggagtgggtccatgcaatcccctatgagtagtcaggacacctcgcagctgcggattcaggcagccaaggagacactgattcttcttctgaagtccctgccaatcggctgttactttaatatttacggatttggtagctcctatgaagcatgctttccggagtccgtcaaatatacccaacagaccatggaagaggccctggggagggtcaaactgatgcaggcggatctgggcgggactgagatcttagccccactgcagaacatatatcgcgggccaagcattcccggtcaccccttgcagttgtttgtgtttactgatggtgaggtcaccgacacattcagcgtcattaaagaagtgcgcataaaccggcagaagcaccgatag

SEQ ID NO: 18007 - DNA, 2301 bp, Artificial Sequence
  Description of Artificial Sequence: Synthetic coding sequence
atggccgctctgagcgggggaggaggcggaggcgcagagcccggccaggctctcttcaacggcgacatggaacccgaagccggcgcaggagccggggcagcggcttcctctgcagctgacccggcgatacctgaagaggtgtggaacattaaacagatgatcaagttgacccaggagcacatagaggcgctcttggataaattcggaggagagcataatcccccaagtatctacctcgaggcctatgaagagtacacttccaaattagacgccctccagcaaagggagcagcaacttctggaaagtctcggtaacggcaccgacttctccgtttcaagttcggctagtatggatacagtcacgtcttcaagcagctcctcactaagtgtgctcccttccagcttaagtgttttccagaaccctaccgatgtcgcaaggtcgaaccctaaaagcccacagaagcctattgtgagagtgtttctgcccaacaagcaaagaaccgtggttccagctaggtgcggagttaccgtgcgggactctctcaagaaagcgctgatgatgcgggggctcattcccgagtgttgcgccgtgtatagaattcaggacggggagaagaagcctattggttgggatacagatatttcatggctgacaggagaggagctgcacgtggaggttctggagaacgtaccactcactacacacaatttcgtgaggaagacgttttttactctggcattctgcgacttttgccgaaaactgctgttccaggggtttagatgccagacatgcggttacaaattccaccagcgttgttctacggaagtcccgctcatgtgtgtgaattatgaccagctggatttgctgttcgtgtccaagtttttcgagcaccatccgatacctcaagaagaagcttctctagcggagacagccctaacaagcggctcctctcctagcgctccagcctcagacagcatagggccccaaatcttaacttccccatctccaagcaagtctatacctattccacagccctttagaccagctgacgaggatcacagaaatcagttcggacagagagataggtctagctcagccccaaacgtgcatataaacactatcgaacctgtgaacattgacgaccttatccgagatcagggattcagaggggacgggggcagcacaacaggactttccgccacgcctccagcttccttacccggctcgctgacaaatgtaaaagccctgcagaaatcccctggacctcagagggagcgcaaatcctcgtctagctccgaggacagaaataggatgaaaacactgggccggagggactcctctgacgactgggagatccctgacggccagattaccgtaggacagcgaatagggtctggatccttcggaactgtgtacaaggggaagtggcatggggatgtcgctgtaaaaatgctcaatgtgacagccccaacaccccagcagcttcaggccttcaaaaatgaagttggggtcctcaggaagactcgacacgtcaatattttgctatttatggggtactccacaaaaccacagcttgccattgtgactcagtggtgcgaaggcagtagcctttatcaccatcttcatatcatcgagaccaaatttgagatgattaagctcattgacatagctagacagaccgcccagggaatggactatcttcacgcaaagtcaattattcacagggatctgaaatcaaacaatatcttcctccatgaggatcttacagtcaaaatcggcgattttgggctcgcaacggtgaagtccaggtggagcggctcacaccagtttgagcaattgagtggttccatcctgtggatggctcccgaggttattaggatgcaggacaaaaatccttactctttccagtccgacgtgtacgcgtttggaattgtgctgtatgagttgatgaccggccagctgccttatagcaacataaacaaccgcgaccagatcatttttatggtagggagaggatacctctccccagatttgtccaaggtaaggtccaattgccctaaggccatgaaacgcctgatggcagagtgtctgaaaaaaaagcgcgatgaaaggcccctgttcccccagattctcgcgtccatcgaattgctcgcccgttccttgcccaagatccaccgttctgcaagcgaaccaagccttaatagggccggcttccagaccgaggacttcagcctgtatgcatgtgcctcaccaaaaacaccaattcaggcgggcggttacggtgctttcccagttcattag

SEQ ID NO: 18008 - DNA, 1947 bp, Artificial Sequence
  Description of Artificial Sequence: Synthetic coding sequence
atggagcacatccagggtgcttggaaaacgatttcaaatggcttcggattcaaggacgctgtctttgatggcagcagttgcatcagccccactatagtccagcagttcggctaccaaagacgcgcttctgacgacgggaaactaacagacccatctaagactagtaataccatccgagtgttcctgcccaacaagcaacgcaccgtggtgaatgtgcggaatggcatgagcctgcacgattgcctcatgaaggccttaaaggttaggggcctccagcctgagtgctgcgccgtgttccgcctccttcatgagcataaaggcaagaaagcgcgcctggactggaatacagacgccgcctctctcattggggaagagttgcaggtggatttcttggatcacgtgcctctgacgacacataactttgcacggaaaacatttttaaagcttgccttttgcgatatctgccagaagtttctgctcaacgggttccggtgccagacatgtgggtacaaatttcacgagcattgcagcaccaaggtgcccaccatgtgtgttgactggagcaacatccgacagcttctgcttttccccaattcaacaataggagatagtggcgtccccgctctgccctcccttacgatgagaaggatgcgagaatctgtctctagaatgccagtaagctctcagcaccgttatagcacaccacacgcctttactttcaatacctcgtctcccagcagcgaaggaagtctgtctcagcggcaaaggtccacctccacccctaatgtgcatatggtatctaccacccttccagtcgacagtcggatgatcgaggatgccatccggagtcattcagaatccgcctcaccctctgcgctctcaagcagccccaataacctctctcccaccggatggagccaaccgaagaccccagtgcccgctcaacgggagagggcacctgtgtccggaacacaagagaagaacaaaattcgtcctcgagggcagagagatagtagttactattgggagattgaagcatcagaagttatgctgagcacccggatcggcagcggctccttcggcactgtctataaagggaagtggcatggcgacgtggccgtcaagattttgaaagttgttgacccaaccccagagcagtttcaggccttccggaatgaagtcgccgtactcaggaagacacggcacgttaatatactcctgttcatgggctacatgacaaaagacaatctcgccatagtcacccagtggtgtgaaggtagctccctctataaacatctccatgtacaggagaccaaattccagatgttccaactgatcgatatcgcaagacagaccgcccaaggaatggactacctgcacgcaaagaacatcatccaccgggatatgaagtctaataacatcttccttcacgagggcttaacagtcaagatcggcgactttggcctggcaaccgttaaatccaggtggtctggctctcagcaggttgagcaacccactgggagcgttctgtggatggccccagaagtgatccgtatgcaagacaataatccatttagtttccagtcggatgtgtattcttatggcattgtcctgtacgagttgatgactggggagttaccgtactcccacatcaacaaccgcgaccagattattttcatggttggccgcggctatgcctcccctgatttgagcaaattgtacaagaactgcccaaaggctatgaagagattggtcgccgactgcgtaaagaaagtgaaggaagagagacctctgttccctcagattctgagcagcatcgaattgttgcagcactcactccccaagataaaccgctcggcctcagagccttctcttcaccgtgctgcccatactgaggacatcaatgcctgcacactcacaaccagccctaggctgcctgtgttttag

SEQ ID NO: 18009 - DNA, 2007 bp, Artificial Sequence
  Description of Artificial Sequence: Synthetic coding sequence
atggagcatatacagggcgcatggaaaactatttctaacgggttcggcttcaaagacgccgttttcgatggctcttcttgtattagcccaaccatcgtgcagcaattcggataccaacggagagcctcagacgatggtaaacttaccgacccttctaaaacctcaaacactattagagtgttcctgcccaacaagcagagaaccgtggtgaacgtgcggaacgggatgtcccttcacgattgtctgatgaaagccctgaaagttcgcgggctccagcccgagtgctgcgcagtgttcagacttctccatgagcataaggggaagaaggctcgcttggactggaataccgacgcagccagcttgatcggggaagagctccaggtcgattttctcgaccacgtgccgttgacaacccacaactttgcccggaaaaccttccttaaactggcattctgcgacatctgccagaagttcctgctgaatgggttcagatgccagacctgcggatataagttccacgaacattgctccaccaaagtgcccacaatgtgtgtggattggtcaaacattagacagctgcttctctttccgaattccaccattggagacagtggggtccccgcgctgccatctctaacaatgaggcggatgagagaatcagtgagcagaatgcctgtttcatcccaacataggtattcgactccgcatgccttcacatttaacactagcagcccgagttctgaagggtctctatctcagaggcagaggagtacaagcaccccgaatgtacacatggtcagcaccacgctgcctgtggatagtaggatgatagagaataacaatctatctgctagcccacgggcgtggagcagacggttttgcctccgtggtcgggacgctataaggtcccacagcgaaagcgcatcaccatctgccttgtcaagcagcccaaacaacctttctcctaccggctggtcacaacccaagactcccgtccctgcccagagagagagagcccccgttagcggaacacaagagaaaaataagattaggccacggggacaacgggactcatcctactactgggagatagaagcaagcgaggttatgctgtctacgcgaatcggcagcggcagctttggcactgtttataaaggaaaatggcatggtgatgtggcggtcaagattctcaaggtcgtcgacccgaccccggagcagtttcaggcttttcggaacgaagtcgccgtgctcaggaagacacgacacgttaatatcctcctgtttatgggatatatgaccaaggacaatttggcaatagttacccagtggtgcgaaggaagctctttatacaaacatctgcacgtgcaggagactaagtttcaaatgtttcagctgatagacatcgctaggcagaccgcccaggggatggactacctccatgctaaaaacatcatccaccgcgacatgaagtccaacaatatcttcctgcacgagggcctaacagtgaagatcggggatttcgggctggccacagtcaagtctaggtggagtggtagtcagcaagtggaacaacctactggctccgtgctttggatggctccagaagtcatccgaatgcaggacaacaacccattttcattccagtctgatgtttacagttatgggattgtgctctacgagcttatgactggtgagcttccttacagccacatcaacaatcgcgatcagatcatcttcatggtaggacggggatacgcaagcccggatctctccaagctatacaaaaattgcccaaaagctatgaagcgcctggttgctgattgtgtcaaaaaggttaaggaagagcggccattattccctcaaatcttgtcatccatagagcttctgcaacacagtctaccgaaaattaacagaagcgccagcgagcctagccttcatcgcgctgcccatacagaagacattaacgcctgtactctcaccaccagcccccggctaccggtgttttag

SEQ ID NO: 18010 - DNA, 1302 bp, Artificial Sequence
  Description of Artificial Sequence: Synthetic coding sequence
atgtgtgtcgattggtccaacatacgacaattgttctcccaacacagatacagcacacctcacgcattcactttcaacacttccagcccctcctctgaagggtcattgagccagcgccaaaggtcaacttctacaccaaacgtccacatggtctctactaccctcccagtggattctaggatgatagaggacgccattcgaagtcactccgagagcgccagtccctcagccctgtcgagtagcccaaataatttatctcctaccggctggtcacagcctaaaaccccagtccccgcccagcgcgagcgcgcgccagttagcggtacccaagagaaaaataaaatccggcctagggggcaacgggactcctcttactactgggagatcgaggcaagcgaggtgatgctgtccacgcgcatcggcagcgggtcatttgggacagtttacaaaggcaagtggcatggggacgttgcagtgaagattcttaaggtggttgaccccactccagagcagttccaggcgttccggaacgaagttgcagttctccgcaagacccgtcatgtgaacattctcctgttcatgggctacatgacgaaagacaatctggcaattgtgacacagtggtgtgaggggagtagtttgtataagcacctgcacgttcaggaaacgaagttccagatgtttcaattaatcgacatagctcggcagacagcgcaaggaatggactatctgcacgctaagaatatcattcaccgagacatgaagtccaacaatattttcctgcatgagggcctgaccgtgaagatcggcgactttggacttgctacggtaaagtcgagatggagcgggtcacagcaggtggaacagcctactggctctgtgctgtggatggccccagaagtaattaggatgcaggacaataacccattctcattccaatccgacgtctactcctatgggatcgttctgtacgaactgatgactggagaacttccatatagccatattaacaacagggaccagatcattttcatggttggcagggggtatgccagccctgatctctccaaactgtacaagaattgccccaaagcaatgaaaaggctggtggcagactgcgtgaaaaaggtcaaagaagagcgccccctgttcccccaaatactatcttctatagaactcttacagcactcattaccgaagatcaatcggtctgccagtgaaccctcgctccatagagccgcccacaccgaagacatcaatgcatgcaccctgactacttctcccagacttcccgtcttctag

SEQ ID NO: 18011 - DNA, 1704 bp, Artificial Sequence
  Description of Artificial Sequence: Synthetic coding sequence
atgatggcgaatagccagatccttttgcgccaagccacgttaagcgtctttagttgtagaacctctaaggagcaatgtaaaaaagcccgcctggattggaacaccgatgctgctagtctgatcggcgaagaactgcaggtggactttctcgatcatgtgccccttacgacgcacaactttgctagaaagacttttctaaagctggccttttgtgacatctgccagaaatttcttcttaacggattcaggtgccagacgtgcggatataaattccatgaacactgttccaccaaggttccgacaatgtgtgtggattggtcaaatatccgccagttactactctttcccaattcaaccatcggggattctggtgtacccgctttgccaagcctcacaatgagaaggatgcgcgaaagcgtttcaagaatgccagtgagcagccagcaccgatactcaactccacatgcttttacattcaacacttcctccccttctagtgagggtagtctgtctcagagacagaggagcaccagtacccctaatgtacatatggtaagtacaacccttcctgtagactctagaatgatagaggatgctatcagatcccactctgagtcagccagtcccagcgctctgtcctccagcccaaacaatctaagccctacaggctggagtcagcctaaaactcccgtcccagcccagagggagcgggctcccgtgtcgggcacccaggaaaagaataaaatacgtccaagagggcaacgtgactccagctactactgggaaattgaggccagtgaggtgatgctgtccacacgaatcgggtccggatcctttggcacggtctacaagggaaagtggcacggcgatgtggctgttaagatcctgaaggtggtcgatccaactcccgagcagttccaggccttccggaatgaagtcgccgtcctccggaagacacggcatgttaacattcttctgttcatggggtacatgactaaagataatctggcaattgtgacgcagtggtgcgagggcagctctctgtataagcacctccatgtgcaggagaccaagttccagatgttccaactaattgatattgctcggcaaacagcgcagggtatggattatctccacgctaaaaacattattcacagggacatgaaatccaacaacattttccttcatgagggtttgactgtgaaaatcggagacttcgggttagccacagtaaagagcagatggagcggatcgcagcaggtagaacagccgactggtagcgtcctttggatggcacccgaggtgatcagaatgcaagataacaaccccttctcgttccagagcgatgtgtactcctacggtattgtattatatgaactgatgaccggcgagctcccttattcacatatcaacaatcgcgatcagatcatcttcatggtgggtcgtggctatgccagcccggatctgagcaagctgtacaaaaactgccctaaggctatgaaacgcttggtggccgactgtgtgaaaaaggttaaggaagagagacccctcttccctcagatcctgtctagtatcgaactgctccagcactccctccccaaaattaatagatcagctagcgaaccttccctgcatcgagctgcccatactgaagacatcaacgcttgcaccctgacaaccagtccaaggctccctgtcttttag

SEQ ID NO: 18012 - DNA, 1611 bp, Artificial Sequence
  Description of Artificial Sequence: Synthetic coding sequence
atgggttctaacaagagtaaacctaaggatgcctcgcagagacgacggtccttggagccagccgaaaacgtccacggggctggagggggagcctttcctgcgtctcagacccccagtaaacccgcctcggctgatgggcaccgcggaccctccgcagcttttgctcccgccgctgcggagcctaaactgttcggtgggttcaattcaagcgatacagtcacaagcccacagagggctggaccgctcgctggaggagtaacaacctttgttgcattgtatgactatgaaagtcggacagaaacagacttgagctttaagaaaggagaacggctgcaaattgtgaacaatactgagggcgattggtggcttgcgcacagcctgagcacaggacaaacaggatacattccgtccaactacgtggccccctctgattctatccaagccgaagagtggtactttggtaagattacccgacgggagtccgaaagactgcttctcaacgcagagaaccctaggggaacatttctggtgagggaatctgaaacaacaaaaggcgcctattgcctgtctgttagtgatttcgacaacgccaaggggcttaatgtaaagcattataagatccgaaagttggatagtggaggcttttatatcacgtctagaactcagtttaattcactccagcaattggtggcttactattcaaaacacgcagacggtctatgccaccgcctgaccacggtatgtcccacgtcaaagccgcagacgcaaggcctggccaaagacgcatgggagatcccacgggagtcactccgtctagaagttaaactaggacaaggctgcttcggggaggtgtggatggggacgtggaatggaaccaccagggttgccattaagacactcaaaccagggaccatgtcgccggaggcctttctgcaggaagctcaggtgatgaaaaagttgcggcatgagaaactggtgcaactttacgccgtggtctcagaagagccaatttacattgttaccgagtacatgagcaagggctccctcctcgacttcctgaagggcgaaacaggcaagtatctgaggctgcctcaactagtggatatggctgcacaaattgccagcggcatggcatacgtcgagaggatgaattacgtgcaccgagacctgagagcagccaatatcctggtaggagaaaacctagtctgcaaggtcgccgacttcggactcgctcgtctgatagaggataatgaatataccgcccggcagggcgccaagtttccaatcaagtggactgcaccggaggctgccttatacgggcggtttaccatcaaaagcgatgtgtggtcctttggcatcctcctcacagaactgacaacaaaaggcagggtgccctatcccggcatggttaacagagaggtactcgaccaggtggagaggggatatagaatgccttgcccccctgaatgtcccgaatctctgcatgatctcatgtgtcaatgctggaggaaagagcctgaggagcgcccaacattcgagtatctgcaagcatttcttgaagattatttcacatctaccgagccacagtaccagccaggggaaaatctgtag

SEQ ID NO: 18013 - DNA, 1629 bp, Artificial Sequence
  Description of Artificial Sequence: Synthetic coding sequence
atgggaagcaataagtcaaaacccaaagacgcctcacagcggagacgtagtcttgaaccggcagagaacgtccacggggcaggtgggggtgcctttccagcttcccagacgccctccaagcctgcctcagccgacggtcatagaggaccctcagcggctttcgcccctgcggctgctgaacccaaactgtttggtggcttcaattcgagcgatacagttacaagtccccaaagggctggcccactggccgggggagtgacaactttcgttgcactgtatgattacgaatccaggacagaaaccgatctgtctttcaagaagggggagaggctgcagattgtgaacaacacacgcaaggtggatgtccgggaaggagattggtggctggcacattcactctccaccggccagaccggatacattcctagtaattatgtggccccctccgactctatacaggccgaagagtggtacttcgggaaaatcactcgccgagaatctgaacgattgctgctaaatgctgagaatcctcggggcacgttcctggtccgagaatcagagacgacaaaaggcgcctactgcctctccgttagtgacttcgataacgccaagggactcaacgtcaaacactataaaatacggaagctagattcaggggggttctacatcactagccggacccagtttaacagcctgcagcaattagtggcgtactactccaagcatgcagacggcctgtgccatagactgacgacagtctgtcccaccagcaaacctcaaacccaagggttggctaaggacgcttgggagatcccccgggaatctcttcgactggaagtgaaattaggacaagggtgctttggtgaggtttggatgggcacctggaacggcaccactagagtggccattaagacactgaagccggggacgatgagcccagaagctttcctgcaggaggcccaggtgatgaagaaactgaggcatgagaagctggtacagctgtacgcggtggtctccgaagagcccatctacattgtcaccgagtacatgtctaaaggcagcttgctggactttttgaagggcgaaacagggaaatacttaaggttgccccaattagtggacatggccgctcagatcgcatccggtatggcgtatgtcgagcgtatgaactacgttcatagggacctgcgcgctgctaacattcttgtcggagagaacttggtgtgtaaggtggctgatttcggcctcgcacgcctcatagaggacaacgagtataccgcacgtcagggcgccaaatttccaatcaagtggaccgctcccgaggctgctctgtatggtcgattcacgattaagagcgacgtgtggagtttcggaattctgttgactgagctgacaacaaaaggaagggtaccttatcccggtatggtgaacagggaggtactggaccaagtggaaaggggttatcgcatgccgtgccctcccgaatgcccagaaagcctccatgatctgatgtgccaatgttggcgcaaggaacctgaagaaaggcctacatttgaatacctccaagcgtttctagaagattactttactagtacagagccgcagtaccagcccggtgagaacctttag

SEQ ID NO: 18014 - DNA, 1611 bp, Artificial Sequence
  Description of Artificial Sequence: Synthetic coding sequence
atggggtctaataagtcgaagccaaaggatgccagccaaagacgcaggtccctggagcccgcggaaaacgtgcacggtgccggcggaggggcgttccccgcatcgcagaccccatccaagccagcgtccgcagacggccaccgagggcccagtgcagcgtttgcccccgccgctgccgaacccaaactattcggaggtttcaattcatcagatactgtgacgtctccccagagagcaggcccccttgctggaggcgtaaccacatttgtggccctgtatgattacgaaagtcggacagagactgacctgagcttcaagaagggtgagcggctgcaaatcgtcaacaacactgaaggggattggtggctcgctcattcgctgagcacaggacagacaggctacattccctccaactacgtggcccccagtgattctattcaagccgaagaatggtactttggaaagataaccaggcgcgaatccgaaagactactgttaaacgctgagaatcctagagggactttcctggtgagagaatcagaaacaaccaagggcgcttactgcctctcagtgtccgattttgacaacgccaaaggcctcaatgttaaacattacaaaatcaggaagctggattcaggaggtttctatatcacatcacgcacccaattcaactctctgcagcagctggtcgcttattattcaaagcacgcggacggcttgtgccaccggttgacaactgtctgccccacttccaagccgcaaacccaggggctcgcaaaagatgcctgggagatcccaagagaatcactgcgactggaggtcaagctgggccagggctgttttggagaggtgtggatgggaacttggaacggaactactcgcgtggccataaaaacattgaagcccggtacgatgagcccagaggctttcctgcaggaagcgcaggtgatgaagaaactgagacatgagaaactggtccaactgtacgctgtcgtgagtgaggagccaatttacatagtcactgagtacatgtcaaaggggtctctgttggactttttgaagggagagacgggcaagtacttgaggctgccgcagcttgtcgatatggctgctcagatcgcctccggcatggcatacgtggagaggatgaactatgtccacagggatctgcgagcggctaacatactggtgggggaaaacttagtttgtaaggtcgcggacttcggactcgctagactgatcgaggataacgagtacacagctcgacagggggcgaagtttcctatcaaatggactgccccagaggctgccctctacgggcggtttactataaaatctgacgtgtggagcttcggcatactccttactgagttaacaaccaagggacgagtgccctatcccgggatggtaaatagagaagtgttagaccaggtagagagggggtatcgaatgccatgcccccctgaatgtcccgaaagtttgcacgatttgatgtgtcagtgttggcggaaggagccagaggaacgccctaccttcgagtacttgcaggccttcttggaggattactttacgagtacagaaccacaataccagccgggagagaacctgtag

SEQ ID NO: 18015 - DNA, 1611 bp, Artificial Sequence
  Description of Artificial Sequence: Synthetic coding sequence
atgggatccaacaagtcgaagcccaaggacgccagtcagagaaggcgttcacttgagccagcagaaaatgtccatggcgcagggggtggcgcctttcctgcttcacaaaccccaagcaagccagcgtcagccgacggccatcgggggccttccgccgcttttgctccagccgctgcagaacctaaactgttcggcggatttaattcaagtgacacggttactagtcctcagagagccggacctctggccggtggggtaactacattcgttgctttgtatgattatgagagcagaacggaaactgacttatcctttaagaaaggcgaacggcttcagatagtgaacaacacggagggagactggtggctggcccattcgctatccactgggcaaactggctacatcccgagtaattatgtagctccaagcgactccattcaggccgaggagtggtattttggaaaaattactcgcagggaaagcgaaaggttgctgctcaacgcggaaaatccacgtggaacttttctcgtgcgcgagtccgaaacaacgaaaggtgcctattgcctttctgtcagtgactttgataacgccaagggactgaacgtaaaacactataagattagaaaactggactctggagggttttacattacatcccggacccagttcaattctttacagcaacttgtggcctactatagcaagcacgctgatggactctgccatcggctcactaccgtgtgtcctacatccaagccgcagacacaagggctggccaaagatgcatgggaaataccgagagagagcctgcgcctggaagtgaagcttggccaggggtgctttggcgaagtctggatggggacttggaacggcactactcgcgtggcaatcaagactctgaagcccggcacaatgtcccctgaggccttcctacaggaagctcaagtaatgaaaaaactgcggcatgagaaattggtgcagctgtatgctgtcgtgtctgaagagccaatatatattgtgaccgagtacatgtctaagggctcattgctggatttcctgaagggcgaaaccgggaagtatctacgtctgccacagctcgtcgatatggcagcccagatcgccagtgggatggcctatgtagaaaggatgaattacgtacatcgcgacctgcgggctgcaaatattctggtgggcgagaatttggtctgtaaagtggccgacttcggcctggccaggctgatcgaggacaatgaatacacagctagacagggagcgaagttccccatcaaatggactgccccagaggccgccctgtacgggaggttcaccatcaagagcgacgtctggtcctttggaatcctgcttacggaactcactactaagggccgggttccctacccaggaatggttaatcgcgaggttctggaccaggtggaaagaggctacaggatgccatgccctccagaatgcccagagtcgctacatgacctgatgtgtcagtgctggaggaaggagcccgaggagaggcctaccttcgagtacttgcaagcctttctggaagattactttacttccacggaaccgcagtaccaaccgggggaaaatttatag

SEQ ID NO: 18016 - DNA, 1611 bp, Artificial Sequence
  Description of Artificial Sequence: Synthetic coding sequence
atgggctcaaacaagtcaaaaccaaaggatgctagccagcggcgacgtagcctcgagccagcagaaaacgtccacggagctggcggcggggccttccccgcgtctcagacacccagcaagccagctagcgcagatggacatagggggccgtccgccgcctttgccccagccgccgctgagccaaaacttttcggcggcttcaatagttcggatacggtgaccagcccacaaagggctggacccctggccggaggcgttaccacattcgtggccttgtacgactatgagtcaagaactgagacagacttgagcttcaagaagggcgagcgcttgcagatcgttaacaataccgaaggggactggtggctggctcactctttgtcaacagggcagactggttatattcctagcaactatgtcgcaccgtcagattcaattcaggcagaggaatggtatttcggcaaaattactagacgcgagtctgaacgactactcttaaatgccgagaatccacgagggacatttctggtcagggagtctgaaaccactaagggcgcctattgcctgagcgtcagtgatttcgacaatgctaagggactcaatgtcaagcattataagatacgtaagctggacagcggtggattctacatcacctctaggactcagtttaatagcttgcagcagcttgtggcctactattctaagcacgccgacggcctctgtcataggctgactaccgtatgccctacgtctaaacctcaaacacagggtctcgctaaggatgcttgggaaatccctcgcgaaagcctcaggctggaggtcaaactggggcagggatgttttggggaggtctggatgggtacctggaatgggacgacacgggtggcaataaagactctcaaacccggcaccatgagccccgaagcctttcttcaggaggcccaggtcatgaaaaaactccggcatgagaaactggtgcagctgtatgccgtggtgtccgaggaacccatttacatcgtcaccgagtatatgagtaagggttcactcctcgatttcctgaagggagagaccgggaaatacttacgactcccacagctcgtggatatggcggcccagatcgcaagcggcatggcttatgtggaacgcatgaattacgtacacagagatttaagggcggcaaacatcttggtaggcgaaaacttggtttgtaaagtggccgactttggattggcccggctgatcgaagataatgagtatacagccaggcagggcgcaaaattcccaatcaagtggacagcaccagaagcagcactgtacggccgattcactattaagagcgatgtctggagctttgggatcctgctgactgaactaacaacaaaaggaagagtgccctaccccgggatggtaaatagggaagtcctcgatcaggtggaaaggggctaccgcatgccctgtcctcctgaatgtcccgagtccctgcacgacttgatgtgccagtgctggaggaaggagccagaagagcggcctacatttgagtaccttcaggcctttcttgaggattatttcacatccaccgaacctcaatatcagccaggagagaacctatag

SEQ ID NO: 18017 - DNA, 423 bp, Artificial Sequence
  Description of Artificial Sequence: Synthetic coding sequence
atgcccctggttaagcgaaatattgatcctaggcatttatgtcatacagctctgcctcgcgggattaagaacgaacttgagtgcgtgacgaacatttcactggccaacattattaggcagctatccagcctgtccaaatacgcggaggatatttttggcgagcttttcaatgaggcacacagtttctcgttccgcgtcaactccctgcaggagcgcgtggatagactatcagtgtccgtgactcaactggatcccaaggaagaagagttatctctgcaggacataaccatgagaaaagcattccggagcagcacaatccaggatcagcagctgttcgatcggaaaaccctgccgatccccctccaggagacctatgatgtctgtgagcaacccccccccttaaacattctcacaccatattag

SEQ ID NO: 18018 - DNA, 1680 bp, Artificial Sequence
  Description of Artificial Sequence: Synthetic coding sequence
atgcctctggttaaacgaaacattgaccctagacatctttgtcacaccgcgttgcccagggggatcaaaaacgagctcgaatgtgttacgaacatcagtctcgctaatatcatccgccagctgagcagcctgtccaagtatgcggaagacatctttggcgagctcttcaatgaagcacactcctttagttttcgcgtgaactccctccaggagagggtggatcgcctgagtgtaagcgtaacccagctggatcccaaagaggaagaattaagcctgcaggacatcacgatgcgcaaagccttccgcagctctacaatccaggatcagcaactgttcgataggaagacattacccattcccctccaggaaacgtacgatgtttgcgaacagcccccacccctgaacatcctgaccccttatcgggatgacggcaaggaaggcctcaagttctacaccaacccatcttatttttttgacctctggaaggaaaaaatgctacaggatacagaggataagagaaaggaaaaacgaaaacagaaacaaaaaaacctggaccggccacacgagcccgaaaaagtaccacgggctccccacgaccgccggcgagagtggcagaagctggcgcagggaccggagctggcagaagacgacgcaaatctattgcacaaacacatagaagtggcaaacggccccgcttctcacttcgaaacccggccccaaacatacgtcgaccacatggacgggtcatacagcctgtccgctttacctttttcacagatgtcagagctcctaacaagagcggaagagagagtcctggtgagacctcacgagcccccacccccaccacccatgcacggagctggtgatgccaagcccatcccaacctgtatttcatcagccacgggattgattgaaaatcggcctcaatcgcccgccacgggacggacgcctgtctttgtgtcccctactcccccaccaccgcctccaccactgcctagtgccctaagtacttccagcttgagagcatccatgacaagtacaccgccacccccggtcccaccaccgccgccaccaccagccactgccttgcaggcgcctgccgtgccgccaccgccagccccgctgcagatagctcccggagtcttacacccagccccccctccgattgcccctccactggtacagccttccccccctgtggccagggcggctccggtgtgcgaaacagtgccagtacatcccctcccgcaaggcgaggtgcaaggtctccctccccctccacctcccccgcctttgccgccccctggaattcgaccctcctcccccgtgaccgttacagcactcgctcatcctccttccggcctgcatccgacaccctcaacagcaccaggccctcatgtgccgctgatgcccccttcgcccccaagccaagttatccctgcatctgagcccaagagacatccttctactctgcctgtgatctccgatgcgcggagtgtattactggaggcaatccggaaaggtatacaactgcgcaaggtggaggagcagcgcgagcaggaggccaaacacgaaaggatagagaatgatgtggcaactatcttgagccgtaggatcgccgtggagtattctgactctgaagacgacagcgagttcgacgaggtcgactggttggagtag

SEQ ID NO: 18019 - DNA, 423 bp, Artificial Sequence
  Description of Artificial Sequence: Synthetic coding sequence
atgcctctggttaagcgcaatatcgacccccgacacttatgccacaccgctttgccgcggggaataaagaatgagcttgaatgtgttactaatatttctttggcaaatatcatacgacaactcagtagcctaagtaaatacgcagaggacatcttcggggagttatttaatgaagcacattccttcagctttcgcgtgaattccctgcaagagagagtcgaccggcttagcgtttccgtgactcagttagatcccaaagaagaagagctcagccttcaggacataactatgcggaaggctttcagatcatcaaccatacaggaccaacagctctttgatcggaagactcttcctatccctctgcaggagacctatgacgtctgtgagcagccgccgcctcttaacatcttaaccccctattag

SEQ ID NO: 18020 - DNA, 1680 bp, Artificial Sequence
  Description of Artificial Sequence: Synthetic coding sequence
atgcccttggtgaaacggaatatcgaccccaggcacctgtgtcacacagctctgccaagagggattaagaacgaacttgaatgcgttacaaacatttcattagcgaacattattcgtcagctgagttcactctccaagtacgccgaggacattttcggggagttgttcaatgaggctcattccttctcctttcgagttaactctctccaggaaagagtggataggctctcagtgagcgttacccagctagaccctaaagaagaagagctgagccttcaagacatcaccatgcgcaaagcctttcgcagttccaccattcaagatcaacagctctttgaccgcaagactctcccaatccccctccaggaaacatatgatgtgtgtgagcagccgccacccctgaacatcctgactccctatcgggacgacggaaaagagggcttgaaattctataccaatccctcttatttttttgacttgtggaaagaaaaaatgctccaagataccgaggacaaaaggaaggagaaaaggaagcagaagcagaagaacctggatcgtccacacgaacctgaaaaggtccctagggccccccatgacaggagaagagaatggcagaaactggctcagggtcctgaactcgcggaagatgacgctaacctgttgcacaaacacattgaagtcgccaacggccctgcatcccactttgagacacgaccgcaaacctatgtcgatcacatggacggtagctactctttgtctgccctgccctttagccagatgtctgaattgctgacacgcgcagaagaaagggttctggtccgcccacatgaacctcctccccctccacccatgcacggagccggtgacgccaagcccattcctacctgcatctccagtgctacaggtttgatcgaaaatcgaccccagtccccagccactgggaggactcctgtgtttgtgagccctaccccccctcccccacccccgcctctcccctctgctctctcaacatcctccctgcgcgcctctatgaccagcactccaccccctcctgttcccccccctcctcctcctcctgctactgctctgcaggctcctgctgtcccaccccctccagcgccgcttcaaatcgcacctggggtgctgcaccctgcaccgccgcccatcgcccctcctttagtccagccctctccacccgtggctcgtgcagccccagtgtgcgagaccgtccccgtgcaccccctaccacagggggaggtccagggcttgcctcctcctcctcccccccctcctctgccaccacctgggatccgtccttcctcgcctgtaaccgtgacagccctcgctcacccgcctagcggcctgcaccccaccccctctacagcccccggaccacacgtgccactgatgccaccttctccgccgagccaggtaatccctgctagtgagccgaagaggcacccctctacactgcccgttatctcagatgcccgctctgtccttttggaagcgattcgaaagggcattcagttacggaaggttgaggagcagcgtgagcaggaggctaagcacgagcgcatagaaaacgacgtcgcaactattctatccaggaggatcgccgtagaatatagtgattccgaggatgactcagaatttgatgaagtcgattggctcgagtag

SEQ ID NO: 18021 - DNA, 1680 bp, Artificial Sequence
  Description of Artificial Sequence: Synthetic coding sequence
atgcccctggtgaagcgaaacatcgatcccagacacctgtgccatacggcacttccaaggggaatcaaaaatgaactcgagtgcgtaactaacatatccctggctaacataatccgtcagctcagttcgttgtctaaatatgcggaagacatctttggtgagttgttcaacgaagcccacagcttctctttccgcgtcaatagcctacaggagagggtggataggttatcagtctcagttacacagctggatccgaaagaggaagagctgagtctgcaggatattacaatgcgtaaggctttccgatcttcaaccattcaagatcagcagttgtttgatagaaagaccttgcctatccctcttcaggagacttacgatgtgtgtgaacaaccacctcccttaaacatcctaaccccctacagggacgatgggaaagaaggattaaaattctacaccaatcctagctattttttcgatctgtggaaggaaaagatgctacaggatacggaggataaacgaaaggaaaagcgtaagcaaaagcagaagaatctggacagaccccacgaaccggagaaggtccctcgagccccacacgaccgaaggcgcgaatggcaaaagttggcacagggtcccgagcttgcggaggatgacgctaatctcctgcataagcatattgaagtggccaatggacctgcctctcacttcgaaacacgcccacagacgtatgtcgatcacatggacggatcctactcccttagcgccttgccattctcacaaatgtcggagttgctcaccagagccgaggaaagagtcctggtgcggccacacgaacccccacctcccccgcctatgcacggggctggtgacgccaagcctattcctacgtgtatctcttccgcaactggtctcatagagaatcgtcctcagtctcctgccactggcaggactccggtgtttgtatctcccacgcctcccccaccacctccacccctgcccagcgcactgtcgacatccagcctcagagcctccatgaccagtacccctcctccacctgtaccacctccaccccctcctcctgctaccgccctacaggcccccgccgtgccgccaccccctgctcccttacagattgcgcccggagttttacatccggccccaccgccaatagcacctccgctcgtgcagccatccccccccgtggctagagctgctccggtctgtgagacagttccagttcacccactaccacagggagaagtgcaaggattgccaccacctcctcccccgccacccctacccccaccaggtatcagaccatcaagtcctgtcaccgtgaccgccttagctcacccaccaagcgggctgcacccaaccccctccacagcccccggacctcacgtccccctaatgcccccctcaccaccaagtcaggtgatcccggcttcagagcccaagagacacccatccactttgcccgtgattagtgacgctcgctccgtgctgctggaagccattcgtaaagggatccagctcaggaaagtagaggaacaaagggagcaggaagccaaacacgagcgcatcgaaaacgatgtggccacaatcctgtctaggcggattgccgtggagtattccgactcagaggacgatagcgagttcgatgaggtagactggttagagtag

SEQ ID NO: 18022 - DNA, 1680 bp, Artificial Sequence
  Description of Artificial Sequence: Synthetic coding sequence
atgcctctggtgaagcggaacatcgatcctcggcacctttgtcatactgcactgcccaggggaatcaaaaatgaattggagtgcgtgacaaacatcagcctggccaacataatacgacagttgagcagcctttctaaatacgccgaggacatctttggtgagctgttcaatgaggcccattcatttagcttccgggtgaactcattgcaggaaagagtggatagactctcagtcagcgtgacacagttggaccccaaggaggaggaacttagcctccaggacattacaatgcggaaggcctttcggtcctctactatacaggaccagcagctctttgacaggaagaccctgcctatcccgctgcaggagacatacgatgtctgcgagcagcccccccccttgaacatcttgactccctatcgcgatgacggtaaggagggactcaaattctataccaatccgtcctactttttcgacctgtggaaagaaaagatgttgcaggacacggaggataaacggaaagagaaacggaaacagaagcagaagaacttagatcggcctcacgagcctgagaaagtaccgagagcacctcatgatagacgcagggaatggcagaagctcgcccagggccctgaattagccgaagatgatgctaacctgctccataaacatattgaagtcgctaatggccctgccagtcattttgaaacgaggccacagacgtatgttgatcacatggacggatcatactcactgtctgccctgccattttctcaaatgagcgagctgttgactcgcgccgaggagcgcgtgctcgtgcgaccacacgaaccacccccaccacccccaatgcacggcgcaggagacgcaaaaccaatacctacttgtatcagcagcgcaacagggctgattgagaaccgcccccagagccccgcaaccgggcgcacgccagtgttcgtgtctcctactcctcctcccccacctccccctctaccaagcgctcttagcacttcttcgcttagagccagcatgacctccactcctccaccccctgttcccccccctcccccaccccccgctacagctctgcaggccccagccgtgccgccacctcccgcgcctctccaaattgcccccggcgtgttacaccctgcccccccacccatagccccccctctggtgcagccaagcccacctgtggccagagctgcaccagtgtgcgaaacagtgccggtgcatcctctgccacagggggaggtgcagggtctcccaccgcctccccctccgcccccacttcctccacctgggattagacctagtagcccagtcactgtgaccgcgttagcccacccaccttcaggtcttcaccccactccctccactgcgcccggaccgcatgtacccctgatgccgccctctcccccctctcaggtgatccccgcgtctgaacccaaaagacatcccagcactctacccgtcatctctgacgccagatctgtcctgcttgaagccatcaggaagggcatccagctacgcaaagttgaagagcaacgggaacaagaggccaaacatgagcgaatcgaaaacgatgtcgccacaatcctaagcaggaggatcgctgtggaatactctgattccgaagacgactccgagttcgacgaggtggactggctggagtag

SEQ ID NO: 18023 - DNA, 1680 bp, Artificial Sequence
  Description of Artificial Sequence: Synthetic coding sequence
atgcccctagtcaaaaggaatatcgaccctcgacacctgtgtcacacagccctacccaggggcatcaaaaacgaattagagtgtgtgacaaatattagcctagcgaatataatacggcagctctcatcactgagcaaatacgccgaagacatctttggcgagctgttcaatgaagcacatagtttctcctttcgcgtgaacagcttgcaggagcgggtcgaccgtctgagcgtgagtgtgacacaactggatccaaaggaggaagaactctctctgcaggacatcacaatgaggaaagctttccggtccagcacgatccaggatcaacagctgtttgacagaaagaccttgcccattcctctgcaggagacctatgacgtctgtgaacagccaccccccctcaatattctcacaccctatcgagacgatggaaaagagggtttgaaattctacaccaatccctcttacttcttcgacctgtggaaagaaaaaatgttgcaggatacagaggacaaacgcaaggagaaacgtaagcagaagcagaagaatctagatagaccccatgaaccagagaaggtgccacgtgccccacacgacaggagacgcgagtggcaaaaactggctcagggtccagagctggccgaggacgacgccaacctcctccacaagcacattgaagtcgctaacggcccagcctcccactttgaaactcgaccccaaacctacgtagaccacatggacgggagctattccctgtctgctctaccattcagccagatgtctgaactactgacgcgggcggaagaaagagtgctggtgcgtccacatgagcctcccccacctccacccatgcacggggccggagatgccaaacccattcctacctgtatcagttctgccactgggctgatcgaaaaccggccacagagtcccgctacaggcaggacgccagtgtttgtctctcctacaccaccaccccctcccccaccactgccctctgccctcagtacatcttccctgagagctagtatgacgagtacaccacccccgccggtccctcctcccccacctcccccggcaacagccctgcaggcccccgctgtccctcccccgcccgcgcctctgcaaatcgcccccggcgtccttcaccctgccccgccccccatcgctccaccgttggtgcagccaagccctcccgtggcccgcgctgcaccagtgtgtgagactgtgcccgtacatccactcccacagggagaggtgcagggcctccccccgcctcctccaccgccgcccttgccgccacccggtatccgtcctagctcacccgttactgtgacggccctggcccaccctcctagcgggcttcatcccacaccttccacggcaccaggccctcatgtgccacttatgccgccctccccaccgagtcaggtgatccctgcctccgagccaaaacgccacccaagcacgctgccagtcattagcgacgccagaagtgtgctcctggaagccattcggaaaggaatccagctacgaaaagtggaagagcagagggagcaggaggctaagcacgagaggatcgagaacgatgtcgcgactatcctgagccgccgcatcgccgttgagtattccgattctgaggacgactccgagtttgacgaggtagactggctggaatag

SEQ ID NO: 18024 - DNA, 270 bp, Artificial Sequence
  Description of Artificial Sequence: Synthetic coding sequence
atgccattggttaaacgcaatatcgatccccggcacctctgccatacagccttgcctaggggcataaaaaatgagctcgagtgtgtgacgaatatctctctcgccaacattattaggcagttgagcagcctatccaaatacgcagaggacatctttggcgagctcttcaatgaggctcatagcttttcatttcgtgtcaattcgctgcaagagagggtcgataggctgtctgtttccgttacccaactggatcccaaagaagaggagtag

SEQ ID NO: 18025 - DNA, 543 bp, Artificial Sequence
  Description of Artificial Sequence: Synthetic coding sequence
atgcctctcgtgaaacggaatatcgaccctaggcacctgtgtcataccgcactgcctcgcggcattaaaaacgaacttgagtgcgtgactaatatcagcctcgctaacatcattcgccaactgagtagcctgtcgaagtacgccgaagatatttttggtgaactgttcaatgaggctcactcctttagcttcagggtaaactctctgcaggaacgcgtggacagactatcagtgagtgtaacccaactggatcccaaggaagaagagctaagtctgcaggacatcaccatgcgaaaggctttcagatcctcaacaattcaagatcagcagctgtttgaccggaaaaccctcccaatccctctgcaagagacctacgatgtgtgtgaacaaccccctcctttgaatattctgacgccttacagagacgacggtaaggagggcctcaagttctatacaaaccccagttatttttttgacctgtggaaagaaaagatgctgcaggataccgaggacaagcgaaaggaaaagaggaaacagaagtag

SEQ ID NO: 18026 - DNA, 270 bp, Artificial Sequence
  Description of Artificial Sequence: Synthetic coding sequence
atgcctttggttaaacgaaacatcgatccacgacacctgtgccataccgcactcccccgcggcatcaagaacgaactagaatgtgtcaccaacatcagtttggcaaacattatccggcagctttcttcactctccaaatatgcagaggatatctttggggaactgtttaacgaggcccactcctttagctttcgcgtgaactctttgcaagaaagagtggacaggctgagcgtgtcagtgacgcaactcgatccgaaagaggaagagtag

SEQ ID NO: 18027 - DNA, 1497 bp, Artificial Sequence
  Description of Artificial Sequence: Synthetic coding sequence
atgcccctggtgacaaggaatattgaacccagacatctttgcagacagaccctacctagcgtgcggtctgagttagaatgcgtgacaaatatcacgctggcaaacgtgattcggcaactgggaagtctatcgaagtacgctgaagatattttcggcgaactgtttactcaagccaatacattcgcaagccgcgttagctcgttggctgagagggtggaccgcttacaagtgaaggttacccagctggacccaaaagaagaagaggtgtcgctgcaagggataaatacgagaaaggcttttaggtcaagcaccatccaggaccaaaagctgtttgaccgtaattcactacctgtaccggtgctggagacttataacacttgtgatactccgcctccactcaataacctcaccccataccgagacgacggcaaagaagctctgaagttttatacggaccccagttatttttttgacctctggaaggaaaaaatgctgcaggacacaaaagatataatgaaagaaaaaaggaaacacaggaaggagaagaaggataatccaaatagggggaacgtcaatcctcggaaaatcaagacgcgaaaggaggagtgggagaagatgaaaatgggacaggaattcgtcgaatcgaaggagaagctgggcacttctggctacccacccaccttagtctatcagaacggaagtataggatgcgtggagaatgtcgatgcctcgtcctaccctccccctccacagtccgactctgcttcgagcccctctcctagcttcagcgaagataatctgcctccccctcctgcggaattcagctatccagttgataaccagcgggggtccggcttggccggccccaaacgaagcagtgtggtgtcaccatctcatccgccgccagccccacctcttggctcacccccgggcccaaaacctggctttgctcccccccccgctcctccaccgccccctccccctatgatcggtattccacctccacccccacccgtgggcttcggcagtccgggaacacctccccctccctcaccgccatccttcccccctcatcctgacttcgcagcccctcctccgccaccaccgcctcccgcagccgattatcccacactgccccccccacccctcagccaacccaccgggggtgcccctcctcccccccctcctcccccgccccccggcccaccacctccaccatttacgggagctgacggccaacctgccatcccacctcctctcagcgatacaacaaaaccaaaatcctccctccctgcagtttcggacgcaagatctgatctcctgtccgctatcagacagggattccaactacggagagtagaagagcagcgagagcaagagaaacgagatgtggttgggaacgatgtcgcgaccattttatcacgccgcatcgcagtagaatactccgactctgaggacgattccagtgagttcgacgaggatgactggtcggactag

SEQ ID NO: 18028 - DNA, 846 bp, Artificial Sequence
  Description of Artificial Sequence: Synthetic coding sequence
atgcctctggtgacccgcaacatcgaaccacggcacctgtgtcgtcagactctaccttctgtacgctccgagctggaatgtgttacaaatattaccttagctaacgtgatccgccagcttggctccctgagtaaatacgcggaggatatcttcggagagctgtttacacaggctaatacgttcgcgtcacgcgtgtcatccctcgccgagcgcgttgatcgactgcaggtgaaagtcactcagctggacccaaaagaagaggaggtgagccttcagggtatcaatacacgcaaggcctttaggtccagtacaatccaggatcagaagctatttgacagaaactcattgcctgtgccagtgcttgagacttataatacgtgcgatactcccccccccctgaataacctcactccatatcgggatgacgggaaggaggccttgaagttttatacagacccttcctacttcttcgatctgtggaaagagaaaatgctccaggataccaaggatattatgaaggagaagcggaagcaccggaaggaaaaaaaggacaaccccaataggggtaatgtcaatcccagaaagatcaagactaggaaagaggagtgggagaagatgaagatgggacaagagttcgtggaaagcaaagaaaaactggggacatccggttaccctccaacacttgtctaccaaaatggttctatcggatgcgtagagaacgttgatgcctcgagttatcccccgccaccccaaagtgacagcgccagcagcccatctccctcttttagcgaagacaatctgccaccaccacccgcagagttcaggttcagtgcggcccagggttag

SEQ ID NO: 18029 - DNA, 1533 bp, Artificial Sequence
  Description of Artificial Sequence: Synthetic coding sequence
atgccagtgcctccgccacctgcccccccccctcctcctaccttcgctttagctaacaccgagaaacccacgctaaataaaaccgagcaggccgggcgaaatgctttgttatctgatatctctaagggaaagaagttaaagaagacagtaacaaatgatagatcggccccgattttggataagcccaaaggagctggtgctggtggcggcgggggagggtttggggggggcggcggctttggcggcggaggaggcggaggcggtgggggcagcttcggggggggaggcccccctggcctgggcggtctgtttcaagccggaatgccaaaattgaggtctacagctaacagggacaacgattccggtggaagtagacctccacttctgcctcccgggggcaggtccaccagcgcgaaacccttttcgcctccttctggcccaggaaggtttcccgtcccttcccctgggcaccggagcggcccacctgagccccagagaaaccgaatgcctcctcctagaccagacgtggggtctaagcccgactcaatccccccacccgtaccatctaccccaagacccattcagtctagtccccacaaccgaggcagtcctccggttcctggtggaccaagacagcctagcccaggccccacacctccccctttccctggaaatcgcggcaccgcacttggtgggggaagtatccgccagtcacctttatcgagctccagtcctttctctaatcgcccacccctgcctccaaccccttccagggctttagacgataaaccgccaccgccccctcccccagtcgggaatcgtccctctatccatagggaggccgtcccccctcctcctccacagaacaacaaacccccagttccctctacccctcgtccttctgccagctctcaggcccctcctcctcctcctccacctagtcgtccggggcctccaccactcccccccagcagttcaggaaatgatgagacccctagattacctcagcgaaatctgtctctttcgagcagcactcctccattacctagccctggaaggagcggtcctttgccaccgcccccctcggagcgtccaccccctccggttagagatcctccaggaagatccgggcccttaccccccccgccccccgtctcacgaaatggctccacctcccgtgcgcttcccgccacaccccagctcccatctagatcaggagtagactctcctagatcgggcccacgaccccccttaccccccgatcgtccttcagccggggcccctccccctcctccgccaagcacgagcattcgaaatgggttccaggattcgccatgtgaagatgagtgggaatctaggttctattttcaccccatctccgacttgccacccccagagccatacgtccagactacaaagtcgtaccctagcaaattagccagaaatgaatcccgatctggctccaacaggagagagcggggtgctccccctttgccccccatcccccggccacctaagcaggcagctgagtag

SEQ ID NO: 18030 - DNA, 1512 bp, Artificial Sequence
  Description of Artificial Sequence: Synthetic coding sequence
atgccagtccctcctccgccagcaccaccacccccaccaacgttcgctctggccaacactgaaaaaccgactctgaataagacagaacaagccgggcggaatgctctgctctccgatatatcaaaggggaagaagctgaaaaagacagtgactaacgatcggagcgcgcccatcttagacaagcctaaaggtgcgggagcaggcggtggcggggggggattcggcggtggtggcggatttggcgggggcggggggggtggcggcggaggatcttttggggggggtggccccccaggtctgggcggactcttccaagccggaatgccaaaactacgctccacagcgaacagggacaatgatagcgggggctcacggcccccactgctgcctcctggaggacggagcacgtccgcaaaacccttctctccacccagtggaccaggcaggttcccagttcccagccctggccaccggtcaggcccccccgaacctcagcggaaccgaatgccccctcctaggcctgacgtagggtccaaacctgatagcatccctccccccgtccccagtactccccgcccgatccagtcgtcaccgcataaccgcggttccccaccggtacctggcggacctcgacagccatcgcccgggcctacacctcctccattcccaggaaaccggggcaccgccctcggcggcgggagcatccggcagtcccctttatcctcttcctccccgttctcaaatcgacctccgctgccaccaacaccatctagagcactcgatgacaaaccgcccccaccccctcctcccgtggggaatagaccttcaattcaccgagaagccgtgccacctccacctccccagaataacaagccccctgttccatctactcctcgcccctccgcttcatcccaggcgcccccacctcctcctcctcccagtcgccctgggcccccaccactgccaccctcaagctccggcaatgacgagacaccccggcttccccagaggaatctgtctctgtccagttcgactccccccctcccaagcccaggacgatctggacccctgccaccgccaccctccgaacggcctccacctcctgttagggatccccctggccgctccgggccactaccccctcctccaccagtttctcgcaacggcagtacaagccgggccttgcccgccactccgcagttgcctagccggagtggcgtagatagccctaggagtggccctcggccgccactacctccggatcggccaagtgcaggcgcgcctccccctccccctcccagcaccagcatcagaaacggattccaagactcaccgtgcgaggatgaatgggaatcccgcttttacttccatcccatttcagatctcccaccgcctgaaccttatgtacagacaacaaagagttaccccagtaaattggccagaaacgagagcagatcagggtcaaatcggagggaacggggcgcccctcccttgccccccattcccaggtag

SEQ ID NO: 18031 - DNA, 1512 bp, Artificial Sequence
  Description of Artificial Sequence: Synthetic coding sequence
atgcccgtgcctccacccccagctccaccaccaccgccaacatttgccctagccaatactgaaaagccaactcttaataaaacagagcaggcaggccgcaacgctcttctctcagacatatctaagggtaagaagctcaaaaagacggtcacaaacgatcggagcgctcccatattagacaaacctaagggcgcaggcgccggcgggggtggaggcggctttgggggaggaggagggtttgggggcgggggagggggcgggggcggggggtcttttggcggggggggcccaccgggactcggcgggctcttccaagcaggaatgcctaaactcagatctaccgctaaccgtgataatgactccggaggcagtaggcctcctttgctccccccgggtggccgaagcacctctgcaaaacccttcagccccccctccggccctgggcgcttccctgtgccctctcctggacacagatctgggccacccgagccccaacgaaaccgtatgcctcccccacggcccgatgtgggtagcaaacctgactcgatcccccctcccgttccctcgactcccagaccaatacagagctcaccccacaaccgcggatctcctcctgtccccgggggcccccggcagccttcccctggacccactcctcctcctttccccggaaatcgcggaacagcccttgggggaggctcaattagacagagtccactctcctccagttcccctttctccaatcgaccacccctgccgccaaccccctctagggccctagacgataaacccccaccccctccgcctcccgtgggaaaccgcccctcaattcatagggaagccgtccctcctcctcccccacagaacaataagccacctgtgcctagcactcctcggccaagcgccagctctcaggcgcctcccccgccgcctccaccatccaggccaggaccaccccccctgcctccatccagttctggcaacgacgaaactcccagactgcctcagcgcaacctgagcctgtcatctagtactcctcctctgcccagccccgggcgatcaggacccctcccaccaccaccaagcgagaggccacccccacccgtcagagatccccccggtcgatcggggcccctgcccccaccacccccggtgtctcgaaacggttccacctctagagcactgcccgctaccccacagctaccttcaagaagtggcgttgactcaccacgcagtggacccagacctcctctgccgccggatcgccctagcgccggcgctccaccacccccccccccgagcacatcaatcaggaacggtttccaggacagcccttgtgaagacgaatgggagagtagattctactttcaccctattagcgacttgccacccccagagccctatgtccaaaccaccaaatcctatccctccaagttagctcggaacgagtcccgctcgggctctaatagaagagagcggggtgctccgcctcttcctccgatccctaggtag

SEQ ID NO: 18032 - DNA, 1512 bp, Artificial Sequence
  Description of Artificial Sequence: Synthetic coding sequence
atgccagtgccccctccccctgcacctcccccacccccgacattcgccttagccaacacagaaaaacccacactcaacaagacagagcaagccggtcggaacgccttactatctgacatttccaaagggaaaaagttaaaaaaaacggtgactaacgataggtcggctcctatcttggacaaaccaaagggagccggcgctgggggtggaggcggaggattcggtggcgggggcggattcggggggggcggaggcgggggtggcggtggatctttcggaggcggaggccctccaggattaggcggactctttcaagcgggtatgcctaagcttagatcaacggcaaaccgggacaatgactctggtgggagtcgacctccactcttaccgcccggaggccggtcgacatctgcgaaacctttcagccctccctctggaccaggtaggttcccagtcccttcccctggccatagaagcggcccgccagaaccccagagaaatagaatgccacccccccgccccgatgttggatctaagccagattcaatccccccgccagtccctagcactccccggcccattcagtctagcccacacaaccgagggtcccctcccgtgccaggtggacctcgacagcccagtccaggaccaacaccaccgccatttcccggcaatcgcggaactgctttgggggggggctccattaggcagagccccctctccagcagctcccctttttcaaacaggccacccctaccccccacccccagtagagccctcgatgataagccgccccctccccccccaccagtgggcaacagaccgagcatccatagggaagccgtgccccctcctccgccccagaacaacaagccacctgtgccatccactccccgccctagtgccagtagtcaggctcctccaccacctccgccccctagcagacccggcccacctcctcttcccccatcctccagtggcaatgatgagacgcctaggctcccgcagcgaaatctgtcgctttcatcaagtaccccaccacttccatcaccagggcggtcagggcccctgccaccacccccctccgagcggcctccgccacccgtgagggacccaccgggcagaagcggccctctgccgccgcccccacctgtgagccggaatggcagcacaagccgggcattgccggccacacctcagctgcccagtaggagcggtgtggactccccacggtctggccctcgaccaccactccctcccgaccggccatcagcgggcgctccccctccaccacctccctccacaagcatccggaacggatttcaggatagcccctgtgaagacgagtgggagagtagattctacttccaccccatcagtgatttgcctccacccgagccttatgtacaaaccaccaagagctatccttcaaagttggcccggaacgaaagtaggtctggaagcaaccgccgggagcggggtgctccacccctaccccccataccccgttag

SEQ ID NO: 18033 - DNA, 1080 bp, Artificial Sequence
  Description of Artificial Sequence: Synthetic coding sequence
atgccggtgccccccccaccagcccctcctccacctccaacatttgcgctcgccaataccgagaaacccacactgaacaaaaccgaacaagcagggaggaatgccctcctgtccgacatcagtaagggcaaaaagctgaaaaagactgtgaccaacgaccgttcagcgcctatcctcgataaacctaagggtgccggggctggcggcggcggcggagggttcggaggcggcgggggctttggcggcggcgggggcggcggcgggggaggatccttcggaggaggagggccgcccgggttaggcgggcttttccaagcagggatgcctaagctgaggtccacagccaaccgagacaacgactccgggggatcacgaccacctttgctgcctccgggcggaaggtccacatctgccaagcctttctcacctccaagcggaccagggagattccctgtgcccagtccggggcaccggtctgggccccctgagccacagagaaataggatgccacctcccaggcccgatgtcggaagtaaaccagatagtattcccccacctgtccctagcacccccaggcccattcagagtagtccccacaaccgaggttcaccccctgtacccggcgggccccgccaaccgtcgcctggaccgaccccaccgccccccccacccgtgcgcgatccccccggtaggtcaggtcccctgcccccgcccccaccggtgtctagaaacgggtcaactagcagggccttaccagccactccacagttaccatccaggtctggcgtcgactctcctcgatctggccccagacctccgctaccccctgaccggccaagtgcgggggccccacccccaccaccgccttccacatcaatcagaaatggtttccaagattctccgtgcgaagacgagtgggaatcaaggttctacttccaccccatatccgacttacctccccccgagccatacgtgcagactaccaagtcttatccaagcaaattagcgaggaacgagagcaggagcggttccaacaggcgcgagagaggcgccccccccctacctcccatacctaggtag

SEQ ID NO: 18034 - DNA, 1482 bp, Artificial Sequence
  Description of Artificial Sequence: Synthetic coding sequence
atgcccgtgcctccacctcccgcacctcctccacccccgacctttgccttagccaacaccgaaaaaccgactctgaataagaccgaacaggcggggcggaacgccctgctgagcgacatttcaaaaggcaaaaaactaaaaaaaacggttaccaacgacaggagcgctcctatcctggacaaacctaaaggggcaggggccggcggtggcggaggcgggttcggcggtggcgggggttttggaggcgggggcggtggaggaggcggcgggagcttcggcggcggtggccctcctggactaggtgggctctttcaggctgggatgcctaaactccgatctacggcaaaccgggacaacgactccggaggatcacggcctccgctactgcctcccgggggtaggagtacctccgccaagcccttcagccccccttccggccccgggcggttcccagtgcctagccctggacaccgatccgggccgcctgagccacagcgaaacaggatgcctcccccacggcccgacgttggcagcaagcctgattctattcccccgcccgtcccatctacccctcggcctatccagtctagcccacataaccgcggcagcccccctgtgcctggcggaccacgccagccctcccccggccccacacccccccccttccctggcaacaggggaaccgcgttagggggagggtctattcgccagtctcccctgagcagctcttcacccttcagcaacaggccacctctgccgccgactcccagtagggcactagacgacaagcctccgcccccaccacctcccgtggggaaccgtccatcaattcaccgagaggctgtgccacctccacccccgcaaaacaataagccaccggtgcctagtacgccccgccccagtgcatcctcacaggcccctcctccgcctccacctccctccagaccgggacccccgcctttgcccccttcctcatctggaaacgatgaaacaccacggctgcctcagagaaatctttccctctcatcttccacaccacccctgccatcacccggtcgaagcggtccgctcccaccgcccccttccgaaaggcctccaccgcccgtcagagaccctcccgggaggagtggccccctgccccctccgccaccagtgtctagaaacggcagtaccagccgggcgctgcctgccacaccccagttacctagcaggtctggcgtggattctccgaggagtggtccacgccctccattgccccccgatcggccatccgcaggtgcgcccccaccccctccgccttcaactagcatacggaatgggttccaggattccccttgtgaagacgagtgggagtcaagattttatttccatccgatcagcgatctaccccccccagagccgtacgtccagaccacgaagtcctatccttctaagctggcacgtaacgaaagcagatcagaatatttctgtcagggcttctag

SEQ ID NO: 18035 - DNA, 303 bp, Artificial Sequence
  Description of Artificial Sequence: Synthetic coding sequence
atgcccgtgcccccgcctccggccccacctcccccccctaccttcgctctggccaacactgaaaaacccacactaaacaaaacagagcaagcaggcaggaacgcattgctgagcgacatttcaaaagggaagaaactcaaaaagaccgtcaccaatgaccgcagtgcacctattctggataagcccaagggggcaggagcagggggggggggtgggggtttcggcggtggcggtggcttcggtggaggcggcggcggcggaggcggtggttccttcggcggaggcggacccccgggtctgtag

SEQ ID NO: 18036 - DNA, 1647 bp, Artificial Sequence
  Description of Artificial Sequence: Synthetic coding sequence
atgaaaactctcgaaacccagcctcttgcccctgactgctgccccagcgatcaggatcccgcacccgcacacccctcgccccacgcttctccgatgaacaagaatgctgattcggagctgatgccaccgccccccgaacgcggcgacccaccacgtctcagtcccgatcctgtggccggcagcgcagtgagccaggagctgagagagggagaccctgtctccttgagtacccctctcgagactgaattcgggtcaccatccgaactgtcaccccgtatcgaggaacaggagctgagtgaaaatacttccttgccagcagaggaagcaaacggctcattgtcggaggaagaagctaacgggccagagctgggatccggtaaagcgatggaagatacctccggcgagcccgctgccgaagacgagggggatacggcgtggaactacagcttctctcaactgccgcggttcttatcgggatcttggtctgaattctctactcagcctgagaatttcctcaaaggatgcaagtgggccccggacggctcttgcattctcacaaattcagcggacaatatactccgaatatacaaccttcctcctgagctgtaccatgaaggcgagcaggtcgaatatgcagaaatggtgccagtgctgcggatggtagagggcgataccatatatgactattgttggtattcattgatgtcatcggcacagcctgacacctcctatgtcgcatcaagttctagggaaaatccaatccacatctgggatgccttcacaggtgaacttagagcgtctttccgagcctacaatcatctcgatgagctgaccgcggcccattctttgtgcttcagtcccgatggaagtcaattattttgcggcttcaatagaacagtgagggtcttttccaccgcaaggccagggcgtgactgcgaggtacgtgctactttcgctaaaaagcagggtcaaagtggaatcatctcctgcatcgctttctcacccgcacagccattatatgcctgtggaagctacggtcggtccctgggtttatacgcctgggatgatggatcaccgctggccttgctgggcggccaccaggggggtatcacgcatctctgttttcacccagatggaaataggttctttagcggcgcacgtaaggacgctgagcttctttgctgggacctcaggcagagcgggtatcctctctggtctctgggccgtgaggtgaccactaatcagcgcatttatttcgacctggatccaaccggacagttcctggtctcaggatccacgtccggggccgttagcgtctgggatactgacggtccgggcaatgatgggaagccggagccggtcttgtctttcctgccacagaaagactgtaccaacggagtatccctgcacccgagtctgcccttgctggccaccgcatccggacagagggtttttcctgagcctactgaaagcggggacgaaggcgaggaactaggcctaccactgctgagtacaaggcacgtgcaccttgagtgtaggctgcagctatggtggtgcggcggcgccccagactccagcattcccgacgatcaccaaggcgaaaaaggccaggggggaaccgagggaggagtgggcgagctgatctag

SEQ ID NO: 18037 - DNA, 1647 bp, Artificial Sequence
  Description of Artificial Sequence: Synthetic coding sequence
atgaagacccttgagacccagccgctcgctcctgattgctgcccctccgatcaagatcctgcaccggcccacccatcacctcacgcctctcctatgaacaagaacgctgattccgaacttatgcctcctcctccagaaaggggtgatcctccaaggctgagtcctgaccctgtggccggcagcgcagtttcccaggaactccgggagggcgaccccgtgtctctctctacccccttagagaccgaattcggcagcccaagtgagctgtccccccggatagaagagcaggagctgagcgagaatacaagccttcctgcagaagaggcgaatggaagtctgtccgaagaggaagccaatggtccggagctcggcagcggtaaggccatggaggatactagcggggaacctgcagccgaggacgaaggagacactgcatggaattattctttcagtcagctgcctcgcttcctctcaggctcttggagtgagttttctacacagcctgaaaactttcttaaggggtgcaaatgggcaccggatggcagctgtatcctcacaaattccgccgataacattttacggatttacaatctgcccccggaactctatcacgagggtgagcaggtggaatatgcggaaatggttcctgtgctgcggatggttgagggagacaccatctatgattactgctggtattccctgatgtcctctgctcagcctgatacaagctacgtcgcaagtagctctcgggagaatcctatacacatctgggacgcattcactggagagctgcgcgcaagcttcagagcatataaccacttggatgagttgacagccgctcacagtctctgctttagccccgatggctcccaactgttctgcgggttcaacaggacagtgcgcgtattcagtacagctcgccctggcagagattgcgaagtgcgtgctaccttcgcgaagaagcaggggcaatctgggattatatcatgcatcgcctttagcccagctcagcctctttacgcctgcggaagttacggaagatctctcggactatacgcatgggatgatggatcccccctggccctgctaggcggccaccagggcggaatcacacatctgtgctttcacccagatggaaacagatttttctccggagcacggaaagacgccgagcttctctgctgggatctgcgccagtcaggataccccctgtggtctctaggtcgagaggtgaccacaaaccagagaatttatttcgacttagatcctactggtcagttcctggtgagtggctccacctccggagcagtatctgtgtgggacactgatggacccgggaatgatggcaagcctgagccagtactgagtttccttccccagaaagactgtacaaatggcgtttcactacatcctagcctcccccttctggccaccgcctcaggccagagagtcttccctgagccgaccgagtctggggacgagggtgaggagcttgggctgccactcttatccactcgccacgtccatctggagtgccgactgcaactttggtggtgcggaggcgctcccgacagcagtatcccagatgaccaccaaggcgagaaaggacaaggcggcacagaggggggagtcggggaactgatttag

SEQ ID NO: 18038 - DNA, 1647 bp, Artificial Sequence
  Description of Artificial Sequence: Synthetic coding sequence
atgaaaacattagagactcagcctctggcaccagactgttgccctagcgatcaggacccggccccagctcatccctctccacacgccagccctatgaacaagaatgcagacagcgaactaatgccaccccctcccgaacgcggagacccaccccggctctcccccgaccctgtggccggtagcgccgtgagccaggaactacgagagggggatcccgtcagcctgagtacacctcttgagaccgaattcgggagtccctccgaattgtccccccgtatagaggagcaggagcttagcgagaataccagcttgcccgccgaagaggcaaacggatccctgtccgaggaggaagcgaatgggcctgaactggggagcgggaaagcgatggaggataccagtggtgaaccggctgccgaggatgaaggcgacaccgcttggaattactcattctcccagcttccgagattccttagcggctcctggtccgaattttcaacacagcccgaaaacttcttgaaaggctgtaagtgggcacctgacggatcctgcattctgactaactctgcagataacatcttgcggatctacaacttaccgccagagctttatcacgaaggggaacaggtagaatacgccgagatggtccccgtacttagaatggtagaaggcgacacgatctacgattattgctggtactccttgatgtcgtctgctcagccagataccagttacgtagcatcctcatcccgcgagaaccctattcacatttgggacgcctttacaggtgaactgagggcgtccttcagggcttacaatcatctggatgaactcacagccgcacactccctttgcttctccccggatggatcccaactgttctgcgggttcaatcgcacagtgcgtgtcttctctaccgcccggccaggaagggattgtgaagtgagggcaacttttgcaaagaagcaagggcagagcgggattatatcatgtattgccttctcccctgctcagccgctgtatgcctgtggaagttacggacgctcactgggactgtacgcgtgggacgatggatccccgttagctctgctgggcggccaccagggcggtatcactcatctatgcttccatccggacggcaaccgtttttttagtggagcacggaaggatgcagaactcttatgctgggatctcaggcagagcggttaccctctgtggtccctgggcagagaggtgacaaccaatcagcgcatctattttgacctggaccccacgggccagttcctagtcagtggttccacatctggggccgtgagcgtgtgggatactgatggcccaggaaatgatgggaagccagagcctgttctgagttttttgccccagaaggactgtacgaacggcgtgagcctgcatccctccctgccacttctggccacagctagcggacagcgggtgtttcccgaacccactgagtcaggtgacgagggggaggaactgggactgccactactctcgacacggcatgtgcatctagagtgtcgcctgcaactctggtggtgcgggggcgccccggacagttcaataccagatgaccaccagggcgagaagggtcagggggggaccgaaggcggggttggagagctgatctag

SEQ ID NO: 18039 - DNA, 567 bp, Artificial Sequence
  Description of Artificial Sequence: Synthetic coding sequence
atgaagacattagagacccaaccccttgcccctgattgttgtccctcagaccaggatcccgctcctgctcagcccgacacttcctacgtggccagcagttccagagagaaccccatccacatctgggatgcttttacaggtgaattgcgagcatccttccgtgcctataatcaccttgacgagctcactgccgcccatagcctgtgtttttcccctgacgggtcacagcttttctgtggcttcaataggacggtcagggtgttctctaccgcgaggcctggtcgcgactgcgaagtaagagctaccttcggcaaacacttatgtttgcaggggcgccggagggggaagggcactgcaacatgcacgggggcattttgcgagcccggtgccacctgcggtggtagtcgcaggcccctctacggccccgggtctagatgctccccagttgggaggggtgccaaccgacttagagctgggcggaagccctctcagggacagcccgcgggtcaaaggacggcctcatttcttaattcttatccagtctcatgcggcgcttttggcctctag

SEQ ID NO: 18040 - DNA, 1647 bp, Artificial Sequence
  Description of Artificial Sequence: Synthetic coding sequence
atgaaaactcttgagacccaaccattagcgcctgactgctgcccttcagaccaggaccctgccccagctcatccatcaccccacgcctccccaatgaataaaaacgccgattcagaactaatgcctcccccaccggagagaggcgatcctccccgcctatcgcccgaccctgtggccgggtctgccgtttcccaagaactgcgggagggtgaccccgtgagcctctctacgcccctggaaacagagtttgggagtcccagtgagctctcccctcggatcgaagaacaggaactgagtgaaaacaccagcctgcccgccgaggaagctaacggaagcctgtctgaggaggaggccaacggccccgaactgggttccggaaaggccatggaggatactagtggagagcctgcagctgaagacgagggcgacaccgcctggaactacagcttttcccagctgcctagattcctgtcaggctcgtggtctgagttctcaacccagcccgaaaacttcctgaagggctgtaagtgggctcccgacggatcgtgtattctcacgaacagtgcagacaacattctacggatatataacctaccacccgagttgtatcacgaaggggagcaggtagaatacgcggaaatggtgcccgttctccgaatggtggagggcgacaccatctacgactactgctggtatagcctgatgagctccgcgcagcctgacaccagttatgtcgcttcaagtagtcgagagaaccctatccacatctgggacgcgttcaccggcgagcttagggccagcttccgtgcatataatcatctggatgagcttacagctgcccattcattatgcttcagtcccgatggatctcagctgttctgcggctttaataggactgtgcgcgtgttctccactgccagacccggacgggactgtgaggtgcgggctaccttcgccaagaagcagggccaatcagggataattagttgtatcgccttctctccagcacagcccctgtacgcatgcggcagctatggccggtccctcggtctgtacgcctgggatgatgggtcccctctagccctgctgggtggtcaccaaggcggcatcacgcacctgtgctttcatccagacggcaatagattcttctccggggcacgaaaagatgcggagctcctgtgttgggacctgcggcagtcggggtaccccctttggtctcttggcagggaagttacaacaaatcagaggatctattttgacttggacccaaccggccagttcctggttagcggcagtacaagcggggccgtcagcgtatgggacacggacggccctggcaatgacggcaagccggagcctgtactgtcttttcttccacagaaagactgtactaacggagtgtccctgcatccatccctccccctcctggctacagcctccggtcagagagtgtttcccgagccaacggagagcggagacgaaggagaagaacttggcctcccactcctgagcacccggcacgtccacctcgagtgcaggctgcagctgtggtggtgtggaggggcaccagactcaagcattcctgacgatcaccagggcgaaaagggacaaggtgggactgaggggggagttggggagctgatctag

SEQ ID NO: 18041 - DNA, 1299 bp, Artificial Sequence
  Description of Artificial Sequence: Synthetic coding sequence
atggacaccgagaagagtggcaaacgagaatttgacgtcagacagaccccccaggtcaacatcaatccattcacccctgactcgctgttactgcactccagtggacaatgcagacgcaggaaaagaacttactggaatgactcttgtggcgaagatatggaggctagcgattacgaactcgaagatgagactcggcctgcaaagcgtattacaatcacagagagtaatatgaaaagtagatataccactgagtttcacgagctggagaaaattggatccggagagttcggcagcgtgtttaaatgtgtgaaaagactcgacggctgcatttacgccataaaaagaagcaagaagccactagccggatccgtcgatgagcagaacgccttgcgtgaggtgtacgcccatgctgtgttggggcagcatagccatgttgtgcgctactttagtgcgtgggcagaagatgaccatatgcttattcaaaatgagtattgtaacgggggttcccttgccgatgctatcagcgaaaattaccgcatcatgagttactttaaggaggcagagctcaaggacctgctgctgcaggtcggacgcgggctgagatacatccactcgatgagtctggttcatatggacatcaaaccaagtaacatattcatttccaggactagcattccaaatgccgcgtccgaggagggggacgaggatgattgggcatcaaataaagtaatgtttaagataggggacctggggcacgtgactagaatttcgtcaccccaggttgaagagggcgacagcaggttccttgcgaatgaggtactgcaggagaattacacacacctgcccaaagctgatattttcgctctggccctaaccgttgtgtgcgccgccggcgccgaaccactaccacgcaacggtgatcagtggcacgagattcgtcaggggagactgccccggataccacaggtactgtctcaggagttcaccgaattactgaaagtgatgatccacccagatcccgagcgcaggccttctgcaatggccctagtaaagcattcagtacttttgtcggcctcacgcaaatctgcggagcagctccggattgagcttaatgccgagaaatttaagaattccctactgcagaaggagttgaaaaaagcgcagatggccaaggcagctgctgaggagagggccctttttaccgaccgcatggccacacggtccacaacccaatccaataggacatcccggcttatcggtaagaaaatgaatcgaagcgtgtcactgacaatctattag

SEQ ID NO: 18042 - DNA, 1941 bp, Artificial Sequence
  Description of Artificial Sequence: Synthetic coding sequence
atgtccttcctctctagacaacagccacctcccccacgccgcgcaggtgcggcatgtactttgcggcagaagctgatattttccccatgctctgattgcgaagaagaggaagaagaggaggaagaggagggtagcgggcactctaccggagaagactccgccttccaagagcctgattctcccttacctccagcccggtctcccaccgagccagggccagagcgacgacgatcgcccggtcccgctcctggcagccccggggagctagaagaggatctgctactgccaggggcctgcccaggggctgatgaagccggaggcggagcagaaggcgatagctgggaggaagaggggttcggcagcagttcaccagtcaagtcacccgcagcaccctatttcctgggcagctcctttagtcccgttagatgcggagggcccggcgatgcaagccctcggggctgcggggcacggcgcgccggtgaaggaagaaggtcacctaggccagatcaccccggtacaccacctcacaagacttttcggaagcttcgcctcttcgatacccctcacacaccaaagagtctcctttccaaagcccgtggaatcgatagctctagcgtcaaactccgtgggtcctcactttttatggataccgaaaagagcggaaagagagaattcgacgtgcgacagacgccccaagtcaacataaaccccttcactccggattccttgctcctgcattctagtgggcaatgtagacgaaggaaacgtacttactggaatgactcctgcggggaagatatggaagctagtgactacgaacttgaagatgagacaaggcctgcgaaacggatcaccattacggaatctaatatgaagtctcggtataccaccgaatttcacgagctggagaagattggttctggtgagtttggctcggtttttaagtgcgtcaaaaggctggatgggtgcatttacgccataaagcgctcaaaaaagcctctagctggttctgttgacgagcaaaatgctttacgagaagtttacgctcacgccgttcttgggcagcacagccatgtggtgaggtacttttcagcgtgggcagaggatgatcacatgctaattcaaaacgagtattgcaacggcgggagtctggccgacgcaatctcagagaattatagaataatgtcttacttcaaggaggccgagttgaaagatctcctgttgcaggtgggccgcggcctgcggtatattcactcaatgtctttggtacacatggatatcaagccctctaatatttttattagtaggacatctattcctaatgcagcttcagaagagggcgacgaggatgactgggcatcaaataaggttatgtttaaaattggcgacctgggccacgttacgcgtatctctagcccacaggtcgaggagggtgacagccgattcttagccaacgaggttcttcaggagaattatacccaccttcccaaggccgatatttttgctcttgctttgacggtcgtatgtgctgccggagctgaaccgctcccaagaaacggcgatcaatggcacgagatcaggcaggggcgactccctcgcatcccacaggtcctgagccaagaattcactgagttattgaaagtcatgatccatcctgacccagaacgtagaccttctgcgatggctctggtgaagcacagcgtcctactctccgctagcaggaagtcagcggaacagctcaggatcgagctgaatgcagaaaaatttaaaaacagcctgcttcagaaagagttaaaaaaggcacagatggccaaagccgcagctgaagaaagagctctatttacagatcgcatggcgaccagatctacaactcagagcaacagaactagtcgcctgattggcaaaaaaatgaaccggagcgtgtcactcaccatatattag

SEQ ID NO: 18043 - DNA, 1554 bp, Artificial Sequence
  Description of Artificial Sequence: Synthetic coding sequence
ctgcaggaccccgcctcaacttgcgtacctgaacctgcctctcagcatactctcaggtcaggccctggctgcctccagcagccggagcaacaaggggtgcgcgatcctggagggatctgggccaagctgggagccgctgaggcctccgctgagcggctgcagggtagaagatcccggggcgctagcggttctgagcctcaacagatggggagcgacgttcgcgaccttaacgccctcctgccagccgtcccatcactgggaggtgggggaggttgcgccctgccggtgtccggggccgcacagtgggctcctgtgctagacttcgctccacccggggcgtccgcctacggatccctgggaggtcccgcacccccacctgccccgccacccccacccccacccccaccacattcgtttattaagcaagaaccttcatgggggggggccgaaccccatgaggagcagtgcctgtcagcgtttaccgtgcatttttcggggcagtttactggcactgccggagcatgcagatatggcccattcgggccaccccctccatcccaggcaagctcgggtcaggcaagaatgtttcctaacgctccatacctgcctagttgtctcgagagccagcccgccattcggaatcagggttactctacagtgaccttcgacgggacccccagctatggccatactccctcacatcacgccgctcagtttccaaaccattccttcaagcatgaggatcccatgggtcagcaggggagcctcggcgaacaacagtacagcgtgccaccccccgtatacggttgtcacacccccacagacagctgtactggaagccaggccctccttctgcgcaccccatacagcagcgacaacctgtaccaaatgacttcccagctggagtgcatgacgtggaatcagatgaaccttggagcgactctaaagggcgtcgcagccggatccagtagctcagttaagtggacggaagggcaatcaaatcattccactggttatgaatccgacaaccatacaacgccaattttatgcggtgcgcagtatcgcatccatacacacggtgtgttcagggggatacaggacgtcagacgggtgcccggtgtggctccgaccctggtccggagtgcgtccgagacatcagagaaaaggccttttatgtgcgcctaccctgggtgtaacaaacgctatttcaaactgagccacctgcagatgcattcccggaaacatactggcgaaaagccttaccaatgtgatttcaaagattgtgaacgcaggtttagtagaagcgatcagcttaagcgccaccaaaggcggcatacaggagtgaaaccctttcaatgtaaaacttgccagcgcaagttctctaggagcgatcatcttaagacccacaccaggactcacaccggaaaaacgagcgaaaagccctttagttgtagatggccatcctgccagaagaaatttgcccgcagcgatgaactggtacgccatcacaacatgcatcaacgcaacatgaccaaactccaattggccctgtag

SEQ ID NO: 18044 - DNA, 954 bp, Artificial Sequence
  Description of Artificial Sequence: Synthetic coding sequence
ctacaggaccctgcgagcacatgcgtaccagagccagcatctcaacacacacttagatccggcccgggatgccttcagcagcccgaacagcagggtgtccgggatccaggcggcatatgggctaagctgggggccgcggaggcctcggctgaacgcctccagggcagacgctctcggggcgcatccggtagtgaacctcagcagatggggagcgatgtgagagatcttaatgcattactgcctgcggtcccgtctctgggtgggggggggggctgtgcacttcccgtgtctggtgcagcacagtgggctcccgtgttagacttcgcgccacccggggccagtgcatacggatcccttggggggccagctccgccacccgccccacctcccccgcctcctccacctcctcacagcttcatcaagcaggaaccatcctggggcggtgctgagccgcatgaggagcagtgcctctcagcatttactgttcacttctctgggcagttcaccggcaccgccggggcctgcaggtacggcccctttggccctccccccccttctcaggcctcctccggccaggcaagaatgttcccaaacgcaccctacctgccttcctgcctggagagccagcccgccattaggaatcaggggtactcgacagtgacctttgacggaaccccttcatatggccataccccatcccatcacgcagcccaatttcccaatcatagtttcaagcatgaggatcccatgggccagcagggttcactaggagagcagcagtattcagtcccccccccagtatatggatgtcacacgcccacggattcatgtaccggaagccaggctctgctgctacgcaccccatacagttccgacaacctgtaccagatgacaagtcagctcgaatgcatgacatggaatcagatgaacttgggagccaccttgaagggatag

SEQ ID NO: 18045 - DNA, 909 bp, Artificial Sequence
  Description of Artificial Sequence: Synthetic coding sequence
atggagaagggctactcaactgtgacattcgatggcacaccttcctatggacataccccttctcatcatgccgcacagttcccaaaccattccttcaagcatgaggaccccatggggcagcaaggcagcctgggcgagcaacaatactctgtacctccgcctgtctatggctgccatacacccactgactcgtgcaccggatctcaagctttgctgctccgtactccatacagtagcgacaatctttaccagatgaccagtcagctggaatgtatgacgtggaaccagatgaacttgggtgccactcttaagggcgttgcggcgggttcctcttctagtgtgaagtggaccgagggacagtcgaaccacagtaccgggtatgaatctgacaaccacacaacgcctatcctctgcggcgctcagtaccggatacatacacacggcgtcttccgcggtatccaagatgtccgcagagtacccggagtggctccaaccctggtgagaagcgcctcggagacttccgagaagaggccatttatgtgcgcctatcccggctgtaataagcgatactttaaactcagtcacctgcaaatgcactctaggaaacatacaggggaaaaaccgtaccaatgcgatttcaaggattgtgagcgaagattctcccgaagtgatcagttaaagagacatcagcgccgccacacgggagtgaagccattccaatgcaaaacgtgtcagcggaagttttctcgtagcgatcaccttaagacacatactagaacgcataccggtgagaagccctttagttgtagatggccatcttgccagaagaaatttgcaaggagtgatgaactggtgcgccaccacaatatgcaccagagaaacatgaccaagcttcaattggctttatag

SEQ ID NO: 18046 - DNA, 1545 bp, Artificial Sequence
  Description of Artificial Sequence: Synthetic coding sequence
ttgcaggaccctgcctctacctgcgtgccagaacccgcaagccagcataccctccgctccggccctggctgtctccagcaacctgagcagcagggagttcgagatcccggcggaatctgggccaaactgggcgcggctgaagcttcagccgagcgcctccagggtcgcaggagtcggggagcttctgggagcgaaccacagcaaatgggctccgatgtgcgcgatctcaacgctctgttgcctgcagtgccatctctcggcggaggcggcggttgcgctctgccggtctctggggctgcccagtgggctccagtgctagatttcgcgccacctggcgctagtgcgtacggcagcctcggcggcccggcaccgccaccagcaccaccgcctccacctccacccccccctcactcatttatcaagcaggagcctagctggggcggtgctgagccgcacgaggaacagtgtcttagcgccttcactgtgcacttcagtggccagttcacaggtacagccggggcatgcagatacggtcctttcggtccccctcccccctcgcaagctagttccgggcaagcccgcatgtttcctaacgccccctacctgccaagttgcctagagtcacagccggccatcaggaaccaggggtattcaaccgtgaccttcgatgggacaccctcatacggccatacgccttctcatcacgcggcccaattccccaaccactcctttaaacatgaggaccccatgggacagcagggtagcctcggtgagcagcaatactctgtcccgcctcctgtatacgggtgccacactcctacggacagttgtaccggatcccaagccttgctgcttcgcactccctactcttctgacaacctttaccaaatgacatctcagctcgaatgcatgacatggaatcagatgaatttgggcgcgacactcaaaggtgtggccgcaggttcgtcctcgagcgtaaagtggaccgaggggcagtccaaccatagcactgggtacgagtccgataatcatactactcccatactgtgcggagcccagtatagaatccatactcacggagtgttccgcgggatacaggacgtgcgccgcgtgcccggcgtggccccaacccttgtaaggtctgctagtgagacctctgagaagcgcccttttatgtgtgcataccctggttgtaacaagcggtacttcaagctctctcatcttcagatgcactctaggaagcacacaggggaaaaaccttaccagtgcgatttcaaggattgcgagcgccggtttagccggtcagaccaactaaagaggcaccagcggagacataccggagtgaaaccttttcagtgcaaaacctgtcaacgaaagttcagccgatctgaccatctgaaaactcatacacggacccatactggggaaaagcctttcagctgccggtggccctcttgccagaagaagttcgcccgatctgatgaattggtgcggcaccataacatgcaccagcgcaatatgacgaaactccagcttgccctctag

SEQ ID NO: 18047 - DNA, 1494 bp, Artificial Sequence
  Description of Artificial Sequence: Synthetic coding sequence
cttcaagatccagcatccacgtgtgttcctgaacccgcctcccaacacacactaaggagcggacccggctgtctccagcagccagaacaacaaggcgtacgagacccaggaggcatctgggcaaagctaggggccgccgaggcatcagccgaacgcctgcagggaagacgatcccgcggggcctctggtagcgagccacaacagatgggttcagatgtccgggatctgaacgctctgttgcctgcagtgccctcactaggtgggggtggtggttgcgccctccctgtttctggggcggcccagtgggcccctgtgctggattttgctccccccggcgcctctgcttacggctccttgggggggcccgcacctcctccagcaccaccccccccgccacctccacccccacactccttcataaagcaagaaccaagttgggggggagctgagcctcacgaagaacaatgtctctctgcttttaccgtgcatttctccggccaattcaccggcaccgctggtgcttgccgatatggcccctttggacctccgccgccgagccaggcttcttccgggcaagctagaatgtttccaaacgctccttatctcccatcatgccttgagagccagcccgccataaggaaccaaggatattctactgtcacatttgatggaacaccatcatacggtcacactccctctcaccacgccgcacaattccctaatcattccttcaaacatgaggatcctatgggccagcagggtagccttggagaacaacaatacagtgttcctccccccgtctatgggtgccacacacctaccgatagctgtacaggatcccaggctttgctgttgcggaccccctacagctcagacaacttgtaccaaatgacatctcaactggaatgcatgacctggaaccagatgaacttgggtgctaccttgaagggacactctaccggctacgaaagcgataatcatactacccccattctgtgtggcgctcaatataggattcatactcacggggtttttagaggcatccaagacgtgaggagagttcctggtgtggccccgacgctggtgcgttctgcgagcgaaaccagcgagaagcggccatttatgtgcgcctatcccggatgcaacaagcgatactttaagctgtctcaccttcaaatgcacagccgcaaacatactggagagaagccctaccagtgcgacttcaaggattgcgagagaaggtttagtagaagcgaccaactaaaacgacaccagagaagacacaccggcgttaagcccttccagtgtaagacttgccagcgaaaattcagtagatctgatcatctcaagacgcacactcggactcacaccggggaaaaacccttctcctgcagatggcccagctgccagaaaaaatttgccagaagcgatgagttagtgcggcaccacaacatgcatcaaaggaacatgacaaaactgcagttggctttatag

SEQ ID NO: 18048 - DNA, 396 bp, Artificial Sequence
  Description of Artificial Sequence: Synthetic coding sequence
atgggacaacagggctccttaggtgagcaacagtactctgtgcccccccctgtttatggttgtcacacacctactgactcttgcacaggctctcaggcactcttgcttagaaccccttactcctcggacaatctgtatcaaatgacctcacagttggagtgcatgacctggaaccaaatgaacctgggtgcgactctgaagggcgtcgccgctggctcgagttcaagtgtgaagtggaccgagggtcagagcaaccactccaccgggtatgaatcggataatcacaccacgccaattctgtgtggcgcacagtatcggatccacacccatggtgtatttagaggaattcaagatgtgcgacgtgtaccaggcgtcgctcccacattggtgcggtag

SEQ ID NO: 18049 - DNA, 537 bp, Artificial Sequence
  Description of Artificial Sequence: Synthetic coding sequence
tgattgggtgctacactgaagggcgtcgcagcaggttcttcatccagcgtgaaatggacagagggacaaagtaatcatagcacgggatacgagtctgataatcacactacaccaattttgtgcggagcccaatacagaatccacactcacggcgtgtttcgggggattcaggatgtacgccgcgttcccggggtcgcgcccacactggtaagaagcgcatccgagacgagtgagaagcggccatttatgtgcgcttaccccggctgcaataagcgctactttaaactgtcccacctccagatgcactcccgtaagcataccggagtgaagccgtttcagtgcaagacctgtcaacggaagttttcccggagtgatcacctgaaaactcacacgcggacacacaccgggaagacttctgagaagccattttcctgtagatggccatcttgccaaaaaaagttcgcacggagtgacgagttggtgagacatcacaatatgcatcaaagaaatatgacaaaactgcaactcgccttgtag

SEQ ID NO: 18050 - DNA, 867 bp, Artificial Sequence
  Description of Artificial Sequence: Synthetic coding sequence
atggaaaaaggctactcgaccgtgaccttcgatggcactcctagctacggccacacaccgtcacatcacgctgcccaattcccgaaccactcttttaagcacgaggatcctatgggccagcaagggtccctcggtgagcaacagtatagcgtcccgcctccggtgtatgggtgccatacccctaccgactcatgtacaggtagccaagccctgctgctgagaaccccatacagttcagataatctgtaccaaatgacatctcagctggaatgcatgacttggaaccagatgaacctcggagcaacactaaaaggccatagcaccggttacgaatcagacaaccacactacccccattctgtgcggagctcagtataggattcatactcacggcgtgtttcgaggcatacaagacgttagaagggtccctggagtcgcacccaccctggttcggagtgcctcagagacaagcgagaaacgaccctttatgtgtgcctacccaggttgtaacaaaagatactttaaattatcccaccttcagatgcacagccgcaaacacacgggggaaaagccgtatcagtgcgatttcaaagactgtgagcgccggtttagtaggtccgaccagctcaagagacatcaacgtagacacaccggcgtgaagccttttcagtgcaaaacctgtcagagaaaattctccaggtctgaccatttgaaaacacacacccggactcacacagggaagacttccgagaagccatttagctgtcggtggcctagctgccagaaaaagttcgcacgttctgatgaactggtccggcaccataacatgcaccaacgcaacatgacgaagctgcagctggcattatag

SEQ ID NO: 18051 - DNA, 1065 bp, Artificial Sequence
  Description of Artificial Sequence: Synthetic coding sequence
atgagggcaagacctcaggtgtgcgaggcattgctgtttgcgctggctctgcaaacaggcgtctgctatggtattaagtggctggccttatccaaaaccccatctgccctggcgctcaaccagacccagcattgcaaacagctagaggggctggtgtctgcacaggtacagctgtgccggtcaaacctcgaactgatgcataccgttgttcacgctgcccgtgaggtgatgaaagcgtgtagaagagcctttgcggacatgaggtggaactgcagctcaattgagctggcaccaaactacctgttggacttagagaggggcactagggagagcgctttcgtgtacgccctgtcagccgcagcgattagccacgctatcgcaagggcttgcacatccggagatctccccggctgtagctgcggcccagtgcccggcgagcctccaggtcctggaaacagatggggaggatgcgctgataatttgagctacgggcttctaatgggggctaagttctcagacgctccaatgaaagtgaaaaaaacaggttcccaggccaacaaactcatgcggttgcacaacagcgaggtgggcagacaagcactgagggctagcctcgagatgaagtgtaagtgccacggcgtaagtggttcctgttcaatacgaacatgctggaaaggactccaggagttacaagatgtcgccgctgatctcaagacccggtatctgtctgcaactaaggtggtacataggccgatggggacgcgcaaacatctcgtaccaaaagacttagatatccgacccgtgaaagattctgagctcgtgtatctgcagtctagtcctgacttctgcatgaaaaacgagaaagtgggcagtcacggcacacaggatcgccagtgtaacaagacgtcaaatgggagcgacagctgtgatctgatgtgttgcggccgggggtataacccctacacagaccgggtggtggagcggtgtcactgcaaatatcactggtgctgttatgtgacttgccgacgatgtgaaaggactgtggagcgctacgtctgcaagtag

SEQ ID NO: 18052 - DNA, 762 bp, Artificial Sequence
  Description of Artificial Sequence: Synthetic coding sequence
atgcgggctagaccccaggtgtgcgaagcactgctttttgctttggccctccaaaccggcgtctgttacggaattaagtggctggctttatctaaaacaccaagcgccctcgcgctgaaccagacccagcactgcaagcagctagagggcttggtatctgcacaggtgcagctttgtcgcagcaatctcgagcttatgcatacagtcgttcacgccgctcgggaggttatgaaagcgtgtcggagagcgttcgcagacatgcggtggaattgctcctctattgagctggctcctaactacttactggacctggaacgcggtacccgagaaagcgcctttgtatatgctttatctgccgctgccatctcacacgcaattgctcgggcctgtacgtcgggcgacctcccgggttgctcatgtggcccagtccctggagaaccacctggtccgggaaatcgttggggaggttgcgccgataatctgagctacggattgctcatgggggccaaattttccgacgcgccaatgaaagtcaagaaaacagggagtcaggccaacaagctcatgcgtctacacaattcagaagtgggccgccaagctcttagagcctctctgctggtgaatagcaggtgccaggcatgggaagctgcctgcgccctgcctagtctgggtagccaccaggaacagaaggtctggccaccctggaaggaaggcaggacctcgaaggagactgacaagattaagaacaaccttgcagcctag

SEQ ID NO: 18053 - DNA, 18 bp, Artificial Sequence
  Description of Artificial Sequence: Synthetic coding sequence
atgagagcacgcccttag

SEQ ID NO: 18054 - DNA, 1143 bp, Artificial Sequence
  Description of Artificial Sequence: Synthetic coding sequence
atgaagaagtcaataggcattctgtcccccggcgtagccctcggcatggccggaagcgctatgtcctctaagtttttcctggttgccctggctattttttttagctttgcacaggtggtgatcgaggctaacagctggtggagcttggggatgaacaatccggtgcaaatgtcggaagtgtacatcatcggggcacagcctctgtgcagccaactggctgggcttagccaagggcagaaaaaactgtgccatttgtaccaagatcacatgcagtatatcggggaaggtgctaagactggcatcaaagagtgccagtatcagtttagacacaggcgctggaattgttccactgtggataatactagcgtatttggtagagttatgcaaattggaagtcgcgagaccgccttcacatacgcagtgtccgcagctggggtggtcaatgcaatgtcccgggcatgccgagagggagaattgagtacatgtggctgcagtagggcagctcgcccgaaggatttgccacgggattggctgtggggagggtgcggagataacatagactacggctaccgcttcgcaaaggaatttgtcgatgcccgggagagggaaagaatccatgcaaaaggatcctacgaatctgcgagaattcttatgaatttgcacaacaacgaagcgggacgccgaacggtttacaatctcgcggacgtggcttgcaagtgtcatggggttagcggcagctgctccctgaaaacctgttggttacagctcgcagatttccggaaagttggtgacgccctgaaggagaagtacgacagtgccgccgccatgcggctaaactctagggggaaactggtccaggtgaacagcaggtttaattccccgaccactcaggatctggtgtatatcgacccgtcccctgattactgcgttcggaacgaaagcactgggagcctgggaacccaaggtagattatgcaacaagaccagcgaaggcatggacggttgtgaattgatgtgctgtgggcgcgggtacgaccagtttaaaacagtgcagacggaacgctgtcattgtaaattccactggtgttgttacgtgaagtgcaaaaagtgcacagagatcgtggaccagttcgtttgcaagtag

SEQ ID NO: 18055 - DNA, 390 bp, Artificial Sequence
  Description of Artificial Sequence: Synthetic coding sequence
atgaagaagtcgatcggtatactgagcccaggggttgctttaggcatggctgggtccgccatgagcagtaaattcttccttgtggccctggctatctttttctcctttgcgcaggttgttatcgaggccaactcctggtggagcctgggcatgaataatcccgtccagatgtcccaggatgtgggcggacacgggtggctgcgtgcacatgttctgcgtccttggttgcgaccagttcaggatagggctgatggcgccctgcctctccaggtccctttagtgttgctacgacaggtccaagaagtccacggagatcggggtccagtatgcgtccaggtcgtcggcgctactcaacacagcgctcctttgccaggccctgcctatctctag

SEQ ID NO: 18056 - DNA, 1143 bp, Artificial Sequence
  Description of Artificial Sequence: Synthetic coding sequence
atgaagaagagcatcggaattctcagcccaggcgtggcgctgggcatggcaggctccgccatgtccagcaaattttttctggtggcattggctatatttttcagtttcgctcaggtagtgattgaagctaactcatggtggtctcttggtatgaacaatcccgtgcagatgtccgaggtgtatatcatcggagctcagcccctgtgtagtcaactggcaggcctgtctcaaggccagaaaaaactctgccacctttatcaggatcacatgcagtacattggagagggcgcaaaaacaggtattaaagagtgccaataccagttccgtcacaggcgatggaactgctctacagtagataatacatctgtttttgggcgcgtgatgcagatcggcagccgcgaaacggcctttacgtacgcggtttccgctgccggcgtggtgaacgcgatgtcaagagcctgtcgagagggtgaattgtcaacgtgcgggtgtagccgcgctgcaagaccaaaggacctcccccgggactggctctggggcgggtgtggggacaacatcgattacgggtatagatttgcaaaagaattcgtggacgcacgcgaaagagagcgcattcatgctaaaggatcttatgaatccgctcgcatacttatgaatctgcacaacaatgaagcaggtcggagaaccgtgtacaatctggcagacgttgcatgcaaatgtcacggagtatccgggtcctgtagtctgaaaacatgttggctacaattagccgactttcgcaaagtgggggacgccctcaaggagaagtatgactccgcagctgccatgcggctgaatagccgtgggaagctcgttcaagtgaatagccgattcaacagcccaactacgcaggacctcgtgtatatcgatccatcgcctgactattgcgtgaggaatgaaagtactggatctctcggcacccaaggccggctgtgtaacaagacttctgaagggatggatggctgtgaactcatgtgctgcggtcgaggttacgaccaattcaaaaccgttcaaaccgaacggtgtcactgcaaatttcactggtgttgctatgttaaatgcaagaagtgcaccgagatagtcgatcaatttgtgtgcaagtag

SEQ ID NO: 18057 - DNA, 645 bp, Artificial Sequence
  Description of Artificial Sequence: Synthetic coding sequence
atggccggcagcgcaatgtccagcaaattcttcttggttgctctggctatcttctttagtttcgctcaggtagtgattgaggctaattcttggtggtcccttggcatgaataaccccgtacagatgagcgaagtttatattattggtgcccagcctttgtgttcgcaactggcaggactgagccaaggccagaaaaagctgtgtcacctctaccaggatcacatgcaatatattggagaaggagccaaaactggcattaaagagtgtcagtaccaatttcgacaccgcaggtggaactgtagcacagttgataacacctccgtgttcggccgggtcatgcagatcgggagccgtgaaacagcctttacctatgcagtgagtgccgccggcgtggttaacgccatgagccgggcctgtagagagggagagcttagcacctgcggatgtagccgggctgcccgccccaaggatcttccaagagactggctttggggcggatgcggcgataacatagattatgggtaccgtttcgctaaagaattcgttgatgcccgggagagggagaggattcatgccaaggggtcttatgagtccgctagaattctcatgaacctgcacaacaacgaggctggacgtagagtgtag

SEQ ID NO: 18058 - DNA, 1098 bp, Artificial Sequence
  Description of Artificial Sequence: Synthetic coding sequence
atggcagggagcgcaatgagttccaaattttttttggttgctttagccatatttttttcctttgcacaagtcgtaatagaggccaactcatggtggagtttgggcatgaataacccggtccaaatgagcgaggtgtacattattggggcacagcctctttgcagtcagcttgctggcctctcgcaaggccaaaagaagctgtgtcacctgtatcaggaccacatgcagtacattggggaaggtgccaagaccggaatcaaagagtgtcaataccagtttcgacacagaaggtggaactgctccaccgtggacaataccagcgtgtttggcagagtaatgcagatcggaagtcgagagacggccttcacctatgctgtgagcgcagccggcgtggtcaatgccatgtcaagggcctgtagggagggggagctctcaacctgcgggtgtagtagggctgcgcgcccaaaggatctgccccgggattggctgtggggcggttgtggggacaacatcgattacggctatcgattcgccaaagaatttgtcgatgcaagagagcgcgagagaatccacgccaagggaagctatgagtcggcccgtatcttgatgaacctacacaacaatgaagctgggcgcagaacagtttacaatctagccgacgtagcatgcaaatgccatggagtcagtgggtcttgttccttgaaaacatgctggctgcagttagcggactttcggaaggtgggcgacgctcttaaggagaagtatgatagtgctgccgccatgagacttaactcaagggggaagctggtacaggtcaactcacgctttaacagccctactacacaggatctcgtttacatagatccgagccctgactactgcgtgagaaacgagagcacagggtccctcggcactcagggtcggctgtgcaataagacgtccgaaggaatggacggatgcgagctgatgtgttgcggacgggggtacgatcagttcaagactgtccaaactgaaagatgtcactgcaagtttcattggtgctgttatgtcaagtgcaagaaatgtaccgagatagtggaccagttcgtttgtaagtag

SEQ ID NO: 18059 - DNA, 876 bp, Artificial Sequence
  Description of Artificial Sequence: Synthetic coding sequence
atgcagtacataggtgaaggggcgaagaccggtatcaaggagtgccagtaccagttcaggcaccgtcggtggaactgctccaccgtcgacaacacctctgtgttcgggagagtcatgcagatagggtccagggaaactgcttttacatacgcggtgtccgcagccggagtcgtgaatgccatgagccgtgcctgccgggagggcgagctgtctacttgtggctgttcaagagccgcgagacccaaggacctcccaagggactggctctgggggggatgcggagataatattgattatgggtatagattcgccaaagagtttgttgatgcacgcgagcgggagcgtatacacgcaaaggggagctatgaaagcgctaggatccttatgaacctccataacaacgaggccggccggcgcacagtatacaacctggctgacgtcgcctgtaagtgtcacggagtatccggcagctgttctctcaagacatgctggcttcagcttgcagacttccggaaggttggcgacgcactcaaagagaagtacgactccgcagccgctatgcggctaaactcccgagggaaacttgtacaggtgaattcgcgctttaacagccccactactcaggaccttgtatacatcgatccaagtcctgattattgtgtccgcaatgaatctactggttccctgggcactcagggcaggctttgtaataaaacatcggagggaatggacggttgcgagctgatgtgctgtggcaggggatacgatcagttcaaaactgttcaaaccgagcgatgtcactgcaaattccattggtgctgctatgtcaagtgtaagaagtgcacagaaatcgtcgatcagttcgtgtgcaaatag

SEQ ID NO: 18060 - DNA, 1080 bp, Artificial Sequence
  Description of Artificial Sequence: Synthetic coding sequence
atgccgagcctgctattgctcttcaccgccgcattactctccagctgggcgcaattactgacggatgcaaacagctggtggtctctagcactgaatccagtgcagcgacccgagatgtttattatcggggcacagcctgtgtgttcccagctgcccggccttagcccaggtcagcgtaagctatgccaactgtaccaggagcacatggcttatattggagagggcgccaagaccggaatcaaggaatgtcagcatcagttcaggcagcgtcgctggaactgctcgactgctgataacgccagcgttttcggccgagtgatgcagataggctcacgcgagactgccttcacgcacgcagtgtctgccgccggggtggtcaatgccattagtcgggcgtgccgggaaggggagctgagcacctgtggttgctcacggaccgctcgtcctaaagatctgcctcgcgactggctatggggcggttgcggtgacaacgtggagtatggctatcggttcgccaaggagtttgtggatgcccgggaacgtgaaaagaacttcgcgaaagggtcagaagaacagggcagggtactcatgaacttgcaaaataacgaggcaggacggcgtgcagtgtacaagatggcagacgtagcttgcaagtgtcacggggtgtcagggagctgctccctgaaaacatgttggttgcaactggccgaattccgcaaggtgggagaccgcctgaaggagaagtacgatagtgcggccgccatgagggtgacccgaaaaggccgccttgagctggttaattccaggtttactcaaccaacccccgaggacctcgtgtacgtcgatccgagcccagactattgtctcaggaacgagtctacaggttccctggggacccagggcagactatgcaacaagacttctgaaggcatggatggttgcgagctcatgtgctgtgggagaggctataatcagtttaaaagtgtgcaagtggagagatgtcactgcaagtttcactggtgctgcttcgtgagatgcaagaagtgcacagagatagtggaccagtatatctgtaagtag

SEQ ID NO: 18061 - DNA, 1080 bp, Artificial Sequence
  Description of Artificial Sequence: Synthetic coding sequence
atgccaagtctgctgctcttatttaccgcggccctcctgtcatcatgggcccagctgctaactgacgctaattcttggtggtctttagcattgaacccagtccagcggccagagatgttcatcattggcgcacaacccgtgtgcagtcaattgcccggtctttctcctggccagcggaagctgtgtcagctgtatcaggagcatatggcatacatcggcgaaggtgccaaaactggaatcaaagaatgtcagcaccagtttcgacagagaagatggaactgctccacagctgacaacgcatctgtgttcggtagggtcatgcaaatcggctcccgagagacggccttcacccatgctgtgtctgccgcaggggtggtgaacgcaatctccagggcctgtagagaaggcgagttaagtacctgtggttgcagccgtacagcacgtcccaaggacttgcctagggactggctctggggcggatgcggggataacgtagaatatgggtacaggtttgctaaggagttcgtggacgctagggaacgagagaagaacttcgccaaaggcagcgaggagcagggccgcgtgttaatgaacctgcaaaataacgaagcgggccggcgcgcggtgtacaaaatggccgatgtggcctgcaaatgccacggcgtgtccggatcttgtagtctgaagacctgttggctgcaacttgccgagtttagaaaggtcggcgataggctcaaagagaagtatgactcggcagcagccatgcgcgtgacaaggaaagggagactcgaactggtgaacagtcgatttacccagcccacacctgaggacctcgtctacgtggacccttcccccgactattgtctcagaaacgagagtactggtagtcttgggacacaagggcggctgtgtaataaaacttctgagggtatggacggctgtgagctcatgtgctgcggtaggggctataaccaatttaaaagtgtccaggtcgaaagatgtcactgtaaattccactggtgttgcttcgtgcggtgtaagaaatgtacggagattgtcgatcagtacatctgcaagtag

SEQ ID NO: 18062 - DNA, 1080 bp, Artificial Sequence
  Description of Artificial Sequence: Synthetic coding sequence
atgcctagtctccttcttttgtttaccgcagccctcttgtcctcttgggcccaactgctgactgatgcaaacagttggtggtcacttgcactgaatcccgtgcagcggccagaaatgttcattatcggcgcccagcctgtgtgttcccaattgcctggcctgagccccggtcagaggaaactctgccagctctatcaagaacatatggcttatattggggaaggagccaaaacagggattaaggaatgccagcatcagttcaggcagcgccgttggaattgcagcaccgctgataacgcctctgttttcgggagggtgatgcaaattgggtcaagggagaccgcgttcacacatgcagtcagtgctgccggtgtagtcaatgccatttcgagagcttgccgagagggcgagctgtccacctgcggatgcagtaggaccgcgcggcctaaagaccttccccgggactggctgtggggaggctgcggagataacgtggagtatggttaccggtttgcaaaggagttcgtcgatgcccgcgagcgtgaaaaaaactttgccaaaggtagtgaagaacagggtcgggtgttgatgaacctacagaacaacgaagccggccggcgcgccgtgtacaaaatggccgatgttgcatgtaaatgtcacggtgtgagcggcagttgtagcttaaaaacatgttggctgcagctagcagaattcagaaaagtgggggatcgacttaaagagaaatatgattctgcagcggcaatgcgagtgacccgaaagggtaggctcgagcttgttaattccagatttacgcagcccacgcctgaggatttagtctatgtcgatccaagccccgactactgcctgcgaaatgaatcaactgggagtcttggcacgcagggtagactctgtaacaaaacctcagaaggaatggacggttgcgaattaatgtgttgcggacggggctataatcaattcaaaagcgttcaggtcgagcgttgccactgtaagtttcactggtgctgcttcgtacgttgtaagaaatgcaccgaaatcgtggaccaatatatctgcaagtag

SEQ ID NO: 18063 - DNA, 1398 bp, Artificial Sequence
  Description of Artificial Sequence: Synthetic coding sequence
atgacgggtagggcaatggaccctttgccagctgcagcagtcggtgccgcagccgaagcagaggctgacgaggaagcagatccaccagccagcgacctccctacaccacaggcgatcgaaccgcaggccattgtacagcaggtgccagctcctagtcgcatgcagatgcctcaaggcaatcctttgctcctcagccacactctgcaggagctgcttgcccgggacacggttcaggttgaactcattccggagaagaaaggacttttcctgaaacacgtagaatatgaggtcagcagccaaagatttaagagtagtgtgtaccgcaggtacaacgacttcgtggtttttcaagagatgttgctgcacaagttcccttaccgcatggtcccggcgttgccacctaagcgaatgctgggggccgacagagagttcattgaggccaggcggagggccctgaaaaggtttgtgaacctggtcgctaggcaccccctgtttagcgaagacgtggttctcaaactctttttaagcttcagcgggagcgacgtgcagaacaagctcaaggaaagcgcccagtgcgtcggagatgagttcctgaactgcaaactagccacaagggccaaggacttccttcctgccgatatacaagctcagttcgccatttccagggagctgatacggaatatttacaacagcttccacaaactgagggacagagccgagcgtatcgcaagccgagcgattgataacgccgcagatctgcttatcttcggtaaagagctatctgccatcggtagcgacacaacgcctctgccgtcttgggcagctctaaactctagcacttgggggtcactgaagcaggcattgaaaggactgtccgtggaattcgcactcctcgccgataaagccgctcaacagggaaaacaggaggaaaacgacgtagtggagaaactcaatcttttcctagatcttcttcagtcttataaagacctctgtgaaaggcatgaaaagggggtgctccataagcatcagcgggcccttcacaagtattctctgatgaagcgtcagatgatgagtgcaacagcccagaaccgcgagcctgagagcgtggagcagctggaaagcaggatcgtggaacaagagaacgccatacagaccatggagctccggaattacttctctctctactgtttacaccaggagacacaactgatacacgtctatctgcctcttacaagtcacatactccgagcattcgttaactctcaaatccagggtcataaagagatgtctaaagtgtggaatgacctgcgacccaagctcagctgccttttcgccgggccccattctacattaactccaccttgtagccccccagaggacggactctgccctcactag

SEQ ID NO: 18064 - DNA, 174 bp, Artificial Sequence
  Description of Artificial Sequence: Synthetic coding sequence
atgtcatccgtgcagcaacagccgccaccacccaggcgagtgaccaatgtgggttctctcttgctcacaccacaggagaatgaatccttgttcaccttcctgggaaagaagtgcgttacaatgagctctgcggtcgtacagctgtatgctgcggatcgcaacctcagctgctag

SEQ ID NO: 18065 - DNA, 1140 bp, Artificial Sequence
  Description of Artificial Sequence: Synthetic coding sequence
atggccagacgctccgcctttccggcagccgctctatggttgtggagcattctcctgtgtctcctagctttgcgcgcggaagccggtccccctcaggaggagtcgctgtatctgtggatcgacgcacaccaggccagggtactgataggattcgaagaggacatcctcattgtatccgagggcaagatggctccattcactcacgatttccgaaaggcccagcagaggatgccagcaatccccgtcaacatccatagtatgaattttacatggcaagctgccggtcaggccgagtatttctatgaatttctgtcactgcgatctctggataagggaataatggccgaccccaccgtaaatgttccgctcctggggacagtaccccacaaggcctcggtggtgcaggttggatttccgtgcctggggaagcaagatggagtagctgccttcgaagtagacgtgatcgtcatgaattccgagggtaacacaatcctgcaaaccccacagaatgctatctttttcaagacttgccagcaggccgaatgtcctggcgggtgtaggaacggcggcttctgcaacgaaaggagaatttgcgaatgccctgacggctttcatgggcctcattgtgagaaagcactttgcacgcctcgttgtatgaatggtgggctttgcgtgaccccaggcttctgtatctgccccccaggcttttacggagtgaattgcgataaagctaactgtagtaccacatgtttcaatgggggtacctgtttctatccaggtaagtgcatatgccctcctggactggagggagaacagtgtgaaatctccaagtgcccacagccctgcagaaacggggggaaatgcatcgggaagagcaaatgtaagtgtagcaaggggtatcagggggatttgtgcagtaagccagtgtgtgagcccggatgtggcgcccacggaacctgccatgagcccaacaagtgccagtgtcaagaagggtggcatggccggcactgcaacaaacgctacgaagcttccctcattcatgctctccggcccgccggagctcaacttagacaacacaccccttctctaaagaaggctgaggaaagacgcgaccctccagagtccaattacatctggtag

SEQ ID NO: 18066 - DNA, 120 bp, Artificial Sequence
  Description of Artificial Sequence: Synthetic coding sequence
aaaaaaaggaaagaaaagaaaagagaaaagcgccgcggaaaggagcgcaaggaattatttaagttggtgtcacatgtgcttgagaataggatgggatggcagcatctaaaatggatgtag

SEQ ID NO: 18067 - DNA, 1095 bp, Artificial Sequence
  Description of Artificial Sequence: Synthetic coding sequence
atggctagagcatccgaggccgtgagtaggatactggaggaatggcacaaggcaaaggtagaagctatgactcttgaccttgccctcctaaggagtgtgcagcatttcgccgaggcatttaaggccaaaaatgtgcccctccatgtgctggtatgcaacgccgcgacctttgcgcttccttggtcgctgactaaggacggtctagagaccacattccaggtcaaccatctcggccatttctacctggtgcagctgctgagaatgttttgcgcagcccagttgctgcccgtcagcctctggtccccccagtcccccattgacttacagatcttgaccacgccttgggaaaactggaccagtgtagccagcctgcagcaaaagactactatcggtagatgctggctaatcaccgggccaagctccgctacctcgagcagtcccaccagctgcacagttgcccccactcggggccacgttgagcgatctgcctcctggaagtacgacgtcctccagcactccagccagctcgtgggtgtgcacaccgcagtttatctaggggaagcttttcaccaagtgcatgcgaccggctcgtgccatcaccgtgtactttgttgttgtcctagaaccgggggttcaggacgagacgtgctgcagcaacttttgcctcttcacgctctgaccaggtcctccgaaaggcgtgacggtccagaccccgttggctctgagaggctcatacaagaacgccttgcatctcctgctaaatggtcaagcgaacgtatgggcacccatacgaggccagtttgcgtcccctctcgaaagtgtcagggaccccttcctaatgtgccccccacacagattcggaaatccaagggcaataagagctcccacaaccgcgtgaagaatttgaaataccaatgggaagcaggaaacagctggggcaaggtgagcctgttttgggggtgggcacggcatcgctctctctgttttctggtcgtcgcctgtcttaaggtgaaaacttgtctggtatgcaggtttaggattagccttgagaagcaccaacagttcagttttttctactgctatcggatcgcctag

SEQ ID NO: 18068 - DNA, 570 bp, Artificial Sequence
  Description of Artificial Sequence: Synthetic coding sequence
atggctgcgctcagatatgctgggctcgacgatacagattccgaggatgagttaccacccggatgggaagaaaggaccacaaaggatgggtgggtttactacgctaatcatacagaggagaaaacgcagtgggagcatcccaagaccggtaagcgtaaaagggtggccggggatctcccatatggttgggaacaggagacagatgagaacggacaggtgttctttgttgaccacataaacaaacgcacaacatacttggatccacgactagctttcactgtggacgacaatcccacaaaacccactactcgacagcgctatgacgggagtacgactgcaatggaaattctccaagggagggactttaccggcaaggtggttgtggttactggagccaacagtggaatcggctttgaaactgccaagagcttcgctcttcacggcgcccacgtgattttagcatgccgcaacatggctcgggcgtctgaagccgtttcaagaatactggaagagtggaaaacaaagtaccaccctccacctgagaaatgcaggattaaaatatttcactag

SEQ ID NO: 18069 - DNA, 936 bp, Artificial Sequence
  Description of Artificial Sequence: Synthetic coding sequence
atggccgcactccgatatgccggactggatgatactgactctgaagacgagctccctccaggatgggaagagcgtaccacgaaggatgggtgggtatattatgctaaccacactgaagagaaaacgcagtgggaacaccccaaaactggaaagcgaaaaagagtggctggagacctgccatatggttgggagcaggagaccgatgagaatggccaggtgttttttgtagatcacatcaataaacgcacaacgtacctggacccacgccttgcattcactgttgatgataatcccacaaagcctaccaccaggcagagatatgatggtagcactaccgccatggaaattcttcaaggccgggacttcaccggtaaagtcgtggttgtgacaggcgcaaactcaggaattgctaccggcagttgccatcatagagtcttgtgttgttgtccacgaactggcggttccggccgagacgtcctgcagcaacttctccctttgcatgcattgacacggtcgagtgaacggcgcgatggaccggatcctgtgggggcacagcgtgaagcagaccctagaaccgcttggcaacctgttagactttccggtgctcagagcggctgggctcacacccctgctctctgtgtgtctccccatgcatccgctcgggccggcccactcccgaatgttccccccacgcaaatccgcaaaagcaagggtaataaaagttctcacaatcgcgtcaagaacctgaagtatcagtgggaagcaggaaactcatggggaaaggtaagcctgttttggggatgggctcgtcaccggtcactttgcttcttagtagttgcatgtctcaaggtaaagacgtgtctcgtgtgccggtttcgtatcagtctggagaagcaccagcagttctcctttttttactgttatcgcattgcctag

SEQ ID NO: 18070 - DNA, 705 bp, Artificial Sequence
  Description of Artificial Sequence: Synthetic coding sequence
atggccgctcttcgctacgcagggctagacgacacggacagcgaagatgaacttcctccaggctgggaagagagaactacgaaggatggatgggtgtactacgcaaatcatactgaagagaaaactcaatgggaacacccgaaaacgggcaaacggaagagggtcgcgggcgacctcccctatggatgggagcaggaaactgacgaaaatggccaagtgttcttcgttgatcacatcaataaacgcacaacttacctggacccgagacttgcttttaccgtcgatgataaccctactaagccaacaacgcggcaaagatatgacggatcaacgaccgcaatggagatactgcagggcagggactttaccggtaaagtcgtggtggttaccggcgctaattcagggatcggtttcgagacagcgaagagctttgctctgcacggggcacatgttatcctggcatgccggaatatggccagagcatctgaggccgtgtccagaatcctggaagagtggcaacagggtgctgcgactacagtctattgcgctgcggtgccggagctcgaaggcctaggcggcatgtattttaacaattgctgtcgctgcatgccatccccagaggcgcaatctgaagaaactgccagaactctgtgggcactttccgaaaggctgatccaggagcgattggggtcccagagcggatag

SEQ ID NO: 18071 - DNA, 1245 bp, Artificial Sequence
  Description of Artificial Sequence: Synthetic coding sequence
atggccgccttacgctacgcagggctggacgacacagatagcgaggacgaattgccccctggatgggaagaacgcaccacaaaagacgggtgggtgtattatgccaaccatacggaggaaaaaactcagtgggagcaccctaagaccggaaagcgcaaacgcgtggcaggagatctcccctacggatgggagcaagaaaccgatgagaacggacaggttttcttcgttgaccacatcaacaaaaggacaacctatctcgacccgcggctcgcctttaccgtagatgataatcccaccaaaccaacgacacgccaacgctatgatggctccaccacggccatggagattctccaggggagggattttacagggaaggtcgtcgttgtgaccggtgcaaactcaggcattgggtttgagaccgcaaaatcttttgccttacacggggcacacgtgatcttggcctgccgtaatatggcccgggcgtctgaggctgtctcaagaatcttggaagagtggcacaaggctaaggtagaagctatgactctggacctggctctcctgcggagtgtgcagcactttgctgaggccttcaaggccaagaacgtaccactccacgttctggtgtgtaatgcagccaccttcgccctgccctggtccctcaccaaggatggccttgagacaaccttccaggtgaatcacctggggcacttttatctcgtccagcttctacaagatgtgttatgccgatctgccccggcccgcgtgatagtcgtctcgtctgagtcccacagatttaccgatattaacgacagtctagggaagctggattttagccgcttgtcccccaccaaaaatgattactgggctatgctggcctataataggtccaagctttgcaacattctctttagcaacgaacttcaccggagactgagccccaggggtgtcacgtccaacgctgtgcatcctggtaatatgatgtactccaatatccatagatcctggtgggtgtacaccttgctattcacactagcccgtccattcacaaagagtatgcagcagggcgcagcgaccacggtctattgcgccgcggtccctgagttggagggccttggcggcatgtacttcaataattgctgtagatgcatgccaagtccagaagcccagtctgaagaaacggcccgaacactttgggccctgtctgaaagactgatacaagagagactggggagccagagcggatag

SEQ ID NO: 18072 - DNA, 642 bp, Artificial Sequence
  Description of Artificial Sequence: Synthetic coding sequence
atggcggccctccggtacgccgggctcgatgacaccgactctgaggacgagctccctccaggttgggaggagcgcacaaccaaggacggatgggtgtactatgcaaatcataccgaggagaagacacagtgggaacatcctaaaaccgggaagaggaaaagggtggcaggagatcttccctacgggtgggagcaagagacagacgaaaatgggcaggtgttttttgtggatcatatcaataagagaaccacctacttggatcccaggctcgcgttcaccgtagacgataatcccaccaaacctacaaccagacaacggtacgacggaagtacaaccgcaatggaaatactacaaggacgggattttacaggtaaggtagtggtggtcacaggggccaactcaggaattggaaaggccagctgccatgtcggcaggatccttaagcacactcgcgtggaagagctatcactcttgcctacggcaatcaatcgcgaattgcctcccccctgcaccgttctgctaagtcaaaattggcgcgtgtgggagggctgcacctctactacggcagctgcggcgtgtccccaccagaaacttcgagccaaacgccggcccggaccctgcggtaggagtgctcggggctag

SEQ ID NO: 18073 - DNA, 1245 bp, Artificial Sequence
  Description of Artificial Sequence: Synthetic coding sequence
atggccgccctgaggtatgcaggcctggatgacactgatagtgaggatgagttgccgcctggatgggaggaacgtaccacaaaggatggctgggtgtattacgctaaccatacagaagagaagacccagtgggaacaccctaaaacaggtaaacggaagagagtagccggggatttaccttatggatgggaacaggaaacagacgaaaatggccaggtgtttttcgtcgaccacatcaataagcggactacatacttggatccgagactcgcctttacagttgacgataaccctaccaaacccacaactcggcagcgctacgatggatctacaactgctatggaaatattgcagggaagagactttaccggtaaagtcgtcgtagtcacaggcgctaattcaggcatcggatttgagacagctaagtcattcgcattgcatggggctcatgttatactggcctgtagaaatatggcccgagcttccgaggccgtgagcagaattcttgaggagtggcataaggccaaagttgaggcaatgaccctcgatctggctttactgaggagtgtccaacatttcgccgaggcctttaaagctaagaatgtccccttacacgtcctggtatgcaacgccgcgacctttgctctaccctggtcacttacgaaagacggtctcgagaccacctttcaggtaaatcaccttggacatttttaccttgtgcagctgctccaggatgttttatgtcgctccgcccctgcacgggtgatcgtcgttagctcagagagccatcgtttcaccgacatcaacgattctctagggaagttggattttagtcgcttgagccctactaagaacgattactgggcgatgctcgcctataatcgatcaaagctgtgcaacatactgttttcgaatgaactgcaccggcgcctcagcccaaggggggtaactagcaacgcagtccacccaggtaatatgatgtatagcaatatccatcgatcctggtgggtttacactttactgtttaccctggccaggccattcacaaaaagcatgcagcagggcgcagctaccaccgtatattgtgccgcagtaccggagctggagggactgggcggaatgtatttcaataattgttgtagatgcatgcctagtcctgaagctcagtcggaagagacagccaggaccctgtgggctttgtctgagagactgatccaggaacgcctagggtctcagagcggctag

SEQ ID NO: 18074 - DNA, 111 bp, Artificial Sequence
  Description of Artificial Sequence: Synthetic coding sequence
atggctgcgctgagatatgcaggcctcgatgacaccgattccgaggatgaactgcctcccgggtgggaggaacgtaccacaaaagatggttgggtgtattatgctaagtag

SEQ ID NO: 18075 - DNA, 1047 bp, Artificial Sequence
  Description of Artificial Sequence: Synthetic coding sequence
atggcccactcacagaattcattggaactgccaataaatatcaacgctacacagataaccacggcctacggtcatcgcgcactgccaaaactcaaggaggagcttcagtccgaggacctgcaaacccggcagaaggccttaatggctttgtgtgacttgatgcatgaccccgagtgcatctataaagcaatgaacatcggttgtatggagaaccttaaagcattgctgaaggacagcaatagcatggtccgcattaaaacaacagaagtgctgcacatcaccgcaagccacagcgtaggacgctacgcatttcttgagcacgatatcgtgctcgccctgagtttcctgcttaacgatccctcacctgtgtgccggggtaatctttacaaggcctatatgcagttagtccaagtgccaagaggtgcacaggagataatctcaaagggacttatttcaagcttggtctggaagttgcaggtagaggtggaggaggaggaatttcaggagtttattttggacacgttggtgctgtgtctgcaagaggatgccactgaagctctcgggtctaatgttgtgcttgtgttaaagcagaagctcctctccgccaaccaaaacatccgtagtaaagcagcaagggccctattaaacgtgtcaatctcaagggaaggtaagaaacaggtttgtcattttgacgttattcccattttagtccacttgctcaaagaccctgtggaacacgtgaagagcaacgcggcaggggcacttatgtttgcaacagtcatcaccgaggggaagtacgcagcccttgaggcccaggctattggtttattgcttgaactgttgcacagccctatgacaatcgccaggctgaatgccacgaaggctctaacaatgcttgcagaggctcccgaaggacggaaggccctgcagacccacgtccccacattccgcgctatggaagtcgaaacatatgagaaaccacaggttgctgaggctctgcagcgggccgctcggatcgccattagcgtgatcgagttcaagccgtag

SEQ ID NO: 18076 - DNA, 1131 bp, Artificial Sequence
  Description of Artificial Sequence: Synthetic coding sequence
atggtcgtcgttgccgctgcaccgaatcctgcggacggtaccccaaaggtgctgttgctctccgggcagcctgcctcggccgcaggcgcacccgccgggcaggctctcccgctgatggtgcccgcccagcgaggcgccagtcctgaagcagcttccggcggactacctcaggctaggaagcgccaacgcctaactcatttgtcccctgaggaaaaggccctccgcagaaagctgaaaaatagggtcgctgcccagacagcgagggaccggaaaaaagcgcgcatgtctgagctggagcagcaggtcgtagatctggaagaagaaaatcagaagctactgctggagaatcagttgctgcgggaaaaaacacacggcctcgtggtcgagaaccaggaactgaggcagcgcttaggaatggacgcgcttgtggcagaagaagaggctgaggccaaggggaacgaggtcaggccagtcgccggaagcgctgaatcagccgcgggggccggcccggtggtaactccccccgaacacctgccaatggacagtggaggaatcgattcaagcgattccgagtccgatatcctccttggcatcctcgacaatctggatccagtcatgttctttaagtgtccaagtcccgagcccgccagtctcgaagaactccccgaggtctaccccgaggggccttcgagcctacccgccagcctctccctgtcagtgggaaccagctcagccaaacttgaagccatcaatgagcttatcagatttgaccacatctacaccaagcctctggtcctcgaaatcccttctgaaaccgaatcccaggccaacgtggtagtgaaaattgaagaggcgcctcttagccccagtgaaaatgatcatccggagtttattgtgtcagttaaagaagaacccgtggaagacgacctggttcctgagcttggcattagtaacttattaagctctagtcactgtccaaagccctcttcctgcttgctcgacgcttattccgattgtgggtacgggggaagcctgtccccctttagtgatatgtctagtctgctgggcgtcaaccatagctgggaggatacctttgcaaatgagctttttcctcaattaatttctgtctag

SEQ ID NO: 18077 - DNA, 801 bp, Artificial Sequence
  Description of Artificial Sequence: Synthetic coding sequence
atggttgtggtcgcagctgcccccaaccccgccgatggcaccccaaaggtgcttttgctaagtggtcagccggctagcgccgctggtgcgccggctgggcaggccctgccgctgatggttcctgcccagcggggtgcaagccccgaggctgcctccgggggattgcctcaagcccgcaaaagacagagattgacccacctcagcccagaggaaaaggcgctgagacgaaaactcaagaatcgggtcgctgcccaaaccgctcgggatcgaaaaaaagccaggatgtctgagctggaacaacaggtggttgacttggaggaagaagtaaagctgttgaagaatcagaaactgctactagaaaaccagcttctgcgagagaaaacacacggactggtggtggaaaaccaggagctgcgccagaggctcggaatggacgcacttgttgctgaggaggaagctgaggcaaaaggtaacgaggtgcggccagtggccggctcagcagagtcagctgcacttaggctgcgggcgccactgcagcaggtgcaagcccagctttcgcctctacagaacatcagtccttggattctcgcagtgctgactctccagattcagtccctcattagctgttgggctttttggacgacttggacccaaagctgctcatcgaacgccctcccccagagcctgccggcctggaggtcgtcccagcgctccactcagaaagatccagtcccctatcaaccgcccttcctgtgccagtggggtcgccatcagcctagctggaagcctcttatgaattag

SEQ ID NO: 18078 - DNA, 636 bp, Artificial Sequence
  Description of Artificial Sequence: Synthetic coding sequence
atgcgcgcccccgtcttccaagcactgctgctttgtggcagacgcctggtggtccagccattgaactcggacatgaggaaactgaaaaaccgcgttgcagctcaaacggccagggatcggaagaaggcgagaatgtctgaactcgaacaacaagtagtcgatctggaggaggaaaaccagaagctgttgctagagaaccagctcctccgggaaaaaacccacggtttggtggtagagaaccaggaactgcggcagcgtctaggaatggacgccctggttgctgaagaggaggccgaggccaagggaaacgaggtgaggcctgttgctggaagtgctgagtccgccgccctgcgcctgagagcgccactccagcaggtccaggcacagctctcaccactacaaaatatctcgccctggatactggctgtgctcactctccaaatccaatctctaattagttgctgggctttctggactacctggacacaaagctgcagcagcaatgccctgccgcaatccctgccagcctggaggtcatcccagaggtctacccagaaagatccggtgccttaccagccaccattcctatgccagtggggtagacaccagccaagctggaagccattgatgaattag

SEQ ID NO: 18079 - DNA, 822 bp, Artificial Sequence
  Description of Artificial Sequence: Synthetic coding sequence
atggctgcagccgatggtgcactgcctgaagctgctgccttagagcagcctgcggaactgcccgcaagcgtgcgtgcctcaatcgagcgtaaaagacagagggctctaatgcttcgacaagctagactggccgctagaccctactccgcgacagctgctgcagctaccggaggcatggccaatgtaaaggccgccccaaagattattgacaccggaggaggcttcatcctggaggaagaggaggaggaggaacagaaaatcggaaaggtcgtgcaccagcctggccccgtgatggagtttgattacgtgatttgcgaggagtgcggcaaagagtttatggacagctatttgatgaaccacttcgaccttcccacctgtgataactgtcgggatgctgacgataaacacaaattgatcacaaagaccgaggccaagcaggagtacttattgaaagactgcgatctggaaaagcgcgagcctcccctgaagtttattgtgaaaaagaacccacaccactctcagtggggtgatatgaagctttacctgaagctgcagatcgttaaacggtccttggaagtgtggggctcccaggaggctctggaggaagctaaagaggttagacaagagaaccgcgagaaaatgaagcagaagaaattcgataaaaaggtgaaagagctgagaagggcagtgagatcctccgtgtggaaacgggaaaccatcgtgcatcagcatgaatacgggcccgaagaaaacttggaggatgatatgtataggaaaacctgcactatgtgcgggcatgaactgacctatgagaagatgtag

SEQ ID NO: 18080 - DNA, 2823 bp, Artificial Sequence
  Description of Artificial Sequence: Synthetic coding sequence
atggccagaaagcgcgctgccggaggagagccaaggggacgcgagcttcgcagccagaaatcaaaggcaaagagcaaggcccgcagggaagaggaggaagaggacgcatttgaagacgagaagccccctaagaagtctctcctgtccaaagttagtcaagggaaaaggaagagggggtgcagccacccaggtgggtctgctgacgggcctgcaaaaaagaaagtcgccaaggttactgttaagtctgaaaaccttaaggttattaaagatgaagcactctcagacggcgacgatctgagagacttccctagtgatctcaaaaaggctcaccatctgaaaaggggcgccaccatgaatgaggactccaatgaggaggaggaagaatcagagaacgactgggaggaggtcgaggagctttctgagcccgtgttgggagacgtccgcgagtctactgcattctctaggagcttgctgcccgtaaaacctgtggagattgagatcgaaaccccagaacaggctaagacacgcgagagatccgagaagattaaattagagtttgaaacttacttgcggagagccatgaagcgattcaataagggtgttcatgaagatacacacaaggttcatctgctttgtctgcttgctaacggattctatcggaacaacatctgcagccaacccgacctccatgcaattgggctgagcattataccagctcgcttcacacgcgttcttccgcgggatgtagatacttactacttgagcaatctggtcaagtggttcatcgggacgtttacagtgaatgcagaactctcggcttcagaacaagataatttgcaaacaactctagaaagaagattcgccatttacagcgctcgggatgacgaagagctcgtccacatttttctattgattcttcgggccctccagctgctcactcgcctcgtattgtcactgcaaccaattccactaaagagcgccacggcaaagggaaaaaagcccagcaaagagagactcacagcagacccaggaggcagctcagagacatcatcacaagttctcgagaaccatacgaagcctaaaacctctaagggcacaaagcaggaggagacatttgcaaagggcacctgccgccccagtgcaaaggggaagcgcaacaagggaggtcggaagaaacgctcaaagcccagtagcagtgaggaagacgagggacctggcgataagcaggaaaaagcaacacaacgcaggcctcacggccgcgaaagaagggtcgcatcacgggtgagttataaagaggagtcaggatccgacgaggcgggcagcgggtcagattttgagctgtcttcaggcgaagcctcggatccaagcgacgaagatagcgaaccaggaccccctaaacagcgtaaggccccagccccccagagaaccaaggctggcagcaagagcgccagccggactcataggggtagtcataggaaggacccctccctgcccgcagcttcatcttctagcagttcctcgaaacggggcaagaagatgtgttcagacggggagaaagccgaaaagcgctccatcgccggcatcgatcagtggctggaggtattttgtgagcaggaggagaagtgggtgtgcgtggattgtgttcacggcgtggtcggtcagcctctgacatgttataagtatgccaccaagccaatgacctacgtagtcggtatcgattcggatggctgggtgcgcgacgtcacccagcggtacgaccctgtttggatgacggtgacgcgcaagtgccgcgtcgacgccgagtggtgggccgagacattgaggccctaccagtctccctttatggaccgcgagaaaaaagaggacctggaattccaggcaaaacacatggatcagcccctgccaacagcaatagggctttacaaaaatcaccctttatatgcgttaaagcgacacctactcaagtatgaagcaatctacccagagactgccgccatcctcggttactgcagaggagaggccgtgtactcgagagactgcgtccacacactacactcaagagacacctggcttaaaaaggcgcgagtcgtacgactcggcgaggtgccttataagatggtgaaaggtttttctaaccgggcccggaaggctcgcttggcagagccacagcttagagaggaaaatgatctggggttgtttgggtattggcaaacagaggagtatcagccaccagtggcggtcgacggcaaagtacccaggaacgaatttggcaatgtctatttatttctgccttctatgatgccgatcggctgcgtgcagctcaatcttcccaatttacatcgcgtggctagaaagctcgacattgattgtgtacaggctattacagggtttgacttccatggcggatattcacatcccgtaaccgatggatacatcgtctgtgaggaattcaaggacgtactcttgacagcctgggagaacgagcaggccgtcatcgaacggaaagaaaaagagaaaaaggagaagcgtgcgcttggcaattggaagttactggccaaaggattgctgatcagagaaaggcttaagaggcggtacggccctaaatctgaagccgcagccccccacacggatgctgggggaggcctcagctcggacgaggaagagggtacatcatctcaagctgaagccgcccggatattggcggcatcctggccccagaacagagaggatgaagaaaagcagaagttaaagggggggcctaagaagaccaaaagggagaagaaggccgccgctagtcatctgtttccatttgaacagctttag

SEQ ID NO: 18081 - DNA, 2712 bp, Artificial Sequence
  Description of Artificial Sequence: Synthetic coding sequence
atggcaaggaaaagagccgccgggggagaacctcgcggccgtgagttgcggagccagaagagcaaggcaaagtccaaggcccgcagagaggaagaagaagaagatgccttcgaagacgaaaagcctccaaaaaagtcccttctgagtaaagtctcgcaaggcaagcggaaaagaggatgcagccacccggggggaagtgccgacgggcccgccaagaagaaggttgcgaaggtgacagtgaaatcagagaacttgaaggtgatcaaagacgaggcactgtccgatggcgatgatttacgcgactttcccagtgacctgaaaaaggcgcatcacctcaagaggggtgctaccatgaatgaggacagcaatgaggaagaggaggaatctgagaacgattgggaggaagctaagacccgagagagaagtgaaaagatcaaactggagttcgagacctacctgagaagagccatgaagaggttcaacaagggggttcatgaagatacccacaaggtgcatttgctgtgcctcctggccaatgggttctacagaaataacatatgctctcaaccagacctgcacgctattggactctcaataatacccgcccgctttaccagggtgctacctagagacgtggacacctactacctgagtaacttggtgaaatggtttattggtacgtttacagtaaatgcagaactctcagcctctgaacaggacaacctgcagactaccctcgagagaagatttgcgatttactcagcgagggacgatgaggagctagtgcatatctttttacttatcctcagggcgctacagctcctgaccaggctggtcttgagcctgcagccaatccctctgaagtctgctacggcaaaggggaaaaaaccctctaaagagcggctgacagcggacccaggcggttctagtgagaccagctctcaagtcctggagaaccacactaagcccaaaacgtcgaagggaaccaagcaggaagagacatttgccaaaggcacatgtagaccatctgcaaagggaaagaggaacaagggtgggcggaaaaagaggtccaagccatcgagctccgaggaagacgaaggacccggtgataaacaggaaaaggctactcaaaggcgcccacatggaagggaacgcagggtggctagtagagtgtcatataaggaggagagcggtagtgatgaggctggttcaggttctgattttgaactcagctctggagaagccagcgatcccagtgatgaagatagcgagcccgggccaccgaagcaacgtaaagcgccagccccccagcgtactaaagccggatccaagagtgcctctagaacgcaccgcggatcacaccggaaagatccttcactgcccgctgcaagcagtagctcttcctcttccaagagaggcaaaaaaatgtgttctgatggtgaaaaagcggagaagcgttccatcgcgggaatcgatcaatggttggaggtgttttgtgagcaggaggaaaaatgggtctgcgttgattgcgtgcacggagtcgtcggacaacctctgacctgttacaagtatgccaccaagccaatgacatacgtggttggaatcgactctgatggctgggttagggatgtcacgcaaagatatgatcctgtgtggatgactgtgacgcgtaagtgtcgcgtggatgcggaatggtgggctgaaacactaagaccataccagtctccatttatggatagagaaaaaaaggaagacctggaattccaggcaaagcacatggaccagccgctcccaaccgctatcggactgtacaaaaatcatcccttgtatgcactgaagcgacatctgctgaaatacgaggcaatatatcccgaaaccgccgcgattctgggctattgtcggggcgaggccgtctacagtagagactgcgtgcacactctgcactcccgggacacttggttgaaaaaggccagagtggtcagactgggggaggtgccgtacaagatggtcaaggggttcagcaacagggctcgcaaggctagactcgcagaacctcaactgcgagaagagaacgacctgggcctgtttggatactggcagaccgaggagtatcagccacctgtggccgtcgacggaaaggtgccccggaatgagttcggtaatgtctacttgtttctgccctccatgatgccgatcggctgtgtacagctgaacctccctaatctgcatagggtggcaaggaaactggatattgactgtgttcaggcgatcaccgggttcgacttccacggaggatacagtcatcccgtgacggacgggtatattgtctgcgaggagttcaaggacgtgctgctcacagcctgggagaacgagcaagcagtcattgagaggaaagaaaaagaaaaaaaggagaagcgtgcactgggtaattggaagctgctcgctaagggtctgctcatccgcgagagattaaaacgccgatatgggccaaagtcggaggcagccgcacctcacaccgacgcaggaggaggactatctagcgacgaggaggagggtacttcctcccaggccgaggcggcccgaatcctggcggctagctggccccaaaacagagaggacgaggagaaacaaaagctcaaaggaggacctaagaagacaaagcgcgagaaaaaagcggccgcgtctcacctgtttccctttgagcaactgtag

SEQ ID NO: 18082 - DNA, 423 bp, Artificial Sequence
  Description of Artificial Sequence: Synthetic coding sequence
atggccaggaaacgagcagccggtggcgagcctcgcggtcgagagttacgcagtcagaagtcgaaggccaaatcaaaagctagacgagaagaggaggaagaggatgcattcgaagatgagaaaccaccaaagaagtctctcctgtcgaaggttagccagggcaagcgtaaacgcggctgctcacatccagggggctcagcagacggtccagctaagaaaaaagttgccaaggtcacagtgaagagcgagaacctgaaggttattaaagatgaggctctgtcagatggagatgatctaagagatttccccagcgaccttaaaaaggcccaccatcttaagaggggggctactatgaatgaggacagtaacgaagaggaagaagaaagcgagaacgactgggaggaggtcgaggtgaagaggtag

SEQ ID NO: 18083 - DNA, 507 bp, Artificial Sequence
  Description of Artificial Sequence: Synthetic coding sequence
atggcgaggaaacgtgcggcaggaggagaaccgaggggtcgggaactgagaagtcagaaaagcaaggcgaagtcaaaggccagacatgctttcgaagatgagaagcccccaaagaaatcattactgtccaaagtaagtcagggcaaacgcaagcgtggctgttcccaccctggcggctctgcagacggaccagccaaaaaaaaggtggccaaggtcacggtgaaaagcgagaacctcaaggtcattaaggatgaggctctttccgacggggatgacctgcgagactttccatctgaccttaagaaagctcaccacctgaagcgcggagcaactatgaatgaagatagcaacgaggaggaagaggagtcagagaatgactgggaggaggttgaagagctctcagagcctgtgcttggagacgttcgggaatcgaccgctttcagccggagcctactaccagtaaaaccggtcgagatcgagattgaaacaccagagcaggccaagtag

SEQ ID NO: 18084 - DNA, 462 bp, Artificial Sequence
  Description of Artificial Sequence: Synthetic coding sequence
agcagcagtaaacgtggcaagaagatgtgttcagatggcgaaaaggccgagaaacggtctatagctggtattgaccaatggctggaagtcttttgcgaacaggaggagaagtgggtgtgcgtcgactgtgtccatggcgtggtaggacaaccgttaacttgctacaagtacgcgactaaacccatgacatacgtggtgggcattgacagcgatggatgggtgcgtgatgtgacccagcggtatgaccccgtgtggatgacagttacccgcaagtgcagggtggatgccgaatggtgggctgaaacactgcggccataccagagccccttcatggatcgcgaaaaaaaggaggacctggagggcttgtgtgcccactccgcgtttcaggggcacgttgccgaagaatctaaatctggtgaggcctggcggtccactctgcaagacggcgagaggctgttctag

SEQ ID NO: 18085 - DNA, 177 bp, Artificial Sequence
  Description of Artificial Sequence: Synthetic coding sequence
atgtgctccgatggcgagaaagccgagaagagaagtattgcgggcatcgaccagtggctggaagtgttctgcgagcaggaggagaaatgggtgtgtgttgattgcaggtgcggaggacccgcttcagacctactgcaggtgcgccaccaggctcacgacctttgcggcggacattag

SEQ ID NO: 18086 - DNA, 231 bp, Artificial Sequence
  Description of Artificial Sequence: Synthetic coding sequence
aaagccacccagagaaggccccatggccgtgaacggcgagtcgctagccgagtgtcttacaaggaggagtccggttccgatgaagctggcagcggaagcgatttcgagttaagctcaggtgaggcatcagaccccagcgacgaggactctgagccagggccccccaagcagagaaaagcccccgccccgcagcgcaccaaggcggggtcaaagagtgcatctagaacctag

SEQ ID NO: 18087 - DNA, 849 bp, Artificial Sequence
  Description of Artificial Sequence: Synthetic coding sequence
atggagggcgacttcagcgtgtgtaggaattgcaaaagacatgtggtctccgctaactttacattacacgaagcttactgcctgcgttttctcgtcctctgccccgagtgtgaagagcctgtgcctaaagaaaccatggaggaacactgcaagctagagcatcagcaagccaatgagtgtcaggaacgaccagttgagtgtaaattctgtaaattggacatgcaactgtctaagctcgaacttcacgagagttactgtggatctagaactgagttatgtcagggttgtggccaattcattatgcatcgaatgttggcccagcaccgcgatgtgtgccgcagcgagcaagcccagctgggaaagggtgagaggatcagcgccccggaacgggaaatatattgtcattattgcaaccaaatgattcctgaaaacaaatacttccatcacatgggcaaatgttgccctgattccgagttcaagaagcacttcccagtcgggaaccctgagatcctaccctcctctctgcccagccaagcggccgaaaaccagacatctacaatggagaaagacgtccggcccaagacgcgatctatcaacagattcccccttcattccgaatcttccagcaaaaaagcgccgagatccaaaaacaagaccctggatcctctgctcatgagtgagcctaagccccgaacaagctcaccacggggagacaaagctgcctacgacatactgcgtcggtgttcacagtgtggcatactcttgcctcttccaattctgaaccaacatcaggagaagtgtcgctggttagcctcttccaagggcaagcaagtacggaacttttcttag

SEQ ID NO: 18088 - DNA, 906 bp, Artificial Sequence
  Description of Artificial Sequence: Synthetic coding sequence
atggagggggacttttcggtgtgtagaaattgcaaacggcatgttgtttccgcaaactttacgctgcacgaggcttattgcctgaggtttctggtgctctgcccagagtgtgaggaacccgtacccaaggagaccatggaagaacactgtaagcttgagcaccaacaggtgggttgtactatgtgtcaacagtctatgcagaaaagttccctggagtttcataaagccaacgagtgccaggagaggcctgtggagtgcaagttctgcaagctagatatgcagttatccaagctggagctccacgagtcttattgtggatcccggaccgaattgtgtcagggctgtgggcagtttataatgcatcggatgttggcccagcatagagatgtctgccggtctgaacaggcacagctaggaaaaggcgaacgaatcagtgcccccgagagggaaatctactgccattactgcaaccagatgatccccgagaacaagtatttccatcacatgggaaaatgttgtccggatagtgagtttaagaagcacttcccagttggcaacccagagatcctgcccagctctctcccctcccaggcagccgagaaccagacttcaaccatggaaaaggatgtcagaccgaaaacccgctccatcaataggtttcctctacactctgagtcgagtagcaagaaggcaccccgcagcaaaaataagactctggatccgctacttatgtcggaacctaagcctcgtacatcatctccacggggggataaggctgcctatgacattctgcgcaggtgctcccaatgtggaatcctcctccctctgccgatcctgaaccaacaccaggaaaaatgtcggtggctggcaagcagcaaaggcaagcaggtgcgtaactttagctag

SEQ ID NO: 18089 - DNA, 600 bp, Artificial Sequence
  Description of Artificial Sequence: Synthetic coding sequence
atgtccttgcattacggttgctgctgtcccgaatgcacctccgtggcgatcaaagagatgatgtgggtgattaggcctcgggtggcctgtgttgtgaaagatgccggcagtgcaggcgaacggatttcagccccagaaagagagatatactgtcattattgtaatcaaatgatccctgagaataagtactttcaccatatggggaagtgctgtcctgattctgagtttaaaaagcacttccctgttgggaatcctgagattcttcccagcagtctaccctcacaggccgccgagaatcaaacttccactatggaaaaggacgtacggccaaagaccaggtctattaaccgatttccacttcactctgagagctctagcaaaaaggccccccgcagtaaaaataagaccctggaccctctgctgatgagcgagcccaaacctaggacatcttcaccgagaggcgataaagccgcttatgatatcctcagacggtgtagccagtgtgggattttgcttcctctgcccattctgaaccagcatcaggaaaagtgccggtggcttgcctccagcaaaggcaagcaagtgcggaatttctcttag

SEQ ID NO: 18090 - DNA, 495 bp, Artificial Sequence
  Description of Artificial Sequence: Synthetic coding sequence
atggaaggggacttttccgtgtgtaggaattgcaagcgccatgttgtttcagcgaattttacattgcatgaagcatattgtctgcgtttcctggtcctatgccccgaatgtgaagagcctgtgcctaaggagacgatggaggaacactgtaagctcgagcatcagcaggtcggatgtacaatgtgtcagcagagtatgcaaaagagctccttggaatttcataaagccaatgagtgccaggaacggccagttgagtgtaaattctgcaaacttgacatgcaactgagcaagctggaactgcatgaatcatattgcggctcccggactgaactgtgccagggatgcggacagtttatcatgcacaggatgttagcacagcatagagacgtgtgtagaagtgaacaggctcagttgggaaaagagacctcacctgacccaggtaagtgcctctccattactgtggctgccgccttaagcgctcatctgtggccctag

SEQ ID NO: 18091 - DNA, 906 bp, Artificial Sequence
  Description of Artificial Sequence: Synthetic coding sequence
atggagggggatttttccgtctgcaggaactgtaagcggcatgtagtgagcgcaaatttcaccttgcatgaagcttattgcctgcggtttctggtgctatgtccggagtgtgaagagccagtcccgaaagagacaatggaggaacactgcaaacttgagcaccagcaggtgtctgagatgggatcaggccgagggaagtgctcaattctccctgcccggaaaaaggccaacgaatgccaggaaagaccagttgagtgtaagttctgcaaactcgatatgcaattgtcgaagcttgaactgcatgaaagctattgcgggagccgaaccgaactgtgtcaaggctgtggacagtttattatgcataggatgctggcgcagcacagagatgtgtgcaggagtgaacaggcacagcttggaaaaggcgaaagaattagtgcaccagagagggagatttattgccactattgtaatcaaatgattcctgaaaataaatattttcaccacatgggcaagtgttgtccggattccgaatttaagaagcattttcccgtaggtaatcccgagatactgccttcttctctcccatcccaggctgctgagaatcaaacctccactatggagaaggatgtgaggcccaagacacggtctattaatagattcccccttcactccgagagttcatctaaaaaagcaccacgtagtaagaacaagaccctggaccctctactcatgtctgagcccaagccgagaaccagttccccgagaggggacaaggcagcatacgacatactccggcgatgtagccagtgcggtattcttcttccgctccccatcctcaaccagcatcaagaaaaatgccgatggcttgcttccagcaaggggaaacaggttaggaatttcagttag

SEQ ID NO: 18092 - DNA, 1494 bp, Artificial Sequence
  Description of Artificial Sequence: Synthetic coding sequence
atgacctttaatagctttgagggatcaaaaacttgcgttcccgccgatattaacaaggaggaagaatttgttgaagagtttaaccgactaaagacctttgctaactttccaagcggctcccctgtttcagcttctacacttgctcgggcaggatttctatatactggggagggtgacacagttcgctgtttctcctgccatgcggcagttgacagatggcagtacggagactccgccgtggggcgccatcggaaagtatctcctaattgtagattcatcaacgggttctacctggaaaatagcgctacgcagtctactaattcaggcatccagaacggccagtataaagtggagaactaccttggttcacgcgatcatttcgcattggataggcccagcgagactcacgccgattatctgttgagaacagggcaggtggtggacattagcgacacaatatatccccgaaatccagcaatgtactcagaagaagcgcgactgaaaagtttccagaattggcccgattacgctcatctgacacctcgcgaactcgcctcagccggattgtattacacgggaattggtgatcaggttcagtgcttctgttgcggcggcaagctcaagaactgggagccctgcgacagagcctggtcagagcacaggcgccatttccccaactgcttctttgtgctagggcggaacttgaacattcgatccgagtctgacgccgtgagcagcgacagaaactttccaaattcaactaatctgccacgcaacccttcaatggccgactatgaagcacgcatttttacatttgggacatggatctacagcgtcaataaagaacagctggcgagggccggattttacgctctcggcgaaggtgataaggtcaaatgttttcactgtgggggcggactgacagactggaaaccatctgaggacccctgggaacagcacgccaaatggtaccccgggtgcaagtacctgctggaacagaagggacaagagtacattaataacattcacctaactcactctctggaagaatgcctcgtcagaacaaccgaaaagaccccttctctgacacggcgcatcgacgatacgatttttcagaaccctatggtacaggaggcaatcaggatgggtttttcctttaaggatataaagaagattatggaggagaaaatccagatcagtggttcaaactacaagtcactggaggtgctggtcgcagacctggtaaacgctcagaaggactctatgcaagatgagtcatcgcagacttctctacagaaagagatctccactgaggagcaactgcggcgcctgcaggaagagaagctctgtaaaatatgcatggacagaaacattgcaatcgtatttgtgccctgcggccacctggtgacctgcaaacaatgcgccgaggctgtggacaagtgtcctatgtgttataccgtgatcacctttaagcagaaaatatttatgtcctag

SEQ ID NO: 18093 - DNA, 1494 bp, Artificial Sequence
  Description of Artificial Sequence: Synthetic coding sequence
atgaccttcaattcatttgaaggctctaaaacgtgtgtgcctgcagatattaataaagaggaggagtttgtcgaagaatttaatagacttaaaacatttgctaactttcccagcgggtcacccgttagtgcaagcaccctggcccgagcaggcttcctgtacactggggaaggcgataccgtgcgctgcttcagctgccatgcagctgtcgatcgctggcagtatggagactctgcggtcggccgacataggaaggtgtcaccaaactgtagattcattaacggtttctatcttgagaatagcgctacacagagtactaactctggcatccagaatggacagtacaaggtcgaaaattacctcggatctagggaccacttcgctcttgaccgccctagcgagacacacgcagactacctcttgcgaaccggccaggttgtggacattagtgatacaatttacccccgcaaccctgccatgtactcagaggaggcgaggctgaagtccttccagaactggcctgactacgcacatctgacacccagagagctggcctctgccggcttgtattatactggcatcggcgaccaagtgcaatgcttctgctgtggcggcaaactgaaaaactgggagccatgcgaccgggcgtggtctgaacacaggagacactttccaaactgtttcttcgtgctgggcagaaacctgaacatccggtccgagtctgacgctgtttcttccgatcggaactttccaaactccacgaacctgcctcggaatccgtctatggccgactatgaagctcggatttttacattcgggacctggatttactccgtgaataaggagcagcttgcacgagcaggcttctacgcactgggcgaaggagacaaagtgaagtgcttccattgtgggggcggactgaccgattggaaaccaagtgaggatccatgggaacaacacgctaagtggtatcctggatgtaaatacctgctcgagcagaagggacaggaatacattaataatattcatctcacccactctctggaggaatgtctcgtgcgaacaactgagaaaactcccagcctgacaagacgtatagacgacaccatcttccagaaccccatggtgcaggaggcaatccggatgggattcagcttcaaggacataaaaaagataatggaagagaagatccagattagtggctctaactacaagagcctggaggtgctggtagctgatttagtcaacgctcaaaaagatagcatgcaggatgaatctagtcagacatctctgcagaaggaaatttctaccgaagagcagctccggcggttacaggaagagaagctctgcaaaatctgcatggaccggaacatcgcaattgtttttgtgccctgtgggcatttggtgacgtgcaaacaatgtgccgaggcagtggataaatgtcccatgtgctataccgtgatcacattcaagcagaagattttcatgagctag

SEQ ID NO: 18094 - DNA, 51 bp, Artificial Sequence
  Description of Artificial Sequence: Synthetic coding sequence
atgacctttaactcattcgagggctcaaaaacatgtgtgcctgctgattag

SEQ ID NO: 18095 - DNA, 471 bp, Artificial Sequence
  Description of Artificial Sequence: Synthetic coding sequence
atgacctttaactcctttgagggcagcaaaacttgcgttcctgctgatatcaataaagaagaggagttcgtggaggagttcaaccgtcttaaaacattcgcaaattttccaagcggtagccctgtgagcgcttccaccctagctcgggcagggttcctatatacaggcgaaggagataccgtccgctgtttctcctgtcacgcggcagtggaccgatggcaatacggggattccgccgttgggcgccatcggaaggtgtcgcctaactgccggttcattaacggattctacctggagaattccgcgacacagtctacgaacagcggcattcaaaatggccaatataaggttgaaaactacctcgggtctcgagaccatttcgccctcgatcggccatccgagacccacgctgattacttgttacgtacagggcaggtcgtagatatttctgataccatctatcctcggtag

SEQ ID NO: 18096 - DNA, 1494 bp, Artificial Sequence
  Description of Artificial Sequence: Synthetic coding sequence
atgacgttcaactcttttgagggcagcaaaacctgtgtgcctgcagacatcaacaaggaagaggagtttgtggaagagttcaaccggctgaagaccttcgcaaatttcccttccgggagcccggtgagcgccagcacactcgcccgcgcaggctttttatacacaggcgagggcgataccgtgcgctgctttagctgtcacgcagcagtggatcgttggcagtacggtgactcggccgtgggtcggcatcggaaggtgtcgccaaactgtcgttttattaatggcttctacctggagaattctgccactcaaagcaccaactcaggtatccagaatggacagtacaaggtggagaattacctgggaagcagagatcactttgctttggacagaccctcagaaacacacgctgactatctgcttcggaccggtcaggtggttgatattagcgacacgatctacccccgcaatcccgctatgtattctgaggaagcccgcctcaaatcattccaaaattggcccgactatgctcacctcacgcctagagaactcgcctctgccggactctattacactggcatcggagaccaggttcagtgtttttgctgcggcgggaagctaaaaaattgggaaccctgcgatcgggcctggagcgaacacaggaggcactttcctaattgcttcttcgtcctcggccgcaatctgaatatcaggagtgaaagtgatgcagttagctcagaccgcaactttccaaacagtactaatctcccacggaacccatcaatggcagattatgaagctcgcatcttcaccttcggaacatggatatactccgtcaacaaggaacagttagctcgcgctgggttctacgcactgggcgaaggcgacaaggttaaatgcttccactgcggcggaggcctgacggattggaagccgagcgaggatccatgggagcagcatgccaagtggtaccccggatgcaagtatctcctggagcagaagggccaggaatatattaacaatatacatcttactcattctctcgaagagtgcttggtgcggacaaccgagaagaccccatccctgaccagaaggattgacgacacaatctttcagaatcctatggtacaggaggccataaggatgggttttagctttaaagatatcaagaagattatggaagaaaaaatacagatctctggcagcaactataaatccttggaagtactggttgctgaccttgttaatgctcagaaagatagtatgcaagatgaatcttcccagaccagtctccagaaagagataagtactgaggaacagctgcggagattacaggaggagaaattgtgcaaaatctgcatggacagaaatatcgccatcgtattcgtgccttgtggacatctggtgacatgcaaacagtgtgccgaagccgttgataaatgtccaatgtgctatacagtcattacatttaagcagaagattttcatgagctag

SEQ ID NO: 18097 - DNA, 2568 bp, Artificial Sequence
  Description of Artificial Sequence: Synthetic coding sequence
atggtagtgatggctcggctctcacggcctgagagaccagatctggtctttgaagaagaggaccttccctacgaagaagaaattatgcggaaccaattttcggtcaagtgctggctcaggtacattgagttcaaacagggggcgcccaaaccccgactgaatcaactgtatgaacgggctctaaaattacttccatgcagctataaattgtggtatcgttatctcaaagcaagaagagcccaagtgaaacacagatgcgtgacagatcctgcctatgaggatgtgaataattgtcatgagcgagcctttgtatttatgcacaaaatgccacgtctgtggctagactattgccagttcctaatggatcagggccgcgtgacccacacccggagaacttttgatcgcgccttgcgagccttgcctattacccagcactcccgtatctggcccttgtacctcagatttctgcgctctcatcccctcccggagactgctgtgcgaggataccgccgttttctgaaattgagcccggaaagtgcggaggagtacatcgagtatctcaaatccagcgaccggctcgatgaagccgcacaacgcctggccaccgtggttaatgacgagagatttgtctccaaggcagggaaatctaattatcaactgtggcacgaactgtgcgacctgatcagccagaaccctgacaaggtgcagtccctaaatgtcgatgctatcattcgggggggcctgactagatttactgatcaactggggaaattatggtgcagcctggcggactactacatacgctccggacacttcgaaaaggcccgtgacgtgtacgaagaggcaattaggacagtcatgactgttagagacttcactcaggtgttcgatagctatgcacagtttgaagagtctatgatcgccgccaaaatggagactgcgtctgagctgggcagggaggaggaggatgatgtggatttggagctcaggctggcccggttcgagcagctgatatcacggagaccccttttactaaactctgtactcctccggcaaaatccccaccatgttcatgagtggcataagcgtgtggcccttcatcaagggcgacctcgcgagatcatcaacacctataccgaggctgtgcagaccgtggatcccttcaaggctacagggaaaccccacactctctgggtggcattcgctaagttttatgaggacaacgggcagctcgatgatgccagagtgatccttgaaaaggccaccaaagttaactttaagcaagtcgacgatctcgcgtccgtttggtgccaatgcggtgaattagagctgcgccatgagaattacgatgaggctctgcgtttgctccgcaaggcaaccgcattgccagcacgtagggctgaatattttgatgggtctgagccagtgcagaatcgcgtgtacaagtccctgaaggtgtggagtatgttggcagaccttgaagaatcgctgggcacctttcaaagcactaaggccgtatatgatagaatcctggatctcagaatagctaccccacagatagtgatcaattatgccatgttcctggaagagcacaaatatttcgaggaaagctttaaggcctatgaacgtggcatctcgctgttcaagtggcccaacgtgtcagatatctggtccacctatctgactaagtttatagcccgttatggggggagaaagctcgagcgtgcgcgggacttgttcgagcaagccctggatggctgcccaccgaaatacgctaagacactctatctgctctatgcacagctggaagaagaatgggggttggctcgacatgccatggcagtgtacgaaagagccacccgggcggtggaaccagcacagcagtatgacatgtttaacatatacataaagcgggctgctgagatctacggggtgacacatacaaggggcatttaccaaaaggcgattgaagttctgtccgatgagcatgctagagaaatgtgtctgcgctttgccgatatggaatgtaagcttggcgagatcgacagggcgcgagccatttactcgttctgtagccagatttgcgatccccggactaccggagccttctggcaaacctggaaggatttcgaggtccgccacggcaacgaagataccatcaaagagatgcttcggatacgtagatccgtccaggccacatataatacccaggttaattttatggcttcacaaatgcttaaggtgtccggtagcgctaccggaacagtgtcagatcttgctcctggacaatctggaatggacgacatgaagctactggagcaacgggctgaacagctggccgctgaggctgagcgggatcagcctctcagagcacagtctaagatcttgtttgtccggagcgatgcatctagggaagaactagctgagctcgcacaacaggttaacccagaagagatccagctgggagaggacgaagatgaggacgagatggatcttgaaccaaatgaagttaggttggaacagcagtctgtgcccgccgcagttttcggcagtctgaaagaggactag

SEQ ID NO: 18098 - DNA, 2559 bp, Artificial Sequence
  Description of Artificial Sequence: Synthetic coding sequence
atggccaggctttcgcggccagaacgcccggacttggtcttcgaagaagaagacctaccctacgaagaggaaatcatgcgaaatcagttctcagtgaagtgttggctccgttatatagaatttaaacagggtgcccctaaacctcgcttaaaccaactgtatgagcgagccctcaaacttctgccatgttcctacaagctatggtataggtacctgaaagccaggcgcgctcaagtgaagcacagatgtgtgacagatcctgcttacgaggacgtgaataattgtcatgagcgcgcgttcgtatttatgcacaaaatgcctcgactgtggctcgactactgccagttcttgatggatcagggtcgtgtcacgcatacccggcggaccttcgatagagcacttcgggccctaccgatcacccaacatagtaggatttggccactgtatctgaggtttttgcgctcacaccccctcccggaaaccgcagtacgaggataccgcagatttctgaagttgtctcccgagagcgccgaggaatacatcgaatatttgaagagttccgatagactagacgaagccgcccagagactggccacggttgtaaatgacgagcgcttcgtgtcaaaagctgggaagagtaactaccagttgtggcatgaactttgtgatttgatctctcagaaccccgataaggtccagagcctgaacgtcgacgctatcattagaggcggactgacaagatttacggatcagctgggcaagctgtggtgctcactggcggactattacatacgaagcggccacttcgagaaagcccgggacgtttacgaggaggccattcggacagttatgacagtgcgtgattttacacaggtgttcgactcctacgcccagtttgaggaatctatgatcgctgctaaaatggagaccgcgtccgagctggggcgcgaggaggaggacgacgttgacctcgagctgcggttggcgagatttgaacaattgatctcaaggcgcccactgttgctgaattccgtgctgttgcggcaaaatccccaccacgtacatgagtggcacaagagggtagctctgcaccaaggccgtcccagggaaattatcaatacgtacaccgaagccgtgcagacagtggacccgtttaaggctactggcaaaccacacacactgtgggtggcctttgctaagttctatgaagataatgggcaacttgatgatgcgcgggtcatactcgagaaggccacaaaagtaaattttaaacaggtggatgacctggcatccgtgtggtgccagtgcggtgagctggagttgcgacacgaaaattacgacgaggccctacggctgctgaggaaggccaccgcgctgccagccagacgtgcagaatatttcgatgggagtgaaccggtccagaatcgcgtctacaagagtctgaaagtctggagtatgctggccgacctggaagagtcattaggaacatttcagtcgacaaaagctgtctacgaccgaatcctcgacctccggatcgctaccccacagattgtgattaactacgcgatgtttctggaggaacacaaatactttgaggaatctttcaaggcatatgagcggggtatctccctatttaaatggcccaatgtgtcagatatatggtcaacttacctgacgaagtttattgcgcggtatggaggcagaaaactcgaacgggccagggatctcttcgagcaggccctcgacggttgtcccccaaaatacgcgaagacgctttacctgctatatgcccaactcgaagaggaatggggcctagcacgacatgcaatggctgtctacgagagagcaacccgggctgtagaaccagcccagcaatacgatatgtttaacatctacataaagagagcagcagaaatctacggggtgacacatacacgaggcatttaccagaaagccatcgaggtgcttagtgacgaacacgctagggaaatgtgtttaaggtttgccgatatggaatgtaaactgggggaaatcgatcgcgcccgcgccatttactccttctgcagccagatatgtgacccaagaactactggcgccttctggcaaacttggaaagatttcgaggtgagacacggcaacgaggacactattaaggaaatgttaagaatccggagaagcgtacaggctacatacaacacccaagtgaacttcatggcttcacaaatgttgaaagtgtcgggttcagcaacagggaccgtgtccgacctagcgccagggcaaagcgggatggacgatatgaagctgctggagcaacgtgccgagcagctagctgcagaagccgagagggaccaacctctccgtgcccagtctaaaatcctttttgtgcgatccgacgcctccagggaagagcttgccgaactggcccaacaagtgaacccggaggagattcagctgggggaggatgaggacgaagacgagatggatctggagcccaacgaggtcagattggagcagcagtcggttccagccgccgtgttcggttccttgaaggaggactag

SEQ ID NO: 18099 - DNA, 1902 bp, Artificial Sequence
  Description of Artificial Sequence: Synthetic coding sequence
atgcctgaaattcggctgaggcacgtggttagttgctcgtcccaagattcaacgcattgcgcggagaacctgctaaaagctgatacataccggaaatggagggcagccaaagctggagagaagactattagtgttgtcctccagcttgagaaagaagaacagatccattctgtggatattggtaacgatggctccgcctttgtggaagtgctggtcgggagctcagccggcggtgctggtgagcaggattacgaagtcctcttagtgacttccagctttatgtctccatccgagagcaggagtggttctaatcccaacagagtaaggatgttcggccctgacaaactggtgagggctgctgcggagaaacggtgggaccgggtaaaaatcgtgtgttcccaaccctattctaaggacagccctttcggactaagttttgtcagattccattcaccgcccgataaagacgaggcagaggctcccagtcaaaaagtgaccgtcaccaaattgggtcagttcagagttaaagaggaggatgagtccgccaattctctgaggcctggagcgctattcttttctaggatcaacaaaacttctccagtcacagcgtcagatccagcaggccctagttacgcggccgcgacactgcaggcatcttctgccgcctcctcagcatctccagtttcaagagcaatcgggtctacatctaagccccaggagagccccaagggcaaaagaaagctcgatctcaaccaagaggagaaaaagacccccagcaagccgcctgcccagcttagtccctccgtgcctaagcgcccaaaactccccgctcctacacgcacccccgcaacggcccctgtacccgcgagggcccagggggctgtcacaggcaaacctcggggtgaggggactgagccacggcggccccgcgctgggcccgaggaactcgggaagattcttcagggagtggttgtagtactgtcaggcttccagaacccttttagatccgagctgcgagataaggcattagagcttggcgccaagtataggcctgactggacaagagacagcacccaccttatttgcgccttcgctaacactccaaaatactcacaggtcctggggcttggcgggaggatcgtgaggaaggaatgggttctggactgccatcgtatgcgacgacgtttaccttcacaaaggtacctgatggccggacccggtagcagcagtgaggaggatgaagcttcccatagtggtgggagcggcgacgaggcccctaagctgccacagaaacaaccccagaccaagacaaagccaacccaagcagccggtccaagttccccacagaaaccgcctacgcccgaggagacaaaggcagctagcccggtcttgcaggaggatattgatattgagggggtacagtcagagggccaggacaatggcgccgaggatagcggggatactgaggacgaactgcggcgggtggcagaacaaaaagaacaccgactgccccctggtcaggaagaaaacggagaggatccatatgcaggtagcactgatgagaacactgattcggaggaacatcaagagcctccggacttgccagtgccggaactgcccgacttcttccagggaaagcacttctttttatatggtgagttccccggcgacgagcgacgcaagctgattcgctacgtgactgcgtttaacggcgaattggaggacaatatgtcagatcgcgtgcagttcgtgatcactgcccaagaatgggacccctctttcgaggaggccctgatggataaccctagccttgcattcgttaggcctcggtggatctattcatgtaatgagaaacagaaacttctaccacatcaactatatggggtcgtcccccaggcctag

SEQ ID NO: 18100 - DNA, 1944 bp, Artificial Sequence
  Description of Artificial Sequence: Synthetic coding sequence
agcacttcaagcttttggccgggcgaagcgcacgatgtagacatgcccgaaatcaggctcagacacgtggttagttgctccagtcaggacagtacccattgcgcagagaaccttctcaaagccgacacctataggaagtggagagccgcaaaggccggagaaaaaacgatctccgtcgtcttgcagcttgagaaggaggaacagatacacagcgtcgacatcgggaatgatgggagcgcctttgtggaggttctggtgggtagttctgctggaggtgccggggagcaggactatgaagtgcttcttgtgacctcaagtttcatgtctccttccgagtcaaggtcgggatcaaaccctaacagggtacggatgttcgggcctgacaaactggttcgtgcagccgcggaaaagagatgggacagggtgaaaattgtctgtagccagccatactctaaggatagtccatttggtttaagctttgttagatttcatagccctcctgacaaggacgaagctgaagccccatctcagaaagtaaccgtgacaaagctgggtcagtttagggttaaggaagaagatgagtctgctaacagtttgaggcccggggctctatttttctcacggatcaacaagacgtcgccagttacggcgtctgaccccgctggccctagctatgccgccgccaccttacaggcctctagcgcagccagctctgcctcaccggtgtctcgtgcaataggctctacctccaaaccccaggaatcccccaagggaaaacggaagcttgatctcaaccaagaggaaaagaagaccccgtctaagccaccggcccaattatccccatctgttcctaaacgtccaaaactgccagcgcccacccgtactcccgcaacagcccctgtgcctgcacgtgcccagggcgctgtcaccgggaagccgcgaggcgaggggacagaaccaagaaggcctcgcgcaggccccgaggaattggggaaaattctgcagggcgtggtggtcgtcctcagtggctttcagaacccctttagatccgaattacgtgataaagcacttgagctaggagcgaaataccgaccagactggaccagagatagcactcacctaatatgcgccttcgccaatactccaaaatactcccaggtgctcggcctaggcggcaggatagtccgaaaagaatgggtgcttgattgtcaccggatgagacggcgactcccaagtcaacgctacctgatggcgggcccaggtagctcatccgaggaagacgaagcttcacattccggggggagcggggacgaagccccaaaacttccacagaaacagccacaaactaaaaccaaacctacccaggctgccggccccagctccccgcagaagcctccgacccccgaggaaactaaggctgccagcccagtccttcaggaagatatcgacatagagggcgtgcagagtgaaggtcaggacaacggggcagaggactctggtgatacagaagacgagctgaggagggtggctgagcagaaagagcataggttaccacccgggcaagaagaaaatggcgaggatccatatgctggaagtacagatgaaaacaccgatagtgaagaacatcaggaacctccagatctccccgttcctgaactcccggatttttttcagggcaaacatttctttttgtacggcgagtttcctggcgacgagcgacgtaaactgattaggtatgtgacagcattcaatggggagttggaggacaacatgagtgaccgcgtccaattcgttatcacagcacaggagtgggatccttccttcgaggaggcgttgatggataatccctccctcgcgttcgtgaggccgcgttggatttacagctgtaacgaaaagcagaaactgctcccccaccagctctacggagtggtcccccaggcgtag

SEQ ID NO: 18101 - DNA, 1203 bp, Artificial Sequence
  Description of Artificial Sequence: Synthetic coding sequence
atgccggagattcgcctacgccatgtcgttagttgctcatctcaggactccacccattgtgctgaaaacttacttaaggcagacacgtacaggaagtggagggctgcaaaggcaggagagaaaacaatctcagtcgtactgcagctcgagaaagaggagcagatccactcagtggatataggaaacgacggctcagctttcgtggaagtcctggtagggtcgtccgccggaggggccggggagcaggattatgaagtattattggtaacttcatcgtttatgagcccatcggagagccggagcggatctaatcccaaccgggtgagaatgttcggacctgacaagctcgtcagagcagccgccgaaaagcgatgggatagggttaaaatagtttgttcacaaccatactccaaagacagccccttcgggctgtccttcgtgcggtttcatagtcccccggataaggacgaagccgaagccccaagccaaaaggtgaccgtaaccaaattgggacaattccgcgtcaaggaagaagacgaaagcgccaattctctgcgtcctggtgctctttttttctcccggattaacaaaacttccccagttacggccagtgaccctgctggaccaagctacgctgctgccacactccaggcctcttctgcagcctcaagcgctagccccgtgtccagggctatcggctctacatctaaaccgcaggagtctcccaagggtaagaggaagctggacctcaatcaagaagagaaaaagactccctccaaacctcccgcgcagctgagtccctccgtgcccaagaggcccaagctgccagcccccactagaactccagctacagcacccgtccccgcccgtgcccaaggcgcggttactggaaagccgcgcggcgaggggactgaaccacgtcgaccccgggctgggcccgaagagctgggaaaaattctgcagggggttgttgttgtgctctcagggtttcagaatccttttcgaagcgaactcagggataaggctctggaactgggcgcaaagtatcggccagactggacgcgagactcaactcacctgatttgcgcatttgctaatacccctaaactcccgcaaaaggtgcccccacaacacacgccagaccagaatcaggcacactcaggctcctggacacagctaacacccgaggctcctaatccgtag

SEQ ID NO: 18102 - DNA, 1809 bp, Artificial Sequence
  Description of Artificial Sequence: Synthetic coding sequence
atgcctgagattaggctccgccacgtggtgtcgtgttcgagccaagacagcctggagaaagaagaacagatccattcagtagacatcgggaacgatggtagcgctttcgtggaggtcctcgtcggaagcagtgcaggcggagcgggcgaacaggactatgaggtcttgctcgtgacttcgagctttatgtcaccctctgagtccaggtctggcagcaatccaaatagggtccggatgtttggaccagacaagctggtacgcgcagcggctgagaaacggtgggaccgagtaaagatcgtgtgttctcagccctatagtaaagattctcctttcggactgtccttcgtccgctttcattcgccacccgacaaagacgaggctgaggctcccagccagaaagtcacagtgaccaagcttggacagtttagagtgaaggaagaggacgagagcgccaattcactaagacctggcgctctgttctttagtcgaataaataagacttctcccgtaactgccagtgacccagccggaccatcttatgccgccgctacactgcaggccagttctgcagcctcttccgcatcccccgtatctcgcgctataggcagcactagtaagccccaagaaagtccgaaaggaaagcgcaagctcgacttaaatcaggaagaaaaaaagacaccctctaagcccccagcccaattatccccatctgtgcctaagcggcctaaattaccggctcccacgcgcacgccggcaaccgcacccgtccccgcacgcgctcagggtgcagtgactgggaagccccgtggcgagggaactgagccgaggcgcccgagagcaggccctgaagagctcggcaagatcctgcagggggtggtggtggtcctctctggttttcagaacccttttagaagtgagctgagggataaggcactggagttgggcgccaaatataggcccgactggactcgtgacagcacccacctgatctgcgcctttgccaacaccccaaagtacagtcaagttttgggtctcggcgggagaattgtgcggaaagagtgggtcctcgactgccataggatgcgacgtcgacttccgtcacagcgctatctaatggccggcccaggcagctccagcgaggaggacgaagcctcccacagcggcggcagcggggacgaggccccaaagttgccacagaagcagcctcaaaccaaaactaagcctactcaggccgccggccccagcagtccacagaagcctcctacgccagaagagacaaaggcagcttcccccgtccttcaggaggatatagacattgaaggcgttcagagcgagggccaggacaacggcgccgaagatagcggcgatacagaggatgagctccggagggtcgccgagcagaaagagcatcggctaccccccggccaggaagagaatggagaggatccttatgccggttcaactgacgaaaacactgatagtgaggaacaccaggagcctccggatctccctgttccggagctcccagacttcttccagggtaagcacttctttctatacggcgagtttcccggggacgagcgccgcaagctcataagatacgttacagctttcaacggcgagcttgaggacaacatgtccgaccgtgtccaatttgtaattactgcccaggagtgggacccctcttttgaggaagctctcatggataacccctcacttgcctttgtgcggcctcgctggatttattcgtgcaatgagaagcagaaactgctgccacatcagttgtacggtgtcgtcccacaggcatag

SEQ ID NO: 18103 - DNA, 843 bp, Artificial Sequence
  Description of Artificial Sequence: Synthetic coding sequence
atgtgttctgcctttcatcgcgccgagagtgggaccgagcttctggctcgcctcgaggggcgaagctctctcaaagagatcgaacctaatctgtttgccgacgaggacagccccgtacacggcgatatcctcgagttccatgggcctgaaggcaccggcaaaactgaaatgctctaccatcttaccgcccgctgtatcctgcctaagagcgagggtggactcgaggtcgaggtcctgtttatcgacaccgactaccactttgacatgttacgattggtgactatcctggaacatcgcttgagtcagtcgagtgaggaaatcattaagtattgcctggggcgcttctttttagtctattgttcctcttcaactcacctgttgctgacactctattccctggaaagcatgttctgcagccacccgtctctctgtctcctgatcctcgactctttatcagccttctactggattgatagggtcaacggcggcgagagcgtgaacctccaggagagtacgttaagaaagtgctctcagtgtctcgagaaattggtgaatgactatcgtctggtgctatttgcaactacgcagactatcatgcagaaggcatctagttcctctgaggagccttcacacgctagtcgacgattgtgcgatgttgatatagattatcgaccatatttgtgcaaggcttggcagcagttggtgaagcacagaatgtttttctctaaacaggatgactcacaatccagcaatcagtttagtctggtgtcgaggtgtttgaaaagtaactccctcaagaaacattttttcataatcggcgagtcgggtgtagagttctgctag

SEQ ID NO: 18104 - DNA, 1041 bp, Artificial Sequence
  Description of Artificial Sequence: Synthetic coding sequence
atggaccttgaccttctggatctaaacccacgaattatagctgccatcaagaaagcgaaattgaaaagcgtgaaggaggtgctccacttctctggaccagatctgaagcgccttaccaatctgtcctctccagaagtgtggcatctgcttcgcaccgcctcactgcacctgcgcggcagctctattttaaccgcccttcaactgcaccagcaaaaagaaagatttcctacccaacaccagaggctttctctgggctgtccggtcctggacgccctgctccgcggagggctgcctctggacggaatcaccgagctcgctggacgcagttcagccggcaagacccagctcgcgttgcagctctgccttgccgttcagtttcctcgccagcacggaggtctcgaggcaggcgctgtgtatatttgcactgaggacgcctttccccataagagactgcagcagctgatggcacaacagcctaggttgaggacagacgtgcccggcgagctactgcagaagctccgcttcggaagtcagatttttatcgagcacgttgctgacgtggatacactgcttgaatgcgtcaacaagaaggtccctgtgctgctgtcccggggaatggcacgactcgtggttattgattccgtggctgcccctttcaggtgtgaattcgatagtcaggcatccgcccctcgggcacggcacctacagagtttaggagcgacactgcgggagctgtcttccgctttccaatccccagttctctgtattaaccaggtgactgaggccatggaggaacagggagctgcccacggtcctttgggcttttgggacgaacgcgtgtcccccgcccttgggataacgtgggctaaccaactgctggtcaggctcttggccgaccggttgcgcgaagaagaggcggccctgggctgcccggccagaacgttacgcgtgctctctgcccctcatctgccaccaagctcgtgctcctatactattagcgcggaaggcgtgaggggtaccccggggacccagtcacactag

SEQ ID NO: 18105 - DNA, 1041 bp, Artificial Sequence
  Description of Artificial Sequence: Synthetic coding sequence
atggacctcgatcttctggatttgaatccaaggatcatcgccgctataaagaaggccaaacttaaaagcgtaaaagaggttttgcacttttcaggtccggatctaaagaggctgaccaacttgtcgagtcctgaggtatggcacctccttagaacagcctctttacatctgcgggggtcatcaatcctgactgcactccaactgcatcagcagaaggagaggtttccaacccagcatcaaaggctctccctgggctgccctgtcttggacgccctcttgcgcggtggtctccctctcgatggcataacggagctggccgggcggtcgagcgccggcaaaacccagttagcactgcagttgtgtctggccgttcagttccccaggcagcacggggggctggaagcaggcgccgtatacatctgtaccgaggacgcgttccctcacaaacgcctgcagcaactgatggctcagcagcccagacttcggactgacgtacctggcgaattgctacaaaaacttaggttcggtagccaaatttttattgaacacgtggccgacgtggataccttactggaatgtgtcaataaaaaagtgcctgtgctcttgagcaggggaatggcaagactggtggtgatagactccgtggctgcccccttcagatgtgaattcgatagtcaggcttctgccccccgcgctcgacacttgcaatctttgggggctaccttacgggagctctcctcagctttccagagcccagttctgtgcataaaccaggttactgaggctatggaagagcagggcgctgcccacgggccgctggggttttgggacgagagggtcagtcctgcactaggcattacttgggccaatcagctccttgtacgcctactggcagataggctgagggaggaagaagctgcacttggctgtccagctcgcaccctcagagtgctgtcagcacctcacctgcctccatcgtcatgctcctacactatttcagctgagggggtaaggggcaccccgggcactcagtcgcattag

SEQ ID NO: 18106 - DNA, 1041 bp, Artificial Sequence
  Description of Artificial Sequence: Synthetic coding sequence
atggatctggatctcctcgacctgaaccctaggattatcgccgctatcaaaaaagctaagctgaagtccgtcaaggaggttctccacttttctggcccagatctgaagcggctgacgaatctgtccagccccgaggtgtggcatttacttcgcactgcgtccctgcacctccgcggcagctcgattctcaccgcgttgcagctccaccagcaaaaggaaaggttccccactcaacaccaacggctgtctctgggctgtcccgtactggatgccctgcttcggggcgggctccccctcgacggaatcactgagctagcagggagaagctctgctggcaagacccaactggccctgcagctatgtctcgcggtgcagtttccaaggcaacatggggggttggaagctggagctgtctatatttgtacggaggacgcctttccccataaacgactccagcaactaatggcccaacagccgcgactgcgtaccgatgttccgggggaattactgcagaagctccgatttgggagccaaatatttatagagcatgtggccgacgttgacactctcctcgagtgtgttaacaagaaggttcccgttctgcttagcagaggaatggcgcggttggttgtcatcgactctgtcgccgctccttttagatgcgaattcgattcacaggcatcagcaccacgcgccagacacctacaaagccttggcgccaccctaagggaactctcctcagcattccagagccccgtgctgtgtatcaatcaggtgaccgaggccatggaggagcagggcgccgcccatgggccactgggattttgggacgaaagggtttcccccgcacttggtattacctgggcgaatcagctgctggtgcgcctgcttgcggaccggctacgcgaagaggaggccgccctgggctgtcctgcgagaacgttgcgggtactaagcgctcctcacctgccgcccagctcatgctcatataccatcagtgcagagggcgtccgtggcacaccaggaacacaaagccactag

SEQ ID NO: 18107 - DNA, 144 bp, Artificial Sequence
  Description of Artificial Sequence: Synthetic coding sequence
atggacctcgatctcctagatctcaacccacggattatcgcagccatcaaaaaggctaagctaaaaagcgtgaaagaagtcctccatttttcagggccggacctcaagcgcctcacaaacttgtcctcccccgaagtctggtag

SEQ ID NO: 18108 - DNA, 138 bp, Artificial Sequence
  Description of Artificial Sequence: Synthetic coding sequence
atggacctggacttgctagatctgaaccctagaattatcgctgccatcaagaaagctaagctgaagtcggtgaaagaagtgctccacttttctggccccgatctcaagagacttacaaacttgtcctctcctgagtag

SEQ ID NO: 18109 - DNA, 1041 bp, Artificial Sequence
  Description of Artificial Sequence: Synthetic coding sequence
atggacctggacctgctcgatcttaacccaagaataatcgctgccatcaagaaggccaagctgaaaagcgtgaaagaggtgttgcatttctctggacctgaccttaagagattgaccaatctctcatctcctgaggtctggcacttgttacgtactgcctctctgcatttgagaggcagctccatcttaaccgcgctgcagttgcatcaacagaaggaacggtttcccacccagcaccagaggctctccctggggtgtcccgtacttgacgccctgctcaggggaggactcccactggacggcattactgagttggcaggtaggtcgagcgctggcaaaacccagcttgctcttcagctgtgtctggcggtgcaattcccacgccagcatggaggcctggaagccggcgccgtgtatatttgtaccgaggacgcgtttccccataaaaggttacagcaactgatggcacaacagcctcgtctgcgaaccgacgtgccgggagaactactacagaaacttcgcttcgggagtcaaatctttattgaacacgtggccgacgtggataccttattggaatgcgtgaacaagaaagtccctgtcctgctcagcaggggtatggcccgcctggtggtcatcgatagtgtggcagctccgttcaggtgtgagttcgactctcaggcatctgcacctcgtgcccggcatcttcaatctctgggggcaaccttgcgtgagctcagttcggcatttcagtcgcccgttctgtgcatcaaccaggtgaccgaggcaatggaagagcagggagccgctcacggacctctggggttttgggacgaaagagtgtcccctgccctgggaattacatgggctaatcagctgctggtcaggcttctggccgaccgactgagggaggaggaggccgctctgggctgcccagcgcgcaccctccgggtgttgtcggcacctcaccttcccccgtcttcttgctcctacacaattagcgccgagggagtgcggggcacccccggaacgcagtcacattag

SEQ ID NO: 18110 - DNA, 1041 bp, Artificial Sequence
  Description of Artificial Sequence: Synthetic coding sequence
atggatttggacttgctggacctgaatccccgcatcatcgcagccatcaagaaggccaagctgaagtctgtaaaagaagtcctgcacttctcaggtcccgacctgaagcggctgactaatctctcgagtcccgaggtgtggcatctccttcgcacagcttctctgcaccttcgaggttcatccatcctaacagccctgcagctgcatcagcagaaggagcgttttcccacacagcaccagaggctgtccctgggctgcccagtgttagatgcgttgctgagaggcgggcttcccctggacgggattactgagttagctggacgatcctcagccgggaagacccaacttgccctgcaactgtgcctggcagtgcaattcccccggcagcacggaggtctagaggccggcgccgtttacatttgtacagaagatgcattcccccacaagagactacaacaattaatggcccaacagcccagattgaggacggacgtgccaggtgagctcctgcagaagctgcgcttcggatcacagatatttatagaacatgtcgcggacgtcgacacactgctggagtgtgttaataaaaaagtcccagtgcttctgtcacgtggtatggccagactggttgttattgactctgtggccgcaccatttcgttgtgagtttgactcgcaggccagcgccccccgtgcccgccatctgcagtccctgggggctaccctaagggaactctcctctgccttccagagccccgttctatgtatcaatcaggtaacagaggcgatggaagaacagggagcggcccacggccctcttggattctgggatgaacgggtgagtccagcgctcgggatcacttgggcaaaccaacttttggtacggctgctcgctgacagacttagagaggaagaggcagcgctgggctgtcccgcccgtactttgcgcgtcttgtccgccccacatctacctccatcctcctgtagttacactatctcggctgagggtgtaaggggtacccccgggacccagtcacattag

SEQ ID NO: 18111 - DNA, 309 bp, Artificial Sequence
  Description of Artificial Sequence: Synthetic coding sequence
atggatttggacctccttgatctaaatccccgcattattgccgctataaaaaaggcgaaattgaagtcagtcaaggaggtacttcatttttctggacccgacctcaaaagacttacgaacctctcctctccagaggtgtggcatctcctgaggaccgcgtctctacacctgcgtgggagcagcatactgaccgccctgcaactgcaccagcagaaggagcgatttcctacacaacaccagaggcttagcttggggtgtcccgttcttgacgccttattgcgcgggggcttgccgctggacgggatctag

SEQ ID NO: 18112 - DNA, 186 bp, Artificial Sequence
  Description of Artificial Sequence: Synthetic coding sequence
atggatctagacctgctggacttgaatccacggattatagctgccataaagaaggctaagctgaaatccgtgaaggaggtgctccatttttcagggccagacctgaagcgactaactaacctttcatcgcctgaggtgtggcacctcttacgaactgcttccctacacttaaggggatcttcttag

SEQ ID NO: 18113 - DNA, 339 bp, Artificial Sequence
  Description of Artificial Sequence: Synthetic coding sequence
atggatctagaccttcttgaccttaacccaagaatcatagctgcaatcaagaaggccaaactgaagagtgtaaaagaagtgctccacttctctggcccagacctgaagaggctcacaaatctttctagccctgaggtatggcacttactgaggaccgcctccctgcacttgagggggagctccattttgactgcccttcagctgcaccagcagaaggaacgcttccccacccagcaccagcgactatcgctggggtgcccagtgcttgacgctctattgaggggaggcctcccactggacggtataacagagcttgcgggccgatcctcagctggatag

SEQ ID NO: 18114 - DNA, 1005 bp, Artificial Sequence
  Description of Artificial Sequence: Synthetic coding sequence
atggagcggaagatctccagaatacacctcgttagcgaaccatcaattacccatttcttacaagtgtcctgggagaagaccctggagtctgggttcgtcatcacactcacagatgggcactctgcctggactggtacagtgagcgaatccgaaatcagtcaggaggctgatgacatggctatggaaaagggaaagtacgttggggagctgcgaaaagctctgctgagtggcgcaggtccagccgatgtgtacacgttcaatttttctaaggaaagctgctatttcttctttgaaaagaacttaaaggatgtttcttttcgccttggcagtttcaacctggagaaggttgagaaccccgctgaagtgatccgcgagctcatttgctactgccttgacacaatcgctgagaatcaagccaagaacgaacacctccagaaggagaatgaaaggttgctgagggactggaatgacgtacaggggagatttgaaaagtgcgtcagtgctaaggaagcgttggaaaccgatctgtacaaacgatttattttggtgcttaacgagaagaagaccaaaatccgaagcctccacaataaactcctgaacgccgcccaagaaagagaaaaagacattaagcaggagggagagaccgctatttgttctgagatgacggccgaccgggaccccgtgtacgacgaaagcacggacgaagagtcagagaatcagactgatctatccggcctcgctagcgccgcagtgagcaaggatgatagcatcatcagcagtctggacgtcaccgacatagccccaagtagaaaaagacgacaaaggatgcagcggaaccttggaaccgaacccaagatggctccccaagagaatcagctccaagagaaagagaaaccagactcgtcattacccgaaacatcaaagaaagagcatatatcagcagaaaacatgagccttgaaactctgagaaacagtagccctgaggatctgtttgatgagatttag

SEQ ID NO: 18115 - DNA, 1011 bp, Artificial Sequence
  Description of Artificial Sequence: Synthetic coding sequence
atggagagaaagatcagcagaatacatctggtgtccgagccaagcattactcatttccttcaggtaagctgggagaaaacgctggaatcagggtttgtgattactctgaccgatggccacagcgcctggaccggcaccgtttcggagtccgagatctctcaggaagcggacgacatggcaatggagaaaggcaagtacgtcggtgagttgagaaaagccctcttgtctggagccggccccgccgatgtgtatacgtttaacttttcaaaagagtcgtgctattttttcttcgagaaaaacttgaaagatgtgtcctttaggcttgggtcatttaatctggagaaggtggagaatccagcagaagtgatacgcgaacttatctgttattgcctcgatactatcgccgagaaccaggccaagaacgaacacctacagaaagaaaatgagagattattgcgcgattggaacgacgtacagggacgatttgaaaaatgcgtcagtgcaaaagaggccttggaaaccgatctctacaaacgattcattctcgtcctgaatgagaagaagacaaagattaggtctttgcacaacaaactcctaaatgccgcacaggaacgcgaaaaagatatcaaacaggagggcgagaccgcaatctgttcagaaatgactgcggatcgggaccctgtgtatgatgagtcaactgacgaggaatcagaaaatcagacagatctaagcggactggccagtgccgcggtcagcaaagatgactctataattagctctttggatgttaccgatatcgctccatccagaaaacgtcgccagcggatgcaacgcaatctggggacagagcctaagatggcccctcaggagaatcaactccaagagaaggaaaattctaggcctgactcgagcctgccagagacctcaaagaaagaacacatctcggccgagaacatgagtctcgagactttaagaaacagtagtcctgaggatctgttcgacgaaatctag

SEQ ID NO: 18116 - DNA, 1005 bp, Artificial Sequence
  Description of Artificial Sequence: Synthetic coding sequence
atggaacgcaagatcagccgaattcacctggttagcgagcctagcataacccacttcctgcaggtctcttgggagaagactctagaaagtgggttcgtgataacgctgaccgatggccatagcgcgtggacaggtacggtgtcagagagcgagatctcacaggaggccgacgatatggcgatggagaaaggcaaatatgtgggagagctgagaaaggccctgttgagtggagctggccctgccgatgtctacacattcaatttctccaaggagtcctgttacttcttctttgaaaagaacttgaaagacgtctcttttaggctgggctccttcaatctcgaaaaagtggagaacccagctgaggtcattagagaattaatctgttactgtctggacaccattgctgagaaccaggccaaaaatgagcatctgcagaaggagaatgaacgcctgctgagagattggaacgacgtgcagggaagatttgagaagtgcgtgagtgcgaaggaagccttggaaacagatctctacaaacgcttcatcctggttctgaatgagaagaagaccaagatccgaagtttgcataataagctcttgaacgccgctcaagagcgggagaaggacattaaacaggaaggggagacggccatatgttcggagatgaccgctgaccgcgatccagtgtacgacgagtcaacggatgaagagtctgagaatcagacagatctaagtggcttggcctccgcagctgtctccaaggatgattcgatcatttccagcctggatgtaacggatattgccccctcccggaagagacgacagcggatgcagaggaacctcggtacggaaccaaaaatggcccctcaagagaaccagttacaagaaaaagaaaagcccgacagcagtcttcccgagacctccaaaaaggaacatatttcagcagagaatatgtcgctggagacgcttagaaacagttcacccgaggatttattcgatgaaatatag

SEQ ID NO: 18117 - DNA, 1011 bp, Artificial Sequence
  Description of Artificial Sequence: Synthetic coding sequence
atggaacggaaaattagtcgcatccacttagtgagtgagcccagcataactcactttttgcaggtgtcttgggagaaaacattagagtccggatttgtgattacactaaccgacgggcactccgcctggactgggacggtctcagagtcggagatcagtcaagaagccgacgacatggctatggagaaaggcaagtatgttggcgaattaagaaaggctctgctgagcggcgccggaccagccgacgtctatactttcaacttctccaaggaatcgtgctatttcttcttcgaaaagaatctcaaagacgtaagcttccggctgggcagtttcaacctcgagaaggtagagaaccccgctgaggtgattagggagctgatttgctactgtcttgataccattgcagagaatcaggcaaagaatgaacacctgcagaaagagaacgagcgacttcttagagactggaacgatgtgcagggccggttcgaaaagtgcgtctccgcaaaggaagcactggaaactgatctctacaagcgtttcattttggtgttaaacgaaaaaaaaactaaaattaggtcactgcacaacaagcttctcaatgctgcccaggaaagagagaaggatattaagcaggagggagaaacagcaatctgctccgaaatgaccgccgacagagaccctgtttacgatgaatctaccgacgaagagtccgagaatcagacagatttatctgggctggccagtgcggcagtgtcgaaggatgattctataatttctagcctggatgtgactgacattgctccgtcacggaagagacgacagcggatgcagcgtaacttggggaccgagcctaagatggccccacaagagaaccagctacaagagaaggagaactccagacccgacagctccctgccggaaaccagcaagaaggaacacatctcggcggaaaatatgtcacttgaaacattacgtaattcctccccggaggatttatttgatgaaatatag

SEQ ID NO: 18118 - DNA, 186 bp, Artificial Sequence
  Description of Artificial Sequence: Synthetic coding sequence
atgcagcggaacttgggaacagagcccaagatggccccacaggagaatcagcttcaggagaaggaaaactcacggcccgactccagccttcccgagactagcaaaaaagaacacatttccgcagagaacatgagcctagagacgctgaggaatagctcgcctgaggacctgttcgtgtctatttag

SEQ ID NO: 18119 - DNA, 2199 bp, Artificial Sequence
  Description of Artificial Sequence: Synthetic coding sequence
atggtgaggagcggcaataaagctgcagtggttctctgcatggatgtgggatttaccatgtccaactcaatccccggaattgagtcccctttcgagcaagccaagaaggtcatcactatgtttgtccaaagacaagttttcgccgagaataaagacgagattgccttagtgttgttcggaacagatggaactgataatccactctccggcggcgaccagtaccagaatatcacggttcatagacatcttatgctgccagactttgatctgctggaagatatcgagagcaagatacaaccgggctcccaacaagctgattttctggatgcactaatcgtgagcatggatgtgattcagcatgagaccatcggtaaaaaattcgagaagcgacacatcgagatttttacagacttaagctcgcggttctcaaagtctcagctggacattataattcacagcctcaaaaaatgcgatatcagcctccagttttttctacccttcagtctggggaaggaagacgggtcaggcgacaggggggatggtccattccgactgggaggacatggaccttccttccccttgaagggcatcacagagcagcagaaggagggcctggagatagtgaaaatggtcatgatctcactggagggcgaagacggactggatgaaatttattctttcagtgaatcattgaggaagctgtgcgtgtttaagaagattgaaagacactccatccattggccgtgtcgtttgacaattggcagtaatcttagtatcaggattgccgcatataagtctattttacaggaacgcgtgaaaaaaacttggactgttgtcgacgcgaagactctgaagaaagaggatatacagaaggaaacagtgtactgcttaaatgacgatgacgagacagaagtcctcaaagaagacatcatccagggatttcggtatggcagcgatattgttccttttagcaaggtggatgaggaacagatgaagtacaagagtgagggcaaatgcttctccgtcctcggcttctgcaagtctagccaagttcagagacgattctttatggggaaccaagtcctgaaagtcttcgccgccagagacgacgaggcagcagcagtggccctgtcttcactgattcatgccctggacgatcttgatatggtagcaatcgtacgctacgcttacgacaagagagcgaatcctcaggtgggggtggcatttccacacattaagcacaactacgagtgcctggtgtacgtccaactaccgtttatggaggacctgcgccagtacatgttctcctctctgaagaactccaaaaagtacgccccgactgaggcccagctgaacgcagtggatgcactgatcgacagtatgagtctggctaaaaaagacgagaagaccgatacacttgaagaccttttccccacaacaaaaatacctaacccgaggttccagcggctcttccagtgcttgcttcatcgagcgctgcacccaagggagccattaccgcctattcagcagcacatctggaatatgctaaaccctccagctgaggtcactaccaaatctcagattcccctgtcaaaaattaagaccctatttccattgattgaagccaaaaagaaggaccaagtgaccgcacaggagatttttcaagacaaccatgaagacgggcctacagccaagaaactaaaaacagagcaagggggtgcccacttctccgtatcgtcattggctgaagggtcggtgactagcgtgggcagcgttaatcccgctgagaactttcgggttctcgtcaagcaaaaaaaagcatccttcgaggaggcatccaatcagttgatcaatcacattgagcagttcttggatacaaatgagacaccatactttatgaaatccatagactgtattcgggcattccgcgaggaggccataaagtttagcgaagaacagcggttcaacaattttctgaaggccctgcaagaaaaggttgagattaagcagctgaatcatttctgggaaatcgtcgtccaggacggaattacactcatcaccaaggaagaggcctccggttcaagcgtgactgctgaggaggctaaaaagtttctggctccaaaggacaagcccagtggggatacagcagctgtctttgaagaagggggtgacgttgacgacctccttgacatgatctag

SEQ ID NO: 18120 - DNA, 2199 bp, Artificial Sequence
  Description of Artificial Sequence: Synthetic coding sequence
atggttaggtctggcaataaagcagccgtggtcctgtgcatggacgttgggtttaccatgagtaactccattccaggtatcgagtccccctttgaacaggctaagaaggtgataactatgttcgtgcaaaggcaggtgtttgcagaaaataaggacgaaatcgcactcgtcctgttcggcacagatggtacagacaatcccctttctggcggagaccaataccagaacatcaccgtccacagacatttgatgctgcccgacttcgatcttcttgaggatatcgaaagtaagatccaacccgggagccagcaggcggactttctggatgcactaatcgtgagtatggatgtcatacagcacgagacaattggtaaaaagtttgaaaagaggcacatagagatcttcacagacttgagtagccgcttctcaaagtcacagctggatatcatcatccacagcctgaagaagtgcgatatcagcctacagttttttctccccttttctctcgggaaggaagacggctcgggggatcgcggagacgggccctttcggcttggcggtcatgggccctcttttcctctaaagggtattacagagcagcagaaagaaggcctggaaatcgtgaaaatggttatgatcagcctggagggtgaagacggcttggacgaaatctatagtttctccgagtccctgcggaaactgtgcgtattcaaaaagatagagcgacacagcattcactggccttgccggctgaccatcggaagcaatctctccattcggattgcagcctataagtctattttgcaggaacgcgtcaagaagacatggactgtggtagatgccaagacactgaagaaggaagacatccagaaggagacagtctactgcttgaacgatgacgacgaaacagaggtgctgaaggaagacatcattcagggatttaggtacggtagcgacatagtccctttctctaaagtagatgaagagcagatgaagtacaaaagtgagggcaagtgctttagtgtactcggattttgcaaatcgtctcaggtgcagcgccgattctttatggggaatcaggtgctcaaggtgttcgcagctagggacgacgaagccgccgccgtcgccctgtcatccctcatccacgcacttgacgacctcgatatggtagccatcgtgaggtatgcttacgacaaacgagctaaccctcaggtaggggtggcctttccgcacataaagcacaactatgagtgtctcgtttacgtccagttgccatttatggaagacctgaggcaatatatgttctccagcctgaagaattcaaagaaatatgctccaactgaggcccagcttaatgctgtagacgcgcttattgacagtatgtcactggccaagaaggacgagaaaacagatacgctcgaggacttattccctaccaccaagatcccgaacccaagatttcaacgactattccagtgtctgctccatagagcacttcaccctcgcgaaccacttcccccgatccagcaacacatctggaatatgctcaatccaccggcagaagtgacgaccaagtctcagatccccctcagcaagataaaaactttatttccactgattgaagccaaaaaaaaagaccaggtcacagcacaagaaatttttcaggacaatcacgaggacgggcctaccgctaagaaactgaagacagagcagggaggggcccactttagtgtgagcagcttagctgagggatctgtcactagcgtgggatctgtgaaccctgccgagaatttccgcgtgttggtgaagcagaagaaagcatcctttgaggaagccagcaaccagctgattaaccacatagaacagtttttggacacaaacgaaaccccatacttcatgaaatctatcgactgtattagagcattccgggaggaagccataaaattttccgaagagcagcggtttaataattttctgaaggctcttcaggaaaaggtagaaattaaacaactgaatcatttttgggagatcgtggtgcaggacggcattaccctgataaccaaagaagaagcgagtgggtctagtgtaacagcggaggaagctaagaagttcctggctcctaaagataaaccctccggggacacggccgccgtgttcgaagagggcggcgacgttgatgatcttctggatatgatatag

SEQ ID NO: 18121 - DNA, 1830 bp, Artificial Sequence
  Description of Artificial Sequence: Synthetic coding sequence
atgtcaggttgggaatcctattataagactgaaggggatgaggaggccgaggaggaacaggaagagaatctggaagccagcggagactacaaatattcaggtcgagactcattaattttcctggtggacgcttctaaggccatgtttgagagccagtcagaggatgagctgactccctttgacatgtcaattcaatgtattcagtccgtgtacatcagtaaaataatttccagcgatagagacttgctggccgtggtcttttacggcactgaaaaggacaagaattctgtcaattttaagaacatttacgtgctgcaggagctcgacaacccgggagccaaaagaatcctggagctcgaccaattcaaaggacaacagggacaaaaacgctttcaggatatgatgggccatggcagtgactatagcctgtctgaagtgctgtgggtatgtgccaacctctttagtgatgtccagtttaaaatgtcccataaacggattatgctgttcacgaacgaggataacccccatgggaacgactcagctaaagcatcccgggctaggacaaaagccggcgacttacgtgacaccgggatcttccttgacctgatgcatctgaagaaacctggtgggtttgacatcagcttgttttatcgggacatcatatcaattgcagaggatgaagacctgcgagtacattttgaagaatctagcaagctggaggatctgttgaggaaggtacgggccaaagagacccgaaaaagagccctgtcacgactgaaactgaaactaaacaaagatatcgtcatcagtgtcggcatttacaaccttgtccagaaggctctaaaaccaccacctatcaaattgtaccgagagacgaatgagcccgtaaagactaaaacaaggactttcaatacatctacaggggggcttctcctccctagcgacaccaaaaggtcccagatttacggttcaaggcagattattctagagaaggaagaaactgaggaactgaaacgatttgacgaccctggactgatgctaatgggctttaagccccttgtcttgttgaaaaagcaccattaccttaggccatccctttttgtgtatcctgaggagtctctcgtcattggctccagcaccttattttctgcccttctaatcaagtgccttgaaaaggaagtggcagcactgtgtcgttacactccaagacgaaacatccccccctactttgttgccttagtgccgcaggaagaggagctagacgaccaaaaaatccaggtgactcccccgggcttccagctcgtttttctgccctttgctgatgacaagcggaaaatgccatttactgagaaaatcatggctacccctgaacaggtcggcaaaatgaaggcaatagtggagaagctgagatttacctaccggagcgacagctttgaaaatccagtgttgcagcaacacttcagaaaccttgaggctcttgccttagatctgatggagcctgagcaagctgtggacctcactctgcctaaagtagaagccatgaataagcgcctcgggtcattggttgacgagttcaaggagctggtgtatcccccagattataacccggagggtaaagtgacaaagcggaagcacgacaacgaaggctccggtagcaagcggccgaaggtcgaatatagcgaagaagagcttaagacccacataagcaagggtacgctggggaagtttaccgtgccgatgctgaaggaggcatgtagagcatacgggctgaaatccggactgaaaaaacaagaacttctggaggcactgacaaagcacttccaggattag

SEQ ID NO: 18122 - DNA, 1830 bp, Artificial Sequence
  Description of Artificial Sequence: Synthetic coding sequence
atgtcagggtgggagtcctactataaaaccgagggagatgaagaggccgaagaagagcaggaggaaaacctggaggcatccggcgactataaatattccggccgtgacagcctgattttcctggttgacgcttccaaagcaatgttcgaatctcaatccgaagatgaactcaccccttttgatatgtccatccagtgtattcaaagcgtatacatcagcaaaatcatctcttcagatagagacctgctggctgtagtgttttacggaactgagaaggacaagaactctgtcaatttcaaaaatatctatgttttgcaggaactcgataacccaggtgctaaacggattctggaactggatcagttcaaaggacagcaggggcaaaagagatttcaggatatgatgggccacggtagtgattatagcctgagcgaagtcctgtgggtgtgtgctaatctattcagtgatgtgcagtttaagatgtctcacaagagaatcatgctttttaccaatgaggacaatcctcacggtaacgattccgcaaaagctagtagggccaggaccaaggctggcgacctccgtgatacaggcatctttctcgacctaatgcacctgaagaaaccaggtgggttcgatatctcactgttctatcgagacatcattagtatcgcagaggacgaggacctgagggtccacttcgaggaaagttctaagctcgaagatcttttgaggaaggtgcgcgccaaggagaccaggaagcgcgctctcagtcgtctgaagctcaagcttaacaaggacatcgtcatctcagttggcatctataacttggtgcagaaggccttgaaacctcctcctattaagttatatagagaaacgaatgagcccgtgaagaccaagacacggacattcaacacgtctaccgggggtctattgctcccgagcgacactaaaagaagtcagatttacgggagccggcagatcatcctggaaaaggaggagacagaggagctaaagcgctttgatgatcccggtcttatgctgatggggtttaagcctctggtcttactcaaaaaacatcactatcttagaccaagtctctttgtataccccgaggagtctctggttatcggctcctctacgctctttagcgcactcctaattaagtgtctcgagaaggaggttgcggctctttgcagatacacccctcgtagaaatattcctccgtacttcgtggccctcgtgccccaagaagaggagttagacgaccagaaaatccaggttacacctcctggattccagcttgtatttctccccttcgctgacgataagaggaagatgccctttacagagaagatcatggccacccccgagcaggtcggaaagatgaaagctatcgtggaaaagcttcgttttacatatcgttcagatagttttgaaaaccctgtgctacagcagcattttaggaatctggaagccctagctctcgacctgatggaacctgaacaggccgtagacctgaccctgccgaaagtagaggccatgaacaagcggctaggctccctggtggacgaatttaaggaattagtttacccacccgactacaacccggaaggaaaggttaccaaacggaaacacgacaacgagggcagcggcagtaagaggccaaaagtcgagtattccgaggaagaattgaagacccatatctccaagggtacccttggcaaatttaccgtgccaatgctcaaagaggcttgtcgagcttacggactgaaaagtggtctgaagaagcaggaactccttgaggcccttaccaaacactttcaggactag

SEQ ID NO: 18123 - DNA, 1674 bp, Artificial Sequence
  Description of Artificial Sequence: Synthetic coding sequence
atgagtggctgggaatcttactacaaaactgagggcgacgaagaagcagaggaggaacaggaggaaaatcttgaagcaagtggtgactacaagtatagcggccgggacagcctcatctttcttgtcgatgctagtaaggctatgttcgaatcacaatccgaagatgagctgacccctttcgatatgtccattcaatgtattcagtcggtgtatatttccaaaatcataagttcggacagggacctgctggccgttgtcttttatggcactgagaaggacaaaaattccgtgaattttaaaaacatctacgtcttgcaagaacttgacaatccaggggctaaaaggattctggagctcgatcagttcaaggggcaacagggccaaaagaggtttcaggatatgatgggccatggaagcgactacagtcttagcgaagtgctgtgggtgtgcgccaatctgttttctgatgtgcagttcaaaatgtcccacaagagaataatgttgtttacgaatgaggataacccccatggtaacgattccgccaaagcttccagggctcggacaaaggcgggcgatctgcgggatactggcatctttttggacctcatgcacctcaagaaaccgggaggcttcgatatttcgctgttttaccgagacattatcagcatagctgaagatgaggaccttcgtgttcactttgaggaaagcagcaaactcgaggatctgcttagaaaggtacgcgccaaagagacccgcaaacgggccctcagccggctaaaactcaaactgaacaaggatatcgtcatctcagtgggcatttacaacctggtccaaaaggctctgaaacccccaccaatcaaactgtatagagaaacgaacgagccagttaagacaaagactcgaaccttcaacacctctacaggggggttgctactgccatccgatactaagcggtcacagatttacggaagtagacagatcatactggagaaggaagaaacagaagagttgaaacggtttgacgatccagggcttatgcttatgggattcaagcctttagtcctgcttaaaaagcaccactatctaaggccttcactattcgtctatcccgaggagagcctggtcattggatctagtaccttgttcagtgctcttctgatcaagtgccttgagaaagaagtggccgccctgtgtaggtatacccctagaagaaacattccgccgtacttcgtcgctttggtgccacaggaggaggaattggacgaccagaagatccaagttactccacctgggtttcagctggtttttctccccttcgctgacgacaagcgcaagatgccttttactgagaagatcatggccacaccagagcaggtggggaagatgaaggccatcgtggagaagctccgcttcacctatagaagtgactccttcgagaatcctgtcctgcagcaacacttcaggaatctagaagcgctggcgctggatttgatggagcctgaacaggccgtggacctgactctgccaaaggtagaggctatgaacaaaaggcttggttctctggttgacgaatttaaggagctcgtgtatcccccagactacaacccagagggaaaggtgactaagcgtaaacatgctaagggtcctaggtggagtatccaaaagaggagttag

SEQ ID NO: 18124 - DNA, 1707 bp, Artificial Sequence
  Description of Artificial Sequence: Synthetic coding sequence
atgagcggatgggagagttactataagacagagggcgacgaagaagcggaggaggaacaagaggaaaacttagaagcatcaggcgattataagtactctgggagggactctcttatttttctggtcgacgccagtaaggctatgttcgaatctcaatctgaggacgaactaaccccatttgacatgagcatccaagagcttgataaccctggggccaagagaattctcgagctagaccagtttaaaggccagcagggacagaaacggttccaggatatgatgggtcacggaagcgattacagtctgtcagaggtgctctgggtctgcgccaacctcttctctgacgttcaatttaagatgagccacaagcgaatcatgttatttacaaacgaagacaacccccacggcaatgatagtgccaaggcaagccgtgcccgcacaaaagcaggagacttgcgagatacaggtatctttctggatcttatgcatctcaagaaacccgggggcttcgacatcagtttattctaccgggatatcatatcaatagccgaagatgaggatctgcgggtgcacttcgaagagtccagcaagcttgaggatttgctgcgtaaggtgcgagctaaggaaaccaggaaaagggcactgtcgagactgaagctgaagctcaacaaggatatcgtgattagtgttggtatttataaccttgtgcagaaagctctgaagccgccaccaattaagctgtaccgcgagactaatgagcctgttaagactaagactaggacctttaacaccagcacaggagggctcctcttgccatccgatacaaagagatcccagatctatggcagccggcagatcatcctagagaaggaagagaccgaggagctgaaaaggttcgacgacccagggttgatgctcatgggatttaagccgctggtgctgctcaagaaacaccactatctaaggccttcactcttcgtttaccccgaggaaagtctggtcatcggttcatcaacactgttttcagcactcctgataaagtgtctcgaaaaagaagtggccgccctctgcagatatactccccgtcggaatatccctccgtactttgtcgccctggttcctcaggaggaagagctagatgaccaaaagatacaggtcactcccccaggttttcagcttgtgtttctgccatttgcagacgataaaaggaaaatgccattcacagaaaagatcatggccaccccagagcaggtgggcaagatgaaagccattgtagaaaagctgaggttcacctaccgaagtgatagttttgaaaatccagtactccagcagcacttcaggaatttggaagcgcttgcacttgacctgatggagcccgaacaagctgtagacctcaccctgcccaaggtggaagctatgaacaaacggctcggatccctggtggatgagtttaaagaactagtctatccacccgattacaacccagaggggaaggtcactaagcggaaacacgacaatgagggctctgggtcaaagcgtccaaaggttgaatacagcgaagaggagcttaagacgcacatctccaagggtacgctgggtaaattcactgtgcccatgctgaaggaagcctgtcgcgcttacgggctgaagtctggtctcaagaaacaagaacttctcgaagccctcaccaagcatttccaggattag

SEQ ID NO: 18125 - DNA, 1680 bp, Artificial Sequence
  Description of Artificial Sequence: Synthetic coding sequence
atgaagaaacaacgtaagaacaaaaagaggacactgaagcaggtgtgtatccagagcgtatacatcagcaaaattatttcttctgatcgagatctgctggctgttgtcttctatgggacggaaaaagacaagaatagcgtcaacttcaagaacatttatgtcctgcaggagctcgataaccctggagccaagcgaatcttggaactggaccagtttaaaggacagcagggccagaagcggttccaggacatgatgggacacggatcagattacagcttgtccgaggtcttatgggtgtgtgctaacttgttctcggatgtgcaatttaagatgagccacaagcggatcatgctattcactaacgaggacaacccccatgggaatgatagtgcaaaggcgtctagggctagaacgaaagccggcgatctgagagacactggcatcttcttggacttgatgcatctaaagaaacccgggggcttcgacattagcctgttttaccgagatataatttctattgccgaggacgaagaccttagggttcacttcgaagaaagttctaagctcgaggacctgctgcgaaaggtgagggctaaggagacccgtaagagggccctgtccaggcttaagctgaagctcaacaaagacattgtgatatccgtaggaatatataacctggtgcagaaagccctcaaacctccacccatcaagctatacagggagaccaacgaaccagttaagaccaaaacaagaaccttcaatacgtctacaggggggctattgttgccgtcagatactaagaggtcacagatctatggttctcgtcagatcattctggaaaaggaggagactgaagagctcaaaaggttcgatgatcctgggttaatgcttatgggctttaaaccgcttgtcctgctgaagaaacatcattatctgaggccatccttatttgtctatccggaggagagtttagtcatcgggagttctacactattctctgccttgcttattaagtgcctcgaaaaagaggtcgctgcactgtgccgatacactccgaggagaaatattcctccatactttgtcgccctcgtaccccaggaggaggagttggacgaccagaagattcaggtcacaccacctggtttccagttggtgtttctaccttttgccgacgacaagaggaagatgcctttcacagaaaagattatggccacccctgagcaggttgggaagatgaaggcgatagtggagaagttacgcttcacatacagaagtgactcctttgagaatcccgtgctccagcagcacttcaggaacctggaggcgctggctcttgatctgatggaacctgagcaagccgtggacttgaccctccccaaagttgaggccatgaacaaaagactagggtccctggttgacgaatttaaggagcttgtgtatccaccggattataatcccgagggcaaggtcactaaacgcaagcacgacaacgagggctctggctccaaaaggcccaaggtggagtatagcgaggaagagcttaagacccacatcagtaaagggactttaggaaaatttaccgttcctatgcttaaagaggcctgcagagcatacggccttaaatccgggctcaagaaacaggaactgctggaagccttgacaaaacactttcaggattag

SEQ ID NO: 18126 - DNA, 1830 bp, Artificial Sequence
  Description of Artificial Sequence: Synthetic coding sequence
atgtcaggctgggagagttattacaaaactgaaggtgatgaggaagccgaagaggagcaagaggagaatctcgaagcctccggcgattataaatattcaggccgagactcgctcatattcctcgtggatgcaagcaaagccatgtttgaatcacaatctgaggacgagctgacccccttcgatatgagcatacagtgcattcagagcgtctatatcagcaagattatctcctctgatagggatctactggctgttgtcttctatggaacagagaaagataaaaacagcgttaatttcaagaacatctatgtcctgcaagagctcgacaacccaggcgctaaacggattctggagctggaccaatttaaagggcagcagggccagaagcgttttcaggacatgatgggacacggctcagactatagtctgagtgaggtcttgtgggtgtgcgccaaccttttcagcgatgttcagttcaagatgtcacataaaagaatcatgttgttcacgaacgaagacaacccgcacgggaatgactcagctaaggcatcccgggctaggacgaaggctggcgacctgagggacacagggatcttcctggatttgatgcaccttaaaaagcctggagggttcgacatctccttgttttatagggacatcatctctatcgctgaggacgaggacctgcgggtgcattttgaagagtcgagcaagctcgaagatctgctgagaaaagttagagcgaaggagacaagaaagagagctctcagccggcttaagctgaagttgaataaggacattgtcatctcggtgggcatctacaacctggtgcagaaggctctcaagcccccgcccattaagctgtatcgagagactaacgagcccgttaaaaccaaaacccgcactttcaacacctctactggaggtctcctcctcccgagtgacacaaaaaggagccagatttacggctcaagacaaattattctggaaaaggaagaaaccgaagaactgaaacgattcgatgatcctgggctgatgctgatgggtttcaaaccgctggtgttgttgaagaagcaccattacctgaggcctagtctgttcgtctatcccgaggaaagcttggtgataggcagctccacgctgtttagcgccctgttgatcaagtgtctggagaaagaagtcgcggcactttgccgctatacgccccggcgcaacatccccccttactttgtggccttggtgccacaggaggaagagctggatgaccaaaaaattcaggtgactccacccggctttcaactcgtgttcctcccctttgccgatgataagaggaaaatgccattcactgaaaagatcatggcaacccctgagcaggttggtaagatgaaggccatcgtggaaaagctccgcttcacatatcgatctgacagttttgaaaaccccgtactccaacagcacttccgcaatctcgaggcactagctctagaccttatggaacctgagcaggctgtagacctcacacttcctaaggtagaagctatgaataagaggttaggctcactcgtggacgaattcaaagagctggtgtatccccccgactacaatcccgagggcaaggttactaagcgcaaacatgataacgaagggagtggatccaagaggcctaaggtggagtactccgaagaagagctgaagactcacatctctaaaggcacacttggaaaattcaccgtccccatgctgaaagaggcctgccgggcttatgggttgaaaagtggcctgaagaagcaggagctactcgaagctctcactaaacatttccaggactag

SEQ ID NO: 18127 - DNA, 1431 bp, Artificial Sequence
  Description of Artificial Sequence: Synthetic coding sequence
atgatgggtcacggatctgactactccctgtcggaggtcttgtgggtgtgtgcaaacctgtttagcgacgttcagttcaagatgtctcataaaaggattatgctgttcacaaatgaggataacccccacggcaacgacagtgccaaggcaagtagagcccggacaaaggcaggcgatctgcgagacaccggcattttccttgacctgatgcacctgaagaagcctggcgggttcgacatcagtctgttttacagagatattatctcaatcgctgaagacgaagacctcagagtgcattttgaggaatcctcaaaactggaagacctgttacgtaaagtccgagcaaaggagactaggaagcgcgcgctgtcaaggctcaagctaaagctcaacaaggatattgtgataagtgtgggcatatacaacctggtccagaaagcgttaaagcctcctccaatcaagttgtaccgcgagacaaatgagcccgtaaaaactaagacacgtacttttaacacctccaccggtgggctgctgctcccctctgatacaaaacggtctcagatctacggcagtcgacaaattattctggagaaagaggaaacagaggaactcaagcgcttcgacgacccaggattaatgctaatgggctttaaaccactggtgttattgaaaaaacatcactatctgcggccttctctgttcgtataccctgaagagtcgttagtgattgggtcatctacgctgttttccgctctcctgattaagtgtctggagaaggaggttgctgcactgtgtcgttacaccccccggaggaatatacccccatacttcgtggccctggtgccacaggaggaagagctggacgatcagaaaattcaggtgaccccccctggatttcaactggtgtttcttcccttcgccgacgataaacggaaaatgcccttcacagagaaaataatggccactccagagcaggtcggaaaaatgaaggcgattgtggaaaagctgagattcacatatagatccgactccttcgaaaaccccgttctgcagcagcattttcgcaatcttgaggcactggccctcgatctgatggagcccgagcaagctgtggacctgacactgcctaaggtggaggcaatgaacaaacgactgggcagtcttgtcgatgagtttaaggagctggtgtacccccctgattacaatcctgaaggcaaagttactaagcggaagcacgataatgagggcagtggtagcaagcgccctaaagtcgagtactccgaagaggaactaaagacccacatttctaagggcacattgggcaaatttacagtgcccatgctgaaagaggcctgtagggcatatgggctgaagtctgggctgaagaagcaggaactcctcgaggccctgaccaagcatttccaggattag

SEQ ID NO: 18128 - DNA, 741 bp, Artificial Sequence
  Description of Artificial Sequence: Synthetic coding sequence
atggctggtgcccccgacgaacggcgcagggggccagcagctggcgagcaactgcagcaacagcatgtatcatgccaggtgtttcctgagagactggcccaggggaacccacagcaaggattcttctcctctttctttacttccaaccagaaatgccaactgaggctgctgaagacactggaaacaaacccctatgtgaagctactccttgacgctatgaagcattcaggctgcgccgttaacaaggacaggcacttctcatgtgaggactgcaacggaaatgtgtcagggggcttcgatgccagcacgagtcagatcgtgttgtgccagaataatattcataaccaggcccacatgaacagagtggtgacacacgaattgatccacgccttcgaccactgtcgcgcccatgtggattggtttactaatatcaggcacctggcatgctccgaagtgcgcgcagcgaacctgagcggagactgttctctggtgaatgaaattttcaggctccatttcgggctcaaacaacaccatcagacctgtgtgcgggatagggcaacattaagcatcctggccgtgaggaatatttctaaggaagtcgcgaagaaagccgtggacgaagtctttgagtcttgtttcaacgaccacgaaccattcgggagaatcccccacaataagacctatgctcgatatgcccaccgggattttgagaatagggacaggtactacagcaacatttag

SEQ ID NO: 18129 - DNA, 1515 bp, Artificial Sequence
  Description of Artificial Sequence: Synthetic coding sequence
atggacccaggccagcagcccccaccacagccagcccctcagggacaagggcaaccacctagccagcccccccagggccagggacctcccagcggcccaggccaacccgccccagccgcgacacaggcagcccctcaggcaccacctgccggacaccagatcgttcatgtaagaggcgatagcgagactgatctcgaggctctctttaacgcggtgatgaaccctaaaacagctaatgttccccagaccgtgcctatgagactaaggaaactaccagacagcttttttaagcccccagagcccaagagccattccaggcaagctagcacagacgcaggcacagccggcgccttgacccctcaacatgtacgggcccactctagccctgccagcctgcagcttggggcagtgtcccctggcaccctcactccaaccggcgtcgtgagcggccctgctgccacccctacggcacagcacctgcgacaatccagctttgaaattccggacgacgttccattacccgcgggttgggagatggctaaaacatccagcgggcaaagatattttcttaaccatattgatcaaacaaccacctggcaggaccctagaaaggctatgctgtcgcagatgaacgttacagctcctactagccctccagtacagcaaaatatgatgaatagcgcatcgggcccactgcccgatggctgggagcaagctatgacacaggacggcgaaatttactacattaaccataaaaacaaaacaacatcttggctcgacccgagattagacccccggtttgctatgaaccagaggatctcacagtcagctccagtgaagcaacctccacctctggctccgcagtcaccccagggaggggtcatgggcggtagcaacagtaaccagcagcagcagatgagacttcagcagctgcagatggagaaggaaagactgaggttgaagcaacaggagctcctacggcaagctatgcggaatatcaatccatccactgccaactcaccaaagtgtcaagaattggccctgcgctcccagttaccaacgctggaacaggatggtgggacccaaaacccggtttcctcccctggaatgagtcaggaattacgcaccatgactacaaacagctcggacccattcctgaattctgggacatatcattcccgagacgagtctaccgatagcggcttgtctatgtccagctattccgtgcctcgcaccccagatgactttctgaacagtgtggacgaaatggatacaggtgacacaatcaatcagtccaccctgcccagtcagcaaaaccggtttccagattatctggaagctattccaggcacgaatgtagatttaggaactctggagggcgacggcatgaatatcgagggcgaggaactgatgccttccctacaggaagccctgagctcagatattttaaacgacatggagagtgtgttggcggcgactaagctggataaggaaagcttcctgacttggttgtag

SEQ ID NO: 18130 - DNA, 1365 bp, Artificial Sequence
  Description of Artificial Sequence: Synthetic coding sequence
atggatcctggacaacagccccctcctcaacctgccccacaggggcaaggtcagcctccctctcagcctccgcaaggtcagggcccacctagtggccctggacaacctgccccagcagcgacccaagctgcaccacaggcacctcccgcggggcaccagattgtccatgtcagaggagacagcgaaactgacttggaagctctgtttaacgcggtgatgaatcccaaaaccgccaacgtgccccagaccgttcctatgcggctgcgtaagctgcccgacagtttcttcaaacctccggaacctaagtcgcacagtagacaggcttcaaccgacgccggcactgcaggtgcgctgacaccccagcacgtgcgggcacattcttcccccgcaagcctccaattaggcgccgtgtcccccgggacgctcacccctactggggtggtgagtggccccgcagcaactccaacggcacagcacctccgacagagctccttcgaaattccggacgacgtacctctcccagctgggtgggaaatggccaaaacttcctccggacagcggtactttttgaaccacatcgatcagactacaacatggcaggatccaaggaaggcaatgttgtctcagatgaatgtcacagcacctactagcccgccagtgcagcagaacatgatgaattcagccagcgctatgaaccagcggatctcacagtctgcaccagtgaaacagcccccccccctggcccctcagagcccccaggggggagtgatgggcgggtctaattcaaaccaacaacagcagatgcggctgcagcagctgcagatggaaaaagagaggctccgactgaagcagcaggaattactacggcaggtgcggccgcaggagctggcacttcggagccagctgcccactctcgagcaggacggaggcactcaaaatccagtgtcatctcccggcatgagccaagagctgcgcacgatgactaccaatagctctgatcccttcctaaactctggtacttatcattctcgcgacgagtcgacggattccgggctgtccatgagttcgtattccgtgccccgaacccctgacgactttctgaacagcgtcgatgaaatggacacaggggacacaataaatcagtccacccttccatcccagcagaaccgattccctgattacctcgaggccatcccgggcacaaatgtggacttggggacactggagggagatggcatgaatattgagggcgaggagctgatgccgtccttgcaggaagctctcagctcagatattctaaatgacatggaaagtgttctggctgcgaccaaattggataaagagagcttcttaacttggctctag

SEQ ID NO: 18131 - DNA, 1266 bp, Artificial Sequence
  Description of Artificial Sequence: Synthetic coding sequence
atgcggttgagaaaactccccgactcattcttcaaacctccagaaccaaaatctcatagtcgccaggccagcaccgatgcaggcacggctggagcactcaccccccagcacgtgagggctcatagcagccctgcctctttgcagttaggtgccgtgtcacctggaacactgactccaactggcgttgttagcggcccggctgcaacacccacagcgcaacatctgaggcagtcaagtttcgagataccagacgatgttccgctcccagccggatgggagatggctaaaacttcatcaggacaacgctacttcctcaatcacatagaccagactaccacctggcaggatcccaggaaggctatgttatcgcaaatgaacgtgacggctccaacctcgcctcccgtgcagcagaatatgatgaattctgcttccggcccactgcccgatggatgggaacaggctatgacacaggatggggaaatctactacattaatcataaaaataaaaccacgtcctggctagatcccaggttggatcccagatttggcaaggcaatgaaccagaggatatcgcaatccgcgcccgtgaagcaaccacctcctctggcgccccagtcccctcaaggcggggtaatgggaggctctaacagtaaccagcagcagcagatgcgactgcaacagttgcagatggagaaggaacgcctgcgactgaagcaacaggaactactgcgtcaggccatgaggaatatcaatccctctactgccaactcgccgaaatgtcaggaactggcccttagatcacagcttccaacactggagcaagacggagggactcaaaatcctgtctcctctcccggcatgtcgcaagagctccgcaccatgaccaccaattcctcagacccttttctgaatagcggtacttaccacagcagagacgagagcaccgactccggcctgtccatgtctagctactccgttcctagaactcctgacgatttcctcaactctgtcgatgagatggacacaggtgacacaattaaccaaagcacactcccaagccaacaaaaccgctttccggactacctggaagccataccaggaactaacgtcgatctgggcactttggaaggagacgggatgaacatcgagggcgaagaattgatgccctcgctccaggaagcgctgtcttcagacattctcaatgacatggagtctgtcctagcggctaccaagctggacaaggagagcttcttaacttggctgtag

SEQ ID NO: 18132 - DNA, 981 bp, Artificial Sequence
  Description of Artificial Sequence: Synthetic coding sequence
atggcaaaaacctcttccgggcagcggtattttcttaaccatatagaccagactacgacttggcaggaccctcggaaagccatgctgtcccagatgaatgtgacagcacccacttccccgcctgtgcagcagaatatgatgaattccgctagcggcccactaccagacggctgggagcaagctatgacgcaggacggcgagatctactatattaatcataagaacaagactacttcttggctcgatccccggcttgaccctaggttcgccatgaaccagcgcatatcccagagtgcacctgtgaagcagccacctcccctggctcctcagtcgccacagggtggagtgatgggaggaagcaactctaatcaacagcagcagatgagactgcaacagctacagatggagaaggagaggctgcgtctgaaacagcaggagctcctgcgacaagcaatgaggaatattaacccgtccacagcaaactctcccaagtgccaggagctggccttgcggagccagcttcccaccctcgagcaagacggcggcacccagaatccagtaagctcccccggaatgagccaggaactaagaaccatgaccactaacagcagtgatcctttccttaacagcggaacctatcatagtagagacgagagcaccgatagtggactgtctatgtccagctattccgtgcccaggactcctgacgacttccttaactcagtggatgaaatggacaccggcgacacaatcaaccagtctaccctgcctagtcagcaaaatcgtttcccagactacttggaggctatccccggcacaaatgtggacctggggaccctagagggggacggcatgaatatcgagggggaggagctcatgcctagccttcaggaagccctgagttcggacatacttaatgacatggagtccgttctggccgcaacaaaattggacaaagagtcctttctcacatggctgtag

SEQ ID NO: 18133 - DNA, 1467 bp, Artificial Sequence
  Description of Artificial Sequence: Synthetic coding sequence
atggatcccgggcagcaaccaccacctcagcctgctcctcagggccaggggcagccccctagccagccgccacaggggcagggtcctccatccggacctgggcagccagcaccagcggctacacaagccgccccacaggctcccccagcggggcaccaaatcgtgcatgttcgtggtgacagtgaaacagacttggaggcccttttcaacgcggtgatgaatccaaaaactgccaacgtgccacaaaccgtccctatgcgcctcaggaagttgcccgatagcttctttaagccacctgagcccaaatcccacagtagacaagcaagcactgacgccggcacggccggcgccttaactccccagcatgtgcgggcacactccagtcctgcgagcctgcagctcggagccgtgtccccgggcaccctaacacctaccggcgttgtatctggccccgccgcaacgccgacggcacagcatttgagacagtcctccttcgaaattcctgatgatgtccctctgcctgccgggtgggagatggctaaaacatcaagcggccaacgctactttttaaaccatatagatcaaacaaccacatggcaggacccacgaaaagccatgctgagccagatgaatgtcacagctcccaccagtcccccagttcagcagaatatgatgaactccgccagcgggccccttcccgacggatgggagcaagcaatgacccaggatggggagatctattacataaaccacaagaataagaccacttcttggctcgatcctcgactcgacccccggttcgccatgaatcagaggataagtcagagcgcccccgtcaagcagccgccacccctagctccacagtccccccaggggggcgtcatgggtggttctaattcaaaccagcagcaacaaatgcgcttgcaacagttacagatggaaaaggagcgtttgcgcctcaagcagcaggaactgctgcggcaggagctggcccttaggagccagctacctacacttgaacaggatggtggaactcaaaatcccgttagctcacccgggatgtctcaggagctgcgtacgatgacaaccaactctagtgatccctttctgaattcagggacatatcactcgcgcgatgagtctacagactccggactgtcaatgtccagctacagcgtcccgcgaacgccagatgactttttgaacagtgtggatgagatggatacaggggacactattaatcagagtactctgcctagtcaacagaataggttccccgactacttagaggcaatacctggcactaacgtcgaccttggaactctggagggggatggtatgaatatcgagggcgaggaattaatgccatccctgcaggaggcgctgagcagtgatatacttaacgacatggagagcgtattggctgcgacaaagctcgataaggagtcatttctgacctggttatag

SEQ ID NO: 18134 - DNA, 1479 bp, Artificial Sequence
  Description of Artificial Sequence: Synthetic coding sequence
atggatcctgggcagcagcctccgccccagcccgctccgcagggacagggccagccgcccagccagcccccccaagggcaggggcctccttcgggtcccggtcagcccgcacccgcagcaactcaagccgcccctcaggcacccccggctgggcatcagattgtgcacgtccgcggtgattctgagacagacctggaggctctgttcaacgccgtcatgaatcccaagactgccaatgtccctcagaccgtacccatgagactgcgtaagcttccagacagttttttcaaaccacctgagcccaagtctcatagtcggcaggcctcaacagatgccggcaccgcaggagcccttaccccgcagcacgtgcgcgctcacagctccccagcttctcttcagctaggggccgttagtccgggcactcttacacctactggtgtggtttcaggacccgcagccacgcctacagctcaacacctccgacaatcttctttcgagataccagatgacgtgccccttccagctggctgggagatggctaaaaccagttccggtcagagatacttcctgaatcatattgatcagaccaccacttggcaagaccctcgcaaagcaatgctatctcagatgaacgttacagcacccactagccctccagtgcagcagaacatgatgaactccgcaagcggccctctcccagacgggtgggagcaggcaatgactcaggatggagaaatctattacatcaatcacaaaaacaaaaccacttcctggctggacccacgcctcgatccccggttcgctatgaaccagcggatctctcaatcagcgccagtaaaacaacccccccctctggctcctcagtctccccagggcggtgtgatgggcggctcgaatagcaatcaacaacaacaaatgcgtctccagcaactgcagatggaaaaggaacgcttaaggcttaagcagcaagaactcctcagacaggtgcgaccccaggaactggccctgcgcagtcaactgccaacgctggagcaagatggggggactcagaatcccgtgtcgagtccaggtatgtctcaagaactcaggacaatgaccaccaacagcagtgaccctttcctgaacagtgggacttatcatagtcgcgatgaatccactgattcagggctctctatgagctcttatagcgtacctaggaccccggacgactttctcaattccgttgatgaaatggatacgggtgacacaataaaccaatcgacattacctagtcagcagaaccgctttccagattaccttgaagccattcccgggaccaacgtagacctgggcacccttgagggagacggaatgaacatcgagggcgaggagctgatgccgtccctgcaagaggctctctcctcagatatacttaacgatatggaatccgtactggccgccacaaagctggataaggagtcctttttgacctggttatag

SEQ ID NO: 18135 - DNA, 1353 bp, Artificial Sequence
  Description of Artificial Sequence: Synthetic coding sequence
atggaccccggacagcaacctcccccacagcctgctcctcaaggccagggccaacctcccagccaaccacctcagggacagggccctccttccggccccggtcagcctgcccctgccgcaacccaagccgccccccaggccccacccgctggccatcagatcgtgcatgttcgaggcgactcagaaactgatctggaagctttatttaatgccgtcatgaaccctaaaacagccaatgtgcctcaaacggttcctatgcgccttaggaaactgcctgactcctttttcaaacccccggagccgaagtcacactcccggcaggccagcaccgatgccggcacagccggggctctaactccccaacacgtgcgcgcccacagttccccagcatccctacaactcggagctgtatcccccggcactcttactccaaccggtgtggtttccggccctgccgccactccaaccgctcaacacctgagacagagttcctttgaaatcccggatgatgtgcctctgcctgccggctgggagatggccaagacctccagcggccagagatatttcctgaaccacatcgaccagacaactacctggcaggacccaagaaaggccatgttatcgcagatgaacgtcactgctccaacttccccacctgtgcagcaaaatatgatgaatagcgcctctgccatgaatcagaggatatcacagtccgctcccgtgaaacagcctccacctctggctccacaatccccgcaagggggggttatgggtggtagcaattcaaatcagcaacagcagatgcgactgcagcagcttcagatggagaaggaaagactgcggctgaagcagcaagagctgctgcgccaggaattagcactgcgctcccagctgcccacactagagcaggacggggggactcagaaccccgtgagcagtcctggtatgtcgcaggaactgcggacgatgacgactaatagttcggacccttttctcaactctgggacataccacagcagggatgaaagtacggatagcggcctgagtatgtcatcatattcagtcccaagaacacccgacgactttctgaatagcgtcgatgagatggacaccggagacacaatcaaccagagcacccttccgtcccagcagaaccgattccctgactatctcgaagcgattcccggcacaaacgttgatctgggcaccctggagggcgacggaatgaacattgagggcgaagagctgatgccaagtctccaggaggcattgagcagcgatattttgaacgatatggaatcagtactggccgctacaaaactcgataaggagtctttccttacatggttgtag

SEQ ID NO: 18136 - DNA, 1860 bp, Artificial Sequence
  Description of Artificial Sequence: Synthetic coding sequence
atggctaatgatatcgacgagctcatcggcattccattccctaaccactcatctgaggtgctgtgttcactaaacgagcaacgccacgatggactgctgtgtgacgtgcttctcgtggtgcaggaacaggaatacagaacccacaggtccgtgctcgccgcctgctctaaatatttcaagaaactttttacggctggcactctcgcgtcacagccatacgtgtacgagatcgattttgtgcagcccgaggctctcgcagctatcctcgaatttgcctacacatcaaccctgaccattacagccggaaatgttaaacacatccttaacgccgcccgcatgctggaaattcagtgtattgtaaatgtgtgcttggagattatggagccagggggagacggaggggaggaggatgataaggaggacgatgacgacgacgaggacgatgatgatgaagaagatgaagaagaagaagaagaggaagaggaagatgatgacgatgacactgaagactttgctgaccaggagaatctgcctgatcctcaggatatatcgtgccatcagtctccctcgaagactgaccacctcactgaaaaggcttactctgataccccccgggattttccagatagcttccaggccggaagtcctggccatttaggtgtcatacgagatttcagcatagagtccctcttaagggaaaatctctaccccaaagctaacataccggacaggaggccaagcctctcaccattcgctcctgatttttttccccatctgtggccaggcgacttcggggcgtttgctcagctgcccgaacagccaatggattcggggcccctcgaccttgttatcaagaaccgtaaaatcaaggaggaggaaaaggaggagcttcctccacctcccccccccccttttccgaacgatttcttcaaggacatgtttcctgacctgcccggaggccccctcgggccaataaaggccgaaaatgactatggcgcatatctgaattttttgagcgcaactcacctcggagggttgtttcctccctggcccctcgtcgaggaacgaaagttgaagccgaaagcgtcgcaacagtgccctatctgccacaaggtcattatgggcgcaggtaagctgcctcggcacatgcggacacacactggtgagaaaccctacatgtgtaccatctgcgaggtcagattcactcgacaggacaagcttaagattcacatgaggaaacacaccggggagagaccttacctgtgcatccactgtaacgctaaatttgtgcataactatgacctgaagaaccatatgcggatccacactggggtacgtccctaccaatgtgaattctgctacaagagcttcacaagatccgatcacctacaccgacatataaagcgacagagctgtcgaatggcccggccacgcagaggcaggaagccagctgcatggcgagctgctagtctgctttttggtcctggtggaccagcccccgacaaagcggcattcgtcatgccacccgcacttggtgaagtgggcggacacctaggtggcgcagccgtatgcctgccaggtcccagtccggcaaagcatttccttgcagcccctaaaggcgcactttctctccaggaactggaacggcagtttgaagagacgcagatgaagctgttcggccgcgcgcagctcgaagcagagagaaacgcgggtggtttgcttgcctttgcactggccgagaatgtggccgccgcccgcccttattttcccctccctgacccttgggcagctggcctagcaggattaccaggtctggccggactcaatcatgtggctagtatgagcgaggccaacaactag

SEQ ID NO: 18137 - DNA, 1860 bp, Artificial Sequence
  Description of Artificial Sequence: Synthetic coding sequence
atggcgaacgatatcgacgagctgattggcattccttttccgaatcattcttcagaagttctctgctctctcaatgaacagaggcacgacggacttttgtgtgatgtactgctggtcgtgcaggaacaggaatacaggacccaccggtcggtactggctgcttgcagtaagtattttaagaagttattcacggccggtacacttgccagccagccgtatgtgtacgaaatcgactttgtacagcccgaggcacttgcagccatcctcgagttcgcctataccagtactttgaccattaccgcgggcaacgtgaagcacatccttaatgccgctagaatgctggagatccagtgcatcgtgaacgtgtgtctcgaaattatggaaccaggcggggatgggggggaagaggacgacaaagaggatgacgacgacgatgaggacgatgatgacgaggaggatgaagaggaggaagaggaggaagaggaggacgatgacgacgacacagaggattttgctgaccaggaaaatttgccagatccacaggacatctcttgtcatcagtctccctccaagactgaccacctcactgagaaggcctatagcgacacccctcgcgactttccagacagctttcaggctggcagccccgggcatctcggagtgattagggatttttcaattgagtccctgttgagagaaaacttgtaccccaaggctaacatacccgacaggagacctagcctctcgcccttcgcccccgatttctttccacacctgtggccaggagacttcggggcatttgcccagctgccagaacaacccatggactctgggcccttggacctagtgatcaagaatcgcaagatcaaagaagaggagaaagaagagttgccccctccacccccacctccttttcctaatgacttcttcaaagatatgtttcctgatctgcccgggggacctttaggtcccatcaaagcagagaatgactatggggcttatctgaattttctctccgctacacacctgggagggctctttccaccttggccattagtggaggaacgcaagcttaagcctaaagcctcccagcagtgcccaatttgtcataaggtgattatgggtgccggtaagctaccgaggcatatgagaacacacacgggagaaaagccatatatgtgtactatttgcgaagtcagattcacccggcaagacaaattaaaaatccacatgaggaaacacactggtgagaggccctatctgtgcatccattgtaatgcaaaattcgttcataactatgatctgaagaaccatatgaggatccacacgggggtgagaccttaccagtgcgaattctgttacaagtcgttcacgcgatctgaccacctccataggcatatcaaacgacaatcatgtcgtatggctagacctaggcgtgggcgaaagcccgccgcatggcgtgccgcctccttgctgttcggacctggcgggcccgctcccgataaggccgcttttgtgatgcctccggcgctgggcgaggtgggcggccacctgggcggggcagctgtttgtctgcctggcccttcaccagccaagcatttcctcgccgcacctaaaggggcactatcgctgcaggaactggagcggcagttcgaggaaactcagatgaagctctttgggagggctcagctggaggccgagagaaacgccggtggattgctggccttcgccctagccgaaaacgttgctgccgccagaccatattttcctctgccggatccctgggctgcaggcctcgccggcctgccgggcctcgcaggccttaaccacgtggcctccatgagcgaggctaacaactag

SEQ ID NO: 18138 - DNA, 78 bp, Artificial Sequence
  Description of Artificial Sequence: Synthetic coding sequence
atggcgaatgacatagacgagctgatcgggatacctttcccgaaccacagctcggaggtcctatgttctctgaattag

SEQ ID NO: 18139 - DNA, 57 bp, Artificial Sequence
  Description of Artificial Sequence: Synthetic coding sequence
atggccaatgacattgatgaactcatcggcattccttttccgaaccactcgagttag

SEQ ID NO: 18140 - DNA, 3375 bp, Artificial Sequence
  Description of Artificial Sequence: Synthetic coding sequence
atggcagacgggccacggtgcaagcgccgcaaacaggcaaatccgcgacgtaataacgtgactaactacaatacagtcgtggagaccaactccgattcagatgatgaggacaaactccacatcgtcgaagaagagtctgtaaccgacgcagccgattgcgagggtgtccctgaggacgacttacctacagaccagaccgtattaccaggcaggtcatcagagagagagggcaacgccaaaaattgttgggaggacgatcggaaggaggggcaggaaattctgggacccgaggcccaggctgatgaggccggttgtaccgtaaaggacgatgagtgcgagagcgacgcggaaaacgaacagaatcatgaccctaacgtggaggaatttctgcaacagcaggatacagctgtcatattccctgaggctcctgaggaggatcaaaggcagggaacgcctgaggcgagcggccacgatgagaatggcacacctgacgccttctctcagcttctgacatgtccctactgtgatagaggttataagcggttcacctcactgaaagagcatatcaagtaccgtcacgaaaaaaacgaggataattttagctgttctctttgttcctacactttcgcatatagaactcaattggagcgccatatgaccagccataaaagcggtcgggatcaaaggcacgtcacgcagtccggttgcaatcgaaagtttaagtgcaccgagtgcggcaaggccttcaaatacaagcatcatctaaaggaacacctcaggatccactccggagagaagccgtacgagtgtccaaactgtaaaaagcgctttagccattccgggtcttactcatcccacatttcttcaaagaagtgcatctctctcatccctgtcaacggacggccacgcacggggcttaagacgtcccagtgctctagccctagccttagcgcctctccaggcagcccaacgaggccccaaatccggcaaaagatcgagaataaaccactccaggaacagctgagcgtaaaccagatcaaaaccgagcccgtcgattacgagttcaagccaattgtggtggctagcggcatcaactgctccactcccctgcagaacggagtcttcactggcggaggcccgcttcaggccacttcgtccccccagggcatggtacaggctgtggtgctgccaacagtgggcctggtgtcccctattagcataaatcttagtgacattcagaatgtgctgaaggtggcagtggatggcaacgttataaggcaggtcctcgagaataatcaagcgaacttggcgtcgaaggaacaagagaccataaacgcgtctcccatccagcagggaggacatagcgtgatttcagctatcagcctgcctcttgtcgaccaggatggcaccacaaaaatcatcattaactactctctcgagcaaccaagccagctgcaggtggtgccccaaaatttaaagaaagagaatccagtggccactaactcctgcaaaagtgaaaaattgccagaagatctgaccgtgaagagcgagaaagacaaaagctttgagggcggagtgaacgattcaacctgcctcctctgcgatgattgccccggcgacattaatgctttgcccgagttaaagcattacgatttgaaacagccaacgcagcccccccctttgcccgcggcggaagcagaaaaacctgagtcctccgtgagctccgctaccggcgatgggaatctgagcccatcccagcctccgctgaaaaatctattgtcgctgcttaaagcctactacgcactgaacgcacaaccgagcgctgaggagctgtcaaagatagccgacagtgtgaacctgcctttagatgttgtcaagaaatggttcgagaagatgcaggccggccagatctcagttcagtcttccgagccttcttcacccgaacccgggaaggtgaacatccccgccaaaaataacgaccagcctcaaagcgccaatgccaacgaaccacaggatagcacagtcaacctgcagtcccctctgaagatgactaatagtcctgtgttgcccgtgggaagcacaacaaacggttccagatcctctacaccctccccttctcccctgaatctaagtagctccagaaacacccagggctacttgtataccgccgagggtgcccaggaggagccccaggtggagcctcttgacctttccctgcctaagcagcagggagaacttctcgagaggtccaccatcaccagcgtgtaccagaattctgtgtactctgtgcaagaagaacccctcaacttatcctgtgcgaaaaaagagccacaaaaggattcatgcgttactgattccgaacccgtggtcaatgttattccaccaagtgcaaatccaatcaacatcgcaatcccaacggtcaccgcacagctgcctactatcgtggctatagcagaccagaatagcgtgccatgcctacgggccctagctgcaaacaaacagaccatcttgattccccaggtagcatatacctattctaccacggtcagccccgctgttcaagaaccgcctctcaaggtgattcagcctaatggtaatcaggatgagcggcaggacacatcctcagagggcgtttccaatgttgaggatcagaacgattctgatagcacccctcccaaaaagaaaatgcgcaagaccgagaacggaatgtatgcatgcgacctttgtgataagatattccagaagtcaagcagtctcctgagacataaatacgagcacaccggcaaaaggccacacgaatgcggcatctgtaagaaggctttcaagcacaagcaccatttgatcgagcacatgcggctgcattctggcgaaaaaccataccagtgcgacaaatgtgggaaaagattttctcattccgggagttacagtcagcacatgaaccacagatattcctattgtaagcgtgaagccgaggaaagagacagcacggaacaggaggaggcaggaccagagatcttgtccaatgaacacgtcggagccagggcctccccatctcagggcgattctgacgagagggagagcctgacccgtgaggaagatgaggattctgagaaagaggaggaagaagaagataaggagatggaggagctgcaggaagagaaggagtgcgaaaaaccccagggagatgaagaagaggaggaagaagaagaagaggttgaagaggaggaggtggaggaagccgagaacgagggggaagaggcgaagaccgagggcttgatgaaggacgaccgggccgagtcccaggcctcctccctggggcagaaagtgggtgagtcctccgaacaggtcagcgaggagaaaaccaatgaagcctag

SEQ ID NO: 18141 - DNA, 3378 bp, Artificial Sequence
  Description of Artificial Sequence: Synthetic coding sequence
atggctgacggtccacgatgcaagcgcagaaagcaagctaaccctaggagaaataatgtcacaaactataataccgtggtggagaccaatagcgatagcgacgacgaggataaactccatattgtcgaagaggagagcgtgaccgatgcagcagactgcgagggagtgcccgaagatgatttgccaaccgaccaaactgtgttgcctgggcgatcatctgagcgggaaggtaacgccaaaaactgttgggaggatgacaccggtaaagaaggacaggagatcctaggtcctgaagctcaggcagatgaggctggctgtacggtgaaagacgacgagtgtgagtccgatgctgaaaacgagcaaaaccacgacccgaatgttgaggagttcctccagcagcaagacaccgccgtgatttttccagaggccccggaggaagatcaaagacagggcacacccgaggcgagtgggcatgacgagaatggaacacccgacgcttttagccagctcctaacctgtccatattgcgatcgtggctacaagaggtttactagccttaaggagcacattaagtacaggcacgagaaaaatgaggacaatttcagctgttctctttgctcctatacgttcgcctatcggactcaactcgaacgccacatgactagtcacaaatccggacgcgatcaacgccacgtgacccagtccggttgcaaccgaaaatttaaatgcacagagtgcggcaaagcctttaaatataagcaccacctgaaggaacacctgaggattcactcaggggaaaaaccctatgaatgtcccaattgcaagaaaagattttcccacagtgggtcttactctagccatatatcatccaagaagtgcatctcactgattcctgttaatggacgtccacggactggactgaagacatctcagtgcagctcaccatcactttccgcgagcccgggctccccgactcgcccacaaataagacaaaagatcgagaacaagccactccaggagcagctctccgtcaatcagataaaaacagaaccggtggactacgagttcaagccaatcgtcgtagcaagcgggatcaactgttctactcccttgcagaacggagtctttaccggcggtgggccattgcaggctacctcctctcctcaaggtatggtacaggctgtggtgctgcccacggtcggcctcgtctcccctatcagcataaacctgtccgatatacaaaacgtgctgaaggtggccgtggacgggaatgtgatcagacaggtcctggagaacaatcaggccaacttagccagcaaggagcaggaaactataaacgcctctcccatacaacaggggggacacagcgtcatatccgctatctctcttcctctggtggatcaggatgggaccacgaagatcattattaattactctcttgagcagccatctcaactgcaggtggtgccgcaaaacttgaaaaaagagaatcccgtcgctacaaacagctgtaagtccgagaaactaccagaagatttgactgtgaagtctgaaaaggacaaatctttcgagggcggagtcaatgactccacatgtctgctgtgtgatgactgtccaggcgacataaatgccttgcctgaactgaaacattacgacttgaaacagcccactcagccccctcccctccccgccgctgaagcggagaagccggaatcatctgtatcctccgcaactggtgatggaaatctcagcccgtcccaaccccccctcaaaaacctcctgagcctgttgaaggcctattacgctcttaacgcccagccaagcgcggaggagctttctaagattgccgattccgtgaatctgccattggatgtggtgaaaaagtggtttgaaaagatgcaggcagggcagatctctgtgcagagctctgaacccagctcccccgagccaggaaaggttaatatcccggccaaaaacaatgatcaaccccaatctgccaatgccaacgagcctcaagactcaaccgtcaacctgcagtcccccctgaaaatgaccaatagccctgtgttacctgttggatccacaaccaatggctccaggtcttctactccaagtccgtcaccactgaatttatcctcaagtaggaacactcagggatatctttacacggctgagggcgctcaggaggagccgcaagtggagccgctcgatctctcactcccgaaacaacaaggagagttgctcgagaggagtaccatcaccagcgtgtaccagaattccgtgtatagtgtgcaagaggagcccctgaatctgagctgtgcaaagaaggagccacagaaagattcatgcgtaactgattcagagccggtcgtcaatgtcatcccgccttccgccaacccaatcaacattgccatccccactgtcactgctcaactacccacaatcgtggccatcgccgatcagaacagtgtgccctgcttgcgcgcgctggccgccaataagcaaaccattttgatacctcaggttgcctacacctactctaccaccgtttctcccgcagtccaggagcctccattgaaggtaattcaaccgaatggcaatcaggatgaaaggcaagatacaagctctgaaggcgtctccaacgtcgaagatcaaaatgacagcgactccacacctccaaagaaaaagatgcgtaagacagaaaatggcatgtacgcttgcgacctgtgtgataaaatttttcagaaatccagtagcctcctccgccataagtacgaacacaccggaaagcggccccacgaatgcggcatctgtaagaaagcctttaagcacaagcaccacctcatagagcatatgcgcctccactcaggagagaagccttaccagtgcgacaaatgcgggaagcgcttcagccacagcggctcctattctcagcacatgaatcacagatattcatattgcaagagggaggcagaggagagggactcaaccgaacaagaagaggcaggccctgaaatcctctcaaatgaacacgtaggggcccgggcctcaccttctcagggcgattctgacgaacgtgagtccctcacccgggaggaggacgaggattctgagaaagaggaggaagaagaggataaagagatggaagaattgcaggaggagaaagaatgtgagaaacctcagggtgacgaagaagaggaggaggaagaagaggaggttgaggaggaggaagttgaggaagcagaaaatgagggtgaggaggcaaaaaccgaggggcttatgaaggatgacagggccgagtcccaggcaagctctctgggccagaaggtcggggaaagcagcgagcaggtgagcgaagagaagaccaacgaagcttag

SEQ ID NO: 18142 - DNA, 870 bp, Artificial Sequence
  Description of Artificial Sequence: Synthetic coding sequence
atggcagacggtccacgttgtaagcggcgtaaacaagcaaatccaagacgtaataatgtgaccaactataacaccgtggtggagactaattccgactcagatgatgaggataaattgcatatcgtagaggaggagagcgtcacggacgctgccgattgcgaaggagtcccggaagatgacctcccgacggaccagaccgtgctacctggtaggtcctctgagcgcgaaggcaatgcgaagaattgttgggaggatgacacagggaaggaaggccaggagatcctcggtcctgaagcccaggctgacgaagctgggtgtactgttaaggatgacgagtgtgaatcagacgcagaaaatgagcagaaccatgatcccaatgttgaggaattcttgcagcagcaggacacagcggtgattttccccgaggcccctgaggaggatcagaggcagggaacaccagaagccagtggacacgacgaaaacggaaccccggacgccttttcacagctgttgacatgtccctattgtgaccgcggttacaaacggttcaccagtctaaaggagcacatcaagtatagacatgaaaagaacgaggataacttttcatgtagtctctgcagttacacctttgcctatcggacccagctcgagcgccatatgacaagtcacaaaagtgggagagatcagcgccatgtaacccaaagcggctgcaataggaaattcaagtgtactgaatgcgggaaagcttttaaatacaagcatcatcttaaagaacatttgcgcattcacagcggggaaaagccttacgagtgcccaaattgcaaaaagcgcttctcgcattctggcagttactctagtcacatcagttag

SEQ ID NO: 18143 - DNA, 2721 bp, Artificial Sequence
  Description of Artificial Sequence: Synthetic coding sequence
atgaccagccacaagtctgggcgagaccagagacacgtcacccagagtggatgtaaccgcaaatttaagtgcacagagtgcgggaaggctttcaaatataagcaccatcttaaggagcaccttcggattcactctggcgaaaagccatatgagtgtcctaattgcaaaaaaaggttctctcatagtgggtcttatagttcccacatctccagtaaaaaatgcatttctctcataccagttaacgggagacccagaactgggcttaaaacgtcacaatgtagttctccctcactgagcgcttcccccgggagtcccacgcggcctcagataaggcagaagattgagaataaacctctccaggagcaacttagcgtaaatcagatcaaaacggaaccagtggattacgagtttaagcctattgtcgtggcatctggaataaattgcagtacgccccttcagaacggcgtgtttacaggaggcgggcctctgcaggccacctccagtccacaaggaatggttcaggctgtggtactgccaactgtggggctggtttctcctatctctataaacctctcagacatccagaatgtgctaaaagtggccgtggacggaaatgttatacgccaggtcctcgagaacaatcaagcgaacctcgccagtaaggagcaggagaccatcaatgctagccctattcagcagggtggccactctgtaatctcggctatttccctacccctggtcgaccaggatggcacaaccaagataattatcaactattctcttgaacagccctcccaactccaagtggtccctcagaatctcaaaaaagaaaaccctgtggctaccaattcctgtaagtctgaaaaactgcctgaagatctcaccgtcaagtctgaaaaggacaaatcctttgaagggggggtcaatgactccacctgtctgctctgtgatgattgccccggcgacataaacgcactgccagagctcaaacattatgacctgaaacaaccaacacagcccccacccctgccagctgctgaggccgagaagccagaatccagcgtcagttcagccaccggagacggcaacctgtcaccctcacagcctccactgaaaaacctgctgtcactgctaaaagcctattatgccctgaacgcccagccatcagcagaagaactgtcaaaaattgctgattcggtgaatttgcccctggacgtcgtcaagaagtggttcgagaagatgcaggctgggcaaatctctgtccagtctagcgagcccagcagtcccgaaccgggaaaagtcaacattccggctaaaaataatgaccagccccagtccgccaacgccaacgagccgcaggacagcacagtcaatctgcaatcaccccttaaaatgacaaacagccccgtcctgccggtggggtccactaccaacggaagtcggagctccaccccatctccatcgcctctcaacctatctagctctaggaacacgcagggctacttgtatacggcagagggagcccaggaggagccccaggtggaacctctggacctctcactgcccaaacagcagggggaattactggagcgcagtacaattacctctgtgtaccagaattctgtgtactccgtccaggaggaacctctgaatctaagctgtgcaaagaaggaaccacagaaagatagctgtgtgacggacagcgaaccagtggttaatgtcataccgccatctgctaaccctatcaacattgcaattcccacagtcactgctcaactgccaaccatcgttgccattgctgaccagaacagcgtgccatgtctgagggcactggccgccaataaacagacaattttaataccccaggtggcatatacatacagtacaaccgtgagccctgcggtccaggagcctccacttaaagttatccaaccaaatgggaatcaggacgaacggcaggacacaagttccgagggcgtgtccaatgtcgaggatcagaacgattccgatagtacgccccctaaaaaaaagatgcgcaagacagagaacgggatgtacgcatgtgatctgtgtgacaagatctttcagaaaagcagctcactgctccgccataagtatgagcacactggaaagagaccccacgaatgtgggatctgcaaaaaagcatttaagcataagcatcaccttattgaacacatgaggctgcattccggcgaaaaaccataccaatgcgataaatgcgggaagcgattcagccactcaggctcttactcccagcacatgaatcataggtactcatattgtaagagggaagcagaagagcgggactccacggaacaggaagaagccgggccagagatcctgtccaacgaacacgtgggggcgagagcttcaccttcccagggagattccgacgaacgagaaagcttgacccgagaggaagatgaggattcagagaaagaggaagaagaagaagataaagagatggaagaactgcaggaagagaaagagtgtgaaaagcctcagggcgatgaggaagaagaagaggaagaagaagaggtcgaggaggaggaggtggaagaggcagagaatgagggcgaggaggctaaaacagaaggcctaatgaaagacgaccgggctgagtcacaagcatctagtcttggccagaaagtgggcgaaagctccgagcaagtgtccgaagaaaaaaccaacgaggcgtag

SEQ ID NO: 18144 - DNA, 3327 bp, Artificial Sequence
  Description of Artificial Sequence: Synthetic coding sequence
atgaaggtgaccaactacaataccgtggtggagacaaacagtgactccgatgatgaagacaaactgcacatagtggaggaagaatctgtgacagatgcagccgattgcgaaggcgtccccgaagacgacctgcccacagaccagaccgtcctgcctggccgatcttccgaaagagaaggcaacgcgaaaaattgctgggaagacgatactgggaaagaagggcaggagatcctcgggcctgaggcgcaggccgacgaggcgggctgtactgtgaaggatgatgagtgcgagagcgatgccgagaatgaacaaaatcatgatcccaatgtagaggaatttcttcaacagcaagataccgctgtcattttccccgaagctccggaagaggatcagagacaaggtacaccggaggcctcaggacacgacgagaatggcacccccgacgccttctctcagctgctgacttgtccttattgcgaccggggttacaagcgtttcacttccctgaaagagcacattaaatatagacacgagaagaacgaagacaacttttcatgcagtctgtgcagttatacatttgcctaccgtacccagcttgagagacacatgaccagccataaaagtggcagagaccaaagacatgtaacccagtctggctgtaaccggaagttcaagtgcacggagtgcggcaaggcttttaaatataagcatcacctgaaagagcatctgagaattcattccggggaaaagccctatgagtgtccaaattgcaagaaacgcttctcacatagtgggtcatattccagtcacattagctccaagaagtgtattagccttattccagtgaacggcagaccacgcacaggcttgaagaccagtcagtgctccagtcccagcctcagtgctagccccggctctcccacacgcccccagattaggcaaaaaatcgaaaacaagcctctacaggaacaactctccgtgaaccagatcaagacggaaccagtagactacgaattcaagcccatagtcgttgcttctggaattaactgcagcaccccactccagaacggtgtcttcacaggcgggggacccctccaggcgacttcatcgccacaaggtatggtccaggccgttgtgctgcctacagtggggctggtctctccgatttcaatcaacctcagtgacatccagaatgtcctgaaggtggccgttgacggaaatgtcattagacaagtgttagaaaataatcaggccaacttagcttctaaagaacaggaaactatcaacgcaagcccgattcagcaagggggacactccgtgatctctgctatctcattaccactagtggaccaggatgggactacaaagattattatcaactatagtttagaacagccaagccagctgcaggtggtcccccagaacctgaaaaaggaaaatcctgtcgcaaccaactcttgtaagagcgagaaattgcctgaggatttgaccgtgaagagcgaaaaagataaaagtttcgaggggggtgttaatgactccacgtgtctgctgtgcgatgattgtccaggcgatattaatgctctcccggagttgaagcactatgacttgaaacagcccacccagcctccccccctccctgctgctgaagctgaaaagccagagtccagtgtctcaagcgcgactggcgacgggaatctctctccgtcccagcctccgctgaagaacttgttgagcttgctaaaggcttattatgcactcaacgcccagcctagtgccgaagagctgagcaagattgccgactctgtgaacctccctctggatgttgtcaaaaaatggtttgaaaaaatgcaagctggccaaatttccgtacaaagttctgaaccttcttccccggaacctgggaaagttaacattcctgctaaaaataacgatcagccacaatcagctaatgcgaacgaaccgcaggattccactgtgaacttacagagcccccttaagatgacaaactcacctgtcctgccagtcggctccaccacaaatggctcccggtcttccacgccctcaccttcaccacttaatctctcttctagccgtaacactcagggttatctctacaccgcagagggcgcgcaggaggagcctcaggtcgagccactcgacctaagcctgccaaagcagcagggcgagttgcttgaaagatctacaattacaagtgtataccagaatagcgtatatagcgttcaggaggaaccgctcaatctttcatgcgctaaaaaagaacctcagaaggattcttgtgtaactgattcggagccagtggtcaacgtcatccctcctagcgccaaccctattaacatcgccattccaactgtgactgcccaactccccactatcgtggctattgcagaccagaacagcgtgccatgtttgagggccctggccgccaataaacagactattctgatcccccaggtggcctatacttactcaacaactgtcagtcccgccgttcaggagcctcctctgaaggtgatccagcctaacggcaaccaggatgaacggcaggacaccagttcagagggcgtgtcaaatgtggaagatcagaacgacagcgacagcacgcctcccaagaagaaaatgcggaaaaccgaaaacggcatgtacgcctgcgatctgtgcgacaaaatttttcagaagtctagttctttgctacggcacaaatacgaacataccggtaaacggcctcacgagtgcggtatttgtaagaaggcttttaagcacaagcatcacctaatcgagcacatgcgtttgcacagtggggagaaaccatatcagtgcgataagtgtggcaaacggttttcgcactccggctcctactcccaacatatgaaccatcgctattcgtattgtaagcgggaggccgaggaacgtgattccacagagcaggaagaagccggacccgagattctgtcgaacgagcacgtgggcgcccgagcctcgccctcacagggtgattcggatgagagggagtctttgacccgagaggaggacgaggactctgagaaggaagaggaagaggaagataaggagatggaagagttgcaggaggagaaggagtgtgagaagcctcaaggggacgaggaggaggaggaggaagaagaagaagtggaagaggaggaggtggaagaagcagagaacgagggcgaggaagccaagaccgagggactcatgaaagatgacagggcggagtctcaggccagctccctgggtcagaaagtgggggagagtagcgagcaagtttctgaggagaaaaccaatgaagcttag

SEQ ID NO: 18145 - DNA, 3180 bp, Artificial Sequence
  Description of Artificial Sequence: Synthetic coding sequence
atggcagatggcccccggtgcaagagacgcaagcaagcgaaccccaggcgcaacaatgtcacaaattataacactgtggtggaaactaattccgactctgatgatgaagacaagctgcatattgtcgaagaggagtcggtgaccgatgccgcagattgcgagggagtgcctgaggacgatctgcctaccgatcagacagtgcttcctggacgttcctctgagcgtgagggaaacgcaaagaactgctgggaggacgatcgaaaggaggggcaggaaatcctcgggccagaggcccaggccgacgaggccggctgtaccgtgaaagatgatgagtgtgaatccgacgccgaaaacgagcagaatcatgacccaaacgtcgaggagtttctccaacagcaggatacagcagtgatttttccagaggctcccgaagaggatcagaggcaggggactccggaggcctcaggacatgacgagaacggcaccccggacgccttctcccagttgttaacttgtccctactgcgacagaggatacaagagatttaccagtctgaaagaacatatcaagtatagacacgagaagaatgaagacaatttctcttgtagtctgtgctcttacacctttgcttatagaacacagctagagcggcatatgacgagccacaagagcggcagagatcagcggcacgtcacacagagtggctgcaaccgaaagtttaagtgtactgaatgtggtaaagcattcaagtacaaacaccatctaaaagaacacctgaggattcatagcggggagaagccttatgagtgccctaactgtaaaaagagattctctcactctggttcctacagctcgcatatcagcagcaaaaagtgcattagcctgatccctgttaacggccgtcctaggacagggctgaaaacctctcagtgttctagcccatcactgtccgcatccccagggtcccctacgaggccgcaaatacgtcagaaaatcgagaacaaaccactgcaggagcaactatccgtgaatcagatcaagacggaacccgtagactacgaatttaagcccatcgtggtggctagtggaatcaattgcagcacaccgctgcaaaatggagtgttcaccggcgggggtccgcttcaagccacctctagcccccaggggatggttcaggcggtggttttgccaacagttggcttggtaagccctatcagcatcaatttgagcgatatccaaaatgtccttaaggtcgccgtcgatggtaacgtgattcgacaagtcttggaaaataatcaggcgaacttggcaagcaaggagcaggaaaccatcaacgccagcccaattcagcagggcggtcactccgttatctccgcgatctccctgccgctggtagatcaggatggaaccactaaaatcattatcaactattccctggagcaaccctcgcagctccaggtggtcccccagaacctcaagaaggaaaatccggttgctaccaattcttgcaaatccgagaagctacctgaagacctgaccgttaaatcggagaaagataagtcttttgaaggtggagttaatgactccacatgcctcttgtgtgatgactgcccaggggacattaacgctctaccagagcttaagcactatgatttaaagcagcccactcagccacctcctttgccagccgccgaggctgagaaacccgagtcatccgtgagtagtgctactggagatggcaatctctctcccagtcagcccccattgaagaacttgctgagtcttctgaaggcatactacgcgctgaatgcccaaccctcagctgaggaactgtctaaaatcgccgactccgtgaacctccccctcgacgttgtgaaaaaatggtttgaaaagatgcaggccgggcagatatcggtccagagctccgagccctcatctcccgaacctggcaaggtgaatataccggccaagaataacgaccagccccagtccgccaatgccaatgaaccgcaggacagtaccgtgaatctgcagtccccgcttaaaatgactaattcacccgtcttacccgtgggcagcacgacaaacggaagccggagttcaacaccatcccctagtccacttaatctctcaagttcacgaaacacacaggggtatctttacacagcagaaggcgcccaagaagagccacaggttgaaccactggacctgtctctgcctaagcagcagggagaactgttggaaagatcaaccatcacatcagtctatcagaattctgtttattctgtgcaggaggagcctctgaacctgagctgcgctaagaaagagcctcagaaagattcctgtgtgacagacagtgagcctgtggttaacgtgattcctccctcagcgaaccctatcaacatagccatcccaaccgtaacagctcagcttccgactattgtcgccatcgccgaccaaaacagtgtcccatgccttagggccctggcggcaaataagcagacaattttaatacctcaggtcgcttacacatactctacaactgtatcgccagctgtgcaggaaccacctcttaaggtcatccagcctaacggcaatcaggacgaacgccaggacacatcgagcgagggagtctcaaatgtggaagatcaaaacgacagcgactctaccccaccaaagaaaaaaatgcgcaaaactgaaaacgggatgtacgcctgtgacttgtgtgataaaatctttcaaaagagcagcagtttgctccggcataaatacgagcacaccgggaaacgaccacacgaatgcggtatctgtaagaaggcattcaaacacaaacaccatctcatcgagcacatgcggctgcatagcggggaaaagccctaccagtgcgataaatgtgggaagagattcagtcacagtggatcctacagtcagcacatgaaccatcggtattcttattgtaaacgggaggccgaggagagggactcaaccgagcaggaggaggcgggccccgaaatcctctcaaacgagcacgttggtgcccgcgcctctcctagccaaggagatagtgacgagagagaatcactcacacgcgaggaggacgaggatagcgaaaaagaagaggaggaggaagacaaggagatggaggaactccaagaagaaaagcataagaaaaagaaatag

SEQ ID NO: 18146 - DNA, 1932 bp, Artificial Sequence
  Description of Artificial Sequence: Synthetic coding sequence
atggccgatggacctagatgcaagagacggaagcaggccaacccgcggcgcaataacggtactcccgatgcgttttctcagttgctgacctgtccgtactgcgatcgagggtacaaaagattcacatctctcaaggaacacatcaaatatcgccacgaaaagaacgaggacaacttttcatgcagcttgtgttcttataccttcgcttatcggacccaactcgaacgtcacatgacgtcacacaaaagcggaagggatcaaagacacgtcactcagtcggggtgtaatagaaagtttaaatgtaccgaatgcgggaaagcattcaagtataagcatcacctcaaagaacacctgcgcattcattcaggggaaaagccttacgagtgccctaattgcaaaaagaggttttctcactcaggaagctacagctctcacatttcctccaagaaatgcatctctcttatccctgtaaacggtaggccccgtaccggattgaaaacatcccaatgcagctctccctccctttctgcatccccgggctcaccaacacgaccccagatacgacagaagatcgagaataaaccacttcaggaacagctgtccgtcaaccagataaagactgagcccgtcgattatgaatttaaacccatcgtggttgcctccggcattaactgctctacaccattgcaaaatggcgtgttcaccggcggcggtcctctgcaggctacatcgagtcctcagggaatggtgcaggccgtcgttctaccaaccgtagggctggtgtctcccataagtatcaatctgagcgacatccagaatgttctgaaggtagcggtggatggcaacgtgatccgccaggtacttgagaataaccaggcgaatctggccagtaaggaacaagagaccattaacgctagccccatccaacagggtggccacagtgtgatttctgcaataagtctaccgctcgtggatcaggatgggacaactaagatcataatcaattatagcctggaacagcccagccaactgcaggtcgtaccccagaatcttaagaaggaaaatcccgtcgcaacaaacagctgtaaaagcgaaaagctgccggaggatctcaccgtgaagtcagaaaaggacaagtctttcgagggcggcgtgaatgatagtacttgcctgctgtgtgacgactgtcctggagacataaatgcactgccagagttgaaacattatgatctgaagcagcctacacagccgccaccgctgccggccgccgaggccgaaaaaccggagagctcagtctccagtgcaactggtgacggtaacctctctccatcccagcctccactgaagaacctgctgtccttactgaaggcttactatgcacttaacgcccaaccatcagctgaggagctgtctaagatcgccgactcagtgaatttgcctctcgacgtggtcaagaaatggttcgaaaagatgcaggctggacagatctcggtccaaagctccgagccaagctcccccgaacctggaaaagttaacataccggcaaaaaacaacgaccagcctcagagcgccaatgcaaacgagccacaggatagcaccgtgaacttgcagtctccactgaagatgacaaattcgccagtcctgcctgtggggtctacaacgaatggaagccgatcttctacaccaagcccatccccactgaatttgtcttcctctcggaatacccaggggtatttatatacagcagaaggggctcaggaagagcctcaggtcgagccccttgacttgtctttacccaaacagcagggcgaggaggctaagaccgagggtctgatgaaggacgaccgagccgagtcccaggcgagttccctcgggcaaaaagtgggcgaatctagcgagcaggtgtccgaggaaaaaacaaatgaagcatag

SEQ ID NO: 18147 - DNA, 3174 bp, Artificial Sequence
  Description of Artificial Sequence: Synthetic coding sequence
atggccgatggccctcgctgcaagcgccgtaaacaggcaaacccaaggcgaaataacgggaaagaaggccaagaaatactgggcccagaagctcaggcagacgaagccggatgtacagtcaaggatgatgaatgtgaatctgacgctgagaacgaacaaaaccatgatcctaatgtggaggaattcttgcagcagcaggacaccgcagtaatattccccgaggccccggaagaagaccagcgccagggaaccccggaagccagtgggcacgacgagaatgggactcctgatgctttctcccaattgctgacatgtccatattgcgatcggggctacaaaaggttcactagcctcaaggagcatattaagtacaggcacgaaaaaaacgaagataatttcagctgtagcctatgttcctataccttcgcctatcgcactcagctggaaagacacatgacaagtcataaaagtgggagggaccagcggcacgtgacacagagcgggtgtaaccggaagttcaagtgcacggagtgcggaaaggccttcaaatacaaacaccaccttaaggaacatttgcggattcattcaggcgaaaagccatatgaatgcccgaactgcaagaaaagattttcacactctggatcgtactctagtcatatctccagcaagaaatgcatttcactgatccccgttaacggaagaccccgaacaggactgaaaacatcacagtgttccagcccctccctgtcagcgagcccaggaagccctacccgccctcagattcgacagaagatcgaaaacaaacccctgcaagagcaactatcagtaaatcaaatcaagaccgaaccagttgattatgagtttaaacccatcgtggtcgcctccgggataaattgcagcaccccgctccagaacggggtgttcaccggaggtggacctttgcaggctacaagcagtccccaagggatggtccaggccgtggtcttgcctaccgtcggcttagtgagccctattagcatcaatttgtccgatatacaaaacgtcctgaaagtcgctgttgacgggaatgtgatacgtcaggttctggagaataaccaggctaatttagcttccaaagaacaggaaacaataaacgcgagtccaatccaacaggggggtcatagtgtgatatccgccatctcactgccattggttgaccaggacggcaccactaagatcataattaactattctttggagcagcccagtcaactacaggttgtcccccagaacttaaagaaagaaaatccagtcgctaccaactcttgcaaaagcgagaaactgcccgaggacttaacagtgaaatccgagaaagacaagagttttgaagggggcgttaacgactctacatgcctcctctgcgacgactgtcccggagatataaacgcactccccgagctgaaacattatgaccttaagcagcccactcaacctccccctttaccagcagctgaggccgagaagcccgagtcttctgtatcaagcgccactggggacgggaatctgtccccttctcagccgccgcttaaaaacctcctgagcctgctcaaagcttactacgccctgaacgcccagccctctgcagaggagttgtctaagattgctgattcagtgaacctccctctggatgttgtgaaaaagtggtttgagaagatgcaagccggccagatcagcgttcaatctagtgagccaagctcgcctgaacctggcaaggtgaacattccagcaaagaataacgaccaaccccagtctgctaacgctaatgagccccaggacagcaccgtgaacttgcagtcgcccctgaagatgacgaatagtcccgtgttgcccgtaggctcaaccactaacggatctcgctcatctaccccttcccctagcccactgaacctttcaagctctaggaacactcaagggtatctgtataccgcggaaggagctcaggaggagcctcaggtggaaccccttgacctgagtctgcctaagcagcagggcgagttgcttgagagaagtactattacttcagtgtaccaaaacagtgtgtattctgttcaggaggagccgttgaatctatcctgcgccaagaaagagcctcaaaaggatagctgcgttacagatagtgagcccgtcgttaacgtgatcccccccagcgctaatccaatcaatatcgcgataccgaccgtcactgctcagctgcctactatcgtggcgatcgccgatcagaattccgtgccatgtctccgagctctggcggcaaacaagcaaacgatcttgatcccccaggtagcttatacttactctaccaccgtgtctcctgccgtccaggagcccccgctgaaggttatccagcctaatggaaatcaagacgagaggcaagataccagctccgaaggcgtctccaacgtggaggaccagaatgatagcgattctacaccccccaagaagaaaatgcgcaaaactgaaaacggcatgtacgcttgtgatttgtgcgacaagatctttcagaagagttcctccctgttaagacacaaatacgagcacacagggaaaaggcctcacgagtgcggtatctgcaagaaggccttcaaacacaagcatcaccttatcgagcacatgcggcttcacagcggagaaaaaccctatcaatgcgataagtgcggcaaacgtttcagtcactcaggtagctatagccagcatatgaaccataggtattcttactgtaaaagggaggcagaggagcgagattcaacagaacaggaagaggcaggtcccgagatcctctcaaatgaacatgtaggcgcccgagcctctcctagccagggcgattccgacgagagggagagcctgactcgcgaggaagacgaggactctgaaaaggaggaggaagaagaagataaagaaatggaggagctacaggaagagaaggagtgtgagaaaccacaaggcgatgaggaggaggaggaggaagaggaagaggttgaggaggaggaggtggaagaggcagagaatgaaggagaagaggcaaaaactgagggcctgatgaaggacgatagggccgagagccaggcatctagtttgggccagaaagtgggtgaatcaagcgaacaggtctccgaggagaagaccaacgaagcctag

SEQ ID NO: 18148 - DNA, 3048 bp, Artificial Sequence
  Description of Artificial Sequence: Synthetic coding sequence
atgatgaacgccagccaaatgcagaagatgtccaagactatgattttaatgttgaaaagcttctataataacaaaacactactgtcattctttctgcgccatttgaagcgcactcgtggaagggcacaccagaagccagtggtcatgatgaaaatggaacaccaaatgcactttcacaattacagccctgtccacatcgtaatcggctacaaacggtttacaagcctaaaagagcatattaagtatcgccacgaaaagaatgaggacaattttagctgctccctctgcagctacacttttgcctatcggacgcaattggagcgtcatatgaccagtcacaagagtggccgcgaccagagacatgtgactcagtccgggtgcaataggaaattcaagtgtacagaatgtggaaaagcatttaaatataaacatcatcttaaagaacatctccgcatccactctggtgaaaagccctatgaatgtccaaactgcaagaaacgtttctcgcactccgggtcttattcttctcacatctcttcgaagaagtgtataagccttatacccgtcaacgggagaccacgaactggactcaaaacaagccaatgctcttcgccctctctcagcgcttcccccgggtctcccaccaggcctcagatcagacaaaagatcgaaaacaagccactgcaggagcagcttagtgtgaaccagattaagaccgagcctgtggattacgaatttaaacccatagtggtagcttccggcatcaactgtagtactccactgcagaacggggtgttcaccggcggaggccccctccaggcgactagctcaccccaagggatggtgcaggcggtagtgctccctaccgttggactggtgagccctatctctatcaacttgtctgatatccagaatgtgctgaaggtggcggtggatgggaatgtcatcaggcaggtgctagagaataaccaggcaaatcttgccagtaaagaacaggagaccatcaacgcaagccctattcagcaaggggggcactctgtcatcagcgccatcagcctgcctctggtagatcaggacggcacaacgaagatcattatcaactattccctggagcagccatcacagctgcaagtcgtgccccaaaatttgaagaaggagaatccagtggccaccaactcgtgcaagtctgagaagcttcctgaagatttgacagtgaaaagcgaaaaagacaagtcattcgaaggcggagtcaatgacagcacgtgtctgctgtgcgatgattgtcccggagacataaatgcacttccggagctcaaacactacgatctgaagcagcccacacagcctcccccactgcctgctgcggaagcggagaagcccgagagcagcgtgagctcggctacaggagatgggaacttgagccctagtcaacctcccctgaaaaatctattgtctctgctgaaagcatactatgcactcaatgcgcagccctctgcagaagagttgtcaaagatcgcagactctgtaaacctccccctagatgtcgtgaagaagtggtttgaaaagatgcaggcaggccagattagcgtgcaatccagcgaaccctccagtccagaaccggggaaagtgaatattccagccaagaataatgatcagccccagagcgccaacgctaacgagccccaagatagcacagttaatctccaaagcccgctgaaaatgacaaattcaccagtgctccctgtgggttctacaaccaatggttctaggtctagcacacccagtccctcgcccctgaatctgagctcatcgcggaatacccagggatacctctacaccgccgagggcgcccaggaggagccacaggtcgaacctctagacttgtcgctccccaagcaacaaggagagcttcttgagaggagcactattacaagcgtgtaccaaaactccgtgtactccgtccaagaagagcccttgaacctatcctgtgccaagaaagagccgcagaaagactcttgcgtcacagattccgaacccgttgtgaatgtgatcccccccagcgcaaacccaatcaacattgcgatccctaccgtcaccgcccagttacctaccattgtggcaattgctgatcaaaactctgtgccttgcctgagggccttggcggccaacaagcagactattttgatacctcaagtggcttacacttacagtactactgtctcgcctgctgttcaggaaccaccattaaaagttatccagcctaacgggaaccaagacgaacggcaagacacatcgtccgaaggtgtctcgaacgtggaagaccagaacgacagtgatagcacccctcctaagaagaaaatgagaaagacagaaaatggcatgtacgcctgcgatctgtgtgataagatttttcaaaagagctcatcattattacgccacaaatatgagcacaccgggaagagaccccatgagtgcgggatatgcaagaaggccttcaagcataagcatcatctgatagagcacatgcgtcttcacagcggagagaagccctatcagtgtgataaatgcgggaagcgatttagtcacagtggcagctactcccagcacatgaatcatcggtatagttattgcaagcgcgaagcggaagagcgagactcaaccgaacaggaggaagctggtcccgagatcctctcaaatgaacacgtaggagccagggcctcccctagccagggcgacagcgacgagcgcgaatccctgacccgcgaggaggacgaagactctgagaaagaagaagaggaggaggacaaggagatggaagagctgcaggaagagaaagagtgcgaaaagccccaaggggatgaggaagaggaggaggaagaggaggaggtcgaggaggaggaggtcgaggaggccgagaacgagggcgaagaagccaagaccgaaggattaatgaaagacgacagggctgagtcccaggcatcctctctgggacagaaggttggcgagtccagtgagcaggtttccgaggagaaaacaaacgaggcttag

SEQ ID NO: 18149 - DNA, 3360 bp, Artificial Sequence
  Description of Artificial Sequence: Synthetic coding sequence
atggcagacggccctaggtgcaaacgccggaaacaggccaatcctcgtcgtaataatgtgacaaattataatactgtggtggaaaccaattctgactctgatgatgaggataagctgcacattgtggaagaggaaagcgtgaccgatgctgccgactgcgaaggtgtcccagaagatgacctgccaaccgatcagacagtccttcctggacgaagcagtgagagggaagggaacgcaaagaattgctgggaggacgaccggaaggaagggcaggaaatcctaggtcccgaggctcaagctgatgaggccggatgtacagttaaagacgacgagtgcgagtctgatgcagaaaacgaacagaatcacgacccaaatgttgaggaatttctgcaacagcaggacacagctgtcatattccccgaggcccccgaggaggatcagagacagggaacacctgaggcctctggccatgacgaaaacggcacaccggatgctttcagccagcttctgacctgcccgtattgcgacagagggtacaaaaggttcacgagcctgaaggagcatatcaagtataggcatgagaaaaacgaggacaactttagctgctccctatgctcttatacgttcgcttatcggacccagcttgagcggcacatgacatcacacaagtccggacgcgatcaaagacacgtgacacagagcggctgtaacagaaaatttaaatgtaccgaatgcggtaaggcgttcaagtataagcaccacctgaaggaacacttacgcatccattccggcgagaagccgtatgagtgccccaactgcaaaaaacggttttcccactcaggcagttacagtagccatatatcctccaaaaagtgcattagcctgatacccgtgaacggaaggccacgaacgggactgaaaactagtcagtgcagcagtccatctctatccgcttccccagggagcccaaccaggcctcagatcagacagaagattgaaaataaacccctgcaggaacagctaagtgtaaatcagattaagaccgagccagtcgactacgagttcaaacccatcgtcgtcgcctccggaatcaactgctccacacctctgcagaacggcgtgtttacaggcggtggcccgctgcaggctaccagttccccacaaggcatggtccaggccgtagtgttaccgaccgttggactggtgagccccatttcaattaatcttagtgatattcaaaatgtactgaaagtcgcagtggatgggaacgtgattaggcaagtgctggagaacaaccaggcaaacctggcctcgaaagagcaagaaaccattaatgcaagccctatccagcagggtggccatagcgtaatttctgccatctcccttcctctggtggatcaagacggaactacaaaaatcattataaactacagtctggaacaaccaagtcaattacaagtggttccgcaaaatcttaagaaagaaaatccagtcgccaccaactcctgcaagtcagagaaactgcccgaagatctaacagtgaaatccgaaaaggataaaagcttcgaagggggagtgaacgattctacctgcctcctatgcgacgattgtccaggcgacatcaatgctctgcccgagctgaagcactacgatcttaagcaacctacacagcctccacctctgcctgcagctgaggcggagaagccagagagctccgtgtcttctgcaaccggcgatggcaacctctcccccagtcagccacccctgaaaaacctgttatctctgctgaaagcctactatgccctcaatgcccagccctctgccgaggaactgtccaagattgctgactccgtcaacctgcctctcgatgttgttaaaaaatggtttgagaaaatgcaggctggacagatctcggtccagtcctctgagccttcctcaccggagccaggcaaggtgaacatacctgctaagaataacgaccagcctcagtctgcaaacgccaatgaaccacaggattctacagtgaacctgcagagccccctgaagatgacaaactcacctgtgttgcccgtagggtccacgaccaatggaagtcggtcctctaccccttccccctcaccccttaacctctcatcgtcgcgtaacacccaaggttatctttatacggctgagggagcccaggaggaacctcaggtcgaacctttagatctttcgctccccaaacagcagggggagctgctagagaggagcagcctgccggaacagtgcttgttttgcccaggtaggacattagagcttgtcttaaaaaaagagccacagaaagactcatgtgtcacggactctgaacctgttgtgaatgtgataccaccctcagctaatcccattaacattgcaattccgactgtaacagcccaattgcctacgattgtcgcgatcgcagaccagaatagcgtgccctgcctgagggcactggccgctaacaagcagacaatcttgattcctcaggtggcctatacttattccaccaccgtgtcgcctgccgtgcaagagcccccattgaaagtgatccaaccgaacggcaatcaggacgagcggcaggatacctcaagcgagggagtttcaaacgttgaagaccaaaatgactctgattctactccccctaagaagaagatgaggaagacagagaatggaatgtatgcatgcgatctgtgtgataagatattccagaaaagtagctcactgcttcgccataagtatgagcacacgggaaagcggccacacgagtgtgggatttgcaagaaggcattcaaacataaacaccacctgatagaacatatgcgcctacacagcggagagaagccttatcagtgcgacaaatgtggaaaacggttctcccactctggcagctattcccagcacatgaaccatagatatagctattgcaaacgggaagctgaggaacgcgactccaccgagcaggaagaggcaggacctgaaatcctgtccaacgaacacgtgggcgcgcgggcctcgccatctcagggagattcggatgagagagagtctttgacccgggaggaggacgaggatagcgagaaggaggaagaagaagaggataaagaaatggaggaactacaggaggaaaaggaatgcgagaaacctcagggagatgaggaggaggaagaagaggaggaggaagttgaagaggaggaggtcgaagaggctgaaaacgaaggcgaagaggcaaagacggaaggacttatgaaggatgatcgcgccgagtcacaagcctccagcttgggtcagaaagtgggtgaatcttctgaacaggtgagcgaagagaagactaacgaagcctag

SEQ ID NO: 18150 - DNA, 834 bp, Artificial Sequence
  Description of Artificial Sequence: Synthetic coding sequence
atgaaggtcactaactacaacaccgtggtggagacaaatagtgattccgacgacgaggataagttacatatcgtcgaagaggaaagtgtgaccgacgcagccgactgtgagggcgtgccagaagatgatctgcccacagaccaaacggttctgccaggtcgaagttccgaacgcgagggcaacgctaaaaactgctgggaagacgatactggtaaggagggacaggagatccttggccccgaggcacaagccgacgaagccggatgtaccgtaaaagatgatgaatgtgaatctgatgccgaaaatgagcagaatcacgaccctaacgtggaggaattcctgcagcagcaggacaccgcagtcatctttcctgaggcacctgaagaggaccagagacaaggtacacctgaggcatcgggccacgatgaaaacggcacgcccgatgctttttcacagctgttgacatgtccctattgtgaccgagggtataagcgcttcacctcactcaaagagcacataaagtacaggcatgagaagaatgaggacaattttagctgctctctctgctcttataccttcgcctataggactcagctggaacggcacatgacatcacacaagtcaggccgcgaccaacgacacgtcactcaatcaggttgcaaccgcaagtttaaatgcacagagtgtgggaaagccttcaaatacaaacaccatcttaaggagcacctgcggattcactctggagagaaaccctatgaatgccccaattgtaagaagcgtttttctcactccggctcatactcctctcatatctcatccaagaagtgtatatag

SEQ ID NO: 18151 - DNA, 3315 bp, Artificial Sequence
  Description of Artificial Sequence: Synthetic coding sequence
atggcggacggaccaaggtgcaaacgaaggaagcaggccaacccccgtcggaataacgtgaccaactacaacacagtggtcgagacaaactccgactcagatgatgaggacaaacttcacatagtagaagaagaatctgtgactgacgcagctgactgcgagggggtgcccgaggacgacttacccactgaccaaacagtgcttcctgggcggagctccgagcgcgaagggaacgccaaaaactgttgggaggacgacatcaaggacgatgaatgcgagagcgacgccgaaaacgaacagaaccatgaccccaacgtcgaggagtttctgcagcagcaggacaccgctgtgatcttcccagaagcgcccgaggaggatcagcggcaagggaccccagaagcaagcgggcacgacgaaaacgggacacccgacgcgttctctcagctactcacttgcccatactgcgacaggggctataaacgttttacatctctaaaggaacacatcaagtatagacatgaaaagaatgaagataatttttcctgcagcttatgctcatatacattcgcctacagaacacaattagagaggcacatgacatctcacaagtcaggaagggatcagagacacgtgactcagtcagggtgtaaccgcaaatttaaatgcaccgagtgcggtaaagcatttaagtacaaacatcatctgaaggaacaccttcggatacactctggggaaaagccttacgagtgtcctaattgcaaaaagcggttttcacacagcggctcctactcaagccacattagcagcaagaagtgtatctctctgatacctgtcaatggccggcctaggaccggtttaaagaccagccagtgttcctcccctagtcttagtgccagcccaggtagtcctacgcgaccccagatccgccagaagatcgagaataagccgctacaggagcagttgtccgttaatcaaataaagacggagccggttgattatgagtttaaacctatcgtggttgcttctgggatcaactgctccacaccacttcagaatggagtgtttaccggtggaggcccactccaagccacaagcagcccccagggaatggttcaggctgttgtgctgcctaccgttggactggtgagcccaatttccattaacctgagcgatattcagaatgtgttaaaggtggccgtggatgggaacgttatccgccaagtgctggagaacaatcaagcaaatctggccagtaaggagcaggaaaccattaatgcctcccccatccagcagggggggcattcagtaatcagtgctatttcactgccactcgtggatcaggacgggacgacaaaaatcatcataaactattctcttgaacaacctagccagcttcaagtcgtgcctcagaatctgaagaaagagaaccctgttgccactaactcctgcaagagcgaaaaacttccagaggatctgactgtcaaatccgagaaggacaagtcatttgaaggcggtgtcaacgactctacatgcttgctgtgcgatgactgtcccggtgacatcaacgccctgccagaactgaaacactacgatcttaagcaacctacacagcctcctccactcccagctgcggaggcagagaaacctgagagctctgtgagctccgccaccggagatgggaatctgtctccctctcagccgccactgaagaacctactctctttactgaaggcctactacgcactcaacgcacaaccaagcgccgaggagctctctaagattgccgattcggtgaacctgcctctcgacgttgtgaaaaaatggtttgaaaagatgcaagctggccaaatctcagtccaatcttccgagcctagctcccctgaacccggcaaagtgaacatcccagcaaaaaataacgatcagccccagtcagcaaacgctaacgagccccaggacagtacagtgaacttacagtcccccttgaagatgactaactcaccggtactaccggtggggtccactactaacggaagccggagcagcactccatctccaagccctctgaacctgtcatcaagccggaacacccagggctatttgtatactgccgagggggctcaggaagagccgcaggttgaaccccttgacctcagcttgcccaaacagcagggggagctactggagaggagcacaataacaagcgtgtaccagaattcagtatatagcgtgcaggaggaaccccttaacttgagctgcgccaagaaagagcctcagaaggattcctgcgtcaccgactccgagcctgtcgtgaatgttattcctccaagcgctaatcctatcaatatcgccattcccacagtaactgcgcagctgccaacaatcgtggctatcgctgatcagaatagcgtgccttgtttgcgcgctctggcggctaacaaacaaactatcctcatcccccaggtggcttacacttactccacaacggtgtctccggcagtacaagagccacctctcaaggtgatccagccaaatggcaatcaggacgagcgccaagatacaagctccgagggggtgtccaatgtcgaggatcagaatgactctgatagcacaccccctaagaaaaagatgagaaaaacagagaatgggatgtatgcctgcgatctatgtgacaagatctttcaaaaaagcagttcgctgttaagacacaagtacgagcacacaggtaagcgcccccatgagtgcggaatttgtaaaaaggccttcaagcacaagcaccatttaatcgaacacatgagactgcacagcggtgaaaaaccatatcaatgtgacaaatgtgggaagcgtttctcccactcgggatcttactcccagcacatgaaccaccgctattcctattgtaagcgcgaggctgaagagagggacagcaccgagcaagaagaggccggacccgagatcctctccaatgaacacgtgggagcccgggcgtcccctagtcagggcgacagcgatgaacgcgagagtctcacacgcgaggaagatgaggactccgaaaaggaggaagaggaagaagataaggagatggaagaactgcaggaggagaaagagtgcgagaagccccagggtgacgaggaagaagaggaagaggaagaagaggtcgaagaagaagaagtggaagaggccgagaatgaaggtgaggaagccaagacggagggcctcatgaaggatgatagggcggagtctcaagcatcctctttgggacagaaggtcggagagagctccgaacaggtgagcgaggagaaaaccaatgaggcttag

SEQ ID NO: 18152 - DNA, 3645 bp, Artificial Sequence
  Description of Artificial Sequence: Synthetic coding sequence
atgaaacaacccattatggcggatggaccccggtgtaaaaggcggaagcaagcaaatcctaggaggaagaatgtcgtcaactatgacaacgttgtcgataccggctccgaaacagacgaggaagacaaacttcacatcgcagaagacgacgggatcgcaaatccgttagatcaagagacatcacctgccagcgtccccaatcatgagagcagccctcacgtctctcaggcattgttgcctcgtgaagaagaggaggatgaaataagggagggtggtgtggagcatccttggcacaacaacgagatcctccaggcttctgtggatggacccgaagaaatgaaggaggattatgataccatgggacccgaggctacgatacaaaccgccatcaataatgggaccgtcaagaacgcaaattgtacaagcgactttgaagagtacttcgccaaaagaaagctggaagagcgagacggacacgccgtgagtatcgaagaatacctgcagaggtccgacaccgccatcatctacccagaagcccctgaggagctttccagattgggtactccagaggcaaacggccaggaggaaaacgatttgcctcccgggacgcctgacgcctttgcacagttgctcacctgcccctactgcgatcgcggttacaaacgactcacttcgctgaaagagcacatcaagtaccgacatgaaaagaatgaagaaaacttctcctgtcctttgtgttcatatacatttgcgtaccgcacacagctggagcgacacatggtgacgcacaaacccggaaccgaccaacaccagatgttaacccaaggtgccggtaatagaaaatttaaatgcactgaatgcggtaaggccttcaagtacaagcaccatctgaaagagcatctgagaatccatagcggggaaaaaccgtatgagtgtcccaattgcaaaaaacgctttagccactctgggtcatacagcagccatatatccagcaagaaatgcattggactgataagcgtgaatggacgaatgagaaataatataaaaacgggatcttcacctaacagcgttagcagttccccaactaacagcgccatcactcagttaagaaataagctagaaaatggtaagccactgagcatgtctgaacaaacgggacttctcaaaatcaagactgagccattggatttcaatgattacaaagttctgatggctacccatggatttagtgggacctctccctttatgaacggcggcttgggagcgacctccccccttggcgtgcacccgtccgcccagtcgccaatgcagcacctcggcgtggggatggaagctccgttgctaggcttcccaaccatgaacagcaacctctcggaggtccaaaaggttctccagatcgtggataataccgtttcccgccaaaagatggactgtaaagccgaggagattagtaaactgaaaggttaccatatgaaagacccttgttctcagccagaagagcagggggtgacctcccctaacatccccccggtggggctccctgtcgtgtcacacaacggcgccaccaaatcgatcatcgactatactctcgaaaaggttaatgaggcgaaagcgtgtcttcagagcctcacaacggactcacggcgccagatatctaacattaagaaggagaagttgaggacactgatagatctggtgaccgatgacaaaatgattgaaaaccataacattagcacaccgtttagctgtcagttttgtaaagaaagtttccctggccctatccctctccaccaacacgaacgatatctgtgtaaaatgaacgaagagatcaaggccgtgttgcagcctcatgagaacattgtgccgaacaaggcaggggtgtttgtggataataaggctcttctcctgtcttccgtgctatctgagaaagggatgacctctcctatcaatccctacaaagatcatatgagtgtcctcaaagcctactacgctatgaacatggaaccaaattctgatgagctcttaaagatttcgatcgctgtggggttgcctcaagaattcgtcaaggaatggttcgagcagcgcaaagtgtaccagtactcgaatagcaggtcccccagtctagagaggagcagtaaaccgctcgctcccaacagcaaccctcctaccaaagattccctgctcccacgcagccccgttaaacctatggactctattaccagtccctcaattgccgaactgcacaacagcgtaaccaactgcgaccctcctctgaggttaacaaaaccatcacatttcactaatatcaaacctgtcgagaaactggaccacagtaggagtaacacaccctccccgttgaacttgtcaagtacttcatctaaaaacagccactccagttcttacacacccaattcatttagtagcgaagaattacaggctgagcctttagatttaagtctgccgaagcaaatgaaggagcccaagagcatcatcgcaacaaaaaacaagaccaaagcaagcagtatttctctcgaccataacagcgtgtctagcagctccgaaaactctgacgaacctcttaaccttactttcattaaaaaggagttcagtaactccaataaccttgataacaaaagcaccaaccccgtcttcagcatgaatcccttttcagccaaacctctgtatactgcgctgcccccacaaagtgccttcccccccgcgacgtttatgccccccgtccagacttccataccgggtctccgcccctacccgggcctagatcagatgtcattcctgcctcatatggcatacacttatccaacaggagctgccacatttgcagacatgcagcagcgcaggaagtaccagcggaagcaagggtttcagggcgaacttctggatggcgcgcaggactacatgtctggcctcgatgacatgaccgacagcgacagttgcctgagccgaaaaaagatcaagaaaaccgagtctggaatgtacgcatgcgacctctgcgacaagacttttcaaaagagttcctcactgctgagacacaagtatgaacatacaggcaaacgcccacatcagtgccagatttgtaagaaggctttcaagcataaacaccatctcatcgagcattctagactccactctggcgaaaagccctatcagtgcgataagtgcgggaaaaggttttcccactcgggcagttactcgcagcacatgaatcataggtactcctattgtaaaagagaagcagaggagcgggaagccgccgagcgggaggccagggagaagggtcatttggagcctaccgaactactgatgaatcgggcttatctgcagtcaatcactccccaggggtattctgactctgaggagcgagaatccatgccgcgcgatggcgagtccgaaaaggaacatgagaaagagggcgaggacgggtacggcaagctgggacgccaggatggcgacgaagagtttgaggaagaggaggaggagagcgaaaataaaagcatggataccgatcccgaaacaatcagagatgaagaggaaacaggcgaccacagcatggacgactcttcggaagacgggaaaatggagaccaaaagcgatcacgaagaggacaatatggaggatggcatgtag

SEQ ID NO: 18153 - DNA, 1275 bp, Artificial Sequence
  Description of Artificial Sequence: Synthetic coding sequence
atggctgatggtcctagatgcaagagaagaaagcaggccaatccccgcaggaaaaatgtagtgaactacgataacgtggtcgacacaggctctgaaacagatgaagaagataagttgcacattgccgaagacgacggcatcgccaatcctttagatcaggagacgtctccggctagtgtcccaaatcacgaaagctctccgcacgtgagtcaggctcttctaccccgggaggaagaggaagacgagattcgggagggaggagtggaacatccttggcacaacaacgagattctgcaagcatcagttgacggcccggaggaaatgaaggaggactacgatactatgggccctgaagctacaattcagaccgcaattaacaacgggaccgtcaagaatgcaaattgcacatccgatttcgaggagtacttcgccaagcgaaagttggaggaacgcgacgggcatgcggtgtcgattgaggaatatctgcaacggagcgatactgctataatctatccagaagctccggaggaactcagccgactggggacacccgaggccaacggccaggaggagaacgacttaccgccaggaactcccgacgcctttgctcaactgctgacttgtccctattgcgatagaggatacaaacgcctcacctccttgaaggaacatatcaaatatcggcatgaaaagaatgaagagaatttttcttgtcctctgtgttcctacactttcgcctatcgaacccagcttgaacgccacatggtgacacacaaaccgggaactgaccaacatcagatgctcacacagggggctggaaaccgcaagtttaaatgcaccgaatgtggaaaagcctttaagtacaaacaccaccttaaggaacacctgcgcattcacagtggcgagaaaccatacgaatgcccgaattgtaagaagcggttctctcacagcggcagttatagtagtcacatctcgagcaagaagtgtatcggccttatcagcgtaaatggtcgcatgcgcaacaatattaagacaggcagcagtccaaattccgtgtcatcatctccaaccaactcagccattacccagttacgtaacaaattagagaacgggaaacccctgagcatgagcgagcagaccggactgctgaagtccgggcgtgcacagtggctgaccccactaattcccgctctgttagaggccgaagtagggcgctcccgcggtcagaaaatagagacccttctggcaaacatggttgaacctcgcctgtattag

SEQ ID NO: 18154 - DNA, 1320 bp, Artificial Sequence
  Description of Artificial Sequence: Synthetic coding sequence
atgaaacaaccaatcatggccgatggcccccgctgcaagcgaagaaagcaagcaaatcctcgtcgaaagaacgtcgtcaactacgataacgtcgttgataccggaagcgagaccgacgaagaggataaactccacatagccgaagacgacggaattgccaacccactggaccaggaaacatctcccgctagcgtcccaaaccacgaaagctccccccacgtgagtcaggccctcctccccagggaggaggaggaggacgaaatcagagagggcggggttgaacacccatggcacaacaatgaaattcttcaagcctcagtcgatggacctgaagagatgaaggaagattacgacaccatggggcctgaagccaccatacagaccgccatcaataacggcacggtgaagaacgcgaactgcacttccgattttgaagagtattttgccaagcgtaaattggaggaaagggacggccacgcagtatctatagaggagtacctgcagagatccgacactgcaatcatttacccggaggctcccgaggagctctcacgcttgggaacccctgaggcaaacggccaggaggagaatgaccttcctccgggcactccagatgccttcgctcagctgttaacttgtccctactgtgaccgtggctacaagcgattgacgtccctaaaggaacacattaaatacagacacgagaagaatgaggagaacttttcttgcccattatgctcctacacattcgcatatagaacccagctcgaacggcacatggtgactcataagccagggacggatcaacaccagatgcttacgcagggggcagggaatagaaagttcaagtgtaccgagtgtggtaaagctttcaagtacaagcatcatctgaaggagcatttgcggatccactcaggggaaaaaccctatgagtgtccaaattgcaaaaagcgattcagtcattccggttcctattcctcccatatttcgtctaagaagtgtatagggttaatatctgtaaacggacgtatgagaaacaacatcaagacggggtcgtctccaaattcagtgtcttcgtccccgacaaattctgccattacgcagctaagaaataagctggaaaacggaaagccactgtcgatgagcgagcagactgggctgctgaagattaagactgaacccttagatttcaatgattacaaggtactgatggccacccacggattttccggcacatcacctttcatgaacggtggtctgggagccacaagccccctaggagttcacccaagcgcacagtcacccatgcaacacttgtag

SEQ ID NO: 18155 - DNA, 408 bp, Artificial Sequence
  Description of Artificial Sequence: Synthetic coding sequence
atgaagcagcctattatggctgatggtcccagatgcaagcgccgaaaacaagctaacccacggcgcaaaaacgtggtgaattatgacaacgtagtagacaccggcagtgagacagatgaagaggataagctccacattgcagaagacgacggcatcgccaaccctctcgaccaagagacatcgccagcctctgtccctaaccatgagagtagccctcatgtgtcccaggccctgctccctcgcgaggaggaagaggatgagatacgcgagggcggtgtagagcacccctggcacaataacgaaattctgcaggcgtctgtggatggtccagaagagatgaaggaggactatgacacgatgggtcccgaggctactattcagactgcaatcaacaatggaactggatag

SEQ ID NO: 18156 - DNA, 3645 bp, Artificial Sequence
  Description of Artificial Sequence: Synthetic coding sequence
atgaagcaacccattatggctgacggaccacgttgtaagcggagaaagcaggctaatcctcgccggaaaaacgtggtgaactacgacaatgtggtagatactggctctgaaacagatgaggaggacaaattgcatattgctgaggacgatgggattgctaatccgctggaccaggagacctcacctgcctccgtgccaaatcatgagtcctcaccacacgtgtctcaggcactattgcctcgggaggaggaggaggacgagattagagagggaggtgtggagcatccatggcataataatgagatccttcaggctagtgttgatggtccggaggaaatgaaagaagactatgacaccatggggccggaggctacaattcagaccgccatcaataacggtaccgtcaaaaacgcaaactgtacgtctgatttcgaggagtattttgccaagcgaaagttagaggagagagacggccatgccgtctcaatcgaggagtatctgcaacgcagcgatactgccattatctatccggaagcaccagaggagctgtcacgtctaggtacaccagaggctaatgggcaagaggagaacgacctgccccctgggacacccgacgcatttgctcagttgctgacatgcccatactgtgaccggggctataagcgcctgactagcctgaaagagcatatcaagtatagacacgagaaaaacgaagagaacttttcgtgcccgctgtgctcatacacctttgcctatcgcacgcaactcgaaaggcacatggtgactcacaagccaggcacagatcagcatcaaatgctgacccagggcgctggcaacagaaagtttaaatgcacagaatgtggtaaggctttcaaatataagcatcacttgaaagaacatctgcggatccattcgggtgagaaaccctacgaatgtcctaattgtaagaagcggttcagccatagcggtagttattccagccatatatcctcaaaaaagtgcatcggcctcatttccgtaaacggtcgcatgaggaataatatcaagaccgggagttcccctaactccgtatcgtctagccccacgaactccgctattacccagctgagaaacaaactggagaatggtaaacccctgtctatgagtgagcagacgggcctgctaaagatcaagacagagccgctcgatttcaatgactacaaagtactcatggccactcacgggttctcagggacctccccttttatgaacggcggtttgggagccacaagcccccttggggtacacccgagcgcccagtcaccaatgcagcacctcggagtgggaatggaagcacctcttctaggcttcccaactatgaatagtaatctctcggaagtgcagaaggtgctgcagattgtagacaatactgtttcacgtcagaaaatggactgtaaggctgaagaaatctccaagctcaagggttaccacatgaaggacccctgctcccagccagaggaacaaggcgtcacttccccaaacattccacctgttggattaccagtggtctctcataacggcgccacaaagtcgatcattgactacactctcgaaaaggttaacgaggcaaaagcctgcctgcagagtcttacaacagacagccggaggcagattagtaacatcaagaaggagaaattgaggaccctgatcgaccttgtgacagatgacaagatgatagagaatcacaacatcagtaccccgttttcctgtcagttttgtaaggaaagttttccgggcccaattcctctccatcagcatgagcggtatttatgcaagatgaatgaagagattaaggccgtgctgcagccccacgagaatatcgtaccaaataaggctggggttttcgttgacaacaaggctctacttctgtctagcgttcttagcgaaaagggcatgactagtccaatcaacccatacaaagatcatatgagcgtgctgaaggcctactacgcaatgaatatggaacctaatagtgacgagctactcaagataagcatagcggtgggcctgcctcaggaatttgtaaaggaatggtttgagcagagaaaggtctatcagtatagcaactccaggtccccgagcctggagcgaagttctaagcctcttgcccctaacagcaatccaccaactaaagatagtctcctgcctcggagccctgtcaaaccgatggacagcattaccagccctagtatcgctgagctgcataactctgttacaaactgcgacccaccactcaggttaaccaagccatctcactttactaacatcaagccagttgaaaaacttgaccactcaagatctaataccccaagcccccttaacctgtccagtacatcgtctaagaactcacactcgtcctcatacacgcccaattcattcagcagcgaagaattgcaggccgaacctttggatctcagtctacctaagcaaatgaaagagcctaagagcatcatagccaccaagaataaaacaaaggcttctagcatctcactcgaccataattccgtatcgagcagttccgagaacagcgatgaaccgctgaacctcacctttattaagaaggaattcagcaattctaacaacttggacaacaagagtactaatcccgtgttctctatgaacccctttagcgccaaacccctgtatacagccctccctccgcagagcgctttcccaccagctacttttatgccgcccgtgcaaacatcaatccctgggctgcgaccgtatcccggcctggaccaaatgtcgttcctcccccatatggcctacacctaccctaccggcgccgccactttcgccgacatgcagcagcgtcgcaaataccagcgaaagcaaggatttcaaggagagctgcttgacggggcccaggactacatgagcggtctggacgacatgacagatagtgattcttgcctgtccaggaaaaaaatcaagaaaacggagtccggcatgtacgcatgtgatctgtgcgacaagacttttcagaaatctagctcactccttagacataaatacgagcacaccggaaagcgccctcatcagtgccagatttgcaaaaaagctttcaaacacaaacatcacctgatagagcattcaaggcttcactccggtgagaaaccctaccagtgcgacaaatgtggcaagcggttctctcacagcgggagctacagccagcatatgaaccacaggtactcctactgcaaacgggaggctgaagagcgcgaagctgctgagagagaagccagggaaaagggccatctcgaacccacagagcttctcatgaacagggcttacctgcagagcatcacccctcagggttactctgactcagaggagagggagtcaatgcccagggacggtgagtctgagaaggagcacgaaaaggaaggggaggatggatacggcaaacttggccggcaagacggggatgaggagttcgaagaagaggaggaagagtccgaaaataaaagtatggacaccgatccggagactattcgcgatgaggaagagacaggtgaccattccatggatgactcatccgaggacgggaaaatggagacaaaatctgatcacgaggaagacaacatggaggacggcatgtag

SEQ ID NO: 18157 - DNA, 2109 bp, Artificial Sequence
  Description of Artificial Sequence: Synthetic coding sequence
atgaaacagccgattatggcggacggtccaagatgcaagcggcgaaaacaagctaaccctcgtcggaaaaacgtagttaattacgacaatgtcgtggatacaggaagtgagaccgacgaggaagataaactgcacattgcagaagacgatggtatcgctaacccactggatcaggagacctcccccgcctcagtcccgaatcacgagagcagtccccacgtatctcaggccctgctgccccgtgaggaggaagaggatgaaatcagagagggaggcgtagaacacccctggcacaataacgaaatattgcaggcatccgtggacgggcccgaagagatgaaggaagactatgacaccatgggccccgaagccaccatccagacagcaatcaataatggtaccgtcaaaaacgctaattgcactagcgactttgaagagtactttgctaaacggaaacttgaggagcgtgatggtcatgccgtctccatcgaagaatacttacagagatctgataccgctattatctacccggaagctcccgaagagctgtcccgtctcggaacaccggaggcaaatggccaagaagagaacgacctgccgcccggtacccctgacgcctttgctcagctgctgacatgcccttattgtgaccgcggatataaaagactgacaagcctgaaagagcatatcaaatatcgacatgaaaagaatgaggaaaatttcagttgccctctgtgttcttacacattcgcttataggacgcagcttgaacggcatatggtcacacacaaacccggaacagaccagcatcagatgctaacccaaggcgccggaaatcgaaaatttaagtgcacagagtgcggtaaagcatttaaatacaaacatcatctgaaagaacacctcagaattcacagtggggagaaaccatacgagtgtcccaattgcaagaaacggttctcacacagcggctcctatagctctcacatctcatctaaaaagtgtatcggactcatttccgtgaatggacggatgagaaataacattaaaaccggaagttcacctaattctgtgagctcctccccaaccaattccgccattacacaactgcgaaacaaattggaaaatggtaaaccactcagtatgtctgaacaaaccggtctcctgaagatcaaaactgagcctctcgattttaatgattacaaagtgctgatggccacacacggcttctccgggactagcccattcatgaacggtgggctgggagctacctcacccctaggtgtccacccttcagctcagagcccaatgcaacatttgggggttgggatggaggcccctctcctgggattccccactatgaacagcaacctgtctgaggtgcagaaggtgcttcagatcgtcgataataccgtcagcaggcagaaaatggattgtaaagcggaggagattagcaagctgaaaggataccacatgaaagatccctgttctcagcctgaggaacaaggggttactagcccaaatattccccctgtgggcctccctgtcgtctcccacaatggggccaccaagagcatcatcgactataccctcgagaaggtgaatgaagccaaggcgtgcctgcagagcctgactacagattcacgaagacaaatcagcaacattaagaaagagaaattgagaacacttatcgatttggtcacagatgataagatgatcgaaaaccacaatattagcacccccttctcatgccaattctgtaaggagagcttccccgggcccatcccacttcaccagcacgaaaggtatttgtgtaaaatgaatgaagaaatcaaagccgtgcttcaaccccatgagaacatcgttccgaataaagccggggtatttgtggataacaaagccctgttactgagtagcgttctttcagaaaagggaatgacatctccaatcaacccttacaaagatcacatgtcagtgctcaaggcctactacgctatgaacatggaaccaaatagtgatgagcttctgaaaatttctattgccgtcgggcttccccaggagtttgtgaaagaatggttcgaacagcgaaaagtctatcagtatagtaactag

SEQ ID NO: 18158 - DNA, 276 bp, Artificial Sequence
  Description of Artificial Sequence: Synthetic coding sequence
atgaagcaaccgatcatggctgacgggcctaggtgtaagcgacgcaagcaagccaaccctaggcgtaaaaacgtcgtgaactatgacaacgttgttgatactgggtccgaaaccgacgaagaggacaaactgcacatcgccgaggacgacgggattgctaaccccttggatcaagaaaccagcccagctagcgttcctaatcatgagagcagcccccacgtgtcccaggcactgctgcctagagaagaagaggaggacgaaattcgggaaggatag

SEQ ID NO: 18159 - DNA, 192 bp, Artificial Sequence
  Description of Artificial Sequence: Synthetic coding sequence
atgaaacaacccatcatggctgacggccctaggtgcaagagaaggaaacaggcaaacccacgcagaaaaaacgtagtgaactacgacaacgtcgtggacacaggtagcgagacagacgaggaggataagcttcacatcgcagaggacgatggaatcgcgaaccctctagatcaggagacttctccagcttag

SEQ ID NO: 18160 - DNA, 3573 bp, Artificial Sequence
  Description of Artificial Sequence: Synthetic coding sequence
atgaagcagcccatcatggctgatggacctcgctgtaaacgaagaaaacaggccaatccccggcgcaaaaacgtcgtcaactacgataacgtcgttgatactggaagcgagaccgatgaggaagataaattacatattgccgaggacgatgggatcgccaatccgttggaccaggagacctctccggcttcagtgcctaatcatgagtcgtcaccgcacgtttctcaagctttgctgcctcgggaagaagaggaggatgagatacgagaaggcggcgtggaacatccatggcacaataacgagatcctgcaggcctctgtggacggaccagtgaaaaacgcaaattgcacgtcagatttcgaggaatactttgccaaacgcaaattggaggaacgcgatgggcacgccgttagcatcgaagaatatctacagcgctccgacactgctattatatatcccgaggcgccggaggaactatcccgtcttggcacccctgaagccaacgggcaggaagaaaacgatctcccacctggcacgcccgacgccttcgctcaattactgacatgcccatactgtgacaggggatacaagagacttacgtctcttaaggaacatataaagtacaggcatgaaaagaatgaggaaaatttctcctgcccattatgttcctatacgtttgcctataggactcagttggaacgccatatggtcactcacaagccgggaaccgaccaacaccaaatgttgactcagggggcaggcaatcgcaaattcaaatgcactgaatgcggtaaagccttcaaatataagcaccacctgaaggagcacctgcgcatacattcgggcgaaaagccttacgagtgtcctaactgtaagaagcggttttcccacagcgggtcatacagcagccatattagcagcaaaaagtgtatcggacttatctccgtgaacggacgtatgcgcaacaacattaagacggggtctagcccaaacagcgtgtcaagttcacctaccaactccgccatcacacaacttaggaataagctggaaaatggtaaaccactgtcgatgtctgagcagaccggcctcctgaagatcaaaacagagcccctagactttaatgattataaagtgctcatggcaacccacggcttcagtggcacttcaccgttcatgaatggcggtctgggcgccacttcaccactgggcgtccatcccagcgcccagagtccgatgcaacatcttggagtcggaatggaggctccacttctaggatttccgaccatgaattctaatctgtccgaggtgcaaaaagtgcttcagatcgttgacaacactgtttcccgccagaagatggactgtaaggctgaagaaattagcaaactgaaaggttaccatatgaaagacccttgtagccaacctgaggagcagggcgtgacatctccgaacattcctccagtgggattgcccgtggtcagtcacaatggggcaactaagtccattatcgattacacactggaaaaagtgaacgaagcaaaggcatgtctacaatcactcaccaccgattctcgtagacagatatcaaatattaagaaggagaaactgagaactctcatcgacttagtcaccgacgacaaaatgatagaaaaccataatatttcaactccattttcctgccaattctgtaaggaaagctttcccggcccgataccgttacatcagcacgagaggtatctgtgtaaaatgaatgaagaaataaaagctgtgctgcagcctcacgagaacatcgtgcctaataaggccggagtgtttgtcgataacaaagctctgttattatcgtccgtcctctctgagaaaggtatgacctccccgataaacccctataaggaccatatgagtgtgctgaaagcctactatgccatgaatatggaaccaaactctgacgagctgctcaaaatcagtatcgcggtggggctgcctcaagaattcgttaaggagtggtttgaacagcggaaagtgtaccaatattccaactcccggtctccgtcgctggagagatcctctaaaccactggcaccgaacagcaatcctcctacgaaagattcactgctgccacgatctcctgtcaagcctatggatagtatcacaagtccatcaatcgccgagttgcacaattccgtgacaaactgtgacccccctctgagattgactaaaccctctcactttactaacatcaagccggtggaaaagctggatcatagcaggtccaatactccgtcccccttgaatctctcaagtacatcaagcaagaatagtcattcatcctcatatacccccaattctttttccagtgaagagctgcaggctgaaccattggatctgtccttgcctaagcagatgaaggaaccaaaatcgatcatagccaccaaaaacaaaaccaaagcatctagtatcagcctggatcacaatagcgtcagttcttcttcggagaactctgacgaacctttaaatttaacattcatcaagaaggagttctccaattctaacaacctagataacaagtcgaccaaccctgtattctccatgaatccattttccgccaaacccctgtacacagcactgccgcctcagtcagctttcccacctgccaccttcatgccccctgtgcagaccagcattccaggcttaaggccctaccccgggctggatcagatgagcttcctgccccacatggcatacacataccctacgggtgccgccacttttgccgacatgcaacaaaggagaaagtatcaacggaagcagggattccagggggaactcctggatggcgcacaggactatatgagtggcctagatgatatgaccgattcagattcgtgcctcagccggaagaaaatcaagaagaccgagtcagggatgtacgcctgcgatctgtgcgacaagacatttcagaaatctagctccttactccgccacaaatacgagcacacggggaagcgcccccaccagtgccagatttgtaagaaagcatttaagcataagcaccatctgatagaacattccaggctgcactccggcgaaaagccatatcagtgtgacaagtgtggcaagcggttttctcatagtggaagctattcgcagcatatgaatcatagatactcttactgtaagcgggaggcagaggagcgggaggcagccgagcgcgaagcccgtgaaaaaggtcacttggagccaaccgaactcctgatgaatcgcgcttacctgcagtccatcacgccacagggatactcagacagtgaagaacgcgagtctatgccacgggacggggagtccgagaaggagcacgagaaggagggagaggacgggtacggcaagctcggtcgtcaagatggcgatgaggaatttgaggaagaagaggaggagagcgaaaataagtctatggatactgaccccgagaccattagagatgaagaggaaaccggagaccattccatggacgattcatctgaagacggcaaaatggagacaaaatccgaccacgaagaggacaacatggaggacgggatgtag

SEQ ID NO: 18161 - DNA, 3645 bp, Artificial Sequence
  Description of Artificial Sequence: Synthetic coding sequence
atgaagcaacctataatggccgacggacctagatgtaagaggcgtaaacaggcaaacccaagacgcaagaatgtggtcaactacgataacgtggtggacaccggcagcgaaactgacgaggaggataagctccatattgccgaggatgatgggatcgctaaccccctggaccaggaaacaagtccagcctccgttccgaatcacgaaagctccccccacgtgtctcaggcgctcctcccacgggaggaagaagaggacgagatacgcgaggggggggtcgaacacccctggcacaacaatgagatcctgcaggcaagcgtcgatggtcccgaggagatgaaagaggactacgacacgatgggcccggaagccacaatccagacggccatcaataatggaacagttaaaaacgccaattgtacgtccgacttcgaagaatatttcgcaaagagaaagctggaggagcgagacggccacgcggtgtccatcgaggaatacctgcagcgcagtgatactgcgattatttaccctgaggctcctgaggagttaagccgtctggggacgccagaggctaatggacaggaggagaatgatctaccaccaggtactcccgacgcttttgcccagctgctgacctgtccgtattgcgaccgcggctataagcggctgaccagtctgaaggagcatatcaagtatcgtcacgaaaagaatgaggagaatttctcttgccccttgtgtagctacacttttgcctaccgcacacagcttgagcggcatatggtcacgcacaaacccggaacagaccagcaccagatgctcacgcagggagccggtaacaggaaatttaagtgtacggagtgcggaaaagccttcaagtataaacaccacttgaaggagcatttacgtattcacagcggcgagaagccgtacgagtgccctaactgcaagaaacggtttagccacagcggtagttatagctcccatattagttccaaaaaatgtataggccttatctcagtgaacggtagaatgcgcaataacattaaaaccgggtccagtccgaactcagtcagcagtagccctaccaatagtgcgattacccagttgcgcaacaaactagaaaacggcaagccactttctatgtcagagcaaaccgggttactgaagattaaaacagagcccttggattttaatgactataaggtcctgatggccactcatggatttagtggcactagcccgttcatgaacggtggattgggtgccacaagccctctgggtgtccacccatccgcacagtcacccatgcaacatttgggggtaggtatggaagcaccgctgttaggatttcctactatgaacagcaatttaagcgaggtccagaaggtcctccagatagtggacaatacagtgtctcgccagaagatggactgcaaggcagaagagatttccaagttgaaaggataccatatgaaagacccatgcagccagccagaagaacagggagtcacctccccgaacattccacccgttggcttacctgtagtatcccacaacggcgccaccaagtccatcatcgactacacattagagaaggttaacgaggcaaaggcttgtctgcaaagcctcaccaccgacagtcggcgacagatatcgaacataaaaaaagagaagctgaggaccttgatcgacctggtaacagacgataaaatgattgaaaaccacaacatttctacccccttctcatgtcaattttgtaaggagtcatttcccgggcccattccactgcatcagcatgagcggtacctgtgcaagatgaacgaggagattaaagcagtgttgcagccccacgagaacattgtgcctaataaggctggagtcttcgttgacaataaggcgttgctgctgagctccgtactcagtgagaagggcatgaccagtcccatcaacccctacaaagatcacatgagcgtgttaaaggcatactacgccatgaatatggagccgaactctgatgagcttcttaagatttcgattgcagtcgggttaccacaggagtttgtcaaggagtggttcgaacagagaaaggtttaccagtacagtaactcccgaagcccgtcactggaacggtcaagcaagcccctggcccctaacagtaaccctcctacgaaagattcgttgttgccacgctcacccgtaaagcccatggattctatcacttcaccatccattgcggaactgcacaatagcgtcacaaactgcgatccaccccttcggttaacaaagcccagccacttcaccaacataaagccggtggagaagcttgaccacagcaggtcaaacacgccatcccctctgaaccttagctccactagctccaagaactcccactcatccagttacactccaaattcctttagctcagaagaacttcaggccgaacccctagatctgtctctgccaaagcaaatgaaagagcctaaatctataattgctacaaagaataaaactaaggcaagctccatcagcctggaccacaactcagtgtcctcttcatccgaaaattcagatgagcccctgaaccttaccttcatcaagaaggaattctctaacagcaacaacctggacaacaagtctaccaatcccgtattctccatgaatccgttttctgcaaaacccctgtatactgccctgccccctcaaagtgcttttccccccgcaacctttatgcctcccgtccagaccagcatccccgggcttagaccttacccaggtttagaccagatgtcttttcttccccacatggcttatacctatcctactggtgccgctacctttgccgatatgcagcagaggaggaagtatcagcgtaagcagggcttccagggtgagctcctggacggtgctcaggactatatgtctgggttggatgacatgacggacagcgactcctgtctgtctcgcaaaaaaattaaaaaaactgagagcgggatgtacgcgtgcgacctttgtgataagacattccaaaaaagttccagcttgctgcggcacaagtacgaacacaccggcaaaaggccacatcagtgccagatctgtaaaaaggcattcaaacataagcaccacttgatagagcattccagactgcacagcggcgagaagccatatcagtgtgacaagtgcggcaagagattcagtcactccgggtcatactcccagcacatgaatcaccgctacagctactgtaagagagaagccgaagaacgggaagcggccgaacgtgaagcccgcgaaaagggccacctggagcctaccgaattattgatgaaccgtgcctatctgcagtccattacccctcaggggtatagcgactctgaggagcgtgaaagcatgcctagagacggtgagtcagagaaagagcacgagaaagagggggaggatgggtacggcaaactagggcggcaagacggagacgaggagtttgaggaggaggaggaggagtcagagaataaatcaatggatactgatcctgagaccatccgagacgaggaggaaaccggagatcacagtatggatgactcctctgaggacggaaaaatggaaactaaatcagaccacgaagaagacaatatggaagatggcatgtag

SEQ ID NO: 18162 - DNA, 1893 bp, Artificial Sequence
  Description of Artificial Sequence: Synthetic coding sequence
atgtctatcagcgcattgggtggacgcaccaagggcaaacccctacccccgggagaggaagagaggaataatgtgttgaagcagatgaaggttcggacaacactcaagggcgacaaaagctggattaccaagcaggatgagtctgagggaaggacaatcgaactcccctcgggacgttcacgggctacatccttctccagcgcgggagaggtgcccaaaccccgccctcctagcacacgggccccaaccgggtacatcatacgaggcgtatttacaaaacctattgattcaagctcacagccgcaacagcagttcccaaaggccaacggaacgcccaagtctgctgccagtctggtgcgcacggctaacgctgggcctcccagaccttcttcctccggctacaaaatgacaacggaagactacaagaagcttgcaccctacaatatcaggagaagttcaactagcggagataccgaggaggaggaagaggaagaggtggtaccattcagctccgacgagcaaaaaaggcgaagcgaagccgccagtggggttttacgtcgaacagctcctagggagcactcctacgtcctgagcgccgccaagaagtcaacgggcccaacccaggagacccaggctccttttattgcaaaacgcgtggaggtagttgaggaggacggcccaagtgagaaatctcaggatccacccgcgctagcccggtccacgcccgggagtaatcgctcgagccctggcaataaggacaaagaggctccctgcagcagagagctccaaagggatttggcaggtgaggaggcatttcgagccccgaatacagatgctgccagatctagcgcccaactatccgatggtaatgttggtagcggagcaactggcagtcgccctgaaggcctggcagcagtagacattgggtctgaaaggggatccagcagcgccacatccgtatcagcagtccctgctgataggaagagcaacagtaccgccgcccaggaggacgccaaagccgatcctaagggcgccttggcagactacgagggcaaggacgttgccactagggttggcgaggcatggcaggagcggcccggtgctccccggggagggcaaggcgatcccgccgttcccgcacagcagccagccgacccgtccacacctgagaggcagagctctccaagtggctcagagcagctggtgcgccgcgagagttgtggttcctcagtcctgacagactttgagggcaaggacgttgccactaaagtgggggaagcctggcaagataggcctggagccccaaggggtggccagggagaccccgctgttccaactcagcagcccgccgatccctcgaccccagagcaacagaattccccctcagggtctgagcagtttgttagacgtgaatcttgtacatctagagtacggtctcccagttcttgtatggttacagtgactgtcactgccaccagtgagcaaccacacatctatatccctgctcccgcgtcagagctggattcgagctctacaaccaagggcatcctgttcgtgaaggaatatgttaatgcctctgaagtttcatctggcaagccagtcagtgcacgctactctaacgtgagttctatcgaagactctttcgccatggagaaaaagccaccttgcgggtctaccccatacagcgaaagaacaactggaggaatttgcacttattgcaacagagagatccgcgattgtcccaagatcacattggagcacttaggtatatgttgtcatgagtactgtttcaaatgtggcatatgcagtaaacctatgggagatcttctggatcagatcttcatccacagagacacaattcattgcggcaagtgctatgagaagctattctag

SEQ ID NO: 18163 - DNA, 1407 bp, Artificial Sequence
  Description of Artificial Sequence: Synthetic coding sequence
atgactaccgaggactataagaagttggcaccatataacatccggcggagtagtacgtccggcgataccgaagaagaagaagaggaagaagttgtgccattttcgtccgacgaacaaaaaagatcttctcctacacaggaaacacaagcaccattcattgccaagagagtcgaagtcgtagaggaggatgggccctccgagaaatcacaggatccacctgcacttgcgcggagcaccccaggaagtaacagaagttccccaggcaataaagataaggaggccccatgctcacgcgagctgcaacgagatctagcgggggaagaagctttccgcgcacccaacaccgatgccgcaagatcttcggcacagctctcagatgggaacgtcgggagtggagcaaccggatctcggcctgaggggcttgcagccgtggacatcggaagcgaaagagggtcctctagcgcaacctccgtctccgcagttcccgccgatcggaagagtaattcaaccgcagcccaagaagacgccaaggcagacccaaaaggggctctggccgactacgagggaaaggatgtcgccacgcgggtgggagaggcctggcaggaacgtccaggagctccccggggagggcagggagatcccgcagtgcctgcacagcagcccgccgacccttcaacaccagaacgccaatcatctccttccgggtccgagcagctggttcgccgggaaagttgtggctcttctgtcctgacagactttgaaggcaaggacgtggccacaaaggtgggggaagcctggcaggacagacctggagcccctcgtggcggccagggggacccagcggtacctacccagcagccagctgatccctccacaccagagcagcagaattcaccatccggcagcgaacagttcgtgcggagggaatcttgcacttcccgggttcgctccccctcaagctgtatggttaccgtgacagtgactgccaccagcgaacaacctcacatatatatccctgctccggccagcgaacttgattcatcctctaccactaagggcattcttttcgtcaaggagtatgtaaacgcttcagaggtatcatccgggaaacctgtgtctgctcgctactctaacgtttcttccatcgaggactctttcgccatggaaaaaaaacctccctgcggctccacaccttactctgaacgcaccactgggggtatttgcacatactgtaatagagagattcgtgactgtcccaaaatcacgttagagcatctgggaatttgctgtcacgaatactgcttcaagtgtgggatctgctccaagccgatgggtgacttgttagatcagatatttatccacagggatacaattcactgtggcaaatgttacgaaaagttgttttag

SEQ ID NO: 18164 - DNA, 1374 bp, Artificial Sequence
  Description of Artificial Sequence: Synthetic coding sequence
atgaccacagaggattataaaaaactggcaccgtataatatccgtaggtcaagcacatcaggtgataccgaggaggaagaagaggaggaagtggtgcctttcagtagcgatgaacagaaaagaagatccgaggcggcgtccggagtgctcagacgaacggctcctcgggagcacagttacgtcctgagcgcagcaaaaaaatccaccgggtcaccgactcaggaaacacaagctccgttcatcgccaagagggtcgaagtagtggaggaagatggcccatccgagaagtcacaagatccacccgccctcgcccggtcaactccgggctccaattcttcacgtggcgaagagatagtccgtctgcaaattctgacgccacgggctggccttagacttgtggccccggacgtcgagggcatgagctctagcgcaactagcgtttctgccgttccagccgataggaagtctaattctacagctgctcaggaggatgccaaggccgaccctaagggtgccctggccgactacgagggtaaggacgttgccaccagggttggggaagcatggcaggagagacctggggctccaaggggtggccagggggaccctgcagtgcccgctcaacagccggcagaccccagcacccctgaaagacagtcttccccatctgggagtgagcagctcgttcgtagggagtcctgcggctctagcgtactgactgacttcgaaggcaaagatgtggccactaaagtcggagaggcatggcaggacagaccgggggctccacgggggggccagggagatcccgccgtgcccacacaacagcctgccgatcccagcacaccggagcagcagaatagcccaagcgggtcagaacagttcgtaaggcgggaaagctgcaccagcagagtgcgaagccccagcagctgcatggttacagttaccgttactgccacttccgagcaaccccacatttacatacccgctcccgcatccgagctggactcttcttccactaccaaagggatcttatttgtgaaagaatacgttaacgccagtgaagtgtcatccgggaaacctgtgagcgcccgatatagcaacgtcagcagcatcgaagactccttcgccatggagaagaagcctccatgcggtagcacaccttactcagaacggacaacaggagggatctgcacatattgtaatcgcgagataagggactgccctaagatcacgctggaacatctgggcatttgttgtcacgagtattgtttcaagtgcgggatatgttcgaaaccgatgggcgatttgttggatcaaattttcatacacagagacactattcattgtggaaaatgctatgaaaagctcttttag

SEQ ID NO: 18165 - DNA, 2070 bp, Artificial Sequence
  Description of Artificial Sequence: Synthetic coding sequence
atgagcatctcggcactcggcggccgtaccaagggtaagcccctgccccccggcgaagaagagcgaaataacgtgctgaagcagatgaaggtgcgcactacactcaaaggagacaagagttggatcacgaagcaggatgaaagcgaaggccgaaccatcgagctaccgagtggaagaagccgcgcaacaagcttctcatcggcgggcgaagtgcctaagcctcgccctccaagtacccgcgcccctaccggctatatcatcaggggtgtgtttactaagccaattgactcctcctctcagccccagcagcagtttcccaaggcaaacggcactcctaaaagtgccgcaagtctcgtacgaactgccaatgccggaccacccagaccatctagctccgggtataagatgaccacggaggactataaaaagttggcaccatataatattaggcggtctagcacaagcggggacactgaggaggaggaagaagaagaagtcgtcccatttagttccgacgagcagaaacggcgctcggaagctgcctccggtgtgcttaggcggaccgcaccgagagaacatagctatgtcctgtccgcagcgaaaaaaagtaccggacctacacaggagacccaggctccttttatcgcgaaacgtgtagaggtggtggaagaggatggcccctcagaaaaatctcaggaccccccagccctggcgcggtctacccccggatcaaactctgccgatgggggccgtaccaaagccagcagggctatctggatcgagtgtcttccgagcatgcccagccccgccggctctcaggagcttagttctcggggtgaagagatagttagactccaaatcctgacgcctcgggcaggactgaggctggtcgccccggacgtcgaggggatgagatcgtcacctggtaacaaagataaagaagctccttgctcccgcgaactgcaacgcgatctggcaggagaggaagcatttagggccccgaacacggacgctgcccgatcatccgctcagttgtctgacggcaacgtagggtccggggctactggctcaaggcccgaagggctggctgccgtcgacatcggttcagagagaggcagtagctctgcaacctccgtgtcagccgtgccggcagataggaagtcaaatagtacagcagcacaggaggacgccaaagccgacccaaagggggctcttgcggactacgaggggaaggacgtggcaactcgcgtcggtgaagcttggcaggaaaggccaggggcgcctcggggtgggcaaggcgatccagccgtgccagcccagcagcccgccgatcctagcacccctgaaagacaatcaagccccagcggatcggagcaacttgtacgcagggaatcgtgtgggtcttctgtgctcacagattttgaaggcaaggatgtggccactaaagtgggcgaggcgtggcaggaccggccaggcgcgcccagaggcgggcaaggagaccccgccgtgccaacacagcaaccagccgatcccagcaccccagagcagcaaaactctcctagtggttctgaacagtttgtgcgccgcgagtcctgtactagtagagttcgcagcccctcatcatgtatggtcacggtgacagtcactgctacctcagaacagccgcacatctatattccggccccggcgtctgagctagactcctcaagcaccactaaaggcatattattcgtcaaggaatatgtgaatgcgtcggaggtcagttctggcaagcccgtttccgctcgctactcaaatgttagctctattgaagactcattcgccatggaaaagaagcccccatgcggcagcaccccttatagtgagcggactacagggggaatctgcacttattgcaatcgggagattcgcgattgtcccaaaatcacactcgaacacctgggcatttgttgtcacgagtattgctttaagtgtggaatttgctccaagcccatgggggacctgctggatcagatttttattcatcgcgatacaatccactgtggcaagtgctatgagaagcttttctag

SEQ ID NO: 18166 - DNA, 1359 bp, Artificial Sequence
  Description of Artificial Sequence: Synthetic coding sequence
atgcagcgccaggcaccatataacatcaggcggagtagcacttccggcgataccgaggaagaagaagaagaagaggtggtccctttttcctctgatgaacagaagagaagatctgaggccgcaagtggggtactgaggcggacagcgcctcgggaacactcatacgttctttccgcggcgaagaaaagcaccggaagccccacccaggaaactcaggcgcctttcattgccaagcgtgtcgaggtggtggaagaggacggaccaagcgagaaaagtcaggatccccccgcactcgcaagatcgacaccgggatctaacagcagccgcggagaggagatcgtgaggctgcagattctaaccccaagagctggtctccgccttgtagcaccggacgtcgagggcatgtctagtagcgccacatctgtgagtgcagtgcctgcagaccgaaaaagtaactcaaccgccgcacaggaggatgcgaaggcggaccctaagggcgctctggccgattatgaaggtaaggatgtggccacaagggtgggtgaggcatggcaggagcggccaggggctccacggggcggccagggagatccggctgtgcctgcccagcagcccgccgatccgtccactcctgaaagacagtcatcacctagcgggtccgaacagcttgttcggagagagagttgcggatccagcgtactgacagactttgagggaaaggatgtcgctaccaaggtgggtgaagcttggcaagatcgccctggtgctcccaggggggggcagggtgaccctgctgtccctacacagcagcccgcagaccctagcacccccgagcaacagaacagtcctagcggttcagaacaattcgtgcgaagggagtcctgcacctctcgcgttaggagcccatcttcctgcatggttacagtgacggtcactgctactagcgagcaaccacatatatatatccctgcacctgcatctgaattggatagtagtagcaccacaaagggcatcttattcgtgaaagaatatgtaaatgccagcgaggtctcttccggtaagcccgtgtcggcgaggtactctaatgtatcttctattgaagattcattcgccatggagaagaagcctccttgtggcagtactccttatagcgagaggacaactggtggcatttgcacttattgcaatcgtgaaatcagggattgcccaaagatcacattagaacacctcggcatctgctgccacgaatactgttttaagtgcggcatttgcagtaagccaatgggcgaccttctggaccagatctttattcatcgggataccatacattgtggtaagtgctacgagaagttgttttag

SEQ ID NO: 18167 - DNA, 1428 bp, Artificial Sequence
  Description of Artificial Sequence: Synthetic coding sequence
tgacgttcttccaccagcggggatacggaggaggaggaggaggaggaagtggtcccctttagcagcgacgagcagaagcgatctttgcgtaggacggccccccgcgagcattcatacgttttgagcgccgctaagaagtccactggcagtcccacccaagagacccaggcaccctttattgccaagcgtgtcgaagtggtggaggaagacggacccagcgagaaatcacaggatccccccgcgctagcaaggtcaactccaggttctaatcgctcctcaccaggaaataaggacaaagaagccccatgcagccgggagctgcagagggatctggctggcgaggaggcattcagagccccgaacacagatgcggctaggagctctgctcagctgagcgatggcaacgtcggcagcggggccaccggctcccgcccagaaggcttggccgcagtagatatagggtcggaaaggggctctagcagcgctaccagcgtctctgcagtgccagccgatcgaaagtcaaactcaacagctgcccaggaagatgcgaaggccgaccccaagggcgcattagccgactatgaaggaaaagacgtcgctactcgcgtcggagaagcctggcaggaaaggccgggtgcaccccgaggggggcagggagaccctgcggtgcccgctcagcagcccgctgatccaagtacccctgaacggcagagctcaccttccgggagtgaacagcttgtccggagggagtcgtgtggatcaagtgtgctcacggactttgagggcaaggatgttgcaacaaaagtcggcgaggcgtggcaagatcggcccggagcacccaggggaggacagggtgatccggccgttcctacccaacagcccgcagacccatccacacctgagcagcagaactctccgtcgggcagcgaacagtttgttagacgtgagagttgcacttcacgagtacgatcaccttcatcctgcatggtgactgtgaccgtgaccgccacaagcgaacagccacatatatatatcccagcacccgcatcagagctggatagctcttctacaacaaaggggatcctcttcgttaaagaatacgtcaatgcctcagaggtctcgtccggaaagccagtaagcgccaggtattcaaatgtctcatcaatcgaggactcttttgctatggaaaagaaaccaccctgcggatcaactccatattctgaaagaacgacagggggaatctgtacatattgtaatcgggaaatacgggactgccctaaaataactctggagcaccttggcatctgctgccatgagtattgcttcaaatgtggtatctgttccaaaccaatgggagacttgcttgatcagatttttattcaccgggacacaattcattgcggcaaatgctacgagaaactgttctag

SEQ ID NO: 18168 - DNA, 1146 bp, Artificial Sequence
  Description of Artificial Sequence: Synthetic coding sequence
atgacaacagaggattacaaaaagttggccccctataacattaggcgcagctctaccagtggggacaccgaagaagaagaggaggaagaggtggtacccttctcttctgatgagcagaaacgccgtagtgaggccgcctccggcgtgctgcggcgcaccgccccccgcgaacacagctacgttctcagcgcggctaaaaagtccactggatcacctacccaagagacgcaagctcccttcattgccaagagagtggaggtggtggaagaagacggcccctctgagaagtcacaggatccaccagccttggcccgctctacaccaggatctaactctgcagatggaggtcgtacaaaggcctcgagagcaatatggattgagtgtctgcccagtatgcctagtcctgctggcagtcaggagctgtcgtcccggggcgaagaaattgtccgactgcagatcctcacaccccgcgccggtctgcggctggtggcaccagacgtggagggcatgcgtagctcaccaggtaacaaagataaggaggcaccctgcagcagagaacttcagcgggatctggcaggcgaagaagcctttcgagccccgaatacagatgcagcgaggtccagtgcccagctttcagacggtaacgtggggtccggcgcgacaggatccagaccggaaggccttgctgccgtcgacattggatcagagcgcggctcctcttcagctacgtctgtgtcagcggtgcccgccgaccgcaagagcaatagtaccgcagctcaggaggacgccaaagctgaccctaagggggccttagccgattatgagggcaaggatgtcgcaacgcgcgtcggggaagcctggcaggagcgcccaggtgcccctaggggcggccagggggatcctgccgtgccagcacaacagccagccgatccttccactcctgagagacagtcttctccctcagggtctgagcagctggtgcgccgagagagttgtgggtcgtctgtgctgactgactttgagggcaaggacgtggccaccaaagtgggtgaagcttggcaagatagacctgggcccagctgcacacactctgcaacttgcagatcccagtatccaaggacagctgagcagccccagcgaatatag

SEQ ID NO: 18169 - DNA, 636 bp, Artificial Sequence
  Description of Artificial Sequence: Synthetic coding sequence
gaagaagcttttcgagcccctaacactgacgcagcgcgatcttctgcccagcttagcgatggaaatgttggctctggtgccaccggaagccggcctgaggggctcgccgctgtggacatcggaagcgaaagaggtcggctctgtgccgccgcgtcttttgcatcctttctcgaggatcaagacggccactcagccaatagtcagagctgtaagcctcggcctgccgctatctcctcatccgccacgagcgtctcagcggtgcctgccgaccgcaagtcgaattcgacagcagcgcaggaagacgctaaagcggaccccaaaggagcgctggcagactatgaaggcaaagacgttgccacaagggtgggcgaagcttggcaggagcggcctggcgccccacgcggtggccaaggggatccagccgttccggcccagcagcccgctgatccatccactcccgaacgccagagctctccctcagggtccgagcagctggtgcggagggaatcttgcggcagtagtgtcttgacggatttcgaaggtaaggatgtggccaccaaagttggtgaagcttggcaagacagacccggcgctccacgtggcgggcaaggcgatccggcagtccctactcaatag

SEQ ID NO: 18170 - DNA, 666 bp, Artificial Sequence
  Description of Artificial Sequence: Synthetic coding sequence
tgacttaggaggacggcgcctcgcgaacacagctatgtcctctccgccgctaaaaagtccaccggatccccgacccaggagacacaagccccattcatcgccaagagagtggaagtggtggaggaggacggaccctcagagaaatcccaagatcctcccgcacttgcacgttcgaccccaggctctaactcagccgatggcggtcggaccaaagcaagcagagccatatggattgagtgtttaccttccatgccttctcccgctgggagccaggagctgtcttccaggggcgaagaaatcgtaagactgcagatcttgaccccacgcgctggcctgagactggtcgccccagacgttgaaggcatgcgaagtagccctggcaataaggacaaggaggccccctgttctagggaactgcaaagggatttagccggggaagaagccttcagagcccccaacacagatgcagcccgaagtagcgcgcaactctcagacggcaacgtcggatctggagccactggctcaagaccggagggtctggctgcggttgacatcggttcagagagaggttcttcaagcgccacatcagttagtgccgtgccagctgatagaaagtctaactcaacggctgctcaggaagatgccaaagcagatcccaagggctag

SEQ ID NO: 18171 - DNA, 414 bp, Artificial Sequence
  Description of Artificial Sequence: Synthetic coding sequence
taggtgctcccacgcaggcatcgacataggctgtcacgacgcggctggagatggtggaaacggactggactgctgcgtagagcaagaacacacttactgtggcaggaccctctgcttgcacagactgtgaggatggaagccggtcctaagaggttgggacaatttggtagtagtgcctgtcaagtgtgtctggctcccttaggcgcccggtcatccgggctcccacaggcaaccaagaccaggcggcccccagccccggagtcatctaggggtacatggcttgtcagacgtctgagcgggccccccactcagatgcttcaggctcccgtcccattacagtctttgctgagcttgttgattggcagagccaccgcgcaacaaccaagacgcatgcagagacagacgcagcgttag

SEQ ID NO: 18172 - DNA, 2073 bp, Artificial Sequence
  Description of Artificial Sequence: Synthetic coding sequence
atgtcaatcagtgccctgggcggacggaccaaggggaaaccacttcccccaggagaagaggaacgaaataacgtgcttaagcaaatgaaggttaggaccaccctgaagggggataaaagctggattacaaagcaggacgagtccgagggccgcactatagaacttccgtctggcaggtcaagggcgacgtcatttagcagcgccggcgaagtgccgaagccgcgccctcccagtacacgagcccccaccggctacattattcgcggagtgtttacgaaacctatcgactcctcatcccagcctcaacagcagttccccaaggccaatggcactccgaaatctgcggccagtctggtgcggaccgcaaatgccggtcccccccggccaagtagctccggttataagatgaccaccgaagactacaaaaagctagcaccatacaatatccgcaggagctccacgtcaggcgacactgaggaggaggaagaagaggaagttgtgcctttctcctccgacgagcagaagcgcaggagtgaagcggccagcggcgttctgcggaggactgccccccgtgaacacagttacgtgttgtcagccgcgaagaagagtaccggttcccccacacaggagacccaggccccttttatcgccaagcgggtggaggtggtcgaagaggacggccctagcgagaagtcccaggatcccccagcactggcaagatcaactcctgggtccaattccgccgatggaggccgtaccaaagcctcaagggcaatctggattgaatgcttgccctcgatgccctcacccgctgggagtcaggaactgagtagccgaggcgaagagatcgtgaggctgcagattcttaccccgagggcaggcctccggcttgttgctcctgatgtggagggcatgcggagttccccaggcaacaaagacaaggaggccccgtgctctcgcgagcttcaacgggacctggctggtgaggaagcgtttagagctcctaatacagacgccgctaggagcagcgctcaacttagtgatggtaatgtagggtctggagcaacaggctcaagaccagaagggctggcagctgtggacataggatccgagcgggggtcgtcaagtgccacctcagtgtccgccgttccagcagaccggaagagcaacagcaccgccgcacaggaggatgcaaaagccgatcctaagggagccttagcagactatgaaggcaaggatgtggcgacacgggtcggtgaagcttggcaggaacgacccggagcaccccgtgggggccagggggacccagccgtgccggcccagcagcccgccgacccatcgacaccagaacgacagagcagtccttctggctctgagcagctagtgaggcgagagtcatgcggctcttccgtgctgacagatttcgaggggaaagacgtggccaccaaggtgggtgaagcttggcaggaccgccctggcgcacctagagggggacaaggcgatccagcagtccctacccagcagccagcagacccctctacgcccgagcagcagaatagtcccagcggcagcgagcagtttgtgcgtcgggagtcctgcactagccgtgtgcgctccccctcgtcctgtatggtaaccgtgacggtgacagccaccagcgagcagcctcacatttatattcccgcacccgccagcgagctcgatagctccagcaccacaaagggcatcctgtttgtgaaagagtacgtgaacgccagcgaggtgtcttcaggcaagccagtctcagctcgctattccaatgtctcctcaattgaagacagctttgctatggagaaaaagcctccatgtggtagtacgccttactccgaaagaaccacagggggaatatgtacttactgtaatcgtgagattagggactgccccaaaatcaccctcgaacatctcggaatctgctgtcacgaatactgctttaaatgcggcatctgctctaagcctatgggagatctcctggatcagattttcattcatagagacaccattcattgcggtaaatgctacgagaaactgttttag

SEQ ID NO: 18173 - DNA, 993 bp, Artificial Sequence
  Description of Artificial Sequence: Synthetic coding sequence
tagtctgagatggcagcccgggatgagctcggtctcggcggagactcacttgaggctatgcccgttcccgctgctaggggaagacctagaatcactaacgggcccgaggagctcgcggctccgtctcccgctgctcttgctgactatgagggaaaagacgtcgccactcgcgttggcgaggcctggcaagagagacctggggcccctcggggtggccagggcgaccccgctgtgccagcccagcagccggccgacccctctactcctgagcggcaaagttctccgtctggcagcgaacaactggtgcgaagagaatcttgcggatcaagtgtgctcaccgactttgagggaaaggacgtagccacaaaagtgggcgaagcctggcaggacaggccgggagccccccggggcgggcagggggatcccgccgtgccgacacagcagcctgccgacccctccacacccgaacaacagaactcaccttcgggatctgagcagtttgtgagaagagagagttgcacctcgagagtgaggagcccgtctagttgtatggtcacagtgaccgtgaccgccacgtctgaacaacctcatatttacataccagcaccagcgagtgaacttgattcctcctccacaaccaaggggattctcttcgtgaaagaatatgttaacgccagtgaggtgtcatctggcaaacctgtgtccgctaggtattcaaacgtctcatccatcgaagattcttttgctatggagaagaaacctccttgtggcagcacaccctacagtgagaggaccacaggaggtatttgcacttactgcaatcgcgagatccgcgactgccctaagattaccctggagcaccttggaatctgctgtcatgagtattgtttcaaatgcgggatttgtagcaaaccaatgggcgatctcctggaccagatctttatccaccgagacaccatacattgcggaaagtgctacgaaaagctgttttag

SEQ ID NO: 18174 - DNA, 1575 bp, Artificial Sequence
  Description of Artificial Sequence: Synthetic coding sequence
atgacaactgaagattacaagaaacttgcaccctacaacatacgacgttcctctacatcaggagacactgaggaggaggaagaagaggaagtggtgccattttccagtgatgagcaaaaaaggaggagcgaggctgcaagcggagtgctgcgacgcaccgctccccgagagcatagttacgtgctgtccgcggccaagaagagtaccggtcccacccaagagacccaggccccgttcatcgccaagagagtggaagtagtagaggaggatgggccaagtgagaagtctcaagatccaccagccctcgccagatctacgcctggctcaaacagttccaggggagaagagatagtgcgcctgcagattttgacccctcgcgccggtctccggctagtggctcctgatgttgaaggcatgcggtcgtcaccaggaaataaggataaggaggctccgtgctcacgcgagctgcagagggatctggctggggaggaggcatttcgcgctccaaacacggacgccgccagatcaagcgctcaactctctgacggcaatgtaggcagtggtgcaactggctctcgcccggagggcctcgccgcggtggacattggttcagagagggggtcctcctctgcgaccagcgtgtctgccgtaccagcagataggaagtcgaactcaaccgccgcacaagaagatgccaaggcggatcctaaaggagcacttgcagactacgaggggaaggacgtggccacacgagtgggtgaggcctggcaggaaagacctggggctccccgcgggggacagggagaccccgccgtgccggctcagcagccagctgatcccagtactcctgagcgccagagcagtccatctggaagtgaacagctggtcagacgggagtcttgtggatcgtcagttctgaccgacttcgaagggaaagatgtcgctaccaaggttggagaggcctggcaggatcgtcctggagcgcctaggggcggccagggcgatcctgccgtacccactcagcaacctgccgacccgagtacaccagagcagcagaattcccccagcggctctgaacagtttgtgaggagggagtcatgcacgtctcgcgtaagaagccctagctcctgtatggttaccgtcactgtcaccgcaacctcggagcagcctcatatctatatcccagctccagcttccgagttggatagcagttccactactaaaggcatcctcttcgtgaaggaatacgtcaatgcctccgaggttagctcgggcaaaccagtctctgctcgctattctaatgtgagctccattgaggactcttttgccatggaaaaaaaacctccttgtggctcgaccccttacagcgagaggactaccggcggcatctgcacttattgcaatcgagagatccgggactgtcccaaaatcacacttgaacatctgggcatctgctgccatgagtattgcttcaaatgtggtatttgctctaagccgatgggcgacctgctggaccagatttttattcatagagacaccatccactgcggcaaatgctacgaaaaactgttttag

SEQ ID NO: 18175 - DNA, 2166 bp, Artificial Sequence
  Description of Artificial Sequence: Synthetic coding sequence
atgagcatcagcgccctcggggggcggacaaaaggaaaacccctgccccccggtgaagaggaacggaacaatgttcttaaacagatgaaggtgcgcacaaccctgaagggagacaagagctggattaccaaacaggatgaaagcgaaggtaggacaattgaactcccttccggacgcagcagagctacgtcctttagttccgctggagaggtgcccaaaccacggcccccctcgacgagggcgccaacaggatacattataaggggagtgtttacgaaacccatcgattcatccagccagccccagcaacagttcccgaaagcaaatggaacccccaaaagcgcagccagcctggtccgaactgcgaatgctggaccaccaagacccagctctagtggatataagatgaccaccgaggactacaaaaaacttgccccctacaacatcagaaggagctccacctccggggacactgaagaggaggaggaagaggaggtcgtcccattcagttcggatgaacagaaacgcagaagtgaggccgctagcggcgtcctgagacgaacagccccacgagaacatagttacgtactaagcgctgctaagaagtctactggccctacgcaggagacacaggccccattcatagccaaaagagtcgaggtggttgaggaagatggcccaagcgagaagagtcaggatccacctgctcttgctcgcagcacccccggctcaaattccgcagatggcggccgaaccaaagcaagcagagcgatttggatcgaatgtctgccatcaatgccttctccggccgggagccaggagttatcctcacgtggtgaagagattgttaggctgcagatcctgaccccgcgagccggactccgcctggttgcccccgatgtggaaggcatgaggtcctcgccggggaacaaagacaaggaggctccctgtagcagagaactgcagagagacctggctggtgaagaagcttttcgcgctcctaacacggacgccgcgaggtcttccgctcagctgagcgatggtaacgtggggtctggagcaacagggagccgccctgaggggctggctgccgtcgacattggatccgaacgtggtaggctttgtgccgccgcctctttcgccagttttcttgaagaccaagacggccacagcgcaaattcacagagttgtaaacccagacctgccgccatctcgagttctgcaacctccgtaagcgccgtcccagccgaccgcaagagtaattctacggccgcccaggaagatgctaaggctgatcctaagggcgcattggcggactacgagggcaaagatgtcgctacccgagtgggggaagcctggcaggagcgaccaggcgccccaagggggggacagggggatccagcggtacccgcacagcagcccgctgatccgtcgacccccgagcggcagtcctccccttccggttcagaacagctggtgcggagggaatcatgtggatcatctgtactgacagattttgagggtaaggatgtggctaccaaggtgggggaggcatggcaagatagaccgggtgcccctagaggtggccaaggcgacccagctgtccctacacaacaaccagcagacccatccacgccagagcagcagaacagcccgtctggctctgaacagttcgtgcggcgtgagagttgcacctcaagggtgagaagtcccagcagttgtatggtgacggtaaccgtgacagccacttcagaacagccgcatatttatatccctgccccagcaagtgaactcgattcttcatctactacgaaagggattcttttcgtgaaggagtacgtcaatgccagtgaagtgtctagcggcaagcccgtgtctgcacggtattcaaatgtctcctctattgaggacagctttgctatggagaaaaagccaccctgtggttcaaccccatattccgagcggaccaccggcggcatatgtacgtattgcaatcgggagatccgagactgccccaagattacattggagcacctgggcatttgttgtcacgagtattgcttcaaatgtggcatttgctccaaaccgatgggcgacctgcttgatcaaattttcatacaccgtgataccatccactgtggaaagtgctacgagaagctgttttag

SEQ ID NO: 18176 - DNA, 2079 bp, Artificial Sequence
  Description of Artificial Sequence: Synthetic coding sequence
atgtcaatatccgcactgggcggacgcacaaagggcaaaccattaccgccaggtgaagaggagaggaataacgtactcaaacagatgaaagtaaggacaaccctaaagggcgataagtcatggattacgaaacaagatgagtccgaaggacgtactattgaactgccatcgggacgcagtcgcgcaacatcatttagctctgccggcgaagtccccaaaccccgccctcccagcacgcgcgcacccactggctacataattcgaggtgtttttaccaagcctatagatagtagttcgcaacctcagcagcagttccctaaggccaacggcactccaaagagcgctgcaagtctagtaagaacagccaatgccgggccgccacgaccttcctcctctggctacaagatgaccaccgaggattacaaaaagctagcaccatacaacataagaagatccagtaccagcggagacaccgaagaagaggaagaagaggaggtggtgcccttttcatctgatgagcagaagcgcaggagcgaggccgccagcggcgtcttgagacgaaccgccccaagggagcattcttatgtcctttcagctgcaaagaaatcgaccgggcctacccaggaaactcaggcccccttcatagcaaagcgcgttgaggtggtggaggaagacggaccctccgagaaaagtcaggatcccccggccctcgcaaggagtaccccaggatctaatagtgcagacggcggtcgcaccaaagcctcccgggccatttggattgagtgtctccccagtatgcctagcccggccggttcccaggaactgaggagctcccccgggaacaaggataaagaggcaccctgtagtcgtgagctgcagcgtgatctggccggcgaagaggctttcagagcccctaatactgacgctgcccgcagctccgcccaacttagcgacgggaatgtcggatcaggagcaactggatcacggcctgaagggttggctgcagtggacatcggatcggagcggggcaggctctgtgccgccgcatcttttgctagttttcttgaagaccaagacggacactccgcaaacagccagagctgtaaaccccgaccggccgccatctcaagttccgcaaccagcgtatccgctgttccagccgaccgaaagagtaactccacagccgcacaggaggacgctaaagctgatcctaagggagcattagccgattacgaaggaaaggacgtggccacgagagtgggggaggcctggcaggaacggcctggagcccctcgcggggggcagggagatcctgccgtccccgctcagcagccagctgaccccagtaccccggagcgccagtcatctcctagcgggagtgagcaactggtgagacgggaaagttgcggatccagcgtgctcacagattttgagggcaaggatgttgccactaaagtcggcgaggcttggcaagacaggccaggtgcaccgcgaggaggccagggcgacccagccgtccctactcagcagcctgcggacccctccacgcctgagcagcaaaatagcccctcgggatctgagcaattcgttaggagagaaagctgtacctctcgggtccggtccccttcctcctgcatggttactgtgaccgtgaccgccacaagtgaacagccacatatctatataccagcccctgcctccgaactcgacagctcatcgacaaccaaaggaattctatttgttaaggagtacgtgaatgccagtgaggtgagcagtggcaagccagtttctgctagatacagtaacgtttctagcattgaggattcatttgcgatggagaaaaagcccccctgtggtagcaccccttattcagagcgcaccaccggtggcatatgtacctactgcaatagagagattcgggactgcccaaagattacgctggaacatttggggatatgttgtcacgagtattgtttcaaatgtggaatttgctccaaacccatgggggacttgctagaccagattttcattcacagagataccatccattgtgggaagtgttacgagaaactcttctag

SEQ ID NO: 18177 - DNA, 1899 bp, Artificial Sequence
  Description of Artificial Sequence: Synthetic coding sequence
atgcagcgggaggagggctttaacacgaaaatggccgacgggcctgatgaatacgacacagaagcggggtgtgtacctctcttacaccccgaggaaattaagcctcaatcccattataatcatggctacggagagccactcggccggaaaacacacattgacgactacagcacctgggatattgtcaaagcaacacagtatggcatctatgagaggtgcagggaactggttgaggccggttacgacgttagacaacctgacaaagaaaacgtgaccctgctgcattgggccgccattaacaatcggatcgatcttgtcaagtactacatctccaagggcgctatcgtcgaccagctggggggagatcttaatagcacgcctctccattgggcaacaagacaaggacacctgtcaatggtcgttcaactcatgaagtacggcgcagatcctagtctcatagatggcgagggatgctcttgcatccaccttgcagcccagtttggtcatacctcgatcgtcgcctatctgattgcaaaagggcaggatgtagacatgatggatcagaacgggatgactccattaatgtgggccgcatatcggacccattccgtggaccccaccaggctgctcttaaccttcaatgtgagcgtcaatctcggcgacaaatatcacaagaataccgcgctgcactgggctgtcttggccggaaacactacagtcatctcactgctactagaggcaggagccaatgtggacgcgcagaacatcaaaggagaatccgcgctggatttggccaagcagcggaagaacgtgtggatgataaatcacctccaggaggcgagacaggcaaaaggatatgacaatcctagcttcctgcggaaactgaaggccgacaaagaatttcggcagaaagtcatgcttggcacccctttcctcgtaatttggctcgtgggttttatcgcagacctaaatatcgatagttggctcattaaaggcctcatgtatggcggagtatgggctactgtgcagttcctgtccaagagcttttttgatcattccatgcacagtgcgctgcctctcgggatctatttggccactaagttctggatgtatgtgacctggtttttttggttctggaatgatctcaattttctgtttatccatctaccattcttggcaaattctgtagccctgttttataacttcgggaagagttggaagagtgatccagggattataaaagctacagaggaacaaaagaagaagacaatagtggagcttgccgagacgggatccctagacctgtctattttctgttccacttgcttgatacgaaaaccagtgcggagcaaacactgcggtgtgtgtaatcgctgcatagctaagttcgatcaccattgcccctgggttggaaattgtgtgggtgccggtaaccacaggtactttatggggtacttgttctttttgttgtttatgatatgctggatgatctacggctgcattagttattggggactccactgcgaaaccacttataccaaggacgggttttggacatatattacacagatcgcgacttgtagcccatggatgttctggatgtttcttaattccgtatttcattttatgtgggttgcagtcctgttgatgtgtcagatgtatcagattagttgtctcgggatcaccactaatgaaaggatgaacgctcgaaggtacaagcatttcaaagtgaccactacctccatcgagagcccatttaaccacgggtgtgttcgaaatattattgacttctttgaattcagatgttgcgggttatttaggcctgtgatcgtcgattggactcggcaatacacgattgaatatgatcaaatatccggctccggataccagctagtttag

SEQ ID NO: 18178 - DNA, 651 bp, Artificial Sequence
  Description of Artificial Sequence: Synthetic coding sequence
atgtccaccataccaaagagggccgtttgtccctttagcacacagaggtacgggatctacgagagatgccgggaactcgttgaagcaggctatgacgtcagacaaccagacaaagaaaacgttacgctgctgcactgggcagcaatcaataaccggatagatttagtgaaatattatattagcaagggcgccatcgtcgaccagctaggtggggacctgaacagcacaccgctgcactgggctacaaggcagggtcacttgtccatggtagtccagctgatgaaatacggcgcagatcccagcctaattgacggggaaggctgtagctgtatacacctggcggcacagtttggtcatacgtccatagtcgcctatctgatcgctaaagggcaagacgttgatatgatggatcaaaatggcatgaccccactcatgtgggccgcgtacagaacacactccgtcgacccgactcgcctgctgctgacatttaacgtctctgtaaatcttggggacaaataccacaagaatactgcgctccactgggccgtgcttgccggcaacacaactgtaatatcacttttgctcgaggcgggcgccaacgtcgatgcacagaacattaaagcaatactgcggtgtcatatggccttatag

SEQ ID NO: 18179 - DNA, 1899 bp, Artificial Sequence
  Description of Artificial Sequence: Synthetic coding sequence
atgcagagagaggaaggattcaatactaaaatggccgatgggcccgacgagtacgacaccgaggcaggatgtgtccccttactgcacccggaggaaattaaaccacagagccactacaaccacggatatggcgaacccctgggccgaaaaacccacatcgacgactactccacctgggatattgtgaaagcgacccagtatggtatttatgaacgttgtcgcgaactggtggaggcgggatatgacgttagacagccggataaggagaatgttactctactgcactgggctgcaatcaacaaccgtattgatctcgttaaatactatatatctaagggggcaatcgtggatcagctggggggggaccttaattccactccactgcattgggcaacacgtcagggtcacctgtctatggttgtgcagcttatgaagtacggagctgacccatccttgattgatggggagggatgttcctgcattcatctagcagcccagttcgggcacactagcatcgtagcgtatttgatcgctaagggccaggatgtggacatgatggaccagaatggaatgacaccactgatgtgggccgcatataggacccactctgttgacccaacaaggctgctgctgacctttaatgtgtctgtcaaccttggcgataagtatcacaagaacacagcactccattgggctgtgctcgcggggaatacaactgtaatcagcctccttttggaggcgggagctaacgtcgatgctcagaatattaagggggagtccgcactagatctggccaaacaacgaaaaaacgtctggatgatcaatcatttgcaggaggcaaggcaagcaaagggatacgacaatccaagctttctgcggaagctgaaggccgacaaagaattcagacaaaaggtgatgttaggaaccccttttctggtcatttggctggtggggttcattgcggatttgaatattgattcctggctgatcaaggggttaatgtacgggggagtgtgggccacggtccagtttttatccaaaagttttttcgaccattctatgcactccgccctccctctcggcatctacctggcaacgaaattctggatgtacgtaacttggtttttctggttctggaacgacctcaactttctctttattcatctgccttttctggccaatagcgttgcattattttacaatttcggaaagtcttggaagtccgatcctgggatcattaaagctaccgaggaacagaaaaagaaaacaatcgtcgaactagctgaaactgggtcgctggatctatctatcttctgttccacttgtttaatcagaaagccagtgcgaagcaagcactgcggtgtgtgcaaccgctgtattgcaaaattcgatcaccactgtccatgggtaggcaattgtgtgggcgctggcaaccaccgatacttcatggggtatctgttctttctgctattcatgatctgctggatgatctatggctgcatatcctattgggggctgcattgtgaaactacatacacgaaggacgggttctggacgtatataacacaaattgctacatgtagcccctggatgttctggatgtttcttaatagcgtgttccactttatgtgggtggccgtgctgctgatgtgtcagatgtaccagattagctgtctggggatcacaactaatgaacggatgaatgcccgaaggtataaacacttcaaagtgaccactacgtcgatcgagtcccccttcaaccacgggtgtgtccgtaacataattgatttttttgaattccgatgctgtggcctgttccggcccgtgatcgtcgattggacaaggcagtacaccattgagtatgatcagatcagtggttcaggctatcagcttgtttag

SEQ ID NO: 18180 - DNA, 2667 bp, Artificial Sequence
  Description of Artificial Sequence: Synthetic coding sequence
atgctgagccgcctcttcaggatgcacggcctgtttgtggccagccacccctgggaggtgattgtgggcaccgtgaccctgaccatctgcatgatgtccatgaacatgttcaccggcaacaacaagatctgtggctggaactatgaatgtcccaagtttgaagaagatgtgctgagcagtgacatcatcatcctgaccatcacccgctgcatcgccatcctgtacatctacttccagttccagaacctgcggcagctgggcagcaagtacatcctgggcattgctggcctcttcaccatcttcagcagctttgtgttcagcacagtggtgatccacttcctggacaaggagctgaccggcctgaatgaggccctgcccttcttcctgctgctgattgacctgagccgggccagcaccctggccaagtttgccctgagcagcaacagccaggatgaggtgagagaaaatattgcccggggcatggccatcctgggccccaccttcaccctggatgccctggtggagtgcctggtgattggagtgggcaccatgtctggagtgcggcagctggagatcatgtgctgcttcggctgcatgtctgtgctggccaactactttgtgttcatgaccttcttccctgcctgtgtgtccctggtgctggagctgagccgggagagccgggagggccggcccatctggcagctgagccactttgcccgggtgctggaggaggaggagaacaagcccaaccctgtgacccagagggtgaagatgatcatgagcctgggcctggtgctggtgcacgcccacagccgctggattgctgaccccagcccccagaacagcacagctgacaccagcaaggtgtccctgggcctggatgaaaatgtgtccaagagaattgagcccagcgtgtccctgtggcagttctacctgagcaagatgatctccatggacatcgagcaggtgatcaccctgagcctggccctgctgctggccgtgaagtacatcttctttgagcagacagaaacagagagcaccctgagcctgaagaaccccatcaccagccctgtggtgacccagaagaaggtgcctgacaactgctgccggcgggagcccatgctggtgaggaacaaccagaagtgtgacagcgtggaggaggagaccggcatcaaccgggagaggaaggtggaggtgatcaagcccctggtggccgagacagacacccccaacagagccacctttgtggtgggcaacagcagcctgctggacaccagctctgtgctggtgacccaggagcctgagattgagctgccccgggagccccggcccaatgaagaatgtctgcagatcctgggcaatgctgagaagggggccaagttcctgagtgatgctgagatcatccagctggtgaatgccaagcacatcccagcctacaagctggagaccctgatggagacccatgagcggggcgtgtccatccggcggcagctgctgagcaagaagctgtctgagcccagcagcctgcagtacctgccctacagagactacaactacagcctggtgatgggcgcctgctgtgaaaatgtgattggctacatgcccatccctgtgggcgtggccggccccctgtgcctggatgagaaggagttccaggtgcccatggccaccacagagggctgcctggtggccagcaccaacagaggctgccgggccatcggcctgggcggcggggccagcagccgggtgctggctgatggcatgacccggggccctgtggtgcggctgccccgggcctgtgacagcgctgaggtgaaggcctggctggagaccagcgagggctttgctgtgatcaaggaggcctttgacagcaccagcagatttgcccggctgcagaagctgcacaccagcattgctggaagaaacctgtacatccgcttccagagccgctctggagatgccatgggcatgaacatgatcagcaagggcacagagaaggccctgagcaagctgcacgagtacttccctgagatgcagatcctggccgtgtctggcaactactgcacagacaagaagccagctgccatcaactggattgagggccggggcaagtctgtggtgtgtgaggccgtcatcccagccaaggtggtgcgggaggtgctgaagaccaccacagaggccatgattgaggtgaacatcaacaagaacctggtgggcagcgccatggccggcagcatcggcggctacaatgcccatgctgccaacatcgtgacagccatctacatcgcctgtggccaggatgctgcccagaatgtgggcagcagcaactgcatcaccctgatggaggccagcggccccaccaatgaagatctctacatcagctgcaccatgcccagcattgagatcggcaccgtgggcggcggcaccaacctgctgccccagcaggcctgcctgcagatgctgggcgtgcagggcgcctgcaaggacaaccctggagaaaatgcccggcagctggccagaattgtgtgtggcaccgtgatggccggggagctgagcctgatggccgccctggccgccggccacctggtgaagagccacatgatccacaacagaagcaagatcaacctgcaggacctgcagggcgcctgcaccaagaagacagcctag

SEQ ID NO: 18181 - DNA, 2508 bp, Artificial Sequence
  Description of Artificial Sequence: Synthetic coding sequence
atgctgagccgcctcttcaggatgcacggcctgtttgtggccagccacccctgggaggtgattgtgggcaccgtgaccctgaccatctgcatgatgtccatgaacatgttcaccggcaacaacaagatctgtggctggaactatgaatgtcccaagtttgaagaagatgtgctgagcagtgacatcatcatcctgaccatcacccgctgcatcgccatcctgtacatctacttccagttccagaacctgcggcagctgggcagcaagtacatcctgggcattgctggcctcttcaccatcttcagcagctttgtgttcagcacagtggtgatccacttcctggacaaggagctgaccggcctgaatgaggccctgcccttcttcctgctgctgattgacctgagccgggccagcaccctggccaagtttgccctgagcagcaacagccaggatgaggtgagagaaaatattgcccggggcatggccatcctgggccccaccttcaccctggatgccctggtggagtgcctggtgattggagtgggcaccatgtctggagtgcggcagctggagatcatgtgctgcttcggctgcatgtctgtgctggccaactactttgtgttcatgaccttcttccctgcctgtgtgtccctggtgctggagctgagccgggagagccgggagggccggcccatctggcagctgagccactttgcccgggtgctggaggaggaggagaacaagcccaaccctgtgacccagagggtgaagatgatcatgagcctgggcctggtgctggtgcacgcccacagccgctggattgctgaccccagcccccagaacagcacagctgacaccagcaaggtgtccctgggcctggatgaaaatgtgtccaagagaattgagcccagcgtgtccctgtggcagttctacctgagcaagatgatctccatggacatcgagcaggtgatcaccctgagcctggccctgctgctggccgtgaagtacatcttctttgagcagacagaaacagagagcaccctgagcctgaagaaccccatcaccagccctgtggtgacccagaagaaggtgcctgacaactgctgccggcgggagcccatgctggtgaggaacaaccagaagtgtgacagcgtggaggaggagaccggcatcaaccgggagaggaaggtggaggtgatcaagcccctggtggccgagacagacacccccaacagagccacctttgtggtgggcaacagcagcctgctggacaccagctctgtgctggtgacccaggagcctgagattgagctgccccgggagccccggcccaatgaagaatgtctgcagatcctgggcaatgctgagaagggggccaagttcctgagtgatgctgagatcatccagctggtgaatgccaagcacatcccagcctacaagctggagaccctgatggagacccatgagcggggcgtgtccatccggcggcagctgctgagcaagaagctgtctgagcccagcagcctgcagtacctgccctacagagactacaactacagcctgctgggcggcggggccagcagccgggtgctggctgatggcatgacccggggccctgtggtgcggctgccccgggcctgtgacagcgctgaggtgaaggcctggctggagaccagcgagggctttgctgtgatcaaggaggcctttgacagcaccagcagatttgcccggctgcagaagctgcacaccagcattgctggcaggaacctgtacatccgcttccagagccgctctggagatgccatgggcatgaacatgatcagcaaaggaacagagaaggccctgagcaagctgcacgagtacttccctgagatgcagatcctggccgtgtctggcaactactgcacagacaagaagccagctgccatcaactggattgagggccggggcaagtctgtggtgtgtgaggccgtcatcccagccaaggtggtgcgggaggtgctgaagaccaccacagaggccatgattgaggtgaacatcaacaagaacctggtgggcagcgccatggccggcagcattggaggctacaatgcccacgccgccaacatcgtgacagccatctacatcgcctgtggccaggatgctgcccagaatgtgggcagcagcaactgcatcaccctgatggaggccagcggccccaccaatgaagacctgtacatcagctgcaccatgcccagcattgaaattggaacagtgggcggcggcaccaacctgctgccccagcaggcctgcctgcagatgctgggcgtgcagggcgcctgcaaggacaaccctggagaaaatgcccggcagctggcccgcatcgtgtgtggcaccgtgatggccggggagctgagcctgatggccgccctggccgccggccacctggtgaagagccacatgatccacaacagaagcaagatcaacctgcaggacctgcagggcgcctgcaccaagaagacagcctag

SEQ ID NO: 18182 - DNA, 798 bp, Artificial Sequence
  Description of Artificial Sequence: Synthetic coding sequence
atgctgagccgcctcttcaggatgcacggcctgtttgtggccagccacccctgggaggtgattgtgggcaccgtgaccctgaccatctgcatgatgtccatgaacatgttcacagagggcacagagaaggccctgagcaagctgcacgagtacttccctgagatgcagatcctggccgtgtctggcaactactgcacagacaagaagccagctgccatcaactggattgagggccggggcaagtctgtggtgtgtgaggccgtcatcccagccaaggtggtgcgggaggtgctgaagaccaccacagaggccatgattgaggtgaacatcaacaagaacctggtgggcagcgccatggccggcagcattggaggctacaatgcccacgccgccaacatcgtgacagccatctacatcgcctgtggccaggatgctgcccagaatgtgggcagcagcaactgcatcaccctgatggaggccagcggccccaccaatgaagacctgtacatcagctgcaccatgcccagcattgaaattggaacagtgggcggcggcaccaacctgctgccccagcaggcctgcctgcagatgctgggcgtgcagggcgcctgcaaggacaaccctggagaaaatgcccggcagctggcccgcatcgtgtgtggcaccgtgatggccggggagctgagcctgatggccgccctggccgccggccacctggtgaagagccacatgatccacaacagaagcaagatcaacctgcaggacctgcagggcgcctgcaccaagaagacagcctag

SEQ ID NO: 18183 - DNA, 57 bp, Artificial Sequence
  Description of Artificial Sequence: Synthetic coding sequence
atgctgagccgcctcttcaggatgcacggcctgtttgtggccagccacccctggtag

SEQ ID NO: 18184 - DNA, 336 bp, Artificial Sequence
  Description of Artificial Sequence: Synthetic coding sequence
atgctgagccgcctcttcaggatgcacggcctgtttgtggccagccacccctgggaggtgattgtgggcaccgtgaccctgaccatctgcatgatgtccatgaacatgttcaccggcaacaacaagatctgtggctggaactatgaatgtcccaagtttgaagaagatgtgctgagcagtgacatcatcatcctgaccatcacccgctgcatcgccatcctgtacatctacttccagttccagaacctgcggcagctgggcagcaagtacatcctgggcattgctggcctcttcaccatcttcagcagctttgtgttcagcacagtggtgatctag

SEQ ID NO: 18185 - DNA, 2667 bp, Artificial Sequence; identical to SEQ ID NO: 18180
  Description of Artificial Sequence: Synthetic coding sequence

SEQ ID NO: 18186 - DNA, 2460 bp, Artificial Sequence
  Description of Artificial Sequence: Synthetic coding sequence
atgcacagccaccctgtgtacctgctgcctgtgcctgagttcaccagcacctggatcaagatctacttcggctactgctggcccttccacaacttcctgaagttctgcatccagtacagctgccacagcctgctgcggcagagaattgaccggctggaggaggccctgcccttcttcctgctgctgattgacctgagccgggccagcaccctggccaagtttgccctgagcagcaacagccaggatgaggtgcgggagaacatcgcccggggcatggccatcctgggccccaccttcaccctggatgccctggtggagtgcctggtgattggagtgggcaccatgtctggagtgcggcagctggagatcatgtgctgcttcggctgcatgtctgtgctggccaactactttgtgttcatgaccttcttccctgcctgtgtgtccctggtgctggagctgagccgggagagccgggagggccggcccatctggcagctgagccactttgcccgggtgctggaggaggaggagaacaagcccaaccctgtgacccagagggtgaagatgatcatgagcctgggcctggtgctggtgcacgcccacagccgctggattgctgaccccagcccccagaacagcacagctgacaccagcaaggtgtccctgggcctggatgaaaatgtgtccaagagaattgagcccagcgtgtccctgtggcagttctacctgagcaagatgatctccatggacatcgagcaggtgatcaccctgagcctggccctgctgctggccgtgaagtacatcttctttgagcagacagaaacagagagcaccctgagcctgaagaaccccatcaccagccctgtggtgacccagaagaaggtgcctgacaactgctgcagaagagagcccatgctggtgaggaacaaccagaagtgtgacagcgtggaggaggagaccggcatcaaccgggagaggaaggtggaggtgatcaagcccctggtggccgagacagacacccccaacagagccacctttgtggtgggcaacagcagcctgctggacaccagctctgtgctggtgacccaggagcctgagattgagctgccccgggagccccggcccaatgaggagtgcctgcagatcctgggcaatgctgagaagggggccaagttcctgagtgatgctgagatcatccagctggtgaatgccaagcacatcccagcctacaagctggagaccctgatggagacccatgagcggggcgtgtccatccggcggcagctgctgagcaagaagctgtctgagcccagcagcctgcagtacctgccctacagagactacaactacagcctggtgatgggcgcctgctgtgaaaatgtcatcggctacatgcccatccctgtgggcgtggccggccccctgtgcctggatgagaaggagttccaggtgcccatggccaccacagagggctgcctggtggccagcaccaacagaggctgccgggccatcggcctgggcggcggggccagcagccgggtgctggctgatggcatgacccggggccctgtggtgcggctgccccgggcctgtgacagcgctgaggtgaaggcctggctggagaccagcgagggctttgctgtgatcaaggaggcctttgacagcaccagcagatttgcccggctgcagaagctgcacaccagcattgctggcaggaacctgtacatccgcttccagagccgctctggagatgccatgggcatgaacatgatcagcaaaggaacagagaaggccctgagcaagctgcacgagtacttccctgagatgcagatcctggccgtgtctggcaactactgcacagacaagaagccagctgccatcaactggattgagggccggggcaagtctgtggtgtgtgaggccgtcatcccagccaaggtggtgcgggaggtgctgaagaccaccacagaggccatgattgaggtgaacatcaacaagaacctggtgggcagcgccatggccggcagcattggaggctacaatgcccacgccgccaacatcgtgacagccatctacatcgcctgtggccaggatgctgcccagaatgtgggcagcagcaactgcatcaccctgatggaggccagcggccccaccaatgaagacctgtacatcagctgcaccatgcccagcattgaaattggaacagtgggcggcggcaccaacctgctgccccagcaggcctgcctgcagatgctgggcgtgcagggcgcctgcaaggacaaccctggagaaaatgcccggcagctggcccgcatcgtgtgtggcaccgtgatggccggggagctgagcctgatggccgccctggccgccggccacctggtgaagagccacatgatccacaacagaagcaagatcaacctgcaggacctgcagggcgcctgcaccaagaagacagcctag

SEQ ID NO: 18187 - DNA, 1671 bp, Artificial Sequence
  Description of Artificial Sequence: Synthetic coding sequence
atggcccggaccaccagccagctgtatgatgctgtgcccatccagagctctgtggtgctgtgcagctgccccagccccagcatggtgaggacccagacagagagcagcaccccacctggcatccctgggggcagccggcagggccctgccatggatggaacagctgctgagcccaggcctggggccggcagcctgcagcacgcccagcccccaccccagcccaggaagaagaggcctgaggacttcaagtttgggaagatcctgggggagggcagcttcagcacagtggtgctggcccgggagctggccaccagccgggagtatgccatcaagatcctggagaagaggcacatcatcaaggagaacaaggtgccctacgtgacccgggagagagatgtgatgagccggctggaccaccccttctttgtgaagctgtacttcaccttccaggatgatgagaagctgtacttcggcctgtcctatgccaagaatggagagctgctgaagtacatcaggaagattggcagctttgatgagacctgcacccgcttctacacagctgagatcgtgtctgccctggagtacctgcacggcaagggcatcatccaccgggacctgaagccagagaacatcctgctgaatgaagacatgcacatccagatcacagactttggaacagccaaggtgctgagccctgagagcaagcaggcccgggccaacagctttgtgggcacagcccagtatgtgtccccagagctgctgacagagaagagcgcctgcaagagcagtgacctgtgggccctgggctgcatcatctaccagctggtggccggcctgccccccttccgggctggaaatgagtacctgatcttccagaagatcatcaagctggagtatgacttccctgagaagttcttccccaaggcccgggacctggtggagaagctgctggtgctggatgccaccaagaggctgggctgtgaggagatggagggctacggccccctgaaggcccaccccttctttgagagcgtgacctgggagaacctgcaccagcagaccccacccaagctgacagcctacctgcctgccatgtctgaagatgatgaggactgctacggcaactatgacaacctgctgagccagtttggctgcatgcaggtgagcagcagcagcagcagccacagcctgagcgccagtgacaccggcctgccccagaggagcggcagcaacatcgagcagtacatccatgacctggacagcaacagctttgagctggacctgcagttctctgaagatgagaagaggctgctgctggagaagcaggccggcggcaacccctggcaccagtttgtggagaacaacctgatcctgaagatgggccctgtggacaagaggaagggcctgtttgcccggcggcggcagctgctgctgacagagggcccccacctgtactacgtggaccctgtgaacaaggtgctgaagggggagatcccctggagccaggagctgcggcctgaggccaagaacttcaagaccttctttgtgcacacccccaacagaacctactacctgatggaccccagcggaaatgcccacaagtggtgcaggaagatccaggaggtgtggaggcagcgctaccagagccacccagatgctgctgtgcagtag

SEQ ID NO: 18188 - DNA, 1599 bp, Artificial Sequence
  Description of Artificial Sequence: Synthetic coding sequence
atggcccggaccaccagccagctgtatgatgctgtgcccatccagagctctgtggtgctgtgcagctgccccagccccagcatggtgaggacccagacagagagcagcaccccacctggcatccctgggggcagccggcagggccctgccatggatggaacagctgctgagcccaggcctggggccggcagcctgcagcacgcccagcccccaccccagcccaggaagaagaggcctgaggacttcaagtttgggaagatcctgggggagggcagcttcagcacagtggtgctggcccgggagctggccaccagccgggagtatgccatcaagatcctggagaagaggcacatcatcaaggagaacaaggtgccctacgtgacccgggagagagatgtgatgagccggctggaccaccccttctttgtgaagctgtacttcaccttccaggatgatgagaagctgtacttcggcctgtcctatgccaagaatggagagctgctgaagtacatcaggaagattggcagctttgatgagacctgcacccgcttctacacagctgagatcgtgtctgccctggagtacctgcacggcaagggcatcatccaccgggacctgaagccagagaacatcctgctgaatgaagacatgcacatccagatcacagactttggaacagccaaggtgctgagccctgagagcaagcagggcgtgtctgacctgtgggccctgggctgcatcatctaccagctggtggccggcctgccccccttccgggctggaaatgagtacctgatcttccagaagatcatcaagctggagtatgacttccctgagaagttcttccccaaggcccgggacctggtggagaagctgctggtgctggatgccaccaagaggctgggctgtgaggagatggagggctacggccccctgaaggcccaccccttctttgagagcgtgacctgggagaacctgcaccagcagaccccacccaagctgacagcctacctgcctgccatgtctgaagatgatgaggactgctacggcaactatgacaacctgctgagccagtttggctgcatgcaggtgagcagcagcagcagcagccacagcctgagcgccagtgacaccggcctgccccagaggagcggcagcaacatcgagcagtacatccatgacctggacagcaacagctttgagctggacctgcagttctctgaagatgagaagaggctgctgctggagaagcaggccggcggcaacccctggcaccagtttgtggagaacaacctgatcctgaagatgggccctgtggacaagaggaagggcctgtttgcccggcggcggcagctgctgctgacagagggcccccacctgtactacgtggaccctgtgaacaaggtgctgaagggggagatcccctggagccaggagctgcggcctgaggccaagaacttcaagaccttctttgtgcacacccccaacagaacctactacctgatggaccccagcggaaatgcccacaagtggtgcaggaagatccaggaggtgtggaggcagcgctaccagagccacccagatgctgctgtgcagtag

SEQ ID NO: 18189 - DNA, 1479 bp, Artificial Sequence
  Description of Artificial Sequence: Synthetic coding sequence
cgggcccaggatgagggcggccactgctggggcagcgccagcggccgccgcaccctgcggcggcggcgggccgcccagagatgtggcggcggggcccgggcagatgctggccccatggcccggaccaccagccagctgtatgatgctgtgcccatccagagctctgtggtgctgtgcagctgccccagccccagcatggtgaggacccagacagagagcagcaccccacctggcatccctgggggcagccggcagggccctgccatggatggaacagctgctgagcccaggcctggggccggcagcctgcagcacgcccagcccccaccccagcccaggaagaagaggcctgaggacttcaagtttgggaagatcctgggggagggcagcttcagcacagtggtgctggcccgggagctggccaccagccgggagtatgccatcaagatcctggagaagaggcacatcatcaaggagaacaaggtgccctacgtgacccgggagagagatgtgatgagccggctggaccaccccttctttgtgaagctgtacttcaccttccaggatgatgagaagctgtacttcggcctgtcctatgccaagaatggagagctgctgaagtacatcaggaagattggcagctttgatgagacctgcacccgcttctacacagctgagatcgtgtctgccctggagtacctgcacggcaagggcatcatccaccgggacctgaagccagagaacatcctgctgaatgaagacatgcacatccagatcacagactttggaacagccaaggtgctgagccctgagagcaagcaggcccgggccaacagctttgtgggcacagcccagtatgtgtccccagagctgctgacagagaagagcgcctgcaagagcagtgacctgtgggccctgggctgcatcatctaccagctggtggccggcctgccccccttccgggctggaaatgagtacctgatcttccagaagatcatcaagctggagtatgacttccctgagaagttcttccccaaggcccgggacctggtggagaagctgctggtgctggatgccaccaagaggctgggctgtgaggagatggagggctacggccccctgaaggcccaccccttctttgagagcgtgacctgggagaacctgcaccagcagaccccacccaagctgacagcctacctgcctgccatgtctgaagatgatgaggactgctacggcaactatgacaacctgctgagccagtttggctgcatgcaggtgagcagcagcagcagcagccacagcctgagcgccagtgacaccggcctgccccagaggagcggcagcaacatcgagcagtacatccatgacctggacagcaacagctttgagctggacctgcagttctctgaagatgagaagaggctgctgctggagaagcaggccggcggcaacccctgcctgaccggccgcatcatctag

SEQ ID NO: 18190 - DNA, 1290 bp, Artificial Sequence
  Description of Artificial Sequence: Synthetic coding sequence
atggcccggaccaccagccagctgtatgatgctgtgcccatccagagctctgtggtgctgtgcagctgccccagccccagcatggtgaggacccagacagagagcagcaccccacctggcatccctgggggcagccggcagggccctgccatggatggaacagctgctgagcccaggcctggggccggcagcctgcagcacgcccagcccccaccccagcccaggaagaagaggcctgaggacttcaagtttgggaagatcctgggggagggcagcttcagcacagtggtgctggcccgggagctggccaccagccgggagtatgccacccgggccaacagctttgtgggcacagcccagtatgtgtccccagagctgctgacagagaagagcgcctgcaagagcagtgacctgtgggccctgggctgcatcatctaccagctggtggccggcctgccccccttccgggctggaaatgagtacctgatcttccagaagatcatcaagctggagtatgacttccctgagaagttcttccccaaggcccgggacctggtggagaagctgctggtgctggatgccaccaagaggctgggctgtgaggagatggagggctacggccccctgaaggcccaccccttctttgaatctgtgacctgggagaacctgcaccagcagaccccacccaagctgacagcctacctgcctgccatgtctgaagatgatgaggactgctacggcaactatgacaacctgctgagccagtttggctgcatgcaggtgagcagcagcagcagcagccacagcctgagcgccagtgacaccggcctgccccagaggagcggcagcaacatcgagcagtacatccatgacctggacagcaacagctttgagctggacctgcagttctctgaagatgagaagaggctgctgctggagaagcaggccggcggcaacccctggcaccagtttgtggagaacaacctgatcctgaagatgggccctgtggacaagaggaagggcctgtttgcccggcggcggcagctgctgctgacagagggcccccacctgtactacgtggaccctgtgaacaaggtgctgaagggggagatcccctggagccaggagctgcggcctgaggccaagaacttcaagaccttctttgtgcacacccccaacagaacctactacctgatggaccccagcggaaatgcccacaagtggtgcaggaagatccaggaggtgtggaggcagcgctaccagagccacccagatgctgctgtgcagtag

SEQ ID NO: 18191 - DNA, 5121 bp, Artificial Sequence
  Description of Artificial Sequence: Synthetic coding sequence
atgggcgtgcccaagttctaccgctggatcagcgagcgctacccctgcctgtctgaggtggtgaaggagcaccagatccctgagtttgacaacctgtacctggacatgaatggcatcatccaccagtgcagccaccccaatgatgatgatgtgcacttccgcatcagtgatgacaagatcttcacagacatcttccactacctggaggtgctcttccgcatcatcaagcccaggaaggtgttcttcatggctgtggatggagtggccccccgggccaagatgaaccagcagaggggccgccgcttccgcagcgccaaggaggccgaggacaagatcaagaaggccatcgagaagggggagaccctgcccacagaggccaggtttgacagcaactgcatcaccccaggcacagagttcatggcccggctgcacgagcacctgaagtactttgtgaacatgaagatcagcacagacaagtcctggcagggcgtgaccatctacttcagcggccacgagaccccaggagagggggagcacaagatcatggagttcatccgctctgagaaggccaagccagaccatgaccccaacaccaggcactgcctgtatggcctggatgctgacctgatcatgctgggcctgaccagccatgaggcccacttcagcctgctgcgggaggaggtgcgctttggaggcaagaagacccagagggtgtgtgcccctgaggagaccaccttccacctgctgcacctgagcctgatgagggagtacatcgactatgagttctctgtgctgaaggagaagatcaccttcaagtatgacatcgagcgcatcattgatgactggatcctgatgggcttcctggtgggcaatgacttcatcccccacctgccccacctgcacatcaaccatgatgccctgcccctgctgtatggcacctacgtgaccatcctgcctgagctgggcggctacatcaatgaaagtggccacctgaacctgcccaggtttgagaagtacctggtgaagctgagtgactttgaccgggagcacttcagcgaggtgtttgtggacctgaagtggtttgagagcaaggtgggcaacaagtacctgaatgaagctgctggggtggccgctgaggaggccaggaactacaaggagaagaagaagctgaagggccaggagaacagcctgtgctggacagccctggacaagaatgaaggagagatgatcaccagcaaggacaacctggaggatgaaacagaagatgatgacctgtttgaaacagagttccggcagtacaagaggacctactacatgaccaagatgggcgtggatgtggtgtctgatgacttcctggccgaccaggccgcctgctacgtgcaggccatccagtggatcctgcactactactaccacggcgtgcagagctggagctggtactacccctaccactacgcccccttcctgagtgacatccacaacatcagcaccctgaagatccactttgagctgggcaagcccttcaagccctttgagcagctgctggccgtgctgcctgctgccagcaagaacctgctgcctgcctgctaccagcacctgatgaccaatgaagacagccccatcatcgagtactaccccccagacttcaagacagacctgaatggcaagcagcaggagtgggaggccgtggtgctgatccccttcattgatgagaagaggctgctggaggccatggagacctgcaaccacagcctgaagaaggaggagaggaagaggaaccagcacagtgaatgtctgatgtgctggtatgaccgggacacagagttcatctaccccagcccctggccagagaagtttcctgccatcgagcgctgctgcacccgctacaagatcatcagcctggatgcctggagggtggacatcaacaagaacaagatcaccagaattgaccagaaggccctgtacttctgtggcttccccaccctgaagcacatccgccacaagttcttcctgaagaagagcggcgtgcaggtgttccagcagagcagcagaggagagaacatgatgctggagatcctggtggatgctgagagtgatgagctgactgtggagaatgtggccagctctgtgctgggcaagtctgtgtttgtgaactggccccacctggaggaggcccgggtggtggccgtgtctgatggagagaccaagttctacctggaggagcccccaggcacccagaagctgtacagcggccgcacagccccacccagcaaggtggtgcacctgggggacaaggagcagagcaactgggccaaggaggtgcagggcatcagcgagcactacctgcggaggaagggcatcatcatcaatgagaccagcgctgtggtgtatgcccagctgctgaccggcaggaagtaccagatcaaccagaatggagaggtgcggctggagaagcagtggagcaagcaggtggtgccctttgtgtaccagaccatcgtgaaggacatccgggcctttgacagccgcttcagcaacatcaagaccctggatgacctcttccccctgcgctccatggtgttcatgctgggcaccccctactacggctgcaccggggaggtgcaggacagcggagatgtgatcacagagggccgcatccgggtcatcttcagcatcccctgtgagcccaacctggatgccctgatccagaaccagcacaagtacagcatcaagtacaaccctggctacgtgctggccagccggctgggcgtgtctggctacctggtgagccgcttcaccggcagcatcttcatcggccggggcagcagaagaaacccccacggggaccacaaggccaacgtgggcctgaacctgaagttcaacaagaagaatgaggaggtgcccggctacaccaagaaggtgggcagcgagtggatgtacagcagcgctgctgagcagctgctggccgagtacctggagcgggcccctgagctgttctcctacatcgccaagaacagccaggaggatgtgttctatgaagatgacatctggccaggagaaaatgaaaatggagctgagaaggtgcaggagatcatcacctggctgaagggccaccctgtgtccaccctgagccgcagcagctgtgacctgcagatcctggatgctgccatcgtggagaagattgaggaggaggtggagaagtgcaagcagaggaagaacaacaagaaggtgcgggtgacagtgaagccccacctgctgtaccggcccctggagcagcagcacggcgtcatcccagacagagatgctgagttctgcctgtttgacagagtggtgaatgtgcgggagaacttctctgtgcctgtgggcctgcggggcaccatcatcggcatcaagggggccaaccgggaggctgatgtgctgtttgaggtgctgtttgatgaggagttccctgggggcctgaccatccgctgcagccctggccggggctaccgcctgcccaccagcgccctggtgaacctgagccacggcagccgctctgagaccggcaaccagaagctgacagccatcgtgaagccccagcctgctgtgcaccagcacagcagcagcagctctgtgagcagcggccacctgggcgccctgaaccacagcccccagagcctgtttgtgcccacccaggtgcccaccaaggatgatgatgagttctgcaacatctggcagagcctgcagggcagcggcaagatgcagtacttccagcccaccatccaggagaagggagctgtgctgccccaggagatcagccaggtgaaccagcaccacaagagcggcttcaatgacaacagcgtgaagtaccagcagaggaagcatgacccccacaggaagttcaaggaggagtgcaagagccccaaggccgagtgctggagccagaagatgagcaacaagcagcccaacagcggcatcgagaacttcctggccagcctgaacatcagcaaagaaaatgaggtgcagagcagccaccacggggagcccccatctgaggagcacctgagcccccagagctttgccatgggcaccaggatgctgaaggagatcctgaagattgatggcagcaacacagtggaccacaagaatgagatcaagcagatcgccaatgagatccctgtgagcagcaacagaagagatgaatatggcctgcccagccagcccaagcagaacaagaagctggccagctacatgaacaagccccacagcgccaatgagtaccacaacgtgcagagcatggacaacatgtgctggccagcccccagccagatcccccctgtgtccacccctgtgacagagctgagccgcatctgcagcctggtgggcatgccccagcctgacttctccttcctgaggatgccccagaccatgacagtgtgccaggtgaagctgagcaatggcctgctggtgcacggcccccagtgccacagtgaaaatgaggccaaggagaaggccgccctgtttgccctgcagcagctgggcagcctgggcatgaacttccccctgcccagccaggtgtttgccaactaccccagcgctgtgcccccaggcaccatccccccagccttccccccacccaccggctgggaccactacggcagcaactatgccctgggcgccgccaacatcatgcccagcagcagccacctgtttggctccatgccctggggccccagcgtgcctgtgcctgggaagcccttccaccacaccctgtacagcggcaccatgcccatggccggcggcatccctggaggagtgcacaaccagttcatccccctgcaggtgaccaagaagagggtggccaacaagaagaactttgagaacaaggaggcccagagcagccaggccacccctgtgcagaccagccagcctgacagcagcaacatcgtgaaggtgagcccccgggagagcagcagcgccagcctgaagagcagccccatcgcccagcctgccagcagcttccaggtggagacagccagccagggccacagcatcagccaccacaagagcacccccatcagcagcagcaggaggaagagcaggaagctggccgtgaactttggagtgtccaagcccagcgagtag

SEQ ID NO: 18192 - DNA, 5085 bp, Artificial Sequence
  Description of Artificial Sequence: Synthetic coding sequence
atgggcgtgcccaagttctaccgctggatcagcgagcgctacccctgcctgtctgaggtggtgaaggagcaccagatccctgagtttgacaacctgtacctggacatgaatggcatcatccaccagtgcagccaccccaatgatgatgatgtgcacttccgcatcagtgatgacaagatcttcacagacatcttccactacctggaggtgctcttccgcatcatcaagcccaggaaggtgttcttcatggctgtggatggagtggccccccgggccaagatgaaccagcagaggggccgccgcttccgcagcgccaaggaggccgaggacaagatcaagaaggccatcgagaagggggagaccctgcccacagaggccaggtttgacagcaactgcatcaccccaggcacagagttcatggcccggctgcacgagcacctgaagtactttgtgaacatgaagatcagcacagacaagtcctggcagggcgtgaccatctacttcagcggccacgagaccccaggagagggggagcacaagatcatggagttcatccgctctgagaaggccaagccagaccatgaccccaacaccaggcactgcctgtatggcctggatgctgacctgatcatgctgggcctgaccagccatgaggcccacttcagcctgctgcgggaggaggtgcgctttggaggcaagaagacccagagggtgtgtgcccctgaggagaccaccttccacctgctgcacctgagcctgatgagggagtacatcgactatgagttctctgtgctgaaggagaagatcaccttcaagtatgacatcgagcgcatcattgatgactggatcctgatgggcttcctggtgggcaatgacttcatcccccacctgccccacctgcacatcaaccatgatgccctgcccctgctgtatggcacctacgtgaccatcctgcctgagctgggcggctacatcaatgaaagtggccacctgaacctgcccaggtttgagaagtacctggtgaagctgagtgactttgaccgggagcacttcagcgaggtgtttgtggacctgaagtggtttgagagcaaggtgggcaacaagtacctgaatgaagctgctggggtggccgctgaggaggccaggaactacaaggagaagaagaagctgaagggccaggagaacagcctgtgctggacagccctggacaagaatgaaggagagatgatcaccagcaaggacaacctggaggatgaaacagaagatgatgacctgtttgaaacagagttccggcagtacaagaggacctactacatgaccaagatgggcgtggatgtggtgtctgatgacttcctggccgaccaggccgcctgctacgtgcaggccatccagtggatcctgcactactactaccacggcgtgcagagctggagctggtactacccctaccactacgcccccttcctgagtgacatccacaacatcagcaccctgaagatccactttgagctgggcaagcccttcaagccctttgagcagctgctggccgtgctgcctgctgccagcaagaacctgctgcctgcctgctaccagcacctgatgaccaatgaagacagccccatcatcgagtactaccccccagacttcaagacagacctgaatggcaagcagcaggagtgggaggccgtggtgctgatccccttcattgatgagaagaggctgctggaggccatggagacctgcaaccacagcctgaagaaggaggagaggaagaggaaccagcacagtgaatgtctgatgtgctggtatgaccgggacacagagttcatctaccccagcccctggccagagaagtttcctgccatcgagcgctgctgcacccgctacaagatcatcagcctggatgcctggagggtggacatcaacaagaacaagatcaccagaattgaccagaaggccctgtacttctgtggcttccccaccctgaagcacatccgccacaagttcttcctgaagaagagcggcgtgcaggtgttccagcagagcagcagaggagagaacatgatgctggagatcctggtggatgctgagagtgatgagctgactgtggagaatgtggccagctctgtgctgggcaagtctgtgtttgtgaactggccccacctggaggaggcccgggtggtggccgtgtctgatggagagaccaagttctacctggaggagcccccaggcacccagaagctgtacagcggccgcacagccccacccagcaaggtggtgcacctgggggacaaggagcagagcaactgggccaaggaggtgcagggcatcagcgagcactacctgcggaggaagggcatcatcatcaatgagaccagcgctgtggtgtatgcccagctgctgaccggcaggaagtaccagatcaaccagaatggagaggtgcggctggagaagcagtggagcaagcaggtggtgccctttgtgtaccagaccatcgtgaaggacatccgggcctttgacagccgcttcagcaacatcaagaccctggatgacctcttccccctgcgctccatggtgttcatgctgggcaccccctactacggctgcaccggggaggtgcaggacagcggagatgtgatcacagagggccgcatccgggtcatcttcagcatcccctgtgagcccaacctggatgccctgatccagaaccagcacaagtacagcatcaagtacaaccctggctacgtgctggccagccggctgggcgtgtctggctacctggtgagccgcttcaccggcagcatcttcatcggccggggcagcagaagaaacccccacggggaccacaaggccaacgtgggcctgaacctgaagttcaacaagaagaatgaggaggtgcccggctacaccaagaaggtgggcagcgagtggatgtacagcagcgctgctgagcagctgctggccgagtacctggagcgggcccctgagctgttctcctacatcgccaagaacagccaggaggatgtgttctatgaagatgacatctggccaggagaaaatgaaaatggagctgagaaggtgcaggagatcatcacctggctgaagggccaccctgtgtccaccctgagccgcagcagctgtgacctgcagatcctggatgctgccatcgtggagaagattgaggaggaggtggagaagtgcaagcagaggaagaacaacaagaaggtgcgggtgacagtgaagccccacctgctgtaccggcccctggagcagcagcacggcgtcatcccagacagagatgctgagttctgcctgtttgacagagtggtgaatgtgcgggagaacttctctgtgcctgtgggcctgcggggcaccatcatcggcatcaagggggccaaccgggaggctgatgtgctgtttgaggtgctgtttgatgaggagttccctgggggcctgaccatccgctgcagccctggccggggctaccgcctgcccaccagcgccctggtgaacctgagccacggcagccgctctgagaccggcaaccagaagctgacagccatcgtgaagccccagcctgctgtgcaccagcacagcagcagcagctctgtgagcagcggccacctgggcgccctgaaccacagcccccagagcctgtttgtgcccacccaggtgcccaccaaggatgatgatgagttctgcaacatctggcagagcctgcagggcagcggcaagatgcagtacttccagcccaccatccaggagaagggagctgtgctgccccaggagatcagccaggtgaaccagcaccacaagagcggcttcaatgacaacagcgtgaagtaccagcagaggaagcatgacccccacaggaagttcaaggaggagtgcaagagccccaaggccgagtgctggagccagaagatgagcaacaagcagcccaacagcggcatcgagaacttcctggccagcctgaacatcagcaaagaaaatgaggtgcagagcagccaccacggggagcccccatctgaggagcacctgagcccccagagctttgccatgaagggcaccaggatgctgaaggagatcctgaagattgatggcagcaacacagtggaccacaagaatgagatcaagcagatcgccaatgagatccctgtgagcagcaacagaagagatgaatatggcctgcccagccagcccaagcagaacaagaagctggccagctacatgaacaagccccacagcgccaatgagtaccacaacgtgcagagcatggacaacatgtgctggccagcccccagccagatcccccctgtgtccacccctgtgacagagctgagccgcatctgcagcctggtgggcatgccccagcctgacttctccttcctgaggatgccccagaccatgacagtgtgccaggtgaagctgagcaatggcctgctggtgcacggcccccagtgccacagtgaaaatgaggccaaggagaaggccgccctgtttgccctgcagcagctgggcagcctgggcatgaacttccccctgcccagccaggtgtttgccaactaccccagcgctgtgcccccaggcaccatccccccagccttccccccacccacagccaacatcatgcccagcagcagccacctgtttggctccatgccctggggccccagcgtgcctgtgcctgggaagcccttccaccacaccctgtacagcggcaccatgcccatggccggcggcatccctggaggagtgcacaaccagttcatccccctgcaggtgaccaagaagagggtggccaacaagaagaactttgagaacaaggaggcccagagcagccaggccacccctgtgcagaccagccagcctgacagcagcaacatcgtgaaggtgagcccccgggagagcagcagcgccagcctgaagagcagccccatcgcccagcctgccagcagcttccaggtggagacagccagccagggccacagcatcagccaccacaagagcacccccatcagcagcagcaggaggaagagcaggaagctggccgtgaactttggagtgtccaagcccagcgagtag

SEQ ID NO: 18193 - DNA, 1380 bp, Artificial Sequence
  Description of Artificial Sequence: Synthetic coding sequence
atgggcgtgcccaagttctaccgctggatcagcgagcgctacccctgcctgtctgaggtggtgaaggagcaccagatccctgagtttgacaacctgtacctggacatgaatggcatcatccaccagtgcagccaccccaatgatgatgatgtgcacttccgcatcagtgatgacaagatcttcacagacatcttccactacctggaggtgctcttccgcatcatcaagcccaggaaggtgttcttcatggctgtggatggagtggccccccgggccaagatgaaccagcagaggggccgccgcttccgcagcgccaaggaggccgaggacaagatcaagaaggccatcgagaagggggagaccctgcccacagaggccaggtttgacagcaactgcatcaccccaggcacagagttcatggcccggctgcacgagcacctgaagtactttgtgaacatgaagatcagcacagacaagtcctggcagggcgtgaccatctacttcagcggccacgagaccccaggagagggggagcacaagatcatggagttcatccgctctgagaaggccaagccagaccatgaccccaacaccaggcactgcctgtatggcctggatgctgacctgatcatgctgggcctgaccagccatgaggcccacttcagcctgctgcgggaggaggtgcgctttggaggcaagaagacccagagggtgtgtgcccctgaggagaccaccttccacctgctgcacctgagcctgatgagggagtacatcgactatgagttctctgtgctgaaggagaagatcaccttcaagtatgacatcgagcgcatcattgatgactggatcctgatgggcttcctggtgggcaatgacttcatcccccacctgccccacctgcacatcaaccatgatgccctgcccctgctgtatggcacctacgtgaccatcctgcctgagctgggcggctacatcaatgaaagtggccacctgaacctgcccaggtttgagaagtacctggtgaagctgagtgactttgaccgggagcacttcagcgaggtgtttgtggacctgaagtggtttgagagcaaggtgggcaacaagtacctgaatgaagctgctggggtggccgctgaggaggccaggaactacaaggagaagaagaagctgaagggccaggagaacagcctgtgctggacagccctggacaagaatgaaggagagatgatcaccagcaaggacaacctggaggatgaaacagaagatgatgacctgtttgaaacagagttccggcagtacaagaggacctactacatgaccaagatgggcgtggatgtggtgtctgaatatgtgtttgccaatgccttcatcctgaagtag

SEQ ID NO: 18194 - DNA, 750 bp, Artificial Sequence
  Description of Artificial Sequence: Synthetic coding sequence
atgctgggcctgaccagccatgaggcccacttcagcctgctgcgggaggaggtgcgctttggaggcaagaagacccagagggtgtgtgcccctgaggagaccaccttccacctgctgcacctgagcctgatgagggagtacatcgactatgagttctctgtgctgaaggagaagatcaccttcaagtatgacatcgagcgcatcattgatgactggatcctgatgggcttcctggtgggcaatgacttcatcccccacctgccccacctgcacatcaaccatgatgccctgcccctgctgtatggcacctacgtgaccatcctgcctgagctgggcggctacatcaatgaaagtggccacctgaacctgcccaggtttgagaagtacctggtgaagctgagtgactttgaccgggagcacttcagcgaggtgtttgtggacctgaagtggtttgagagcaaggtgggcaacaagtacctgaatgaagctgctggggtggccgctgaggaggccaggaactacaaggagaagaagaagctgaagggccaggagaacagcctgtgctggacagccctggacaagaatgaaggagagatgatcaccagcaaggacaacctggaggatgaaacagaagatgatgacctgtttgaaacagagttccggcagtacaagaggacctactacatgaccaagatgggcgtggatgtggtgtctgaatatgtgtttgccaatgccttcatcctgaagtag

SEQ ID NO: 18195 - DNA, 3483 bp, Artificial Sequence
  Description of Artificial Sequence: Synthetic coding sequence
tgaacaaatgaagacagccccatcatcgagtactaccccccagacttcaagacagacctgaatggcaagcagcaggagtgggaggccgtggtgctgatccccttcattgatgagcggctgctggaggccatggagacctgcaaccacagcctgaagaaggaggagaggaagaggaaccagcacagtgaatgtctgatgtgctggtatgaccgggacacagagttcatctaccccagcccctggccagagaagtttcctgccatcgagcgctgctgcacccgctacaagatcatcagcctggatgcctggagggtggacatcaacaagaacaagatcaccagaattgaccagaaggccctgtacttctgtggcttccccaccctgaagcacatccgccacaagttcttcctgaagaagagcggcgtgcaggtgttccagcagagcagcagaggagagaacatgatgctggagatcctggtggatgctgagagtgatgagctgactgtggagaatgtggccagctctgtgctgggcaagtctgtgtttgtgaactggccccacctggaggaggcccgggtggtggccgtgtctgatggagagaccaagttctacctggaggagcccccaggcacccagaagctgtacagcggccgcacagccccacccagcaaggtggtgcacctgggggacaaggagcagagcaactgggccaaggaggtgcagggcatcagcgagcactacctgcggaggaagggcatcatcatcaatgagaccagcgctgtggtgtatgcccagctgctgaccggcaggaagtaccagatcaaccagaatggagaggtgcggctggagaagcagtggagcaagcaggtggtgccctttgtgtaccagaccatcgtgaaggacatccgggcctttgacagccgcttcagcaacatcaagaccctggatgacctcttccccctgcgctccatggtgttcatgctgggcaccccctactacggctgcaccggggaggtgcaggacagcggagatgtgatcacagagggccgcatccgggtcatcttcagcatcccctgtgagcccaacctggatgccctgatccagaaccagcacaagtacagcatcaagtacaaccctggctacgtgctggccagccggctgggcgtgtctggctacctggtgagccgcttcaccggcagcatcttcatcggccggggcagcagaagaaacccccacggggaccacaaggccaacgtgggcctgaacctgaagttcaacaagaagaatgaggaggtgcccggctacaccaagaaggtgggcagcgagtggatgtacagcagcgctgctgagcagctgctggccgagtacctggagcgggcccctgagctgttctcctacatcgccaagaacagccaggaggatgtgttctatgaagatgacatctggccaggagaaaatgaaaatggagctgagaaggtgcaggagatcatcacctggctgaagggccaccctgtgtccaccctgagccgcagcagctgtgacctgcagatcctggatgctgccatcgtggagaagattgaggaggaggtggagaagtgcaagcagaggaagaacaacaagaaggtgcgggtgacagtgaagccccacctgctgtaccggcccctggagcagcagcacggcgtcatcccagacagagatgctgagttctgcctgtttgacagagtggtgaatgtgcgggagaacttctctgtgcctgtgggcctgcggggcaccatcatcggcatcaagggggccaaccgggaggctgatgtgctgtttgaggtgctgtttgatgaggagttccctgggggcctgaccatccgctgcagccctggccggggctaccgcctgcccaccagcgccctggtgaacctgagccacggcagccgctctgagaccggcaaccagaagctgacagccatcgtgaagccccagcctgctgtgcaccagcacagcagcagcagctctgtgagcagcggccacctgggcgccctgaaccacagcccccagagcctgtttgtgcccacccaggtgcccaccaaggatgatgatgagttctgcaacatctggcagagcctgcagggcagcggcaagatgcagtacttccagcccaccatccaggagaagggagctgtgctgccccaggagatcagccaggtgaaccagcaccacaagagcggcttcaatgacaacagcgtgaagtaccagcagaggaagcatgacccccacaggaagttcaaggaggagtgcaagagccccaaggccgagtgctggagccagaagatgagcaacaagcagcccaacagcggcatcgagaacttcctggccagcctgaacatcagcaaagaaaatgaggtgcagagcagccaccacggggagcccccatctgaggagcacctgagcccccagagctttgccatgaagggcaccaggatgctgaaggagatcctgaagattgatggcagcaacacagtggaccacaagaatgagatcaagcagatcgccaatgagatccctgtgagcagcaacagaagagatgaatatggcctgcccagccagcccaagcagaacaagaagctggccagctacatgaacaagccccacagcgccaatgagtaccacaacgtgcagagcatggacaacatgtgctggccagcccccagccagatcccccctgtgtccacccctgtgacagagctgagccgcatctgcagcctggtgggcatgccccagcctgacttctccttcctgaggatgccccagaccatgacagtgtgccaggtgaagctgagcaatggcctgctggtgcacggcccccagtgccacagtgaaaatgaggccaaggagaaggccgccctgtttgccctgcagcagctgggcagcctgggcatgaacttccccctgcccagccaggtgtttgccaactaccccagcgctgtgcccccaggcaccatccccccagccttccccccacccacagccaacatcatgcccagcagcagccacctgtttggctccatgccctggggccccagcgtgcctgtgcctgggaagcccttccaccacaccctgtacagcggcaccatgcccatggccggcggcatccctggaggagtgcacaaccagttcatccccctgcaggtgaccaagaagagggtggccaacaagaagaactttgagaacaaggaggcccagagcagccaggccacccctgtgcagaccagccagcctgacagcagcaacatcgtgaaggtgagcccccgggagagcagcagcgccagcctgaagagcagccccatcgcccagcctgccagcagcttccaggtggagacagccagccagggccacagcatcagccaccacaagagcacccccatcagcagcagcaggaggaagagcaggaagctggccgtgaactttggagtgtccaagcccagcgagtag

SEQ ID NO: 18196 - DNA, 1233 bp, Artificial Sequence
  Description of Artificial Sequence: Synthetic coding sequence
atgcctgcccgggccctgctgcccaggaggatgggccacaggaccctggccagcaccccagccctgtgggccagcatcccctgccccaggtctgagctgcggctggacctggtgctgcccagcggccagagcttccgctggagggagcagagccctgcccactggagcggcgtgctggccgaccaggtgtggaccctgacccagacagaggagcagctgcactgcaccgtgtacagaggagacaagagccaggccagccggcccaccccagatgagctggaggccgtgaggaagtacttccagctggatgtgaccctggcccagctgtaccaccactggggctctgtggacagccacttccaggaggtggcccagaagttccagggcgtgcggctgctgcggcaggaccccattgaatgtctcttctccttcatctgcagcagcaacaacaacatcgcccgcatcaccggcatggtggagcggctgtgccaggccttcggccccaggctcatccagctggatgatgtgacctaccacggcttccccagcctgcaggccctggccggccctgaggtggaggcccacctgaggaagctgggcctgggctaccgggcccgctacgtgtctgccagcgcccgggccatcctggaggagcagggcggcctggcctggctgcagcagctgcgggagagcagctatgaggaggcccacaaggccctgtgcatcctgcccggggtgggcaccaaggtggccgactgcatctgcctgatggccctggacaagccccaggccgtgcctgtggatgtgcacatgtggcacatcgcccagagggactacagctggcaccccaccaccagccaggccaagggccccagcccccagaccaacaaggagctgggcaacttcttccgcagcctgtggggcccctatgccggctgggcccaggccaccccacccagctaccgctgctgcagcgtgcccacctgtgccaacccagccatgctgcggagccaccagcagagcgctgagcgggtgcccaagggcaggaaggcccgctggggcaccctggacaaggagatcccccaggcccccagcccccccttccccaccagcctgagccccagcccccccagcctgatgctgggccggggcctgcctgtgaccaccagcaaggcccggcacccccagatcaagcagagcgtgtgcaccacccgctggggcggcggctactag

SEQ ID NO: 18197 - DNA, 1071 bp, Artificial Sequence
  Description of Artificial Sequence: Synthetic coding sequence
atgcctgcccgggccctgctgcccaggaggatgggccacaggaccctggccagcaccccagccctgtgggccagcatcccctgccccaggtctgagctgcggctggacctggtgctgcccagcggccagagcttccgctggagggagcagagccctgcccactggagcggcgtgctggccgaccaggtgtggaccctgacccagacagaggagcagctgcactgcaccgtgtacagaggagacaagagccaggccagccggcccaccccagatgagctggaggccgtgaggaagtacttccagctggatgtgaccctggcccagctgtaccaccactggggctctgtggacagccacttccaggaggtggcccagaagttccagggcgtgcggctgctgcggcaggaccccattgaatgtctcttctccttcatctgcagcagcaacaacaacatcgcccgcatcaccggcatggtggagcggctgtgccaggccttcggccccaggctcatccagctggatgatgtgacctaccacggcttccccagcctgcaggccctggccggccctgaggtggaggcccacctgaggaagctgggcctgggctaccgggcccgctacgtgtctgccagcgcccgggccatcctggaggagcagggcggcctggcctggctgcagcagctgcgggagagcagctatgaggaggcccacaaggccctgtgcatcctgcccggggtgggcaccaaggtggccgactgcatctgcctgatggccctggacaagccccaggccgtgcctgtggatgtgcacatgtggcacatcgcccagagggactacagctggcaccccaccaccagccaggccaagggccccagcccccagaccaacaaggagctgggcaacttcttccgcagcctgtggggcccctatgccggctgggcccaggccctgtgccaggtgatcaccaccttcatgaccttcctgggcccccaccggctggaccagatgcctcctgaggagctgcagaccagcagcagccggctgggcggccccccctggcagtgcatctag

SEQ ID NO: 18198 - DNA, 1275 bp, Artificial Sequence
  Description of Artificial Sequence: Synthetic coding sequence
atgcctgcccgggccctgctgcccaggaggatgggccacaggaccctggccagcaccccagccctgtgggccagcatcccctgccccaggtctgagctgcggctggacctggtgctgcccagcggccagagcttccgctggagggagcagagccctgcccactggagcggcgtgctggccgaccaggtgtggaccctgacccagacagaggagcagctgcactgcaccgtgtacagaggagacaagagccaggccagccggcccaccccagatgagctggaggccgtgaggaagtacttccagctggatgtgaccctggcccagctgtaccaccactggggctctgtggacagccacttccaggaggtggcccagaagttccagggcgtgcggctgctgcggcaggaccccattgaatgtctcttctccttcatctgcagcagcaacaacaacatcgcccgcatcaccggcatggtggagcggctgtgccaggccttcggccccaggctcatccagctggatgatgtgacctaccacggcttccccagcctgcaggccctggccggccctgaggtggaggcccacctgaggaagctgggcctgggctaccgggcccgctacgtgtctgccagcgcccgggccatcctggaggagcagggcggcctggcctggctgcagcagctgcgggagagcagctatgaggaggcccacaaggccctgtgcatcctgcccggggtgggcaccaaggtggccgactgcatctgcctgatggccctggacaagccccaggccgtgcctgtggatgtgcacatgtggcacatcgcccagagggactacagctggcaccccaccaccagccaggccaagggccccagcccccagaccaacaaggagctgggcaacttcttccgcagcctgtggggcccctatgccggctgggcccaggccggcctgctgggcaatgcctttgatggccaccagctgctgcggcccctcatcttctgccaggaccacctgcgggagggcccccccatcggccgcggggacagccagggcgaggagctggagccccagctgcccagcagcctgagcagcatcccctacggcttctgtgaccactgctggaccaaggatgtggatgacccccccctggtgacccaccccagccctggcagcagagatggccacatgacccaggcctggcctgtgaaggtggtgagccccctggccaccgtgattggacatgtgatgcaggccagcctgctggccctgtag

SEQ ID NO: 18199 - DNA, 975 bp, Artificial Sequence
  Description of Artificial Sequence: Synthetic coding sequence
atgcctgcccgggccctgctgcccaggaggatgggccacaggaccctggccagcaccccagccctgtgggccagcatcccctgccccaggtctgagctgcggctggacctggtgctgcccagcggccagagcttccgctggagggagcagagccctgcccactggagcggcgtgctggccgaccaggtgtggaccctgacccagacagaggagcagctgcactgcaccgtgtacagaggagacaagagccaggccagccggcccaccccagatgagctggaggccgtgaggaagtacttccagctggatgtgaccctggcccagctgtaccaccactggggctctgtggacagccacttccaggaggtggcccagaagttccagggcgtgcggctgctgcggcaggaccccattgaatgtctcttctccttcatctgcagcagcaacaacaacatcgcccgcatcaccggcatggtggagcggctgtgccaggccttcggccccaggctcatccagctggatgatgtgacctaccacggcttccccagcctgcaggccctggccggccctgaggtggaggcccacctgaggaagctgggcctgggctaccgggcccgctacgtgtctgccagcgcccgggccatcctggaggagcagggcggcctggcctggctgcagcagctgcgggagagcagctatgaggaggcccacaaggccctgtgcatcctgcccggggtgggcaccaaggtggccgactgcatctgcctgatggccctggacaagccccaggccgtgcctgtggatgtgcacatgtggcacatcgcccagagggactacagctggcaccccaccaccagccaggccaagggccccagcccccagaccaacaaggagctgggcaacttcttccgcagcctgtggggcccctatgccggctgggcccaggccgtgtctgtgccccgctgccccccatag

SEQ ID NO: 18200 - DNA, 594 bp, Artificial Sequence
  Description of Artificial Sequence: Synthetic coding sequence
atggtggagcggctgtgccaggccttcggccccaggctcatccagctggatgatgtgacctaccacggcttccccagcctgcaggccctggccggccctgaggtggaggcccacctgaggaagctgggcctgggctaccgggcccgctacgtgtctgccagcgcccgggccatcctggaggagcagggcggcctggcctggctgcagcagctgcgggagagcagctatgaggaggcccacaaggccctgtgcatcctgcccggggtgggcaccaaggagaccttcagcggggcctgtggggacctgatgctggccggccccaagcgctgctgcagcgtgcccacctgtgccaacccagccatgctgcggagccaccagcagagcgctgagcgggtgcccaagggcaggaaggcccgctggggcaccctggacaaggagatcccccaggcccccagcccccccttccccaccagcctgagccccagcccccccagcctgatgctgggccggggcctgcctgtgaccaccagcaaggcccggcacccccagatcaagcagagcgtgtgcaccacccgctggggcggcggctactag

SEQ ID NO: 18201 - DNA, 1038 bp, Artificial Sequence
  Description of Artificial Sequence: Synthetic coding sequence
atgcctgcccgggccctgctgcccaggaggatgggccacaggaccctggccagcaccccagccctgtgggccagcatcccctgccccaggtctgagctgcggctggacctggtgctgcccagcggccagagcttccgctggagggagcagagccctgcccactggagcggcgtgctggccgaccaggtgtggaccctgacccagacagaggagcagctgcactgcaccgtgtacagaggagacaagagccaggccagccggcccaccccagatgagctggaggccgtgaggaagtacttccagctggatgtgaccctggcccagctgtaccaccactggggctctgtggacagccacttccaggaggtggcccagaagttccagggcgtgcggctgctgcggcaggaccccattgaatgtctcttctccttcatctgcagcagcaacaacaacatcgcccgcatcaccggcatggtggagcggctgtgccaggccttcggccccaggctcatccagctggatgatgtgacctaccacggcttccccagcctgcaggccctggccggccctgaggtggaggcccacctgaggaagctgggcctgggctaccgggcccgctacgtgtctgccagcgcccgggccatcctggaggagcagggcggcctggcctggctgcagcagctgcgggagagcagctatgaggaggcccacaaggccctgtgcatcctgcccggggtgggcaccaaggtggccgactgcatctgcctgatggccctggacaagccccaggccgtgcctgtggatgtgcacatgtggcacatcgcccagagggactacagctggcaccccaccaccagccaggccaagggccccagcccccagaccaacaaggagctgggcaacttcttccgcagcctgtggggcccctatgccggctgggcccaggccgtgctcttctctgctgacctgcggcagagcagacatgcccaggagcccccagccaagaggaggaagggcagcaaaggacctgagggctag

SEQ ID NO: 18202 - DNA, 1074 bp, Artificial Sequence
  Description of Artificial Sequence: Synthetic coding sequence
atgcctgcccgggccctgctgcccaggaggatgggccacaggaccctggccagcaccccagccctgtgggccagcatcccctgccccaggtctgagctgcggctggacctggtgctgcccagcggccagagcttccgctggagggagcagagccctgcccactggagcggcgtgctggccgaccaggtgtggaccctgacccagacagaggagcagctgcactgcaccgtgtacagaggagacaagagccaggccagccggcccaccccagatgagctggaggccgtgaggaagtacttccagctggatgtgaccctggcccagctgtaccaccactggggctctgtggacagccacttccaggaggtggcccagaagttccagggcgtgcggctgctgcggcaggaccccattgaatgtctcttctccttcatctgcagcagcaacaacaacatcgcccgcatcaccggcatggtggagcggctgtgccaggccttcggccccaggctcatccagctggatgatgtgacctaccacggcttccccagcctgcaggccctggccggccctgaggtggaggcccacctgaggaagctgggcctgggctaccgggcccgctacgtgtctgccagcgcccgggccatcctggaggagcagggcggcctggcctggctgcagcagctgcgggagagcagctatgaggaggcccacaaggccctgtgcatcctgcccggggtgggcaccaagggcctgctgggcaatgcctttgatggccaccagctgctgcggcccctcatcttctgccaggaccacctgcgggagggcccccccatcggccgcggggacagccagggcgaggagctggagccccagctgcccagcagcctgagcagcatcccctacggcttctgtgaccactgctggaccaaggatgtggatgatcctcccctggtgacccaccccagccctggcagcagagatggccacatgacccaggcctggcctgtgaaggtggtgagccccctggccaccgtcatcggccacgtgatgcaggccagcctgctggccctgtag

SEQ ID NO: 18203 - DNA, 588 bp, Artificial Sequence
  Description of Artificial Sequence: Synthetic coding sequence
atgcctgcccgggccctgctgcccaggaggatgggccacaggaccctggccagcaccccagccctgtgggccagcatcccctgccccaggtctgagctgcggctggacctggtgctgcccagcggccagagcttccgctggagggagcagagccctgcccactggagcggcgtgctggccgaccaggtgtggaccctgacccagacagaggagcagctgcactgcaccgtgtacagaggagacaagagccaggccagccggcccaccccagatgagctggaggccgtgaggaagtacttccagctggatgtgaccctggcccagctgtaccaccactggggctctgtggacagccacttccaggaggtggcccagaagttccagggcgtgcggctgctgcggcaggaccccattgaatgtctcttctccttcatctgcagcagcaacaacaacatcgcccgcatcaccggcatggtggagcggctgtgccaggccttcggccccaggctcatccagctggatgatgtgacctaccacggcttccccagcctgcaggccctggccggccccccctggcagtgcatctag

SEQ ID NO: 18204 - DNA, 969 bp, Artificial Sequence
  Description of Artificial Sequence: Synthetic coding sequence
atgcctgcccgggccctgctgcccaggaggatgggccacaggaccctggccagcaccccagccctgtgggccagcatcccctgccccaggtctgagctgcggctggacctggtgctgcccagcggccagagcttccgctggagggagcagagccctgcccactggagcggcgtgctggccgaccaggtgtggaccctgacccagacagaggagcagctgcactgcaccgtgtacagaggagacaagagccaggccagccggcccaccccagatgagctggaggccgtgaggaagtacttccagctggatgtgaccctggcccagctgtaccaccactggggctctgtggacagccacttccaggaggtggcccagaagttccagggcgtgcggctgctgcggcaggaccccattgaatgtctcttctccttcatctgcagcagcaacaacaacatcgcccgcatcaccggcatggtggagcggctgtgccaggccttcggccccaggctcatccagctggatgatgtgacctaccacggcttccccagcctgcaggccctggccggccctgaggtggaggcccacctgaggaagctgggcctgggctaccgggcccgctacgtgtctgccagcgcccgggccatcctggaggagcagggcggcctggcctggctgcagcagctgcgggagagcagctatgaggaggcccacaaggccctgtgcatcctgcccggggtgggcaccaaggtggccgactgcatctgcctgatggccctggacaagccccaggccgtgcctgtggatgtgcacatgtggcacatcgcccagagggactacagctggcaccccaccaccagccaggccaagggccccagcccccagaccaacaaggagctgggcaacttcttccgcagcctgtggggcccctatgccggctgggcccaggccgccggcagtgatgccagctag

SEQ ID NO: 18205 - DNA, 6807 bp, Artificial Sequence
  Description of Artificial Sequence: Synthetic coding sequence
atgagcggcctgcacctggtgaagcagggccgggacaggaagaagattgacagccagagggacttcaccgtggccagccctgctgagtttgtgaccaggtttggaggcaacaaggtgattgagaaggtgctgattgccaacaacggcattgctgctgtgaagtgcatgaggagcatccgccgctggagctatgagatgttcagaaatgaaagagccatccgctttgtggtgatggtgaccccagaggacctgaaggccaatgctgagtacatcaagatggctgaccactacgtgcctgtgcctgggggccccaacaacaacaactatgccaacgtggagctgatcctggacatcgccaagagaattcctgtgcaggccgtgtgggccggctggggccacgccagcgagaaccccaagctgcctgagctgctgctgaagaatggaattgccttcatgggcccccccagccaggccatgtgggccctgggggacaagatcgccagcagcatcgtggcccagacagctggcatccccaccctgccctggagcggcagcggcctgcgggtggactggcaggagaatgacttcagcaagaggatcctgaatgtgccccaggagctgtatgagaagggctacgtgaaggatgtggatgatggcctgcaggccgctgaggaggtgggctaccctgtgatgatcaaggccagcgagggcggcggcggcaagggcatcaggaaggtgaacaatgctgatgacttccccaacctcttccggcaggtgcaggccgaggtgcccggcagccccatctttgtgatgaggctggccaagcagagccgccacctggaggtgcagatcctggccgaccagtatggaaatgccatcagcctgtttggccgggactgcagcgtgcagaggaggcaccagaagatcatcgaggaggccccagccaccatcgccaccccagctgtgtttgagcacatggagcagtgtgctgtgaagctggccaagatggtgggctacgtgtctgctggcaccgtggagtacctgtacagccaggacggcagcttctacttcctggagctgaacccccggctgcaggtggagcacccctgcacagagatggtggctgatgtgaacctgcctgctgcccagctgcagatcgccatgggcatccccctgtaccgcatcaaggacatccgcatgatgtatggagtgagcccctggggagacagccccatcgactttgaagattctgcccacgtgccctgcccccggggccacgtgattgctgcccgcatcaccagtgaaaatccagatgagggcttcaagcccagcagcggcaccgtgcaggagctgaacttccgcagcaacaagaatgtgtggggctacttctctgtggccgccgccggcggcctgcacgagtttgctgacagccagtttggccactgcttctcctggggagaaaatcgggaggaggccatcagcaacatggtggtggccctgaaggagctgagcatccggggggacttccgcaccaccgtggagtacctgatcaagctgctggagacagagagcttccagatgaacagaattgacaccggctggctggaccggctgattgctgagaaggtgcaggccgagaggccagacaccatgctgggcgtggtgtgtggggccctgcacgtggctgatgtgtccctgagaaattctgtgagcaacttcctgcacagcctggagcggggccaggtgctgcctgcccacaccctgctgaacacagtggatgtggagctgatctatgagggcgtgaagtatgtgctgaaggtgacccggcagagccccaacagctatgtggtgatcatgaatggcagctgtgtggaggtggatgtgcaccggctgagtgatggcggcctgctgctgtcctatgatggcagcagctacaccacctacatgaaggaggaggtggaccgctaccgcatcaccatcggcaacaagacctgtgtgtttgagaaggaaaatgaccccagcgtgatgaggagccccagcgctgggaagctgatccagtacatcgtggaggatggcggccacgtgtttgctggccagtgctacgccgagattgaggtgatgaagatggtgatgaccctgacagctgtggagagcggctgcatccactacgtgaagaggcctggagctgccctggaccccggctgtgtgctggccaagatgcagctggacaaccccagcaaggtgcagcaggccgagctgcacacaggcagcctgccccgcatccagagcacagccctgcggggggagaagctgcacagggtcttccactacgtgctggacaacctggtgaatgtgatgaatggctactgcctgcctgaccccttcttcagcagcaaggtgaaggactgggtggagcggctgatgaagaccctgcgggaccccagcctgcccctgctggagctgcaggacatcatgacctctgtgtctggccgcatccccccaaatgtggagaagagcatcaagaaggagatggcccagtatgccagcaacatcacctctgtgctgtgccagttccccagccagcagatcgccaacatcctggacagccatgctgccaccctgaacaggaagtctgagcgggaggtgttcttcatgaacacccagagcatcgtgcagctggtgcagcgctacagaagtggcatccggggccacatgaaggctgtggtgatggacctgctgcggcagtacctgcgggtggagacccagttccagaatggccactatgacaagtgtgtgtttgccctgcgggaggagaacaagagtgacatgaacacagtgctgaactacatcttcagccacgcccaggtgaccaagaagaacctgctggtgaccatgctgattgaccagctgtgtggccgggaccccaccctgacagatgagctgctgaacatcctgacagagctgacccagctgagcaagaccaccaatgccaaggtggccctgcgggcccggcaggtgctgattgccagccacctgcccagctatgagctgcggcacaaccaggtggagagcatcttcctgagcgccatcgacatgtatggccaccagttctgcatcgagaacctgcagaagctgatcctgtctgagaccagcatctttgatgtgctgcccaacttcttctaccacagcaaccaggtggtgaggatggccgccctggaggtgtatgtgagaagagcctacatcgcctatgagctgaacagcgtgcagcaccggcagctgaaggacaacacctgtgtggtggagttccagttcatgctgcccaccagccaccccaacagaggcaacatccccaccctgaacaggatgtccttcagcagcaacctgaaccactacggcatgacccacgtggcctctgtgtctgatgtgctgctggacaacagcttcaccccaccctgccagaggatgggcggcatggtgtccttccgcacctttgaagattttgtgcgcatctttgatgaggtgatgggctgcttcagtgacagccccccccagagccccaccttccctgaggccggccacaccagcctgtatgatgaggacaaggtgcccagagatgagcccatccacatcctgaatgtggccatcaagacagactgtgacattgaagatgaccggctggccgccatgttccgggagttcacccagcagaacaaggccaccctggtggaccacggcatccggcggctgaccttcctggtggcccagaaggacttcaggaagcaggtgaactatgaggtggaccggcgcttccaccgggagttccccaagttcttcaccttccgggcccgggacaagtttgaggaggaccgcatctaccgccacctggagcccgccctggccttccagctggagctgaacaggatgaggaactttgacctgacagccatcccctgtgccaaccacaagatgcacctgtacctgggcgccgccaaggtggaggtgggcacagaggtgacagactaccgcttctttgtgcgggccatcatccgccacagcgacctggtgaccaaggaggccagctttgagtacctgcagaatgaaggagagcggctgctgctggaggccatggatgagctggaggtggccttcaacaacaccaacgtgaggacagactgcaaccacatcttcctgaactttgtgcccaccgtcatcatggaccccagcaagattgaggagagcgtgcgctccatggtgatgagatatggcagccggctgtggaagctgcgggtgctgcaggccgagctgaagatcaacatccggctgacccccaccgggaaggccatccccatccgcctcttcctgaccaatgaaagtggctactacctggacatcagcctgtacaaggaggtgacagacagcaggacagcccagatcatgttccaggcctatggagacaagcagggccccctgcacggcatgctgatcaacaccccctacgtgaccaaggacctgctgcagagcaagcgcttccaggcccagagcctgggcaccacctacatctatgacatccctgagatgttccggcagagcctcatcaagctgtgggagagcatgagcacccaggccttcctgcccagcccccccctgcccagcgacatgctgacctacacagagctggtgctggatgaccagggccagctggtgcacatgaaccggctgcccggcggcaatgaaattggcatggtggcctggaagatgaccttcaagagccctgagtacccagagggccgggacatcatcgtgattggaaatgacatcacctaccgcatcggcagctttggcccccaggaggacctgctcttcctgcgggccagcgagctggcccgggcagagggcatcccccgcatctacgtgtctgccaacagcggggcccgcatcggcctggccgaggagatccgccacatgtttcatgtggcctgggtggaccctgaggacccctacaagggctaccgctacctgtacctgaccccccaggactacaagagggtgtctgccctgaacagcgtgcactgtgaacatgtggaggatgaaggagagagccgctacaagatcacagacatcatcggcaaggaggagggcatcggccctgagaacctgcggggcagcggcatgattgctggggagagcagcctggcctacaatgagatcatcaccatcagcctggtgacctgccgggccatcggcattggagcctacctggtgcggctgggccagaggaccatccaggtggagaacagccacctgatcctgactggagctggggccctgaacaaggtgctgggccgggaggtgtacaccagcaacaaccagctgggcggcatccagatcatgcacaacaacggggtgacccactgcaccgtgtgtgatgactttgaaggagtcttcaccgtgctgcactggctgagctacatgcccaagtctgtgcacagctctgtgcccctgctgaacagcaaggaccccatcgaccgcatcattgaatttgtgcccaccaagaccccctatgacccccgctggatgctggccggccggccccaccccacccagaagggccagtggctgagcggcttctttgattatggcagcttcagcgagatcatgcagccctgggcccagacagtggtggtgggccgggcccggctgggcggcatccctgtgggcgtggtggccgtggagaccaggacagtggagctgagcatcccagctgaccctgccaacctggacagcgaggccaagatcatccagcaggccggccaggtgtggttcccagacagcgccttcaagacctaccaggccatcaaggacttcaaccgggagggcctgcccctgatggtgtttgccaactggaggggcttcagcggcggcatgaaggacatgtatgaccaggtgctgaagtttggagcctacatcgtggatggcctgcgggagtgctgccagcctgtgctggtgtacatccccccccaggccgagctgcggggcggctcctgggtggtgattgacagcagcatcaaccccaggcacatggagatgtatgctgaccgggagagccggggctctgtgctggagcctgagggcaccgtggagatcaagttccggaggaaggacctggtgaagaccatgagaagagtggaccctgtgtacatccacctggccgagcggctgggcaccccagagctgagcacagctgagaggaaggagctggagaacaagctgaaggagcgggaggagttcctgatccccatctaccaccaggtggccgtgcagtttgctgacctgcatgacaccccaggccgcatgcaggagaagggcgtcatcagtgacatcctggactggaagaccagcaggaccttcttctactggaggctgcggcggctgctgctggaggacctggtgaagaagaagatccacaatgccaaccctgagctgacagatggccagatccaggccatgctgcggcgctggtttgtggaggtggagggcaccgtgaaggcctacgtgtgggacaacaacaaggacctggccgagtggctggagaagcagctgacagaagaagatggagtgcacagcgtcatcgaggagaacatcaagtgcatcagccgggactatgtgctgaagcagatccgcagcctggtgcaggccaaccctgaggtggccatggacagcatcatccacatgacccagcacatcagccccacccagagagctgaggtgatccgcatcctgagcaccatggacagccccagcacctag

SEQ ID NO: 18206 - DNA, 7152 bp, Artificial Sequence
  Description of Artificial Sequence: Synthetic coding sequence
atgtggtggagcaccctgatgagcatcctgcgggcccggagcttctggaagtggatcagcacccagacagtgcgcatcatccgggctgtgcgggcccactttggaggcatcatggatgagcccagccccctggcccagcccctggagctgaaccagcacagccgcttcatcatcggctctgtgtctgaggacaacagtgaagatgagatcagcaacctggtgaagctggacctgctggaggagaaggagggcagcctgagccctgcctctgtgggcagtgacaccctgagtgacctgggcatcagcagcctgcaggacggcctggccctgcacatccgcagctccatgagcggcctgcacctggtgaagcagggccgggacaggaagaagattgacagccagagggacttcaccgtggccagccctgctgagtttgtgaccaggtttggaggcaacaaggtgattgagaaggtgctgattgccaacaatggaattgctgctgtgaagtgcatgaggagcatccgccgctggagctatgagatgttcagaaatgaaagagccatccgctttgtggtgatggtgaccccagaggacctgaaggccaatgctgagtacatcaagatggctgaccactacgtgcctgtgcctgggggccccaacaacaacaactatgccaacgtggagctgatcctggacatcgccaagagaattcctgtgcaggccgtgtgggccggctggggccacgccagcgagaaccccaagctgcctgagctgctgctgaagaatggcatcgccttcatgggcccccccagccaggccatgtgggccctgggggacaagatcgccagcagcatcgtggcccagacagctggcatccccaccctgccctggagcggcagcggcctgcgggtggactggcaggagaatgacttcagcaagaggatcctgaatgtgccccaggagctgtatgagaagggctacgtgaaggatgtggatgatggcctgcaggccgctgaggaggtgggctaccctgtgatgatcaaggccagcgagggcggcggcggcaagggcatcaggaaggtgaacaatgctgatgacttccccaacctcttccggcaggtgcaggccgaggtgcccggcagccccatctttgtgatgaggctggccaagcagagccgccacctggaggtgcagatcctggccgaccagtatggaaatgccatcagcctgtttggccgggactgcagcgtgcagaggaggcaccagaagatcatcgaggaggccccagccaccatcgccaccccagctgtgtttgagcacatggagcagtgtgctgtgaagctggccaagatggtgggctacgtgtctgctggcaccgtggagtacctgtacagccaggacggcagcttctacttcctggagctgaacccccggctgcaggtggagcacccctgcacagagatggtggctgatgtgaacctgcctgctgcccagctgcagatcgccatgggcatccccctgtaccgcatcaaggacatccgcatgatgtatggagtgagcccctggggagacagccccatcgactttgaggacagcgcccacgtgccctgcccccggggccacgtgattgctgcccgcatcaccagcgagaacccagatgagggcttcaagcccagcagcggcaccgtgcaggagctgaacttccgcagcaacaagaatgtgtggggctacttctctgtggccgctgctgggggcctgcatgaatttgctgacagccagtttggccactgcttctcctggggcgagaaccgggaggaggccatcagcaacatggtggtggccctgaaggagctgagcatccggggggacttccgcaccaccgtggagtacctgatcaagctgctggagacagagagcttccagatgaacagaattgacaccggctggctggaccggctgattgctgagaaggtgcaggccgagaggccagacaccatgctgggcgtggtgtgtggggccctgcacgtggctgatgtgtccctgaggaacagcgtgagcaacttcctgcacagcctggagcggggccaggtgctgcctgcccacaccctgctgaacacagtggatgtggagctgatctatgaaggagtgaagtatgtgctgaaggtgacccggcagagccccaacagctatgtggtgatcatgaatggcagctgtgtggaggtggatgtgcaccggctgagtgatggcggcctgctgctgtcctatgatggcagcagctacaccacctacatgaaggaggaggtggaccgctaccgcatcaccatcggcaacaagacctgtgtgtttgagaaggaaaatgaccccagcgtgatgaggagccccagcgctgggaagctgatccagtacatcgtggaggatggcggccacgtgtttgctggccagtgctacgcagaaattgaggtgatgaagatggtgatgaccctgacagctgtggagagcggctgcatccactacgtgaagaggcctggggccgccctggaccccggctgtgtgctggccaagatgcagctggacaaccccagcaaggtgcagcaggccgagctgcacacaggcagcctgccccgcatccagagcacagccctgcggggggagaagctgcacagggtcttccactacgtgctggacaacctggtgaatgtgatgaatggctactgcctgcctgaccccttcttcagcagcaaggtgaaggactgggtggagcggctgatgaagaccctgcgggaccccagcctgcccctgctggagctgcaggacatcatgacctctgtgtctggccgcatcccccccaacgtggagaagagcatcaagaaggagatggcccagtatgccagcaacatcacctctgtgctgtgccagttccccagccagcagatcgccaacatcctggacagccacgccgccaccctgaacaggaagtctgagcgggaggtgttcttcatgaacacccagagcatcgtgcagctggtgcagcgctaccgcagcggcatccggggccacatgaaggctgtggtgatggacctgctgcggcagtacctgcgggtggagacccagttccagaatggccactatgacaagtgtgtgtttgccctgcgggaggagaacaagagtgacatgaacacagtgctgaactacatcttcagccacgcccaggtgaccaagaagaacctgctggtgaccatgctgattgaccagctgtgtggccgggaccccaccctgacagatgagctgctgaacatcctgacagagctgacccagctgagcaagaccaccaatgccaaggtggccctgcgggcccggcaggtgctgattgccagccacctgcccagctatgagctgcggcacaaccaggtggagagcatcttcctgagcgccatcgacatgtatggccaccagttctgcatcgagaacctgcagaagctgatcctgtctgagaccagcatctttgatgtgctgcccaacttcttctaccacagcaaccaggtggtgaggatggccgccctggaggtgtatgtgcggcgggcctacatcgcctatgagctgaacagcgtgcagcaccggcagctgaaggacaacacctgtgtggtggagttccagttcatgctgcccaccagccaccccaacagaggcaacatccccaccctgaacaggatgtccttcagcagcaacctgaaccactacggcatgacccacgtggcctctgtgtctgatgtgctgctggacaacagcttcaccccaccctgccagaggatgggcggcatggtgtccttccgcacctttgaggactttgtgcgcatctttgatgaggtgatgggctgcttcagtgacagccccccccagagccccaccttccctgaggccggccacaccagcctgtatgatgaggacaaggtgcccagagatgagcccatccacatcctgaatgtggccatcaagacagactgtgacattgaagatgaccggctggccgccatgttccgggagttcacccagcagaacaaggccaccctggtggaccacggcatccggcggctgaccttcctggtggcccagaaggacttcaggaagcaggtgaactatgaggtggaccggcgcttccaccgggagttccccaagttcttcaccttccgggcccgggacaagtttgaagaagatcgcatctaccgccacctggagcccgccctggccttccagctggagctgaacaggatgaggaactttgacctgacagccatcccctgtgccaaccacaagatgcacctgtacctgggcgccgccaaggtggaggtgggcacagaggtgacagactaccgcttctttgtgcgggccatcatccgccacagcgacctggtgaccaaggaggccagctttgagtacctgcagaatgaaggagagcggctgctgctggaggccatggatgagctggaggtggccttcaacaacaccaacgtgaggacagactgcaaccacatcttcctgaactttgtgcccaccgtcatcatggaccccagcaagattgaggagagcgtgcgctccatggtgatgagatatggcagccggctgtggaagctgcgggtgctgcaggccgagctgaagatcaacatccggctgacccccaccgggaaggccatccccatccgcctcttcctgaccaatgaaagtggctactacctggacatcagcctgtacaaggaggtgacagacagcaggacagcccagatcatgttccaggcctacggggacaagcagggccccctgcacggcatgctgatcaacaccccctacgtgaccaaggacctgctgcagagcaagcgcttccaggcccagagcctgggcaccacctacatctatgacatccctgagatgttccggcagagcctcatcaagctgtgggagagcatgagcacccaggccttcctgcccagcccccccctgcccagcgacatgctgacctacacagagctggtgctggatgaccagggccagctggtgcacatgaaccggctgcccggcggcaatgagatcggcatggtggcctggaagatgaccttcaagagccctgagtacccagagggccgggacatcatcgtgattggaaatgacatcacctacagaattggcagctttggcccccaggaggacctgctcttcctgcgggccagcgagctggcccgggcagagggcatcccccgcatctacgtgtctgccaacagcggggccagaattggcctggccgaggagatccgccacatgttccacgtggcctgggtggaccctgaggacccctacaagggctaccgctacctgtacctgaccccccaggactacaagagggtgtctgccctgaacagcgtgcactgtgagcacgtggaggatgaaggagagagccgctacaagatcacagacatcatcggcaaggaggagggcatcggccctgagaacctgcggggcagcggcatgattgctggggagagcagcctggcctacaatgagatcatcaccatcagcctggtgacctgccgggccatcggcatcggggcctacctggtgcggctgggccagaggaccatccaggtggagaacagccacctgatcctgaccggggccggggccctgaacaaggtgctgggccgggaggtgtacaccagcaacaaccagctgggcggcatccagatcatgcacaacaatggagtgacccactgcaccgtgtgtgatgactttgagggcgtcttcaccgtgctgcactggctgagctacatgcccaagtctgtgcacagctctgtgcccctgctgaacagcaaggaccccatcgaccgcatcatcgagtttgtgcccaccaagaccccctatgacccccgctggatgctggccggccggccccaccccacccagaagggccagtggctgagcggcttctttgattatggcagcttcagcgagatcatgcagccctgggcccagacagtggtggtgggccgggcccggctgggcggcatccctgtgggcgtggtggccgtggagaccaggacagtggagctgagcatcccagctgaccctgccaacctggacagcgaggccaagatcatccagcaggccggccaggtgtggttcccagattctgccttcaagacctaccaggccatcaaggacttcaaccgggagggcctgcccctgatggtgtttgccaactggaggggcttcagcggcggcatgaaggacatgtatgaccaggtgctgaagtttggagcctacatcgtggatggcctgcgggagtgctgccagcctgtgctggtgtacatccccccccaggccgagctgcggggcggctcctgggtggtgattgacagcagcatcaaccccaggcacatggagatgtatgctgaccgggagagccggggctctgtgctggagcctgagggcaccgtggagatcaagttccggaggaaggacctggtgaagaccatgagaagagtggaccctgtgtacatccacctggccgagcggctgggcaccccagagctgagcacagctgagaggaaggagctggagaacaagctgaaggagcgggaggagttcctgatccccatctaccaccaggtggccgtgcagtttgctgacctgcatgacaccccaggccgcatgcaggagaagggcgtcatcagtgacatcctggactggaagaccagcaggaccttcttctactggaggctgcggcggctgctgctggaggacctggtgaagaagaagatccacaatgccaaccctgagctgacagatggccagatccaggccatgctgcggcgctggtttgtggaggtggagggcaccgtgaaggcctacgtgtgggacaacaacaaggacctggccgagtggctggagaagcagctgacagaggaggatggagtgcacagcgtgattgaggagaacatcaagtgcatcagccgggactatgtgctgaagcagatccgcagcctggtgcaggccaaccctgaggtggccatggacagcatcatccacatgacccagcacatcagccccacccagagagctgaggtgatccgcatcctgagcaccatggacagccccagcacctag

SEQ ID NO: 18207 - DNA, 6867 bp, Artificial Sequence
  Description of Artificial Sequence: Synthetic coding sequence
atggagggcagccctgaggagaacaaggagatgagatactacatgctgcagaggagctccatgagcggcctgcacctggtgaagcagggccgggacaggaagaagattgacagccagagggacttcaccgtggccagccctgctgagtttgtgaccaggtttggaggcaacaaggtgattgagaaggtgctgattgccaacaacggcattgctgctgtgaagtgcatgaggagcatccgccgctggagctatgagatgttcagaaatgaaagagccatccgctttgtggtgatggtgaccccagaggacctgaaggccaatgctgagtacatcaagatggctgaccactacgtgcctgtgcctgggggccccaacaacaacaactatgccaacgtggagctgatcctggacatcgccaagagaattcctgtgcaggccgtgtgggccggctggggccacgccagcgagaaccccaagctgcctgagctgctgctgaagaatggaattgccttcatgggcccccccagccaggccatgtgggccctgggggacaagatcgccagcagcatcgtggcccagacagctggcatccccaccctgccctggagcggcagcggcctgcgggtggactggcaggagaatgacttcagcaagaggatcctgaatgtgccccaggagctgtatgagaagggctacgtgaaggatgtggatgatggcctgcaggccgctgaggaggtgggctaccctgtgatgatcaaggccagcgagggcggcggcggcaagggcatcaggaaggtgaacaatgctgatgacttccccaacctcttccggcaggtgcaggccgaggtgcccggcagccccatctttgtgatgaggctggccaagcagagccgccacctggaggtgcagatcctggccgaccagtatggaaatgccatcagcctgtttggccgggactgcagcgtgcagaggaggcaccagaagatcatcgaggaggccccagccaccatcgccaccccagctgtgtttgagcacatggagcagtgtgctgtgaagctggccaagatggtgggctacgtgtctgctggcaccgtggagtacctgtacagccaggacggcagcttctacttcctggagctgaacccccggctgcaggtggagcacccctgcacagagatggtggctgatgtgaacctgcctgctgcccagctgcagatcgccatgggcatccccctgtaccgcatcaaggacatccgcatgatgtatggagtgagcccctggggagacagccccatcgactttgaagattctgcccacgtgccctgcccccggggccacgtgattgctgcccgcatcaccagtgaaaatccagatgagggcttcaagcccagcagcggcaccgtgcaggagctgaacttccgcagcaacaagaatgtgtggggctacttctctgtggccgccgccggcggcctgcacgagtttgctgacagccagtttggccactgcttctcctggggagaaaatcgggaggaggccatcagcaacatggtggtggccctgaaggagctgagcatccggggggacttccgcaccaccgtggagtacctgatcaagctgctggagacagagagcttccagatgaacagaattgacaccggctggctggaccggctgattgctgagaaggtgcaggccgagaggccagacaccatgctgggcgtggtgtgtggggccctgcacgtggctgatgtgtccctgagaaattctgtgagcaacttcctgcacagcctggagcggggccaggtgctgcctgcccacaccctgctgaacacagtggatgtggagctgatctatgagggcgtgaagtatgtgctgaaggtgacccggcagagccccaacagctatgtggtgatcatgaatggcagctgtgtggaggtggatgtgcaccggctgagtgatggcggcctgctgctgtcctatgatggcagcagctacaccacctacatgaaggaggaggtggaccgctaccgcatcaccatcggcaacaagacctgtgtgtttgagaaggaaaatgaccccagcgtgatgaggagccccagcgctgggaagctgatccagtacatcgtggaggatggcggccacgtgtttgctggccagtgctacgccgagattgaggtgatgaagatggtgatgaccctgacagctgtggagagcggctgcatccactacgtgaagaggcctggagctgccctggaccccggctgtgtgctggccaagatgcagctggacaaccccagcaaggtgcagcaggccgagctgcacacaggcagcctgccccgcatccagagcacagccctgcggggggagaagctgcacagggtcttccactacgtgctggacaacctggtgaatgtgatgaatggctactgcctgcctgaccccttcttcagcagcaaggtgaaggactgggtggagcggctgatgaagaccctgcgggaccccagcctgcccctgctggagctgcaggacatcatgacctctgtgtctggccgcatccccccaaatgtggagaagagcatcaagaaggagatggcccagtatgccagcaacatcacctctgtgctgtgccagttccccagccagcagatcgccaacatcctggacagccatgctgccaccctgaacaggaagtctgagcgggaggtgttcttcatgaacacccagagcatcgtgcagctggtgcagcgctacagaagtggcatccggggccacatgaaggctgtggtgatggacctgctgcggcagtacctgcgggtggagacccagttccagaatggccactatgacaagtgtgtgtttgccctgcgggaggagaacaagagtgacatgaacacagtgctgaactacatcttcagccacgcccaggtgaccaagaagaacctgctggtgaccatgctgattgaccagctgtgtggccgggaccccaccctgacagatgagctgctgaacatcctgacagagctgacccagctgagcaagaccaccaatgccaaggtggccctgcgggcccggcaggtgctgattgccagccacctgcccagctatgagctgcggcacaaccaggtggagagcatcttcctgagcgccatcgacatgtatggccaccagttctgcatcgagaacctgcagaagctgatcctgtctgagaccagcatctttgatgtgctgcccaacttcttctaccacagcaaccaggtggtgaggatggccgccctggaggtgtatgtgagaagagcctacatcgcctatgagctgaacagcgtgcagcaccggcagctgaaggacaacacctgtgtggtggagttccagttcatgctgcccaccagccaccccaacagaggcaacatccccaccctgaacaggatgtccttcagcagcaacctgaaccactacggcatgacccacgtggcctctgtgtctgatgtgctgctggacaacagcttcaccccaccctgccagaggatgggcggcatggtgtccttccgcacctttgaagattttgtgcgcatctttgatgaggtgatgggctgcttcagtgacagccccccccagagccccaccttccctgaggccggccacaccagcctgtatgatgaggacaaggtgcccagagatgagcccatccacatcctgaatgtggccatcaagacagactgtgacattgaagatgaccggctggccgccatgttccgggagttcacccagcagaacaaggccaccctggtggaccacggcatccggcggctgaccttcctggtggcccagaaggacttcaggaagcaggtgaactatgaggtggaccggcgcttccaccgggagttccccaagttcttcaccttccgggcccgggacaagtttgaggaggaccgcatctaccgccacctggagcccgccctggccttccagctggagctgaacaggatgaggaactttgacctgacagccatcccctgtgccaaccacaagatgcacctgtacctgggcgccgccaaggtggaggtgggcacagaggtgacagactaccgcttctttgtgcgggccatcatccgccacagcgacctggtgaccaaggaggccagctttgagtacctgcagaatgaaggagagcggctgctgctggaggccatggatgagctggaggtggccttcaacaacaccaacgtgaggacagactgcaaccacatcttcctgaactttgtgcccaccgtcatcatggaccccagcaagattgaggagagcgtgcgctccatggtgatgagatatggcagccggctgtggaagctgcgggtgctgcaggccgagctgaagatcaacatccggctgacccccaccgggaaggccatccccatccgcctcttcctgaccaatgaaagtggctactacctggacatcagcctgtacaaggaggtgacagacagcaggacagcccagatcatgttccaggcctatggagacaagcagggccccctgcacggcatgctgatcaacaccccctacgtgaccaaggacctgctgcagagcaagcgcttccaggcccagagcctgggcaccacctacatctatgacatccctgagatgttccggcagagcctcatcaagctgtgggagagcatgagcacccaggccttcctgcccagcccccccctgcccagcgacatgctgacctacacagagctggtgctggatgaccagggccagctggtgcacatgaaccggctgcccggcggcaatgaaattggcatggtggcctggaagatgaccttcaagagccctgagtacccagagggccgggacatcatcgtgattggaaatgacatcacctaccgcatcggcagctttggcccccaggaggacctgctcttcctgcgggccagcgagctggcccgggcagagggcatcccccgcatctacgtgtctgccaacagcggggcccgcatcggcctggccgaggagatccgccacatgtttcatgtggcctgggtggaccctgaggacccctacaagggctaccgctacctgtacctgaccccccaggactacaagagggtgtctgccctgaacagcgtgcactgtgaacatgtggaggatgaaggagagagccgctacaagatcacagacatcatcggcaaggaggagggcatcggccctgagaacctgcggggcagcggcatgattgctggggagagcagcctggcctacaatgagatcatcaccatcagcctggtgacctgccgggccatcggcattggagcctacctggtgcggctgggccagaggaccatccaggtggagaacagccacctgatcctgactggagctggggccctgaacaaggtgctgggccgggaggtgtacaccagcaacaaccagctgggcggcatccagatcatgcacaacaacggggtgacccactgcaccgtgtgtgatgactttgaaggagtcttcaccgtgctgcactggctgagctacatgcccaagtctgtgcacagctctgtgcccctgctgaacagcaaggaccccatcgaccgcatcattgaatttgtgcccaccaagaccccctatgacccccgctggatgctggccggccggccccaccccacccagaagggccagtggctgagcggcttctttgattatggcagcttcagcgagatcatgcagccctgggcccagacagtggtggtgggccgggcccggctgggcggcatccctgtgggcgtggtggccgtggagaccaggacagtggagctgagcatcccagctgaccctgccaacctggacagcgaggccaagatcatccagcaggccggccaggtgtggttcccagacagcgccttcaagacctaccaggccatcaaggacttcaaccgggagggcctgcccctgatggtgtttgccaactggaggggcttcagcggcggcatgaaggacatgtatgaccaggtgctgaagtttggagcctacatcgtggatggcctgcgggagtgctgccagcctgtgctggtgtacatccccccccaggccgagctgcggggcggctcctgggtggtgattgacagcagcatcaaccccaggcacatggagatgtatgctgaccgggagagccggggctctgtgctggagcctgagggcaccgtggagatcaagttccggaggaaggacctggtgaagaccatgagaagagtggaccctgtgtacatccacctggccgagcggctgggcaccccagagctgagcacagctgagaggaaggagctggagaacaagctgaaggagcgggaggagttcctgatccccatctaccaccaggtggccgtgcagtttgctgacctgcatgacaccccaggccgcatgcaggagaagggcgtcatcagtgacatcctggactggaagaccagcaggaccttcttctactggaggctgcggcggctgctgctggaggacctggtgaagaagaagatccacaatgccaaccctgagctgacagatggccagatccaggccatgctgcggcgctggtttgtggaggtggagggcaccgtgaaggcctacgtgtgggacaacaacaaggacctggccgagtggctggagaagcagctgacagaagaagatggagtgcacagcgtcatcgaggagaacatcaagtgcatcagccgggactatgtgctgaagcagatccgcagcctggtgcaggccaaccctgaggtggccatggacagcatcatccacatgacccagcacatcagccccacccagagagctgaggtgatccgcatcctgagcaccatggacagccccagcacctag

SEQ ID NO: 18208 - DNA, 1419 bp, Artificial Sequence
  Description of Artificial Sequence: Synthetic coding sequence
atgcacaacaacggggtgacccactgcaccgtgtgtgatgactttgaaggagtcttcaccgtgctgcactggctgagctacatgcccaagtctgtgcacagctctgtgcccctgctgaacagcaaggaccccatcgaccgcatcattgaatttgtgcccaccaagaccccctatgacccccgctggatgctggccggccggccccaccccacccagaagggccagtggctgagcggcttctttgattatggcagcttcagcgagatcatgcagccctgggcccagacagtggtggtgggccgggcccggctgggcggcatccctgtgggcgtggtggccgtggagaccaggacagtggagctgagcatcccagctgaccctgccaacctggacagcgaggccaagatcatccagcaggccggccaggtgtggttcccagacagcgccttcaagacctaccaggccatcaaggacttcaaccgggagggcctgcccctgatggtgtttgccaactggaggggcttcagcggcggcatgaaggacatgtatgaccaggtgctgaagtttggagcctacatcgtggatggcctgcgggagtgctgccagcctgtgctggtgtacatccccccccaggccgagctgcggggcggctcctgggtggtgattgacagcagcatcaaccccaggcacatggagatgtatgctgaccgggagagccggggctctgtgctggagcctgagggcaccgtggagatcaagttccggaggaaggacctggtgaagaccatgagaagagtggaccctgtgtacatccacctggccgagcggctgggcaccccagagctgagcacagctgagaggaaggagctggagaacaagctgaaggagcgggaggagttcctgatccccatctaccaccaggtggccgtgcagtttgctgacctgcatgacaccccaggccgcatgcaggagaagggcgtcatcagtgacatcctggactggaagaccagcaggaccttcttctactggaggctgcggcggctgctgctggaggacctggtgaagaagaagatccacaatgccaaccctgagctgacagatggccagatccaggccatgctgcggcgctggtttgtggaggtggagggcaccgtgaaggcctacgtgtgggacaacaacaaggacctggccgagtggctggagaagcagctgacagaagaagatggagtgcacagcgtcatcgaggagaacatcaagtgcatcagccgggactatgtgctgaagcagatccgcagcctggtgcaggccaaccctgaggtggccatggacagcatcatccacatgacccagcacatcagccccacccagagagctgaggtgatccgcatcctgagcaccatggacagccccagcacctag

SEQ ID NO: 18209 - DNA, 129 bp, Artificial Sequence
  Description of Artificial Sequence: Synthetic coding sequence
atgagcggcctgcacctggtgaagcagggccgggacaggaagaagattgacagccagagggacttcaccgtggccagccctgctgagtttgtgaccaggtttggaggcaacaaggtgattgagaagtag

SEQ ID NO: 18210 - DNA, 7041 bp, Artificial Sequence
  Description of Artificial Sequence: Synthetic coding sequence
atggatgagcccagccccctggcccagcccctggagctgaaccagcacagccgcttcatcatcggctctgtgtctgaggacaacagtgaagatgagatcagcaacctggtgaagctggacctgctggaggagaaggagggcagcctgagccctgcctctgtgggcagtgacaccctgagtgacctgggcatcagcagcctgcaggacggcctggccctgcacatccgcagctccatgagcggcctgcacctggtgaagcagggccgggacaggaagaagattgacagccagagggacttcaccgtggccagccctgctgagtttgtgaccaggtttggaggcaacaaggtgattgagaaggtgctgattgccaacaacggcattgctgctgtgaagtgcatgaggagcatccgccgctggagctatgagatgttcagaaatgaaagagccatccgctttgtggtgatggtgaccccagaggacctgaaggccaatgctgagtacatcaagatggctgaccactacgtgcctgtgcctgggggccccaacaacaacaactatgccaacgtggagctgatcctggacatcgccaagagaattcctgtgcaggccgtgtgggccggctggggccacgccagcgagaaccccaagctgcctgagctgctgctgaagaatggaattgccttcatgggcccccccagccaggccatgtgggccctgggggacaagatcgccagcagcatcgtggcccagacagctggcatccccaccctgccctggagcggcagcggcctgcgggtggactggcaggagaatgacttcagcaagaggatcctgaatgtgccccaggagctgtatgagaagggctacgtgaaggatgtggatgatggcctgcaggccgctgaggaggtgggctaccctgtgatgatcaaggccagcgagggcggcggcggcaagggcatcaggaaggtgaacaatgctgatgacttccccaacctcttccggcaggtgcaggccgaggtgcccggcagccccatctttgtgatgaggctggccaagcagagccgccacctggaggtgcagatcctggccgaccagtatggaaatgccatcagcctgtttggccgggactgcagcgtgcagaggaggcaccagaagatcatcgaggaggccccagccaccatcgccaccccagctgtgtttgagcacatggagcagtgtgctgtgaagctggccaagatggtgggctacgtgtctgctggcaccgtggagtacctgtacagccaggacggcagcttctacttcctggagctgaacccccggctgcaggtggagcacccctgcacagagatggtggctgatgtgaacctgcctgctgcccagctgcagatcgccatgggcatccccctgtaccgcatcaaggacatccgcatgatgtatggagtgagcccctggggagacagccccatcgactttgaagattctgcccacgtgccctgcccccggggccacgtgattgctgcccgcatcaccagtgaaaatccagatgagggcttcaagcccagcagcggcaccgtgcaggagctgaacttccgcagcaacaagaatgtgtggggctacttctctgtggccgccgccggcggcctgcacgagtttgctgacagccagtttggccactgcttctcctggggagaaaatcgggaggaggccatcagcaacatggtggtggccctgaaggagctgagcatccggggggacttccgcaccaccgtggagtacctgatcaagctgctggagacagagagcttccagatgaacagaattgacaccggctggctggaccggctgattgctgagaaggtgcaggccgagaggccagacaccatgctgggcgtggtgtgtggggccctgcacgtggctgatgtgtccctgagaaattctgtgagcaacttcctgcacagcctggagcggggccaggtgctgcctgcccacaccctgctgaacacagtggatgtggagctgatctatgagggcgtgaagtatgtgctgaaggtgacccggcagagccccaacagctatgtggtgatcatgaatggcagctgtgtggaggtggatgtgcaccggctgagtgatggcggcctgctgctgtcctatgatggcagcagctacaccacctacatgaaggaggaggtggaccgctaccgcatcaccatcggcaacaagacctgtgtgtttgagaaggaaaatgaccccagcgtgatgaggagccccagcgctgggaagctgatccagtacatcgtggaggatggcggccacgtgtttgctggccagtgctacgccgagattgaggtgatgaagatggtgatgaccctgacagctgtggagagcggctgcatccactacgtgaagaggcctggagctgccctggaccccggctgtgtgctggccaagatgcagctggacaaccccagcaaggtgcagcaggccgagctgcacacaggcagcctgccccgcatccagagcacagccctgcggggggagaagctgcacagggtcttccactacgtgctggacaacctggtgaatgtgatgaatggctactgcctgcctgaccccttcttcagcagcaaggtgaaggactgggtggagcggctgatgaagaccctgcgggaccccagcctgcccctgctggagctgcaggacatcatgacctctgtgtctggccgcatccccccaaatgtggagaagagcatcaagaaggagatggcccagtatgccagcaacatcacctctgtgctgtgccagttccccagccagcagatcgccaacatcctggacagccatgctgccaccctgaacaggaagtctgagcgggaggtgttcttcatgaacacccagagcatcgtgcagctggtgcagcgctacagaagtggcatccggggccacatgaaggctgtggtgatggacctgctgcggcagtacctgcgggtggagacccagttccagaatggccactatgacaagtgtgtgtttgccctgcgggaggagaacaagagtgacatgaacacagtgctgaactacatcttcagccacgcccaggtgaccaagaagaacctgctggtgaccatgctgattgaccagctgtgtggccgggaccccaccctgacagatgagctgctgaacatcctgacagagctgacccagctgagcaagaccaccaatgccaaggtggccctgcgggcccggcaggtgctgattgccagccacctgcccagctatgagctgcggcacaaccaggtggagagcatcttcctgagcgccatcgacatgtatggccaccagttctgcatcgagaacctgcagaagctgatcctgtctgagaccagcatctttgatgtgctgcccaacttcttctaccacagcaaccaggtggtgaggatggccgccctggaggtgtatgtgagaagagcctacatcgcctatgagctgaacagcgtgcagcaccggcagctgaaggacaacacctgtgtggtggagttccagttcatgctgcccaccagccaccccaacagaggcaacatccccaccctgaacaggatgtccttcagcagcaacctgaaccactacggcatgacccacgtggcctctgtgtctgatgtgctgctggacaacagcttcaccccaccctgccagaggatgggcggcatggtgtccttccgcacctttgaagattttgtgcgcatctttgatgaggtgatgggctgcttcagtgacagccccccccagagccccaccttccctgaggccggccacaccagcctgtatgatgaggacaaggtgcccagagatgagcccatccacatcctgaatgtggccatcaagacagactgtgacattgaagatgaccggctggccgccatgttccgggagttcacccagcagaacaaggccaccctggtggaccacggcatccggcggctgaccttcctggtggcccagaaggacttcaggaagcaggtgaactatgaggtggaccggcgcttccaccgggagttccccaagttcttcaccttccgggcccgggacaagtttgaggaggaccgcatctaccgccacctggagcccgccctggccttccagctggagctgaacaggatgaggaactttgacctgacagccatcccctgtgccaaccacaagatgcacctgtacctgggcgccgccaaggtggaggtgggcacagaggtgacagactaccgcttctttgtgcgggccatcatccgccacagcgacctggtgaccaaggaggccagctttgagtacctgcagaatgaaggagagcggctgctgctggaggccatggatgagctggaggtggccttcaacaacaccaacgtgaggacagactgcaaccacatcttcctgaactttgtgcccaccgtcatcatggaccccagcaagattgaggagagcgtgcgctccatggtgatgagatatggcagccggctgtggaagctgcgggtgctgcaggccgagctgaagatcaacatccggctgacccccaccgggaaggccatccccatccgcctcttcctgaccaatgaaagtggctactacctggacatcagcctgtacaaggaggtgacagacagcaggacagcccagatcatgttccaggcctatggagacaagcagggccccctgcacggcatgctgatcaacaccccctacgtgaccaaggacctgctgcagagcaagcgcttccaggcccagagcctgggcaccacctacatctatgacatccctgagatgttccggcagagcctcatcaagctgtgggagagcatgagcacccaggccttcctgcccagcccccccctgcccagcgacatgctgacctacacagagctggtgctggatgaccagggccagctggtgcacatgaaccggctgcccggcggcaatgaaattggcatggtggcctggaagatgaccttcaagagccctgagtacccagagggccgggacatcatcgtgattggaaatgacatcacctaccgcatcggcagctttggcccccaggaggacctgctcttcctgcgggccagcgagctggcccgggcagagggcatcccccgcatctacgtgtctgccaacagcggggcccgcatcggcctggccgaggagatccgccacatgtttcatgtggcctgggtggaccctgaggacccctacaagggctaccgctacctgtacctgaccccccaggactacaagagggtgtctgccctgaacagcgtgcactgtgaacatgtggaggatgaaggagagagccgctacaagatcacagacatcatcggcaaggaggagggcatcggccctgagaacctgcggggcagcggcatgattgctggggagagcagcctggcctacaatgagatcatcaccatcagcctggtgacctgccgggccatcggcattggagcctacctggtgcggctgggccagaggaccatccaggtggagaacagccacctgatcctgactggagctggggccctgaacaaggtgctgggccgggaggtgtacaccagcaacaaccagctgggcggcatccagatcatgcacaacaacggggtgacccactgcaccgtgtgtgatgactttgaaggagtcttcaccgtgctgcactggctgagctacatgcccaagtctgtgcacagctctgtgcccctgctgaacagcaaggaccccatcgaccgcatcattgaatttgtgcccaccaagaccccctatgacccccgctggatgctggccggccggccccaccccacccagaagggccagtggctgagcggcttctttgattatggcagcttcagcgagatcatgcagccctgggcccagacagtggtggtgggccgggcccggctgggcggcatccctgtgggcgtggtggccgtggagaccaggacagtggagctgagcatcccagctgaccctgccaacctggacagcgaggccaagatcatccagcaggccggccaggtgtggttcccagacagcgccttcaagacctaccaggccatcaaggacttcaaccgggagggcctgcccctgatggtgtttgccaactggaggggcttcagcggcggcatgaaggacatgtatgaccaggtgctgaagtttggagcctacatcgtggatggcctgcgggagtgctgccagcctgtgctggtgtacatccccccccaggccgagctgcggggcggctcctgggtggtgattgacagcagcatcaaccccaggcacatggagatgtatgctgaccgggagagccggggctctgtgctggagcctgagggcaccgtggagatcaagttccggaggaaggacctggtgaagaccatgagaagagtggaccctgtgtacatccacctggccgagcggctgggcaccccagagctgagcacagctgagaggaaggagctggagaacaagctgaaggagcgggaggagttcctgatccccatctaccaccaggtggccgtgcagtttgctgacctgcatgacaccccaggccgcatgcaggagaagggcgtcatcagtgacatcctggactggaagaccagcaggaccttcttctactggaggctgcggcggctgctgctggaggacctggtgaagaagaagatccacaatgccaaccctgagctgacagatggccagatccaggccatgctgcggcgctggtttgtggaggtggagggcaccgtgaaggcctacgtgtgggacaacaacaaggacctggccgagtggctggagaagcagctgacagaagaagatggagtgcacagcgtcatcgaggagaacatcaagtgcatcagccgggactatgtgctgaagcagatccgcagcctggtgcaggccaaccctgaggtggccatggacagcatcatccacatgacccagcacatcagccccacccagagagctgaggtgatccgcatcctgagcaccatggacagccccagcacctag

SEQ ID NO: 18211 - DNA, 129 bp, Artificial Sequence; identical to SEQ ID NO: 18209
  Description of Artificial Sequence: Synthetic coding sequence

SEQ ID NO: 18212 - DNA, 234 bp, Artificial Sequence
  Description of Artificial Sequence: Synthetic coding sequence
atggatgagcccagccccctggcccagcccctggagctgaaccagcacagccgcttcatcatcggctctgtgtctgaggacaacagtgaagatgagatcagcaacctggtgaagctggacctgctggaggagaaggagggcagcctgagccctgcctctgtgggcagtgacaccctgagtgacctgggcatcagcagcctgcaggacggcctggccctgcacatccggctgtag

SEQ ID NO: 18213 - DNA, 3138 bp, Artificial Sequence
  Description of Artificial Sequence: Synthetic coding sequence
atgggctgcttcagtgacagccccccccagagccccaccttccctgaggccggccacaccagcctgtatgatgaggacaaggtgcccagagatgagcccatccacatcctgaatgtggccatcaagacagactgtgacattgaagatgaccggctggccgccatgttccgggagttcacccagcagaacaaggccaccctggtggaccacggcatccggcggctgaccttcctggtggcccagaaggacttcaggaagcaggtgaactatgaggtggaccggcgcttccaccgggagttccccaagttcttcaccttccgggcccgggacaagtttgaggaggaccgcatctaccgccacctggagcccgccctggccttccagctggagctgaacaggatgaggaactttgacctgacagccatcccctgtgccaaccacaagatgcacctgtacctgggcgccgccaaggtggaggtgggcacagaggtgacagactaccgcttctttgtgcgggccatcatccgccacagcgacctggtgaccaaggaggccagctttgagtacctgcagaatgaaggagagcggctgctgctggaggccatggatgagctggaggtggccttcaacaacaccaacgtgaggacagactgcaaccacatcttcctgaactttgtgcccaccgtcatcatggaccccagcaagattgaggagagcgtgcgctccatggtgatgagatatggcagccggctgtggaagctgcgggtgctgcaggccgagctgaagatcaacatccggctgacccccaccgggaaggccatccccatccgcctcttcctgaccaatgaaagtggctactacctggacatcagcctgtacaaggaggtgacagacagcaggacagcccagatcatgttccaggcctatggagacaagcagggccccctgcacggcatgctgatcaacaccccctacgtgaccaaggacctgctgcagagcaagcgcttccaggcccagagcctgggcaccacctacatctatgacatccctgagatgttccggcagatcggcatggtggcctggaagatgaccttcaagagccctgagtacccagagggccgggacatcatcgtgattggaaatgacatcacctacagaattggcagctttggcccccaggaggacctgctcttcctgcgggccagcgagctggcccgggcagagggcatcccccgcatctacgtgtctgccaacagcggggccagaattggcctggccgaggagatccgccacatgttccacgtggcctgggtggaccctgaggacccctacaagggctaccgctacctgtacctgaccccccaggactacaagagggtgtctgccctgaacagcgtgcactgtgagcacgtggaggatgaaggagagagccgctacaagatcacagacatcatcggcaaggaggagggcatcggccctgagaacctgcggggcagcggcatgattgctggggagagcagcctggcctacaatgagatcatcaccatcagcctggtgacctgccgggccatcggcatcggggcctacctggtgcggctgggccagaggaccatccaggtggagaacagccacctgatcctgaccggggccggggccctgaacaaggtgctgggccgggaggtgtacaccagcaacaaccagctgggcggcatccagatcatgcacaacaatggagtgacccactgcaccgtgtgtgatgactttgagggcgtcttcaccgtgctgcactggctgagctacatgcccaagtctgtgcacagctctgtgcccctgctgaacagcaaggaccccatcgaccgcatcatcgagtttgtgcccaccaagaccccctatgacccccgctggatgctggccggccggccccaccccacccagaagggccagtggctgagcggcttctttgattatggcagcttcagcgagatcatgcagccctgggcccagacagtggtggtgggccgggcccggctgggcggcatccctgtgggcgtggtggccgtggagaccaggacagtggagctgagcatcccagctgaccctgccaacctggacagcgaggccaagatcatccagcaggccggccaggtgtggttcccagattctgccttcaagacctaccaggccatcaaggacttcaaccgggagggcctgcccctgatggtgtttgccaactggaggggcttcagcggcggcatgaaggacatgtatgaccaggtgctgaagtttggagcctacatcgtggatggcctgcgggagtgctgccagcctgtgctggtgtacatccccccccaggccgagctgcggggcggctcctgggtggtgattgacagcagcatcaaccccaggcacatggagatgtatgctgaccgggagagccggggctctgtgctggagcctgagggcaccgtggagatcaagttccggaggaaggacctggtgaagaccatgagaagagtggaccctgtgtacatccacctggccgagcggctgggcaccccagagctgagcacagctgagaggaaggagctggagaacaagctgaaggagcgggaggagttcctgatccccatctaccaccaggtggccgtgcagtttgctgacctgcatgacaccccaggccgcatgcaggagaagggcgtcatcagtgacatcctggactggaagaccagcaggaccttcttctactggaggctgcggcggctgctgctggaggacctggtgaagaagaagatccacaatgccaaccctgagctgacagatggccagatccaggccatgctgcggcgctggtttgtggaggtggagggcaccgtgaaggcctacgtgtgggacaacaacaaggacctggccgagtggctggagaagcagctgacagaggaggatggagtgcacagcgtgattgaggagaacatcaagtgcatcagccgggactatgtgctgaagcagatccgcagcctggtgcaggccaaccctgaggtggccatggacagcatcatccacatgacccagcacatcagccccacccagagagctgaggtgatccgcatcctgagcaccatggacagccccagcacctag

SEQ ID NO: 18214 - DNA, 363 bp, Artificial Sequence
  Description of Artificial Sequence: Synthetic coding sequence
atggatgagcccagccccctggcccagcccctggagctgaaccagcacagccgcttcatcatcggctctgtgtctgaggacaacagtgaagatgagatcagcaacctggtgaagctggacctgctggaggagaaggagggcagcctgagccctgcctctgtgggcagtgacaccctgagtgacctgggcatcagcagcctgcaggacggcctggccctgcacatccgcagctccatgagcggcctgcacctggtgaagcagggccgggacaggaagaagattgacagccagagggacttcaccgtggccagccctgctgagtttgtgaccaggtttggaggcaacaaggtgattgagaagtag

SEQ ID NO: 18215 - DNA, 7113 bp, Artificial Sequence
  Description of Artificial Sequence: Synthetic coding sequence
tccttctggaagtggatcagcacccagacagtgcgcatcatccgggctgtgcgggcccactttggaggcatcatggatgagcccagccccctggcccagcccctggagctgaaccagcacagccgcttcatcatcggctctgtgtctgaggacaacagtgaagatgagatcagcaacctggtgaagctggacctgctggaggagaaggagggcagcctgagccctgcctctgtgggcagtgacaccctgagtgacctgggcatcagcagcctgcaggacggcctggccctgcacatccgcagctccatgagcggcctgcacctggtgaagcagggccgggacaggaagaagattgacagccagagggacttcaccgtggccagccctgctgagtttgtgaccaggtttggaggcaacaaggtgattgagaaggtgctgattgccaacaacggcattgctgctgtgaagtgcatgaggagcatccgccgctggagctatgagatgttcagaaatgaaagagccatccgctttgtggtgatggtgaccccagaggacctgaaggccaatgctgagtacatcaagatggctgaccactacgtgcctgtgcctgggggccccaacaacaacaactatgccaacgtggagctgatcctggacatcgccaagagaattcctgtgcaggccgtgtgggccggctggggccacgccagcgagaaccccaagctgcctgagctgctgctgaagaatggaattgccttcatgggcccccccagccaggccatgtgggccctgggggacaagatcgccagcagcatcgtggcccagacagctggcatccccaccctgccctggagcggcagcggcctgcgggtggactggcaggagaatgacttcagcaagaggatcctgaatgtgccccaggagctgtatgagaagggctacgtgaaggatgtggatgatggcctgcaggccgctgaggaggtgggctaccctgtgatgatcaaggccagcgagggcggcggcggcaagggcatcaggaaggtgaacaatgctgatgacttccccaacctcttccggcaggtgcaggccgaggtgcccggcagccccatctttgtgatgaggctggccaagcagagccgccacctggaggtgcagatcctggccgaccagtatggaaatgccatcagcctgtttggccgggactgcagcgtgcagaggaggcaccagaagatcatcgaggaggccccagccaccatcgccaccccagctgtgtttgagcacatggagcagtgtgctgtgaagctggccaagatggtgggctacgtgtctgctggcaccgtggagtacctgtacagccaggacggcagcttctacttcctggagctgaacccccggctgcaggtggagcacccctgcacagagatggtggctgatgtgaacctgcctgctgcccagctgcagatcgccatgggcatccccctgtaccgcatcaaggacatccgcatgatgtatggagtgagcccctggggagacagccccatcgactttgaagattctgcccacgtgccctgcccccggggccacgtgattgctgcccgcatcaccagtgaaaatccagatgagggcttcaagcccagcagcggcaccgtgcaggagctgaacttccgcagcaacaagaatgtgtggggctacttctctgtggccgccgccggcggcctgcacgagtttgctgacagccagtttggccactgcttctcctggggagaaaatcgggaggaggccatcagcaacatggtggtggccctgaaggagctgagcatccggggggacttccgcaccaccgtggagtacctgatcaagctgctggagacagagagcttccagatgaacagaattgacaccggctggctggaccggctgattgctgagaaggtgcaggccgagaggccagacaccatgctgggcgtggtgtgtggggccctgcacgtggctgatgtgtccctgagaaattctgtgagcaacttcctgcacagcctggagcggggccaggtgctgcctgcccacaccctgctgaacacagtggatgtggagctgatctatgagggcgtgaagtatgtgctgaaggtgacccggcagagccccaacagctatgtggtgatcatgaatggcagctgtgtggaggtggatgtgcaccggctgagtgatggcggcctgctgctgtcctatgatggcagcagctacaccacctacatgaaggaggaggtggaccgctaccgcatcaccatcggcaacaagacctgtgtgtttgagaaggaaaatgaccccagcgtgatgaggagccccagcgctgggaagctgatccagtacatcgtggaggatggcggccacgtgtttgctggccagtgctacgccgagattgaggtgatgaagatggtgatgaccctgacagctgtggagagcggctgcatccactacgtgaagaggcctggagctgccctggaccccggctgtgtgctggccaagatgcagctggacaaccccagcaaggtgcagcaggccgagctgcacacaggcagcctgccccgcatccagagcacagccctgcggggggagaagctgcacagggtcttccactacgtgctggacaacctggtgaatgtgatgaatggctactgcctgcctgaccccttcttcagcagcaaggtgaaggactgggtggagcggctgatgaagaccctgcgggaccccagcctgcccctgctggagctgcaggacatcatgacctctgtgtctggccgcatccccccaaatgtggagaagagcatcaagaaggagatggcccagtatgccagcaacatcacctctgtgctgtgccagttccccagccagcagatcgccaacatcctggacagccatgctgccaccctgaacaggaagtctgagcgggaggtgttcttcatgaacacccagagcatcgtgcagctggtgcagcgctacagaagtggcatccggggccacatgaaggctgtggtgatggacctgctgcggcagtacctgcgggtggagacccagttccagaatggccactatgacaagtgtgtgtttgccctgcgggaggagaacaagagtgacatgaacacagtgctgaactacatcttcagccacgcccaggtgaccaagaagaacctgctggtgaccatgctgattgaccagctgtgtggccgggaccccaccctgacagatgagctgctgaacatcctgacagagctgacccagctgagcaagaccaccaatgccaaggtggccctgcgggcccggcaggtgctgattgccagccacctgcccagctatgagctgcggcacaaccaggtggagagcatcttcctgagcgccatcgacatgtatggccaccagttctgcatcgagaacctgcagaagctgatcctgtctgagaccagcatctttgatgtgctgcccaacttcttctaccacagcaaccaggtggtgaggatggccgccctggaggtgtatgtgagaagagcctacatcgcctatgagctgaacagcgtgcagcaccggcagctgaaggacaacacctgtgtggtggagttccagttcatgctgcccaccagccaccccaacagaggcaacatccccaccctgaacaggatgtccttcagcagcaacctgaaccactacggcatgacccacgtggcctctgtgtctgatgtgctgctggacaacagcttcaccccaccctgccagaggatgggcggcatggtgtccttccgcacctttgaagattttgtgcgcatctttgatgaggtgatgggctgcttcagtgacagccccccccagagccccaccttccctgaggccggccacaccagcctgtatgatgaggacaaggtgcccagagatgagcccatccacatcctgaatgtggccatcaagacagactgtgacattgaagatgaccggctggccgccatgttccgggagttcacccagcagaacaaggccaccctggtggaccacggcatccggcggctgaccttcctggtggcccagaaggacttcaggaagcaggtgaactatgaggtggaccggcgcttccaccgggagttccccaagttcttcaccttccgggcccgggacaagtttgaggaggaccgcatctaccgccacctggagcccgccctggccttccagctggagctgaacaggatgaggaactttgacctgacagccatcccctgtgccaaccacaagatgcacctgtacctgggcgccgccaaggtggaggtgggcacagaggtgacagactaccgcttctttgtgcgggccatcatccgccacagcgacctggtgaccaaggaggccagctttgagtacctgcagaatgaaggagagcggctgctgctggaggccatggatgagctggaggtggccttcaacaacaccaacgtgaggacagactgcaaccacatcttcctgaactttgtgcccaccgtcatcatggaccccagcaagattgaggagagcgtgcgctccatggtgatgagatatggcagccggctgtggaagctgcgggtgctgcaggccgagctgaagatcaacatccggctgacccccaccgggaaggccatccccatccgcctcttcctgaccaatgaaagtggctactacctggacatcagcctgtacaaggaggtgacagacagcaggacagcccagatcatgttccaggcctatggagacaagcagggccccctgcacggcatgctgatcaacaccccctacgtgaccaaggacctgctgcagagcaagcgcttccaggcccagagcctgggcaccacctacatctatgacatccctgagatgttccggcagagcctcatcaagctgtgggagagcatgagcacccaggccttcctgcccagcccccccctgcccagcgacatgctgacctacacagagctggtgctggatgaccagggccagctggtgcacatgaaccggctgcccggcggcaatgaaattggcatggtggcctggaagatgaccttcaagagccctgagtacccagagggccgggacatcatcgtgattggaaatgacatcacctaccgcatcggcagctttggcccccaggaggacctgctcttcctgcgggccagcgagctggcccgggcagagggcatcccccgcatctacgtgtctgccaacagcggggcccgcatcggcctggccgaggagatccgccacatgtttcatgtggcctgggtggaccctgaggacccctacaagggctaccgctacctgtacctgaccccccaggactacaagagggtgtctgccctgaacagcgtgcactgtgaacatgtggaggatgaaggagagagccgctacaagatcacagacatcatcggcaaggaggagggcatcggccctgagaacctgcggggcagcggcatgattgctggggagagcagcctggcctacaatgagatcatcaccatcagcctggtgacctgccgggccatcggcattggagcctacctggtgcggctgggccagaggaccatccaggtggagaacagccacctgatcctgactggagctggggccctgaacaaggtgctgggccgggaggtgtacaccagcaacaaccagctgggcggcatccagatcatgcacaacaacggggtgacccactgcaccgtgtgtgatgactttgaaggagtcttcaccgtgctgcactggctgagctacatgcccaagtctgtgcacagctctgtgcccctgctgaacagcaaggaccccatcgaccgcatcattgaatttgtgcccaccaagaccccctatgacccccgctggatgctggccggccggccccaccccacccagaagggccagtggctgagcggcttctttgattatggcagcttcagcgagatcatgcagccctgggcccagacagtggtggtgggccgggcccggctgggcggcatccctgtgggcgtggtggccgtggagaccaggacagtggagctgagcatcccagctgaccctgccaacctggacagcgaggccaagatcatccagcaggccggccaggtgtggttcccagacagcgccttcaagacctaccaggccatcaaggacttcaaccgggagggcctgcccctgatggtgtttgccaactggaggggcttcagcggcggcatgaaggacatgtatgaccaggtgctgaagtttggagcctacatcgtggatggcctgcgggagtgctgccagcctgtgctggtgtacatccccccccaggccgagctgcggggcggctcctgggtggtgattgacagcagcatcaaccccaggcacatggagatgtatgctgaccgggagagccggggctctgtgctggagcctgagggcaccgtggagatcaagttccggaggaaggacctggtgaagaccatgagaagagtggaccctgtgtacatccacctggccgagcggctgggcaccccagagctgagcacagctgagaggaaggagctggagaacaagctgaaggagcgggaggagttcctgatccccatctaccaccaggtggccgtgcagtttgctgacctgcatgacaccccaggccgcatgcaggagaagggcgtcatcagtgacatcctggactggaagaccagcaggaccttcttctactggaggctgcggcggctgctgctggaggacctggtgaagaagaagatccacaatgccaaccctgagctgacagatggccagatccaggccatgctgcggcgctggtttgtggaggtggagggcaccgtgaaggcctacgtgtgggacaacaacaaggacctggccgagtggctggagaagcagctgacagaagaagatggagtgcacagcgtcatcgaggagaacatcaagtgcatcagccgggactatgtgctgaagcagatccgcagcctggtgcaggccaaccctgaggtggccatggacagcatcatccacatgacccagcacatcagccccacccagagagctgaggtgatccgcatcctgagcaccatggacagccccagcacctag

SEQ ID NO: 18216 - DNA, 777 bp, Artificial Sequence
  Description of Artificial Sequence: Synthetic coding sequence
atgagcggcctgcacctggtgaagcagggccgggacaggaagaagattgacagccagagggacttcaccgtggccagccctgctgagtttgtgaccaggtttggaggcaacaaggtgattgagaaggtgctgattgccaacaacggcattgctgctgtgaagtgcatgaggagcatccgccgctggagctatgagatgttcagaaatgaaagagccatccgctttgtggtgatggtgaccccagaggacctgaaggccaatgctgagtacatcaagatggctgaccactacgtgcctgtgcctgggggccccaacaacaacaactatgccaacgtggagctgatcctggacatcgccaagagaattcctgtgcaggccgtgtgggccggctggggccacgccagcgagaaccccaagctgcctgagctgctgctgaagaatggaattgccttcatgggcccccccagccaggccatgtgggccctgggggacaagatcgccagcagcatcgtggcccagacagctggcatccccaccctgccctggagcggcagcggcctgcgggtggactggcaggagaatgacttcagcaagaggatcctgaatgtgccccaggagctgtatgagaagggctacgtgaaggatgtggatgatggcctgcaggccgctgaggaggtgggctaccctgtgatgatcaaggccagcgagggcggcggcggcaagggcatcaggaaggtgaacaatgctgatgacttccccaacctcttccggcagtag

SEQ ID NO: 18217 - DNA, 144 bp, Artificial Sequence
  Description of Artificial Sequence: Synthetic coding sequence
atggatgagcccagccccctggcccagcccctggagctgaaccagcacagccgcttcatcatcggctctgtgtctgaggacaacagtgaagatgagatcagcaacctggtgaagctggacctgctggaggagaaggagggctag

SEQ ID NO: 18218 - DNA, 2679 bp, Artificial Sequence
  Description of Artificial Sequence: Synthetic coding sequence
atggaccactatgacagccagcagaccaatgactacatgcagcctgaggaggactgggaccgggacctgctgctggaccctgcctgggagaagcagcagaggaagaccttcaccgcctggtgcaacagccacctgaggaaggccggcacccagattgaaaatattgaggaggacttcagagatggcctgaagctgatgctgctgctggaggtgatctctggagagcggctggccaagccagagcggggcaagatgagggtgcacaagatcagcaatgtgaacaaggccctggacttcatcgccagcaaaggagtgaagctggtgtccatcggggctgaggagatcgtggatggaaatgtgaagatgaccctgggcatgatctggaccatcatcctgcgctttgccatccaggacatctctgtggaggagaccagcgccaaggagggcctgctgctgtggtgccagaggaagacagccccctacaagaatgtgaacatccagaacttccacatctcctggaaggatggcctgggcttctgtgccctgatccaccgccacaggcctgagctgattgattatggcaagctgaggaaggatgaccccctgaccaacctgaacacagcctttgatgtggccgagaagtacctggacatccccaagatgctggatgctgaagatattgtgggcacagcccggccagatgagaaggccatcatgacctacgtgagcagcttctaccacgccttcagcggggcccagaaggccgagacagctgccaaccgcatctgcaaggtgctggccgtgaaccaggagaatgagcagctgatggaggactatgagaagctggccagtgacctgctggagtggatccggaggaccatcccctggctggagaacagagtgcctgagaacaccatgcacgccatgcagcagaagctggaggacttccgggactaccgccgcctgcacaagccacccaaggtgcaggagaagtgccagctggagatcaacttcaacaccctgcagaccaagctgcggctgagcaacagacctgccttcatgcccagcgagggccgcatggtgtctgacatcaacaatgcctggggctgcctggagcaggtggagaagggctatgaggagtggctgctgaatgagatccggcggctggagcggctggaccacctggccgagaagttccggcagaaggccagcatccacgaggcctggacagatggcaaggaggccatgctgcggcagaaggactatgaaacagccaccctgtctgagatcaaggccctgctgaagaagcatgaggcctttgaaagtgacctggccgcccaccaggacagagtggagcagattgctgccatcgcccaggagctgaatgagctggactactatgacagccccagcgtgaatgcccgctgccagaagatctgtgaccagtgggacaacctgggcgccctgacccagaagagaagagaggccctggagaggacagagaagctgctggagaccatcgaccagctgtacctggagtatgccaagagagctgcccccttcaacaactggatggagggcgccatggaggacctgcaggacaccttcatcgtgcacaccatcgaggagatccagggcctgaccacagcccacgagcagttcaaggccaccctgcctgatgctgacaaggagcggctggccatcctgggcatccacaatgaggtgtccaagatcgtgcagacctaccacgtgaacatggccggcaccaacccctacaccaccatcaccccccaggagatcaatggcaagtgggaccacgtgcggcagctggtgccccggcgggaccaggccctgacagaggagcacgcccggcagcagcacaatgaaaggctgaggaagcagtttggagcccaggccaacgtcatcggcccctggatccagaccaagatggaggagatcggccgcatcagcattgagatgcacggcaccctggaggaccagctgagccacctgcggcagtatgagaagagcatcgtgaactacaagcccaagattgaccagctggagggggaccaccagctgatccaggaggccctgatctttgacaacaagcacaccaactacaccatggagcacatccgggtgggctgggagcagctgctgaccaccatcgcccggaccatcaatgaggtggagaaccagatcctgaccagagatgccaagggcatcagccaggagcagatgaatgagttccgggccagcttcaaccactttgaccgggaccacagcggcaccctgggccctgaggagttcaaggcctgcctgatcagcctgggctatgacattggaaatgacccccagggcgaggccgagtttgcccgcatcatgagcatcgtggaccccaaccggctgggcgtggtgaccttccaggccttcatcgacttcatgagccgggagacagctgacacagacacagctgaccaggtgatggccagcttcaagatcctggccggggacaagaactacatcaccatggatgagctgcggcgggagctgcccccagaccaggccgagtactgcatcgccaggatggccccctacacaggccctgacagcgtgcctggggccctggactacatgtccttcagcacagccctgtatggagagagtgacctgtag

SEQ ID NO: 18219 - DNA, 2745 bp, Artificial Sequence
  Description of Artificial Sequence: Synthetic coding sequence
atggaccactatgacagccagcagaccaatgactacatgcagcctgaggaggactgggaccgggacctgctgctggaccctgcctgggagaagcagcagaggaagaccttcaccgcctggtgcaacagccacctgaggaaggccggcacccagattgaaaatattgaggaggacttcagagatggcctgaagctgatgctgctgctggaggtgatctctggagagcggctggccaagccagagcggggcaagatgagggtgcacaagatcagcaatgtgaacaaggccctggacttcatcgccagcaaaggagtgaagctggtgtccatcggggctgaggagatcgtggatggaaatgtgaagatgaccctgggcatgatctggaccatcatcctgcgctttgccatccaggacatctctgtggaggagaccagcgccaaggagggcctgctgctgtggtgccagaggaagacagccccctacaagaatgtgaacatccagaacttccacatctcctggaaggatggcctgggcttctgtgccctgatccaccgccacaggcctgagctgattgattatggcaagctgaggaaggatgaccccctgaccaacctgaacacagcctttgatgtggccgagaagtacctggacatccccaagatgctggatgctgaagatattgtgggcacagcccggccagatgagaaggccatcatgacctacgtgagcagcttctaccacgccttcagcggggcccagaaggccgagacagctgccaaccgcatctgcaaggtgctggccgtgaaccaggagaatgagcagctgatggaggactatgagaagctggccagtgacctgctggagtggatccggaggaccatcccctggctggagaacagagtgcctgagaacaccatgcacgccatgcagcagaagctggaggacttccgggactaccgccgcctgcacaagccacccaaggtgcaggagaagtgccagctggagatcaacttcaacaccctgcagaccaagctgcggctgagcaacagacctgccttcatgcccagcgagggccgcatggtgtctgacatcaacaatgcctggggctgcctggagcaggtggagaagggctatgaggagtggctgctgaatgagatccggcggctggagcggctggaccacctggccgagaagttccggcagaaggccagcatccacgaggcctggacagatggcaaggaggccatgctgcggcagaaggactatgaaacagccaccctgtctgagatcaaggccctgctgaagaagcatgaggcctttgaaagtgacctggccgcccaccaggacagagtggagcagattgctgccatcgcccaggagctgaatgagctggactactatgacagccccagcgtgaatgcccgctgccagaagatctgtgaccagtgggacaacctgggcgccctgacccagaagagaagagaggccctggagaggacagagaagctgctggagaccatcgaccagctgtacctggagtatgccaagagagctgcccccttcaacaactggatggagggcgccatggaggacctgcaggacaccttcatcgtgcacaccatcgaggagatccagggcctgaccacagcccacgagcagttcaaggccaccctgcctgatgctgacaaggagcggctggccatcctgggcatccacaatgaggtgtccaagatcgtgcagacctaccacgtgaacatggccggcaccaacccctacaccaccatcaccccccaggagatcaatggcaagtgggaccacgtgcggcagctggtgccccggcgggaccaggccctgacagaggagcacgcccggcagcagcacaatgaaaggctgaggaagcagtttggagcccaggccaacgtcatcggcccctggatccagaccaagatggaggagatcggccgcatcagcattgagatgcacggcaccctggaggaccagctgagccacctgcggcagtatgagaagagcatcgtgaactacaagcccaagattgaccagctggagggggaccaccagctgatccaggaggccctgatctttgacaacaagcacaccaactacaccatggagcacatccgggtgggctgggagcagctgctgaccaccatcgcccggaccatcaatgaggtggagaaccagatcctgaccagagatgccaagggcatcagccaggagcagatgaatgagttccgggccagcttcaaccactttgaccgggaccacagcggcaccctgggccctgaggagttcaaggcctgcctgatcagcctgggctatgacattggaaatgacccccagaagaagacaggcatgatggacacagatgacttccgggcctgcctgatctccatgggctacaacatgggagaggccgagtttgcccgcatcatgagcatcgtggaccccaaccggctgggcgtggtgaccttccaggccttcatcgacttcatgagccgggagacagctgacacagacacagctgaccaggtgatggccagcttcaagatcctggccggggacaagaactacatcaccatggatgagctgcggcgggagctgcccccagaccaggccgagtactgcatcgccaggatggccccctacacaggccctgacagcgtgcctggggccctggactacatgtccttcagcacagccctgtatggagagagtgacctgtag

SEQ ID NO: 18220 - DNA, 2664 bp, Artificial Sequence
  Description of Artificial Sequence: Synthetic coding sequence
atggaccactatgacagccagcagaccaatgactacatgcagcctgaggaggactgggaccgggacctgctgctggaccctgcctgggagaagcagcagaggaagaccttcaccgcctggtgcaacagccacctgaggaaggccggcacccagattgaaaatattgaggaggacttcagagatggcctgaagctgatgctgctgctggaggtgatctctggagagcggctggccaagccagagcggggcaagatgagggtgcacaagatcagcaatgtgaacaaggccctggacttcatcgccagcaaaggagtgaagctggtgtccatcggggctgaggagatcgtggatggaaatgtgaagatgaccctgggcatgatctggaccatcatcctgcgctttgccatccaggacatctctgtggaggagaccagcgccaaggagggcctgctgctgtggtgccagaggaagacagccccctacaagaatgtgaacatccagaacttccacatctcctggaaggatggcctgggcttctgtgccctgatccaccgccacaggcctgagctgattgattatggcaagctgaggaaggatgaccccctgaccaacctgaacacagcctttgatgtggccgagaagtacctggacatccccaagatgctggatgctgaagatattgtgggcacagcccggccagatgagaaggccatcatgacctacgtgagcagcttctaccacgccttcagcggggcccagaaggccgagacagctgccaaccgcatctgcaaggtgctggccgtgaaccaggagaatgagcagctgatggaggactatgagaagctggccagtgacctgctggagtggatccggaggaccatcccctggctggagaacagagtgcctgagaacaccatgcacgccatgcagcagaagctggaggacttccgggactaccgccgcctgcacaagccacccaaggtgcaggagaagtgccagctggagatcaacttcaacaccctgcagaccaagctgcggctgagcaacagacctgccttcatgcccagcgagggccgcatggtgtctgacatcaacaatgcctggggctgcctggagcaggtggagaagggctatgaggagtggctgctgaatgagatccggcggctggagcggctggaccacctggccgagaagttccggcagaaggccagcatccacgaggcctggacagatggcaaggaggccatgctgcggcagaaggactatgaaacagccaccctgtctgagatcaaggccctgctgaagaagcatgaggcctttgaaagtgacctggccgcccaccaggacagagtggagcagattgctgccatcgcccaggagctgaatgagctggactactatgacagccccagcgtgaatgcccgctgccagaagatctgtgaccagtgggacaacctgggcgccctgacccagaagagaagagaggccctggagaggacagagaagctgctggagaccatcgaccagctgtacctggagtatgccaagagagctgcccccttcaacaactggatggagggcgccatggaggacctgcaggacaccttcatcgtgcacaccatcgaggagatccagggcctgaccacagcccacgagcagttcaaggccaccctgcctgatgctgacaaggagcggctggccatcctgggcatccacaatgaggtgtccaagatcgtgcagacctaccacgtgaacatggccggcaccaacccctacaccaccatcaccccccaggagatcaatggcaagtgggaccacgtgcggcagctggtgccccggcgggaccaggccctgacagaggagcacgcccggcagcagcacaatgaaaggctgaggaagcagtttggagcccaggccaacgtcatcggcccctggatccagaccaagatggaggagatcggccgcatcagcattgagatgcacggcaccctggaggaccagctgagccacctgcggcagtatgagaagagcatcgtgaactacaagcccaagattgaccagctggagggggaccaccagctgatccaggaggccctgatctttgacaacaagcacaccaactacaccatggagcacatccgggtgggctgggagcagctgctgaccaccatcgcccggaccatcaatgaggtggagaaccagatcctgaccagagatgccaagggcatcagccaggagcagatgaatgagttccgggccagcttcaaccactttgacaggaagaagacaggcatgatggacacagatgacttccgggcctgcctgatctccatgggctacaacatgggagaggccgagtttgcccgcatcatgagcatcgtggaccccaaccggctgggcgtggtgaccttccaggccttcatcgacttcatgagccgggagacagctgacacagacacagctgaccaggtgatggccagcttcaagatcctggccggggacaagaactacatcaccatggatgagctgcggcgggagctgcccccagaccaggccgagtactgcatcgccaggatggccccctacacaggcccagattctgtgcctggggccctggactacatgtccttcagcacagccctgtatggagagagtgacctgtag

SEQ ID NO: 18221 - DNA, 2736 bp, Artificial Sequence
  Description of Artificial Sequence: Synthetic coding sequence
atggtggactaccacgccgccaaccagagctaccagtatggccccagcagcgctggaaatggagctgggggcggcggctccatgggagactacatggcccaggaggatgactgggaccgggacctgctgctggaccctgcctgggagaagcagcagaggaagaccttcaccgcctggtgcaacagccacctgaggaaggccggcacccagatcgagaacattgatgaggacttcagagatggcctgaagctgatgctgctgctggaggtgatcagcggggagcggctgcccaagccagagcggggcaagatgagggtgcacaagatcaacaacgtgaacaaggccctggacttcatcgccagcaagggcgtgaagctggtgtccattggagctgaggagatcgtggatggaaatgccaagatgaccctgggcatgatctggaccatcatcctgcgctttgccatccaggacatctctgtggaggagaccagcgccaaggagggcctgctgctgtggtgccagaggaagacagccccctacaagaatgtgaatgtgcagaacttccacatctcctggaaggatggcctggccttcaatgccctgatccaccgccacaggcctgagctgattgaatatgacaagctgaggaaggatgatcctgtgaccaacctgaacaatgcctttgaggtggccgagaagtacctggacatccccaagatgctggatgctgaggacatcgtgaacacagcccggccagatgagaaggccatcatgacctacgtgtcctccttctaccacgccttcagcggggcccagaaggccgagacagctgccaaccgcatctgcaaggtgctggccgtgaaccaggagaatgagcacctgatggaggactatgagaagctggccagtgacctgctggagtggatccggaggaccatcccctggctggaggacagagtgccccagaagaccatccaggagatgcagcagaagctggaggacttccgggactacagaagagtgcacaagccacccaaggtgcaggagaagtgccagctggagatcaacttcaacaccctgcagaccaagctgcggctgagcaacagacctgccttcatgcccagcgagggcaagatggtgtctgacatcaacaacggctggcagcacctggagcaggccgagaagggctatgaggagtggctgctgaatgagatccggcggctggagcggctggaccacctggccgagaagttccggcagaaggccagcatccacgaggcctggacagatggcaaggaggccatgctgaagcaccgggactatgaaacagccaccctgagtgacatcaaggccctgatcaggaagcatgaggcctttgaaagtgacctggccgcccaccaggacagagtggagcagattgctgccatcgcccaggagctgaatgagctggactactatgacagccacaacgtgaacacccgctgccagaagatctgtgaccagtgggatgccctgggcagcctgacccacagccggcgggaggccctggagaagacagagaagcagctggaggccatcgaccagctgcacctggagtatgccaagagagctgcccccttcaacaactggatggagagcgccatggaggacctgcaggacatgttcatcgtgcacaccatcgaggagattgagggcctcatcagcgcccatgaccagttcaagagcaccctgcctgatgctgaccgggagcgggaggccatcctggccatccacaaggaggcccagagaattgctgagagcaaccacatcaagctgagcggcagcaacccctacaccaccgtgaccccccagatcatcaacagcaagtgggagaaggtgcagcagctggtgcccaagagggaccacgccctgctggaggagcagagcaagcagcagagcaatgagcacctgcggcggcagtttgccagccaggccaacgtggtgggcccctggatccagaccaagatggaggagatcggccgcatcagcattgagatgaatggcaccctggaggaccagctgagccacctgaagcagtatgaaagaagcatcgtggactacaagcccaacctggacctgctggagcagcagcaccagctgatccaggaggccctgatctttgacaacaagcacaccaactacaccatggagcacatccgggtgggctgggagcagctgctgaccaccatcgcccggaccatcaatgaggtggagaaccagatcctgaccagagatgccaagggcatcagccaggagcagatgcaggagttccgggccagcttcaaccactttgacaaggaccatggaggagccctgggccctgaggagttcaaggcctgcctgatcagcctgggctatgatgtggagaatgaccggcagggcgaggccgagttcaaccgcatcatgagcctggtggaccccaaccacagcggcctggtgaccttccaggccttcatcgacttcatgagccgggagaccacagacacagacacagctgaccaggtgattgccagcttcaaggtgctggccggggacaagaacttcatcacagctgaggagctgcggcgggagctgcccccagaccaggccgagtactgcatcgccaggatggccccctaccagggcccagatgctgtgcctggggccctggactacaagagcttcagcacagccctgtatggagagagtgacctgtag

SEQ ID NO: 18222 - DNA, 2079 bp, Artificial Sequence
  Description of Artificial Sequence: Synthetic coding sequence
atggtggactaccacgccgccaaccagagctaccagtatggccccagcagcgctggaaatggagctgggggcggcggctccatgggagactacatggcccaggaggatgactgggaccgggacctgctgctggaccctgcctgggagaagcagcagaggaaggccgagacagctgccaaccgcatctgcaaggtgctggccgtgaaccaggagaatgagcacctgatggaggactatgagaagctggccagtgacctgctggagtggatccggaggaccatcccctggctggaggacagagtgccccagaagaccatccaggagatgcagcagaagctggaggacttccgggactaccgccgggtgcacaagccacccaaggtgcaggagaagtgccagctggagatcaacttcaacaccctgcagaccaagctgcggctgagcaacagacctgccttcatgcccagcgagggcaagatggtgtctgacatcaacaacggctggcagcacctggagcaggccgagaagggctatgaggagtggctgctgaatgagatccggcggctggagcggctggaccacctggccgagaagttccggcagaaggccagcatccacgaggcctggacagatggcaaggaggccatgctgaagcaccgggactatgaaacagccaccctgagtgacatcaaggccctgatcaggaagcatgaggcctttgaaagtgacctggccgcccaccaggacagagtggagcagattgctgccatcgcccaggagctgaatgagctggactactatgacagccacaacgtgaacacccgctgccagaagatctgtgaccagtgggatgccctgggcagcctgacccacagcagaagagaggccctggagaagacagagaagcagctggaggccatcgaccagctgcacctggagtatgccaagagagctgcccccttcaacaactggatggagagcgccatggaggacctgcaggacatgtttattgtgcacaccatcgaggagattgagggcctcatcagcgcccatgaccagttcaagagcaccctgcctgatgctgaccgggagcgggaggccatcctggccatccacaaggaggcccagagaattgctgagagcaaccacatcaagctgagcggcagcaacccctacaccaccgtgaccccccagatcatcaacagcaagtgggagaaggtgcagcagctggtgcccaagagggaccacgccctgctggaggagcagagcaagcagcagagcaatgagcacctgcggcggcagtttgccagccaggccaacgtggtgggcccctggatccagaccaagatggaggagatcggccgcatcagcattgagatgaatggcaccctggaggaccagctgagccacctgaagcagtatgaaagaagcatcgtggactacaagcccaacctggacctgctggagcagcagcaccagctgatccaggaggccctgatctttgacaacaagcacaccaactacaccatggagcacatccgggtgggctgggagcagctgctgaccaccatcgcccggaccatcaatgaggtggagaaccagatcctgaccagagatgccaagggcatcagccaggagcagatgcaggagttccgggccagcttcaaccactttgacaaggaccacggcggggccctgggccctgaggagttcaaggcctgcctgatcagcctgggctatgatgtggagaatgaccggcagggcgaggccgagttcaaccgcatcatgagcctggtggaccccaaccacagcggcctggtgaccttccaggccttcatcgacttcatgagccgggagaccacagacacagacacagctgaccaggtgattgccagcttcaaggtgctggccggggacaagaacttcatcacagctgaggagctgcggcgggagctgcccccagaccaggccgagtactgcatcgccaggatggccccctaccagggcccagatgctgtgcctggggccctggactacaagagcttcagcacagccctgtatggagagagtgacctgtag

SEQ ID NO: 18223 - DNA, 1566 bp, Artificial Sequence
  Description of Artificial Sequence: Synthetic coding sequence
atggtggactaccacgccgccaaccagagctaccagtatggccccagcagcgctggaaatggagctgggggcggcggctccatgggagactacatggcccaggaggatgactgggaccgggacctgctgctggaccctgcctgggagaagcagcagaggaagaccttcaccgcctggtgcaacagccacctgaggaaggccggcacccagatcgagaacattgatgaggacttcagagatggcctgaagctgatgctgctgctggaggtgcatgagctggactactatgacagccacaacgtgaacacccgctgccagaagatctgtgaccagtgggatgccctgggcagcctgacccacagccggcgggaggccctggagaagacagagaagcagctggaggccatcgaccagctgcacctggagtatgccaagagagctgcccccttcaacaactggatggagagcgccatggaggacctgcaggacatgttcatcgtgcacaccatcgaggagattgagggcctcatcagcgcccatgaccagttcaagagcaccctgcctgatgctgaccgggagcgggaggccatcctggccatccacaaggaggcccagagaattgctgagagcaaccacatcaagctgagcggcagcaacccctacaccaccgtgaccccccagatcatcaacagcaagtgggagaaggtgcagcagctggtgcccaagagggaccacgccctgctggaggagcagagcaagcagcagagcaatgagcacctgcggcggcagtttgccagccaggccaacgtggtgggcccctggatccagaccaagatggaggagatcggccgcatcagcattgagatgaatggcaccctggaggaccagctgagccacctgaagcagtatgaaagaagcatcgtggactacaagcccaacctggacctgctggagcagcagcaccagctgatccaggaggccctgatctttgacaacaagcacaccaactacaccatggagcacatccgggtgggctgggagcagctgctgaccaccatcgcccggaccatcaatgaggtggagaaccagatcctgaccagagatgccaagggcatcagccaggagcagatgcaggagttccgggccagcttcaaccactttgacaaggaccatggaggagccctgggccctgaggagttcaaggcctgcctgatcagcctgggctatgatgtggagaatgaccggcagggcgaggccgagttcaaccgcatcatgagcctggtggaccccaaccacagcggcctggtgaccttccaggccttcatcgacttcatgagccgggagaccacagacacagacacagctgaccaggtgattgccagcttcaaggtgctggccggggacaagaacttcatcacagctgaggagctgcggcgggagctgcccccagaccaggccgagtactgcatcgccaggatggccccctaccagggcccagatgctgtgcctggggccctggactacaagagcttcagcacagccctgtatggagagagtgacctgtag

SEQ ID NO: 18224 - DNA, 1689 bp, Artificial Sequence
  Description of Artificial Sequence: Synthetic coding sequence
atggtggactaccacgccgccaaccagagctaccagtatggccccagcagcgctggaaatggagctgggggcggcggctccatgggagactacatggcccaggaggatgactgggaccgggacctgctgctggaccctgcctgggagaagcagcagaggaagaccttcaccgcctggtgcaacagccacctgaggaaggccggcacccagatcgagaacattgatgaggacttcagagatggcctgaagctgatgctgctgctggaggtgatcagcggggagcggctgcccaagccagagcggggcaagatgagggtgcacaagatcaacaacgtgaacaaggccctggacttcatcgccagcaagggcgtgaagctggtgtccattggagctgaggagatcgtggatggaaatgccaagatgaccctgggcatgatctggaccatcatcctgcgctttgccatccaggacatctctgtggaggagaccagcgccaaggagggcctgctgctgtggtgccagaggaagacagccccctacaagaatgtgaatgtgcagaacttccacatctcctggaaggatggcctggccttcaatgccctgatccaccgccacaggcctgagctgattgaatatgacaagctgaggaaggatgatcctgtgaccaacctgaacaatgcctttgaggtggccgagaagtacctggacatccccaagatgctggatgctgaggacatcgtgaacacagcccggccagatgagaaggccatcatgacctacgtgtcctccttctaccacgccttcagcggggcccagaaggccgagacagctgccaaccgcatctgcaaggtgctggccgtgaaccaggagaatgagcacctgatggaggactatgagaagctggccagtgacctgctggagtggatccggaggaccatcccctggctggaggacagagtgccccagaagaccatccaggagatgcagcagaagctggaggacttccgggactacagaagagtgcacaagccacccaaggtgcaggagaagtgccagctggagatcaacttcaacaccctgcagaccaagctgcggctgagcaacagacctgccttcatgcccagcgagggcaagatggtgtctgacatcaacaacggctggcagcacctggagcaggccgagaagggctatgaggagtggctgctgaatgagatccggcggctggagcggctggaccacctggccgagaagttccggcagaaggccagcatccacgaggcctggacagatggcaaggaggccatgctgaagcaccgggactatgaaacagccaccctgagtgacatcaaggccctgatcaggaagcatgaggcctttgaaagtgacctggccgcccaccaggacagagtggagcagattgctgccatcgcccaggagctgaatgagctggactactatgacagccacaacgtgaacaccccagatggcctgcaggagggccctggccagccccacagccccatcccccccctgtgcatctatgccaagcacagcctgcagagcagcggcgtgggcggctgggccggccggggctggggccgcctgagccccctgagcctgtgtggcctggcccggcgcttcccccggcccggctggggagacctgggccctgccctgctggtgtggtag

SEQ ID NO: 18225 - DNA, 1518 bp, Artificial Sequence
  Description of Artificial Sequence: Synthetic coding sequence
atgaagttcaagctgcacgtgaacagcgcccggcagtacaaggacctgtggaacatgtctgatgacaagcccttcctgtgcacagcccctggctgcggccagcgcttcaccaatgaagaccacctggccgtgcacaagcacaagcatgagatgaccctgaagtttggacctgccagaaatgacagcgtcatcgtggccgaccagacccccacccccacccgcttcctgaagaactgtgaggaggtgggcctcttcaatgagctggccagcccctttgaaaatgagttcaagaaggcctctgaagatgacatcaagaagatgcccctggacctgagccccctggccacccccatcatccgcagcaagattgaggagcccagcgtggtggagaccacccaccaggacagccccctgccccaccctgagagcaccaccagtgatgagaaggaggtgcccctggcccagacagcccagcccaccagcgccatcgtgcggcctgccagcctgcaggtgcccaacgtgctgctgaccagcagtgacagcagcgtcatcatccagcaggccgtgcccagccccaccagcagcaccgtcatcacccaggcccccagcagcaaccggcccatcgtgcctgtgcccggccccttccccctgctgctgcacctgcccaacggccagaccatgcctgtggccatcccagccagcatcaccagcagcaatgtgcacgtgcctgctgctgtgcccctggtgcggcctgtgaccatggtgcccagcgtgcccggcatccctggccccagcagcccccagcctgtgcagagcgaggccaagatgaggctgaaggccgccctgacccagcagcacccccctgtgaccaatggagacacagtgaagggccacggcagcggcctggtgaggacccagagcgaggagagccggccccagagcctgcagcagcctgccaccagcaccacagagaccccagccagccctgcccacaccaccccccagacccagagcaccagcggcagaagaagaagagctgccaatgaagatcctgatgagaagaggaggaagttcctggagaggaacagagctgctgccagccgctgccggcagaagaggaaggtgtgggtgcagagcctggagaagaaggccgaggacctgagcagcctgaatggccagctgcagagcgaggtgaccctgctgagaaatgaggtggcccagctgaagcagctgctgctggcccacaaggactgccctgtgacagccatgcagaagaagagcggctaccacacagctgacaaggatgacagcagcgaggacatctctgtgcccagcagcccccacacagaggccatccagcacagctctgtgtccaccagcaatggagtgagcagcaccagcaaggccgaggccgtggccacctctgtgctgacccagatggctgaccagagcacagagcccgccctgagccagatcgtgatggcccccagcagccagagccagcccagcggcagctag

SEQ ID NO: 18226 - DNA, 1344 bp, Artificial Sequence
  Description of Artificial Sequence: Synthetic coding sequence
atgtactgtgcctggatgtggccagaccagacccccacccccacccgcttcctgaagaactgtgaggaggtgggcctcttcaatgagctggccagcccctttgaaaatgagttcaagaaggcctctgaagatgacatcaagaagatgcccctggacctgagccccctggccacccccatcatccgcagcaagattgaggagcccagcgtggtggagaccacccaccaggacagccccctgccccaccctgagagcaccaccagtgatgagaaggaggtgcccctggcccagacagcccagcccaccagcgccatcgtgcggcctgccagcctgcaggtgcccaacgtgctgctgaccagcagtgacagcagcgtcatcatccagcaggccgtgcccagccccaccagcagcaccgtcatcacccaggcccccagcagcaaccggcccatcgtgcctgtgcccggccccttccccctgctgctgcacctgcccaacggccagaccatgcctgtggccatcccagccagcatcaccagcagcaatgtgcacgtgcctgctgctgtgcccctggtgcggcctgtgaccatggtgcccagcgtgcccggcatccctggccccagcagcccccagcctgtgcagagcgaggccaagatgaggctgaaggccgccctgacccagcagcacccccctgtgaccaatggagacacagtgaagggccacggcagcggcctggtgaggacccagagcgaggagagccggccccagagcctgcagcagcctgccaccagcaccacagagaccccagccagccctgcccacaccaccccccagacccagagcaccagcggcagaagaagaagagctgccaatgaagatcctgatgagaagaggaggaagttcctggagaggaacagagctgctgccagccgctgccggcagaagaggaaggtgtgggtgcagagcctggagaagaaggccgaggacctgagcagcctgaatggccagctgcagagcgaggtgaccctgctgagaaatgaggtggcccagctgaagcagctgctgctggcccacaaggactgccctgtgacagccatgcagaagaagagcggctaccacacagctgacaaggatgacagcagcgaggacatctctgtgcccagcagcccccacacagaggccatccagcacagctctgtgtccaccagcaatggagtgagcagcaccagcaaggccgaggccgtggccacctctgtgctgacccagatggctgaccagagcacagagcccgccctgagccagatcgtgatggcccccagcagccagagccagcccagcggcagctag

SEQ ID NO: 18227 - DNA, 381 bp, Artificial Sequence
  Description of Artificial Sequence: Synthetic coding sequence
atgtctgatgacaagcccttcctgtgcacagcccctggctgcggccagagcgaggtgaccctgctgagaaatgaggtggcccagctgaagcagctgctgctggcccacaaggactgccctgtgacagccatgcagaagaagagcggctaccacacagctgacaaggatgacagcagcgaggacatctctgtgcccagcagcccccacacagaggccatccagcacagctctgtgtccaccagcaatggagtgagcagcaccagcaaggccgaggccgtggccacctctgtgctgacccagatggctgaccagagcacagagcccgccctgagccagatcgtgatggcccccagcagccagagccagcccagcggcagctag

SEQ ID NO: 18228 - DNA, 1518 bp, Artificial Sequence; identical to SEQ ID NO: 18225
  Description of Artificial Sequence: Synthetic coding sequence

SEQ ID NO: 18229 - DNA, 1344 bp, Artificial Sequence; identical to SEQ ID NO: 18226
  Description of Artificial Sequence: Synthetic coding sequence

SEQ ID NO: 18230 - DNA, 630 bp, Artificial Sequence
  Description of Artificial Sequence: Synthetic coding sequence
atgaagttcaagctgcacgtgaacagcgcccggcagtacaaggacctgtggaacatgtctgatgacaagcccttcctgtgcacagcccctggctgcggccagcgcttcaccaatgaagaccacctggccgtgcacaagcacaagcatgagatgaccctgaagtttggacctgccagaaatgacagcgtcatcgtggccgaccagacccccacccccacccgcttcctgaagaactgtgaggaggtgggcctcttcaatgagctggccagcccctttgaaaatgagttcaagaaggcctctgaagatgacatcaagaagatgcccctggacctgagccccctggccacccccatcatccgcagcaagattgaggagcccagcgtggtggagaccacccaccaggacagccccctgccccaccctgagagcaccaccagtgatgagaaggaggtgcccctggcccagacagcccagcccaccagcgccatcgtgcggcctgccagcctgcaggtgcccaacgtgctgctgaccagcagtgacagcagcgtcatcatccagcaggccgtgcccagccccaccagcagcaccgtcatcacccaggcccccagcagcaaccggcccatcgtgtag

SEQ ID NO: 18231 - DNA, 1188 bp, Artificial Sequence
  Description of Artificial Sequence: Synthetic coding sequence
atgaagttcaagctgcacgtgaacagcgcccggcagtacaaggacctgtggaacatgtctgatgacaagcccttcctgtgcacagcccctggctgcggccagcgcttcaccaatgaagaccacctggccgtgcacaagcacaagcatgagatgaccctgaagtttggacctgccagaaatgacagcgtcatcgtggccgaccagacccccacccccacccgcttcctgaagaactgtgaggaggtgggcctcttcaatgagctggccagcccctttgaaaatgagttcaagaaggcctctgaagatgacatcaagaagatgcccctggacctgagccccctggccacccccatcatccgcagcaagattgaggagcccagcgtggtggagaccacccaccaggacagccccctgccccaccctgagagcaccaccagtgatgagaaggaggtgcccctggcccagacagcccagcccaccagcgccatcgtgcggcctgccagcctgcaggtgcccaacgtgctgctgaccagcagtgacagcagcgtcatcatccagcaggccgtgcccagccccaccagcagcaccgtcatcacccaggcccccagcagcaaccggcccatcgtgcctgtgcccggccccttccccctgctgctgcacctgcccaacggccagaccatgcctgtggccatcccagccagcatcaccagcagcaatgtgcacgtgcctgctgctgtgcccctggtgcggcctgtgaccatggtgcccagcgtgcccggcatccctggccccagcagcccccagcctgtgcagagcgaggccaagatgaggctgaaggccgccctgacccagcagcacccccctgtgaccaatggagacacagtgaagggccacggcagcggcctggtgaggacccagagcgaggagagccggccccagagcctgcagcagcctgccaccagcaccacagagaccccagccagccctgcccacaccaccccccagacccagagcaccagcggcagaagaagaagagctgccaatgaagatcctgatgagaagaggaggaagttcctggagaggaacagagctgctgccagccgctgccggcagaagaggaaggtgtgggtgcagagcctggagaagaaggccgaggacctgagcagcctgaatggccagctgcagtag

SEQ ID NO: 18232 - DNA, 714 bp, Artificial Sequence
  Description of Artificial Sequence: Synthetic coding sequence
atgaagttcaagctgcacgtgaacagcgcccggcagtacaaggacctgtggaacatgtctgatgacaagcccttcctgtgcacagcccctggctgcggccagcgcttcaccaatgaagaccacctggccgtgcacaagcacaagcatgagatgaccctgaagtttggacctgccagaaatgacagcgtcatcgtggccgaccagacccccacccccacccgcttcctgaagaactgtgaggaggtgggcctcttcaatgagctggccagcccctttgaaaatgagttcaagaaggcctctgaagatgacatcaagaagatgcccctggacctgagccccctggccacccccatcatccgcagcaagattgaggagcccagcgtggtggagaccacccaccaggacagccccctgccccaccctgagagcaccaccagtgatgagaaggaggtgcccctggcccagacagcccagcccaccagcgccatcgtgcggcctgccagcctgcaggtgcccaacgtgctgctgaccagcagtgacagcagcgtcatcatccagcaggccgtgcccagccccaccagcagcaccgtcatcacccaggcccccagcagcaaccggcccatcgtgtcctttgaccagagcccctggtgcctggtgttccaggagagccaggtgctgcccctgcccaaccagtacagccagaagcagaagtag

SEQ ID NO: 18233 - DNA, 1464 bp, Artificial Sequence
  Description of Artificial Sequence: Synthetic coding sequence
atgtctgatgacaagcccttcctgtgcacagcccctggctgcggccagcgcttcaccaatgaagaccacctggccgtgcacaagcacaagcatgagatgaccctgaagtttggacctgccagaaatgacagcgtcatcgtggccgaccagacccccacccccacccgcttcctgaagaactgtgaggaggtgggcctcttcaatgagctggccagcccctttgaaaatgagttcaagaaggcctctgaagatgacatcaagaagatgcccctggacctgagccccctggccacccccatcatccgcagcaagattgaggagcccagcgtggtggagaccacccaccaggacagccccctgccccaccctgagagcaccaccagtgatgagaaggaggtgcccctggcccagacagcccagcccaccagcgccatcgtgcggcctgccagcctgcaggtgcccaacgtgctgctgaccagcagtgacagcagcgtcatcatccagcaggccgtgcccagccccaccagcagcaccgtcatcacccaggcccccagcagcaaccggcccatcgtgcctgtgcccggccccttccccctgctgctgcacctgcccaacggccagaccatgcctgtggccatcccagccagcatcaccagcagcaatgtgcacgtgcctgctgctgtgcccctggtgcggcctgtgaccatggtgcccagcgtgcccggcatccctggccccagcagcccccagcctgtgcagagcgaggccaagatgaggctgaaggccgccctgacccagcagcacccccctgtgaccaatggagacacagtgaagggccacggcagcggcctggtgaggacccagagcgaggagagccggccccagagcctgcagcagcctgccaccagcaccacagagaccccagccagccctgcccacaccaccccccagacccagagcaccagcggcagaagaagaagagctgccaatgaagatcctgatgagaagaggaggaagttcctggagaggaacagagctgctgccagccgctgccggcagaagaggaaggtgtgggtgcagagcctggagaagaaggccgaggacctgagcagcctgaatggccagctgcagagcgaggtgaccctgctgagaaatgaggtggcccagctgaagcagctgctgctggcccacaaggactgccctgtgacagccatgcagaagaagagcggctaccacacagctgacaaggatgacagcagcgaggacatctctgtgcccagcagcccccacacagaggccatccagcacagctctgtgtccaccagcaatggagtgagcagcaccagcaaggccgaggccgtggccacctctgtgctgacccagatggctgaccagagcacagagcccgccctgagccagatcgtgatggcccccagcagccagagccagcccagcggcagctag

SEQ ID NO: 18234 - DNA, 1188 bp, Artificial Sequence; identical to SEQ ID NO: 18231
  Description of Artificial Sequence: Synthetic coding sequence

SEQ ID NO: 18235 - DNA, 1188 bp, Artificial Sequence; identical to SEQ ID NO: 18231
  Description of Artificial Sequence: Synthetic coding sequence

SEQ ID NO: 18236 - DNA, 660 bp, Artificial Sequence
  Description of Artificial Sequence: Synthetic coding sequence
atgtctgatgacaagcccttcctgtgcacagcccctggctgcggccagcgcttcaccaatgaagaccacctggccgtgcacaagcacaagcatgagatgaccctgaagtttggacctgccagaaatgacagcgtcatcgtggccgaccagacccccacccccacccgcttcctgaagaactgtgaggaggtgggcctcttcaatgagctggccagcccctttgaaaatgagttcaagaaggcctctgaagatgacatcaagaagatgcccctggacctgagccccctggccacccccatcatccgcagcaagattgaggagcccagcgtggtggagaccacccaccaggacagccccctgccccaccctgagagcaccaccagtgatgagaaggaggtgcccctggcccagacagcccagcccaccagcgccatcgtgcggcctgccagcctgcaggtgcccaacgtgctgctgaccagcagtgacagcagcgtcatcatccagcaggccgtgcccagccccaccagcagcaccgtcatcacccaggcccccagcagcaaccggcccatcgtgtcctttgaccagagcccctggtgcctggtgttccaggagagccaggtgctgcccctgcccaaccagtacagccagaagcagaagtag

SEQ ID NO: 18237 - DNA, 1134 bp, Artificial Sequence
  Description of Artificial Sequence: Synthetic coding sequence
atgtctgatgacaagcccttcctgtgcacagcccctggctgcggccagcgcttcaccaatgaagaccacctggccgtgcacaagcacaagcatgagatgaccctgaagtttggacctgccagaaatgacagcgtcatcgtggccgaccagacccccacccccacccgcttcctgaagaactgtgaggaggtgggcctcttcaatgagctggccagcccctttgaaaatgagttcaagaaggcctctgaagatgacatcaagaagatgcccctggacctgagccccctggccacccccatcatccgcagcaagattgaggagcccagcgtggtggagaccacccaccaggacagccccctgccccaccctgagagcaccaccagtgatgagaaggaggtgcccctggcccagacagcccagcccaccagcgccatcgtgcggcctgccagcctgcaggtgcccaacgtgctgctgaccagcagtgacagcagcgtcatcatccagcaggccgtgcccagccccaccagcagcaccgtcatcacccaggcccccagcagcaaccggcccatcgtgcctgtgcccggccccttccccctgctgctgcacctgcccaacggccagaccatgcctgtggccatcccagccagcatcaccagcagcaatgtgcacgtgcctgctgctgtgcccctggtgcggcctgtgaccatggtgcccagcgtgcccggcatccctggccccagcagcccccagcctgtgcagagcgaggccaagatgaggctgaaggccgccctgacccagcagcacccccctgtgaccaatggagacacagtgaagggccacggcagcggcctggtgaggacccagagcgaggagagccggccccagagcctgcagcagcctgccaccagcaccacagagaccccagccagccctgcccacaccaccccccagacccagagcaccagcggcagaagaagaagagctgccaatgaagatcctgatgagaagaggaggaagttcctggagaggaacagagctgctgccagccgctgccggcagaagaggaaggtgtgggtgcagagcctggagaagaaggccgaggacctgagcagcctgaatggccagctgcagtag

SEQ ID NO: 18238 - DNA, 1449 bp, Artificial Sequence
  Description of Artificial Sequence: Synthetic coding sequence
atgaagttcaagctgcacgtgaacagcgcccggcagtacaaggacctgtggaacatgtctgatgacaagcccttcctgtgcacagcccctggctgcggccagcgcttcaccaatgaagaccacctggccgaccagacccccacccccacccgcttcctgaagaactgtgaggaggtgggcctcttcaatgagctggccagcccctttgaaaatgagttcaagaaggcctctgaagatgacatcaagaagatgcccctggacctgagccccctggccacccccatcatccgcagcaagattgaggagcccagcgtggtggagaccacccaccaggacagccccctgccccaccctgagagcaccaccagtgatgagaaggaggtgcccctggcccagacagcccagcccaccagcgccatcgtgcggcctgccagcctgcaggtgcccaacgtgctgctgaccagcagtgacagcagcgtcatcatccagcaggccgtgcccagccccaccagcagcaccgtcatcacccaggcccccagcagcaaccggcccatcgtgcctgtgcccggccccttccccctgctgctgcacctgcccaacggccagaccatgcctgtggccatcccagccagcatcaccagcagcaatgtgcacgtgcctgctgctgtgcccctggtgcggcctgtgaccatggtgcccagcgtgcccggcatccctggccccagcagcccccagcctgtgcagagcgaggccaagatgaggctgaaggccgccctgacccagcagcacccccctgtgaccaacggggacacagtgaagggccacggcagcggcctggtgaggacccagagcgaggagagccggccccagagcctgcagcagcctgccaccagcaccacagagaccccagccagccctgcccacaccaccccccagacccagagcaccagcggcagaagaagaagagctgccaatgaagatcctgatgagaagaggaggaagttcctggagaggaacagagctgctgccagccgctgccggcagaagaggaaggtgtgggtgcagagcctggagaagaaggccgaggacctgagcagcctgaatggccagctgcagagcgaggtgaccctgctgagaaatgaggtggcccagctgaagcagctgctgctggcccacaaggactgccctgtgacagccatgcagaagaagagcggctaccacacagctgacaaggatgacagcagcgaggacatctctgtgcccagcagcccccacacagaggccatccagcacagctctgtgtccaccagcaatggagtgagcagcaccagcaaggccgaggccgtggccacctctgtgctgacccagatggctgaccagagcacagagcccgccctgagccagatcgtgatggcccccagcagccagagccagcccagcggcagctag

SEQ ID NO: 18239 - DNA, 2136 bp, Artificial Sequence
  Description of Artificial Sequence: Synthetic coding sequence
atgaagctgaagctgaatgtgctgaccatcatcctgctgcctgtgcacctgctgatcaccatctacagcgccctgatcttcatcccctggtacttcctgaccaatgccaagaagaagaatgccatggccaagaggatcaaggccaagcccaccagtgacaagccaggcagcccctacagatctgtgacccactttgacagcctggccgtgattgacatccctggagctgacaccctggacaagctgtttgaccatgctgtgtccaagtttgggaagaaggacagcctgggcacccgggagatcctgtctgaagaaaatgagatgcagcccaacgggaaggtgttcaagaagctgatcctgggcaactacaagtggatgaactacctggaggtgaacagaagagtgaacaactttggcagcggcctgacagccctgggcctgaagcccaagaacaccatcgccatcttctgtgagaccagggctgagtggatgattgctgcccagacctgcttcaagtacaacttccccctggtgaccctgtatgccaccctgggcaaggaggccgtggtgcacggcctgaatgaaagtgaggccagctacctgatcacctctgtggagctgctggagagcaagctgaagacagccctgctggacatcagctgtgtgaagcacatcatctacgtggacaacaaggccatcaacaaggccgagtacccagagggctttgagatccacagcatgcagagcgtggaggagctgggcagcaaccctgagaacctgggcatcccccccagccggcccacccccagcgacatggccatcgtgatgtacaccagcggcagcacaggccggcccaagggcgtgatgatgcaccacagcaacctgattgctggcatgacaggccagtgtgagcgcatccctggcctgggccccaaggacacctacatcggctacctgcccctggcccacgtgctggagctgacagctgagatcagctgcttcacctacggctgccgcatcggctacagcagccccctgaccctgagtgaccagagcagcaagatcaagaagggcagcaagggggactgcaccgtgctgaagcccaccctgatggctgctgtgcctgagatcatggaccgcatctacaagaatgtgatgagcaaggtgcaggagatgaactacatccagaagaccctcttcaagattggctatgactacaagctggagcagatcaagaagggctatgatgcccccctgtgcaacctgctgctcttcaagaaggtgaaggccctgctgggcggcaatgtgaggatgatgctgtctggaggagcccccctgagcccccagacccaccgcttcatgaatgtgtgcttctgctgccccatcggccagggctacggcctgacagagagctgtggggccggcaccgtgacagaggtgacagactacaccaccggccgggtgggcgcccccctcatctgctgtgagatcaagctgaaggactggcaggagggcggctacaccatcaatgacaagcccaaccccagaggagaaattgtgattggaggccagaacatctccatgggctacttcaagaatgaggagaagacagctgaggactacagcgtggatgaaaatggccagcgctggttctgcacaggagacatcggggagttccacccagatggctgcctgcagatcatcgacaggaagaaggacctggtgaagctgcaggccggggagtatgtgtccctgggcaaggtggaggccgccctgaagaactgccccctgattgacaacatctgtgcctttgccaagagtgaccagagctatgtgatcagctttgtggtgcccaaccagaagaggctgaccctgctggcccagcagaagggcgtggagggcacctgggtggacatctgcaacaacccagccatggaggccgagatcctgaaggagatccgggaggccgccaatgccatgaagctggagagatttgagatccccatcaaggtgcggctgagccctgagccctggaccccagagaccggcctggtgacagatgccttcaagctgaagaggaaggagctgaggaaccactacctgaaggacatcgagaggatgtatggaggcaagtag

SEQ ID NO: 18240 - DNA, 2013 bp, Artificial Sequence
  Description of Artificial Sequence: Synthetic coding sequence
atggccaagaggatcaaggccaagcccaccagtgacaagccaggcagcccctacagatctgtgacccactttgacagcctggccgtcatcgacatccctggagctgacaccctggacaagctgtttgaccatgctgtgtccaagtttgggaagaaggacagcctgggcacccgggagatcctgtctgaggagaatgagatgcagcccaacgggaaggtgttcaagaagctgatcctgggcaactacaagtggatgaactacctggaggtgaacagaagagtgaacaactttggaagtggcctgacagccctgggcctgaagcccaagaacaccatcgccatcttctgtgagaccagggctgagtggatgattgctgcccagacctgcttcaagtacaacttccccctggtgaccctgtatgccaccctgggcaaggaggccgtggtgcacggcctgaatgaaagtgaggccagctacctgatcacctctgtggagctgctggagagcaagctgaagacagccctgctggacatcagctgtgtgaagcacatcatctacgtggacaacaaggccatcaacaaggccgagtacccagagggctttgagatccacagcatgcagagcgtggaggagctgggcagcaaccctgagaacctgggcatcccccccagccggcccacccccagcgacatggccatcgtgatgtacaccagcggcagcacaggccggcccaagggcgtgatgatgcaccacagcaacctgattgctggcatgacaggccagtgtgagcgcatccctggcctgggccccaaggacacctacatcggctacctgcccctggcccacgtgctggagctgacagctgagatcagctgcttcacctacggctgcagaattggctacagcagccccctgaccctgagtgaccagagcagcaagatcaagaagggcagcaaaggagactgcaccgtgctgaagcccaccctgatggctgctgtgcctgagatcatggaccgcatctacaagaatgtgatgagcaaggtgcaggagatgaactacatccagaagaccctcttcaagattggctatgactacaagctggagcagatcaagaagggctatgatgcccccctgtgcaacctgctgctcttcaagaaggtgaaggccctgctgggcggcaatgtgaggatgatgctgagcggcggggcccccctgagcccccagacccaccgcttcatgaatgtgtgcttctgctgccccatcggccagggctacggcctgacagagagctgtggggccggcaccgtgacagaggtgacagactacaccaccggccgggtgggcgcccccctcatctgctgtgagatcaagctgaaggactggcaggagggcggctacaccatcaatgacaagcccaaccccagaggagagatcgtcatcggcggccagaacatctccatgggctacttcaagaatgaggagaagacagctgaggactacagcgtggatgaaaatggccagcgctggttctgcaccggggacattggagagttccacccagatggctgcctgcagatcatcgacaggaagaaggacctggtgaagctgcaggccggggagtatgtgtccctgggcaaggtggaggccgccctgaagaactgccccctgattgacaacatctgtgcctttgccaagagtgaccagagctatgtgatcagctttgtggtgcccaaccagaagaggctgaccctgctggcccagcagaagggcgtggagggcacctgggtggacatctgcaacaacccagccatggaggccgagatcctgaaggagatccgggaggccgccaatgccatgaagctggagagatttgagatccccatcaaggtgcggctgagccctgagccctggaccccagagaccggcctggtgacagatgccttcaagctgaagaggaaggagctgaggaaccactacctgaaggacattgaaagaatgtatggaggcaagtag

SEQ ID NO: 18241 - DNA, 2136 bp, Artificial Sequence; identical to SEQ ID NO: 18239
  Description of Artificial Sequence: Synthetic coding sequence

SEQ ID NO: 18242 - DNA, 165 bp, Artificial Sequence
  Description of Artificial Sequence: Synthetic coding sequence
atgaagctgaagctgaatgtgctgaccatcatcctgctgcctgtgcacctgctgatcaccatctacagcgccctgatcttcatcccctggtacttcctgaccaatgccaagaagaagaatgccatggccaagaggatcaaggccaagcccaccagtgacaagtag

SEQ ID NO: 18243 - DNA, 438 bp, Artificial Sequence
  Description of Artificial Sequence: Synthetic coding sequence
atgaagctgaagctgaatgtgctgaccatcatcctgctgcctgtgcacctgctgatcaccatctacagcgccctgatcttcatcccctggtacttcctgaccaatgccaagaagaagaatgccatggccaagaggatcaaggccaagcccaccagtgacaagccaggcagcccctacagatctgtgacccactttgacagcctggccgtgattgacatccctggagctgacaccctggacaagctgtttgaccatgctgtgtccaagtttgggaagaaggacagcctgggcacccgggagatcctgtctgaagaaaatgagatgcagcccaacgggaaggtgttcaagaagctgatcctgggcaactacaagtggatgaactacctggaggtgaacagaagagtgaacaactttggcagcggcctgacagccctgtag

SEQ ID NO: 18244 - DNA, 381 bp, Artificial Sequence
  Description of Artificial Sequence: Synthetic coding sequence
atgaagctgaagctgaatgtgctgaccatcatcctgctgcctgtgcacctgctgatcaccatctacagcgccctgatcttcatcccctggtacttcctgaccaatgccaagaagaagaatgccatggccaagaggatcaaggccaagcccaccagtgacaagccaggcagcccctacagatctgtgacccactttgacagcctggccgtgattgacatccctggagctgacaccctggacaagctgtttgaccatgctgtgtccaagtttgggaagaaggacagcctgggcacccgggagatcctgtctgaagaaaatgagatgcagcccaacgggaaggtgttcaagaagctgatcctgggcaactacaagtggatgtag

SEQ ID NO: 18245 - DNA, 465 bp, Artificial Sequence
  Description of Artificial Sequence: Synthetic coding sequence
atggccaagaggatcaaggccaagcccaccagtgacaagccaggcagcccctacagatctgtgacccactttgacagcctggccgtcatcgacatccctggagctgacaccctggacaagctgtttgaccatgctgtgtccaagtttgggaagaaggacagcctgggcacccgggagatcctgtctgaggagaatgagatgcagcccaacgggaaggtgttcaagaagctgatcctgggcaactacaagtggatgaactacctggaggtgaacagaagagtgaacaactttggaagtggcctgacagccctgggcctgaagcccaagaacaccatcgccatcttctgtgagaccagggctgagtggatgattgctgcccagacctgcttcaagtacaacttccccctggtgaccctgtatgccaccctgggcaaggaggccgtggtgcacggcctgaatgaatag

SEQ ID NO: 18246 - DNA, 387 bp, Artificial Sequence
  Description of Artificial Sequence: Synthetic coding sequence
atgaagctgaagctgaatgtgctgaccatcatcctgctgcctgtgcacctgctgatcaccatctacagcgccctgatcttcatcccctggtacttcctgaccaatgccaagaagaagaatgccatggccaagaggatcaaggccaagcccaccagtgacaagccaggcagcccctacagatctgtgacccactttgacagcctggccgtgattgacatccctggagctgacaccctggacaagctgtttgaccatgctgtgtccaagtttgggaagaaggacagcctgggcacccgggagatcctgtctgaagaaaatgagatgcagcccaacgggaaggtgttcaagaagctgatcctgggcaactacaagtggatgaactactag

SEQ ID NO: 18247 - DNA, 2475 bp, Artificial Sequence
  Description of Artificial Sequence: Synthetic coding sequence
atgaggcagagcctgctcttcctgacctctgtggtgccctttgtgctggccccccggcccccagatgaccccggcttcggcccccaccagaggctggagaagctggacagcctgctgagtgactatgacatcctgagcctgagcaacatccagcagcacagcgtgaggaagagggacctgcagaccagcacccacgtggagaccctgctgaccttcagcgccctgaagaggcacttcaagctgtacctgaccagcagcacagagcgcttcagccagaacttcaaggtggtggtggtggatggcaagaatgaaagtgagtacacagtgaagtggcaggacttcttcaccggccacgtggtgggggagccagacagccgggtgctggcccacatcagagatgatgatgtgatcatccgcatcaacacagatggagctgagtacaacatcgagcccctgtggaggtttgtgaatgacaccaaggacaagaggatgctggtgtacaagtctgaggacatcaagaatgtgtcccggctgcagagccccaaggtgtgtggctacctgaaggtggacaatgaggagctgctgcccaagggcctggtggaccgggagcccccagaggagctggtgcaccgggtgaagagaagagctgaccctgaccccatgaagaacacctgcaagctgctggtggtggccgaccaccgcttctaccgctacatgggccgcggggaggagagcaccaccaccaactacctgattgagctgattgacagagtggatgacatctacagaaacacctcctgggacaatgccggcttcaagggctacggcatccagatcgagcagatccgcatcctgaagagcccccaggaggtgaagccaggagagaagcactacaacatggccaagagctacccaaatgaggagaaggatgcctgggatgtgaagatgctgctggagcagttctcctttgatattgctgaggaggccagcaaggtgtgcctggcccacctgttcacctaccaggactttgacatgggcaccctgggcctggcctacgtgggcagcccccgggccaacagccatggaggagtgtgccccaaggcctactacagccctgtgggcaagaagaacatctacctgaacagcggcctgaccagcaccaagaactacggcaagaccatcctgaccaaggaggccgacctggtgaccacccatgagctgggccacaactttggagctgagcatgaccctgatggcctggccgagtgtgccccaaatgaagaccagggcggcaagtatgtgatgtaccccatcgctgtgtctggggaccacgagaacaacaagatgttcagcaactgcagcaagcagagcatctacaagaccatcgagagcaaggcccaggagtgcttccaggagaggagcaacaaggtgtgtggcaacagccgggtggatgaaggagaggagtgtgaccccggcatcatgtacctgaacaatgacacctgctgcaacagcgactgcaccctgaaggagggcgtgcagtgcagcgacaggaacagcccctgctgcaagaactgccagtttgaaacagcccagaagaagtgccaggaggccatcaatgccacctgcaagggcgtgtcctactgcaccggcaacagcagcgagtgccccccacctggaaatgcagaagatgacacagtgtgcctggacctgggcaagtgcaaggatggcaagtgcatccccttctgtgagcgggagcagcagctggagagctgtgcctgcaatgaaacagacaacagctgcaaggtgtgctgccgggacctgagcggccgctgtgtgccctacgtggatgctgagcagaagaacctcttcctgaggaagggcaagccctgcaccgtgggcttctgtgacatgaatggaaaatgtgagaagagggtgcaggatgtgattgagcgcttctgggacttcatcgaccagctgagcatcaacaccttcggcaagttcctggccgacaacatcgtgggctctgtgctggtgttcagcctcatcttctggatccccttcagcatcctggtgcactgtgtggacaagaagctggacaagcagtatgagagcctgagcctcttccaccccagcaatgtggagatgctgagctccatggattctgcctctgtgcgcatcatcaagcccttccctgccccccagaccccaggccgcctgcagcctgcccctgtgatccccagcgccccagctgcccccaagctggaccaccagaggatggacaccatccaggaggaccccagcacagacagccacatggatgaagatggctttgagaaggaccccttccccaacagcagcacagctgccaagagctttgaggacctgacagaccaccctgtgaccaggtctgagaaggccgccagcttcaagctgcagaggcagaacagagtggacagcaaggagacagaatgttag

SEQ ID NO: 18248 - DNA, 777 bp, Artificial Sequence
  Description of Artificial Sequence: Synthetic coding sequence
atgaggcagagcctgctcttcctgacctctgtggtgccctttgtgctggccccccggcccccagatgaccccggcttcggcccccaccagaggctggagaagctggacagcctgctgagtgactatgacatcctgagcctgagcaacatccagcagcacagcgtgaggaagagggacctgcagaccagcacccacgtggagaccctgctgaccttcagcgccctgaagaggcacttcaagctgtacctgaccagcagcacagagcgcttcagccagaacttcaaggtggtggtggtggatggcaagaatgaaagtgagtacacagtgaagtggcaggacttcttcaccggccacgtggtgggggagccagacagccgggtgctggcccacatcagagatgatgatgtgatcatccgcatcaacacagatggagctgagtacaacatcgagcccctgtggaggtttgtgaatgacaccaaggacaagaggatgctggtgtacaagtctgaggacatcaagaatgtgtcccggctgcagagccccaaggtgtgtggctacctgaaggtggacaatgaggagctgctgcccaagggcctggtggaccgggagcccccagaggagctggtgcaccgggtgaagagaagagctgaccctgaccccatgaagaacacctgcaagctgctggtggtggccgaccaccgcttctaccgctacatgggccgcggggaggagagcaccaccaccaactacctgatccacacagaccgggccaactag

SEQ ID NO: 18249 - DNA, 2499 bp, Artificial Sequence
  Description of Artificial Sequence: Synthetic coding sequence
atgaagcccccaggcagcagcagccggcagccccccctggccggctgcagcctggccggggccagctgtggcccccagaggggccctgctggctctgtgcctgccagcgccccagcccggaccccaccctgccgcctgctgctggtgctgctgctgctgccccccctggccgccagcagccggccccgggcctggggcgccgccgcccccagcgccccccactggaatgaaacagctgagaagaacctgggcgtgctggctgatgaggacaacaccctgcagcagaacagcagcagcaacatctcctacagcaatgccatgcagaaggagatcaccctgcccagccgcctcatctactacatcaaccaggacagcgagagcccctaccacgtgctggacaccaaggcccggcaccagcagaagcacaacaaggctgtgcacctggcccaggccagcttccagatcgaggccttcggcagcaagttcatcctggacctgatcctgaacaacggcctgctgagcagtgactatgtggagatccactatgaaaatggcaagccccagtacagcaaaggaggagagcactgctactaccacggcagcatccggggcgtgaaggacagcaaggtggccctgagcacctgcaatggcctgcacggcatgtttgaagatgacacctttgtgtacatgattgagcccctggagctggtgcatgatgagaagagcacaggccggccccacatcatccagaagaccctggccggccagtacagcaagcagatgaagaacctgaccatggagcggggggaccagtggcccttcctgtctgagctgcagtggctgaagaggaggaagagagctgtgaaccccagccggggcatctttgaggagatgaagtacctggagctgatgattgtgaatgaccacaagacctacaagaagcacaggagcagccacgcccacaccaacaactttgccaagtctgtggtgaacctggtggacagcatctacaaggagcagctgaacaccagggtggtgctggtggccgtggagacctggacagagaaggaccagattgacatcaccaccaaccctgtgcagatgctgcacgagttcagcaagtaccggcagaggatcaagcagcacgcagatgctgtgcacctgatcagccgggtgaccttccactacaagaggagcagcctgagctactttggaggagtgtgcagcaggacccggggcgtgggcgtgaatgaatatggcctgcccatggctgtggcccaggtgctgagccagagcctggcccagaacctgggcatccagtgggagcccagcagcaggaagcccaagtgtgactgcacagagagctggggcggctgcatcatggaggagaccggggtgagccacagcaggaagttcagcaagtgcagcatcctggagtacagagacttcctgcagagaggaggaggagcctgcctcttcaaccggcccaccaagctgtttgagcccacagaatgtggaaatggctacgtggaggccggggaggagtgtgactgtggcttccacgtggagtgctacggcctgtgctgcaagaagtgcagcctgagcaatggagcccactgcagtgatggcccctgctgcaacaacaccagctgcctcttccagccccggggctatgaatgtagagatgctgtgaatgaatgtgacatcacagagtactgcaccggggacagcggccagtgcccccccaacctgcacaagcaggacggctacgcctgcaaccagaaccagggccgctgctacaatggagagtgcaagacccgggacaaccagtgccagtacatctggggcaccaaggccgccggcagtgacaagttctgctatgagaagctgaacacagagggcacagagaagggcaactgtgggaaggatggagaccgctggatccagtgcagcaagcatgatgtgttctgtggcttcctgctgtgcaccaacctgacccgggcccccagaattggccagctgcagggcgagatcatccccaccagcttctaccaccagggccgggtcatcgactgcagcggggcccacgtggtgctggatgatgacacagatgtgggctacgtggaggatggcaccccctgtggccccagcatgatgtgcctggacaggaagtgcctgcagatccaggccctgaacatgagcagctgccccctggacagcaagggcaaggtgtgcagcggccacggcgtgtgcagcaatgaggccacctgcatctgtgacttcacctgggccggcacagactgcagcatccgggaccctgtgaggaacctgcacccccccaaggatgagggccccaagggccccagcgccaccaacctgatcatcggcagcattgctggggccatcctggtggccgccatcgtgctgggcggcaccggctggggcttcaagaatgtgaagaagagaagatttgaccccacccagcagggccccatctag

SEQ ID NO: 18250 - DNA, 2499 bp, Artificial Sequence
  Description of Artificial Sequence: Synthetic coding sequence
atgaagcccccaggcagcagcagccggcagccccccctggccggctgcagcctggccggggccagctgtggcccccagaggggccctgctggctctgtgcctgccagcgccccagcccggaccccaccctgccgcctgctgctggtgctgctgctgctgccccccctggccgccagcagccggccccgggcctggggcgccgccgcccccagcgccccccactggaatgaaacagctgagaagaacctgggcgtgctggctgatgaggacaacaccctgcagcagaacagcagcagcaacatctcctacagcaatgccatgcagaaggagatcaccctgcccagccgcctcatctactacatcaaccaggacagcgagagcccctaccacgtgctggacaccaaggcccggcaccagcagaagcacaacaaggctgtgcacctggcccaggccagcttccagatcgaggccttcggcagcaagttcatcctggacctgatcctgaacaacggcctgctgagcagtgactatgtggagatccactatgaaaatggcaagccccagtacagcaaaggaggagagcactgctactaccacggcagcatccggggcgtgaaggacagcaaggtggccctgagcacctgcaatggcctgcacggcatgtttgaagatgacacctttgtgtacatgattgagcccctggagctggtgcatgatgagaagagcacaggccggccccacatcatccagaagaccctggccggccagtacagcaagcagatgaagaacctgaccatggagcggggggaccagtggcccttcctgtctgagctgcagtggctgaagaggaggaagagagctgtgaaccccagccggggcatctttgaggagatgaagtacctggagctgatgattgtgaatgaccacaagacctacaagaagcacaggagcagccacgcccacaccaacaactttgccaagtctgtggtgaacctggtggacagcatctacaaggagcagctgaacaccagggtggtgctggtggccgtggagacctggacagagaaggaccagattgacatcaccaccaaccctgtgcagatgctgcacgagttcagcaagtaccggcagaggatcaagcagcacgcagatgctgtgcacctgatcagccgggtgaccttccactacaagaggagcagcctgagctactttggaggagtgtgcagcaggacccggggcgtgggcgtgaatgaatatggcctgcccatggctgtggcccaggtgctgagccagagcctggcccagaacctgggcatccagtgggagcccagcagcaggaagcccaagtgtgactgcacagagagctggggcggctgcatcatggaggagaccggggtgagccacagcaggaagttcagcaagtgcagcatcctggagtacagagacttcctgcagagaggaggaggagcctgcctcttcaaccggcccaccaagctgtttgagcccacagaatgtggaaatggctacgtggaggccggggaggagtgtgactgtggcttccacgtggagtgctacggcctgtgctgcaagaagtgcagcctgagcaatggagcccactgcagtgatggcccctgctgcaacaacaccagctgcctcttccagccccggggctatgaatgtagagatgctgtgaatgaatgtgacatcacagagtactgcaccggggacagcggccagtgcccccccaacctgcacaagcaggacggctacgcctgcaaccagaaccagggccgctgctacaatggagagtgcaagacccgggacaaccagtgccagtacatctggggcaccaaggccgccggcagtgacaagttctgctatgagaagctgaacacagagggcacagagaagggcaactgtgggaaggatggagaccgctggatccagtgcagcaagcatgatgtgttctgtggcttcctgctgtgcaccaacctgacccgggcccccagaattggccagctgcagggcgagatcatccccaccagcttctaccaccagggccgggtcatcgactgcagcggggcccacgtggtgctggatgatgacacagatgtgggctacgtggaggatggcaccccctgtggccccagcatgatgtgcctggacaggaagtgcctgcagatccaggccctgaacatgagcagctgccccctggacagcaagggcaaggtgtgcagcggccacggcgtgtgcagcaatgaggccacctgcatctgtgacttcacctgggccggcacagactgcagcatccgggaccctgtgaggaacctgcacccccccaaggatgagggccccaaggtgaacatggccaccagccggctgattggagctgtggccggcaccatcctggccctgggcgtcatctttggaggcaccggctggggcattgaaaatgtgaagaagagaagatttgaccccacccagcagggccccatctag

SEQ ID NO: 18251 - DNA, 2499 bp, Artificial Sequence
  Description of Artificial Sequence: Synthetic coding sequence
atgaagcccccaggcagcagcagccggcagccccccctggccggctgcagcctggccggggccagctgtggcccccagaggggccctgctggctctgtgcctgccagcgccccagcccggaccccaccctgccgcctgctgctggtgctgctgctgctgccccccctggccgccagcagccggccccgggcctggggcgccgccgcccccagcgccccccactggaatgaaacagctgagaagaacctgggcgtgctggctgatgaggacaacaccctgcagcagaacagcagcagcaacatctcctacagcaatgccatgcagaaggagatcaccctgcccagccgcctcatctactacatcaaccaggacagcgagagcccctaccacgtgctggacaccaaggcccggcaccagcagaagcacaacaaggctgtgcacctggcccaggccagcttccagatcgaggccttcggcagcaagttcatcctggacctgatcctgaacaacggcctgctgagcagtgactatgtggagatccactatgaaaatggcaagccccagtacagcaaaggaggagagcactgctactaccacggcagcatccggggcgtgaaggacagcaaggtggccctgagcacctgcaatggcctgcacggcatgtttgaagatgacacctttgtgtacatgattgagcccctggagctggtgcatgatgagaagagcacaggccggccccacatcatccagaagaccctggccggccagtacagcaagcagatgaagaacctgaccatggagcggggggaccagtggcccttcctgtctgagctgcagtggctgaagaggaggaagagagctgtgaaccccagccggggcatctttgaggagatgaagtacctggagctgatgattgtgaatgaccacaagacctacaagaagcacaggagcagccacgcccacaccaacaactttgccaagtctgtggtgaacctggtggacagcatctacaaggagcagctgaacaccagggtggtgctggtggccgtggagacctggacagagaaggaccagattgacatcaccaccaaccctgtgcagatgctgcacgagttcagcaagtaccggcagaggatcaagcagcacgcagatgctgtgcacctgatcagccgggtgaccttccactacaagaggagcagcctgagctactttggaggagtgtgcagcaggacccggggcgtgggcgtgaatgaatatggcctgcccatggctgtggcccaggtgctgagccagagcctggcccagaacctgggcatccagtgggagcccagcagcaggaagcccaagtgtgactgcacagagagctggggcggctgcatcatggaggagaccggggtgagccacagcaggaagttcagcaagtgcagcatcctggagtacagagacttcctgcagagaggaggaggagcctgcctcttcaaccggcccaccaagctgtttgagcccacagaatgtggaaatggctacgtggaggccggggaggagtgtgactgtggcttccacgtggagtgctacggcctgtgctgcaagaagtgcagcctgagcaatggagcccactgcagtgatggcccctgctgcaacaacaccagctgcctcttccagccccggggctatgaatgtagagatgctgtgaatgaatgtgacatcacagagtactgcaccggggacagcggccagtgcccccccaacctgcacaagcaggacggctacgcctgcaaccagaaccagggccgctgctacaatggagagtgcaagacccgggacaaccagtgccagtacatctggggcaccaaggccgccggcagtgacaagttctgctatgagaagctgaacacagagggcacagagaagggcaactgtgggaaggatggagaccgctggatccagtgcagcaagcatgatgtgttctgtggcttcctgctgtgcaccaacctgacccgggcccccagaattggccagctgcagggcgagatcatccccaccagcttctaccaccagggccgggtcatcgactgcagcggggcccacgtggtgctggatgatgacacagatgtgggctacgtggaggatggcaccccctgtggccccagcatgatgtgcctggacaggaagtgcctgcagatccaggccctgaacatgagcagctgccccctggacagcaagggcaaggtgtgcagcggccacggcgtgtgcagcaatgaggccacctgcatctgtgacttcacctgggccggcacagactgcagcatccgggaccctgtgaggaacctgcacccccccaaggatgagggccccaaggagatgagccggcgggagggcagcatcctgctgagcaaggcccccagcgagagcgctgccctggatggccaccggctggccctgctggacagcggctatgacatcctggccgctgtgctgctggagctgctgagcctgtag

SEQ ID NO: 18252 - DNA, 2100 bp, Artificial Sequence
  Description of Artificial Sequence: Synthetic coding sequence
atgcagaaggagatcaccctgcccagccgcctcatctactacatcaaccaggacagcgagagcccctaccacgtgctggacaccaaggcccggcaccagcagaagcacaacaaggctgtgcacctggcccaggccagcttccagatcgaggccttcggcagcaagttcatcctggacctgatcctgaacaacggcctgctgagcagtgactatgtggagatccactatgaaaatggcaagccccagtacagcaaaggaggagagcactgctactaccacggcagcatccggggcgtgaaggacagcaaggtggccctgagcacctgcaatggcctgcacggcatgtttgaagatgacacctttgtgtacatgattgagcccctggagctggtgcatgatgagaagagcacaggccggccccacatcatccagaagaccctggccggccagtacagcaagcagatgaagaacctgaccatggagcggggggaccagtggcccttcctgtctgagctgcagtggctgaagaggaggaagagagctgtgaaccccagccggggcatctttgaggagatgaagtacctggagctgatgattgtgaatgaccacaagacctacaagaagcacaggagcagccacgcccacaccaacaactttgccaagtctgtggtgaacctggtggacagcatctacaaggagcagctgaacaccagggtggtgctggtggccgtggagacctggacagagaaggaccagattgacatcaccaccaaccctgtgcagatgctgcacgagttcagcaagtaccggcagaggatcaagcagcacgcagatgctgtgcacctgatcagccgggtgaccttccactacaagaggagcagcctgagctactttggaggagtgtgcagcaggacccggggcgtgggcgtgaatgaatatggcctgcccatggctgtggcccaggtgctgagccagagcctggcccagaacctgggcatccagtgggagcccagcagcaggaagcccaagtgtgactgcacagagagctggggcggctgcatcatggaggagaccggggtgagccacagcaggaagttcagcaagtgcagcatcctggagtacagagacttcctgcagagaggaggaggagcctgcctcttcaaccggcccaccaagctgtttgagcccacagaatgtggaaatggctacgtggaggccggggaggagtgtgactgtggcttccacgtggagtgctacggcctgtgctgcaagaagtgcagcctgagcaatggagcccactgcagtgatggcccctgctgcaacaacaccagctgcctcttccagccccggggctatgaatgtagagatgctgtgaatgaatgtgacatcacagagtactgcaccggggacagcggccagtgcccccccaacctgcacaagcaggacggctacgcctgcaaccagaaccagggccgctgctacaatggagagtgcaagacccgggacaaccagtgccagtacatctggggcaccaaggccgccggcagtgacaagttctgctatgagaagctgaacacagagggcacagagaagggcaactgtgggaaggatggagaccgctggatccagtgcagcaagcatgatgtgttctgtggcttcctgctgtgcaccaacctgacccgggcccccagaattggccagctgcagggcgagatcatccccaccagcttctaccaccagggccgggtcatcgactgcagcggggcccacgtggtgctggatgatgacacagatgtgggctacgtggaggatggcaccccctgtggccccagcatgatgtgcctggacaggaagtgcctgcagatccaggccctgaacatgagcagctgccccctggacagcaaggatgagggccccaaggcctgcttcctgaagaggaccaagtgcaagagctaccccaagcacaggaagtgccaggaggagaaggtgcgcagctacagcgcccggccccacctgaaccagctgcgctggatggacacagccctgcactgctggatcctgggcatgacctacagccagcagtgctactggaactactag

SEQ ID NO: 18253 - DNA, 324 bp, Artificial Sequence
  Description of Artificial Sequence: Synthetic coding sequence
tgacagatccaggccctgaacatgagcagctgccccctggacagcaagggcaaggtgtgcagcggccatggagtgtgcagcaatgaggccacctgcatctgtgacttcacctgggccggcacagactgcagcatccgggaccctgtgaggaacctgcacccccccaaggatgagggccccaaggagatgagcagaagagagggcagcatcctgctgagcaaggcccccagcgagagcgctgccctggatggccaccggctggccctgctggacagcggctatgacatcctggccgctgtgctgctggagctgctgagcctgtag

SEQ ID NO: 18254 - DNA, 8532 bp, Artificial Sequence
  Description of Artificial Sequence: Synthetic coding sequence
atggctgctgccagctatgaccagctgctgaagcaggtggaggccctgaagatggagaacagcaacctgcggcaggagctggaggacaacagcaaccacctgaccaagctggagacagaggccagcaacatgaaggaggtgctgaagcagctgcagggcagcattgaagatgaggccatggccagcagcggccagattgacctgctggagcggctgaaggagctgaacctggacagcagcaacttccctggggtgaagctgcggagcaagatgagcctgcggagctatggcagccgggagggctctgtgagcagccgctctggagaatgttctcctgtgcccatgggcagcttcccccggcggggctttgtgaatggcagccgggagagcacaggctacctggaggagctggagaaggagaggagcctgctgctggccgacctggacaaggaggagaaggagaaggactggtactatgcccagctgcagaacctgaccaagagaattgacagcctgcccctgacagagaacttcagcctgcagacagacatgacccggcggcagctggagtatgaggcccggcagatccgggtggccatggaggagcagctgggcacctgccaggacatggagaagagggcccagaggcgcatcgcccgcatccagcagatcgagaaggacatcctgcgcatccggcagctgctgcagagccaggccacagaggccgagaggagcagccagaacaagcatgagaccggcagccatgatgctgagcggcagaatgaaggccagggcgtgggggagatcaacatggccaccagcggaaatggccagggcagcaccaccaggatggaccacgagacagcctctgtgctgagcagcagcagcacccacagcgccccccggcggctgaccagccacctgggcaccaaggtggagatggtgtacagcctgctgtccatgctgggcacccatgacaaggatgacatgagcaggaccctgctggccatgagcagcagccaggacagctgcatctccatgaggcagagcggctgcctgcccctgctgatccagctgctgcatggaaatgacaaggacagcgtgctgctgggcaacagccggggcagcaaggaggcccgggcccgggccagcgctgccctgcacaacatcatccacagccagccagatgacaagagaggaagaagagagatccgggtgctgcacctgctggagcagatccgggcctactgtgagacctgctgggagtggcaggaggcccacgagcccggcatggaccaggacaagaaccccatgcctgcccctgtggagcaccagatctgcccagctgtgtgtgtgctgatgaagctgagctttgatgaggagcacagacatgccatgaatgagctgggcggcctgcaggccatcgccgagctgctgcaggtggactgtgagatgtatggcctgaccaatgaccactacagcatcaccctgcggcgctatgccggcatggccctgaccaacctgacctttggagatgtggccaacaaggccaccctgtgcagcatgaagggctgcatgagggccctggtggcccagctgaagtctgagagcgaggacctgcagcaggtgattgcctctgtgctgaggaacctgtcctggagggcagatgtgaacagcaagaagaccctgcgggaggtgggctctgtgaaggccctgatggagtgtgccctggaggtgaagaaggagagcaccctgaagtctgtgctgagcgccctgtggaacctgagcgcccactgcacagagaacaaggctgacatctgtgctgtggatggagccctggccttcctggtgggcaccctgacctaccgcagccagaccaacaccctggccatcatcgagagcggcggcggcatcctgagaaatgtgagcagcctcatcgccaccaatgaagaccaccggcagatcctgcgggagaacaactgcctgcagaccctgctgcagcacctgaagagccacagcctgaccatcgtgtccaatgcctgtggcaccctgtggaacctgagcgccaggaaccccaaggaccaggaggccctgtgggacatgggcgctgtgtccatgctgaagaacctgatccacagcaagcacaagatgattgccatgggcagcgctgctgccctgaggaacctgatggccaacagacctgccaagtacaaggatgccaacatcatgagccctggcagcagcctgcccagcctgcacgtgaggaagcagaaggccctggaggccgagctggatgcccagcacctgtctgagacctttgacaacatcgacaacctgagccccaaggccagccacaggagcaagcagaggcacaagcagagcctgtatggagactatgtgtttgacaccaacagacatgatgacaacagaagtgacaacttcaacacaggcaacatgacagtgctgagcccctacctgaacaccaccgtgctgcccagcagcagcagcagccggggcagcctggacagcagccgctctgagaaggacaggagcctggagcgggagcggggcatcggcctgggcaactaccacccagccacagagaaccctggcaccagcagcaagaggggcctgcagatcagcaccacagctgcccagatcgccaaggtgatggaggaggtgtctgccatccacaccagccaggaggacaggagcagcggcagcaccacagagctgcactgtgtgacagatgaaagaaatgccctgcggcgcagcagcgctgcccacacccacagcaacacctacaacttcaccaagtctgagaacagcaacagaacctgcagcatgccctatgccaagctggagtacaagaggagcagcaatgacagcctgaacagcgtgagcagcagtgatggctacggcaagaggggccagatgaagcccagcattgagagctacagtgaagatgatgagagcaagttctgcagctatggccagtacccagctgacctggcccacaagatccacagcgccaaccacatggatgacaatgatggagagctggacacccccatcaactacagcctgaagtacagtgatgagcagctgaacagcggccggcagagccccagccagaatgaacgctgggcccggcccaagcacatcattgaagatgagatcaagcagagcgagcagaggcagagcaggaaccagagcaccacctaccctgtgtacacagagagcacagatgacaagcacctgaagttccagccccacttcggccagcaggagtgtgtgagcccctaccgcagcagaggagccaacggcagcgagaccaacagagtgggcagcaaccacggcatcaaccagaatgtgtcccagagcctgtgccaggaggatgattatgaagatgacaagcccaccaactacagcgagcgctacagcgaggaggagcagcacgaggaggaggagcggcccaccaactacagcatcaagtacaatgaggagaagagacatgtggaccagcccatcgactacagcctgaagtatgccacagacatccccagcagccagaagcagagcttctccttcagcaagagcagcagcggccagagcagcaagacagagcacatgagcagcagcagcgagaacaccagcacccccagcagcaatgccaagaggcagaaccagctgcaccccagcagcgcccagagccgcagcggccagccccagaaggccgccacctgcaaggtgagcagcatcaaccaggagaccatccagacctactgtgtggaggacacccccatctgcttcagccgctgcagcagcctgagcagcctgagcagcgcagaagatgaaattggctgcaaccagaccacccaggaggccgacagcgccaacaccctgcagattgctgagatcaaggagaagattggcaccaggtctgcagaagatcctgtgtctgaggtgcctgctgtgtcccagcaccccaggaccaagagcagccggctgcagggcagcagcctgagcagcgagagcgcccggcacaaggctgtggagttcagcagcggggccaagagccccagcaagagcggggcccagacccccaagagccccccagagcactacgtgcaggagacccccctgatgttcagccgctgcacctctgtgagcagcctggacagctttgagagccgcagcatcgccagctctgtgcagagcgagccctgcagcggcatggtgtctggcatcatcagccccagcgacctgcctgacagccctggccagaccatgccacccagccgcagcaagaccccacctcctccaccccagacagcccagaccaagcgggaggtgcccaagaacaaggcccccacagctgagaagcgggagagcggccccaagcaggccgctgtgaatgctgctgtgcagagggtgcaggtgctgcctgatgctgacaccctgctgcactttgccacagagagcaccccagatggcttcagctgcagcagcagcctgagcgccctgagcctggatgagcccttcatccagaaggatgtggagctgcgcatcatgcctcctgtgcaggagaatgacaatggaaatgaaacagaaagtgagcagcccaaggagagcaatgaaaaccaggagaaggaggccgagaagaccattgattctgagaaggacctgctggatgacagtgatgatgatgacatcgagatcctggaggagtgcatcatcagcgccatgcccaccaagagcagcaggaaggccaagaagccagcccagacagccagcaagctgcccccacctgtggccaggaagcccagccagctgcctgtgtacaagctgctgcccagccagaaccggctgcagccccagaagcacgtgtccttcaccccaggagatgacatgccccgggtgtactgtgtggagggcacccccatcaacttcagcacagccaccagcctgagtgacctgaccatcgagagccccccaaatgagctggccgccggggagggcgtgcggggcggggcccagagcggggagtttgagaagagggacaccatccccacagagggccgcagcacagatgaggcccagggcggcaagaccagctctgtgaccatccctgagctggatgacaacaaggccgaggagggggacatcctggccgagtgcatcaacagcgccatgcccaagggcaagagccacaagcccttccgggtgaagaagatcatggaccaggtgcagcaggccagcgccagcagcagcgcccccaacaagaaccagctggatggcaagaagaagaagcccaccagccctgtgaagcccatcccccagaacacagagtaccgcaccagggtgaggaagaatgctgacagcaagaacaacctgaatgctgagagggtcttcagtgacaacaaggacagcaagaagcagaacctgaagaacaacagcaaggtgttcaatgacaagctgcccaacaatgaagatagagtgcggggcagctttgcctttgacagcccccaccactacacccccatcgagggcaccccctactgcttcagcagaaatgacagcctgagcagcctggactttgatgatgatgatgtggacctgagccgggagaaggccgagctgaggaaggccaaggagaacaaggagagcgaggccaaggtgaccagccacacagagctgaccagcaaccagcagagcgccaacaagacccaggccatcgccaagcagcccatcaacagaggccagcccaagcccatcctgcagaagcagagcaccttcccccagagcagcaaggacatcccagacagaggagctgccacagatgagaagctgcagaactttgccatcgagaacacccctgtgtgcttcagccacaacagcagcctgagcagcctgagtgacatcgaccaggagaacaacaacaaggaaaatgagcccatcaaggagacagagcccccagacagccagggcgagcccagcaagccccaggccagcggctacgcccccaagagcttccacgtggaggacacccctgtgtgcttcagcaggaacagcagcctgagcagcctgagcattgacagtgaagatgacctgctgcaggagtgcatcagcagcgccatgcccaagaagaagaagcccagccggctgaagggggacaatgagaagcacagccccaggaacatgggcggcatcctgggggaggacctgaccctggacctgaaggacatccagaggccagacagcgagcacggcctgagcccagacagtgaaaattttgactggaaggccatccaggagggcgccaacagcatcgtgagcagcctgcaccaggccgctgctgctgcctgcctgagccggcaggccagcagtgacagcgacagcatcctgagcctgaagagcggcatcagcctgggcagccccttccacctgaccccagaccaggaggagaagcccttcaccagcaacaagggcccccgcatcctgaagccaggagagaagagcaccctggagaccaagaagattgaaagtgagagcaagggcatcaagggcggcaagaaggtgtacaagagcctcatcaccgggaaggtgcgcagcaacagcgagatcagcggccagatgaagcagcccctgcaggccaacatgcccagcatcagccggggccgcaccatgatccacatccctggggtgaggaacagcagcagcagcaccagccctgtgtccaagaagggcccccccctgaagaccccagccagcaagagccccagcgagggccagacagccaccaccagccccaggggggccaagcccagcgtgaagtctgagctgagccctgtggcccggcagaccagccagatcggcggcagcagcaaggcccccagccgcagcggcagccgggacagcacccccagcaggcctgcccagcagcccctgagccggcccatccagagccctggcaggaacagcatcagccctggaagaaatggcatcagcccccccaacaagctgagccagctgcccaggaccagcagccccagcacagccagcaccaagagcagcggcagcggcaagatgagctacaccagccctggccggcagatgagccagcagaacctgaccaagcagacaggcctgagcaagaatgccagcagcatccccaggtctgagagcgccagcaagggcctgaaccagatgaacaatggaaatggagccaacaagaaggtggagctgagcaggatgagcagcaccaagagcagcggcagcgagagtgacagaagtgagaggcctgtgctggtgcggcagagcaccttcatcaaggaggcccccagccccaccctgcggaggaagctggaggagagcgccagctttgagagcctgagccccagcagcaggcctgccagccccaccaggagccaggcccagacccctgtgctgagccccagcctgcctgacatgagcctgagcacccacagctctgtgcaggccggcggctggaggaagctgccccccaacctgagccccaccatcgagtacaatgatggccggcctgccaagagacatgacatcgcccggagccacagcgagagccccagccggctgcccatcaacagaagtggcacctggaagcgggagcacagcaagcacagcagcagcctgccccgggtgtccacctggaggagaacaggcagcagcagcagcatcctgagcgccagcagcgagagcagcgagaaggccaagtcagaagatgagaagcacgtgaacagcatcagcggcaccaagcagagcaaagaaaaccaggtgtctgccaagggcacctggaggaagatcaaggaaaatgagttcagccccaccaacagcaccagccagacagtgagcagcggggccaccaacggggctgagagcaagaccctcatctaccagatggccccagctgtgtccaagacagaagatgtgtgggtgagaattgaggactgccccatcaacaaccccaggagcggccgcagccccaccggcaacaccccacctgtgattgattctgtgtctgagaaggccaaccccaacatcaaggacagcaaggacaaccaggccaagcagaatgtgggcaatggatctgtgcccatgaggacagtgggcctggagaaccggctgaacagcttcatccaggtggatgccccagaccagaagggcacagagatcaagccaggccagaacaaccctgtgcctgtgtctgagaccaatgaaagcagcatcgtggagaggacccccttcagcagcagcagcagcagcaagcacagcagccccagcggcaccgtggccgcccgggtgacccccttcaactacaaccccagccccaggaagagcagcgctgacagcaccagcgcccggcccagccagatccccacccctgtgaacaacaacaccaagaagagggacagcaagacagacagcacagagagcagcggcacccagagccccaagaggcacagcggcagctacctggtgacctctgtgtag

SEQ ID NO: 18255 - DNA, 8532 bp, Artificial Sequence; identical to SEQ ID NO: 18254
  Description of Artificial Sequence: Synthetic coding sequence

SEQ ID NO: 18256 - DNA, 8532 bp, Artificial Sequence; identical to SEQ ID NO: 18254
  Description of Artificial Sequence: Synthetic coding sequence

SEQ ID NO: 18257 - DNA, 864 bp, Artificial Sequence
  Description of Artificial Sequence: Synthetic coding sequence
atggctgctgccagctatgaccagctgctgaagcaggtggaggccctgaagatggagaacagcaacctgcggcaggagctggaggacaacagcaaccacctgaccaagctggagacagaggccagcaacatgaaggaggtgctgaagcagctgcagggcagcattgaagatgaggccatggccagcagcggccagattgacctgctggagcggctgaaggagctgaacctggacagcagcaacttccctggggtgaagctgcggagcaagatgagcctgcggagctatggcagccgggagggctctgtgagcagccgctctggagaatgttctcctgtgcccatgggcagcttcccccggcggggctttgtgaatggcagccgggagagcacaggctacctggaggagctggagaaggagaggagcctgctgctggccgacctggacaaggaggagaaggagaaggactggtactatgcccagctgcagaacctgaccaagagaattgacagcctgcccctgacagagaacttcagcctgcagacagacatgacccggcggcagctggagtatgaggcccggcagatccgggtggccatggaggagcagctgggcacctgccaggacatggagaagagggcccagaggcgcatcgcccgcatccagcagatcgagaaggacatcctgcgcatccggcagctgctgcagagccaggccacagaggccgagaggagcagccagaacaagcatgagaccggcagccatgatgctgagcggcagaatgaaggccagggcgtgggggagatcaacatggccaccagcggaaatggccagatcgagaagatgaggatgtttgagtgctag

SEQ ID NO: 18258 - DNA, 357 bp, Artificial Sequence
  Description of Artificial Sequence: Synthetic coding sequence
atggctgctgccagctatgaccagctgctgaagcaggtggaggccctgaagatggagaacagcaacctgcggcaggagctggaggacaacagcaaccacctgaccaagctggagacagaggccagcaacatgaaggaggtgctgaagcagctgcagggcagcattgaagatgaggccatggccagcagcggccagattgacctgctggagcggctgaaggagctgaacctggacagcagcaacttccctggggtgaagctgcggagcaagatgagcctgcggagctatggcagccgggagggctctgtgagcagccgctctggagaatgttctcctgtgcccatgggcagcttctag

SEQ ID NO: 18259 - DNA, 3918 bp, Artificial Sequence
  Description of Artificial Sequence: Synthetic coding sequence
atggctgctgccagctatgaccagctgctgaagcaggtggaggccctgaagatggagaacagcaacctgcggcaggagctggaggacaacagcaaccacctgaccaagctggagacagaggccagcaacatgaaggaggtgctgaagcagctgcagggcagcattgaagatgaggccatggccagcagcggccagattgacctgctggagcggctgaaggagctgaacctggacagcagcaacttccctggggtgaagctgcggagcaagatgagcctgcggagctatggcagccgggagggctctgtgagcagccgctctggagaatgttctcctgtgcccatgggcagcttcccccggcggggctttgtgaatggcagccgggagagcacaggctacctggaggagctggagaaggagaggagcctgctgctggccgacctggacaaggaggagaaggagaaggactggtactatgcccagctgcagaacctgaccaagagaattgacagcctgcccctgacagagaacttcagcctgcagacagacatgacccggcggcagctggagtatgaggcccggcagatccgggtggccatggaggagcagctgggcacctgccaggacatggagaagagggcccagaggcgcatcgcccgcatccagcagatcgagaaggacatcctgcgcatccggcagctgctgcagagccaggccacagaggccgagaggagcagccagaacaagcatgagaccggcagccatgatgctgagcggcagaatgaaggccagggcgtgggggagatcaacatggccaccagcggaaatggccagggcagcaccaccaggatggaccacgagacagcctctgtgctgagcagcagcagcacccacagcgccccccggcggctgaccagccacctgggcaccaaggtggagatggtgtacagcctgctgtccatgctgggcacccatgacaaggatgacatgagcaggaccctgctggccatgagcagcagccaggacagctgcatctccatgaggcagagcggctgcctgcccctgctgatccagctgctgcatggaaatgacaaggacagcgtgctgctgggcaacagccggggcagcaaggaggcccgggcccgggccagcgctgccctgcacaacatcatccacagccagccagatgacaagagaggaagaagagagatccgggtgctgcacctgctggagcagatccgggcctactgtgagacctgctgggagtggcaggaggcccacgagcccggcatggaccaggacaagaaccccatgcctgcccctgtggagcaccagatctgcccagctgtgtgtgtgctgatgaagctgagctttgatgaggagcacagacatgccatgaatgagctgggcggcctgcaggccatcgccgagctgctgcaggtggactgtgagatgtatggcctgaccaatgaccactacagcatcaccctgcggcgctatgccggcatggccctgaccaacctgacctttggagatgtggccaacaaggccaccctgtgcagcatgaagggctgcatgagggccctggtggcccagctgaagtctgagagcgaggacctgcagcaggtgattgcctctgtgctgaggaacctgtcctggagggcagatgtgaacagcaagaagaccctgcgggaggtgggctctgtgaaggccctgatggagtgtgccctggaggtgaagaaggagagcaccctgaagtctgtgctgagcgccctgtggaacctgagcgcccactgcacagagaacaaggctgacatctgtgctgtggatggagccctggccttcctggtgggcaccctgacctaccgcagccagaccaacaccctggccatcatcgagagcggcggcggcatcctgagaaatgtgagcagcctcatcgccaccaatgaagaccaccggcagatcctgcgggagaacaactgcctgcagaccctgctgcagcacctgaagagccacagcctgaccatcgtgtccaatgcctgtggcaccctgtggaacctgagcgccaggaaccccaaggaccaggaggccctgtgggacatgggcgctgtgtccatgctgaagaacctgatccacagcaagcacaagatgattgccatgggcagcgctgctgccctgaggaacctgatggccaacagacctgccaagtacaaggatgccaacatcatgagccctggcagcagcctgcccagcctgcacgtgaggaagcagaaggccctggaggccgagctggatgcccagcacctgtctgagacctttgacaacatcgacaacctgagccccaaggccagccacaggagcaagcagaggcacaagcagagcctgtatggagactatgtgtttgacaccaacagacatgatgacaacagaagtgacaacttcaacacaggcaacatgacagtgctgagcccctacctgaacaccaccgtgctgcccagcagcagcagcagccggggcagcctggacagcagccgctctgagaaggacaggagcctggagcgggagcggggcatcggcctgggcaactaccacccagccacagagaaccctggcaccagcagcaagaggggcctgcagatcagcaccacagctgcccagatcgccaaggtgatggaggaggtgtctgccatccacaccagccaggaggacaggagcagcggcagcaccacagagctgcactgtgtgacagatgaaagaaatgccctgcggcgcagcagcgctgcccacacccacagcaacacctacaacttcaccaagtctgagaacagcaacagaacctgcagcatgccctatgccaagctggagtacaagaggagcagcaatgacagcctgaacagcgtgagcagcagtgatggctacggcaagaggggccagatgaagcccagcattgagagctacagtgaagatgatgagagcaagttctgcagctatggccagtacccagctgacctggcccacaagatccacagcgccaaccacatggatgacaatgatggagagctggacacccccatcaactacagcctgaagtacagtgatgagcagctgaacagcggccggcagagccccagccagaatgaacgctgggcccggcccaagcacatcattgaagatgagatcaagcagagcgagcagaggcagagcaggaaccagagcaccacctaccctgtgtacacagagagcacagatgacaagcacctgaagttccagccccacttcggccagcaggagtgtgtgagcccctaccgcagcagaggagccaacggcagcgagaccaacagagtgggcagcaaccacggcatcaaccagaatgtgtcccagagcctgtgccaggaggatgattatgaagatgacaagcccaccaactacagcgagcgctacagcgaggaggagcagcacgaggaggaggagcggcccaccaactacagcatcaagtacaatgaggagaagagacatgtggaccagcccatcgactacagcctgaagtatgccacagacatccccagcagccagaagcagagcttctccttcagcaagagcagcagcggccagagcagcaagacagagcacatgagcagcagcagcgagaacaccagcacccccagcagcaatgccaagaggcagaaccagctgcaccccagcagcgcccagagccgcagcggccagccccagaaggccgccacctgcaaggtgagcagcatcaaccaggagaccatccagacctactgtgtggaggacacccccatctgcttcagccgctgcagcagcctgagcagcctgagcagcgcagaagatgaaattggctgcaaccagaccacccaggaggccgacagcgccaacaccctgcagatcgcctag

SEQ ID NO: 18260 - DNA, 2796 bp, Artificial Sequence
  Description of Artificial Sequence: Synthetic coding sequence
atggccgagatcaaggagaagatctgtgactacctgttcaacgtgtctgacagcagcgccctgaacctggccaagaacatcggcctgaccaaggcccgggacatcaatgctgtgctgattgacatggagcggcagggagatgtgtaccggcagggcaccaccccacccatctggcacctgacagacaagaagcgggagaggatgcagatcaagaggaacaccaacagcgtgcctgagacagccccagctgccatccctgagaccaagagaaatgctgagttcctgacctgcaacatccccaccagcaatgccagcaacaacatggtgaccacagagaaggtggagaatggccaggagcccgtcatcaagctggagaaccggcaggaggcccggcctgagcccgcccggctgaagccccctgtgcactacaacggccccagcaaggccggctacgtggactttgaaaatggccagtgggccacagatgacatcccagatgacctgaacagcatccgggccgcccctggagagttccgggccatcatggagatgcccagcttctacagccacggcctgccccgctgcagcccctacaagaagctgacagagtgccagctgaagaaccccatcagcggcctgctggagtatgcccagtttgccagccagacctgtgagttcaacatgattgagcagagcggcccccctcatgagccccgcttcaagttccaggtggtgatcaatggccgggagttccccccagctgaggccggcagcaagaaggtggccaagcaggatgctgccatgaaggccatgaccatcctgctggaggaggccaaggccaaggacagcggcaagtctgaggagagcagccactacagcacagagaaggagagcgagaagacagctgagagccagacccccacccccagcgccaccagcttcttcagcggcaagagccctgtgaccaccctgctggagtgcatgcacaagctgggcaacagctgtgagttccggctgctgagcaaggagggccctgcccacgagcccaagttccagtactgtgtggccgtgggcgcccagaccttccccagcgtgtctgcccccagcaagaaggtggccaagcagatggctgctgaggaggccatgaaggccctgcacggggaggccaccaacagcatggccagtgacaaccagcctgagggcatgatcagcgagagcctggacaacctggagagcatgatgcccaacaaggtgaggaagattggagagctggtgcgctacctgaacaccaaccctgtgggcggcctgctggagtatgcccggagccacggctttgctgctgagttcaagctggtggaccagagcggcccccctcatgagcccaagtttgtgtaccaggccaaggtgggcggccgctggttccctgctgtgtgtgcccacagcaagaagcagggcaagcaggaggccgcagatgctgccctgcgggtgctgattggagaaaatgagaaggccgagaggatgggcttcacagaggtgacccctgtgactggagccagcctgcggaggaccatgctgctgctgagccgcagccctgaggcccagcccaagaccctgcccctgaccggcagcaccttccatgaccagatcgccatgctgagccaccgctgcttcaacaccctgaccaacagcttccagcccagcctgctgggcaggaagatcctggccgccatcatcatgaagaaggacagcgaggacatgggcgtggtggtgtccctgggcaccggcaacagatgtgtgaagggggacagcctgagcctgaagggggagaccgtgaatgactgccacgccgagatcatcagcagaagaggcttcatccgcttcctgtacagcgagctgatgaagtacaacagccagacagccaaggacagcatctttgagcccgccaagggcggggagaagctgcagatcaagaagacagtgtccttccacctgtacatcagcacagccccctgtggagatggagccctgtttgacaagagctgcagcgaccgggccatggagagcacagagagccgccactaccctgtgtttgagaaccccaagcagggcaagctgcggaccaaggtggagaatggagagggcaccatccctgtggagagcagtgacatcgtgcccacctgggatggcatccggctgggggagcggctgcggaccatgagctgcagcgacaagatcctgcgctggaatgtgctgggcctgcagggcgccctgctgacccacttcctgcagcccatctacctgaagtctgtgaccctgggctacctgttcagccagggccacctgacccgggccatctgctgccgggtgaccagagatggcagcgcctttgaagatggcctgcggcaccccttcatcgtgaaccaccccaaggtgggccgggtgtccatctatgacagcaagaggcagagcggcaagaccaaggagacctctgtgaactggtgcctggctgatggctatgacctggagatcctggatggcacccggggcaccgtggatggccccagaaatgagctgagccgggtgtccaagaagaacatcttcctgctcttcaagaagctgtgcagcttccgctacagaagagacctgctgcggctgtcctatggagaggccaagaaggccgcccgggactatgaaacagccaagaactacttcaagaagggcctgaaggacatgggctacggcaactggatcagcaagccccaggaggagaagaacttctacctgtgccctgtgtag

SEQ ID NO: 18261 - DNA, 3681 bp, Artificial Sequence
  Description of Artificial Sequence: Synthetic coding sequence
atgaacccccggcagggctacagcctgagcggctactacacccaccccttccagggctatgagcaccggcagctgcgctaccagcagcccggccctggcagcagccccagcagcttcctgctgaagcagatcgagttcctgaagggccagctgcctgaggcccctgtgattggcaagcagacccccagcctgccccccagcctgcccggcctgcggccccgcttccctgtgctgctggccagcagcacccggggccggcaggtggacatccggggcgtgccccggggcgtgcacctgcggagccagggcctgcagaggggcttccagcaccccagcccccggggccgcagcctgccccagaggggcgtggactgcctgagcagccacttccaggagctgagcatctaccaggaccaggagcagaggatcctgaagttcctggaggagctgggggagggcaaggccaccacagcccatgacctgagcggcaagctgggcacccccaagaaggagatcaacagagtgctgtacagcctggccaagaagggcaagctgcagaaggaggccggcaccccacccctgtggaagattgctgtgtccacccaggcctggaaccagcacagcggcgtggtgcggccagatggccacagccagggcgcccccaacagcgaccccagcctggagcctgaggacaggaacagcacctctgtgtctgaggacctgctggagcccttcatcgctgtgtctgcccaggcctggaaccagcacagcggcgtggtgcggccagacagccacagccagggcagccccaacagcgaccccggcctggagcctgaggacagcaacagcaccagcgccctggaggaccccctggagttcctggacatggccgagatcaaggagaagatctgtgactacctgttcaacgtgtctgacagcagcgccctgaacctggccaagaacatcggcctgaccaaggcccgggacatcaatgctgtgctgattgacatggagcggcagggagatgtgtaccggcagggcaccaccccacccatctggcacctgacagacaagaagcgggagaggatgcagatcaagaggaacaccaacagcgtgcctgagacagccccagctgccatccctgagaccaagagaaatgctgagttcctgacctgcaacatccccaccagcaatgccagcaacaacatggtgaccacagagaaggtggagaatggccaggagcctgtgatcaagctggagaaccggcaggaggcccggcctgagcccgcccggctgaagccccctgtgcactacaacggccccagcaaggccggctacgtggactttgaaaatggccagtgggccacagatgacatcccagatgacctgaacagcatccgggccgcccctggagagttccgggccatcatggagatgcccagcttctacagccacggcctgccccgctgcagcccctacaagaagctgacagagtgccagctgaagaaccccatcagcggcctgctggagtatgcccagtttgccagccagacctgtgagttcaacatgattgagcagagcggcccccctcatgagccccgcttcaagttccaggtggtgatcaatggccgggagttccccccagctgaggccggcagcaagaaggtggccaagcaggatgctgccatgaaggccatgaccatcctgctggaggaggccaaggccaaggacagcggcaagtctgaggagagcagccactacagcacagagaaggagagcgagaagacagctgagagccagacccccaccccatctgccaccagcttcttcagcggcaagagccctgtgaccaccctgctggagtgcatgcacaagctgggcaacagctgtgagttccggctgctgagcaaggagggccctgcccacgagcccaagttccagtactgtgtggccgtgggcgcccagaccttccccagcgtgtctgcccccagcaagaaggtggccaagcagatggctgctgaggaggccatgaaggccctgcatggagaggccaccaacagcatggccagtgacaaccagcctgagggcatgatcagcgagagcctggacaacctggagagcatgatgcccaacaaggtgaggaagatcggggagctggtgcgctacctgaacaccaaccctgtgggcggcctgctggagtatgcccggagccacggctttgctgctgagttcaagctggtggaccagagcggcccccctcatgagcccaagtttgtgtaccaggccaaggtgggcggccgctggttccctgctgtgtgtgcccacagcaagaagcagggcaagcaggaggccgcagatgctgccctgcgggtgctgattggagaaaatgagaaggccgagaggatgggcttcacagaggtgacccctgtgactggagccagcctgcggaggaccatgctgctgctgagccgcagccctgaggcccagcccaagaccctgcccctgaccggcagcaccttccatgaccagatcgccatgctgagccaccgctgcttcaacaccctgaccaacagcttccagcccagcctgctgggcaggaagatcctggccgccatcatcatgaagaaggacagcgaggacatgggcgtggtggtgtccctgggcactggaaacagatgtgtgaagggggacagcctgagcctgaagggggagaccgtgaatgactgccacgccgagatcatcagccggcggggcttcatccgcttcctgtacagcgagctgatgaagtacaacagccagacagccaaggacagcatctttgagcccgccaagggcggggagaagctgcagatcaagaagacagtgtccttccacctgtacatcagcacagccccctgtggagatggagccctgtttgacaagagctgcagcgaccgggccatggagagcacagagagccgccactaccctgtgtttgagaaccccaagcagggcaagctgcggaccaaggtggagaatggagagggcaccatccctgtggagagcagtgacatcgtgcccacctgggatggcatccggctgggggagcggctgcggaccatgagctgcagcgacaagatcctgcgctggaatgtgctgggcctgcagggcgccctgctgacccacttcctgcagcccatctacctgaagtctgtgaccctgggctacctgttcagccagggccacctgacccgggccatctgctgccgggtgaccagagatggcagcgcctttgaagatggcctgcggcaccccttcatcgtgaaccaccccaaggtgggccgggtgtccatctatgacagcaagaggcagagcggcaagaccaaggagacctctgtgaactggtgcctggctgatggctatgacctggagatcctggatggcacccggggcaccgtggatggccccagaaatgagctgagccgggtgtccaagaagaacatcttcctgctcttcaagaagctgtgcagcttccgctaccgccgggacctgctgcggctgtcctatggagaggccaagaaggccgcccgggactatgaaacagccaagaactacttcaagaagggcctgaaggacatgggctacggcaactggatcagcaagccccaggaggagaagaacttctacctgtgccctgtgtag

SEQ ID NO: 18262 - DNA, 3588 bp, Artificial Sequence
  Description of Artificial Sequence: Synthetic coding sequence
ggctacagcctgagcggctactacacccaccccttccagggctatgagcaccggcagctgcgctaccagcagcccggccctggcagcagccccagcagcttcctgctgaagcagatcgagttcctgaagggccagctgcctgaggcccctgtgattggcaagcagacccccagcctgccccccagcctgcccggcctgcggccccgcttccctgtgctgctggccagcagcacccggggccggcaggtggacatccggggcgtgccccggggcgtgcacctgcggagccagggcctgcagaggggcttccagcaccccagcccccggggccgcagcctgccccagaggggcgtggactgcctgagcagccacttccaggagctgagcatctaccaggaccaggagcagaggatcctgaagttcctggaggagctgggggagggcaaggccaccacagcccatgacctgagcggcaagctgggcacccccaagaaggagatcaacagagtgctgtacagcctggccaagaagggcaagctgcagaaggaggccggcaccccacccctgtggaagattgctgtgtccacccaggcctggaaccagcacagcggcgtggtgcggccagatggccacagccagggcgcccccaacagcgaccccagcctggagccagaagatagaaacagcacctctgtgtctgaggacctgctggagcccttcatcgctgtgtctgcccaggcctggaaccagcacagcggcgtggtgcggccagacagccacagccagggcagccccaacagcgaccccggcctggagcctgaggacagcaacagcaccagcgccctggaggaccccctggagttcctggacatggccgagatcaaggagaagatctgtgactacctgttcaacgtgtctgacagcagcgccctgaacctggccaagaacatcggcctgaccaaggcccgggacatcaatgctgtgctgattgacatggagcggcagggagatgtgtaccggcagggcaccaccccacccatctggcacctgacagacaagaagcgggagaggatgcagatcaagaggaacaccaacagcgtgcctgagacagccccagctgccatccctgagaccaagagaaatgctgagttcctgacctgcaacatccccaccagcaatgccagcaacaacatggtgaccacagagaaggtggagaatggccaggagcccgtcatcaagctggagaaccggcaggaggcccggcctgagcccgcccggctgaagccccctgtgcactacaacggccccagcaaggccggctacgtggactttgaaaatggccagtgggccacagatgacatcccagatgacctgaacagcatccgggccgcccctggagagttccgggccatcatggagatgcccagcttctacagccacggcctgccccgctgcagcccctacaagaagctgacagagtgccagctgaagaaccccatcagcggcctgctggagtatgcccagtttgccagccagacctgtgagttcaacatgattgagcagagcggcccccctcatgagccccgcttcaagttccaggtggtgatcaatggccgggagttccccccagctgaggccggcagcaagaaggtggccaagcaggatgctgccatgaaggccatgaccatcctgctggaggaggccaaggccaaggacagcggcaagtctgaggagagcagccactacagcacagagaaggagagcgagaagacagctgagagccagacccccacccccagcgccaccagcttcttcagcggcaagagccctgtgaccaccctgctggagtgcatgcacaagctgggcaacagctgtgagttccggctgctgagcaaggagggccctgcccacgagcccaagttccagtactgtgtggccgtgggcgcccagaccttccccagcgtgtctgcccccagcaagaaggtggccaagcagatggctgctgaggaggccatgaaggccctgcacggggaggccaccaacagcatggccagtgacaaccagcctgagggcatgatcagcgagagcctggacaacctggagagcatgatgcccaacaaggtgaggaagattggagagctggtgcgctacctgaacaccaaccctgtgggcggcctgctggagtatgcccggagccacggctttgctgctgagttcaagctggtggaccagagcggcccccctcatgagcccaagtttgtgtaccaggccaaggtgggcggccgctggttccctgctgtgtgtgcccacagcaagaagcagggcaagcaggaggccgcagatgctgccctgcgggtgctgattggagaaaatgagaaggccgagaggatgggcttcacagagctgcccctgaccggcagcaccttccatgaccagatcgccatgctgagccaccgctgcttcaacaccctgaccaacagcttccagcccagcctgctgggcaggaagatcctggccgccatcatcatgaagaaggacagcgaggacatgggcgtggtggtgtccctgggcaccggcaacagatgtgtgaagggggacagcctgagcctgaagggggagaccgtgaatgactgccacgccgagatcatcagcagaagaggcttcatccgcttcctgtacagcgagctgatgaagtacaacagccagacagccaaggacagcatctttgagcccgccaagggcggggagaagctgcagatcaagaagacagtgtccttccacctgtacatcagcacagccccctgtggagatggagccctgtttgacaagagctgcagcgaccgggccatggagagcacagagagccgccactaccctgtgtttgagaaccccaagcagggcaagctgcggaccaaggtggagaatggagagggcaccatccctgtggagagcagtgacatcgtgcccacctgggatggcatccggctgggggagcggctgcggaccatgagctgcagcgacaagatcctgcgctggaatgtgctgggcctgcagggcgccctgctgacccacttcctgcagcccatctacctgaagtctgtgaccctgggctacctgttcagccagggccacctgacccgggccatctgctgccgggtgaccagagatggcagcgcctttgaagatggcctgcggcaccccttcatcgtgaaccaccccaaggtgggccgggtgtccatctatgacagcaagaggcagagcggcaagaccaaggagacctctgtgaactggtgcctggctgatggctatgacctggagatcctggatggcacccggggcaccgtggatggccccagaaatgagctgagccgggtgtccaagaagaacatcttcctgctcttcaagaagctgtgcagcttccgctacagaagagacctgctgcggctgtcctatggagaggccaagaaggccgcccgggactatgaaacagccaagaactacttcaagaagggcctgaaggacatgggctacggcaactggatcagcaagccccaggaggagaagaacttctacctgtgccctgtgtag

SEQ ID NO: 18263 - DNA, 528 bp, Artificial Sequence
  Description of Artificial Sequence: Synthetic coding sequence
atgggcaaggtgctgagcaagatctttggaaacaaggagatgaggatcctgatgctgggcctggatgctgctgggaagaccaccatcctgtacaagctgaagctgggccagagcgtgaccaccatccccaccgtgggcttcaacgtggagaccgtgacctacaagaatgtgaagttcaacgtgtgggatgtgggcggccaggacaagatccggcccctgtggaggcactactacacaggcacccagggcctcatctttgtggtggactgtgccgaccgggacagaattgatgaggcccggcaggagctgcaccgcatcatcaatgaccgggagatgagagatgccatcatcctgatctttgccaacaagcaggacctgcctgatgccatgaagccccatgagatccaggagaagctgggcctgacccgcatccgggacaggaactggtacgtgcagcccagctgtgccaccagcggagatggcctgtatgagggcctgacctggctgaccagcaactacaagagctag

SEQ ID NO: 18264 - DNA, 1398 bp, Artificial Sequence
  Description of Artificial Sequence: Synthetic coding sequence
atgttccggcaggagcagcccctggccgagggcagctttgcccccatgggcagcctgcagccagatgctggaaatgcctcctggaatggaacagaggcccctgggggcggggcccgggccaccccctacagcctgcaggtgaccctgaccctggtgtgcctggccggcctgctgatgctgctgactgtgtttggaaatgtgctggtgatcatcgctgtgttcaccagccgggccctgaaggccccccagaacctcttcctggtgtccctggccagcgctgacatcctggtggccaccctggtgatccccttcagcctggccaatgaggtgatgggctactggtactttgggaaggcctggtgtgagatctacctggccctggatgtgctcttctgcaccagcagcatcgtgcacctgtgtgccatcagcctggaccgctactggagcatcacccaggccatcgagtacaacctgaagaggaccccccggcgcatcaaggccatcatcatcaccgtgtgggtgatctctgctgtgatctccttccccccactcatcagcattgagaagaagggcggcggcggcggcccccagcctgctgagccccgctgtgagatcaatgaccagaagtggtacgtgatcagcagctgcatcggcagcttctttgccccctgcctgatcatgatcctggtgtatgtgcgcatctaccagatcgccaagaggaggaccagggtgccccccagccggcggggcccagatgctgtggccgcccctcctgggggcacagaaagaagacccaacggcctgggccctgagaggtctgctggccctgggggcgctgaggccgagcccctgcccacccagctgaatggagcccctggagagcccgccccagctggcccccgggacacagatgccctggacctggaggagagcagcagcagtgaccatgctgagcggcccccaggcccccggcggcctgagcggggcccccggggcaagggcaaggcccgggccagccaggtgaagccaggggacagcctgccccggcggggccctggggccactggaattggcaccccagctgctggccctggagaggagcgggtgggcgccgccaaggccagccgctggaggggccggcagaaccgggagaagcgcttcacctttgtgctggccgtggtgattggagtgtttgtggtgtgctggttccccttcttcttcacctacaccctgacagctgtgggctgcagcgtgcccaggaccctcttcaagttcttcttctggtttggctactgcaacagcagcctgaaccctgtgatctacaccatcttcaaccacgacttcagaagagccttcaagaagatcctgtgccgcggggacaggaagagaattgtgtag

SEQ ID NO: 18265 - DNA, 285 bp, Artificial Sequence
  Description of Artificial Sequence: Synthetic coding sequence
atggcccccctgaagatgctggccctggtgaccctgctgctgggcgccagcctgcagcacatccatgctgcccggggcaccaacgtgggccgggagtgctgcctggagtacttcaagggggccatccccctgaggaagctgaagacctggtaccagaccagcgaggactgcagcagagatgccatcgtgtttgtgacagtgcagggccgggccatctgcagcgaccccaacaacaagagggtgaagaatgctgtgaagtacctgcagagcctggagaggagctag

SEQ ID NO: 18266 - DNA, 1635 bp, Artificial Sequence
  Description of Artificial Sequence: Synthetic coding sequence
atgcctggccgctgccagagtgatgctgccatgagggtgaatggacctgccagccgggccccagctggctggaccagcggcagcctgcacacaggccccagggctggccggccccgggcccaggcccggggcgtgcggggccggggcctgctgctgcggcccaggcctgccaaggagctgcccctgcccaggaaaggaggagcctgggccccagctggcaaccctggccccctgcaccccctgggcgtggccgtgggcatggccggcagcggccgcctggtgctgcggccctggatccgggagctgatcctgggcagcgagacccccagcagcccccgggccggccagctgctggaggtgctgcaggatgctgaggccgctgtggccggccccagccacgccccagacaccagtgatgtgggcgccaccctgctggtgtctgatggcacccacagcgtgcgctgcctggtgacccgggaggccctggacaccagtgactgggaggagaaggagtttggcttccggggcacagagggccgcctgctgctgctgcaggactgtggggtgcacgtgcaggtggccgagggcggggccccagctgagttctacctgcaggtggaccgcttcagcctgctgcccacagagcagccccggctgcgggtgcccggctgcaaccaggacctggatgtgcagaagaagctgtatgactgcctggaggagcacctgtctgagagcaccagcagcaatgccggcctgagcctgagccagctgctggatgagatgagggaggaccaggagcaccagggcgccctggtgtgcctggccgagagctgcctgaccctggagggcccctgcacagcccctcctgtgacccactgggccgccagccgctgcaaggccactggagaggccgtgtacacagtgcccagctccatgctgtgcatcagtgaaaatgaccagctgatcctgagcagcctgggcccctgccagaggacccagggccctgagctgcccccaccagaccctgccctgcaggacctgagcctgaccctcatcgccagcccccccagcagccccagcagcagcggcaccccagccctgcccggccacatgagcagcgaggagagcggcaccagcatcagcctgctgcctgccctgagcctggccgccccagaccccggccagaggagcagcagccagcccagccctgccatctgcagcgccccagccaccctgacccccaggagcccccacgccagcaggacccccagcagccccctgcagagctgcacccccagcctgagccccaggagccacgtgcccagcccccaccaggccctggtgacccggccccagaagcccagcctggagttcaaggagtttgtgggcctgccctgcaagaaccggccccccttccccaggactggagccaccaggggggcccaggagccctgcagcgtgtgggagccccccaagaggcacagagatggcagcgccttccagtatgaatatgagcccccctgcaccagcctgtgtgcccgggtgcaggccgtgcggctgcccccccagctgatggcctgggccctgcacttcctgatggatgcccagcccggcagcgagcccacccccatgtag

SEQ ID NO: 18267 - DNA, 558 bp, Artificial Sequence
  Description of Artificial Sequence: Synthetic coding sequence
atgaagctggtgtctgtggccctgatgtacctgggcagcctggccttcctgggcgctgacacagcccggctggatgtggccagcgagttcaggaagaagtggaacaagtgggccctgagccggggcaagcgggagctgaggatgagcagcagctaccccaccggcctggctgatgtgaaggccggccctgcccagaccctcatccggccccaggacatgaagggggccagccgcagccctgaggacagcagcccagatgctgcccgcatccgggtgaagcgctaccggcagagcatgaacaacttccagggcctgcggagctttggctgccgcttcggcacctgcaccgtgcagaagctggcccaccagatctaccagttcacagacaaggacaaggacaacgtggcccccaggagcaagatcagcccccagggctacggcagaagaagaagaagaagcctgcctgaggccggccctggccgcaccctggtgagcagcaagccccaggcccatggagccccagccccacccagcggcagcgccccccacttcctgtag

SEQ ID NO: 18268 - DNA, 558 bp, Artificial Sequence; identical to SEQ ID NO: 18267
  Description of Artificial Sequence: Synthetic coding sequence

SEQ ID NO: 18269 - DNA, 558 bp, Artificial Sequence; identical to SEQ ID NO: 18267
  Description of Artificial Sequence: Synthetic coding sequence

SEQ ID NO: 18270 - DNA, 702 bp, Artificial Sequence
  Description of Artificial Sequence: Synthetic coding sequence
atggctgctggaacagctgtgggcgcctgggtgctggtgctgagcctgtggggcgctgtggtgggcgcccagaacatcacagcccgcatcggggagcccctggtgctgaagtgcaagggggcccccaagaagccaccccagaggctggagtggaagctgaacacaggccgcacagaggcctggaaggtgctgagcccccagggcggcggcccctgggacagcgtggcccgggtgctgcccaacagcagcctcttcctgcctgctgtgggcatccaggatgagggcatcttccgctgccaggccatgaacagaaatggcaaggagaccaagagcaactacagagtgcgggtgtaccagatccctgggaagccagagatcgtggacagcgccagcgagctgacagctggggtgcccaacaaggtggtggaggagagccgccgcagcaggaagaggccctgtgagcaggaggtgggcacctgtgtgtctgagggcagctacccagctggcaccctgtcctggcacctggatggcaagcccctggtgcccaatgaaaaaggagtgtctgtgaaggagcagacccggcggcaccctgagaccggcctcttcaccctgcagagcgagctgatggtgaccccagcccggggcggggacccccggcccaccttcagctgcagcttcagccctggcctgcccaggcactag

SEQ ID NO: 18271 - DNA, 1029 bp, Artificial Sequence
  Description of Artificial Sequence: Synthetic coding sequence
atggctgctggaacagctgtgggcgcctgggtgctggtgctgagcctgtggggcgctgtggtgggcgcccagaacatcacagcccgcatcggggagcccctggtgctgaagtgcaagggggcccccaagaagccaccccagaggctggagtggaagctgggcggcggcccctgggacagcgtggcccgggtgctgcccaacagcagcctcttcctgcctgctgtgggcatccaggatgagggcatcttccgctgccaggccatgaacagaaatggcaaggagaccaagagcaactacagagtgcgggtgtaccagatccctgggaagccagagatcgtggacagcgccagcgagctgacagctggggtgcccaacaaggtgggcacctgtgtgtctgagggcagctacccagctggcaccctgtcctggcacctggatggcaagcccctggtgcccaatgaaaaaggagtgtctgtgaaggagcagacccggcggcaccctgagaccggcctcttcaccctgcagagcgagctgatggtgaccccagcccggggcggggacccccggcccaccttcagctgcagcttcagccctggcctgcccaggcaccgggccctgaggacagcccccatccagccccgggtgtgggagcctgtgcccctggaggaggtgcagctggtggtggagcctgagggcggcgctgtggcccctgggggcaccgtgaccctgacctgtgaggtgcctgcccagcccagcccccagatccactggatgaaggatgtgtctgacctggagcggggggccggccgcacccggcggggcggggccaactgccgcctgtgtggccgcatccgggccggcaacagcagccctggccctggggaccccggccggcctggggacagcaggcctgcccactggggccacctggtggccaaggccgccaccccccggcggggggaggagggccccaggaagccaggcggccggggcggggcctgcaggacagagagcgtgggcggcacctag

SEQ ID NO: 18272 - DNA, 1044 bp, Artificial Sequence
  Description of Artificial Sequence: Synthetic coding sequence
atggctgctggaacagctgtgggcgcctgggtgctggtgctgagcctgtggggcgctgtggtgggcgcccagaacatcacagcccgcatcggggagcccctggtgctgaagtgcaagggggcccccaagaagccaccccagaggctggagtggaagctgaacacaggccgcacagaggcctggaaggtgctgagcccccagggcggcggcccctgggacagcgtggcccgggtgctgcccaacagcagcctcttcctgcctgctgtgggcatccaggatgagggcatcttccgctgccaggccatgaacagaaatggcaaggagaccaagagcaactacagagtgcgggtgtaccagatccctgggaagccagagatcgtggacagcgccagcgagctgacagctggggtgcccaacaaggtgggcacctgtgtgtctgagggcagctacccagctggcaccctgtcctggcacctggatggcaagcccctggtgcccaatgaaaaaggagtgtctgtgaaggagcagacccggcggcaccctgagaccggcctcttcaccctgcagagcgagctgatggtgaccccagcccggggcggggacccccggcccaccttcagctgcagcttcagccctggcctgcccaggcaccgggccctgaggacagcccccatccagccccgggtgtgggagcctgtgcccctggaggaggtgcagctggtggtggagcctgagggcggcgctgtggcccctgggggcaccgtgaccctgacctgtgaggtgcctgcccagcccagcccccagatccactggatgaaggatggagtgcccctgcccctgccccccagccctgtgctgatcctgcctgagatcggcccccaggaccagggcacctacagctgtgtggccacccacagcagccacggcccccaggagagcagagctgtgtccatcagcatcatcgagcctggagaggagggccccacagctggggagggctttgacaaggtgcgggaggccgaggacagcccccagcacatgtag

SEQ ID NO: 18273 - DNA, 1215 bp, Artificial Sequence
  Description of Artificial Sequence: Synthetic coding sequence
atggctgctggaacagctgtgggcgcctgggtgctggtgctgagcctgtggggcgctgtggtgggcgcccagaacatcacagcccgcatcggggagcccctggtgctgaagtgcaagggggcccccaagaagccaccccagaggctggagtggaagctgaacacaggccgcacagaggcctggaaggtgctgagcccccagggcggcggcccctgggacagcgtggcccgggtgctgcccaacagcagcctcttcctgcctgctgtgggcatccaggatgagggcatcttccgctgccaggccatgaacagaaatggcaaggagaccaagagcaactacagagtgcgggtgtaccagatccctgggaagccagagatcgtggacagcgccagcgagctgacagctggggtgcccaacaaggtgggcacctgtgtgtctgagggcagctacccagctggcaccctgtcctggcacctggatggcaagcccctggtgcccaatgaaaaaggagtgtctgtgaaggagcagacccggcggcaccctgagaccggcctcttcaccctgcagagcgagctgatggtgaccccagcccggggcggggacccccggcccaccttcagctgcagcttcagccctggcctgcccaggcaccgggccctgaggacagcccccatccagccccgggtgtgggagcctgtgcccctggaggaggtgcagctggtggtggagcctgagggcggcgctgtggcccctgggggcaccgtgaccctgacctgtgaggtgcctgcccagcccagcccccagatccactggatgaaggatggagtgcccctgcccctgccccccagccctgtgctgatcctgcctgagatcggcccccaggaccagggcacctacagctgtgtggccacccacagcagccacggcccccaggagagcagagctgtgtccatcagcatcatcgagcctggagaggagggccccacagctggctctgtgggcggcagcggcctgggcaccctggccctggccctgggcatcctgggcggcctgggcacagctgccctgctgattggagtcatcctgtggcagaggcggcagaggagaggagaggagaggaaggcccctgagaaccaggaggaggaggaggagcgggcagagctgaaccagagcgaggagcctgaggccggggagagcagcactggaggcccctag

SEQ ID NO: 18274 - DNA, 705 bp, Artificial Sequence
  Description of Artificial Sequence: Synthetic coding sequence
atggctgctggaacagctgtgggcgcctgggtgctggtgctgagcctgtggggcgctgtggtgggcgcccagaacatcacagcccgcatcggggagcccctggtgctgaagtgcaagggggcccccaagaagccaccccagaggctggagtggaagctgaacacaggccgcacagaggcctggaaggtgctgagcccccagggcggcggcccctgggacagcgtggcccgggtgctgcccaacagcagcctcttcctgcctgctgtgggcatccaggatgagggcatcttccgctgccaggccatgaacagaaatggcaaggagaccaagagcaactaccgcagcctgcggaccttcaccatcacagccagtgactggatcttccccccatctgagatccctgggaagccagaaattgtggacagcgccagcgagctgacagctggggtgcccaacaaggtgggcacctgtgtgtctgagggcagctacccagctggcaccctgtcctggcacctggatggcaagcccctggtgcccaatgagaagggcgtgtctgtgaaggagcagaccaggaggcaccctgagaccggcctcttcaccctgcagagcgagctgatggtgaccccagcccggggcggggacccccggcccaccttcagctgcagcttcagccctggcctgcccaggcaccgggccctgaggtag

SEQ ID NO: 18275 - DNA, 402 bp, Artificial Sequence
  Description of Artificial Sequence: Synthetic coding sequence
atgaaggatggagtgcccctgcccctgccccccagccctgtgctgatcctgcctgagatcggcccccaggaccagggcacctacagctgtgtggccacccacagcagccacggcccccaggagagcagagctgtgtccatcagcatcatcgagcccggggaggagggccccacagctggctctgtgggcggcagcggcctgggcaccctggccctggccctgggcatcctgggcggcctgggcacagctgccctgctgattggagtcatcctgtggcagaggcggcagaggagaggagaggagaggaaggcccctgagaaccaggaggaggaggaggagagagctgagctgaaccagagcgaggagcctgaggccggggagagcagcactggaggcccctag

SEQ ID NO: 18276 - DNA, 1308 bp, Artificial Sequence
  Description of Artificial Sequence: Synthetic coding sequence
atgggcgctggggagcgggtgcaggccccacccagggctgaggccacagctggaagaggagctgaccgggcccggaccctggagggcagcaggatggccgccggcacagctgtgggcgcctgggtgctggtgctgagcctgtggggcgctgtggtgggcgcccagaacatcacagccagaattggagagcccctggtgctgaagtgcaagggggcccccaagaagccaccccagaggctggagtggaagctgaacacaggccgcacagaggcctggaaggtgctgagcccccagggcggcggcccctgggacagcgtggcccgggtgctgcccaacagcagcctcttcctgcctgctgtgggcatccaggatgagggcatcttccgctgccaggccatgaacagaaatggcaaggagaccaagagcaactacagagtgcgggtgtaccagatccctgggaagccagaaattgtggacagcgccagcgagctgacagctggggtgcccaacaaggtgggcacctgtgtgtctgagggcagctacccagctggcaccctgtcctggcacctggatggcaagcccctggtgcccaatgagaagggcgtgtctgtgaaggagcagaccaggaggcaccctgagaccggcctcttcaccctgcagagcgagctgatggtgaccccagcccggggcggggacccccggcccaccttcagctgcagcttcagccctggcctgcccaggcaccgggccctgaggacagcccccatccagccccgggtgtgggagcctgtgcccctggaggaggtgcagctggtggtggagcctgagggcggcgctgtggcccctgggggcaccgtgaccctgacctgtgaggtgcctgcccagcccagcccccagatccactggatgaaggatggagtgcccctgcccctgccccccagccctgtgctgatcctgcctgagatcggcccccaggaccagggcacctacagctgtgtggccacccacagcagccacggcccccaggagagcagagctgtgtccatcagcatcatcgagcccggggaggagggccccacagctggctctgtgggcggcagcggcctgggcaccctggccctggccctgggcatcctgggcggcctgggcacagctgccctgctgattggagtcatcctgtggcagaggcggcagaggagaggagaggagaggaaggcccctgagaaccaggaggaggaggaggagagagctgagctgaaccagagcgaggagcctgaggccggggagagcagcactggaggcccctag

SEQ ID NO: 18277 - DNA, 387 bp, Artificial Sequence
  Description of Artificial Sequence: Synthetic coding sequence
atggctgctggaacagctgtgggcgcctgggtgctggtgctgagcctgtggggcgctgtggtgggcgcccagaacatcacagcccgcatcggggagcccctggtgctgaagtgcaagggggcccccaagaagccaccccagaggctggagtggaagctgaacacaggccgcacagaggcctggaaggtgctgagcccccagggcggcggcccctgggacagcgtggcccgggtgctgcccaacagcagcctcttcctgcctgctgtgggcatccaggatgagggcatcttccgctgccaggccatgaacagaaatggcaaggagaccaagagcaactacagagtgcgggtgtaccagtttgagaacctgcacaactacagcctgtag

SEQ ID NO: 18278 - DNA, 462 bp, Artificial Sequence
  Description of Artificial Sequence: Synthetic coding sequence
atggctgctggaacagctgtgggcgcctgggtgctggtgctgagcctgtggggcgctgtggtgggcgcccagaacatcacagcccgcatcggggagcccctggtgctgaagtgcaagggggcccccaagaagccaccccagaggctggagtggaagctgaacacaggccgcacagaggcctggaaggtgctgagcccccagggcggcggcccctgggacagcgtggcccgggtgctgcccaacagcagcctcttcctgcctgctgtgggcatccaggatgagggcatcctgggcggcctgggcacagctgccctgctgattggagtcatcctgtggcagaggcggcagaggagaggagaggagaggaaggcccctgagaaccaggaggaggaggaggagagagctgagctgaaccagagcgaggagcctgaggccggggagagcagcactggaggcccctag

SEQ ID NO: 18279 - DNA, 885 bp, Artificial Sequence
  Description of Artificial Sequence: Synthetic coding sequence
atgaacagaaatggcaaggagaccaagagcaactacagagtgcgggtgtaccagatccctgggaagccagaaattgtggacagcgccagcgagctgacagctggggtgcccaacaaggtgggcacctgtgtgtctgagggcagctacccagctggcaccctgtcctggcacctggatggcaagcccctggtgcccaatgagaagggcgtgtctgtgaaggagcagaccaggaggcaccctgagaccggcctcttcaccctgcagagcgagctgatggtgaccccagcccggggcggggacccccggcccaccttcagctgcagcttcagccctggcctgcccaggcaccgggccctgaggacagcccccatccagccccgggtgtgggagcctgtgcccctggaggaggtgcagctggtggtggagcctgagggcggcgctgtggcccctgggggcaccgtgaccctgacctgtgaggtgcctgcccagcccagcccccagatccactggatgaaggatggagtgcccctgcccctgccccccagccctgtgctgatcctgcctgagatcggcccccaggaccagggcacctacagctgtgtggccacccacagcagccacggcccccaggagagcagagctgtgtccatcagcatcatcggctctgtgggcggcagcggcctgggcaccctggccctggccctgggcatcctgggcggcctgggcacagctgccctgctgattggagtcatcctgtggcagaggcggcagaggagaggagaggagaggaaggcccctgagaaccaggaggaggaggaggagcgggcagagctgaaccagagcgaggagcctgaggccggggagagcagcactggaggcccctag

SEQ ID NO: 18280 - DNA, 366 bp, Artificial Sequence
  Description of Artificial Sequence: Synthetic coding sequence
atggctgctggaacagctgtgggcgcctgggtgctggtgctgagcctgtggggcgctgtggtgggcgcccagaacatcacagcccgcatcggggagcccctggtgctgaagtgcaagggggcccccaagaagccaccccagaggctggagtggaagctgaacacaggccgcacagaggcctggaaggtgctgagcccccagggcggcggcccctgggacagcgtggcccgggtgctgcccaacagcagcctcttcctgcctgctgtgggcatccaggatgagggcatcttccgctgccaggccatgaacagaaatggcaaggagaccaagagcaactggtggtggagccagaaggtggagcagtag

SEQ ID NO: 18281 - DNA, 1092 bp, Artificial Sequence
  Description of Artificial Sequence: Synthetic coding sequence
atggctgctggaacagctgtgggcgcctgggtgctggtgctgagcctgtggggcgctgtggtgggcgcccagaacatcacagcccgcatcggggagcccctggtgctgaagtgcaagggggcccccaagaagccaccccagaggctggagtggaagctgaacacaggccgcacagaggcctggaaggtgctgagcccccagggcggcggcccctgggacagcgtggcccgggtgctgcccaacagcagcctcttcctgcctgctgtgggcatccaggatgagggcatcttccgctgccaggccatgaacagaaatggcaaggagaccaagagcaactacagagtgcgggtgtaccagatccctgggaagccagagatcgtggacagcgccagcgagctgacagctggggtgcccaacaaggtggtggaggagagccgccgcagcaggaagaggccctgtgagcaggaggtgggcacctgtgtgtctgagggcagctacccagctggcaccctgtcctggcacctggatggcaagcccctggtgcccaatgaaaaaggagtgtctgtgaaggagcagacccggcggcaccctgagaccggcctcttcaccctgcagagcgagctgatggtgaccccagcccggggcggggacccccggcccaccttcagctgcagcttcagccctggcctgcccaggcaccgggccctgaggacagcccccatccagccccgggtgtgggagcctgtgcccctggaggaggtgcagctggtggtggagcctgagggcggcgctgtggcccctgggggcaccgtgaccctgacctgtgaggtgcctgcccagcccagcccccagatccactggatgaaggatggagtgcccctgcccctgccccccagccctgtgctgatcctgcctgagatcggcccccaggaccagggcacctacagctgtgtggccacccacagcagccacggcccccaggagagcagagctgtgtccatcagcatcatcgagcctggagaggagggccccacagctggggagggctttgacaaggtgcgggaggccgaggacagcccccagcacatgtag

SEQ ID NO: 18282 - DNA, 3633 bp, Artificial Sequence
  Description of Artificial Sequence: Synthetic coding sequence
atggccgcccagagcagcctgtacaatgatgacaggaacctgctgcgcatccgggagaaggagaggaggaaccaggaggcccaccaggagaaggaggccttccctgagaagatccccctgtttggagagccctacaagacagccaagggagatgagctgagcagccgcatccagaacatgctgggcaactatgaggaggtgaaggagttcctgagcaccaagagccacacccaccggctggatgccagcgagaaccggctgggcaagcccaagtaccccctcatcccagacaagggcagcagcatccccagcagcagcttccacacctctgtgcaccaccagagcatccacaccccagccagcggccccctgtctgtgggcaacatcagccacaaccccaagatggcccagcccaggacagagcccatgcccagcctgcacgccaagagctgtggccccccagacagccagcacctgacccaggaccggctgggccaggagggcttcggcagcagccaccacaagaagggggacagaagagcagatggagaccactgtgcctctgtgacagacagcgcccctgagcgggagctgagccccctcatcagcctgcccagccctgtgccccccctgagccccatccacagcaaccagcagaccctgcccaggacccagggcagcagcaaggtgcacggcagcagcaacaacagcaagggctactgcccagccaagagccccaaggacctggccgtgaaggtgcatgacaaggagaccccccaggacagcctggtggccccagcccagccccccagccagaccttccccccacccagcctgcccagcaagtctgtggccatgcagcagaagcccacagcctacgtgcggcccatggatggccaggaccaggcccccagcgagagccctgagctgaagcccctgcctgaggactaccggcagcagacctttgagaagacagacctgaaggtgcctgccaaggccaagctgaccaagctgaagatgcccagccagagcgtggagcagacctacagcaatgaggtgcactgtgtggaggagatcctgaaggagatgacccacagctggcccccacccctgacagccatccacacccccagcacagctgagcccagcaagttccccttccccaccaaggacagccagcacgtgtcctctgtgacccagaaccagaagcagtatgacaccagcagcaagacccacagcaacagccagcagggcaccagctccatgctggaggatgacctgcagctgagtgacagtgaagattctgattctgagcagaccccagagaagccacccagcagcagcgccccacccagcgccccccagagcctgcctgagcctgtggccagcgcccacagcagcagcgctgagagcgagagcaccagtgacagcgacagcagcagtgacagcgagagcgagagcagcagcagtgacagcgaggagaatgagcccctggagaccccagcccctgagcctgagccccccaccaccaacaagtggcagctggacaactggctgaccaaggtgtcccagcctgctgcccctcctgagggccccaggagcacagagcccccaagaagacaccctgagagcaagggcagcagtgacagcgccaccagccaggagcacagcgagagcaaggaccccccacccaagagcagcagcaaggccccccgggcccctcctgaggccccccaccctgggaagaggagctgccagaagagccctgcccagcaggagcccccccagaggcagacagtgggcaccaagcagcccaagaagcctgtgaaggccagcgcccgggccggcagcaggaccagcctgcagggcgagcgggagcccggcctgctgccctacggcagccgggaccagaccagcaaggacaagcccaaggtgaagaccaagggccggcccagggctgctgccagcaatgagcccaagccagctgtgccccccagcagcgagaagaagaagcacaagagcagcctgcctgcccccagcaaggccctgagcggccctgagcccgccaaggacaacgtggaggacaggaccccagagcactttgccctggtgcccctgacagagagccagggccccccccacagcggcagcggcagcaggaccagcggctgccggcaggccgtggtggtgcaggaggacagcaggaaggaccggctgcccctgcccctgcgggacaccaagctgctgagccccctgcgggacaccccaccaccccagagcctgatggtgaagatcaccctggacctgctgagccgcatcccccagcccccaggcaagggcagccggcagaggaaggccgaggacaagcagcccccagctgggaagaagcacagcagcgagaagaggagcagtgacagcagcagcaagctggccaagaagaggaaaggagaggccgagcgggactgtgacaacaagaagatccggctggagaaggagatcaagagccagagcagcagcagcagcagcagccacaaggagagcagcaagaccaagcccagccggcccagcagccagagcagcaagaaggagatgctgcccccacctcctgtgagcagcagcagccagaagccagccaagccagccctgaagaggagccggcgggaggccgacacctgtggccaggacccccccaagagcgccagcagcaccaagagcaaccacaaggacagcagcatccccaagcagaggagagtggagggcaagggcagccgcagcagcagcgagcacaagggcagcagcggggacacagccaaccccttccctgtgcccagcctgcccaatggaaacagcaagccaggcaagccccaggtgaagtttgacaagcagcaggccgacctgcacatgagggaggccaagaagatgaagcagaaggccgagctgatgacagacagagtgggcaaggccttcaagtacctggaggccgtgctgtccttcattgaatgtggcatcgccacagaaagtgagagccagagcagcaagagcgcctacagcgtgtacagcgagaccgtggacctgatcaagttcatcatgagcctgaagagcttcagtgatgccacagcccccacccaggagaagatctttgctgtgctgtgcatgcgctgccagagcatcctgaacatggccatgttccgctgcaagaaggacatcgccatcaagtacagcaggaccctgaacaagcactttgagagcagcagcaaggtggcccaggcccccagcccctgcatcgccagcacaggcacccccagccccctgagccccatgcccagccctgccagctctgtgggcagccagagcagcgctggctctgtgggcagcagcggcgtggccgccaccatcagcacccctgtgaccatccagaacatgaccagcagctatgtgaccatcaccagccacgtgctgacagcctttgacctgtgggagcaggccgaggccctgaccaggaagaacaaggagttctttgcccggctgagcaccaacgtgtgcaccctggccctgaacagcagcctggtggacctggtgcactacacccggcagggcttccagcagctgcaggagctgaccaagaccccctag

SEQ ID NO: 18283 - DNA, 1266 bp, Artificial Sequence
  Description of Artificial Sequence: Synthetic coding sequence
atggccttcacagagcgggtgaacagcagcggcaacagcctgtacaatgatgacaggaacctgctgcgcatccgggagaaggagaggaggaaccaggaggcccaccaggagaaggaggccttccctgagaagatccccctgtttggagagccctacaagacagccaagggagatgagctgagcagccgcatccagaacatgctgggcaactatgaggaggtgaaggagttcctgagcaccaagagccacacccaccggctggatgcctctgaaaatcggctgggcaagcccaagtaccccctcatcccagacaagggcagcagcatccccagcagcagcttccacacctctgtgcaccaccagagcatccacaccccagccagcggccccctgtctgtgggcaacatcagccacaaccccaagatggcccagcccaggacagagcccatgcccagcctgcacgccaagagctgtggccccccagacagccagcacctgacccaggaccggctgggccaggagggcttcggcagcagccaccacaagaagggggaccggcgggcagatggagaccactgtgcctctgtgacagattctgcccctgagcgggagctgagccccctcatcagcctgcccagccctgtgccccccctgagccccatccacagcaaccagcagaccctgcccaggacccagggcagcagcaaggtgcacggcagcagcaacaacagcaagggctactgcccagccaagagccccaaggacctggccgtgaaggtgcatgacaaggagaccccccaggacagcctggtggccccagcccagccccccagccagaccttccccccacccagcctgcccagcaagtctgtggccatgcagcagaagcccacagcctacgtgcggcccatggatggccaggaccaggcccccagcgagagccctgagctgaagcccctgcctgaggactaccggcagcagacctttgagaagacagacctgaaggtgcctgccaaggccaagctgaccaagctgaagatgcccagccagagcgtggagcagacctacagcaatgaggtgcactgtgtggaggagatcctgaaggacagccagcacgtgtcctctgtgacccagaaccagaagcagtatgacaccagcagcaagacccacagcaacagccagcagggcaccagctccatgctggaggatgacctgcagctgagtgacagtgaagattctgattctgagcagaccccagccccctag

SEQ ID NO: 18284 - DNA, 3657 bp, Artificial Sequence
  Description of Artificial Sequence: Synthetic coding sequence
atggccttcacagagcgggtgaacagcagcggcaacagcctgtacaatgatgacaggaacctgctgcgcatccgggagaaggagaggaggaaccaggaggcccaccaggagaaggaggccttccctgagaagatccccctgtttggagagccctacaagacagccaagggagatgagctgagcagccgcatccagaacatgctgggcaactatgaggaggtgaaggagttcctgagcaccaagagccacacccaccggctggatgcctctgaaaatcggctgggcaagcccaagtaccccctcatcccagacaagggcagcagcatccccagcagcagcttccacacctctgtgcaccaccagagcatccacaccccagccagcggccccctgtctgtgggcaacatcagccacaaccccaagatggcccagcccaggacagagcccatgcccagcctgcacgccaagagctgtggccccccagacagccagcacctgacccaggaccggctgggccaggagggcttcggcagcagccaccacaagaagggggaccggcgggcagatggagaccactgtgcctctgtgacagattctgcccctgagcgggagctgagccccctcatcagcctgcccagccctgtgccccccctgagccccatccacagcaaccagcagaccctgcccaggacccagggcagcagcaaggtgcacggcagcagcaacaacagcaagggctactgcccagccaagagccccaaggacctggccgtgaaggtgcatgacaaggagaccccccaggacagcctggtggccccagcccagccccccagccagaccttccccccacccagcctgcccagcaagtctgtggccatgcagcagaagcccacagcctacgtgcggcccatggatggccaggaccaggcccccagcgagagccctgagctgaagcccctgcctgaggactaccggcagcagacctttgagaagacagacctgaaggtgcctgccaaggccaagctgaccaagctgaagatgcccagccagagcgtggagcagacctacagcaatgaggtgcactgtgtggaggagatcctgaaggagatgacccacagctggcccccacccctgacagccatccacacccccagcacagctgagcccagcaagttccccttccccaccaaggacagccagcacgtgtcctctgtgacccagaaccagaagcagtatgacaccagcagcaagacccacagcaacagccagcagggcaccagctccatgctggaggatgacctgcagctgagtgacagcgaggacagcgacagcgagcagaccccagagaagccacccagcagcagcgcccctccttctgccccccagagcctgcctgagcctgtggccagcgcccacagcagcagcgctgagagcgagagcaccagtgacagcgacagcagcagtgacagcgagagcgagagcagcagcagtgacagtgaagaaaatgagcccctggagaccccagcccctgagcctgagccccccaccaccaacaagtggcagctggacaactggctgaccaaggtgtcccagcctgctgcccctcctgagggccccaggagcacagagcccccccggcggcaccctgagagcaagggcagcagtgacagcgccaccagccaggagcacagcgagagcaaggaccccccacccaagagcagcagcaaggccccccgggcccctcctgaggccccccaccctgggaagaggagctgccagaagagccctgcccagcaggagcccccccagaggcagacagtgggcaccaagcagcccaagaagcctgtgaaggccagcgcccgggccggcagcaggaccagcctgcagggcgagcgggagcccggcctgctgccctacggcagccgggaccagaccagcaaggacaagcccaaggtgaagaccaagggccggcccagggctgctgccagcaatgagcccaagccagctgtgccccccagcagcgagaagaagaagcacaagagcagcctgcctgcccccagcaaggccctgagcggccctgagcccgccaaggacaacgtggaggacaggaccccagagcactttgccctggtgcccctgacagagagccagggccccccccacagcggcagcggcagcaggaccagcggctgccggcaggccgtggtggtgcaggaggacagcaggaaggaccggctgcccctgcccctgcgggacaccaagctgctgagccccctgcgggacaccccaccaccccagagcctgatggtgaagatcaccctggacctgctgagccgcatcccccagcccccaggcaagggcagccggcagaggaaggccgaggacaagcagcccccagctgggaagaagcacagcagcgagaagaggagcagtgacagcagcagcaagctggccaagaagaggaagggggaggccgagcgggactgtgacaacaagaagatccggctggagaaggagatcaagagccagagcagcagcagcagcagcagccacaaggagagcagcaagaccaagcccagccggcccagcagccagagcagcaagaaggagatgctgcccccacctcctgtgagcagcagcagccagaagccagccaagccagccctgaagaggagcagaagagaggccgacacctgtggccaggacccccccaagagcgccagcagcaccaagagcaaccacaaggacagcagcatccccaagcagaggagagtggagggcaagggcagccgcagcagcagcgagcacaagggcagcagcggggacacagccaaccccttccctgtgcccagcctgcccaacggcaacagcaagccaggcaagccccaggtgaagtttgacaagcagcaggccgacctgcacatgagggaggccaagaagatgaagcagaaggccgagctgatgacagacagagtgggcaaggccttcaagtacctggaggccgtgctgtccttcattgaatgtggcatcgccacagagagcgagagccagagcagcaagagcgcctacagcgtgtacagcgagaccgtggacctgatcaagttcatcatgagcctgaagagcttcagtgatgccacagcccccacccaggagaagatctttgctgtgctgtgcatgcgctgccagagcatcctgaacatggccatgttccgctgcaagaaggacatcgccatcaagtacagcaggaccctgaacaagcactttgagagcagcagcaaggtggcccaggcccccagcccctgcatcgcccggagcacaggcacccccagccccctgagccccatgcccagccctgccagctctgtgggcagccagagcagcgctggctctgtgggcagcagcggcgtggccgccaccatcagcacccctgtgaccatccagaacatgaccagcagctatgtgaccatcaccagccacgtgctgacagcctttgacctgtgggagcaggccgaggccctgaccaggaagaacaaggagttctttgcccggctgagcaccaacgtgtgcaccctggccctgaacagcagcctggtggacctggtgcactacacccggcagggcttccagcagctgcaggagctgaccaagaccccctag

SEQ ID NO: 18285 - DNA, 1221 bp, Artificial Sequence
  Description of Artificial Sequence: Synthetic coding sequence
atggccttcacagagcgggtgaacagcagcggcaacagcctgtacaatgatgacaggaacctgctgcgcatccgggagaaggagaggaggaaccaggaggcccaccaggagaaggaggccttccctgagaagatccccctgtttggagagccctacaagacagccaagggagatgagctgagcagccgcatccagaacatgctgggcaactatgaggaggtgaaggagttcctgagcaccaagagccacacccaccggctggatgcctctgaaaatcggctgggcaagcccaagtaccccctcatcccagacaagggcagcagcatccccagcagcagcttccacacctctgtgcaccaccagagcatccacaccccagccagcggccccctgtctgtgggcaacatcagccacaaccccaagatggcccagcccaggacagagcccatgcccagcctgcacgccaagagctgtggccccccagacagccagcacctgacccaggaccggctgggccaggagggcttcggcagcagccaccacaagaagggggaccggcgggcagatggagaccactgtgcctctgtgacagattctgcccctgagcgggagctgagccccctcatcagcctgcccagccctgtgccccccctgagccccatccacagcaaccagcagaccctgcccaggacccagggcagcagcaaggtgcacggcagcagcaacaacagcaagggctactgcccagccaagagccccaaggacctggccgtgaaggtgcatgacaaggagaccccccaggacagcctggtggccccagcccagccccccagccagaccttccccccacccagcctgcccagcaagtctgtggccatgcagcagaagcccacagcctacgtgcggcccatggatggccaggaccaggcccccagcgagagccctgagctgaagcccctgcctgaggactaccggcagcagacctttgagaagacagacctgaaggtgcctgccaaggccaagctgaccaagctgaagatgcccagccagagcgtggagacctacagcaatgaggtgcactgtgtggaggagatcctgaaggagatgacccacagctggcccccacccctgacagccatccacacccccagcacagctgagcccagcaagttccccttccccaccaaggacagccagcacgtgtcctctgtgacccagtag

SEQ ID NO: 18286 - DNA, 1473 bp, Artificial Sequence
  Description of Artificial Sequence: Synthetic coding sequence
atgcccagccagagcgtggagcagacctacagcaatgaggtgcactgtgtggaggagatcctgaaggagatgacccacagctggcccccacccctgacagccatccacacccccagcacagctgagcccagcaagttccccttccccaccaaggacagccagcacgtgtcctctgtgacccagaaccagaagcagtatgacaccagcagcaagacccacagcaacagccagcagggcaccagctccatgctggaggatgacctgcagctgagtgacagcgaggacagcgacagcgagcagaccccagagaagccaccccacctgcacctgcaggtgctgcacagccccttccagaaccagtggcaccagcacatcccagctgtgcagagccagaaggcccctgtgacccagacagtgccccagacccagagggcccgggctgtgcaggacagtgaagaaaatgagcccctggagaccccagcccctgagcctgagccccccaccaccaacaagtggcagctggacaactggctgaccaaggtgtcccagcctgctgcccctcctgagggccccaggagcacagagcccccccggcggcaccctgagagcaagggcagcagtgacagcgccaccagccaggagcacagcgagagcaaggaccccccacccaagagcagcagcaaggccccccgggcccctcctgaggccccccaccctgggaagaggagctgccagaagagccctgcccagcaggagcccccccagaggcagacagtgggcaccaagcagcccaagaagcctgtgaaggccagcgcccgggccggcagcaggaccagcctgcagggcgagcgggagcccggcctgctgccctacggcagccgggaccagaccagcaaggacaagcccaaggtgaagaccaagggccggcccagggctgctgccagcaatgagcccaagccagctgtgccccccagcagcgagaagaagaagcacaagagcagcctgcctgcccccagcaaggccctgagcggccctgagcccgccaaggacaacgtggaggacaggaccccagagcactttgccctggtgcccctgacagagagccagggccccccccacagcggcagcggcagcaggaccagcggctgccggcaggccgtggtggtgcaggaggacagcaggaaggaccggctgcccctgcccctgcgggacaccaagctgctgagccccctgcgggacaccccaccaccccagagcctgatggtgaagatcaccctggacctgctgagccgcatcccccagcccccaggcaagggcagccggcagaggaaggccgaggacaagcagcccccagctgggaagaagcacagcagcgagaagaggagcagtgacagcagcagcaagctggccaagaagaggaagggggaggccgagcgggactgtgacaacaagaagatccggctggagaagtag

SEQ ID NO: 18287 - DNA, 2550 bp, Artificial Sequence
  Description of Artificial Sequence: Synthetic coding sequence
atgacccacagctggcccccacccctgacagccatccacacccccagcacagctgagcccagcaagttccccttccccaccaaggacagccagcacgtgtcctctgtgacccagaaccagaagcagtatgacaccagcagcaagacccacagcaacagccagcagggcaccagctccatgctggaggatgacctgcagctgagtgacagtgaagattctgattctgagcagaccccagagaagccacccagcagcagcgccccacccagcgccccccagagcctgcctgagcctgtggccagcgcccacagcagcagcgctgagagcgagagcaccagtgacagcgacagcagcagtgacagcgagagcgagagcagcagcagtgacagcgaggagaatgagcccctggagaccccagcccctgagcctgagccccccaccaccaacaagtggcagctggacaactggctgaccaaggtgtcccagcctgctgcccctcctgagggccccaggagcacagagcccccaagaagacaccctgagagcaagggcagcagtgacagcgccaccagccaggagcacagcgagagcaaggaccccccacccaagagcagcagcaaggccccccgggcccctcctgaggccccccaccctgggaagaggagctgccagaagagccctgcccagcaggagcccccccagaggcagacagtgggcaccaagcagcccaagaagcctgtgaaggccagcgcccgggccggcagcaggaccagcctgcagggcgagcgggagcccggcctgctgccctacggcagccgggaccagaccagcaaggacaagcccaaggtgaagaccaagggccggcccagggctgctgccagcaatgagcccaagccagctgtgccccccagcagcgagaagaagaagcacaagagcagcctgcctgcccccagcaaggccctgagcggccctgagcccgccaaggacaacgtggaggacaggaccccagagcactttgccctggtgcccctgacagagagccagggccccccccacagcggcagcggcagcaggaccagcggctgccggcaggccgtggtggtgcaggaggacagcaggaaggaccggctgcccctgcccctgcgggacaccaagctgctgagccccctgcgggacaccccaccaccccagagcctgatggtgaagatcaccctggacctgctgagccgcatcccccagcccccaggcaagggcagccggcagaggaaggccgaggacaagcagcccccagctgggaagaagcacagcagcgagaagaggagcagtgacagcagcagcaagctggccaagaagaggaaaggagaggccgagcgggactgtgacaacaagaagatccggctggagaaggagatcaagagccagagcagcagcagcagcagcagccacaaggagagcagcaagaccaagcccagccggcccagcagccagagcagcaagaaggagatgctgcccccacctcctgtgagcagcagcagccagaagccagccaagccagccctgaagaggagccggcgggaggccgacacctgtggccaggacccccccaagagcgccagcagcaccaagagcaaccacaaggacagcagcatccccaagcagaggagagtggagggcaagggcagccgcagcagcagcgagcacaagggcagcagcggggacacagccaaccccttccctgtgcccagcctgcccaatggaaacagcaagccaggcaagccccaggtgaagtttgacaagcagcaggccgacctgcacatgagggaggccaagaagatgaagcagaaggccgagctgatgacagacagagtgggcaaggccttcaagtacctggaggccgtgctgtccttcattgaatgtggcatcgccacagaaagtgagagccagagcagcaagagcgcctacagcgtgtacagcgagaccgtggacctgatcaagttcatcatgagcctgaagagcttcagtgatgccacagcccccacccaggagaagatctttgctgtgctgtgcatgcgctgccagagcatcctgaacatggccatgttccgctgcaagaaggacatcgccatcaagtacagcaggaccctgaacaagcactttgagagcagcagcaaggtggcccaggcccccagcccctgcatcgcccggagcacaggcacccccagccccctgagccccatgcccagccctgccagctctgtgggcagccagagcagcgctggctctgtgggcagcagtggagtggccgccaccatcagcacccctgtgaccatccagaacatgaccagcagctatgtgaccatcaccagccacgtgctgacagcctttgacctgtgggagcaggccgaggccctgaccaggaagaacaaggagttctttgcccggctgagcaccaacgtgtgcaccctggccctgaacagcagcctggtggacctggtgcactacacccggcagggcttccagcagctgcaggagctgaccaagaccccctag

SEQ ID NO: 18288 - DNA, 2376 bp, Artificial Sequence
  Description of Artificial Sequence: Synthetic coding sequence
atgccagacatgcacttcaaggcccccaagatctccatgccagatgtggacctgcacctgaagggccccaaggtgaagggagatgtggatgtgtctgtgcccaagctggagggggacctgaccggccccagcgtgggcgtggaggtgcctgatgtggagctggagtgcccagatgccaagctgaagggccccaagttcaagatgcctgagatgcacttcaagacccccaagatctccatgccagatgtggacctgcacctgaagggccccaaggtgaagggggacatggatgtgtctgtgcccaaggtggagggggagatgaaggtgcctgatgtggacatcaagggccccaagatggacattgatgccccagatgtggatgtgcacggccctgactggcacctgaagatgcccaagatgaagatgcccaagttctccatgcctggcttcaaggccgagggccctgaggtggatgtgaacctgcccaaggcagatgtggtggtgtctggccccaaggtggatgtggaggtgcctgatgtgtccctggagggccctgagggcaagctgaagggccccaagctgaagatgcctgagatgcacttcaaggcccccaagatctccatgccagatgtggacctgcacctgaagggccccaaggtgaagggagatgtggatgtgtccctgcccaagctggagggggacctgaccggccccagcgtggatgtggaggtgcctgatgtggagctggagtgcccagatgccaagctgaagggccccaagttcaagatgcctgagatgcacttcaagacccccaagatctccatgccagatgtgaacctgaacctgaagggccccaaggtgaagggggacatggatgtgtctgtgcccaaggtggagggggagatgaaggtgcctgatgtggacatccggggccccaaggtggacattgatgccccagatgtggatgtgcacggccctgactggcacctgaagatgcccaagatgaagatgcccaagttctccatgcctggcttcaagggggagggccctgaggtggatgtgaacctgcccaaggcagatgtggatgtgtctggccccaaggtggatgtggaggtgcctgatgtgtccctggagggccctgagggcaagctgaagggccccaagttcaagatgcctgagatgcacttcaagacccccaagatctccatgccagatgtggacttcaacctgaagggccccaagatcaagggagatgtggatgtgtctgcccccaagctggagggggagctgaagggccctgagctggatgtgaagggccccaagctggatgctgacatgcctgaggtggccgtggagggccccaacgggaagtggaagacccccaagttcaagatgccagacatgcacttcaaggcccccaagatctccatgccagacctggacctgcacctgaagagccccaaggccaagggggaggtggatgtggatgtgcccaagctggagggggacctgaagggcccccacgtggatgtgtctggccctgacatcgacatcgagggccctgagggcaagctgaagggccccaagttcaagatgccagacatgcacttcaaggcccccaacatctccatgccagatgtggacctgaacctgaagggccccaagatcaagggagatgtggatgtgtctgtgcctgaggtggagggcaagctggaggtgcctgacatgaacatccggggccccaaggtggatgtgaatgccccagatgtgcaggccccagactggcacctgaagatgcccaagatgaagatgcccaagttctccatgcctggcttcaaggccgagggccctgaggtggatgtgaacctgcccaaggcagatgtggacatcagcggccccaaggtggacatcgagggcccagatgtgaacatcgagggccctgagggcaagctgaagggccccaagctgaagatgcctgagatgaacatcaaggcccccaagatctccatgccagactttgacctgcacctgaagggccccaaggtgaagggagatgtggatgtgtccctgcccaaggtggagggggacctgaagggccctgaggtggacatcaagggccccaaggtggacatcaatgccccagatgtgggcgtgcagggccctgactggcacctgaagatgcccaaggtgaagatgcccaagttctccatgcctggcttcaagggggagggcccagatggagatgtgaagctgcccaaggctgacattgatgtgtctggccccaaggtggacatcgagggcccagatgtgaacatcgagggccctgagggcaagctgaagggccccaagttcaagatggcccagcgctggtggtag

SEQ ID NO: 18289 - DNA, 450 bp, Artificial Sequence
  Description of Artificial Sequence: Synthetic coding sequence
atggagaaggaggagaccacccgggagctgctgctgcccaactggcagggcagcggcagccacggcctgaccatcgcccagagagatgatggagtgtttgtgcaggaggtgacccagaacagccctgctgccaggactggagtggtgaaggagggggaccagatcgtgggcgccaccatctactttgacaacctgcagagcggggaggtgacccagctgctgaacaccatgggccaccacacagtgggcctgaagctgcacaggaaaggagacaggagccctgagcccggccagacctggacccgggaggtgttcagcagctgcagcagcgaggtggtgctgaacaccccccagcccagcgccctggagtgcaaggaccagaacaagcagaaggaggccagcagccaggccggggctgtgtctgtgtccaccccaaatgccggcctgtag

SEQ ID NO: 18290 - DNA, 17673 bp, Artificial Sequence
  Description of Artificial Sequence: Synthetic coding sequence
atggagaaggaggagaccacccgggagctgctgctgcccaactggcagggcagcggcagccacggcctgaccatcgcccagagagatgatggagtgtttgtgcaggaggtgacccagaacagccctgctgccaggactggagtggtgaaggagggggaccagatcgtgggcgccaccatctactttgacaacctgcagagcggggaggtgacccagctgctgaacaccatgggccaccacacagtgggcctgaagctgcacaggaaaggagacaggagccctgagcccggccagacctggacccgggaggtgttcagcagctgcagcagcgaggtggtgctgtctggagatgatgaggagtaccagaggatctacaccaccaagatcaagccccggctgaagtcagaagatggagtggagggggacctgggggagacccagagcaggaccatcaccgtgaccaggagagtgacagcctacacagtggatgtgacaggccgggagggcgccaaggacatcgacatcagcagccctgagttcaagatcaagatccccaggcatgagctgacagagatcagcaatgtggatgtggagacccagagcggcaagacagtcatccggctgcccagcggcagcggggccgccagccccaccggcagcgctgtggacatccgggccggggccatcagcgccagcggccctgagctgcagggcgccggccacagcaagctgcaggtgaccatgcctggcatcaaggtgggcggcagcggcgtgaatgtgaatgccaagggcctggacctgggcggccggggcggcgtgcaggtgcctgctgtggacatcagcagcagcctgggcggccgggctgtggaggtgcagggccccagcctggagagcggggaccacggcaagatcaagttccccaccatgaaggtgcccaagtttggagtgtccacaggccgggagggccagacccccaaggccggcctgcgggtgtctgcccctgaggtgtctgtgggccacaagggcggcaagccaggcctgaccatccaggccccccagctggaggtgtctgtgcccagcgccaacatcgagggcctggagggcaagctgaagggcccccagatcaccggccccagcctggagggggacctgggcctgaagggggccaagccccagggccacatcggcgtggatgccagcgccccccagatcggcggcagcatcaccggccccagcgtggaggtgcaggccccagacattgatgtgcagggccctggcagcaagctgaatgtgcccaagatgaaggtgcccaagttctctgtgtctggggccaagggggaggagactggaattgatgtgaccctgcccactggagaggtgacagtgcctggggtgtctggagatgtgtccctgcctgagatcgccaccggcggcctggagggcaagatgaagggcaccaaggtgaagaccccagagatgatcatccagaagcccaagatctccatgcaggatgtggacctgagcctgggcagccccaagctgaagggggacatcaaggtgtctgcccctggggtgcagggagatgtgaagggcccccaggtggccctgaagggcagccgggtggacatcgagacccccaacctggagggcaccctgaccggcccccggctgggcagccccagcggcaagacaggcacctgccgcatctccatgtctgaggtggacctgaatgtggccgcccccaaggtgaagggcggcgtggatgtgaccctgccccgggtggagggcaaggtgaaggtgcctgaggtggatgtgcggggccccaaggtggatgtgtctgccccagatgtggaggcccacggccctgagtggaacctgaagatgcccaagatgaagatgcccaccttcagcacccctggggccaagggggagggcccagatgtgcacatgaccctgcccaagggggacatcagcatcagcggccccaaggtgaatgtggaggccccagatgtgaacctggagggcctgggcggcaagctgaagggcccagatgtgaagctgcctgacatgtctgtgaagacccccaagatctccatgccagatgtggacctgcacgtgaagggcaccaaggtgaagggggagtatgatgtgacagtgcccaagctggagggggagctgaagggccccaaggtggacattgatgccccagatgtggatgtgcacggccctgactggcacctgaagatgcccaagatgaagatgcccaagttctctgtgcccggcttcaaggccgagggccctgaggtggatgtgaacctgcccaaggcagatgtggacatcagcggccccaagattgatgtgacagccccagatgtgtccattgaggagcctgagggcaagctgaagggccccaagttcaagatgcctgagatgaacatcaaggtgcccaagatctccatgccagatgtggacctgcacctgaagggccccaacgtgaagggggagtatgatgtgaccatgcccaaggtggagagcgagatcaaggtgcctgatgtggagctgaagagcgccaagatggacattgatgtgcctgatgtggaggtgcagggccctgactggcacctgaagatgcccaagatgaagatgcccaagttctccatgcctggcttcaaggccgagggccctgaggtggatgtgaacctgcccaaggcagatgtggacatcagcggccccaaggtgggcgtggaggtgcctgatgtgaacatcgagggccctgagggcaagctgaagggccccaagttcaagatgcctgagatgaacatcaaggcccccaagatctccatgccagatgtggacctgcacatgaagggccccaaggtgaagggggagtatgacatgacagtgcccaagctggagggggacctgaagggccccaaggtggatgtgtctgccccagatgtggagatgcagggccctgactggaacctgaagatgcccaagatcaagatgcccaagttctccatgcccagcctgaagggggagggccctgagtttgatgtgaacctgagcaaggccaacgtggacatcagcgcccccaaggtggacaccaatgccccagacctgagcctggagggccctgagggcaagctgaagggccccaagttcaagatgcctgagatgcacttccgggcccccaagatgagcctgcctgatgtggacctggacctgaagggccccaagatgaagggaaatgtggacatcagcgcccccaagattgaaggagagatgcaggtgcctgatgtggacatccggggccccaaggtggacatcaaggccccagatgtggagggccagggcctggactggagcctgaagatccccaagatgaagatgcccaagttctccatgcccagcctgaagggggagggccctgaggtggatgtgaacctgcccaaggcagatgtggtggtgtctggccccaaggtggacatcgaggccccagatgtgtccctggagggccctgagggcaagctgaagggccccaagttcaagatgcctgagatgcacttcaagacccccaagatctccatgccagatgtggacctgcacctgaagggccccaaggtgaagggagatgtggatgtgtctgtgcccaaggtggagggggagatgaaggtgcctgatgtggagatcaagggccccaagatggacattgatgccccagatgtggaggtgcagggccctgactggcacctgaagatgcccaagatgaagatgcccaagttctccatgcctggcttcaagggggagggccgggaggtggatgtgaacctgcccaaggctgacattgatgtgtctggccccaaggtggatgtggaggtgcctgatgtgtccctggagggccctgagggcaagctgaagggccccaagttcaagatgcctgagatgcacttcaaggcccccaagatctccatgccagatgtggacctgaacctgaagggccccaagctgaagggagatgtggatgtgtccctgcctgaggtggagggggagatgaaggtgcctgatgtggacatcaagggccccaaggtggacatcagcgccccagatgtggatgtgcacggccctgactggcacctgaagatgcccaaggtgaagatgcccaagttctccatgcctggcttcaagggggagggccctgaggtggatgtgaagctgcccaaggcagatgtggatgtgtctggccccaagatggatgctgaggtgcctgatgtgaacatcgagggcccagatgccaagctgaagggccccaagttcaagatgcctgagatgagcatcaagccccagaagatcagcatcccagatgtgggcctgcacctgaagggccccaagatgaagggggactatgatgtgacagtgcccaaggtggagggggagatcaaggccccagatgtggacatcaagggccccaaggtggacatcaatgccccagatgtggaggtgcacggccctgactggcacctgaagatgcccaaggtgaagatgcccaagttctccatgcctggcttcaagggggagggccctgaggtggacatgaacctgcccaaggctgacctgggcgtgtctggccccaaggtggacattgatgtgcctgatgtgaacctggaggcccctgagggcaagctgaagggccccaagttcaagatgcccagcatgaacatccagacccacaagatctccatgccagatgtgggcctgaacctgaaggcccccaagctgaagacagatgtggatgtgtccctgcccaaggtggagggggacctgaagggccctgagattgatgtgaaggcccccaagatggatgtgaatgtgggggacattgatattgagggccctgagggcaagctgaagggccccaagttcaagatgcctgagatgcacttcaaggcccccaagatctccatgccagatgtggacctgcacctgaagggccccaaggtgaagggggacatggatgtgtctgtgcccaaggtggagggggagatgaaggtgcctgatgtggacatcaagggccccaaggtggacattgatgccccagatgtggaggtgcatgaccctgactggcacctgaagatgcccaagatgaagatgcccaagttctccatgcctggcttcaaggccgagggccctgaggtggatgtgaacctgcccaaggctgacattgatgtgtctggccccagcgtggacacagatgccccagacctggacatcgagggccctgagggcaagctgaagggcagcaagttcaagatgcccaagctgaacatcaaggcccccaaggtgtccatgccagatgtggacctgaacctgaagggccccaagctgaagggggagattgatgcctctgtgcctgagctggagggggacctgcggggcccccaggtggatgtgaagggcccctttgtggaggccgaggtgcctgatgtggacctggagtgcccagatgccaagctgaagggccccaagttcaagatgcctgagatgcacttcaaggcccccaagatctccatgccagatgtggacctgcacctgaagggccccaaggtgaagggagatgctgatgtgtctgtgcccaagctggagggggacctgaccggccccagcgtgggcgtggaggtgcctgatgtggagctggagtgcccagatgccaagctgaagggccccaagttcaagatgccagacatgcacttcaaggcccccaagatctccatgccagatgtggacctgcacctgaagggccccaaggtgaagggagatgtggatgtgtctgtgcccaagctggagggggacctgaccggccccagcgtgggcgtggaggtgcctgatgtggagctggagtgcccagatgccaagctgaagggccccaagttcaagatgcctgagatgcacttcaagacccccaagatctccatgccagatgtggacctgcacctgaagggccccaaggtgaagggggacatggatgtgtctgtgcccaaggtggagggggagatgaaggtgcctgatgtggacatcaagggccccaagatggacattgatgccccagatgtggatgtgcacggccctgactggcacctgaagatgcccaagatgaagatgcccaagttctccatgcctggcttcaaggccgagggccctgaggtggatgtgaacctgcccaaggcagatgtggtggtgtctggccccaaggtggatgtggaggtgcctgatgtgtccctggagggccctgagggcaagctgaagggccccaagctgaagatgcctgagatgcacttcaaggcccccaagatctccatgccagatgtggacctgcacctgaagggccccaaggtgaagggagatgtggatgtgtccctgcccaagctggagggggacctgaccggccccagcgtggatgtggaggtgcctgatgtggagctggagtgcccagatgccaagctgaagggccccaagttcaagatgcctgagatgcacttcaagacccccaagatctccatgccagatgtgaacctgaacctgaagggccccaaggtgaagggggacatggatgtgtctgtgcccaaggtggagggggagatgaaggtgcctgatgtggacatccggggccccaaggtggacattgatgccccagatgtggatgtgcacggccctgactggcacctgaagatgcccaagatgaagatgcccaagttctccatgcctggcttcaagggggagggccctgaggtggatgtgaacctgcccaaggcagatgtggatgtgtctggccccaaggtggatgtggaggtgcctgatgtgtccctggagggccctgagggcaagctgaagggccccaagttcaagatgcctgagatgcacttcaagacccccaagatctccatgccagatgtggacttcaacctgaagggccccaagatcaagggagatgtggatgtgtctgcccccaagctggagggggagctgaagggccctgagctggatgtgaagggccccaagctggatgctgacatgcctgaggtggccgtggagggccccaacgggaagtggaagacccccaagttcaagatgccagacatgcacttcaaggcccccaagatctccatgccagacctggacctgcacctgaagagccccaaggccaagggggaggtggatgtggatgtgcccaagctggagggggacctgaagggcccccacgtggatgtgtctggccctgacattgatattgagggccctgagggcaagctgaagggccccaagttcaagatgccagacatgcacttcaaggcccccaacatctccatgccagatgtggacctgaacctgaagggccccaagatcaagggagatgtggatgtgtctgtgcctgaggtggagggcaagctggaggtgcctgacatgaacatccggggccccaaggtggatgtgaatgccccagatgtgcaggccccagactggcacctgaagatgcccaagatgaagatgcccaagttctccatgcctggcttcaaggccgagggccctgaggtggatgtgaacctgcccaaggcagatgtggacatcagcggccccaaggtggacatcgagggcccagatgtgaacatcgagggccctgagggcaagctgaagggccccaagctgaagatgcctgagatgaacatcaaggcccccaagatctccatgccagactttgacctgcacctgaagggccccaaggtgaagggagatgtggatgtgtccctgcccaaggtggagggggacctgaagggccctgaggtggacatcaagggccccaaggtggacatcaatgccccagatgtgggcgtgcagggccctgactggcacctgaagatgcccaaggtgaagatgcccaagttctccatgcctggcttcaagggggagggcccagatggagatgtgaagctgcccaaggctgacattgatgtgtctggccccaaggtggacatcgagggcccagatgtgaacatcgagggccctgagggcaagctgaagggccccaagttcaagatgcctgagatgaacatcaaggcccccaagatctccatgccagacatcgacctgaacctgaagggccccaaggtgaagggagatgtggatgtgtccctgcccaaggtggagggggacctgaagggccctgaggtggacatcaagggccccaaggtggacattgatgccccagatgtggatgtgcacggccctgactggcacctgaagatgcccaagatcaagatgcccaagatctccatgcctggcttcaagggggagggcccagatgtggatgtgaacctgcccaaggctgacattgatgtgtctggccccaaggtggatgtggagtgcccagatgtgaacatcgagggccctgagggcaagtggaagagccccaagttcaagatgcctgagatgcacttcaagacccccaagatctccatgccagacatcgacctgaacctgaccggccccaagatcaagggagatgtggatgtgacaggccccaaggtggagggggacctgaagggccctgaggtggacctgaagggccccaaggtggacattgatgtgcctgatgtgaatgtgcagggccctgactggcacctgaagatgcccaagatgaagatgcccaagttctccatgcctggcttcaaggccgagggccctgaggtggatgtgaacctgcccaaggcagatgtggatgtgtctggccccaaggtggatgtggagggcccagatgtgaacatcgagggccctgagggcaagctgaagggccccaagttcaagatgcctgagatgaacatcaaggcccccaagatccccatgccagactttgacctgcacctgaagggccccaaggtgaagggagatgtggacatcagcctgcccaaggtggagggggacctgaagggccctgaggtggacatccggggcccccaggtggacattgatgtgcctgatgtgggcgtgcagggccctgactggcacctgaagatgcccaaggtgaagatgcccaagttctccatgcctggcttcaagggggagggcccagatgtggatgtgaacctgcccaaggctgacctggatgtgtctggccccaaggtggacattgatgtgcctgatgtgaacatcgagggccctgagggcaagctgaagggccccaagttcaagatgcctgagatgaacatcaaggcccccaagatctccatgccagacatcgacctgaacctgaagggccccaaggtgaagggggacatggatgtgtccctgcccaaggtggagggggacatgaaggtgcctgatgtggacatcaagggccccaaggtggacatcaatgccccagatgtggatgtgcagggccctgactggcacctgaagatgcccaagatcaagatgcccaagatctccatgcctggcttcaagggggagggccctgaggtggatgtgaacctgcccaaggctgacctggatgtgtctggccccaaggtggatgtggatgtgcctgatgtgaacatcgagggcccagatgccaagctgaagggccccaagttcaagatgcctgagatgaacatcaaggcccccaagatctccatgccagacctggacctgaacctgaagggccccaagatgaagggggaggtggatgtgtccctggccaacgtggagggggacctgaagggccctgccctggacatcaagggccccaagattgatgtggatgccccagacatcgacatccacggcccagatgccaagctgaagggccccaagctgaagatgccagacatgcacgtgaacatgcccaagatctccatgcctgagattgacctgaacctgaagggcagcaagctgaagggagatgtggatgtgtctggccccaagctggagggggacatcaaggcccccagcctggacatcaagggccctgaggtggatgtgtctggccccaagctgaacatcgagggcaagagcaagaagagccgcttcaagctgcccaagttcaacttcagcggcagcaaggtgcagaccccagaggtggatgtgaagggcaagaagccagacatcgacatcaccggccccaaggtggacatcaatgccccagatgtggaggtgcagggcaaggtgaagggcagcaagttcaagatgcccttcctgagcatcagcagccccaaggtgtccatgccagatgtggagctgaacctgaagagccccaaggtgaagggggacctggacattgctggccccaacctggagggggacttcaagggccccaaggtggacatcaaggcccctgaggtgaacctgaatgccccagatgtggatgtgcacggccctgactggaacctgaagatgcccaagatgaagatgcccaagttctctgtgtctggcctgaaggccgagggcccagatgtggccgtggacctgcccaagggggacatcaacatcgagggccccagcatgaacatcgagggccctgacctgaatgtggagggccctgagggcggcctgaagggccccaagttcaagatgccagacatgaacatcaaggcccccaagatctccatgccagacatcgacctgaacctgaagggccccaaggtgaagggagatgtggacatcagcctgcccaagctggagggggacctgaagggccctgaggtggacatcaagggccccaaggtggacatcaatgccccagatgtggatgtgcacggccctgactggcacctgaagatgcccaaggtgaagatgcccaagttctccatgcctggcttcaagggggagggccctgaggtggatgtgaccctgcccaaggctgacatcgacatcagcggccccaacgtggatgtggatgtgcctgatgtgaacatcgagggcccagatgccaagctgaagggccccaagttcaagatgcctgagatgaacatcaaggcccccaagatctccatgccagactttgacctgaacctgaagggccccaagatgaagggagatgtggtggtgtccctgcccaaggtggagggggacctgaagggccctgaggtggacatcaagggccccaaggtggacatcgacaccccagacatcaacatcgagggcagcgagggcaagttcaagggccccaagttcaagatccctgagatgcacctgaaggcccccaagatctccatgccagacatcgacctgaacctgaagggccccaaggtgaagggagatgtggatgtgtccctgcccaagatggagggggacctgaagggccctgaggtggacatcaagggccccaaggtggacatcaatgccccagatgtggatgtgcagggccctgactggcacctgaagatgcccaaggtgaagatgcccaagttctccatgcctggcttcaagggggagggcccagatgtggatgtgaacctgcccaaggctgacctggatgtgtctggccccaaggtggacattgatgtgcctgatgtgaacatcgagggccctgagggcaagctgaagggccccaagttcaagatgcctgagatgaacatcaaggcccccaagatctccatgccagacatcgacctgaacctgaagggccccaaggtgaagggggacatggatgtgtccctgcccaaggtggagggggacatgcaggtgcctgacctggacatcaagggccccaaggtggacatcaatgccccagatgtggatgtgcggggccctgactggcacctgaagatgcccaagatcaagatgcccaagatctccatgcctggcttcaagggggagggccctgaggtggatgtgaacctgcccaaggctgacctggatgtgtctggccccaaggtggatgtggatgtgcctgatgtgaacatcgagggcccagatgccaagctgaagggccccaagttcaagatgcctgagatgaacatcaaggcccccaagatctccatgccagactttgacctgcacctgaagggccccaaggtgaagggagatgtggatgtgtccctgcccaagatggagggggacctgaaggcccctgaggtggacatcaagggccccaaggtggacattgatgccccagatgtggatgtgcacggccctgactggcacctgaagatgcccaaggtgaagatgcccaagttctccatgcctggcttcaagggggagggccctgaggtggatgtgaacctgcccaaggctgacattgatgtgtctggccccaaggtggacatcgacaccccagacatcgacatccacggccctgagggcaagctgaagggccccaagttcaagatgccagacctgcacctgaaggcccccaagatctccatgcctgaggtggacctgaacctgaagggccccaagatgaagggagatgtggatgtgtccctgcccaaggtggagggggacctgaagggccctgaggtggacatcaagggccccaaggtggacattgatgtgcctgatgtggatgtgcagggccctgactggcacctgaagatgcccaaggtgaagatgcccaagttctccatgcctggcttcaagggggagggcccagatgtggatgtgaacctgcccaaggctgacctggatgtgtctggccccaaggtggacattgatgtgcctgatgtgaacatcgagggcccagatgccaagctgaagggccccaagttcaagatgcctgagatgaacatcaaggcccccaagatctccatgccagactttgacctgcacctgaagggccccaaggtgaagggagatgtggatgtgtccctgcccaaggtggagggggacctgaagggccctgaggtggacatcaagggccccaaggtggacattgatgccccagatgtggatgtgcacggccctgactggcacctgaagatgcccaaggtgaagatgcccaagttctccatgcctggcttcaagggggagggcccagatgtggatgtgaccctgcccaaggctgacatcgagatcagcggccccaaggtggacattgatgccccagatgtgtccattgagggcccagatgccaagctgaagggccccaagttcaagatgcctgagatgaacatcaaggcccccaagatctccatgccagacatcgacttcaacctgaagggccccaaggtgaagggagatgtggatgtgtccctgcccaaggtggagggggacctgaagggccctgagattgacatcaagggccccagcctggacatcgacaccccagatgtgaacatcgagggccctgagggcaagctgaagggccccaagttcaagatgcctgagatgaacatcaaggcccccaagatctccatgccagactttgacctgcacctgaagggccccaaggtgaagggagatgtggatgtgtccctgcccaaggtggagagtgacctgaagggccctgaggtggacatcgagggccctgagggcaagctgaagggccccaagttcaagatgccagatgtgcacttcaagagcccccagatctccatgtctgacatcgacctgaacctgaagggccccaagatcaagggggacatggacatctctgtgcccaagctggagggggacctgaagggccccaaggtggatgtgaagggccccaaggtgggcatcgacaccccagacatcgacatccacggccctgagggcaagctgaagggccccaagttcaagatgccagacctgcacctgaaggcccccaagatctccatgcctgaggtggacctgaacctgaagggccccaaggtgaagggggacatggacatcagcctgcccaaggtggagggggacctgaagggccctgaggtggacatccgggaccccaaggtggacattgatgtgcctgatgtggatgtgcagggccctgactggcacctgaagatgcccaaggtgaagatgcccaagttctccatgcctggcttcaagggggagggcccagatgtggatgtgaacctgcccaaggctgacattgatgtgtctggccccaaggtggatgtggatgtgcctgatgtgaacatcgagggcccagatgccaagctgaagggccccaagttcaagatgcctgagatgagcatcaaggcccccaagatctccatgccagacatcgacctgaacctgaagggccccaaggtgaagggagatgtggatgtgaccctgcccaaggtggagggggacctgaagggccctgaggccgacatcaagggccccaaggtggacatcaacaccccagatgtggatgtgcacggccctgactggcacctgaagatgcccaaggtgaagatgcccaagttctccatgcctggcttcaagggggagggcccagatgtggatgtgtccctgcccaaggctgacattgatgtgtctggccccaaggtggatgtggacatcccagatgtgaacatcgagggcccagatgccaagctgaagggccccaagttcaagatgcctgagatcaacatcaaggcccccaagatcagcatcccagatgtggacctggacctgaagggccccaaggtgaagggggactttgatgtgtctgtgcccaaggtggagggcaccctgaagggccctgaggtggacctgaagggcccccggctggactttgagggcccagatgccaagctgagcggccccagcctgaagatgcccagcctggagatcagcgcccccaaggtgacagccccagatgtggacctgcacctgaaggcccccaagattggcttcagcggccccaagctggagggcggggaggtggacctgaagggccccaaggtggaggcccccagcctggatgtgcacatggacagcccagacatcaacatcgagggcccagatgtgaagatccccaagttcaagaagcccaagtttggatttggagccaagagccccaaggctgacatcaagagccccagcctggatgtgacagtgcctgaggccgagctgaacctggagaccccagagatctctgtgggcggcaagggcaagaagagcaagttcaagatgcccaagatccacatgagcggccccaagatcaaggccaagaagcagggctttgacctgaatgtgcctggaggagaaattgatgccagcctgaaggccccagatgtggatgtgaacattgctggcccagatgctgccctgaaggtggatgtgaagagccccaagaccaagaagaccatgtttgggaagatgtacttcccagatgtggagtttgacatcaagagccccaagttcaaggccgaggcccccctgcccagccccaagctggagggggagctgcaggccccagacctggagctgagcctgcctgccatccacgtggagggcctggacatcaaggccaaggcccccaaggtgaagatgccagatgtggacatctctgtgcccaagattgaaggagacctgaagggccccaaggtgcaggccaacctgggcgccccagacatcaacatcgagggcctggatgccaaggtgaagacccccagctttggcatcagcgccccccaggtgtccatcccagatgtgaatgtgaacctgaagggccccaagatcaagggagatgtgcccagcgtgggcctggagggcccagatgtggacctgcagggccctgaggccaagatcaagttccccaagttctccatgcccaagattggcatccctggggtgaagatggagggcggcggcgctgaggtgcacgcccagctgcccagcctggagggggacctgcggggcccagatgtgaagctggagggcccagatgtgtccctgaagggccctggggtggacctgcccagcgtgaacctgtccatgcccaaggtgtctggccctgacctggacctgaacctgaagggccccagcctgaagggggacctggatgcctctgtgcccagcatgaaggtgcacgcccctggcctgaacctgagcggcgtgggcggcaagatgcaggtgggcggagatggagtgaaggtgcccggcattgatgccaccaccaagctgaatgtgggcgccccagatgtgaccctgcggggccccagcctgcagggcgacctggccgtgtctggggacatcaagtgccccaaggtgtctgtgggcgccccagacctgagcctggaggccagcgagggcagcatcaagctgcccaagatgaagctgccccagtttggcatcagcaccccaggcagtgacctgcacgtgaatgccaagggcccccaggtgtctggagagctgaagggccctggggtggatgtgaacctgaagggcccccgcatcagcgccccaaatgtggacttcaacctggagggccccaaggtgaagggcagcctgggcgccaccggggagatcaagggccccaccgtgggcggcggcctgcccggcattggagtgcagggcctggagggcaacctgcagatgcctggcatcaagagcagcggctgtgatgtgaacctgcccggggtgaatgtgaagctgcccaccggccagatcagcggccctgagatcaagggcggcctgaagggcagcgaggtgggcttccatggagctgccccagacatctctgtgaagggccctgccttcaacatggccagccctgagagtgactttggcatcaacctgaagggccccaagatcaagggcggcgcagatgtgtctggaggagtgtctgccccagacatcagcctgggggagggccacctgtctgtgaagggcagcggcggggagtggaagggcccccaggtgagcagcgccctgaacctggacaccagcaagtttgctgggggcctgcacttcagcggccccaaggtggagggcggcgtgaagggcggccagatcggcctgcaggcccctggcctgtctgtgtctggcccccagggccacctggagagcggcagcggcaaggtgaccttccccaagatgaagatccccaagttcaccttcagcggccgggagctggtgggccgggagatgggcgtggatgtgcacttccccaaggccgaggccagcatccaggccggggctggagatggagagtgggaggagagcgaggtgaagctgaagaagagcaagatcaagatgcccaagttcaacttcagcaagcccaagggcaaaggaggagtgacaggcagccctgaggccagcatcagcggcagcaagggggacctgaagagcagcaaggccagcctgggcagcctggagggggaggccgaggccgaggccagcagccccaagggcaagttcagcctcttcaagagcaagaagcccaggcacaggagcaacagcttcagtgatgagcgggagttcagcggccccagcacccccaccggcaccctggagtttgaaggaggagaggtgtccctggagggcggcaaggtgaagggcaagcacggcaagctgaagtttggcacctttggaggcctgggcagcaagagcaagggccactatgaggtgactggaagtgatgatgaaacaggcaagctgcagggcagcggcgtgtccctggccagcaagaagagccggctgagcagcagcagcagcaatgacagcggcaacaaggtgggcatccagctgcctgaggtggagctgtctgtgtccaccaagaaggagtag

SEQ ID NO: 18291 - DNA, 372 bp, Artificial Sequence
  Description of Artificial Sequence: Synthetic coding sequence
atggagaaggaggagaccacccgggagctgctgctgcccaactggcagggcagcggcagccacggcctgaccatcgcccagagagatgatggagtgtttgtgcaggaggtgacccagaacagccctgctgccaggactggagtggtgaaggagggggaccagatcgtgggcgccaccatctactttgacaacctgcagagcggggaggtgacccagctgctgaacaccatgggccaccacacagtgggcctgaagctgcacaggaaaggagacaggagccctgagcccggccagacctggacccgggaggtgttcagcagctgcagcagcgaggtggtgctgtctggagatgatgaggagtaccagaggtag

SEQ ID NO: 18292 - DNA, 435 bp, Artificial Sequence
  Description of Artificial Sequence: Synthetic coding sequence
atggagaaggaggagaccacccgggagctgctgctgcccaactggcagggcagcggcagccacggcctgaccatcgcccagagagatgatggagtgtttgtgcaggaggtgacccagaacagccctgctgccaggactggagtggtgaaggagggggaccagatcgtgggcgccaccatctactttgacaacctgcagagcggggaggtgacccagctgctgaacaccatgggccaccacacagtgggcctgaagctgcacaggaaaggagacaggagccctgagcccggccagacctggacccgggaggtgttcagcagctgcagcagcgaggtggtgctgtctggagatgatgaggagtaccagaggatctacaccaccaagatcaagccccggctgaagtcagaagatggagtggagggggacctgggctag

SEQ ID NO: 18293 - DNA, 261 bp, Artificial Sequence
  Description of Artificial Sequence: Synthetic coding sequence
atggagaaggaggagaccacccgggagctgctgctgcccaactggcagggcagcggcagccacggcctgaccatcgcccagagagatgatggagtgtttgtgcaggaggtgacccagaacagccctgctgccaggactggagtggtgaaggagggggaccagatcgtgggcgccaccatctactttgacaacctgcagagcggggaggtgacccagctgctgaacaccatgggccaccacacagtgggcctgaagctgtag

SEQ ID NO: 18294 - DNA, 366 bp, Artificial Sequence
  Description of Artificial Sequence: Synthetic coding sequence
atggagaaggaggagaccacccgggagctgctgctgcccaactggcagggcagcggcagccacggcctgaccatcgcccagagagatgatggagtgtttgtgcaggaggtgacccagaacagccctgctgccaggactggagtggtgaaggagggggaccagatcgtgggcgccaccatctactttgacaacctgcagagcggggaggtgacccagctgctgaacaccatgggccaccacacagtgggcctgaagctgcacaggaaaggagacaggagccctgagcccggccagacctggacccgggaggtgttcagcagctgcagcagcgaggtggtgctgaacaccccccagcccagcgcctag

SEQ ID NO: 18295 - DNA, 2904 bp, Artificial Sequence
  Description of Artificial Sequence: Synthetic coding sequence
atggccaagggcttctacatcagcaagagcctgggcatcctgggcatcctgctgggcgtggccgctgtgtgcaccatcatcgccctgtctgtggtgtacagccaggagaagaacaagaatgccaacagcagccctgtggccagcaccacccccagcgccagcgccaccaccaacccagccagcgccaccaccctggaccagagcaaggcctggaaccgctaccgcctgcccaacaccctgaagccagacagctacagagtgaccctgcggccctacctgaccccaaatgaccggggcctgtatgtgttcaagggcagcagcacagtgcgcttcacctgcaaggaggccacagatgtgatcatcatccacagcaagaagctgaactacaccctgagccagggccaccgggtggtgctgcggggcgtgggcggcagccagcccccagacatcgacaagacagagctggtggagcccacagagtacctggtggtgcacctgaagggcagcctggtgaaggacagccagtatgagatggacagcgagtttgaaggagagctggctgatgacctggccggcttctacagaagtgagtacatggagggcaatgtgaggaaggtggtggccaccacccagatgcaggccgcagatgccaggaagagcttcccctgctttgatgagcccgccatgaaggccgagttcaacatcaccctcatccaccccaaggacctgacagccctgagcaacatgctgcccaagggccccagcacccccctgcctgaggaccccaactggaatgtgacagagttccacaccacccccaagatgagcacctacctgctggccttcatcgtgtctgaatttgattatgtggagaagcaggccagcaatggagtgctgatccgcatctgggcccggcccagcgccatcgctgctggccatggagactatgccctgaatgtgacaggccccatcctgaacttctttgctggccactatgacaccccctaccccctgcccaagagtgaccagatcggcctgcctgacttcaatgctggggccatggagaactggggcctggtgacctaccgggagaacagcctgctgtttgaccccctgagcagcagcagcagcaacaaggagcgggtggtgaccgtcatcgcccacgagctggcccaccagtggtttggaaacctggtgaccatcgagtggtggaatgacctgtggctgaatgaaggatttgccagctatgtggagtacctgggcgctgactatgcagagcccacctggaacctgaaggacctgatggtgctgaatgatgtgtacagagtgatggctgtggatgccctggccagcagccaccccctgagcaccccagccagcgagatcaacaccccagcccagatcagcgagctgtttgatgccatctcctacagcaaaggagcctctgtgctgaggatgctgagcagcttcctgtctgaagatgtgttcaagcagggcctggccagctacctgcacacctttgcctaccagaacaccatctacctgaacctgtgggaccacctgcaggaggccgtgaacaacagaagcatccagctgcccaccaccgtgcgggacatcatgaaccgctggaccctgcagatgggcttccctgtgatcaccgtggacaccagcacaggcaccctgagccaggagcacttcctgctggaccctgacagcaatgtgacccggcccagcgagttcaactacgtgtggatcgtgcccatcaccagcatcagagatggccggcagcagcaggactactggctgattgatgtgcgggcccagaatgacctcttcagcaccagcggaaatgagtgggtgctgctgaacctgaatgtgacaggctactacagagtgaactatgatgaggagaactggaggaagatccagacccagctgcagagggaccacagcgccatccctgtgatcaacagagcccagatcatcaatgatgccttcaacctggccagcgcccacaaggtgcctgtgaccctggccctgaacaacaccctcttcctgattgaggagcggcagtacatgccctgggaggccgccctgagcagcctgagctacttcaagctgatgtttgacagaagtgaggtgtatggccccatgaagaactacctgaagaagcaggtgacccccctcttcatccacttcaggaacaacaccaacaactggagggagatccctgagaacctgatggaccagtacagcgaggtgaatgccatcagcacagcctgcagcaatggagtgcctgaatgtgaggagatggtgtctggcctcttcaagcagtggatggagaaccccaacaacaaccccatccaccccaacctgcggagcacagtgtactgcaatgccatcgcccagggcggggaggaggagtgggactttgcctgggagcagttcagaaatgccaccctggtgaatgaagctgacaagctgcgggccgccctggcctgcagcaaggagctgtggatcctgaaccgctacctgagctacaccctgaacccagacctgatcaggaagcaggatgccaccagcaccatcatcagcatcaccaacaacgtgattggccagggcctggtgtgggactttgtgcagagcaactggaagaagctgttcaatgactatggaggcggcagcttctccttcagcaacctgatccaggccgtgacccggcgcttcagcacagaatatgagctgcagcagctggagcagttcaagaaggacaatgaggagaccggcttcggcagcggcacccgggccctggagcaggccctggagaagaccaaggccaacatcaagtgggtgaaggagaacaaggaggtggtgctgcagtggttcacagagaacagcaagtag

SEQ ID NO: 18296 - DNA, 312 bp, Artificial Sequence
  Description of Artificial Sequence: Synthetic coding sequence
atggccaagggcttctacatcagcaagagcctgggcatcctgggcatcctgctgggcgtggccgctgtgtgcaccatcatcgccctgtctgtggtgtacagccaggagaagaacaagaatgccaacagcagccctgtggccagcaccacccccagcgccagcgccaccaccaacccagccagcgccaccaccctggaccagagcaaggcctggaaccgctaccgcctgcccaacaccctgaagccagacagctacagagtgaccctgcggccctacctgaccccaaatgaccggggcctgtatgtgttctag

SEQ ID NO: 18297 - DNA, 186 bp, Artificial Sequence
  Description of Artificial Sequence: Synthetic coding sequence
atggccaagggcttctacatcagcaagagcctgggcatcctgggcatcctgctgggcgtggccgctgtgtgcaccatcatcgccctgtctgtggtgtacagccaggagaagaacaagaatgccaacagcagccctgtggccagcaccacccccagcgccagcgccaccaccaacccagccagctag

SEQ ID NO: 18298 - DNA, 381 bp, Artificial Sequence
  Description of Artificial Sequence: Synthetic coding sequence
atgaaccagaacacagacaagatcagcggcagcggcagcaacagcgacatgatggagaacagcaaggaggagggcaccagcagcagcgagaagagcaagagcagcggcagcagccgcagcaagaggaagcccagcatcgtgaccaagtatgtggagagtgatgatgagaagcccctggatgatgaaacagtgaatgaagatgccagcaatgaaaattctgaaaatgacatcaccatgcagagcctgcccaagggcaccgtcatcgtgcagcctgagcctgtgctgaatgaagacaaggatgacttcaagggccctgagttccgcagccgcagcaagatgaagacagagaacctgaagaagaggggcggcaagtacaagtag

SEQ ID NO: 18299 - DNA, 7479 bp, Artificial Sequence
  Description of Artificial Sequence: Synthetic coding sequence
atgacagctgagcccatgtctgagagcaagctgaacaccctggtgcagaagctgcatgacttcctggcccacagcagcgaggagagcgaggagaccagcagccccccccggctggccatgaaccagaacacagacaagatcagcggcagcggcagcaacagcgacatgatggagaacagcaaggaggagggcaccagcagcagcgagaagagcaagagcagcggcagcagccgcagcaagaggaagcccagcatcgtgaccaagtatgtggagagtgatgatgagaagcccctggatgatgagaccgtgaatgaagatgccagcaatgaaaattctgaaaatgacatcaccatgcagagcctgcccaagggcaccgtgattgtgcagcctgagcctgtgctgaatgaagacaaggatgacttcaagggccctgagttccgcagccgcagcaagatgaagacagagaacctgaagaagagaggagaagatggcctgcacggcatcgtgtcctgcacagcctgtggccagcaggtgaaccacttccagaaggacagcatctaccgccaccccagcctgcaggtgctgatctgcaagaactgcttcaagtactacatgtctgatgacatcagccgggacagtgatggcatggatgagcagtgccgctggtgtgccgagggcggcaacctgatctgctgtgacttctgccacaatgccttctgcaagaagtgcatcctgaggaacctgggcaggaaggagctgagcaccatcatggatgagaacaaccagtggtactgctacatctgccaccctgagcccctgctggacctggtgacagcctgcaacagcgtgtttgagaacctggagcagctgctgcagcagaacaagaagaagatcaaggtggacagcgagaagagcaacaaggtgtatgagcacaccagccgcttcagccccaagaagaccagcagcaactgcaatggagaggagaagaagctggatgacagctgcagcggctctgtgacctacagctacagcgccctgattgtgcccaaggagatgatcaagaaggccaagaagctgattgagaccacagccaacatgaacagcagctatgtgaagttcctgaagcaggccacagacaacagcgagatcagcagcgccaccaagctgcggcagctgaaggccttcaagtctgtgctggccgacatcaagaaggcccacctggccctggaggaggacctgaacagcgagttccgggccatggatgctgtgaacaaggagaagaacaccaaggagcacaaggtgattgatgccaagtttgagaccaaggccaggaaaggagagaagccctgtgccctggagaagaaggacatcagcaagtctgaggccaagctgagcaggaagcaggtggacagcgagcacatgcaccagaatgtgcccacagaggagcagaggaccaacaagagcactggaggagagcacaagaagagtgacaggaaggaggagccccagtatgagcccgccaacaccagcgaggacctggacatggacatcgtgtctgtgcccagctctgtgcctgaggacatctttgagaacctggagacagccatggaggtgcagagctctgtggaccaccagggagatggcagcagcggcacagagcaggaggtggagagcagctctgtgaagctgaacatcagcagcaaggacaacagaggaggcatcaagagcaagaccacagccaaggtgaccaaggagctgtatgtgaagctgacccctgtgtccctgagcaacagccccatcaagggagctgactgccaggaggtgccccaggacaaggatggctacaagagctgtggcctgaaccccaagctggagaagtgtggcctgggccaggagaacagcgacaatgagcacctggtggagaatgaggtgtccctgctgctggaggagagtgacctgcggcgcagcccccgggtgaagaccacccccctgcggcggcccacagagaccaaccctgtgaccagcaacagtgatgaggagtgcaatgagaccgtgaaggagaagcagaagctgtctgtgcctgtgaggaagaaggacaagaggaacagcagtgacagcgccatcgacaaccccaagcccaacaagctgcccaagagcaagcagagcgagaccgtggaccagaacagcgacagtgatgagatgctggccatcctgaaggaggtgtccaggatgagccacagcagcagcagtgacacagacatcaatgagatccacaccaaccacaagaccctgtatgacctgaagacccaggccggcaaggatgacaagggcaagaggaagaggaagagcagcaccagcggcagtgactttgacaccaagaagggcaagagcgccaagagcagcatcatcagcaagaagaagaggcagacccagagcgagagcagcaactatgattctgagctggagaaggagatcaagtccatgagcaagattggagctgcccggaccaccaagaagaggatccccaacaccaaggactttgacagcagtgaagatgagaagcacagcaagaagggcatggacaaccagggccacaagaacctgaagaccagccaggagggcagcagtgatgatgctgagaggaagcaggagcgggagaccttcagcagcgctgagggcaccgtggacaaggacaccaccatcatggagctgcgggaccggctgcccaagaagcagcaggccagcgccagcacagatggagtggacaagctgagcggcaaggagcagagcttcaccagcctggaggtgaggaaggtggccgagaccaaggagaagagcaagcacctgaagaccaagacctgcaagaaggtgcaggacggcctgagtgacattgctgagaagttcctgaagaaggaccagagtgatgagaccagtgaagatgacaagaagcagagcaagaagggcacagaggagaagaagaagcccagcgacttcaagaagaaggtgatcaagatggagcagcagtatgagagcagcagtgatggaacagagaagctgcctgagcgggaggagatctgccacttccccaagggcatcaagcagatcaagaatggcaccacagatggagagaagaagagcaagaagatccgggacaagaccagcaagaagaaggatgagctgagtgactatgcagagaagagcacaggcaagggggacagctgtgacagcagcgaggacaagaagagcaagaatggagcctacggccgggagaagaagcgctgcaagctgctgggcaagagcagcaggaagaggcaggactgcagcagcagtgacacagagaagtacagcatgaaggaggatggctgcaacagcagtgacaagaggctgaagagaattgagctgcgggagaggaggaacctgagcagcaagaggaacaccaaggagatccagagcggcagcagcagcagtgatgctgaggagagcagcgaggacaacaagaagaagaagcagaggaccagcagcaagaagaaggccgtcatcgtgaaggagaagaagaggaacagcctgcggaccagcaccaagaggaagcaggccgacatcaccagcagcagcagcagtgacattgaagatgatgaccagaacagcatcggggagggcagcagtgatgagcagaagatcaagcctgtgacagagaacctggtgctgagcagccacacaggcttctgccagagcagtggagatgaggccctgagcaagtctgtgcctgtgacagtggatgatgatgatgatgacaatgaccctgagaacagaattgccaagaagatgctgctggaggagatcaaggccaacctgagcagtgatgaagatggcagcagtgatgatgagcctgaggagggcaagaagaggacaggcaagcagaatgaagaaaatcctggagatgaggaggccaagaaccaggtgaacagcgagagtgacagcgacagcgaggagagcaagaagccccgctaccgccaccggctgctgcggcacaagctgactgtgtctgatggagagagcggggaggagaagaagaccaagcccaaggagcacaaggaggtgaagggcaggaacagaaggaaggtgtccagtgaagattctgaggacagcgacttccaggagagcggcgtgtctgaggaggtgtctgagagtgaagatgagcagaggcccaggaccaggtctgccaagaaggccgagctggaggagaaccagaggagctacaagcagaagaagaagagaagacgcatcaaggtgcaggaggacagcagcagcgagaacaagagcaacagcgaggaggaggaggaggagaaggaggaggaggaggaggaggaggaggaggaggaggaggaggaggaggatgaaaatgatgacagcaagagccctggaaaaggaaggaagaagatcaggaagatcctgaaggatgacaagctgaggacagagacccagaatgccctgaaggaggaggaggagaggaggaagagaattgctgagcgggagcgggagcgggagaagctgcgggaggtgattgaaattgaagatgccagccccaccaagtgccccatcaccaccaagctggtgctggatgaagatgaggagaccaaggagcccctggtgcaggtgcacaggaacatggtgatcaagctgaagccccaccaggtggatggagtgcagttcatgtgggactgctgctgtgagagcgtgaagaagaccaagaagagccctggcagcggctgcatcctggcccactgcatgggcctgggcaagaccctgcaggtggtgtccttcctgcacacagtgctgctgtgtgacaagctggacttcagcacagccctggtggtgtgccccctgaacacagccctgaactggatgaatgaatttgagaagtggcaggagggcctgaaggatgatgagaagctggaggtgtctgagctggccaccgtgaagaggccccaggagaggagctacatgctgcagcgctggcaggaggatggaggagtgatgatcatcggctatgagatgtacagaaacctggcccagggcagaaatgtgaagagcaggaagctgaaggagatcttcaacaaggccctggtggaccccggccctgactttgtggtgtgtgatgagggccacatcctgaagaatgaggccagcgctgtgtccaaggccatgaacagcatccgcagcagaagacgcatcatcctgaccggcacccccctgcagaacaacctgattgagtaccactgcatggtgaacttcatcaaggagaacctgctgggcagcatcaaggagttcaggaaccgcttcatcaaccccatccagaatggccagtgtgccgacagcaccatggtggatgtgcgggtgatgaagaagagggcccacatcctgtatgagatgctggccggctgtgtgcagaggaaggactacacagccctgaccaagttcctgccccccaagcatgaatatgtgctggccgtgaggatgaccagcatccagtgcaagctgtaccagtactacctggaccacctgactggagtgggcaacaacagcgagggcggccggggcaaggccggggccaagctgttccaggacttccagatgctgagccgcatctggacccacccctggtgcctgcagctggactacatcagcaaagaaaataaaggctactttgatgaggacagcatggatgagttcatcgccagtgacagtgatgagacctccatgagcctgagcagtgatgactacaccaagaagaagaagaagggcaagaagggcaagaaggacagcagcagcagcggcagcggcagtgacaatgatgtggaggtgatcaaggtgtggaacagccgcagccggggcggcggggagggcaatgtggatgaaacaggcaacaaccccagcgtgtccctgaagctggaggagagcaaggccaccagcagcagcaaccccagcagccctgccccagactggtacaaggactttgtgacagatgctgatgctgaggtgctggagcacagcggcaagatggtgctgctgtttgagatcctgaggatggccgaggagattggagacaaggtgctggtgttcagccagagcctcatcagcctggacctgattgaggacttcctggagctggccagccgggagaagacagaggacaaggacaagcccctcatctacaagggggagggcaagtggctgagaaatattgactactaccgcctggatggcagcaccacagcccagagcaggaagaagtgggccgaggagttcaatgatgagaccaacgtgcggggccgcctcttcatcatcagcaccaaggccggcagcctgggcatcaacctggtggccgccaacagagtcatcatctttgatgcctcctggaaccccagctatgacatccagagcatcttccgggtgtaccgcttcggccagaccaagcctgtgtatgtgtaccgcttcctggcccagggcaccatggaggacaagatctatgaccggcaggtgaccaagcagagcctgtccttccgggtggtggaccagcagcaggtggagcggcacttcaccatgaatgagctgacagagctgtacacctttgagccagacctgctggatgaccccaacagcgagaagaagaagaagagggacacccccatgctgcccaaggacaccatcctggccgagctgctgcagatccacaaggagcacatcgtgggctaccacgagcatgacagcctgctggaccacaaggaggaggaggagctgacagaggaggagaggaaggccgcctgggccgagtatgaggccgagaagaagggcctgaccatgaggttcaacatccccaccggcaccaacctgccccctgtgtccttcaacagccagaccccctacatccccttcaacctgggcgccctgagcgccatgagcaaccagcagctggaggacctgatcaaccagggccgggagaaggtggtggaggccaccaacagcgtgacagctgtgcgcatccagcccctggaggacatcatctctgctgtgtggaaggagaacatgaacctgtctgaggcccaggtgcaggccctggccctgagccggcaggccagccaggagctggatgtgaagaggcgggaggccatctacaatgatgtgctgaccaagcagcagatgctgatcagctgtgtgcagaggatcctgatgaacagaaggctgcagcagcagtacaaccagcagcagcagcagcagatgacctaccagcaggccaccctgggccacctgatgatgcccaagccacccaacctgatcatgaaccccagcaactaccagcagattgacatgaggggcatgtaccagcctgtggccggcggcatgcagcccccacccctgcagagggcccccccacccatgaggagcaagaaccctggccccagccagggcaagtccatgtag

SEQ ID NO: 18300 - DNA, 7365 bp, Artificial Sequence
  Description of Artificial Sequence: Synthetic coding sequence
atgacagctgagcccatgtctgagagcaagctgaacaccctggtgcagaagctgcatgacttcctggcccacagcagcgaggagagcgaggagaccagcagccccccccggctggccatgaaccagaacacagacaagatcagcggcagcggcagcaacagcgacatgatggagaacagcaaggaggagggcaccagcagcagcgagaagagcaagagcagcggcagcagccgcagcaagaggaagcccagcatcgtgaccaagtatgtggagagtgatgatgagaagcccctggatgatgagaccgtgaatgaagatgccagcaatgaaaattctgaaaatgacatcaccatgcagagcctgcccaaggaggatggcctgcacggcatcgtgtcctgcacagcctgtggccagcaggtgaaccacttccagaaggacagcatctaccgccaccccagcctgcaggtgctgatctgcaagaactgcttcaagtactacatgtctgatgacatcagccgggacagtgatggcatggatgagcagtgccgctggtgtgccgagggcggcaacctgatctgctgtgacttctgccacaatgccttctgcaagaagtgcatcctgaggaacctgggcaggaaggagctgagcaccatcatggatgagaacaaccagtggtactgctacatctgccaccctgagcccctgctggacctggtgacagcctgcaacagcgtgtttgagaacctggagcagctgctgcagcagaacaagaagaagatcaaggtggacagcgagaagagcaacaaggtgtatgagcacaccagccgcttcagccccaagaagaccagcagcaactgcaatggagaggagaagaagctggatgacagctgcagcggctctgtgacctacagctacagcgccctgattgtgcccaaggagatgatcaagaaggccaagaagctgattgagaccacagccaacatgaacagcagctatgtgaagttcctgaagcaggccacagacaacagcgagatcagcagcgccaccaagctgcggcagctgaaggccttcaagtctgtgctggccgacatcaagaaggcccacctggccctggaggaggacctgaacagcgagttccgggccatggatgctgtgaacaaggagaagaacaccaaggagcacaaggtgattgatgccaagtttgagaccaaggccaggaaaggagagaagccctgtgccctggagaagaaggacatcagcaagtctgaggccaagctgagcaggaagcaggtggacagcgagcacatgcaccagaatgtgcccacagaggagcagaggaccaacaagagcactggaggagagcacaagaagagtgacaggaaggaggagccccagtatgagcccgccaacaccagcgaggacctggacatggacatcgtgtctgtgcccagctctgtgcctgaggacatctttgagaacctggagacagccatggaggtgcagagctctgtggaccaccagggagatggcagcagcggcacagagcaggaggtggagagcagctctgtgaagctgaacatcagcagcaaggacaacagaggaggcatcaagagcaagaccacagccaaggtgaccaaggagctgtatgtgaagctgacccctgtgtccctgagcaacagccccatcaagggagctgactgccaggaggtgccccaggacaaggatggctacaagagctgtggcctgaaccccaagctggagaagtgtggcctgggccaggagaacagcgacaatgagcacctggtggagaatgaggtgtccctgctgctggaggagagtgacctgcggcgcagcccccgggtgaagaccacccccctgcggcggcccacagagaccaaccctgtgaccagcaacagtgatgaggagtgcaatgagaccgtgaaggagaagcagaagctgtctgtgcctgtgaggaagaaggacaagaggaacagcagtgacagcgccatcgacaaccccaagcccaacaagctgcccaagagcaagcagagcgagaccgtggaccagaacagcgacagtgatgagatgctggccatcctgaaggaggtgtccaggatgagccacagcagcagcagtgacacagacatcaatgagatccacaccaaccacaagaccctgtatgacctgaagacccaggccggcaaggatgacaagggcaagaggaagaggaagagcagcaccagcggcagtgactttgacaccaagaagggcaagagcgccaagagcagcatcatcagcaagaagaagaggcagacccagagcgagagcagcaactatgattctgagctggagaaggagatcaagtccatgagcaagattggagctgcccggaccaccaagaagaggatccccaacaccaaggactttgacagcagtgaagatgagaagcacagcaagaagggcatggacaaccagggccacaagaacctgaagaccagccaggagggcagcagtgatgatgctgagaggaagcaggagcgggagaccttcagcagcgctgagggcaccgtggacaaggacaccaccatcatggagctgcgggaccggctgcccaagaagcagcaggccagcgccagcacagatggagtggacaagctgagcggcaaggagcagagcttcaccagcctggaggtgaggaaggtggccgagaccaaggagaagagcaagcacctgaagaccaagacctgcaagaaggtgcaggacggcctgagtgacattgctgagaagttcctgaagaaggaccagagtgatgagaccagtgaagatgacaagaagcagagcaagaagggcacagaggagaagaagaagcccagcgacttcaagaagaaggtgatcaagatggagcagcagtatgagagcagcagtgatggaacagagaagctgcctgagcgggaggagatctgccacttccccaagggcatcaagcagatcaagaatggcaccacagatggagagaagaagagcaagaagatccgggacaagaccagcaagaagaaggatgagctgagtgactatgcagagaagagcacaggcaagggggacagctgtgacagcagcgaggacaagaagagcaagaatggagcctacggccgggagaagaagcgctgcaagctgctgggcaagagcagcaggaagaggcaggactgcagcagcagtgacacagagaagtacagcatgaaggaggatggctgcaacagcagtgacaagaggctgaagagaattgagctgcgggagaggaggaacctgagcagcaagaggaacaccaaggagatccagagcggcagcagcagcagtgatgctgaggagagcagcgaggacaacaagaagaagaagcagaggaccagcagcaagaagaaggccgtcatcgtgaaggagaagaagaggaacagcctgcggaccagcaccaagaggaagcaggccgacatcaccagcagcagcagcagtgacattgaagatgatgaccagaacagcatcggggagggcagcagtgatgagcagaagatcaagcctgtgacagagaacctggtgctgagcagccacacaggcttctgccagagcagtggagatgaggccctgagcaagtctgtgcctgtgacagtggatgatgatgatgatgacaatgaccctgagaacagaattgccaagaagatgctgctggaggagatcaaggccaacctgagcagtgatgaagatggcagcagtgatgatgagcctgaggagggcaagaagaggacaggcaagcagaatgaagaaaatcctggagatgaggaggccaagaaccaggtgaacagcgagagtgacagcgacagcgaggagagcaagaagccccgctaccgccaccggctgctgcggcacaagctgactgtgtctgatggagagagcggggaggagaagaagaccaagcccaaggagcacaaggaggtgaagggcaggaacagaaggaaggtgtccagtgaagattctgaggacagcgacttccaggagagcggcgtgtctgaggaggtgtctgagagtgaagatgagcagaggcccaggaccaggtctgccaagaaggccgagctggaggagaaccagaggagctacaagcagaagaagaagagaagacgcatcaaggtgcaggaggacagcagcagcgagaacaagagcaacagcgaggaggaggaggaggagaaggaggaggaggaggaggaggaggaggaggaggaggaggaggaggaggatgaaaatgatgacagcaagagccctggaaaaggaaggaagaagatcaggaagatcctgaaggatgacaagctgaggacagagacccagaatgccctgaaggaggaggaggagaggaggaagagaattgctgagcgggagcgggagcgggagaagctgcgggaggtgattgaaattgaagatgccagccccaccaagtgccccatcaccaccaagctggtgctggatgaagatgaggagaccaaggagcccctggtgcaggtgcacaggaacatggtgatcaagctgaagccccaccaggtggatggagtgcagttcatgtgggactgctgctgtgagagcgtgaagaagaccaagaagagccctggcagcggctgcatcctggcccactgcatgggcctgggcaagaccctgcaggtggtgtccttcctgcacacagtgctgctgtgtgacaagctggacttcagcacagccctggtggtgtgccccctgaacacagccctgaactggatgaatgaatttgagaagtggcaggagggcctgaaggatgatgagaagctggaggtgtctgagctggccaccgtgaagaggccccaggagaggagctacatgctgcagcgctggcaggaggatggaggagtgatgatcatcggctatgagatgtacagaaacctggcccagggcagaaatgtgaagagcaggaagctgaaggagatcttcaacaaggccctggtggaccccggccctgactttgtggtgtgtgatgagggccacatcctgaagaatgaggccagcgctgtgtccaaggccatgaacagcatccgcagcagaagacgcatcatcctgaccggcacccccctgcagaacaacctgattgagtaccactgcatggtgaacttcatcaaggagaacctgctgggcagcatcaaggagttcaggaaccgcttcatcaaccccatccagaatggccagtgtgccgacagcaccatggtggatgtgcgggtgatgaagaagagggcccacatcctgtatgagatgctggccggctgtgtgcagaggaaggactacacagccctgaccaagttcctgccccccaagcatgaatatgtgctggccgtgaggatgaccagcatccagtgcaagctgtaccagtactacctggaccacctgactggagtgggcaacaacagcgagggcggccggggcaaggccggggccaagctgttccaggacttccagatgctgagccgcatctggacccacccctggtgcctgcagctggactacatcagcaaagaaaataaaggctactttgatgaggacagcatggatgagttcatcgccagtgacagtgatgagacctccatgagcctgagcagtgatgactacaccaagaagaagaagaagggcaagaagggcaagaaggacagcagcagcagcggcagcggcagtgacaatgatgtggaggtgatcaaggtgtggaacagccgcagccggggcggcggggagggcaatgtggatgaaacaggcaacaaccccagcgtgtccctgaagctggaggagagcaaggccaccagcagcagcaaccccagcagccctgccccagactggtacaaggactttgtgacagatgctgatgctgaggtgctggagcacagcggcaagatggtgctgctgtttgagatcctgaggatggccgaggagattggagacaaggtgctggtgttcagccagagcctcatcagcctggacctgattgaggacttcctggagctggccagccgggagaagacagaggacaaggacaagcccctcatctacaagggggagggcaagtggctgagaaatattgactactaccgcctggatggcagcaccacagcccagagcaggaagaagtgggccgaggagttcaatgatgagaccaacgtgcggggccgcctcttcatcatcagcaccaaggccggcagcctgggcatcaacctggtggccgccaacagagtcatcatctttgatgcctcctggaaccccagctatgacatccagagcatcttccgggtgtaccgcttcggccagaccaagcctgtgtatgtgtaccgcttcctggcccagggcaccatggaggacaagatctatgaccggcaggtgaccaagcagagcctgtccttccgggtggtggaccagcagcaggtggagcggcacttcaccatgaatgagctgacagagctgtacacctttgagccagacctgctggatgaccccaacagcgagaagaagaagaagagggacacccccatgctgcccaaggacaccatcctggccgagctgctgcagatccacaaggagcacatcgtgggctaccacgagcatgacagcctgctggaccacaaggaggaggaggagctgacagaggaggagaggaaggccgcctgggccgagtatgaggccgagaagaagggcctgaccatgaggttcaacatccccaccggcaccaacctgccccctgtgtccttcaacagccagaccccctacatccccttcaacctgggcgccctgagcgccatgagcaaccagcagctggaggacctgatcaaccagggccgggagaaggtggtggaggccaccaacagcgtgacagctgtgcgcatccagcccctggaggacatcatctctgctgtgtggaaggagaacatgaacctgtctgaggcccaggtgcaggccctggccctgagccggcaggccagccaggagctggatgtgaagaggcgggaggccatctacaatgatgtgctgaccaagcagcagatgctgatcagctgtgtgcagaggatcctgatgaacagaaggctgcagcagcagtacaaccagcagcagcagcagcagatgacctaccagcaggccaccctgggccacctgatgatgcccaagccacccaacctgatcatgaaccccagcaactaccagcagattgacatgaggggcatgtaccagcctgtggccggcggcatgcagcccccacccctgcagagggcccccccacccatgaggagcaagaaccctggccccagccagggcaagtccatgtag

SEQ ID NO: 18301 - DNA, 369 bp, Artificial Sequence
  Description of Artificial Sequence: Synthetic coding sequence
atcaactacaacagagacaagatcagcggcagcggcagcaacagcgacatgatggagaacagcaaggaggagggcaccagcagcagcgagaagagcaagagcagcggcagcagccgcagcaagaggaagcccagcatcgtgaccaagtatgtggagagtgatgatgagaagcccctggatgatgaaacagtgaatgaagatgccagcaatgaaaattctgaaaatgacatcaccatgcagagcctgcccaagggcaccgtcatcgtgcagcctgagcctgtgctgaatgaagacaaggatgacttcaagggccctgagttccgcagccgcagcaagatgaagacagagaacctgaagaagaggggctag

SEQ ID NO: 18302 - DNA, 4038 bp, Artificial Sequence
  Description of Artificial Sequence: Synthetic coding sequence
atgtctgagagcaagctgaacaccctggtgcagaagctgcatgacttcctggcccacagcagcgaggagagcgaggagaccagcagccccccccggctggccatgaaccagaacacagacaagatcagcggcagcggcagcaacagcgacatgatggagaacagcaaggaggagggcaccagcagcagcgagaagagcaagagcagcggcagcagccgcagcaagaggaagcccagcatcgtgaccaagtatgtggagagtgatgatgagaagcccctggatgatgaaacagtgaatgaagatgccagcaatgaaaattctgaaaatgacatcaccatgcagagcctgcccaaggatggcctgcacggcatcgtgtcctgcacagcctgtggccagcaggtgaaccacttccagaaggacagcatctaccgccaccccagcctgcaggtgctgatctgcaagaactgcttcaagtactacatgtctgatgacatcagccgggacagtgatggcatggatgagcagtgccgctggtgtgccgagggcggcaacctgatctgctgtgacttctgccacaatgccttctgcaagaagtgcatcctgaggaacctgggcaggaaggagctgagcaccatcatggatgagaacaaccagtggtactgctacatctgccaccctgagcccctgctggacctggtgacagcctgcaacagcgtgtttgagaacctggagcagctgctgcagcagaacaagaagaagatcaaggtggacagcgagaagagcaacaaggtgtatgagcacaccagccgcttcagccccaagaagaccagcagcaactgcaatggagaggagaagaagctggatgacagctgcagcggctctgtgacctacagctacagcgccctgattgtgcccaaggagatgatcaagaaggccaagaagctgattgagaccacagccaacatgaacagcagctatgtgaagttcctgaagcaggccacagacaacagcgagatcagcagcgccaccaagctgcggcagctgaaggccttcaagtctgtgctggccgacatcaagaaggcccacctggccctggaggaggacctgaacagcgagttccgggccatggatgctgtgaacaaggagaagaacaccaaggagcacaaggtgattgatgccaagtttgagaccaaggccaggaaaggagagaagccctgtgccctggagaagaaggacatcagcaagtctgaggccaagctgagcaggaagcaggtggacagcgagcacatgcaccagaatgtgcccacagaggagcagaggaccaacaagagcactggaggagagcacaagaagagtgacaggaaggaggagccccagtatgagcccgccaacaccagcgaggacctggacatggacatcgtgtctgtgcccagctctgtgcctgaggacatctttgagaacctggagacagccatggaggtgcagagctctgtggaccaccagggagatggcagcagcggcacagagcaggaggtggagagcagctctgtgaagctgaacatcagcagcaaggacaacagaggaggagctgactgccaggaggtgccccaggacaaggatggctacaagagctgtggcctgaaccccaagctggagaagtgtggcctgggccaggagaacagcgacaatgagcacctggtggagaatgaggtgtccctgctgctggaggagagtgacctgcggcgcagcccccgggtgaagaccacccccctgcggcggcccacagagaccaaccctgtgaccagcaacagtgatgaagaatgtaatgaaacagtgaaggagaagcagaagctgtctgtgcctgtgaggaagaaggacaagaggaacagcagtgacagcgccatcgacaaccccaagcccaacaagctgcccaagagcaagcagagcgagaccgtggaccagaacagcgacagtgatgagatgctggccatcctgaaggaggtgtccaggatgagccacagcagcagcagtgacacagacatcaatgagatccacaccaaccacaagaccctgtatgacctgaagacccaggccggcaaggatgacaagggcaagaggaagaggaagagcagcaccagcggcagtgactttgacaccaagaagggcaagagcgccaagagcagcatcatcagcaagaagaagaggcagacccagagcgagagcagcaactatgacagcgagctggagaaggagatcaagtccatgagcaagatcggggccgcccggaccaccaagaagaggatccccaacaccaaggactttgacagcagtgaagatgagaagcacagcaagaagggcatggacaaccagggccacaagaacctgaagaccagccaggagggcagcagtgatgatgctgagaggaagcaggagcgggagaccttcagcagcgctgagggcaccgtggacaaggacaccaccatcatggagctgcgggaccggctgcccaagaagcagcaggccagcgccagcacagatggagtggacaagctgagcggcaaggagcagagcttcaccagcctggaggtgaggaaggtggccgagaccaaggagaagagcaagcacctgaagaccaagacctgcaagaaggtgcaggacggcctgagtgacattgctgagaagttcctgaagaaggaccagagtgatgagaccagtgaagatgacaagaagcagagcaagaagggcacagaggagaagaagaagcccagcgacttcaagaagaaggtgatcaagatggagcagcagtatgagagcagcagtgatggaacagagaagctgcctgagcgggaggagatctgccacttccccaagggcatcaagcagatcaagaatggcaccacagatggagagaagaagagcaagaagatccgggacaagaccagcaagaagaaggatgagctgagtgactatgcagagaagagcactggaaaaggagacagctgtgacagcagcgaggacaagaagagcaagaatggagcctacggccgggagaagaagcgctgcaagctgctgggcaagagcagcaggaagaggcaggactgcagcagcagtgacacagagaagtacagcatgaaggaggatggctgcaacagcagtgacaagaggctgaagagaattgagctgcgggagaggaggaacctgagcagcaagaggaacaccaaggagatccagagcggcagcagcagcagtgatgctgaggagagcagcgaggacaacaagaagaagaagcagaggaccagcagcaagaagaaggctgtgattgtgaaggagaagaagaggaacagcctgcggaccagcaccaagaggaagcaggccgacatcaccagcagcagcagcagtgacattgaagatgatgaccagaacagcattggagagggcagcagtgatgagcagaagatcaagcctgtgacagagaacctggtgctgagcagccacacaggcttctgccagagcagtggagatgaggccctgagcaagtctgtgcctgtgacagtggatgatgatgatgatgacaatgaccctgaaaatcgcatcgccaagaagatgctgctggaggagatcaaggccaacctgagcagtgatgaagatggcagcagtgatgatgagcctgaggagggcaagaagaggacaggcaagcagaatgaggagaaccctggagatgaggaggccaagaaccaggtgaacagcgagagtgacagcgacagcgaggagagcaagaagccccgctaccgccaccggctgctgcggcacaagctgactgtgtctgatggagagagcggggaggagaagaagaccaagcccaaggagcacaaggaggtgaagggcaggaacagaaggaaggtgtcctctgaggacagtgaagattctgacttccaggagagcggcgtgtctgaggaggtgtctgagagtgaagatgagcagaggcccaggaccaggtctgccaagaaggccgagctggaggagaaccagaggagctag

SEQ ID NO: 18303 - DNA, 483 bp, Artificial Sequence
  Description of Artificial Sequence: Synthetic coding sequence
tgaccagactttgtggtgtgtgatgagggccacatcctgaagaatgaggccagcgctgtgtccaaggccatgaacagcatccgcagcagaagacgcatcatcctgaccggcacccccctgcagaacaacctgattgagtaccactgcatggtgaacttcatcaaggagaacctgctgggcagcatcaaggagttcaggaaccgcttcatcaaccccatccagaatggccagtgtgccgacagcaccatggtggatgtgcgggtgatgaagaagagggcccacatcctgtatgagatgctggccggctgtgtgcagaggaaggactacacagccctgaccaagttcctgccccccaagcatgaatatgtgctggccgtgaggatgaccagcatccagtgcaagctgtaccagtactacctggaccacctgactgtgctgcacctgaacaagatgggcatgctgaagagcatcaagtacttctag

SEQ ID NO: 18304 - DNA, 2514 bp, Artificial Sequence
  Description of Artificial Sequence: Synthetic coding sequence
atgaaccacctggagggcagcgctgaggtggaggtgacagatgaggccgccggcggggaggtgaatgaatctgtggaggccgacctggagcaccctgaggtggaggaggagcagcagcagcccccccagcagcagcactacgtgggccgccaccagaggggccgggccctggaggacctgcgggcccagctgggccaggaggaggaggagagaggagaatgtctggcccggagcgccagcacagaaagtggcttccacaaccacacagacacagcagaaggagatgtgattgctgctgccagagatggctatgatgctgagcgggcccaggaccctgaagatgagagcgcctatgctgtgcagtacagacctgaggccgaggagtacacagagcaggccgaggccgagcacgccgaggccacccacagaagagccctgcccaaccacctgcacttccacagcctggagcacgaggaggccatgaatgctgcctacagcggctacgtgtacacccacaggctcttccacagaggagaagatgagccctacagcgagccctatgctgactatggaggcctgcaggagcacgtgtatgaggagattggagatgcccctgagctggatgccagagatggcctgcggctgtatgagcaggagagagatgaagctgctgcctaccggcaggaggccctgggcgcccggctgcaccactatgatgagaggagtgatggagagagtgacagccctgagaaggaggccgagtttgccccctaccccaggatggacagctatgagcaggaggaggacatcgaccagatcgtggccgaggtgaagcagagcatgagcagccagagcctggacaaggctgctgaggacatgcctgaggccgagcaggacctggagaggcctcccaccccagctgggggccgcccagacagccctggcctgcaggccccagctggccagcagagagctgtgggccctgctgggggcggggaggccggccagcgctacagcaaggagaagagagatgccatcagcctggccatcaaggacatcaaggaggccatcgaggaggtgaagaccaggaccatccgcagcccctacaccccagatgagcccaaggagcccatctgggtgatgaggcaggacatcagccccacccgggactgtgatgaccagaggcccatggatggagacagccccagccctggcagcagcagccccctgggcgctgagagcagcagcaccagcctgcaccccagcgaccctgtggaggccagcaccaacaaggagagcaggaagagcctggccagcttccccacctacgtggaggtgcccggcccctgtgaccctgaggacctgattgatggcatcatctttgctgccaactacctgggcagcacccagctgctgagtgacaagacccccagcaagaatgtgaggatgatgcaggcccaggaggccgtgagccgcatcaagatggcccagaagctggccaagagcaggaagaaggcccctgagggggagagccagcccatgacagaggtggacctcttcatcagcacccagaggatcaaggtgctgaatgctgacacccaggagaccatgatggaccaccccctgcggaccatctcctacatcgctgacatcggcaacatcgtggtgctgatggcccggcggaggatgcccaggagcaacagccaggagaatgtggaggccagccaccccagccaggacggcaagaggcagtacaagatgatctgccacgtgtttgaaagtgaagatgcccagctgattgcccagagcatcggccaggccttctctgtggcctaccaggagttcctgcgggccaacggcatcaaccctgaggacctgagccagaaggagtacagcgacctgctgaacacccaggacatgtacaatgatgacctgatccacttcagcaagtctgagaactgcaaggatgtgttcatcgagaagcagaagggggagatcctgggcgtggtgattgtggagagcggctggggcagcatcctgcccaccgtcatcatcgccaacatgatgcacggcggccctgctgagaagagcggcaagctgaacatcggggaccagatcatgagcatcaatggcaccagcctggtgggcctgcccctgagcacctgccagagcatcatcaagggcctgaagaaccagagccgggtgaagctgaacatcgtgcgctgcccccctgtgaccaccgtgctgatcagaagaccagacctgcgctaccagctgggcttctctgtgcagaatggcatcatctgcagcctgatgaggggcggcattgctgagcggggcggcgtgcgggtgggccaccgcatcatcgagatcaatggccagagcgtggtggccacccctcatgagaagatcgtgcacatcctgagcaatgctgtgggggagatccacatgaagaccatgcctgctgccatgtaccgcctgctgacagcccaggagcagcctgtgtacatctag

SEQ ID NO: 18305 - DNA, 2469 bp, Artificial Sequence
  Description of Artificial Sequence: Synthetic coding sequence
atggctgctgctgtggtggtggccgagggggacagcgacagccggcccggccaggagctgctggtggcctggaacacagtgtccacaggcctggtgcccccagctgccctgggcctggtgagcagcaggaccagcggggctgtgccccccaaggaggaggagctgcgggctgctgtggaggtgctgcggggccacggcctgcacagcgtgctggaggagtggtttgtggaggtgctgcagaatgacctgcaggccaacatcagccctgagttctggaatgccatcagccagtgtgaaaattctgcagatgagccccagtgcctgctgctgctgctggatgccttcggcctgctggagagccggctggacccctacctgcggagcctggagctgctggagaagtggacccggctgggcctgctgatgggcaccggggcccagggcctgcgggaggaggtgcacaccatgctgcggggcgtgctcttcttcagcacccccaggaccttccaggagatgatccagaggctgtatggctgcttcctgcgggtgtacatgcagagcaagaggaagggggagggcggcacagatcctgagctggagggggagctggacagccgctatgcccggcggcgctactaccgcctgctgcagagccccctgtgtgccggctgcagcagtgacaagcagcagtgctggtgccggcaggccctggagcagttccaccagctgagccaggtgctgcaccggctgagcctgctggagcgggtgtctgctgaggccgtgaccaccaccctgcaccaggtgacccgggagaggatggaggaccgctgccgcggggagtatgaaagaagcttcctgcgggagttccacaagtggattgagcgggtggtgggctggctgggcaaggtgttcctgcaggacggccctgcccggcctgccagccctgaggccggcaacaccctgcggcgctggcgctgccacgtgcagcgcttcttctaccgcatctatgccagcctgagaattgaggagctgttcagcatcgtgcgggacttcccagacagcaggcctgccatcgaggacctgaagtactgcctggagaggacagaccagaggcagcagctgctggtgtccctgaaggccgccctggagacccggctgctgcaccctggggtgaacacctgtgacatcatcaccctgtacatcagcgccatcaaggccctgcgggtgctggaccccagcatggtgatcctggaggtggcctgtgagcccatccgccgctacctgcggacccgggaggacacagtgcggcagatcgtggccggcctgactggagacagtgatggcactggagacctggccgtggagctgagcaagacagatcctgccagcctggagaccggccaggacagtgaagatgacagcggggagcctgaggactgggtgcctgaccctgtggatgctgaccccgggaagagcagcagcaagaggaggagcagtgacatcatcagcctgctggtgtccatctacggcagcaaggacctcttcatcaatgagtaccgcagcctgctggccgaccggctgctgcaccagttctccttcagccctgagcgggagatcagaaatgtggagctgctgaagctgcgctttggagaggcccccatgcacttctgtgaggtgatgctgaaggacatggctgacagccgccgcatcaatgccaacatccgggaggaggatgagaagaggcctgctgaggagcagcccccatttggagtgtatgctgtgatcctgagcagcgagttctggccacccttcaaggatgagaagctggaggtgcctgaggacatccgggccgccctggaggcctactgcaagaagtatgagcagctgaaggccatgaggaccctgtcctggaagcacaccctgggcctggtgaccatggatgtggagctggccgacaggaccctgtctgtggccgtgacccctgtgcaggccgtcatcctgctgtacttccaggaccaggcctcctggaccctggaggagctgagcaaggctgtgaagatgcctgtggccctgctgcggcggaggatgtctgtgtggctgcagcagggcgtgctgcgggaggagcccccaggcaccttcagcgtcatcgaggaggagcggccccaggaccgggacaacatggtgctgattgacagtgatgatgaaagtgacagcggcatggccagccaggccgaccagaaggaggaggagctgctgctcttctggacctacatccaggccatgctgaccaacctggagagcctgagcctggaccgcatctacaacatgctgaggatgtttgtggtgactggacctgccctggccgagattgacctgcaggagctgcagggctacctgcagaagaaggtgcgggaccagcagctggtgtacagcgctggggtgtaccgcctgcccaagaactgcagctag

SEQ ID NO: 18306 - DNA, 4863 bp, Artificial Sequence
  Description of Artificial Sequence: Synthetic coding sequence
atgggcgccatcggcctgctgtggctgctgcccctgctgctgagcacagctgctgtgggcagcggcatgggcaccggccagagagctggcagccctgctgctggcccccccctgcagccccgggagcccctgagctacagccggctgcagaggaagagcctggccgtggactttgtggtgcccagcctcttccgggtgtatgcccgggacctgctgctgccccccagcagcagcgagctgaaggccggccggcctgaggcccggggcagcctggccctggactgtgcccccctgctgcggctgctgggccctgcccctggggtgtcctggacagctggcagccctgccccagctgaggcccggaccctgagccgggtgctgaagggcggctctgtgaggaagctgcggcgggccaagcagctggtgctggagctgggggaggaggccatcctggagggctgtgtgggccccccaggagaggccgctgtgggcctgctgcagttcaacctgtctgagctgttctcctggtggatccggcagggcgagggccgcctgcgcatccggctgatgcctgagaagaaggccagcgaggtgggccgggagggccgcctgtctgctgccatccgggccagccagccccggctgctcttccagatcttcggcaccggccacagcagcctggagagccccaccaacatgcccagccccagcccagactacttcacctggaacctgacctggatcatgaaggacagcttccccttcctgagccacaggagccgctatggcctggagtgcagctttgacttcccctgtgagctggagtacagcccccccctgcatgacctgaggaaccagagctggagctggaggcgcatccccagcgaggaggccagccagatggacctgctggatggccctggagctgagaggagcaaggagatgccccggggcagcttcctgctgctgaacaccagcgctgacagcaagcacaccatcctgagcccctggatgaggagcagcagcgagcactgcaccctggccgtgtctgtgcaccgccacctgcagcccagcggccgctacatcgcccagctgctgccccacaatgaagctgcccgggagatcctgctgatgcccaccccaggcaagcacggctggacagtgctgcagggcagaattggccgcccagacaaccccttccgggtggccctggagtacatcagcagcggcaacagaagcctgtctgctgtggacttctttgccctgaagaactgcagcgagggcaccagccctggcagcaagatggccctgcagagcagcttcacctgctggaatggaacagtgctgcagctgggccaggcctgtgacttccaccaggactgtgcccagggagaagatgagagccagatgtgcaggaagctgcctgtgggcttctactgcaactttgaagatggcttctgtggctggacccagggcaccctgagcccccacaccccccagtggcaggtgaggaccctgaaggatgcccgcttccaggaccaccaggaccacgccctgctgctgagcaccacagatgtgcctgccagcgagagcgccaccgtgaccagcgccaccttccctgcccccatcaagagcagcccctgtgagctgaggatgtcctggctgatccggggcgtgctgcggggaaatgtgtccctggtgctggtggagaacaagacaggcaaggagcagggccgcatggtgtggcacgtggccgcctatgagggcctgagcctgtggcagtggatggtgctgcccctgctggatgtgtctgaccgcttctggctgcagatggtggcctggtggggccagggcagccgggccatcgtggcctttgacaacatcagcatcagcctggactgctacctgaccatctctggagaggacaagatcctgcagaacacagcccccaagagcaggaacctgtttgagaggaaccccaacaaggagctgaagccaggagagaacagcccccggcagacccccatctttgaccccaccgtgcactggctgttcaccacctgtggggccagcggcccccacggccccacccaggcccagtgcaacaatgcctaccagaacagcaacctgtctgtggaggtgggcagcgagggccccctgaagggcatccagatctggaaggtgcctgccacagacacctacagcatcagcggctatggagctgctgggggcaaaggaggcaagaacaccatgatgaggagccatggagtgtctgtgctgggcatcttcaacctggagaaggatgacatgctgtacatcctggtgggccagcagggagaagatgcctgccccagcaccaaccagctgatccagaaggtgtgcattggagaaaataatgtgattgaggaggagatccgggtgaacagatctgtgcatgagtgggccggcggcggcggcggcggcggcggggccacctacgtgttcaagatgaaggatggagtgcctgtgcccctcatcatcgccgccggcggcggcggccgggcctatggagccaagacagacaccttccaccctgagcggctggagaacaacagctctgtgctgggcctgaatggaaacagcggggctgctgggggcggcggcggctggaatgacaacaccagcctgctgtgggccggcaagagcctgcaggagggcgccactggaggccacagctgcccccaggccatgaagaagtggggctgggagacccggggcggctttggaggcggcggcggcggctgcagcagcggcggcggcggcggcggctacatcggcggcaatgctgccagcaacaatgaccctgagatggatggagaagatggagtgtccttcatcagccccctgggcatcctgtacaccccagccctgaaggtgatggagggccacggggaggtgaacatcaagcactacctgaactgcagccactgtgaggtggatgagtgccacatggaccctgagagccacaaggtgatctgcttctgtgaccacggcaccgtgctggccgaggatggagtgtcctgcatcgtgagccccaccccagagccccacctgcccctgagcctcatcctgtctgtggtgaccagcgccctggtggccgccctggtgctggccttcagcggcatcatgattgtgtacagaaggaagcaccaggagctgcaggccatgcagatggagctgcagagccctgagtacaagctgagcaagctgcggaccagcaccatcatgacagactacaaccccaactactgctttgctgggaagaccagcagcatcagtgacctgaaggaggtgcccaggaagaacatcaccctcatccggggcctgggccacggggcctttggagaggtgtatgagggccaggtgtctggcatgcccaatgaccccagccccctgcaggtggccgtgaagaccctgcctgaggtgtgcagcgagcaggatgagctggacttcctgatggaggccctgatcatcagcaagttcaaccaccagaacatcgtgcgctgcattggagtgtccctgcagagcctgccccgcttcatcctgctggagctgatggccggcggggacctgaagagcttcctgcgggagacccggccccggcccagccagcccagcagcctggccatgctggacctgctgcacgtggcccgggacatcgcctgtggctgccagtacctggaggagaaccacttcatccaccgggacattgctgccaggaactgcctgctgacctgccccggccctggccgggtggccaagatcggggactttggcatggcccgggacatctaccgggccagctactacagaaaaggaggctgtgccatgctgcctgtgaagtggatgcctcctgaggccttcatggagggcatcttcaccagcaagacagacacctggagctttggagtgctgctgtgggagatcttcagcctgggctacatgccctaccccagcaagagcaaccaggaggtgctggagtttgtgaccagcggcggccgcatggacccccccaagaactgccccggccctgtgtaccgcatcatgacccagtgctggcagcaccagccagaagatcggcccaactttgccatcatcctggagagaattgagtactgcacccaggaccctgatgtgatcaacacagccctgcccattgaatatggccccctggtggaggaggaggagaaggtgcctgtgcggcccaaggaccctgagggcgtgccccccctgctggtgtcccagcaggccaagcgggaggaggagaggagccctgctgcccccccacccctgcccaccaccagcagcggcaaggccgccaagaagcccacagctgctgagatctctgtgcgggtgccccggggccctgctgtggagggcggccacgtgaacatggccttcagccagagcaaccccccatctgagctgcacaaggtgcacggcagcaggaacaagcccaccagcctgtggaaccccacctacggctcctggttcacagagaagcccaccaagaagaacaaccccatcgccaagaaggagccccatgaccggggcaacctgggcctggagggcagctgcaccgtgccccccaacgtggccaccggccgcctgcccggggccagcctgctgctggagcccagcagcctgacagccaacatgaaggaggtgcccctcttccggctgcggcacttcccctgtggaaatgtgaactacggctaccagcagcagggcctgcccctggaggccgccacagcccctggagctggccactatgaggacaccatcctgaagagcaagaacagcatgaaccagcccggcccctag

SEQ ID NO: 18307 - DNA, 1353 bp, Artificial Sequence
  Description of Artificial Sequence: Synthetic coding sequence
atgggcgccatcggcctgctgtggctgctgcccctgctgctgagcacagctgctgtgggcagcggcatgggcaccggccagagagctggcagccctgctgctggcccccccctgcagccccgggagcccctgagctacagccggctgcagaggaagagcctggccgtggactttgtggtgcccagcctcttccgggtgtatgcccgggacctgctgctgccccccagcagcagcgagctgaaggccggccggcctgaggcccggggcagcctggccctggactgtgcccccctgctgcggctgctgggccctgcccctggggtgtcctggacagctggcagccctgccccagctgaggcccggaccctgagccgggtgctgaagggcggctctgtgaggaagctgcggcgggccaagcagctggtgctggagctgggggaggaggccatcctggagggctgtgtgggccccccaggagaggccgctgtgggcctgctgcagttcaacctgtctgagctgttctcctggtggatccggcagggcgagggccgcctgcgcatccggctgatgcctgagaagaaggccagcgaggtgggccgggagggccgcctgtctgctgccatccgggccagccagccccggctgctcttccagatcttcggcaccggccacagcagcctggagagccccaccaacatgcccagccccagcccagactacttcacctggaacctgacctggatcatgaaggacagcttccccttcctgagccacaggagccgctatggcaaggagaggagccctgctgcccccccacccctgcccaccaccagcagcggcaaggccgccaagaagcccacagctgctgagatctctgtgcgggtgccccggggccctgctgtggagggcggccacgtgaacatggccttcagccagagcaaccccccatctgagctgcacaaggtgcacggcagcaggaacaagcccaccagcctgtggaaccccacctacggctcctggttcacagagaagcccaccaagaagaacaaccccatcgccaagaaggagccccatgaccggggcaacctgggcctggagggcagctgcaccgtgccccccaacgtggccaccggccgcctgcccggggccagcctgctgctggagcccagcagcctgacagccaacatgaaggaggtgcccctcttccggctgcggcacttcccctgtggaaatgtgaactacggctaccagcagcagggcctgcccctggaggccgccacagcccctggagctggccactatgaggacaccatcctgaagagcaagaacagcatgaaccagcccggcccctag

SEQ ID NO: 18308 - DNA, 1935 bp, Artificial Sequence
  Description of Artificial Sequence: Synthetic coding sequence
atggaggtgcagctgggcctgggccgggtgtacccccggccccccagcaagacctacagaggagccttccagaacctcttccagagcgtgcgggaggtgatccagaaccctggccccaggcaccctgaggccgccagcgctgcccctcctggggccagcctgctgctgctgcagcagcagcagcagcagcagcagcagcagcagcagcagcagcagcagcagcagcagcagcagcagcaggagaccagcccccggcagcagcagcagcagcagggagaagatggcagcccccaggcccacagaagaggccccaccggctacctggtgctggatgaggagcagcagcccagccagccccagagcgccctggagtgccaccctgagcggggctgtgtgcctgagcctggagctgctgtggccgccagcaagggcctgccccagcagctgcctgcccccccagatgaagatgacagcgctgcccccagcaccctgagcctgctgggccccaccttccctggcctgagcagctgcagcgctgacctgaaggacatcctgtctgaggccagcaccatgcagctgctgcagcagcagcagcaggaggccgtgtctgagggcagcagcagcggccgggcccgggaggccagcggggcccccaccagcagcaaggacaactacctgggcggcaccagcaccatcagtgacaatgccaaggagctgtgcaaggctgtgtctgtgtccatgggcctgggcgtggaggccctggagcacctgagccctggagagcagctgcggggggactgcatgtatgcccccctgctgggcgtgcccccagctgtgcggcccaccccctgtgcccccctggctgaatgtaaaggcagcctgctggatgacagcgctgggaagagcacagaggacacagctgagtacagccccttcaagggcggctacaccaagggcctggagggggagagcctgggctgcagcggcagcgctgctgctggcagcagcggcaccctggagctgcccagcaccctgagcctgtacaagagcggggccctggatgaggccgccgcctaccagagccgggactactacaacttccccctggccctggccggccccccacctcctcctcctccaccccacccccacgcccgcatcaagctggagaaccccctggactatggcagcgcctgggccgctgctgctgcccagtgccgctacggggacctggccagcctgcatggagctggagctgctggccctggcagcggcagccccagcgctgctgccagcagctcctggcacaccctcttcaccgctgaggagggccagctgtatggcccctgtggcggcggcggcggcggcggcggcggcggcggcggcggcggcggcggcggcggcggcggcggcggcggggaggccggggctgtggccccctacggctacacccggcccccccagggcctggccggccaggagagtgacttcaccgccccagatgtgtggtacccaggcggcatggtgtcccgggtgccctaccccagccccacctgtgtgaagtctgagatgggcccctggatggacagctacagcggcccctatggagacatgaggctggagacagcccgggaccacgtgctgcccatcgactactacttccccccccagaagacctgcctgatctgtggagatgaggccagcggctgccactacggggccctgacctgtggcagctgcaaggtgttcttcaagagagctgctgagggcaagcagaagtacctgtgtgccagcagaaatgactgcaccatcgacaagttccggaggaagaactgccccagctgccgcctgaggaaatgttatgaagctggcatgaccctgggggagaagttccgggtgggcaactgcaagcacctgaagatgacccggccctag

SEQ ID NO: 18309 - DNA, 1803 bp, Artificial Sequence
  Description of Artificial Sequence: Synthetic coding sequence
atggaggtgcagctgggcctgggccgggtgtacccccggccccccagcaagacctacagaggagccttccagaacctcttccagagcgtgcgggaggtgatccagaaccctggccccaggcaccctgaggccgccagcgctgcccctcctggggccagcctgctgctgctgcagcagcagcagcagcagcagcagcagcagcagcagcagcagcagcagcagcagcagcagcagcagcaggagaccagcccccggcagcagcagcagcagcagggagaagatggcagcccccaggcccacagaagaggccccaccggctacctggtgctggatgaggagcagcagcccagccagccccagagcgccctggagtgccaccctgagcggggctgtgtgcctgagcctggagctgctgtggccgccagcaagggcctgccccagcagctgcctgcccccccagatgaagatgacagcgctgcccccagcaccctgagcctgctgggccccaccttccctggcctgagcagctgcagcgctgacctgaaggacatcctgtctgaggccagcaccatgcagctgctgcagcagcagcagcaggaggccgtgtctgagggcagcagcagcggccgggcccgggaggccagcggggcccccaccagcagcaaggacaactacctgggcggcaccagcaccatcagtgacaatgccaaggagctgtgcaaggctgtgtctgtgtccatgggcctgggcgtggaggccctggagcacctgagccctggagagcagctgcggggggactgcatgtatgcccccctgctgggcgtgcccccagctgtgcggcccaccccctgtgcccccctggctgaatgtaaaggcagcctgctggatgacagcgctgggaagagcacagaggacacagctgagtacagccccttcaagggcggctacaccaagggcctggagggggagagcctgggctgcagcggcagcgctgctgctggcagcagcggcaccctggagctgcccagcaccctgagcctgtacaagagcggggccctggatgaggccgccgcctaccagagccgggactactacaacttccccctggccctggccggccccccacctcctcctcctccaccccacccccacgcccgcatcaagctggagaaccccctggactatggcagcgcctgggccgctgctgctgcccagtgccgctacggggacctggccagcctgcatggagctggagctgctggccctggcagcggcagccccagcgctgctgccagcagctcctggcacaccctcttcaccgctgaggagggccagctgtatggcccctgtggcggcggcggcggcggcggcggcggcggcggcggcggcggcggcggcggcggcggcggcggcggcggggaggccggggctgtggccccctacggctacacccggcccccccagggcctggccggccaggagagtgacttcaccgccccagatgtgtggtacccaggcggcatggtgtcccgggtgccctaccccagccccacctgtgtgaagtctgagatgggcccctggatggacagctacagcggcccctatggagacatgaggctggagacagcccgggaccacgtgctgcccatcgactactacttccccccccagaagacctgcctgatctgtggagatgaggccagcggctgccactacggggccctgacctgtggcagctgcaaggtgttcttcaagagagctgctgagggcttcttcaggatgaacaagctgaaggagagctag

SEQ ID NO: 18310 - DNA, 444 bp, Artificial Sequence
  Description of Artificial Sequence: Synthetic coding sequence
atggtgatgggcctgggcgtgctgctgctggtgtttgtgctgggcctgggcctgaccccacccaccctggcccaggacaacagccgctacacccacttcctgacccagcactatgatgccaagccccagggcagagatgaccgctactgtgagagcatcatgagaagaagaggcctgaccagcccctgcaaggacatcaacaccttcatccacggcaacaagaggagcatcaaggccatctgtgagaacaagaatggaaacccccaccgggagaacctgcgcatcagcaagagcagcttccaggtgaccacctgcaagctgcacggcggcagcccctggccaccctgccagtaccgggccacagctggcttcagaaatgtggtggtggcctgtgaaaatggcctgcctgtgcacctggaccagagcatcttcagaagaccctag

SEQ ID NO: 18311 - DNA, 444 bp, Artificial Sequence; identical to SEQ ID NO: 18310
  Description of Artificial Sequence: Synthetic coding sequence

SEQ ID NO: 18312 - DNA, 1494 bp, Artificial Sequence
  Description of Artificial Sequence: Synthetic coding sequence
atgaccgtcttcctgagctttgccttcctggccgccatcctgacccacatcggctgcagcaaccagaggaggagcccagaaaattctggaagacgctacaaccgcatccagcacggccagtgtgcctacaccttcatcctgcctgagcatgatggcaactgccgggagagcaccacagaccagtacaacaccaatgccctgcagagagatgcccctcatgtggagccagacttcagcagccagaagctgcagcacctggagcacgtgatggagaactacacccagtggctgcagaagctggagaactacatcgtggagaacatgaagtctgagatggcccagatccagcagaatgctgtgcagaaccacacagccaccatgctggagatcggcaccagcctgctgagccagacagctgagcagaccaggaagctgacagatgtggagacccaggtgctgaaccagaccagccggctggagatccagctgctggagaacagcctgagcacctacaagctggagaagcagctgctgcagcagaccaatgagatcctgaagatccacgagaagaacagcctgctggagcacaagatcctggagatggagggcaagcacaaggaggagctggacaccctgaaggaggagaaggagaacctgcagggcctggtgacccggcagacctacatcatccaggagctggagaagcagctgaacagagccaccaccaacaacagcgtgctgcagaagcagcagctggagctgatggacacagtgcacaacctggtgaacctgtgcaccaaggaggtgctgctgaagggcggcaagcgggaggaggagaagcccttccgggactgtgctgatgtgtaccaggccggcttcaacaagagcggcatctacaccatctacatcaacaacatgcctgagcccaagaaggtgttctgcaacatggatgtgaatggaggcggctggacagtcatccagcaccgggaggatggcagcctggacttccagaggggctggaaggagtacaagatgggctttggaaaccccagcggggagtactggctgggcaatgagttcatctttgccatcaccagccagaggcagtacatgctgcgcatcgagctgatggactgggagggcaacagagcctacagccagtatgaccgcttccacatcggaaatgagaagcagaactaccgcctgtacctgaagggccacactggaacagctgggaagcagagcagcctcatcctgcacggggctgacttcagcaccaaggatgctgacaatgacaactgcatgtgcaagtgtgccctgatgctgactggaggctggtggtttgatgcctgtggccccagcaacctgaatggcatgttctacacagctggccagaaccacggcaagctgaatggcatcaagtggcactacttcaagggccccagctacagcctgcggagcaccaccatgatgatccggcccctggacttctag

SEQ ID NO: 18313 - DNA, 459 bp, Artificial Sequence
  Description of Artificial Sequence: Synthetic coding sequence
actgtgagcaacctgctggagcacaagatcctggagatggagggcaagcacaaggaggagctggacaccctgaaggaggagaaggagaacctgcagggcctggtgacccggcagacctacatcatccaggagctggagaagcagctgaacagagccaccaccaacaacagcgtgctgcagaagcagcagctggagctgatggacacagtgcacaacctggtgaacctgtgcaccaaggagggcgtgctgctgaagggcggcaagcgggaggaggagaagcccttccgggactgtgctgatgtgtaccaggccggcttcaacaagagcggcatctacaccatctacatcaacaacatgcctgagcccaagaaggtgttctgcaacatggatgtgaatggaggcggctggacagtcatccagcacagagaagatggcagcctggacttccagaggggctag

SEQ ID NO: 18314 - DNA, 1497 bp, Artificial Sequence
  Description of Artificial Sequence: Synthetic coding sequence
atgaccgtcttcctgagctttgccttcctggccgccatcctgacccacatcggctgcagcaaccagaggaggagcccagaaaattctggaagacgctacaaccgcatccagcacggccagtgtgcctacaccttcatcctgcctgagcatgatggcaactgccgggagagcaccacagaccagtacaacaccaatgccctgcagagagatgcccctcatgtggagccagacttcagcagccagaagctgcagcacctggagcacgtgatggagaactacacccagtggctgcagaagctggagaactacatcgtggagaacatgaagtctgagatggcccagatccagcagaatgctgtgcagaaccacacagccaccatgctggagatcggcaccagcctgctgagccagacagctgagcagaccaggaagctgacagatgtggagacccaggtgctgaaccagaccagccggctggagatccagctgctggagaacagcctgagcacctacaagctggagaagcagctgctgcagcagaccaatgagatcctgaagatccacgagaagaacagcctgctggagcacaagatcctggagatggagggcaagcacaaggaggagctggacaccctgaaggaggagaaggagaacctgcagggcctggtgacccggcagacctacatcatccaggagctggagaagcagctgaacagagccaccaccaacaacagcgtgctgcagaagcagcagctggagctgatggacacagtgcacaacctggtgaacctgtgcaccaaggagggcgtgctgctgaagggcggcaagcgggaggaggagaagcccttccgggactgtgctgatgtgtaccaggccggcttcaacaagagcggcatctacaccatctacatcaacaacatgcctgagcccaagaaggtgttctgcaacatggatgtgaatggaggcggctggacagtcatccagcacagagaagatggcagcctggacttccagaggggctggaaggagtacaagatgggcttcggcaaccccagcggggagtactggctgggcaatgagttcatctttgccatcaccagccagaggcagtacatgctgagaattgagctgatggactgggagggcaacagagcctacagccagtatgaccgcttccacatcggaaatgagaagcagaactaccgcctgtacctgaagggccacactggaacagctgggaagcagagcagcctcatcctgcatggagctgacttcagcaccaaggatgctgacaatgacaactgcatgtgcaagtgtgccctgatgctgaccggcggctggtggtttgatgcctgtggccccagcaacctgaatggcatgttctacacagctggccagaaccacggcaagctgaatggcatcaagtggcactacttcaagggccccagctacagcctgcggagcaccaccatgatgatccggcccctggacttctag

SEQ ID NO: 18315 - DNA, 894 bp, Artificial Sequence
  Description of Artificial Sequence: Synthetic coding sequence
atggagggcaagcacaaggaggagctggacaccctgaaggaggagaaggagaacctgcagggcctggtgacccggcagacctacatcatccaggagctggagaagcagctgaacagagccaccaccaacaacagcgtgctgcagaagcagcagctggagctgatggacacagtgcacaacctggtgaacctgtgcaccaaggaggtgctgctgaagggcggcaagcgggaggaggagaagcccttccgggactgtgctgatgtgtaccaggccggcttcaacaagagcggcatctacaccatctacatcaacaacatgcctgagcccaagaaggtgttctgcaacatggatgtgaatggaggcggctggacagtcatccagcaccgggaggatggcagcctggacttccagaggggctggaaggagtacaagatgggctttggaaaccccagcggggagtactggctgggcaatgagttcatctttgccatcaccagccagaggcagtacatgctgcgcatcgagctgatggactgggagggcaacagagcctacagccagtatgaccgcttccacatcggaaatgagaagcagaactaccgcctgtacctgaagggccacactggaacagctgggaagcagagcagcctcatcctgcacggggctgacttcagcaccaaggatgctgacaatgacaactgcatgtgcaagtgtgccctgatgctgactggaggctggtggtttgatgcctgtggccccagcaacctgaatggcatgttctacacagctggccagaaccacggcaagctgaatggcatcaagtggcactacttcaagggccccagctacagcctgcggagcaccaccatgatgatccggcccctggacttctag

SEQ ID NO: 18316 - DNA, 897 bp, Artificial Sequence
  Description of Artificial Sequence: Synthetic coding sequence
atggagggcaagcacaaggaggagctggacaccctgaaggaggagaaggagaacctgcagggcctggtgacccggcagacctacatcatccaggagctggagaagcagctgaacagagccaccaccaacaacagcgtgctgcagaagcagcagctggagctgatggacacagtgcacaacctggtgaacctgtgcaccaaggagggcgtgctgctgaagggcggcaagcgggaggaggagaagcccttccgggactgtgctgatgtgtaccaggccggcttcaacaagagcggcatctacaccatctacatcaacaacatgcctgagcccaagaaggtgttctgcaacatggatgtgaatggaggcggctggacagtcatccagcacagagaagatggcagcctggacttccagaggggctggaaggagtacaagatgggcttcggcaaccccagcggggagtactggctgggcaatgagttcatctttgccatcaccagccagaggcagtacatgctgagaattgagctgatggactgggagggcaacagagcctacagccagtatgaccgcttccacatcggaaatgagaagcagaactaccgcctgtacctgaagggccacactggaacagctgggaagcagagcagcctcatcctgcatggagctgacttcagcaccaaggatgctgacaatgacaactgcatgtgcaagtgtgccctgatgctgaccggcggctggtggtttgatgcctgtggccccagcaacctgaatggcatgttctacacagctggccagaaccacggcaagctgaatggcatcaagtggcactacttcaagggccccagctacagcctgcggagcaccaccatgatgatccggcccctggacttctag

SEQ ID NO: 18317 - DNA, 1491 bp, Artificial Sequence
  Description of Artificial Sequence: Synthetic coding sequence
atgtggcagatcgtgttcttcaccctgagctgtgacctggtgctggccgccgcctacaacaacttcaggaagtccatggacagcatcggcaagaagcagtaccaggtgcagcacggcagctgcagctacaccttcctgctgcctgagatggacaactgccgcagcagcagcagcccctacgtgtccaatgctgtgcagagagatgcccccctggagtatgatgacagcgtgcagaggctgcaggtgctggagaacatcatggagaacaacacccagtggctgatgaagctggagaactacatccaggacaacatgaagaaggagatggtggagatccagcagaatgctgtgcagaaccagacagctgtgatgattgaaattggcaccaacctgctgaaccagacagctgagcagaccaggaagctgacagatgtggaggcccaggtgctgaaccagaccacccggctggagctgcagctgctggagcacagcctgagcaccaacaagctggagaagcagatcctggaccagaccagcgagatcaacaagctgcaggacaagaacagcttcctggagaagaaggtgctggccatggaggacaagcacatcatccagctgcagagcatcaaggaggagaaggaccagctgcaggtgctggtgtccaagcagaacagcatcatcgaggagctggagaagaagatcgtgacagccaccgtgaacaacagcgtgctgcagaagcagcagcacgacctgatggagaccgtgaacaacctgctgaccatgatgagcaccagcaacagcgccaaggaccccaccgtggccaaggaggagcagatctccttccgggactgtgccgaggtgttcaagagcggccacaccaccaacggcatctacaccctgaccttccccaacagcacagaggagatcaaggcctactgtgacatggaggccggcggcggcggctggaccatcatccagaggagagaagatggctctgtggacttccagaggacctggaaggagtacaaggtgggcttcggcaaccccagcggggagtactggctgggcaatgaatttgtgtcccagctgaccaaccagcagagatatgtgctgaagatccacctgaaggactgggagggcaatgaggcctacagcctgtatgagcacttctacctgagcagcgaggagctgaactaccgcatccacctgaagggcctgactggaacagctgggaagatcagcagcatcagccagcctggaaatgacttcagcaccaaggatggagacaatgacaagtgcatctgcaagtgcagccagatgctgaccggcggctggtggtttgatgcctgtggccccagcaacctgaatggcatgtactacccccagaggcagaacaccaacaagttcaacggcatcaagtggtactactggaagggcagcggctacagcctgaaggccaccaccatgatgatccggcctgctgacttctag

SEQ ID NO: 18318 - DNA, 1488 bp, Artificial Sequence
  Description of Artificial Sequence: Synthetic coding sequence
atgtggcagatcgtgttcttcaccctgagctgtgacctggtgctggccgccgcctacaacaacttcaggaagtccatggacagcatcggcaagaagcagtaccaggtgcagcacggcagctgcagctacaccttcctgctgcctgagatggacaactgccgcagcagcagcagcccctacgtgtccaatgctgtgcagagagatgcccccctggagtatgatgacagcgtgcagaggctgcaggtgctggagaacatcatggagaacaacacccagtggctgatgaagctggagaactacatccaggacaacatgaagaaggagatggtggagatccagcagaatgctgtgcagaaccagacagctgtgatgattgaaattggcaccaacctgctgaaccagacagctgagcagaccaggaagctgacagatgtggaggcccaggtgctgaaccagaccacccggctggagctgcagctgctggagcacagcctgagcaccaacaagctggagaagcagatcctggaccagaccagcgagatcaacaagctgcaggacaagaacagcttcctggagaagaaggtgctggccatggaggacaagcacatcatccagctgcagagcatcaaggaggagaaggaccagctgcaggtgctggtgtccaagcagaacagcatcatcgaggagctggagaagaagatcgtgacagccaccgtgaacaacagcgtgctgcagaagcagcagcacgacctgatggagaccgtgaacaacctgctgaccatgatgagcaccagcaacagcaaggaccccaccgtggccaaggaggagcagatctccttccgggactgtgccgaggtgttcaagagcggccacaccaccaacggcatctacaccctgaccttccccaacagcacagaggagatcaaggcctactgtgacatggaggccggcggcggcggctggaccatcatccagaggcgggaggatggctctgtggacttccagaggacctggaaggagtacaaggtgggctttggaaaccccagcggggagtactggctgggcaatgaatttgtgtcccagctgaccaaccagcagcgctacgtgctgaagatccacctgaaggactgggagggcaatgaggcctacagcctgtatgagcacttctacctgagcagcgaggagctgaactaccgcatccacctgaagggcctgaccggcacagctgggaagatcagcagcatcagccagcctggaaatgacttcagcaccaaggatggagacaatgacaagtgcatctgcaagtgcagccagatgctgactggaggctggtggtttgatgcctgtggccccagcaacctgaatggcatgtactacccccagaggcagaacaccaacaagttcaacggcatcaagtggtactactggaagggcagcggctacagcctgaaggccaccaccatgatgatccggcctgctgacttctag

SEQ ID NO: 18319 - DNA, 1335 bp, Artificial Sequence
  Description of Artificial Sequence: Synthetic coding sequence
atgtggcagatcgtgttcttcaccctgagctgtgacctggtgctggccgccgcctacaacaacttcaggaagtccatggacagcatcggcaagaagcagtaccaggtgcagcacggcagctgcagctacaccttcctgctgcctgagatggacaactgccgcagcagcagcagcccctacgtgtccaatgctgtgcagagagatgcccccctggagtatgatgacagcgtgcagaggctgcaggtgctggagaacatcatggagaacaacacccagtggctgatgaaggtgctgaaccagaccacccggctggagctgcagctgctggagcacagcctgagcaccaacaagctggagaagcagatcctggaccagaccagcgagatcaacaagctgcaggacaagaacagcttcctggagaagaaggtgctggccatggaggacaagcacatcatccagctgcagagcatcaaggaggagaaggaccagctgcaggtgctggtgtccaagcagaacagcatcatcgaggagctggagaagaagatcgtgacagccaccgtgaacaacagcgtgctgcagaagcagcagcacgacctgatggagaccgtgaacaacctgctgaccatgatgagcaccagcaacagcgccaaggaccccaccgtggccaaggaggagcagatctccttccgggactgtgccgaggtgttcaagagcggccacaccaccaacggcatctacaccctgaccttccccaacagcacagaggagatcaaggcctactgtgacatggaggccggcggcggcggctggaccatcatccagaggagagaagatggctctgtggacttccagaggacctggaaggagtacaaggtgggcttcggcaaccccagcggggagtactggctgggcaatgaatttgtgtcccagctgaccaaccagcagagatatgtgctgaagatccacctgaaggactgggagggcaatgaggcctacagcctgtatgagcacttctacctgagcagcgaggagctgaactaccgcatccacctgaagggcctgactggaacagctgggaagatcagcagcatcagccagcctggaaatgacttcagcaccaaggatggagacaatgacaagtgcatctgcaagtgcagccagatgctgaccggcggctggtggtttgatgcctgtggccccagcaacctgaatggcatgtactacccccagaggcagaacaccaacaagttcaacggcatcaagtggtactactggaagggcagcggctacagcctgaaggccaccaccatgatgatccggcctgctgacttctag

SEQ ID NO: 18320 - DNA, 1221 bp, Artificial Sequence
  Description of Artificial Sequence: Synthetic coding sequence
atgtctggggcccccacagctggagctgccctgatgctgtgtgccgccacagctgtgctgctgagcgcccagggcggccctgtgcagagcaagagccccaggtttgcctcctgggatgagatgaatgtgctggcccacggcctgctgcagctgggccagggcctgcgggagcacgccgagaggaccaggagccagctgagcgccctggagcggcggctgagcgcctgtggcagcgcctgccagggcacagagggcagcacagacctgcccctggcccctgagagccgggtggaccctgaggtgctgcacagcctgcagacccagctgaaggcccagaacagccgcatccagcagctgttccacaaggtggcccagcagcagaggcacctggagaagcagcacctgcgcatccagcacctgcagagccagtttggcctgctggaccacaagcacctggaccacgaggtggccaagccagcccggaggaagaggctgcctgagatggcccagcctgtggaccctgcccacaacgtgtcccggctgcaccggctgccccgggactgccaggagctgttccaggtgggggagcggcagagcggcctgtttgagatccagccccagggcagcccccccttcctggtgaactgcaagatgaccagtgatggcggctggacagtcatccagaggagacatgatggctctgtggacttcaaccggccctgggaggcctacaaggccggctttggagacccccacggggagttctggctgggcctggagaaggtgcacagcatcaccggggacaggaacagccggctggccgtgcagctgcgggactgggatggaaatgctgagctgctgcagttctctgtgcacctgggcggggaggacacagcctacagcctgcagctgacagcccctgtggccggccagctgggcgccaccaccgtgccccccagcggcctgtctgtgcccttcagcacctgggaccaggaccatgacctgcggcgggacaagaactgtgccaagagcctgagcggcggctggtggtttggcacctgcagccacagcaacctgaatggccagtacttccgcagcatcccccagcagaggcagaagctgaagaagggcatcttctggaagacctggaggggccgctactaccccctgcaggccaccaccatgctgatccagcccatggctgctgaggccgccagctag

SEQ ID NO: 18321 - DNA, 1107 bp, Artificial Sequence
  Description of Artificial Sequence: Synthetic coding sequence
atgtctggggcccccacagctggagctgccctgatgctgtgtgccgccacagctgtgctgctgagcgcccagggcggccctgtgcagagcaagagccccaggtttgcctcctgggatgagatgaatgtgctggcccacggcctgctgcagctgggccagggcctgcgggagcacgccgagaggaccaggagccagctgagcgccctggagcggcggctgagcgcctgtggcagcgcctgccagggcacagagggcagcacagacctgcccctggcccctgagagccgggtggaccctgaggtgctgcacagcctgcagacccagctgaaggcccagaacagccgcatccagcagctgttccacaaggtggcccagcagcagaggcacctggagaagcagcacctgcgcatccagcacctgcagagccagtttggcctgctggaccacaagcacctggaccacgaggtggccaagccagcccggaggaagaggctgcctgagatggcccagcctgtggaccctgcccacaacgtgtcccggctgcaccacggcggctggacagtcatccagaggagacatgatggctctgtggacttcaaccggccctgggaggcctacaaggccggctttggagacccccacggggagttctggctgggcctggagaaggtgcacagcatcaccggggacaggaacagccggctggccgtgcagctgcgggactgggatggaaatgctgagctgctgcagttctctgtgcacctgggcggggaggacacagcctacagcctgcagctgacagcccctgtggccggccagctgggcgccaccaccgtgccccccagcggcctgtctgtgcccttcagcacctgggaccaggaccatgacctgcggcgggacaagaactgtgccaagagcctgagcggcggctggtggtttggcacctgcagccacagcaacctgaatggccagtacttccgcagcatcccccagcagaggcagaagctgaagaagggcatcttctggaagacctggaggggccgctactaccccctgcaggccaccaccatgctgatccagcccatggctgctgaggccgccagctag

SEQ ID NO: 18322 - DNA, 720 bp, Artificial Sequence
  Description of Artificial Sequence: Synthetic coding sequence
atggcccagcctgtggaccctgcccacaacgtgtcccggctgcaccggctgccccgggactgccaggagctgttccaggtgggggagcggcagagcggcctgtttgagatccagccccagggcagcccccccttcctggtgaactgcaagatgaccagtgatggcggctggacagtcatccagaggagacatgatggctctgtggacttcaaccggccctgggaggcctacaaggccggctttggagacccccatggagagttctggctgggcctggagaaggtgcacagcatcactggagacaggaacagccggctggccgtgcagctgcgggactgggatggaaatgctgagctgctgcagttctctgtgcacctgggcggggaggacacagcctacagcctgcagctgacagcccctgtggccggccagctgggcgccaccaccgtgcccccatctggcctgtctgtgcccttcagcacctgggaccaggaccatgacctgcggcgggacaagaactgtgccaagagcctgagcggcggctggtggtttggcacctgcagccacagcaacctgaatggccagtacttccgcagcatcccccagcagaggcagaagctgaagaagggcatcttctggaagacctggaggggccgctactaccccctgcaggccaccaccatgctgatccagcccatggctgctgaggccgccagctag

SEQ ID NO: 18323 - DNA, 837 bp, Artificial Sequence
  Description of Artificial Sequence: Synthetic coding sequence
atggagcccagggctgctgatggctgcttcctgggagatgtgggcttctgggtggagaggacccctgtgcatgaggccgcccagagaggagagagcctgcagctgcagcagctgattgaaagtggggcctgtgtgaaccaggtgacagtggacagcatcacccccctgcacgccgccagcctgcagggccaggcccgctgtgtgcagctgctgctggccgccggggcccaggtggatgccagaaatattgatggcagcacccccctgtgtgatgcctgtgccagcggcagcattgaatgtgtgaagctgctgctgtcctatggagccaaggtgaacccccccctgtacacagccagccccctgcacgaggcctgcatgagcggcagcagtgaatgtgtgcggctgctgattgatgtgggcgccaacctggaggcccatgactgccacttcggcacccccctgcacgtggcctgtgcccgggagcacctggactgtgtgaaggtgctgctgaatgctggggccaacgtgaatgctgccaagctgcacgagacagccctgcaccacgccgccaaggtgaagaatgtggacctgattgagatgctgattgaatttggaggcaacatctatgcccgggacaacagaggcaagaagcccagcgactacacctggagcagcagcgccccagccaagtgctttgagtactatgagaagacccccctgaccctgagccagctgtgccgggtgaacctgaggaaggccaccggggtgcggggcctggagaagatcgccaagctgaacatccccccccggctgattgactacctgagctacaactag

SEQ ID NO: 18324 - DNA, 396 bp, Artificial Sequence
  Description of Artificial Sequence: Synthetic coding sequence
atggagaagatccctgtgtctgccttcctgctgctggtggccctgagctacaccctggcccgggacaccaccgtgaagccaggggccaagaaggacaccaaggacagccggcccaagctgccccagaccctgagccggggctggggagaccagctgatctggacccagacctatgaggaggccctgtacaagagcaagaccagcaacaagcccctgatgatcatccaccacctggatgagtgcccccacagccaggccctgaagaaggtgtttgctgagaacaaggagatccagaagctggccgagcagtttgtgctgctgaacctggtgtatgagaccacagacaagcacctgagcccagatggccagtatgtgccccgcatcatgtttgtgtag

SEQ ID NO: 18325 - DNA, 528 bp, Artificial Sequence
  Description of Artificial Sequence: Synthetic coding sequence
atggagaagatccctgtgtctgccttcctgctgctggtggccctgagctacaccctggcccgggacaccaccgtgaagccaggggccaagaaggacaccaaggacagccggcccaagctgccccagaccctgagccggggctggggagaccagctgatctggacccagacctatgaggaggccctgtacaagagcaagaccagcaacaagcccctgatgatcatccaccacctggatgagtgcccccacagccaggccctgaagaaggtgtttgctgagaacaaggagatccagaagctggccgagcagtttgtgctgctgaacctggtgtatgagaccacagacaagcacctgagcccagatggccagtatgtgccccgcatcatgtttgtggaccccagcctgactgtgcgggctgacatcaccggccgctacagcaaccggctgtatgcctatgagcctgctgacacagccctgctgctggacaacatgaagaaggccctgaagctgctgaagacagagctgtag

SEQ ID NO: 18326 - DNA, 588 bp, Artificial Sequence
  Description of Artificial Sequence: Synthetic coding sequence
atgagcaactacacagatgctgagagcagcttcagcaagcaggagatcatccgggtggccatggagaagatccctgtgtctgccttcctgctgctggtggccctgagctacaccctggcccgggacaccaccgtgaagccaggggccaagaaggacaccaaggacagccggcccaagctgccccagaccctgagccggggctggggagaccagctgatctggacccagacctatgaggaggccctgtacaagagcaagaccagcaacaagcccctgatgatcatccaccacctggatgagtgcccccacagccaggccctgaagaaggtgtttgctgagaacaaggagatccagaagctggccgagcagtttgtgctgctgaacctggtgtatgagaccacagacaagcacctgagcccagatggccagtatgtgccccgcatcatgtttgtggaccccagcctgactgtgcgggctgacatcaccggccgctacagcaaccggctgtatgcctatgagcctgctgacacagccctgctgctggacaacatgaagaaggccctgaagctgctgaagacagagctgtag

SEQ ID NO: 18327 - DNA, 1251 bp, Artificial Sequence
  Description of Artificial Sequence: Synthetic coding sequence
atgtggcccacccggcggctggtgaccatcaagaggtctggagtggatggcccccacttccccctgagcctgagcacctgcctgtttggccgctatgaaaatgaaagcctgcagaatggaaggaagagcacagagttccccaggaagatccgggagcaggagcccgccaggagagtgagccgcagcagcttcagcagtgaccctgatgaaagtgagggcatccccctgaagagaagaagagtgtcctttggaggccacctgcggcctgagctgtttgatgagaacctgccccccaacacccccctgaagagaggagaggcccccaccaagaggaagagcctggtgatgcacaccccacctgtgctgaagaagatcatcaaggagcagccccagcccagcggcaagcaggagagcggcagcgagatccacgtggaggtgaaggcccagagcctggtgatcagccccccagcccccagccccaggaagacccctgtggccagtgaccagaggagaagaagctgcaagacagccccagccagcagcagcaagagccagacagaggtgcccaagaggggcggcaggaagagcggcaacctgcccagcaagagggtgtccatcagccgcagccagcacgacatcctgcagatgatctgcagcaagagaagaagtggggccagcgaggccaacctgattgtggccaagtcctgggcagatgtggtgaagctgggcgccaagcagacccagaccaaggtgatcaagcacggcccccagaggtccatgaacaagaggcagaggaggcctgccacccccaagaagcctgtgggggaggtgcacagccagttcagcactggacatgccaacagcccctgcaccatcatcatcggcaaggcccacacagagaaggtgcacgtgcctgcccggccctacagagtgctgaacaacttcatcagcaaccagaagatggacttcaaggaggacctgagcggcattgctgagatgttcaagacccctgtgaaggagcagccccagctgaccagcacctgccacatcgccatcagcaacagcgagaacctgctgggcaagcagttccagggcacagacagcggggaggagcccctgctgcccaccagcgagagctttggaggaaatgtgttcttcagcgcccagaatgctgccaagcagcccagcgacaagtgcagcgccagcccccccctgcggcggcagtgcatccgggagaatggaaatgtgtag

SEQ ID NO: 18328 - DNA, 8691 bp, Artificial Sequence
  Description of Artificial Sequence: Synthetic coding sequence
atgtggcccacccggcggctggtgaccatcaagaggtctggagtggatggcccccacttccccctgagcctgagcacctgcctgtttggccggggcattgaatgtgacatccgcatccagctgcctgtggtgtccaagcagcactgcaagattgagatccacgagcaggaggccatcctgcacaacttcagcagcaccaaccccacccaggtgaatggatctgtgattgatgagcctgtgcggctgaagcatggagatgtgatcaccatcatcgacaggagcttccgctatgaaaatgaaagcctgcagaatggaaggaagagcacagagttccccaggaagatccgggagcaggagcccgcccggcgggtgagccgcagcagcttcagcagtgaccctgatgagagcgagggcatccccctgaagagaagaagagtgtcctttggaggccacctgcggcctgagctgtttgatgagaacctgccccccaacacccccctgaagagaggagaggcccccaccaagaggaagagcctggtgatgcacaccccacctgtgctgaagaagatcatcaaggagcagccccagcccagcggcaagcaggagagcggcagcgagatccacgtggaggtgaaggcccagagcctggtgatcagccccccagcccccagccccaggaagacccctgtggccagtgaccagaggcggcgcagctgcaagacagccccagccagcagcagcaagagccagacagaggtgcccaagagaggaggcaggaagagcggcaacctgcccagcaagagggtgtccatcagccgcagccagcacgacatcctgcagatgatctgcagcaagagaagaagtggggccagcgaggccaacctgattgtggccaagtcctgggcagatgtggtgaagctgggcgccaagcagacccagaccaaggtgatcaagcacggcccccagaggtccatgaacaagaggcagaggaggcctgccacccccaagaagcctgtgggggaggtgcacagccagttcagcacaggccacgccaacagcccctgcaccatcatcatcggcaaggcccacacagagaaggtgcacgtgcctgcccggccctacagagtgctgaacaacttcatcagcaaccagaagatggacttcaaggaggacctgtctggaattgctgagatgttcaagacccctgtgaaggagcagccccagctgaccagcacctgccacatcgccatcagcaacagcgagaacctgctgggcaagcagttccagggcacagattctggagaggagcccctgctgcccaccagcgagagctttggaggaaatgtgttcttcagcgcccagaatgctgccaagcagcccagcgacaagtgcagcgccagcccccccctgcggcggcagtgcatcagagaaaatggaaatgtggccaagacccccaggaacacctacaagatgaccagcctggagaccaagaccagtgacacagaaacagagcccagcaagacagtgtccacagccaacagaagtggccgcagcacagagttcaggaacatccagaagctgcctgtggagagcaagtctgaggagaccaacacagagatcgtggagtgcatcctgaagaggggccagaaggccaccctgctgcagcagaggcgggagggggagatgaaggagattgagcggccctttgagacctacaaggagaacatcgagctgaaggaaaatgatgagaagatgaaggccatgaagaggagcaggacctggggccagaagtgtgcccccatgtctgacctgacagacctgaagagcctgcctgacacagagctgatgaaggacacagcccggggccagaacctgctgcagacccaggaccacgccaaggcccccaagtctgagaagggcaagatcaccaagatgccctgccagagcctgcagcctgagcccatcaacacccccacccacaccaagcagcagctgaaggccagcctgggcaaggtgggcgtgaaggaggagctgctggccgtgggcaagttcaccaggaccagcggggagaccacccacacccaccgggagcctgctggagatggcaagagcatccgcaccttcaaggagagccccaagcagatcctggaccctgctgcccgggtgacaggcatgaagaagtggcccaggacccccaaggaggaggcccagagcctggaggacctggccggcttcaaggagctgttccagaccccaggccccagcgaggagagcatgacagatgagaagaccaccaagatcgcctgcaagagccccccacctgagagcgtggacacccccaccagcaccaagcagtggcccaagaggagcctgaggaaggcagatgtggaggaggagttcctggccctgaggaagctgaccccatctgctgggaaggccatgctgacccccaagccagctggaggagatgagaaggacatcaaggccttcatgggcacccctgtgcagaagctggacctggccggcaccctgcccggcagcaagaggcagctgcagacccccaaggagaaggcccaggccctggaggacctggccggcttcaaggagctgttccagaccccaggccacacagaggagctggtggccgccggcaagaccaccaagatcccctgtgacagcccccagagcgaccctgtggacacccccaccagcaccaagcagaggcccaagaggagcatcaggaaggcagatgtggagggggagctgctggcctgcaggaacctgatgcccagcgctgggaaggccatgcacacccccaagcccagcgtgggggaggagaaggacatcatcatctttgtgggcacccctgtgcagaagctggacctgacagagaacctgaccggcagcaagagaagaccccagacccccaaggaggaggcccaggccctggaggacctgaccggcttcaaggagctgttccagaccccaggccacacagaggaggccgtggccgccggcaagaccaccaagatgccctgtgagagcagccccccagagagcgctgacacccccaccagcacccggcggcagcccaagacccccctggagaagagagatgtgcagaaggagctgagcgccctgaagaagctgacccagaccagcggggagaccacccacacagacaaggtgcctggaggagaggacaagagcatcaatgccttccgggagacagccaagcagaagctggaccctgctgcctctgtgacaggcagcaagaggcaccccaagaccaaggagaaggcccagcccctggaggacctggccggcctgaaggagctgttccagacccctgtgtgcacagacaagcccaccacccatgagaagaccaccaagatcgcctgccgcagccagcctgaccctgtggacacccccaccagcagcaagccccagagcaagaggagcctgaggaaggtggatgtggaggaggagttctttgccctgaggaagaggaccccatctgctgggaaggccatgcacacccccaagccagctgtgtctggagagaagaacatctatgccttcatgggcacccctgtgcagaagctggacctgacagagaacctgaccggcagcaagaggcggctgcagacccccaaggagaaggcccaggccctggaggacctggccggcttcaaggagctgttccagacccggggccacacagaggagagcatgaccaatgacaagacagccaaggtggcctgcaagagcagccagcctgaccctgacaagaacccagccagcagcaagaggcggctgaagaccagcctgggcaaggtgggcgtgaaggaggagctgctggccgtgggcaagctgacccagaccagcggggagaccacccacacccacacagagcccactggagatggcaagtccatgaaggccttcatggagagccccaagcagatcctggacagcgctgccagcctgaccggcagcaagaggcagctgcggacccccaagggcaagtctgaggtgcctgaggacctggccggcttcatcgagctgttccagacccccagccacaccaaggagagcatgaccaatgagaagaccaccaaggtgtcctaccgggccagccagcctgacctggtggacacccccaccagcagcaagccccagcccaagaggagcctgaggaaggctgacacagaggaggagttcctggccttcaggaagcagaccccatctgctgggaaggccatgcacacccccaagccagctgtgggggaggagaaggacatcaacaccttcctgggcacccctgtgcagaagctggaccagcccggcaacctgcccggcagcaacagaaggctgcagaccaggaaggagaaggcccaggccctggaggagctgaccggcttccgggagctgttccagaccccctgcacagacaaccccaccacagatgagaagaccaccaagaagatcctgtgcaagagcccccagagcgaccctgctgacacccccaccaacaccaagcagaggcccaagaggagcctgaagaaggcagatgtggaggaggagttcctggccttcaggaagctgaccccatctgctgggaaggccatgcacacccccaaggctgctgtgggggaggagaaggacatcaacacctttgtgggcacccctgtggagaagctggacctgctgggcaacctgcccggcagcaagagaagaccccagacccccaaggagaaggccaaggccctggaggacctggccggcttcaaggagctgttccagaccccaggccacacagaggagagcatgacagatgacaagatcacagaggtgtcctgcaagagcccccagcctgaccctgtgaagacccccaccagcagcaagcagaggctgaagatcagcctgggcaaggtgggcgtgaaggaggaggtgctgcctgtgggcaagctgacccagaccagcggcaagaccacccagacccaccgggagacagctggagatggcaagagcatcaaggccttcaaggagagcgccaagcagatgctggaccctgccaactatggaacaggcatggagcgctggcccaggacccccaaggaggaggcccagagcctggaggacctggccggcttcaaggagctgttccagaccccagaccacacagaggagagcaccacagatgacaagaccaccaagatcgcctgcaagagccccccacctgagagcatggacacccccaccagcaccaggagaagacccaagacccccctgggcaagagggacatcgtggaggagctgagcgccctgaagcagctgacccagaccacccacacagacaaggtgcctggagatgaagataaaggcatcaacgtgttccgggagacagccaagcagaagctggaccctgctgcctctgtgacaggcagcaagaggcagcccaggacccccaagggcaaggcccagcccctggaggacctggccggcctgaaggagctgttccagacccccatctgcacagacaagcccaccacccatgagaagaccaccaagatcgcctgccgcagcccccagcctgaccctgtgggcacccccaccatcttcaagccccagagcaagaggagcctgaggaaggcagatgtggaggaggagagcctggccctgaggaagaggaccccatctgtgggcaaggccatggacacccccaagccagctggaggagatgagaaggacatgaaggccttcatgggcacccctgtgcagaagctggacctgcccggcaacctgcccggcagcaagcgctggccccagacccccaaggagaaggcccaggccctggaggacctggccggcttcaaggagctgttccagaccccaggcacagacaagcccaccacagatgagaagaccaccaagatcgcctgcaagagcccccagcctgaccctgtggacaccccagccagcaccaagcagaggcccaagaggaacctgaggaaggcagatgtggaggaggagttcctggccctgaggaagaggacccccagcgctgggaaggccatggacacccccaagccagctgtgtctgatgagaagaacatcaacacctttgtggagacccctgtgcagaagctggacctgctgggcaacctgcccggcagcaagaggcagccccagacccccaaggagaaggccgaggccctggaggacctggtgggcttcaaggagctgttccagaccccaggccacacagaggagagcatgacagatgacaagatcacagaggtgtcctgcaagagcccccagcctgagagcttcaagaccagccgcagcagcaagcagaggctgaagatccccctggtgaaggtggacatgaaggaggagcccctggccgtgtccaagctgaccaggaccagcggggagaccacccagacccacacagagcccaccggggacagcaagagcatcaaggccttcaaggagagccccaagcagatcctggaccctgctgcctctgtgacaggcagccggcggcagctgcggaccaggaaggagaaggcccgggccctggaggacctggtggacttcaaggagctgttcagcgcccctggccacacagaggagagcatgaccatcgacaagaacaccaagatcccctgcaagagccccccacctgagctgacagacacagccaccagcaccaagcgctgccccaagacccggcccaggaaggaggtgaaggaggagctgtctgctgtggagcggctgacccagaccagcggccagagcacccacacccacaaggagcccgccagcggagatgagggcatcaaggtgctgaagcagagggccaagaagaagcccaaccctgtggaggaggagcccagcagaagaagaccccgggcccccaaggagaaggcccagcccctggaggacctggccggcttcacagagctgtctgagaccagcggccacacccaggagagcctgacagctgggaaggccaccaagatcccctgtgagagcccccccctggaggtggtggacaccacagccagcaccaagaggcacctgcggaccagggtgcagaaggtgcaggtgaaggaggagcccagcgctgtgaagttcacccagaccagcggggagaccacagatgctgacaaggagcctgctggagaagataaaggcatcaaggccctgaaggagagcgccaagcagaccccagccccagctgcctctgtgacaggcagcagaagaagaccccgggccccccgggagagcgcccaggccatcgaggacctggccggcttcaaggaccctgctgctggccacacagaggagagcatgacagatgacaagaccaccaagatcccctgcaagagcagccctgagctggaggacacagccaccagcagcaagaggcggcccaggacccgggcccagaaggtggaggtgaaggaggagctgctggccgtgggcaagctgacccagaccagcggggagaccacccacacagacaaggagcctgtgggggagggcaagggcaccaaggccttcaagcagcctgccaagaggaagctggatgctgaagatgtgattggcagccggcggcagccccgggcccccaaggagaaggcccagcccctggaggacctggccagcttccaggagctgagccagaccccaggccacacagaggagctggccaacggggctgctgacagcttcaccagcgcccccaagcagaccccagacagcggcaagcccctgaagatcagccggcgggtgctgcgggcccccaaggtggagcctgtgggagatgtggtgtccacccgggaccctgtgaagagccagagcaagagcaacaccagcctgccccccctgcccttcaagagaggaggcggcaaggatggctctgtgacaggcaccaagaggctgcgctgcatgcctgcccctgaggagatcgtggaggagctgcctgccagcaagaagcagagggtggccccccgggcccggggcaagagcagcgagcctgtggtgatcatgaagaggagcctgcggaccagcgccaagagaattgagcctgctgaggagctgaacagcaatgacatgaagaccaacaaggaggagcacaagctgcaggacagcgtgcctgaaaataaaggcatcagcctgcggagccggcggcagaacaagacagaagctgagcagcagatcacagaggtgtttgtgctggccgagagaattgagatcaacagaaatgagaagaagcccatgaagaccagccctgagatggacatccagaacccagatgatggagccaggaagcccatcccccgggacaaggtgacagagaacaagcgctgcctgcggagcgcccggcagaatgaaagcagccagcccaaggtggccgaggagagcggcggccagaagagcgccaaggtgctgatgcagaaccagaagggcaaaggagaggccggcaacagcgacagcatgtgcctgcggagcaggaagaccaagagccagcctgctgccagcaccctggagagcaagtctgtgcagagggtgaccaggtctgtgaagagatgtgccgagaaccccaagaaggcagaagataatgtgtgtgtgaagaagatccgcaccaggagccaccgggacagcgaggacatctag

SEQ ID NO: 18329 - DNA, 9771 bp, Artificial Sequence
  Description of Artificial Sequence: Synthetic coding sequence
atgtggcccacccggcggctggtgaccatcaagaggtctggagtggatggcccccacttccccctgagcctgagcacctgcctgtttggccggggcattgaatgtgacatccgcatccagctgcctgtggtgtccaagcagcactgcaagattgagatccacgagcaggaggccatcctgcacaacttcagcagcaccaaccccacccaggtgaatggatctgtgattgatgagcctgtgcggctgaagcatggagatgtgatcaccatcatcgacaggagcttccgctatgaaaatgaaagcctgcagaatggaaggaagagcacagagttccccaggaagatccgggagcaggagcccgcccggcgggtgagccgcagcagcttcagcagtgaccctgatgagaaggcccaggacagcaaggcctacagcaagatcacagagggcaaggtgtctggcaacccccaggtgcacatcaagaatgtgaaggaggacagcacagcagatgacagcaaggacagcgtggcccagggcaccaccaacgtgcacagcagcgagcacgccggcagaaatggaagaaatgctgctgaccccatcagcggggacttcaaggagatcagctctgtgaagctggtgagccgctatggagagctgaagtctgtgcccaccacccagtgcctggacaacagcaagaagaatgaaagccccttctggaagctgtatgaatctgtgaagaaggagctggatgtgaagagccagaaggaaaatgtgctgcagtactgcaggaagagcggcctgcagacagattatgccacagagaaggagagcgcagatggcctgcagggcgagacccagctgctggtgtccaggaagagccggcccaagagcggcggcagcggccatgctgtggccgagcccgccagccctgagcaggagctggaccagaacaagggcaagggcagagatgtggagagcgtgcagacccccagcaaggctgtgggcgccagcttccccctgtatgagcccgccaagatgaagacccctgtgcagtacagccagcagcagaacagcccccagaagcacaagaacaaggacctgtacaccactggaagaagagagagcgtgaacctgggcaagtctgagggcttcaaggccggggacaagaccctgacccccaggaagctgagcaccaggaacagaacaccagccaaggtggaggatgctgctgacagcgccaccaagccagagaacctgagcagcaagacccggggcagcatccccacagatgtggaggtgctgcccacagaaacagagatccacaatgagcccttcctgaccctgtggctgacccaggtggagaggaagatccagaaggacagcctgagcaagccagagaagctgggcaccacagctggccagatgtgcagcggcctgcccggcctgagctctgtggacatcaacaactttggagacagcatcaatgaaagtgagggcatccccctgaagagaagaagagtgtcctttggaggccacctgcggcctgagctgtttgatgagaacctgccccccaacacccccctgaagagaggagaggcccccaccaagaggaagagcctggtgatgcacaccccacctgtgctgaagaagatcatcaaggagcagccccagcccagcggcaagcaggagagcggcagcgagatccacgtggaggtgaaggcccagagcctggtgatcagccccccagcccccagccccaggaagacccctgtggccagtgaccagaggcggcgcagctgcaagacagccccagccagcagcagcaagagccagacagaggtgcccaagagaggaggcaggaagagcggcaacctgcccagcaagagggtgtccatcagccgcagccagcacgacatcctgcagatgatctgcagcaagagaagaagtggggccagcgaggccaacctgattgtggccaagtcctgggcagatgtggtgaagctgggcgccaagcagacccagaccaaggtgatcaagcacggcccccagaggtccatgaacaagaggcagaggaggcctgccacccccaagaagcctgtgggggaggtgcacagccagttcagcacaggccacgccaacagcccctgcaccatcatcatcggcaaggcccacacagagaaggtgcacgtgcctgcccggccctacagagtgctgaacaacttcatcagcaaccagaagatggacttcaaggaggacctgtctggaattgctgagatgttcaagacccctgtgaaggagcagccccagctgaccagcacctgccacatcgccatcagcaacagcgagaacctgctgggcaagcagttccagggcacagattctggagaggagcccctgctgcccaccagcgagagctttggaggaaatgtgttcttcagcgcccagaatgctgccaagcagcccagcgacaagtgcagcgccagcccccccctgcggcggcagtgcatcagagaaaatggaaatgtggccaagacccccaggaacacctacaagatgaccagcctggagaccaagaccagtgacacagaaacagagcccagcaagacagtgtccacagccaacagaagtggccgcagcacagagttcaggaacatccagaagctgcctgtggagagcaagtctgaggagaccaacacagagatcgtggagtgcatcctgaagaggggccagaaggccaccctgctgcagcagaggcgggagggggagatgaaggagattgagcggccctttgagacctacaaggagaacatcgagctgaaggaaaatgatgagaagatgaaggccatgaagaggagcaggacctggggccagaagtgtgcccccatgtctgacctgacagacctgaagagcctgcctgacacagagctgatgaaggacacagcccggggccagaacctgctgcagacccaggaccacgccaaggcccccaagtctgagaagggcaagatcaccaagatgccctgccagagcctgcagcctgagcccatcaacacccccacccacaccaagcagcagctgaaggccagcctgggcaaggtgggcgtgaaggaggagctgctggccgtgggcaagttcaccaggaccagcggggagaccacccacacccaccgggagcctgctggagatggcaagagcatccgcaccttcaaggagagccccaagcagatcctggaccctgctgcccgggtgacaggcatgaagaagtggcccaggacccccaaggaggaggcccagagcctggaggacctggccggcttcaaggagctgttccagaccccaggccccagcgaggagagcatgacagatgagaagaccaccaagatcgcctgcaagagccccccacctgagagcgtggacacccccaccagcaccaagcagtggcccaagaggagcctgaggaaggcagatgtggaggaggagttcctggccctgaggaagctgaccccatctgctgggaaggccatgctgacccccaagccagctggaggagatgagaaggacatcaaggccttcatgggcacccctgtgcagaagctggacctggccggcaccctgcccggcagcaagaggcagctgcagacccccaaggagaaggcccaggccctggaggacctggccggcttcaaggagctgttccagaccccaggccacacagaggagctggtggccgccggcaagaccaccaagatcccctgtgacagcccccagagcgaccctgtggacacccccaccagcaccaagcagaggcccaagaggagcatcaggaaggcagatgtggagggggagctgctggcctgcaggaacctgatgcccagcgctgggaaggccatgcacacccccaagcccagcgtgggggaggagaaggacatcatcatctttgtgggcacccctgtgcagaagctggacctgacagagaacctgaccggcagcaagagaagaccccagacccccaaggaggaggcccaggccctggaggacctgaccggcttcaaggagctgttccagaccccaggccacacagaggaggccgtggccgccggcaagaccaccaagatgccctgtgagagcagccccccagagagcgctgacacccccaccagcacccggcggcagcccaagacccccctggagaagagagatgtgcagaaggagctgagcgccctgaagaagctgacccagaccagcggggagaccacccacacagacaaggtgcctggaggagaggacaagagcatcaatgccttccgggagacagccaagcagaagctggaccctgctgcctctgtgacaggcagcaagaggcaccccaagaccaaggagaaggcccagcccctggaggacctggccggcctgaaggagctgttccagacccctgtgtgcacagacaagcccaccacccatgagaagaccaccaagatcgcctgccgcagccagcctgaccctgtggacacccccaccagcagcaagccccagagcaagaggagcctgaggaaggtggatgtggaggaggagttctttgccctgaggaagaggaccccatctgctgggaaggccatgcacacccccaagccagctgtgtctggagagaagaacatctatgccttcatgggcacccctgtgcagaagctggacctgacagagaacctgaccggcagcaagaggcggctgcagacccccaaggagaaggcccaggccctggaggacctggccggcttcaaggagctgttccagacccggggccacacagaggagagcatgaccaatgacaagacagccaaggtggcctgcaagagcagccagcctgaccctgacaagaacccagccagcagcaagaggcggctgaagaccagcctgggcaaggtgggcgtgaaggaggagctgctggccgtgggcaagctgacccagaccagcggggagaccacccacacccacacagagcccactggagatggcaagtccatgaaggccttcatggagagccccaagcagatcctggacagcgctgccagcctgaccggcagcaagaggcagctgcggacccccaagggcaagtctgaggtgcctgaggacctggccggcttcatcgagctgttccagacccccagccacaccaaggagagcatgaccaatgagaagaccaccaaggtgtcctaccgggccagccagcctgacctggtggacacccccaccagcagcaagccccagcccaagaggagcctgaggaaggctgacacagaggaggagttcctggccttcaggaagcagaccccatctgctgggaaggccatgcacacccccaagccagctgtgggggaggagaaggacatcaacaccttcctgggcacccctgtgcagaagctggaccagcccggcaacctgcccggcagcaacagaaggctgcagaccaggaaggagaaggcccaggccctggaggagctgaccggcttccgggagctgttccagaccccctgcacagacaaccccaccacagatgagaagaccaccaagaagatcctgtgcaagagcccccagagcgaccctgctgacacccccaccaacaccaagcagaggcccaagaggagcctgaagaaggcagatgtggaggaggagttcctggccttcaggaagctgaccccatctgctgggaaggccatgcacacccccaaggctgctgtgggggaggagaaggacatcaacacctttgtgggcacccctgtggagaagctggacctgctgggcaacctgcccggcagcaagagaagaccccagacccccaaggagaaggccaaggccctggaggacctggccggcttcaaggagctgttccagaccccaggccacacagaggagagcatgacagatgacaagatcacagaggtgtcctgcaagagcccccagcctgaccctgtgaagacccccaccagcagcaagcagaggctgaagatcagcctgggcaaggtgggcgtgaaggaggaggtgctgcctgtgggcaagctgacccagaccagcggcaagaccacccagacccaccgggagacagctggagatggcaagagcatcaaggccttcaaggagagcgccaagcagatgctggaccctgccaactatggaacaggcatggagcgctggcccaggacccccaaggaggaggcccagagcctggaggacctggccggcttcaaggagctgttccagaccccagaccacacagaggagagcaccacagatgacaagaccaccaagatcgcctgcaagagccccccacctgagagcatggacacccccaccagcaccaggagaagacccaagacccccctgggcaagagggacatcgtggaggagctgagcgccctgaagcagctgacccagaccacccacacagacaaggtgcctggagatgaagataaaggcatcaacgtgttccgggagacagccaagcagaagctggaccctgctgcctctgtgacaggcagcaagaggcagcccaggacccccaagggcaaggcccagcccctggaggacctggccggcctgaaggagctgttccagacccccatctgcacagacaagcccaccacccatgagaagaccaccaagatcgcctgccgcagcccccagcctgaccctgtgggcacccccaccatcttcaagccccagagcaagaggagcctgaggaaggcagatgtggaggaggagagcctggccctgaggaagaggaccccatctgtgggcaaggccatggacacccccaagccagctggaggagatgagaaggacatgaaggccttcatgggcacccctgtgcagaagctggacctgcccggcaacctgcccggcagcaagcgctggccccagacccccaaggagaaggcccaggccctggaggacctggccggcttcaaggagctgttccagaccccaggcacagacaagcccaccacagatgagaagaccaccaagatcgcctgcaagagcccccagcctgaccctgtggacaccccagccagcaccaagcagaggcccaagaggaacctgaggaaggcagatgtggaggaggagttcctggccctgaggaagaggacccccagcgctgggaaggccatggacacccccaagccagctgtgtctgatgagaagaacatcaacacctttgtggagacccctgtgcagaagctggacctgctgggcaacctgcccggcagcaagaggcagccccagacccccaaggagaaggccgaggccctggaggacctggtgggcttcaaggagctgttccagaccccaggccacacagaggagagcatgacagatgacaagatcacagaggtgtcctgcaagagcccccagcctgagagcttcaagaccagccgcagcagcaagcagaggctgaagatccccctggtgaaggtggacatgaaggaggagcccctggccgtgtccaagctgaccaggaccagcggggagaccacccagacccacacagagcccaccggggacagcaagagcatcaaggccttcaaggagagccccaagcagatcctggaccctgctgcctctgtgacaggcagccggcggcagctgcggaccaggaaggagaaggcccgggccctggaggacctggtggacttcaaggagctgttcagcgcccctggccacacagaggagagcatgaccatcgacaagaacaccaagatcccctgcaagagccccccacctgagctgacagacacagccaccagcaccaagcgctgccccaagacccggcccaggaaggaggtgaaggaggagctgtctgctgtggagcggctgacccagaccagcggccagagcacccacacccacaaggagcccgccagcggagatgagggcatcaaggtgctgaagcagagggccaagaagaagcccaaccctgtggaggaggagcccagcagaagaagaccccgggcccccaaggagaaggcccagcccctggaggacctggccggcttcacagagctgtctgagaccagcggccacacccaggagagcctgacagctgggaaggccaccaagatcccctgtgagagcccccccctggaggtggtggacaccacagccagcaccaagaggcacctgcggaccagggtgcagaaggtgcaggtgaaggaggagcccagcgctgtgaagttcacccagaccagcggggagaccacagatgctgacaaggagcctgctggagaagataaaggcatcaaggccctgaaggagagcgccaagcagaccccagccccagctgcctctgtgacaggcagcagaagaagaccccgggccccccgggagagcgcccaggccatcgaggacctggccggcttcaaggaccctgctgctggccacacagaggagagcatgacagatgacaagaccaccaagatcccctgcaagagcagccctgagctggaggacacagccaccagcagcaagaggcggcccaggacccgggcccagaaggtggaggtgaaggaggagctgctggccgtgggcaagctgacccagaccagcggggagaccacccacacagacaaggagcctgtgggggagggcaagggcaccaaggccttcaagcagcctgccaagaggaagctggatgctgaagatgtgattggcagccggcggcagccccgggcccccaaggagaaggcccagcccctggaggacctggccagcttccaggagctgagccagaccccaggccacacagaggagctggccaacggggctgctgacagcttcaccagcgcccccaagcagaccccagacagcggcaagcccctgaagatcagccggcgggtgctgcgggcccccaaggtggagcctgtgggagatgtggtgtccacccgggaccctgtgaagagccagagcaagagcaacaccagcctgccccccctgcccttcaagagaggaggcggcaaggatggctctgtgacaggcaccaagaggctgcgctgcatgcctgcccctgaggagatcgtggaggagctgcctgccagcaagaagcagagggtggccccccgggcccggggcaagagcagcgagcctgtggtgatcatgaagaggagcctgcggaccagcgccaagagaattgagcctgctgaggagctgaacagcaatgacatgaagaccaacaaggaggagcacaagctgcaggacagcgtgcctgaaaataaaggcatcagcctgcggagccggcggcagaacaagacagaagctgagcagcagatcacagaggtgtttgtgctggccgagagaattgagatcaacagaaatgagaagaagcccatgaagaccagccctgagatggacatccagaacccagatgatggagccaggaagcccatcccccgggacaaggtgacagagaacaagcgctgcctgcggagcgcccggcagaatgaaagcagccagcccaaggtggccgaggagagcggcggccagaagagcgccaaggtgctgatgcagaaccagaagggcaaaggagaggccggcaacagcgacagcatgtgcctgcggagcaggaagaccaagagccagcctgctgccagcaccctggagagcaagtctgtgcagagggtgaccaggtctgtgaagagatgtgccgagaaccccaagaaggcagaagataatgtgtgtgtgaagaagatccgcaccaggagccaccgggacagcgaggacatctag

SEQ ID NO: 18330 - DNA, 9768 bp, Artificial Sequence
  Description of Artificial Sequence: Synthetic coding sequence
atgtggcccacccggcggctggtgaccatcaagaggtctggagtggatggcccccacttccccctgagcctgagcacctgcctgtttggccggggcattgaatgtgacatccgcatccagctgcctgtggtgtccaagcagcactgcaagattgagatccacgagcaggaggccatcctgcacaacttcagcagcaccaaccccacccaggtgaatggatctgtgattgatgagcctgtgcggctgaagcatggagatgtgatcaccatcatcgacaggagcttccgctatgaaaatgaaagcctgcagaatggaaggaagagcacagagttccccaggaagatccgggagcaggagcccgcccggcgggtgagccgcagcagcttcagcagtgaccctgatgagaaggcccaggacagcaaggcctacagcaagatcacagagggcaaggtgtctggcaacccccaggtgcacatcaagaatgtgaaggaggacagcacagcagatgacagcaaggacagcgtggcccagggcaccaccaacgtgcacagcagcgagcacgccggcagaaatggaagaaatgctgctgaccccatcagcggggacttcaaggagatcagctctgtgaagctggtgagccgctatggagagctgaagtctgtgcccaccacccagtgcctggacaacagcaagaagaatgaaagccccttctggaagctgtatgaatctgtgaagaaggagctggatgtgaagagccagaaggaaaatgtgctgcagtactgcaggaagagcggcctgcagacagattatgccacagagaaggagagcgcagatggcctgcagggcgagacccagctgctggtgtccaggaagagccggcccaagagcggcggcagcggccatgctgtggccgagcccgccagccctgagcaggagctggaccagaacaagggcaagggcagagatgtggagagcgtgcagacccccagcaaggctgtgggcgccagcttccccctgtatgagcccgccaagatgaagacccctgtgcagtacagccagcagcagaacagcccccagaagcacaagaacaaggacctgtacaccactggaagaagagagagcgtgaacctgggcaagtctgagggcttcaaggccggggacaagaccctgacccccaggaagctgagcaccaggaacagaacaccagccaaggtggaggatgctgctgacagcgccaccaagccagagaacctgagcagcaagacccggggcagcatccccacagatgtggaggtgctgcccacagaaacagagatccacaatgagcccttcctgaccctgtggctgacccaggtggagaggaagatccagaaggacagcctgagcaagccagagaagctgggcaccacagctggccagatgtgcagcggcctgcccggcctgagctctgtggacatcaacaactttggagacagcatcaatgaaagtgagggcatccccctgaagagaagaagagtgtcctttggaggccacctgcggcctgagctgtttgatgagaacctgccccccaacacccccctgaagagaggagaggcccccaccaagaggaagagcctggtgatgcacaccccacctgtgctgaagaagatcatcaaggagcagccccagcccagcggcaagcaggagagcggcagcgagatccacgtggaggtgaaggcccagagcctggtgatcagccccccagcccccagccccaggaagacccctgtggccagtgaccagaggcggcgcagctgcaagacagccccagccagcagcagcaagagccagacagaggtgcccaagagaggaggagagcgggtggccacctgcctgcagagggtgtccatcagccgcagccagcacgacatcctgcagatgatctgcagcaagagaagaagtggggccagcgaggccaacctgattgtggccaagtcctgggcagatgtggtgaagctgggcgccaagcagacccagaccaaggtgatcaagcacggcccccagaggtccatgaacaagaggcagaggaggcctgccacccccaagaagcctgtgggggaggtgcacagccagttcagcactggacatgccaacagcccctgcaccatcatcatcggcaaggcccacacagagaaggtgcacgtgcctgcccggccctacagagtgctgaacaacttcatcagcaaccagaagatggacttcaaggaggacctgagcggcattgctgagatgttcaagacccctgtgaaggagcagccccagctgaccagcacctgccacatcgccatcagcaacagcgagaacctgctgggcaagcagttccagggcacagacagcggggaggagcccctgctgcccaccagcgagagctttggaggaaatgtgttcttcagcgcccagaatgctgccaagcagcccagcgacaagtgcagcgccagcccccccctgcggcggcagtgcatccgggagaatggaaatgtggccaagaccccaagaaacacctacaagatgaccagcctggagaccaagaccagtgacacagaaacagagcccagcaagacagtgtccacagccaacagaagtggccgcagcacagagttcaggaacatccagaagctgcctgtggagagcaagtctgaggagaccaacacagaaattgtggagtgcatcctgaagaggggccagaaggccaccctgctgcagcagaggcgggagggggagatgaaggagattgaaagaccatttgagacctacaaggaaaatattgagctgaaggaaaatgatgagaagatgaaggccatgaagaggagcaggacctggggccagaagtgtgcccccatgtctgacctgacagacctgaagagcctgcctgacacagagctgatgaaggacacagcccggggccagaacctgctgcagacccaggaccacgccaaggcccccaagtctgagaagggcaagatcaccaagatgccctgccagagcctgcagcctgagcccatcaacacccccacccacaccaagcagcagctgaaggccagcctgggcaaggtgggcgtgaaggaggagctgctggccgtgggcaagttcaccaggaccagcggggagaccacccacacccaccgggagcctgctggagatggcaagagcatccgcaccttcaaggagagccccaagcagatcctggaccctgctgcccgggtgacaggcatgaagaagtggcccaggacccccaaggaggaggcccagagcctggaggacctggccggcttcaaggagctgttccagaccccaggccccagcgaggagagcatgacagatgagaagaccaccaagatcgcctgcaagagccccccacctgagagcgtggacacccccaccagcaccaagcagtggcccaagaggagcctgaggaaggcagatgtggaggaggagttcctggccctgaggaagctgacccccagcgctgggaaggccatgctgacccccaagccagctggaggagatgagaaggacatcaaggccttcatgggcacccctgtgcagaagctggacctggccggcaccctgcccggcagcaagaggcagctgcagacccccaaggagaaggcccaggccctggaggacctggccggcttcaaggagctgttccagaccccaggccacacagaggagctggtggccgccggcaagaccaccaagatcccctgtgacagcccccagagcgaccctgtggacacccccaccagcaccaagcagaggcccaagaggagcatcaggaaggcagatgtggagggggagctgctggcctgcaggaacctgatgcccagcgctgggaaggccatgcacacccccaagcccagcgtgggggaggagaaggacatcatcatctttgtgggcacccctgtgcagaagctggacctgacagagaacctgaccggcagcaagaggcggccccagacccccaaggaggaggcccaggccctggaggacctgaccggcttcaaggagctgttccagaccccaggccacacagaggaggccgtggccgccggcaagaccaccaagatgccctgtgagagcagccccccagagagcgctgacacccccaccagcacccggcggcagcccaagacccccctggagaagagagatgtgcagaaggagctgagcgccctgaagaagctgacccagaccagcggggagaccacccacacagacaaggtgcctggaggagaggacaagagcatcaatgccttccgggagacagccaagcagaagctggaccctgctgcctctgtgacaggcagcaagaggcaccccaagaccaaggagaaggcccagcccctggaggacctggccggcctgaaggagctgttccagacccctgtgtgcacagacaagcccaccacccatgagaagaccaccaagatcgcctgccgcagccagcctgaccctgtggacacccccaccagcagcaagccccagagcaagaggagcctgaggaaggtggatgtggaggaggagttctttgccctgaggaagaggacccccagcgctgggaaggccatgcacacccccaagccagctgtgtctggagagaagaacatctatgccttcatgggcacccctgtgcagaagctggacctgacagagaacctgaccggcagcaagaggcggctgcagacccccaaggagaaggcccaggccctggaggacctggccggcttcaaggagctgttccagacccggggccacacagaggagagcatgaccaatgacaagacagccaaggtggcctgcaagagcagccagcctgaccctgacaagaacccagccagcagcaagaggcggctgaagaccagcctgggcaaggtgggcgtgaaggaggagctgctggccgtgggcaagctgacccagaccagcggggagaccacccacacccacacagagcccactggagatggcaagtccatgaaggccttcatggagagccccaagcagatcctggacagcgctgccagcctgaccggcagcaagaggcagctgcggacccccaagggcaagtctgaggtgcctgaggacctggccggcttcatcgagctgttccagacccccagccacaccaaggagagcatgaccaatgagaagaccaccaaggtgtcctaccgggccagccagcctgacctggtggacacccccaccagcagcaagccccagcccaagaggagcctgaggaaggctgacacagaggaggagttcctggccttcaggaagcagacccccagcgctgggaaggccatgcacacccccaagccagctgtgggggaggagaaggacatcaacaccttcctgggcacccctgtgcagaagctggaccagcccggcaacctgcccggcagcaacagaaggctgcagaccaggaaggagaaggcccaggccctggaggagctgaccggcttccgggagctgttccagaccccctgcacagacaaccccaccacagatgagaagaccaccaagaagatcctgtgcaagagcccccagagcgaccctgctgacacccccaccaacaccaagcagaggcccaagaggagcctgaagaaggcagatgtggaggaggagttcctggccttcaggaagctgacccccagcgctgggaaggccatgcacacccccaaggctgctgtgggggaggagaaggacatcaacacctttgtgggcacccctgtggagaagctggacctgctgggcaacctgcccggcagcaagaggcggccccagacccccaaggagaaggccaaggccctggaggacctggccggcttcaaggagctgttccagaccccaggccacacagaggagagcatgacagatgacaagatcacagaggtgtcctgcaagagcccccagcctgaccctgtgaagacccccaccagcagcaagcagaggctgaagatcagcctgggcaaggtgggcgtgaaggaggaggtgctgcctgtgggcaagctgacccagaccagcggcaagaccacccagacccaccgggagacagctggagatggcaagagcatcaaggccttcaaggagagcgccaagcagatgctggaccctgccaactacggcaccggcatggagcgctggcccaggacccccaaggaggaggcccagagcctggaggacctggccggcttcaaggagctgttccagaccccagaccacacagaggagagcaccacagatgacaagaccaccaagatcgcctgcaagagccccccacctgagagcatggacacccccaccagcacccggcggcggcccaagacccccctgggcaagagggacatcgtggaggagctgagcgccctgaagcagctgacccagaccacccacacagacaaggtgcctggagatgaggacaagggcatcaacgtgttccgggagacagccaagcagaagctggaccctgctgcctctgtgacaggcagcaagaggcagcccaggacccccaagggcaaggcccagcccctggaggacctggccggcctgaaggagctgttccagacccccatctgcacagacaagcccaccacccatgagaagaccaccaagatcgcctgccgcagcccccagcctgaccctgtgggcacccccaccatcttcaagccccagagcaagaggagcctgaggaaggcagatgtggaggaggagagcctggccctgaggaagaggacccccagcgtgggcaaggccatggacacccccaagccagctggaggagatgagaaggacatgaaggccttcatgggcacccctgtgcagaagctggacctgcccggcaacctgcccggcagcaagcgctggccccagacccccaaggagaaggcccaggccctggaggacctggccggcttcaaggagctgttccagaccccaggcacagacaagcccaccacagatgagaagaccaccaagatcgcctgcaagagcccccagcctgaccctgtggacaccccagccagcaccaagcagaggcccaagaggaacctgaggaaggcagatgtggaggaggagttcctggccctgaggaagaggaccccatctgctgggaaggccatggacacccccaagccagctgtgtctgatgagaagaacatcaacacctttgtggagacccctgtgcagaagctggacctgctgggcaacctgcccggcagcaagaggcagccccagacccccaaggagaaggccgaggccctggaggacctggtgggcttcaaggagctgttccagaccccaggccacacagaggagagcatgacagatgacaagatcacagaggtgtcctgcaagagcccccagcctgagagcttcaagaccagccgcagcagcaagcagaggctgaagatccccctggtgaaggtggacatgaaggaggagcccctggccgtgtccaagctgaccaggaccagcggggagaccacccagacccacacagagcccactggagacagcaagagcatcaaggccttcaaggagagccccaagcagatcctggaccctgctgcctctgtgacaggcagccggcggcagctgcggaccaggaaggagaaggcccgggccctggaggacctggtggacttcaaggagctgttcagcgcccctggccacacagaggagagcatgaccatcgacaagaacaccaagatcccctgcaagagccccccacctgagctgacagacacagccaccagcaccaagcgctgccccaagacccggcccaggaaggaggtgaaggaggagctgtctgctgtggagcggctgacccagaccagcggccagagcacccacacccacaaggagcccgccagcggagatgagggcatcaaggtgctgaagcagagggccaagaagaagcccaaccctgtggaggaggagcccagcagaagaagaccccgggcccccaaggagaaggcccagcccctggaggacctggccggcttcacagagctgtctgagaccagcggccacacccaggagagcctgacagctgggaaggccaccaagatcccctgtgagagcccccccctggaggtggtggacaccacagccagcaccaagaggcacctgcggaccagggtgcagaaggtgcaggtgaaggaggagcccagcgctgtgaagttcacccagaccagcggggagaccacagatgctgacaaggagcctgctggggaggacaagggcatcaaggccctgaaggagagcgccaagcagaccccagccccagctgcctctgtgacaggcagcagaagaagaccccgggccccccgggagagcgcccaggccatcgaggacctggccggcttcaaggaccctgctgctggccacacagaggagagcatgacagatgacaagaccaccaagatcccctgcaagagcagccctgagctggaggacacagccaccagcagcaagagaagacccaggacccgggcccagaaggtggaggtgaaggaggagctgctggccgtgggcaagctgacccagaccagcggggagaccacccacacagacaaggagcctgtgggggagggcaagggcaccaaggccttcaagcagcctgccaagaggaagctggatgctgaagatgtgattggcagccggcggcagccccgggcccccaaggagaaggcccagcccctggaggacctggccagcttccaggagctgagccagaccccaggccacacagaggagctggccaatggagctgctgacagcttcaccagcgcccccaagcagaccccagattctgggaagcccctgaagatcagcagaagagtgctgcgggcccccaaggtggagcctgtgggagatgtggtgtccacccgggaccctgtgaagagccagagcaagagcaacaccagcctgccccccctgcccttcaagaggggcggcggcaaggatggctctgtgacaggcaccaagaggctgcgctgcatgcctgcccctgaggagatcgtggaggagctgcctgccagcaagaagcagagggtggccccccgggcccggggcaagagcagcgagcctgtggtgatcatgaagaggagcctgcggaccagcgccaagagaattgagcctgctgaggagctgaacagcaatgacatgaagaccaacaaggaggagcacaagctgcaggacagcgtgcctgagaacaagggcatcagcctgcggagccggcggcagaacaagacagaggccgagcagcagatcacagaggtgtttgtgctggccgagcgcatcgagatcaacagaaatgagaagaagcccatgaagaccagccctgagatggacatccagaacccagatgatggagccaggaagcccatcccccgggacaaggtgacagagaacaagcgctgcctgcggagcgcccggcagaatgaaagcagccagcccaaggtggccgaggagagcggcggccagaagagcgccaaggtgctgatgcagaaccagaagggcaagggggaggccggcaacagcgacagcatgtgcctgcggagcaggaagaccaagagccagcctgctgccagcaccctggagagcaagtctgtgcagagggtgaccaggtctgtgaagagatgtgccgagaaccccaagaaggccgaggacaacgtgtgtgtgaagaagatccgcaccaggagccaccgggacagcgaggacatctag

SEQ ID NO: 18331 - DNA, 141 bp, Artificial Sequence
  Description of Artificial Sequence: Synthetic coding sequence
atgtggcccacccggcggctggtgaccatcaagaggtctggagtggatggcccccacttccccctgagcctgagcacctgcctgtttggaagaagaaaatgtgtgctgcagtgcacagagtgcagcaagacagccatctag

SEQ ID NO: 18332 - DNA, 1557 bp, Artificial Sequence
  Description of Artificial Sequence: Synthetic coding sequence
atgctgcgggtggtgtcctggaacatcaatggcatcagaagacccctgcagggcgtggccaaccaggagcccagcaactgtgccgctgtggccgtgggccgcatcctggatgagctggatgctgacatcgtgtgcctgcaggagaccaaggtgaccagagatgccctgacagagcccctggccatcgtggagggctacaacagctacttctccttcagcaggaacagaagtggctacagcggcgtggccaccttctgcaaggacaatgccacccctgtggccgctgaggagggcctgagcggcctgtttgccacccagaatggagatgtgggctgctacggcaacatggatgagttcacccaggaggagctgcgggccctggacagcgagggccgggccctgctgacccagcacaagatccgcacctgggagggcaaggagaagaccctgaccctcatcaacgtgtactgcccccacgccgaccccggccggcctgagcggctggtgttcaagatgaggttctaccgcctgctgcagatccgggcagaggccctgctggccgccggcagccacgtgatcatcctgggggacctgaacacagcccaccggcccatcgaccactgggatgctgtgaacctggagtgctttgaggaggaccccggcaggaagtggatggacagcctgctgagcaacctgggctgccagagcgccagccacgtgggccccttcatcgacagctaccgctgcttccagcccaagcaggagggcgccttcacctgctggagcgctgtgactggagcccggcacctgaactacggcagccggctggactatgtgctgggggacaggaccctggtgattgacaccttccaggccagcttcctgctgcctgaggtgatgggcagtgaccactgccctgtgggcgctgtgctgtctgtgtcctctgtgcctgccaagcagtgcccccccctgtgcacccgcttcctgcctgagtttgctggcacccagctgaagatcctgcgcttcctggtgcccctggagcagagccctgtgctggagcagagcaccctgcagcacaacaaccagaccagggtgcagacctgccagaacaaggcccaggtgcgcagcacccggccccagcccagccaggtgggcagcagccggggccagaagaacctgaagagctacttccagcccagccccagctgcccccaggccagcccagacatcgagctgcccagcctgcccctgatgtctgccctgatgacccccaagaccccagaggagaaggctgtggccaaggtggtgaagggccaggccaagaccagcgaggccaaggatgagaaggagctgcggaccagcttctggaagtctgtgctggccggccccctgcggacccccctgtgtggcggccaccgggagccctgtgtgatgaggacagtgaagaagccaggccccaacctgggccgccgcttctacatgtgtgcccggccccggggccccccaacagaccccagcagccgctgcaacttcttcctgtggagccggcccagctag

SEQ ID NO: 18333 - DNA, 1191 bp, Artificial Sequence
  Description of Artificial Sequence: Synthetic coding sequence
atgccccgggtgaaggccgcccaggccggccggcagagcagcgccaagaggcacctggccgagcagtttgctgtgggggagatcatcacagacatggccaagaaggagtggaaggtgggcctgcccatcggccagggcggcttcggctgcatctacctggccgacatgaacagcagcgagagcgtgggcagtgatgccccctgtgtggtgaaggtggagcccagcgacaatggccccctcttcacagagctgaagttctaccagagagctgccaagccagagcagatccagaagtggatccgcaccaggaagctgaagtacctgggcgtgcccaagtactggggcagcggcctgcatgacaagaatggcaagagctaccgcttcatgatcatggaccgcttcggcagtgacctgcagaagatctatgaggccaatgccaagcgcttcagcaggaagacagtgctgcagctgagcctgcgcatcctggacatcctggagtacatccatgaacatgaatatgtgcatggagacatcaaggccagcaacctgctgctgaactacaagaacccagaccaggtgtacctggtggactatggcctggcctaccgctactgcccagagggcgtgcacaaggagtacaaggaggaccccaagcgctgccatgatggcaccatcgagttcaccagcattgatgcccacaacggggtggcccccagccggcggggggacctggagatcctgggctactgcatgatccagtggctgaccggccacctgccctgggaggacaacctgaaggaccccaagtatgtgcgggacagcaagatccgctaccgggagaacatcgccagcctgatggacaagtgcttccctgagaagaacaagccaggagaaattgccaagtacatggagaccgtgaagctgctggactacacagagaagcccctgtatgagaacctgcgggacatcctgctgcagggcctgaaggccatcggcagcaaggatgatggcaagctggacctgtctgtggtggagaatggaggcctgaaggccaagaccatcaccaagaagaggaagaaggagattgaggagagcaaggagcccggggtggaggacacagagtggagcaacacccagacagaggaggccatccagaccaggagcaggaccaggaagagggtgcagaagtag

SEQ ID NO: 18334 - DNA, 957 bp, Artificial Sequence
  Description of Artificial Sequence: Synthetic coding sequence
atgcccaagaggggcaagaagggagctgtggccgaggatggagatgagctgaggacagagcctgaggccaagaagagcaagacagctgccaagaagaatgacaaggaggccgccggggagggccctgccctgtatgaggaccccccagaccagaagaccagccccagcggcaagccagccaccctgaagatctgctcctggaatgtggatggcctgcgggcctggatcaagaagaagggcctggactgggtgaaggaggaggccccagacatcctgtgcctgcaggagaccaagtgcagcgagaacaagctgcctgctgagctgcaggagctgcccggcctgagccaccagtactggagcgcccccagcgacaaggagggctacagcggcgtgggcctgctgagccggcagtgccccctgaaggtgtcctatggaattggagatgaggagcatgaccaggagggccgggtcatcgtggccgagtttgacagctttgtgctggtgacagcctacgtgcccaatgccggccggggcctggtgcggctggagtaccggcagcgctgggatgaggccttcaggaagttcctgaagggcctggccagcaggaagcccctggtgctgtgtggggacctgaatgtggcccacgaggagattgacctgaggaaccccaagggcaacaagaagaatgccggcttcaccccccaggagcggcagggctttggagagctgctgcaggccgtgcccctggccgacagcttccgccacctgtaccccaacaccccctatgcctacaccttctggacctacatgatgaatgcccggagcaagaatgtgggctggaggctggactacttcctgctgagccacagcctgctgcctgccctgtgtgacagcaagatccgcagcaaggccctgggcagtgaccactgccccatcaccctgtacctggccctgtag

SEQ ID NO: 18335 - DNA, 792 bp, Artificial Sequence
  Description of Artificial Sequence: Synthetic coding sequence
atgcccaagaggggcaagaagggagctgtggccgaggatggagatgagctgaggacagagcctgaggccaagaagagcaagacagctgccaagaagaatgacaaggaggccgccggggagggccctgccctgtatgaggaccccccagaccagaagaccagccccagcggcaagccagccaccctgaagatctgctcctggaatgtggatggcctgcgggcctggatcaagaagaagggcctggactgggtgaaggaggaggccccagacatcctgtgcctgcaggagaccaagtgcagcgagaacaagctgcctgctgagctgcaggagctgcccggcctgagccaccagtactggagcgcccccagcgacaaggagggctacagcggcgtgggcctgctgagccggcagtgccccctgaaggtgtcctatggaattggagatgaggagcatgaccaggagggccgggtcatcgtggccgagtttgacagctttgtgctggtgacagcctacgtgcccaatgccggccggggcctggtgcggctggagtaccggcagcgctgggatgaggccttcaggaagttcctgaagggcctggccagcaggaagcccctggtgctgtgtggggacctgaatgtggcccacgaggagattgacctgaggaaccccaagggcaacaagaagaatgccggcttcaccccccaggagcggcagggctttggagagctgctgcaggccgtgcccctggccgacagcttccgccacctgtaccccaacaccccctatgcctag

SEQ ID NO: 18336 - DNA, 957 bp, Artificial Sequence; identical to SEQ ID NO: 18334
  Description of Artificial Sequence: Synthetic coding sequence

SEQ ID NO: 18337 - DNA, 525 bp, Artificial Sequence
  Description of Artificial Sequence: Synthetic coding sequence
atgcccaagaggggcaagaagggagctgtggccgaggatggagatgagctgaggacagagcctgaggccaagaagagcaagacagctgccaagaagaatgacaaggaggccgccggggagggccctgccctgtatgaggaccccccagaccagaagaccagccccagcggcaagccagccaccctgaagatctgctcctggaatgtggatggcctgcgggcctggatcaagaagaagggcctggactgggtgaaggaggaggccccagacatcctgtgcctgcaggagaccaagtgcagcgagaacaagctgcctgctgagctgcaggagctgcccggcctgagccaccagtactggagcgcccccagcgacaaggagggctacagcggcgtgggcctgctgagccggcagtgccccctgaaggtgtcctatggaattggagatgaggagcatgaccaggagggccgggtcatcgtggccgagtttgacagctttgtgctggtgacagcctacgtgcccaactag

SEQ ID NO: 18338 - DNA, 327 bp, Artificial Sequence
  Description of Artificial Sequence: Synthetic coding sequence
atgcccaagaggggcaagaagggagctgtggccgaggatggagatgagctgaggacagagcctgaggccaagaagagcaagacagctgccaagaagaatgacaaggaggccgccggggagggccctgccctgtatgaggaccccccagaccagaagaccagccccagcggcaagccagccaccctgaagatctgctcctggaatgtggatggcctgcgggcctggatcaagaagaagggcctggactgggtgaaggaggaggccccagacatcctgtgcctgcaggagaccaagtgcagcgagaacaagctgcctgctgagctgtag

SEQ ID NO: 18339 - DNA, 441 bp, Artificial Sequence
  Description of Artificial Sequence: Synthetic coding sequence
atgcccaagaggggcaagaagggagctgtggccgaggatggagatgagctgaggacagagcctgaggccaagaagagcaagacagctgccaagaagaatgacaaggaggccgccggggagggccctgccctgtatgaggaccccccagaccagaagaccagccccagcggcaagccagccaccctgaagatctgctcctggaatgtggatggcctgcgggcctggatcaagaagaagggcctggactgggtgaaggaggaggccccagacatcctgtgcctgcaggagaccaagtgcagcgagaacaagctgcctgctgagctgcaggagctgcccggcctgagccaccagtactggagcgcccccagcgacaaggagggctacagcggcgtgggcctgctgagccggcagtgccccctgaaggtgtcctatggcatctag

SEQ ID NO: 18340 - DNA, 975 bp, Artificial Sequence
  Description of Artificial Sequence: Synthetic coding sequence
atgttccgctgtggcggcctggccgccggggccctgaagcagaagctggtgcccctggtgaggacagtgtgtgtgcgcagcccccggcagaggaaccggctgcccggcaacctcttccagcgctggcacgtgcccctggagctgcagatgacccggcagatggccagcagcggggccagcggcggcaagattgacaacagcgtgctggtgctgattgtgggcctgagcacagtgggcgctggggcctatgcctacaagaccatgaaggaggatgagaagcgctacaatgaaagaatcagcggcctgggcctgaccccagagcagaagcagaagaaggccgccctgagcgccagcgagggggaggaggtgccccaggacaaggcccccagccacgtgcccttcctgctgattggaggcggcacagctgcctttgctgctgcccggagcatccgggcccgggaccccggggcccgggtgctgattgtgtctgaggaccctgagctgccctacatgaggcctcccctgagcaaggagctgtggttcagtgatgaccccaacgtgaccaagaccctgcgcttcaagcagtggaatggcaaggagaggagcatctacttccagcccccatccttctacgtgtctgcccaggacctgccccacattgaaaatggaggagtggccgtgctgaccgggaagaaggtggtgcagctggatgtgcgggacaacatggtgaagctgaatgatggcagccagatcacctatgaaaaatgtctcatcgccaccggcggcacccccaggagcctgagcgccatcgacagagctggagctgaggtgaagagcaggaccaccctcttcaggaagattggagacttccgcagcctggagaagatcagccgggaggtgaagagcatcaccatcatcggcggcggcttcctgggcagcgagctggcctgtgccctgggcaggaaggacatctag

SEQ ID NO: 18341 - DNA, 1842 bp, Artificial Sequence
  Description of Artificial Sequence: Synthetic coding sequence
atgttccgctgtggcggcctggccgccggggccctgaagcagaagctggtgcccctggtgaggacagtgtgtgtgcgcagcccccggcagaggaaccggctgcccggcaacctcttccagcgctggcacgtgcccctggagctgcagatgacccggcagatggccagcagcggggccagcggcggcaagattgacaacagcgtgctggtgctgattgtgggcctgagcacagtgggcgctggggcctatgcctacaagaccatgaaggaggatgagaagcgctacaatgaaagaatcagcggcctgggcctgaccccagagcagaagcagaagaaggccgccctgagcgccagcgagggggaggaggtgccccaggacaaggcccccagccacgtgcccttcctgctgattggaggcggcacagctgcctttgctgctgcccggagcatccgggcccgggaccccggggcccgggtgctgattgtgtctgaggaccctgagctgccctacatgaggcctcccctgagcaaggagctgtggttcagtgatgaccccaacgtgaccaagaccctgcgcttcaagcagtggaatggcaaggagaggagcatctacttccagcccccatccttctacgtgtctgcccaggacctgccccacattgaaaatggaggagtggccgtgctgaccgggaagaaggtggtgcagctggatgtgcgggacaacatggtgaagctgaatgatggcagccagatcacctatgaaaaatgtctcatcgccaccggcggcacccccaggagcctgagcgccatcgacagagctggagctgaggtgaagagcaggaccaccctcttcaggaagattggagacttccgcagcctggagaagatcagccgggaggtgaagagcatcaccatcatcggcggcggcttcctgggcagcgagctggcctgtgccctgggcaggaaggcccgggccctgggcacagaggtgatccagctgtttcctgagaagggcaacatgggcaagatcctgcctgagtacctgagcaactggaccatggagaaggtgagaagagagggcgtgaaggtgatgcccaatgccatcgtgcagagcgtgggcgtgagcagcggcaagctgctgatcaagctgaaggatggcaggaaggtggagacagaccacatcgtggccgctgtgggcctggagcccaacgtggagctggccaagacaggaggcctggagattgacagcgactttggaggcttccgggtgaatgctgagctgcaggcccggagcaacatctgggtggccggagatgctgcctgcttctatgacatcaagctgggcagaagaagagtggagcaccacgaccatgctgtggtgtctggccgcctggccggggagaacatgaccggggccgccaagccctactggcaccagagcatgttctggagcgacctgggcccagatgtgggctatgaggccatcggcctggtggacagcagcctgcccaccgtgggcgtgtttgccaaggccacagcccaggacaaccccaagagcgccacagagcagagcggcaccggcatccgctctgagagcgagacagagagcgaggccagcgagatcaccatcccccccagcaccccagctgtgccccaggcccctgtgcagggcgaggactatggcaagggcgtcatcttctacctgcgggacaaggtggtggtgggcatcgtgctgtggaacatcttcaacaggatgcccatcgccaggaagatcatcaaggatggagagcagcacgaggacctgaatgaggtggccaagctgttcaacatccacgaggactag

SEQ ID NO: 18342 - DNA, 1830 bp, Artificial Sequence
  Description of Artificial Sequence: Synthetic coding sequence
atgttccgctgtggcggcctggccgccggggccctgaagcagaagctggtgcccctggtgaggacagtgtgtgtgcgcagcccccggcagaggaaccggctgcctgtggtgcagagccaccacctgggcagccccagccgcagcctggccagcactggagccagcggcaaggatggcagcaacctggtgtacttcctgattgtgggcgccaccgtgactggagctggggtgtactatgcctacaagaccatgaaggaggatgagaagcgctacaatgaaagaatcagcggcctgggcctgaccccagagcagaagcagaagaaggccgccctgagcgccagcgagggggaggaggtgccccaggacaaggcccccagccacgtgcccttcctgctgattggaggcggcacagctgcctttgctgctgcccggagcatccgggcccgggaccccggggcccgggtgctgattgtgtctgaggaccctgagctgccctacatgaggcctcccctgagcaaggagctgtggttcagtgatgaccccaacgtgaccaagaccctgcgcttcaagcagtggaatggcaaggagaggagcatctacttccagcccccatccttctacgtgtctgcccaggacctgccccacattgaaaatggaggagtggccgtgctgaccgggaagaaggtggtgcagctggatgtgcgggacaacatggtgaagctgaatgatggcagccagatcacctatgaaaaatgtctcatcgccaccggcggcacccccaggagcctgagcgccatcgacagagctggagctgaggtgaagagcaggaccaccctcttcaggaagattggagacttccgcagcctggagaagatcagccgggaggtgaagagcatcaccatcatcggcggcggcttcctgggcagcgagctggcctgtgccctgggcaggaaggcccgggccctgggcacagaggtgatccagctgtttcctgagaagggcaacatgggcaagatcctgcctgagtacctgagcaactggaccatggagaaggtgagaagagagggcgtgaaggtgatgcccaatgccatcgtgcagagcgtgggcgtgagcagcggcaagctgctgatcaagctgaaggatggcaggaaggtggagacagaccacatcgtggccgctgtgggcctggagcccaacgtggagctggccaagacaggaggcctggagattgacagcgactttggaggcttccgggtgaatgctgagctgcaggcccggagcaacatctgggtggccggagatgctgcctgcttctatgacatcaagctgggcagaagaagagtggagcaccacgaccatgctgtggtgtctggccgcctggccggggagaacatgaccggggccgccaagccctactggcaccagagcatgttctggagcgacctgggcccagatgtgggctatgaggccatcggcctggtggacagcagcctgcccaccgtgggcgtgtttgccaaggccacagcccaggacaaccccaagagcgccacagagcagagcggcaccggcatccgctctgagagcgagacagagagcgaggccagcgagatcaccatcccccccagcaccccagctgtgccccaggcccctgtgcagggcgaggactatggcaagggcgtcatcttctacctgcgggacaaggtggtggtgggcatcgtgctgtggaacatcttcaacaggatgcccatcgccaggaagatcatcaaggatggagagcagcacgaggacctgaatgaggtggccaagctgttcaacatccacgaggactag

SEQ ID NO: 18343 - DNA, 981 bp, Artificial Sequence
  Description of Artificial Sequence: Synthetic coding sequence
atgttccgctgtggcggcctggccgccggggccctgaagcagaagctggtgcccctggtgaggacagtgtgtgtgcgcagcccccggcagaggaaccggctgcctgcccgggccctgggcacagaggtgatccagctgtttcctgagaagggcaacatgggcaagatcctgcctgagtacctgagcaactggaccatggagaaggtgcggcgggagggcgtgaaggtgatgcccaatgccatcgtgcagagcgtgggcgtgtcctctgggaagctgctgatcaagctgaaggatggcaggaaggtggagacagaccacatcgtggccgctgtgggcctggagcccaacgtggagctggccaagacaggaggcctggagattgacagcgactttggaggcttccgggtgaatgctgagctgcaggcccggagcaacatctgggtggccggagatgctgcctgcttctatgacatcaagctgggcagaagaagagtggagcaccacgaccatgctgtggtgtctggccgcctggccggggagaacatgactggagctgccaagccctactggcaccagagcatgttctggagcgacctgggcccagatgtgggctatgaggccatcggcctggtggacagcagcctgcccaccgtgggcgtgtttgccaaggccacagcccaggacaaccccaagagcgccacagagcagagcggcaccggcatccgctctgagagcgagacagaaagtgaggccagcgagatcaccatcccccccagcaccccagctgtgccccaggcccctgtgcagggagaagattatggaaaaggagtcatcttctacctgcgggacaaggtggtggtgggcatcgtgctgtggaacatcttcaacaggatgcccatcgccaggaagatcatcaaggatggagagcagcacgaggacctgaatgaggtggccaagctgttcaacatccatgaagattag

SEQ ID NO: 18344 - DNA, 786 bp, Artificial Sequence
  Description of Artificial Sequence: Synthetic coding sequence
atggagaaggtgagaagagagggcgtgaaggtgatgcccaatgccatcgtgcagagcgtgggcgtgagcagcggcaagctgctgatcaagctgaaggatggcaggaaggtggagacagaccacatcgtggccgctgtgggcctggagcccaacgtggagctggccaagacaggaggcctggagattgacagcgactttggaggcttccgggtgaatgctgagctgcaggcccggagcaacatctgggtggccggagatgctgcctgcttctatgacatcaagctgggcagaagaagagtggagcaccacgaccatgctgtggtgtctggccgcctggccggggagaacatgaccggggccgccaagccctactggcaccagagcatgttctggagcgacctgggcccagatgtgggctatgaggccatcggcctggtggacagcagcctgcccaccgtgggcgtgtttgccaaggccacagcccaggacaaccccaagagcgccacagagcagagcggcaccggcatccgctctgagagcgagacagagagcgaggccagcgagatcaccatcccccccagcaccccagctgtgccccaggcccctgtgcagggcgaggactatggcaagggcgtcatcttctacctgcgggacaaggtggtggtgggcatcgtgctgtggaacatcttcaacaggatgcccatcgccaggaagatcatcaaggatggagagcagcacgaggacctgaatgaggtggccaagctgttcaacatccacgaggactag

SEQ ID NO: 18345 - DNA, 825 bp, Artificial Sequence
  Description of Artificial Sequence: Synthetic coding sequence
atgggcaagatcctgcctgagtacctgagcaactggaccatggagaaggtgcggcgggagggcgtgaaggtgatgcccaatgccatcgtgcagagcgtgggcgtgtcctctgggaagctgctgatcaagctgaaggatggcaggaaggtggagacagaccacatcgtggccgctgtgggcctggagcccaacgtggagctggccaagacaggaggcctggagattgacagcgactttggaggcttccgggtgaatgctgagctgcaggcccggagcaacatctgggtggccggagatgctgcctgcttctatgacatcaagctgggcagaagaagagtggagcaccacgaccatgctgtggtgtctggccgcctggccggggagaacatgactggagctgccaagccctactggcaccagagcatgttctggagcgacctgggcccagatgtgggctatgaggccatcggcctggtggacagcagcctgcccaccgtgggcgtgtttgccaaggccacagcccaggacaaccccaagagcgccacagagcagagcggcaccggcatccgctctgagagcgagacagaaagtgaggccagcgagatcaccatcccccccagcaccccagctgtgccccaggcccctgtgcagggagaagattatggaaaaggagtcatcttctacctgcgggacaaggtggtggtgggcatcgtgctgtggaacatcttcaacaggatgcccatcgccaggaagatcatcaaggatggagagcagcacgaggacctgaatgaggtggccaagctgttcaacatccatgaagattag

SEQ ID NO: 18346 - DNA, 714 bp, Artificial Sequence
  Description of Artificial Sequence: Synthetic coding sequence
atgaaggaggatgagaagcgctacaatgaaagaatttctggcctgggcctgaccccagagcagaagcagaagaaggccgccctgagcgccagcgagggggaggaggtgccccaggacaaggcccccagccacgtgcccttcctgctgattggaggcggcacagctgcctttgctgctgcccggagcatccgggcccgggaccccggggcccgggtgctgattgtgtctgaagatcctgagctgccctacatgaggcctcccctgagcaaggagctgtggttcagtgatgaccccaacgtgaccaagaccctgcgcttcaagcagtggaatggcaaggagaggagcatctacttccagccccccagcttctacgtgtctgcccaggacctgccccacattgaaaatggaggagtggccgtgctgaccgggaagaaggtggtgcagctggatgtgcgggacaacatggtgaagctgaatgatggcagccagatcacctatgagaagtgcctgattgccactggaggcacccccaggagcctgagcgccatcgaccgggccggggctgaggtgaagagcaggaccaccctcttcaggaagatcggggacttccgcagcctggagaagatcagccgggaggtgaagagcatcaccatcattggaggcggcttcctgggcagcgagctggcctgtgccctgggcaggaaggacatctag

SEQ ID NO: 18347 - DNA, 1017 bp, Artificial Sequence
  Description of Artificial Sequence: Synthetic coding sequence
atggatgccaaggccaggaactgcctgctgcagcaccgggaggccctggagaaggacatcaagaccagctacatcatggaccacatgatcagtgatggcttcctgaccatcagcgaggaggagaaggtgagaaatgagcccacccagcagcagagagctgccatgctgatcaagatgatcctgaagaaggacaatgacagctatgtgtccttctacaatgccctgctgcacgagggctacaaggacctggccgccctgctgcatgatggcatccctgtggtgagcagcagcagcggcaaggacagcgtgtctggcatcaccagctatgtgaggacagtgctgtgtgagggcggcgtgccccagaggcctgtggtgtttgtgaccaggaagaagctggtgaatgccatccagcagaagctgagcaagctgaagggggagcccggctgggtgaccatccacggcatggccggctgtgggaagtctgtgctggccgctgaggccgtgcgggaccacagcctgctggagggctgcttccctggaggagtgcactgggtgtctgtgggcaagcaggacaagagcggcctgctgatgaagctgcagaacctgtgcacccggctggaccaggatgagagcttcagccagaggctgcccctgaacatcgaggaggccaaggaccggctgcgcatcctgatgctgaggaagcaccccaggagcctgctgatcctggatgatgtgtgggacagctgggtgctgaaggcctttgacagccagtgccagatcctgctgaccacccgggacaagtctgtgacagacagcgtgatgggccccaagtatgtggtgcctgtggagagcagcctgggcaaggagaagggcctggagatcctgagcctgtttgtgaacatgaagaaggctgacctgcctgagcaggcccacagcatcatcaaggagtgcaaggtggtggagcgctgccactggggcatcctgacagacctgctgcacaagtggaaccagagctag

SEQ ID NO: 18348 - DNA, 3492 bp, Artificial Sequence
  Description of Artificial Sequence: Synthetic coding sequence
atggatgccaaggccaggaactgcctgctgcagcaccgggaggccctggagaaggacatcaagaccagctacatcatggaccacatgatcagtgatggcttcctgaccatcagcgaggaggagaaggtgagaaatgagcccacccagcagcagagagctgccatgctgatcaagatgatcctgaagaaggacaatgacagctatgtgtccttctacaatgccctgctgcacgagggctacaaggacctggccgccctgctgcatgatggcatccctgtggtgagcagcagcagcggcaaggacagcgtgtctggcatcaccagctatgtgaggacagtgctgtgtgagggcggcgtgccccagaggcctgtggtgtttgtgaccaggaagaagctggtgaatgccatccagcagaagctgagcaagctgaagggggagcccggctgggtgaccatccacggcatggccggctgtgggaagtctgtgctggccgctgaggccgtgcgggaccacagcctgctggagggctgcttccctggaggagtgcactgggtgtctgtgggcaagcaggacaagagcggcctgctgatgaagctgcagaacctgtgcacccggctggaccaggatgagagcttcagccagaggctgcccctgaacatcgaggaggccaaggaccggctgcgcatcctgatgctgaggaagcaccccaggagcctgctgatcctggatgatgtgtgggacagctgggtgctgaaggcctttgacagccagtgccagatcctgctgaccacccgggacaagtctgtgacagacagcgtgatgggccccaagtatgtggtgcctgtggagagcagcctgggcaaggagaagggcctggagatcctgagcctgtttgtgaacatgaagaaggctgacctgcctgagcaggcccacagcatcatcaaggagtgcaagggcagccccctggtggtgtccctgattggagccctgctgcgggacttccccaaccgctgggagtactacctgaagcagctgcagaacaagcagttcaagaggatcaggaagagcagcagctatgactatgaggccctggatgaggccatgagcatctctgtggagatgctgcgggaggacatcaaggactactacacagacctgagcatcctgcagaaggatgtgaaggtgcccaccaaggtgctgtgcatcctgtgggacatggagacagaggaggtggaggacatcctgcaggagtttgtgaacaagagcctgctcttctgtgacagaaatggcaagagcttccgctactacctgcatgacctgcaggtggacttcctgacagagaagaactgcagccagctgcaggacctgcacaagaagatcatcacccagttccagcgctaccaccagccccacaccctgagcccagaccaggaggactgcatgtactggtacaacttcctggcctaccacatggccagcgccaagatgcacaaggagctgtgtgccctgatgttcagcctggactggatcaaggccaagacagagctggtgggccctgcccacctgatccacgagtttgtggagtaccgccacatcctggatgagaaggactgtgctgtgtctgagaacttccaggagttcctgagcctgaatggccacctgctgggccggcagcccttccccaacatcgtgcagctgggcctgtgtgagcctgagaccagcgaggtgtaccagcaggccaagctgcaggccaagcaggaggtggacaatggcatgctgtacctggagtggatcaacaagaagaacatcaccaacctgagccggctggtggtgcggccccacacagatgctgtgtaccacgcctgcttctctgaagatggccagagaattgccagctgtggggctgacaagaccctgcaggtgttcaaggccgagaccggggagaagctgctggagatcaaggcccatgaagatgaggtgctgtgctgtgccttcagcacagatgaccgcttcatcgccacctgcagcgtggacaagaaggtgaagatctggaacagcatgaccggggagctggtgcacacctatgatgagcacagcgagcaggtgaactgctgccacttcaccaacagcagccaccacctgctgctggccaccggcagcagtgactgcttcctgaagctgtgggacctgaaccagaaggagtgcaggaacaccatgtttggccacaccaacagcgtgaaccactgccgcttctccccagatgacaagctgctggccagctgcagcgcagatggcaccctgaagctgtgggatgccaccagcgccaatgaaaggaagagcatcaacgtgaagcagttcttcctgaacctggaggacccccaggaggacatggaggtgattgtgaagtgctgctcctggagcgcagatggagcccgcatcatggtggccgccaagaacaagatcttcctgtggaacacagacagccgcagcaaggtggccgactgccggggccacctgtcctgggtgcatggagtgatgttctccccagatggcagcagcttcctgaccagcagtgatgaccagaccatccggctgtgggagaccaagaaggtgtgcaagaacagcgctgtgatgctgaagcaggaggtggatgtggtgttccaggagaatgaggtgatggtgctggccgtggaccacatccggcggctgcagctgatcaatggaagaacaggccagattgactacctgacagaggcccaggtgtcctgctgctgcctgagcccccacctgcagtacatcgcctttggagatgaaaatggagccatcgagatcctggagctggtgaacaaccgcatcttccagagccgcttccagcacaagaagacagtgtggcacatccagttcaccgcagatgagaagaccctcatcagcagcagtgatgatgctgagatccaggtgtggaactggcagctggacaagtgcatcttcctgcggggccaccaggagaccgtgaaggacttccggctgctgaagaacagccggctgctgtcctggagctttgatggcaccgtgaaggtgtggaacatcatcactggaaacaaggagaaggactttgtgtgccaccagggcaccgtgctgagctgtgacatcagccatgatgccaccaagttcagcagcaccagcgctgacaagacagccaagatctggaatgtgtccaatggagagctgctgcacctgtgtgcccccctgtctgaggagggcgccgccacccatggaggctgggtgacagacctgtgcttctccccagatggcaagatgctgatctctgctgggggctacatcaagtggtggaatgtggtgactggagagagcagccagaccttctacaccaacggcaccaacctgaagaagatccacgtgtccccagacttcaagacctacgtgacagtggacaacctgggcatcctgtacatcctgcagaccctggagtag

SEQ ID NO: 18349 - DNA, 3618 bp, Artificial Sequence
  Description of Artificial Sequence: Synthetic coding sequence
atggatgccaaggccaggaactgcctgctgcagcaccgggaggccctggagaaggacatcaagaccagctacatcatggaccacatgatcagtgatggcttcctgaccatcagcgaggaggagaaggtgagaaatgagcccacccagcagcagagagctgccatgctgatcaagatgatcctgaagaaggacaatgacagctatgtgtccttctacaatgccctgctgcacgagggctacaaggacctggccgccctgctgcatgatggcatccctgtggtgagcagcagcagcggcaaggacagcgtgtctggcatcaccagctatgtgaggacagtgctgtgtgagggcggcgtgccccagaggcctgtggtgtttgtgaccaggaagaagctggtgaatgccatccagcagaagctgagcaagctgaagggggagcccggctgggtgaccatccacggcatggccggctgtgggaagtctgtgctggccgctgaggccgtgcgggaccacagcctgctggagggctgcttccctggaggagtgcactgggtgtctgtgggcaagcaggacaagagcggcctgctgatgaagctgcagaacctgtgcacccggctggaccaggatgagagcttcagccagaggctgcccctgaacatcgaggaggccaaggaccggctgcgcatcctgatgctgaggaagcaccccaggagcctgctgatcctggatgatgtgtgggacagctgggtgctgaaggcctttgacagccagtgccagatcctgctgaccacccgggacaagtctgtgacagacagcgtgatgggccccaagtatgtggtgcctgtggagagcagcctgggcaaggagaagggcctggagatcctgagcctgtttgtgaacatgaagaaggctgacctgcctgagcaggcccacagcatcatcaaggagtgcaagggcagccccctggtggtgtccctgattggagccctgctgcgggacttccccaaccgctgggagtactacctgaagcagctgcagaacaagcagttcaagaggatcaggaagagcagcagctatgactatgaggccctggatgaggccatgagcatctctgtggagatgctgcgggaggacatcaaggactactacacagacctgagcatcctgcagaaggatgtgaaggtgcccaccaaggtgctgtgcatcctgtgggacatggagacagaggaggtggaggacatcctgcaggagtttgtgaacaagagcctgctcttctgtgacagaaatggcaagagcttccgctactacctgcatgacctgcaggtggacttcctgacagagaagaactgcagccagctgcaggacctgcacaagaagatcatcacccagttccagcgctaccaccagccccacaccctgagcccagaccaggaggactgcatgtactggtacaacttcctggcctaccacatggccagcgccaagatgcacaaggagctgtgtgccctgatgttcagcctggactggatcaaggccaagacagagctggtgggccctgcccacctgatccacgagtttgtggagtaccgccacatcctggatgagaaggactgtgctgtgtctgagaacttccaggagttcctgagcctgaatggccacctgctgggccggcagcccttccccaacatcgtgcagctgggcctgtgtgagcctgagaccagcgaggtgtaccagcaggccaagctgcaggccaagcaggaggtggacaatggcatgctgtacctggagtggatcaacaagaagaacatcaccaacctgagccggctggtggtgcggccccacacagatgctgtgtaccacgcctgcttctctgaagatggccagagaattgccagctgtggggctgacaagaccctgcaggtgttcaaggccgagaccggggagaagctgctggagatcaaggcccatgaagatgaggtgctgtgctgtgccttcagcacagatgaccgcttcatcgccacctgcagcgtggacaagaaggtgaagatctggaacagcatgaccggggagctggtgcacacctatgatgagcacagcgagcaggtgaactgctgccacttcaccaacagcagccaccacctgctgctggccaccggcagcagtgactgcttcctgaagctgtgggacctgaaccagaaggagtgcaggaacaccatgtttggccacaccaacagcgtgaaccactgccgcttctccccagatgacaagctgctggccagctgcagcgcagatggcaccctgaagctgtgggatgccaccagcgccaatgaaaggaagagcatcaacgtgaagcagttcttcctgaacctggaggacccccaggaggacatggaggtgattgtgaagtgctgctcctggagcgcagatggagcccgcatcatggtggccgccaagaacaagatcttcctgtggaacacagacagccgcagcaaggtggccgactgccggggccacctgtcctgggtgcatggagtgatgttctccccagatggcagcagcttcctgaccagcagtgatgaccagaccatccggctgtgggagaccaagaaggtgtgcaagaacagcgctgtgatgctgaagcaggaggtggatgtggtgttccaggagaatgaggtgatggtgctggccgtggaccacatccggcggctgcagctgatcaatggaagaacaggccagattgactacctgacagaggcccaggtgtcctgctgctgcctgagcccccacctgcagtacatcgcctttggagatgaaaatggagccatcgagatcctggagctggtgaacaaccgcatcttccagagccgcttccagcacaagaagacagtgtggcacatccagttcaccgcagatgagaagaccctcatcagcagcagtgatgatgctgagatccaggtgtggaactggcagctggacaagtgcatcttcctgcggggccaccaggagaccgtgaaggacttccggctgctgaagaacagccggctgctgtcctggagctttgatggcaccgtgaaggtgtggaacatcatcactggaaacaaggagaaggactttgtgtgccaccagggcaccgtgctgagctgtgacatcagccatgatgccaccaagttcagcagcaccagcgctgacaagacagccaagatctggagctttgacctgctgctgcccctgcacgagctgcggggccacaacggctgtgtgcgctgcagcgccttctctgtggacagcaccctgctggccactggagatgacaatggagagatccgcatctggaatgtgtccaatggagagctgctgcacctgtgtgcccccctgtctgaggagggcgccgccacccatggaggctgggtgacagacctgtgcttctccccagatggcaagatgctgatctctgctgggggctacatcaagtggtggaatgtggtgactggagagagcagccagaccttctacaccaacggcaccaacctgaagaagatccacgtgtccccagacttcaagacctacgtgacagtggacaacctgggcatcctgtacatcctgcagaccctggagtag

SEQ ID NO: 18350 - DNA, 3585 bp, Artificial Sequence
  Description of Artificial Sequence: Synthetic coding sequence
atggatgccaaggccaggaactgcctgctgcagcaccgggaggccctggagaaggacatcaagaccagctacatcatggaccacatgatcagtgatggcttcctgaccatcagcgaggaggagaaggtgagaaatgagcccacccagcagcagagagctgccatgctgatcaagatgatcctgaagaaggacaatgacagctatgtgtccttctacaatgccctgctgcacgagggctacaaggacctggccgccctgctgcatgatggcatccctgtggtgagcagcagctctgtgaggacagtgctgtgtgagggcggcgtgccccagaggcctgtggtgtttgtgaccaggaagaagctggtgaatgccatccagcagaagctgagcaagctgaagggggagcccggctgggtgaccatccacggcatggccggctgcggcaagtctgtgctggccgctgaggccgtgcgggaccacagcctgctggagggctgcttccctgggggcgtgcactgggtgtctgtgggcaagcaggacaagagcggcctgctgatgaagctgcagaacctgtgcacccggctggaccaggatgagagcttcagccagaggctgcccctgaacatcgaggaggccaaggaccggctgcgcatcctgatgctgaggaagcaccccaggagcctgctgatcctggatgatgtgtgggacagctgggtgctgaaggcctttgacagccagtgccagatcctgctgaccacccgggacaagtctgtgacagattctgtgatgggccccaagtatgtggtgcctgtggagagcagcctgggcaaggagaagggcctggagatcctgagcctgtttgtgaacatgaagaaggctgacctgcctgagcaggcccacagcatcatcaaggaatgtaaaggcagccccctggtggtgtccctcatcggggccctgctgcgggacttccccaaccgctgggagtactacctgaagcagctgcagaacaagcagttcaagaggatcaggaagagcagcagctatgactatgaggccctggatgaggccatgagcatctctgtggagatgctgcgggaggacatcaaggactactacacagacctgagcatcctgcagaaggatgtgaaggtgcccaccaaggtgctgtgcatcctgtgggacatggagacagaggaggtggaggacatcctgcaggagtttgtgaacaagagcctgctcttctgtgacagaaatggcaagagcttccgctactacctgcatgacctgcaggtggacttcctgacagagaagaactgcagccagctgcaggacctgcacaagaagatcatcacccagttccagcgctaccaccagccccacaccctgagcccagaccaggaggactgcatgtactggtacaacttcctggcctaccacatggccagcgccaagatgcacaaggagctgtgtgccctgatgttcagcctggactggatcaaggccaagacagagctggtgggccctgcccacctgattcatgaatttgtggagtaccgccacatcctggatgagaaggactgtgctgtgtctgagaacttccaggagttcctgagcctgaatggccacctgctgggccggcagcccttccccaacatcgtgcagctgggcctgtgtgagcctgagaccagcgaggtgtaccagcaggccaagctgcaggccaagcaggaggtggacaatggcatgctgtacctggagtggatcaacaagaagaacatcaccaacctgagccggctggtggtgcggccccacacagatgctgtgtaccacgcctgcttctctgaagatggccagagaattgccagctgtggggctgacaagaccctgcaggtgttcaaggccgagactggagagaagctgctggagatcaaggcccatgaagatgaggtgctgtgctgtgccttcagcacagatgaccgcttcatcgccacctgcagcgtggacaagaaggtgaagatctggaacagcatgactggagagctggtgcacacctatgatgagcacagcgagcaggtgaactgctgccacttcaccaacagcagccaccacctgctgctggccaccggcagcagtgactgcttcctgaagctgtgggacctgaaccagaaggaatgtagaaacaccatgtttggccacaccaacagcgtgaaccactgccgcttctccccagatgacaagctgctggccagctgcagcgcagatggcaccctgaagctgtgggatgccaccagcgccaatgaaaggaagagcatcaacgtgaagcagttcttcctgaacctggaggacccccaggaggacatggaggtgattgtgaagtgctgctcctggagcgcagatggagcccgcatcatggtggccgccaagaacaagatcttcctgtggaacacagacagccgcagcaaggtggccgactgccggggccacctgtcctgggtgcacggcgtgatgttctccccagatggcagcagcttcctgaccagcagtgatgaccagaccatccggctgtgggagaccaagaaggtgtgcaagaacagcgctgtgatgctgaagcaggaggtggatgtggtgttccaggagaatgaggtgatggtgctggccgtggaccacatccggcggctgcagctgatcaatggccgcacaggccagattgactacctgacagaggcccaggtgtcctgctgctgcctgagcccccacctgcagtacatcgcctttggagatgaaaatggagccatcgagatcctggagctggtgaacaaccgcatcttccagagccgcttccagcacaagaagacagtgtggcacatccagttcaccgcagatgagaagaccctcatcagcagcagtgatgatgctgagatccaggtgtggaactggcagctggacaagtgcatcttcctgcggggccaccaggagaccgtgaaggacttccggctgctgaagaacagccggctgctgtcctggagctttgatggcaccgtgaaggtgtggaacatcatcaccggcaacaaggagaaggactttgtgtgccaccagggcaccgtgctgagctgtgacatcagccatgatgccaccaagttcagcagcaccagcgctgacaagacagccaagatctggagctttgacctgctgctgcccctgcacgagctgcggggccacaacggctgtgtgcgctgcagcgccttctctgtggacagcaccctgctggccactggagatgacaacggggagatccgcatctggaatgtgtccaatggagagctgctgcacctgtgtgcccccctgtctgaggagggcgccgccacccacggcggctgggtgacagacctgtgcttctccccagatggcaagatgctgatctctgctgggggctacatcaagtggtggaatgtggtgactggagagagcagccagaccttctacaccaacggcaccaacctgaagaagatccacgtgtccccagacttcaagacctacgtgacagtggacaacctgggcatcctgtacatcctgcagaccctggagtag

SEQ ID NO: 18351 - DNA, 3618 bp, Artificial Sequence; identical to SEQ ID NO: 18349
  Description of Artificial Sequence: Synthetic coding sequence

SEQ ID NO: 18352 - DNA, 3492 bp, Artificial Sequence; identical to SEQ ID NO: 18348
  Description of Artificial Sequence: Synthetic coding sequence

SEQ ID NO: 18353 - DNA, 3714 bp, Artificial Sequence
  Description of Artificial Sequence: Synthetic coding sequence
atggatgccaaggccaggaactgcctgctgcagcaccgggaggccctggagaaggacatcaagaccagctacatcatggaccacatgatcagtgatggcttcctgaccatcagcgaggaggagaaggtgagaaatgagcccacccagcagcagagagctgccatgctgatcaagatgatcctgaagaaggacaatgacagctatgtgtccttctacaatgccctgctgcacgagggctacaaggacctggccgccctgctgcatgatggcatccctgtggtgagcagcagctctgtgaggacagtgctgtgtgagggcggcgtgccccagaggcctgtggtgtttgtgaccaggaagaagctggtgaatgccatccagcagaagctgagcaagctgaagggggagcccggctgggtgaccatccacggcatggccggctgcggcaagtctgtgctggccgctgaggccgtgcgggaccacagcctgctggagggctgcttccctgggggcgtgcactgggtgtctgtgggcaagcaggacaagagcggcctgctgatgaagctgcagaacctgtgcacccggctggaccaggatgagagcttcagccagaggctgcccctgaacatcgaggaggccaaggaccggctgcgcatcctgatgctgaggaagcaccccaggagcctgctgatcctggatgatgtgtgggacagctgggtgctgaaggcctttgacagccagtgccagatcctgctgaccacccgggacaagtctgtgacagattctgtgatgggccccaagtatgtggtgcctgtggagagcagcctgggcaaggagaagggcctggagatcctgagcctgtttgtgaacatgaagaaggctgacctgcctgagcaggcccacagcatcatcaaggaatgtaaaggcagccccctggtggtgtccctcatcggggccctgctgcgggacttccccaaccgctgggagtactacctgaagcagctgcagaacaagcagttcaagaggatcaggaagagcagcagctatgactatgaggccctggatgaggccatgagcatctctgtggagatgctgcgggaggacatcaaggactactacacagacctgagcatcctgcagaaggatgtgaaggtgcccaccaaggtgctgtgcatcctgtgggacatggagacagaggaggtggaggacatcctgcaggagtttgtgaacaagagcctgctcttctgtgacagaaatggcaagagcttccgctactacctgcatgacctgcaggtggacttcctgacagagaagaactgcagccagctgcaggacctgcacaagaagatcatcacccagttccagcgctaccaccagccccacaccctgagcccagaccaggaggactgcatgtactggtacaacttcctggcctaccacatggccagcgccaagatgcacaaggagctgtgtgccctgatgttcagcctggactggatcaaggccaagacagagctggtgggccctgcccacctgattcatgaatttgtggagtaccgccacatcctggatgagaaggactgtgctgtgtctgagaacttccaggagttcctgagcctgaatggccacctgctgggccggcagcccttccccaacatcgtgcagctgggcctgtgtgagcctgagaccagcgaggtgtaccagcaggccaagctgcaggccaagcaggaggtggacaatggcatgctgtacctggagtggatcaacaagaagaacatcaccaacctgagccggctggtggtgcggccccacacagatgctgtgtaccacgcctgcttctctgaagatggccagagaattgccagctgtggggctgacaagaccctgcaggtgttcaaggccgagactggagagaagctgctggagatcaaggcccatgaagatgaggtgctgtgctgtgccttcagcacagatgaccgcttcatcgccacctgcagcgtggacaagaaggtgaagatctggaacagcatgactggagagctggtgcacacctatgatgagcacagcgagcaggtgaactgctgccacttcaccaacagcagccaccacctgctgctggccaccggcagcagtgactgcttcctgaagctgtgggacctgaaccagaaggaatgtagaaacaccatgtttggccacaccaacagcgtgaaccactgccgcttctccccagatgacaagctgctggccagctgcagcgcagatggcaccctgaagctgtgggatgccaccagcgccaatgaaaggaagagcatcaacgtgaagcagttcttcctgaacctggaggacccccaggaggacatggaggtgattgtgaagtgctgctcctggagcgcagatggagcccgcatcatggtggccgccaagaacaagatcttcctgtttgacatccacaccagcggcctgctgggggagatccacacaggccaccacagcaccatccagtactgtgacttcagcccccagaaccacctggccgtggtggccctgagccagtactgtgtggagctgtggaacacagacagccgcagcaaggtggccgactgccggggccacctgtcctgggtgcatggagtgatgttctccccagatggcagcagcttcctgaccagcagtgatgaccagaccatccggctgtgggagaccaagaaggtgtgcaagaacagcgctgtgatgctgaagcaggaggtggatgtggtgttccaggagaatgaggtgatggtgctggccgtggaccacatccggcggctgcagctgatcaatggaagaacaggccagattgactacctgacagaggcccaggtgtcctgctgctgcctgagcccccacctgcagtacatcgcctttggagatgaaaatggagccatcgagatcctggagctggtgaacaaccgcatcttccagagccgcttccagcacaagaagacagtgtggcacatccagttcaccgcagatgagaagaccctcatcagcagcagtgatgatgctgagatccaggtgtggaactggcagctggacaagtgcatcttcctgcggggccaccaggagaccgtgaaggacttccggctgctgaagaacagccggctgctgtcctggagctttgatggcaccgtgaaggtgtggaacatcatcactggaaacaaggagaaggactttgtgtgccaccagggcaccgtgctgagctgtgacatcagccatgatgccaccaagttcagcagcaccagcgctgacaagacagccaagatctggagctttgacctgctgctgcccctgcacgagctgcggggccacaacggctgtgtgcgctgcagcgccttctctgtggacagcaccctgctggccactggagatgacaatggagagatccgcatctggaatgtgtccaatggagagctgctgcacctgtgtgcccccctgtctgaggagggcgccgccacccatggaggctgggtgacagacctgtgcttctccccagatggcaagatgctgatctctgctgggggctacatcaagtggtggaatgtggtgactggagagagcagccagaccttctacaccaacggcaccaacctgaagaagatccacgtgtccccagacttcaagacctacgtgacagtggacaacctgggcatcctgtacatcctgcagaccctggagtag

SEQ ID NO: 18354 - DNA, 3747 bp, Artificial Sequence
  Description of Artificial Sequence: Synthetic coding sequence
atggatgccaaggccaggaactgcctgctgcagcaccgggaggccctggagaaggacatcaagaccagctacatcatggaccacatgatcagtgatggcttcctgaccatcagcgaggaggagaaggtgagaaatgagcccacccagcagcagagagctgccatgctgatcaagatgatcctgaagaaggacaatgacagctatgtgtccttctacaatgccctgctgcacgagggctacaaggacctggccgccctgctgcatgatggcatccctgtggtgagcagcagcagcggcaaggacagcgtgtctggcatcaccagctatgtgaggacagtgctgtgtgagggcggcgtgccccagaggcctgtggtgtttgtgaccaggaagaagctggtgaatgccatccagcagaagctgagcaagctgaagggggagcccggctgggtgaccatccacggcatggccggctgtgggaagtctgtgctggccgctgaggccgtgcgggaccacagcctgctggagggctgcttccctggaggagtgcactgggtgtctgtgggcaagcaggacaagagcggcctgctgatgaagctgcagaacctgtgcacccggctggaccaggatgagagcttcagccagaggctgcccctgaacatcgaggaggccaaggaccggctgcgcatcctgatgctgaggaagcaccccaggagcctgctgatcctggatgatgtgtgggacagctgggtgctgaaggcctttgacagccagtgccagatcctgctgaccacccgggacaagtctgtgacagacagcgtgatgggccccaagtatgtggtgcctgtggagagcagcctgggcaaggagaagggcctggagatcctgagcctgtttgtgaacatgaagaaggctgacctgcctgagcaggcccacagcatcatcaaggagtgcaagggcagccccctggtggtgtccctgattggagccctgctgcgggacttccccaaccgctgggagtactacctgaagcagctgcagaacaagcagttcaagaggatcaggaagagcagcagctatgactatgaggccctggatgaggccatgagcatctctgtggagatgctgcgggaggacatcaaggactactacacagacctgagcatcctgcagaaggatgtgaaggtgcccaccaaggtgctgtgcatcctgtgggacatggagacagaggaggtggaggacatcctgcaggagtttgtgaacaagagcctgctcttctgtgacagaaatggcaagagcttccgctactacctgcatgacctgcaggtggacttcctgacagagaagaactgcagccagctgcaggacctgcacaagaagatcatcacccagttccagcgctaccaccagccccacaccctgagcccagaccaggaggactgcatgtactggtacaacttcctggcctaccacatggccagcgccaagatgcacaaggagctgtgtgccctgatgttcagcctggactggatcaaggccaagacagagctggtgggccctgcccacctgatccacgagtttgtggagtaccgccacatcctggatgagaaggactgtgctgtgtctgagaacttccaggagttcctgagcctgaatggccacctgctgggccggcagcccttccccaacatcgtgcagctgggcctgtgtgagcctgagaccagcgaggtgtaccagcaggccaagctgcaggccaagcaggaggtggacaatggcatgctgtacctggagtggatcaacaagaagaacatcaccaacctgagccggctggtggtgcggccccacacagatgctgtgtaccacgcctgcttctctgaagatggccagagaattgccagctgtggggctgacaagaccctgcaggtgttcaaggccgagaccggggagaagctgctggagatcaaggcccatgaagatgaggtgctgtgctgtgccttcagcacagatgaccgcttcatcgccacctgcagcgtggacaagaaggtgaagatctggaacagcatgaccggggagctggtgcacacctatgatgagcacagcgagcaggtgaactgctgccacttcaccaacagcagccaccacctgctgctggccaccggcagcagtgactgcttcctgaagctgtgggacctgaaccagaaggagtgcaggaacaccatgtttggccacaccaacagcgtgaaccactgccgcttctccccagatgacaagctgctggccagctgcagcgcagatggcaccctgaagctgtgggatgccaccagcgccaatgaaaggaagagcatcaacgtgaagcagttcttcctgaacctggaggacccccaggaggacatggaggtgattgtgaagtgctgctcctggagcgcagatggagcccgcatcatggtggccgccaagaacaagatcttcctgtttgacatccacaccagcggcctgctgggggagatccacacaggccaccacagcaccatccagtactgtgacttcagcccccagaaccacctggccgtggtggccctgagccagtactgtgtggagctgtggaacacagacagccgcagcaaggtggccgactgccggggccacctgtcctgggtgcacggcgtgatgttctccccagatggcagcagcttcctgaccagcagtgatgaccagaccatccggctgtgggagaccaagaaggtgtgcaagaacagcgctgtgatgctgaagcaggaggtggatgtggtgttccaggagaatgaggtgatggtgctggccgtggaccacatccggcggctgcagctgatcaatggccgcacaggccagattgactacctgacagaggcccaggtgtcctgctgctgcctgagcccccacctgcagtacatcgcctttggagatgaaaatggagccatcgagatcctggagctggtgaacaaccgcatcttccagagccgcttccagcacaagaagacagtgtggcacatccagttcaccgcagatgagaagaccctcatcagcagcagtgatgatgctgagatccaggtgtggaactggcagctggacaagtgcatcttcctgcggggccaccaggagaccgtgaaggacttccggctgctgaagaacagccggctgctgtcctggagctttgatggcaccgtgaaggtgtggaacatcatcaccggcaacaaggagaaggactttgtgtgccaccagggcaccgtgctgagctgtgacatcagccatgatgccaccaagttcagcagcaccagcgctgacaagacagccaagatctggagctttgacctgctgctgcccctgcacgagctgcggggccacaacggctgtgtgcgctgcagcgccttctctgtggacagcaccctgctggccactggagatgacaacggggagatccgcatctggaatgtgtccaatggagagctgctgcacctgtgtgcccccctgtctgaggagggcgccgccacccacggcggctgggtgacagacctgtgcttctccccagatggcaagatgctgatctctgctgggggctacatcaagtggtggaatgtggtgactggagagagcagccagaccttctacaccaacggcaccaacctgaagaagatccacgtgtccccagacttcaagacctacgtgacagtggacaacctgggcatcctgtacatcctgcagaccctggagtag

SEQ ID NO: 18355 - DNA, 1017 bp, Artificial Sequence; identical to SEQ ID NO: 18347
  Description of Artificial Sequence: Synthetic coding sequence

SEQ ID NO: 18356 - DNA, 2025 bp, Artificial Sequence
  Description of Artificial Sequence: Synthetic coding sequence
atgcccagctacacagtgacagtggccaccggcagccagtggtttgctggaacagatgactacatctacctgagcctggtgggcagcgctggctgcagcgagaagcacctgctggacaagcccttctacaatgactttgaaagaggagctgtggacagctatgatgtgacagtggatgaggagctgggggagatccagctggtgcgcatcgagaagaggaagtactggctgaatgatgactggtacctgaagtacatcaccctgaagaccccccacggggactacatcgagttcccctgctaccgctggatcactggagatgtggaggtggtgctgagagatggccgggccaagctggccagagatgaccagatccacatcctgaagcagcacaggaggaaggagctggagacccggcagaagcagtaccgctggatggagtggaaccctggcttccccctgagcattgatgccaagtgccacaaggacctgccccgggacatccagtttgacagcgagaagggcgtggactttgtgctgaactacagcaaggccatggagaacctcttcatcaaccgcttcatgcacatgttccagagctcctggaatgactttgctgactttgagaagatctttgtgaagatcagcaacaccatcagcgagcgggtgatgaaccactggcaggaggacctgatgtttggctaccagttcctgaatggctgcaaccctgtgctgatccgccgctgcacagagctgcctgagaagctgcctgtgaccacagagatggtggagtgcagcctggagcggcagctgagcctggagcaggaggtgcagcagggcaacatcttcatcgtggactttgagctgctggatggcattgatgccaacaagacagacccctgcaccctgcagttcctggccgcccccatctgcctgctgtacaagaacctggccaacaagatcgtgcccatcgccatccagctgaaccagatccctggagatgagaaccccatcttcctgcccagtgatgccaagtatgactggctgctggccaagatctgggtgcgcagcagtgacttccacgtgcaccagaccatcacccacctgctgcggacccacctggtgtctgaggtgtttggaattgccatgtaccggcagctgcctgctgtgcaccccatcttcaagctgctggtggcccacgtgcgcttcaccatcgccatcaacaccaaggcccgggagcagctgatctgtgaatgtggcctgtttgacaaggccaatgccaccggcggcggcggccacgtgcagatggtgcagagggccatgaaggacctgacctacgccagcctgtgcttccctgaggccatcaaggcccggggcatggagagcaaggaggacatcccctactacttctacagagatgatggcctgctggtgtgggaggccatccgcaccttcaccgctgaggtggtggacatctactatgaaggagaccaggtggtggaggaggaccctgagctgcaggactttgtgaatgatgtgtatgtgtatggcatgaggggcaggaagagcagcggcttccccaagtctgtgaagagccgggagcagctgtctgagtacctgactgtggtgatcttcaccgccagcgcccagcacgccgctgtgaactttggccagtatgactggtgctcctggatccccaatgccccacccaccatgagggcccccccacccacagccaagggcgtggtgaccatcgagcagatcgtggacaccctgcctgaccggggccgcagctgctggcacctgggcgctgtgtgggccctgagccagttccaggagaatgagctgttcctgggcatgtacccagaggagcacttcatcgagaagcctgtgaaggaggccatggcccgcttcaggaagaacctggaggccatcgtgtctgtgattgctgagaggaacaagaagaagcagctgccctactactacctgagcccagaccgcatccccaacagcgtggccatctag

SEQ ID NO: 18357 - DNA, 1854 bp, Artificial Sequence
  Description of Artificial Sequence: Synthetic coding sequence
atgcccagctacacagtgacagtggccaccggcagccagtggtttgctggaacagatgactacatctacctgagcctggtgggcagcgctggctgcagcgagaagcacctgctggacaagcccttctacaatgactttgaaagaggagctgtggacagctatgatgtgacagtggatgaggagctgggggagatccagctggtgcgcatcgagaagaggaagtactggctgaatgatgactggtacctgaagtacatcaccctgaagaccccccacggggactacatcgagttcccctgctaccgctggatcactggagatgtggaggtggtgctgagagatggccgggccaagctggccagagatgaccagatccacatcctgaagcagcacaggaggaaggagctggagacccggcagaagcagtaccgctggatggagtggaaccctggcttccccctgagcattgatgccaagtgccacaaggacctgccccgggacatccagtttgacagcgagaagggcgtggactttgtgctgaactacagcaaggccatggagaacctcttcatcaaccgcttcatgcacatgttccagagctcctggaatgactttgctgactttgagaagatctttgtgaagatcagcaacaccatcagcgagcgggtgatgaaccactggcaggaggacctgatgtttggctaccagttcctgaatggctgcaaccctgtgctgatccgccgctgcacagagctgcctgagaagctgcctgtgaccacagagatggtggagtgcagcctggagcggcagctgagcctggagcaggaggtgcagcagggcaacatcttcatcgtggactttgagctgctggatggcattgatgccaacaagacagacccctgcaccctgcagttcctggccgcccccatctgcctgctgtacaagaacctggccaacaagatcgtgcccatcgccatccagctgaaccagatccctggagatgagaaccccatcttcctgcccagtgatgccaagtatgactggctgctggccaagatctgggtgcgcagcagtgacttccacgtgcaccagaccatcacccacctgctgcggacccacctggtgtctgaggtgtttggaattgccatgtaccggcagctgcctgctgtgcaccccatcttcaagctgctggtggcccacgtgcgcttcaccatcgccatcaacaccaaggcccgggagcagctgatctgtgaatgtggcctgtttgacaaggccaatgccaccggcggcggcggccacgtgcagatggtgcagagggccatgaaggacctgacctacgccagcctgtgcttccctgaggccatcaaggcccggggcatggagagcaaggaggacatcccctactacttctacagagatgatggcctgctggtgtgggaggccatccgcaccttcaccgctgaggtggtggacatctactatgaaggagaccaggtggtggaggaggaccctgagctgcaggactttgtgaatgatgtgtatgtgtatggcatgaggggcaggaagagcagcggcttccccaagtctgtgaagagccgggagcagctgtctgagtacctgactgtggtgatcttcaccgccagcgcccagcacgccgctgtgaactttggccagctgttcctgggcatgtacccagaggagcacttcatcgagaagcctgtgaaggaggccatggcccgcttcaggaagaacctggaggccatcgtgtctgtgattgctgagaggaacaagaagaagcagctgccctactactacctgagcccagaccgcatccccaacagcgtggccatctag

SEQ ID NO: 18358 - DNA, 2511 bp, Artificial Sequence
  Description of Artificial Sequence: Synthetic coding sequence
atgcacgcccagaggcagtttgtggtggccgctgtgcgggcagaggtgagaagacatgaggtggccaagcaggccctgaaccggctgaggaagctggccgagcgggtggatgatcctgagctgcaggacagcatccaggccagcctggacagcatccgggaggccgtcatcaacagccaggagtggaccctgagccgcagcatccctgagctgcggctgggcgtgctgggagatgcccggagcggcaagagcagcctcatccaccgcttcctgaccggcagctaccaggtgctggagaagacagaaagtgagcagtacaagaaggagatgctggtggatggccagacccacctggtgctgatccgggaggaggccggggccccagatgccaagttcagcggctgggcagatgctgtgatctttgtgttcagcctggaggatgagaacagcttccaggccgtgtcccggctgcacggccagctgagcagcctgcggggggagggccggggcggcctggccctggccctggtgggcacccaggaccgcatcagcgccagcagcccccgggtggtgggagatgcccgggcccgggccctgtgtgccgacatgaagcgctgcagctactatgagacctgtgccacctacggcctgaatgtggacagagtcttccaggaggtggcccagaaggtggtgaccctgaggaagcagcagcagctgctggccgcctgcaagagcctgcccagcagccccagccacagcgctgccagcacccctgtggccggccaggccagcaatggaggccacaccagtgactacagcagcagcctgcccagcagccccaacgtgggccaccgggagctgcgggcagaggccgctgctgtggccggcctgagcaccccaggcagcctgcaccgggccgccaagaggaggaccagcctgtttgccaacagaagaggaagtgacagcgagaagaggagcctggacagcagaggagagaccaccggcagcggccgggccatccccatcaagcagagcttcctgctgaagaggagcggcaacagcctgaacaaggagtggaagaagaagtatgtgaccctgagcagcaatggcttcctgctgtaccaccccagcatcaatgactacatccacagcacccacggcaaggagatggacctgctgcggaccaccgtgaaggtgcctgggaagaggcctccccgggccatcagcgccttcggccccagcgccagcatcaatggcctggtgaaggacatgagcacagtgcagatgggagagggcctggaggccaccacccccatgcccagccccagccccagccccagcagcctgcagcccccaccagaccagaccagcaagcacctgctgaagccagacaggaacctggcccgggccctgagcacagactgcacccccagcggggacctgagccccctgagccgggagcccccacccagccccatggtgaagaagcagaggaggaagaagctgaccacccccagcaagacagagggcagcgctggccaggccgaggaggagaactttgagttcctgattgtgagcagcacaggccagacctggcactttgaggccgccagctttgaggagagagatgcctgggtgcaggccatcgagagccagatcctggccagcctgcagtgctgtgagagcagcaaggtgaagctgaggacagacagccagagcgaggccgtggccatccaggccatcagaaatgccaagggcaacagcatctgtgtggactgtggggcccccaaccccacctgggccagcctgaacctgggcgccctgatctgcatcgagtgcagcggcatccacaggaacctgggcacccacctgagccgggtgcgcagcctggacctggatgactggccccgggagctgaccctggtgctgacagccatcggaaatgacacagccaacagagtgtgggagagtgacacccggggccgggccaagcccagccgggacagcagccgggaggagcgggagagctggatccgggccaagtatgagcagctgctcttcctggcccccctgagcaccagcgaggagcccctgggccggcagctgtgggccgctgtgcaggcccaggatgtggccaccgtgctgctgctgctggcccacgcccggcacggccccctggacacctctgtggaggacccccagctgcggagccccctgcacctggccgctgagctggcccacgtggtgatcacccagctgctgctgtggtatggagcagatgtggccgccagagatgcccagggccgcacagccctcttctacgcccggcaggccggcagccagctgtgtgccgacatcctgctgcagcacggctgccctggagagggcggcagcgctgccaccacccccagcgctgccaccacccccagcatcacagccacccccagccccaggagaagaagcagcgctgcctctgtgggccgggcagatgcccctgtggccctggtgtag

SEQ ID NO: 18359 - DNA, 3579 bp, Artificial Sequence
  Description of Artificial Sequence: Synthetic coding sequence
atgagcagaggagctggggccctgcagaggaggaccaccacctacctgatcagcctgaccctggtgaagctggagagcgtgcccccacctccacccagccccagcgctgctgctgctggagctgctggggcccggggcagcgagactggagaccccggcagccccagaggagctgaggagcccgggaagaagagacatgagcggctcttccaccggcaggatgccctgtggatcagcaccagcagcgctggcactggaggagctgagcccccagccctgagccctgccccagccagccctgcccggcctgtgtccccagcccctggccggcggctgagcctgtgggccgtgcccccaggcccccccctgagcggcggcctgagcccagaccccaagccaggaggagcccccaccagcagcagaagacccctgctgagcagccccagctggggcggccctgagcctgagggccgggccggcggcggcatccctggcagcagcagcccccaccctggcaccggcagccggcggctgaaggtggcccctcctcctccagcccccaagccctgcaagacagtgaccaccagcggggccaaggccggcggcggcaagggggccggcagccggctgtcctggccagagagcgagggcaagccccgggtgaagggcagcaagagcagcgctggcaccggggcctctgtgtctgctgctgccacagctgctgctgctgggggcggcggcagcacagccagcaccagcggaggagtgggcgctggggccggggcccggggcaagctgagccccaggaagggcaagagcaagaccctggacaacagcgacctgcaccctggccccccagctggcagccccccacccctgaccctgccccccacccccagccctgccacagctgtgacagctgccagcgcccagcccccaggccctgccccacccatcaccctggagcccccagcccctggcctgaagaggggccgggagggcggccgggccagcacccgggacaggaagatgctgaagttcatcagcggcatcttcaccaagagcactggaggccccccaggcagcggccccctgcccggcccccccagcctgagcagcggcagcggcagccgggagctgctgggcgctgagctgcgggccagccccaaggctgtgatcaacagccaggagtggaccctgagccgcagcatccctgagctgcggctgggcgtgctgggagatgcccggagcggcaagagcagcctcatccaccgcttcctgaccggcagctaccaggtgctggagaagacagaaagtgagcagtacaagaaggagatgctggtggatggccagacccacctggtgctgatccgggaggaggccggggccccagatgccaagttcagcggctgggcagatgctgtgatctttgtgttcagcctggaggatgagaacagcttccaggccgtgtcccggctgcacggccagctgagcagcctgcggggggagggccggggcggcctggccctggccctggtgggcacccaggaccgcatcagcgccagcagcccccgggtggtgggagatgcccgggcccgggccctgtgtgccgacatgaagcgctgcagctactatgagacctgtgccacctacggcctgaatgtggacagagtcttccaggaggtggcccagaaggtggtgaccctgaggaagcagcagcagctgctggccgcctgcaagagcctgcccagcagccccagccacagcgctgccagcacccctgtggccggccaggccagcaatggaggccacaccagtgactacagcagcagcctgcccagcagccccaacgtgggccaccgggagctgcgggcagaggccgctgctgtggccggcctgagcaccccaggcagcctgcaccgggccgccaagaggaggaccagcctgtttgccaacagaagaggaagtgacagcgagaagaggagcctggacagcagaggagagaccaccggcagcggccgggccatccccatcaagcagagcttcctgctgaagaggagcggcaacagcctgaacaaggagtggaagaagaagtatgtgaccctgagcagcaatggcttcctgctgtaccaccccagcatcaatgactacatccacagcacccacggcaaggagatggacctgctgcggaccaccgtgaaggtgcctgggaagaggcctccccgggccatcagcgccttcggccccagcgccagcatcaatggcctggtgaaggacatgagcacagtgcagatgggagagggcctggaggccaccacccccatgcccagccccagccccagccccagcagcctgcagcccccaccagaccagaccagcaagcacctgctgaagccagacaggaacctggcccgggccctgagcacagactgcacccccagcggggacctgagccccctgagccgggagcccccacccagccccatggtgaagaagcagaggaggaagaagctgaccacccccagcaagacagagggcagcgctggccaggccgaggccaagaggaagatgtggaagctgaagagctttggcagcctgaggaacatctacaaggccgaggagaactttgagttcctgattgtgagcagcacaggccagacctggcactttgaggccgccagctttgaggagagagatgcctgggtgcaggccatcgagagccagatcctggccagcctgcagtgctgtgagagcagcaaggtgaagctgaggacagacagccagagcgaggccgtggccatccaggccatcagaaatgccaagggcaacagcatctgtgtggactgtggggcccccaaccccacctgggccagcctgaacctgggcgccctgatctgcatcgagtgcagcggcatccacaggaacctgggcacccacctgagccgggtgcgcagcctggacctggatgactggccccgggagctgaccctggtgctgacagccatcggaaatgacacagccaacagagtgtgggagagtgacacccggggccgggccaagcccagccgggacagcagccgggaggagcgggagagctggatccgggccaagtatgagcagctgctcttcctggcccccctgagcaccagcgaggagcccctgggccggcagctgtgggccgctgtgcaggcccaggatgtggccaccgtgctgctgctgctggcccacgcccggcacggccccctggacacctctgtggaggacccccagctgcggagccccctgcacctggccgctgagctggcccacgtggtgatcacccagctgctgctgtggtatggagcagatgtggccgccagagatgcccagggccgcacagccctcttctacgcccggcaggccggcagccagctgtgtgccgacatcctgctgcagcacggctgccctggagagggcggcagcgctgccaccacccccagcgctgccaccacccccagcatcacagccacccccagccccaggagaagaagcagcgctgcctctgtgggccgggcagatgcccctgtggccctggtgtag

SEQ ID NO: 18360 - DNA, 1185 bp, Artificial Sequence
  Description of Artificial Sequence: Synthetic coding sequence
atggacagccagggcaggaaggtggtggtgtgtgacaatggaactggatttgtgaagtgtggctacgccggcagcaacttccctgagcacatcttccctgccctggtgggccggcccatcatccgcagcaccaccaaggtgggcaacatcgagatcaaggacctgatggtgggagatgaggccagcgagctgcgctccatgctggaggtgaactaccccatggagaatggcatcgtgaggaactgggatgacatgaagcacctgtgggactacacctttggacctgagaagctgaacatcgacaccaggaactgcaagatcctgctgacagagccccccatgaaccccaccaagaaccgggagaagatcgtggaggtgatgtttgagacctaccagttcagcggcgtgtatgtggccatccaggccgtgctgaccctgtatgcccagggcctgctgactggagtggtggtggacagcggagatggagtgacccacatctgccctgtgtatgagggcttcagcctgccccacctgacccggcggctggacattgctggccgggacatcacccgctacctgatcaagctgctgctgctgcggggctacgccttcaaccacagcgctgactttgagaccgtgaggatgatcaaggagaagctgtgctacgtgggctacaacatcgagcaggagcagaagctggccctggagaccaccgtgctggtggagagctacaccctgcctgatggccgcatcatcaaggtgggcggggagagatttgaggcccctgaggccctcttccagccccacctgatcaacgtggagggcgtgggcgtggccgagctgctcttcaacaccatccaggccgctgacatcgacaccaggtctgagttctacaagcacatcgtgctgagcggcggcagcaccatgtacccaggcctgcccagccggctggagcgggagctgaagcagctgtacctggagcgggtgctgaagggagatgtggagaagctgagcaagttcaagatcagaattgaagatcctcccaggaggaagcacatggtgttcctgggcggcgctgtgctggccgacatcatgaaggacaaggacaacttctggatgacccggcaggagtaccaggagaagggcgtgcgggtgctggagaagctgggcgtgacagtgaggtag

SEQ ID NO: 18361 - DNA, 1200 bp, Artificial Sequence
  Description of Artificial Sequence: Synthetic coding sequence
atggacagccagggcaggaaggtggtggtgtgtgacaatggaactggatttgtgaagtgtggctacgccggcagcaacttccctgagcacatcttccctgccctggtgggccggcccatcatccgcagcaccaccaaggtgggcaacatcgagatcaagaacaacaagaagatggacctgatggtgggagatgaggccagcgagctgcgctccatgctggaggtgaactaccccatggagaatggaattgtgaggaactgggatgacatgaagcacctgtgggactacaccttcggccctgagaagctgaacatcgacaccaggaactgcaagatcctgctgacagagccccccatgaaccccaccaagaaccgggagaagatcgtggaggtgatgtttgagacctaccagttctctggagtgtatgtggccatccaggccgtgctgaccctgtatgcccagggcctgctgactggagtggtggtggacagcggagatggagtgacccacatctgccctgtgtatgagggcttcagcctgccccacctgacccggcggctggacattgctggccgggacatcacccgctacctgatcaagctgctgctgctgcggggctacgccttcaaccacagcgctgactttgaaacagtgaggatgatcaaggagaagctgtgctacgtgggctacaacatcgagcaggagcagaagctggccctggagaccaccgtgctggtggagagctacaccctgcctgatggccgcatcatcaaggtgggcggggagagatttgaggcccctgaggccctcttccagccccacctgatcaacgtggagggcgtgggcgtggccgagctgctcttcaacaccatccaggccgctgacatcgacaccaggtctgagttctacaagcacatcgtgctgagcggcggcagcaccatgtacccaggcctgcccagccggctggagcgggagctgaagcagctgtacctggagcgggtgctgaagggagatgtggagaagctgagcaagttcaagatcagaattgaggacccccccaggaggaagcacatggtgttcctgggcggcgctgtgctggccgacatcatgaaggacaaggacaacttctggatgacccggcaggagtaccaggagaagggcgtgcgggtgctggagaagctgggcgtgacagtgaggtag

SEQ ID NO: 18362 - DNA, 1020 bp, Artificial Sequence
  Description of Artificial Sequence: Synthetic coding sequence
atggtgggagatgaggccagcgagctgcgctccatgctggaggtgaactaccccatggagaatggaattgtgaggaactgggatgacatgaagcacctgtgggactacaccttcggccctgagaagctgaacatcgacaccaggaactgcaagatcctgctgacagagccccccatgaaccccaccaagaaccgggagaagatcgtggaggtgatgtttgagacctaccagttctctggagtgtatgtggccatccaggccgtgctgaccctgtatgcccagggcctgctgactggagtggtggtggacagcggagatggagtgacccacatctgccctgtgtatgagggcttcagcctgccccacctgacccggcggctggacattgctggccgggacatcacccgctacctgatcaagctgctgctgctgcggggctacgccttcaaccacagcgctgactttgaaacagtgaggatgatcaaggagaagctgtgctacgtgggctacaacatcgagcaggagcagaagctggccctggagaccaccgtgctggtggagagctacaccctgcctgatggccgcatcatcaaggtgggcggggagagatttgaggcccctgaggccctcttccagccccacctgatcaacgtggagggcgtgggcgtggccgagctgctcttcaacaccatccaggccgctgacatcgacaccaggtctgagttctacaagcacatcgtgctgagcggcggcagcaccatgtacccaggcctgcccagccggctggagcgggagctgaagcagctgtacctggagcgggtgctgaagggagatgtggagaagctgagcaagttcaagatcagaattgaggacccccccaggaggaagcacatggtgttcctgggcggcgctgtgctggccgacatcatgaaggacaaggacaacttctggatgacccggcaggagtaccaggagaagggcgtgcgggtgctggagaagctgggcgtgacagtgaggtag

SEQ ID NO: 18363 - DNA, 918 bp, Artificial Sequence
  Description of Artificial Sequence: Synthetic coding sequence
atggtgggagatgaggccagcgagctgcgctccatgctggaggtgaactaccccatggagaatggaattgtgaggaactgggatgacatgaagcacctgtgggactacaccttcggccctgagaagctgaacatcgacaccaggaactgcaagatcctgctgacagagccccccatgaaccccaccaagaaccgggagaagatcgtggaggtgatgtttgagacctaccagttctctggagtgtatgtggccatccaggccgtgctgaccctgtatgcccagggcctgctgactggagtggtggtggacagcggagatggagtgacccacatctgccctgtgtatgagggcttcagcctgccccacctgacccggcggctggacattgctggccgggacatcacccgctacctgatcaagctgctgctgctgcggggctacgccttcaaccacagcgctgactttgaaacagtgaggatgatcaaggagaagctgtgctacgtgggctacaacatcgagcaggagcagaagctggccctggagaccaccgtgctggtggagagctacaccctgcctgatggccgcatcatcaaggtgggcggggagagatttgaggcccctgaggccctcttccagccccacctgatcaacgtggagggcgtgggcgtggccgagctgctcttcaacaccatccaggccgctgacatcgacaccaggtctgagttctacaagcacatcgtgctgagcggcggcagcaccatgtacccaggcctgcccagccggctggagcgggagctgaagcagctgtacctggagcgggtgctgaagggagatgtggagaagctgtctgtgtccatcagcaagagcaccatcaccaacatcctgctgaagggctacacagtggtgtgtgagagctag

SEQ ID NO: 18364 - DNA, 1257 bp, Artificial Sequence
  Description of Artificial Sequence: Synthetic coding sequence
atggccggccgcctgcctgcctgtgtggtggactgtggcaccggctacaccaagctgggctacgccggcaacacagagccccagttcatcatccccagctgcatcgccatcaaggagagcgccaaggtgggggaccaggcccagaggagagtgatgaagggcgtggatgacctggacttcttcatcggagatgaggccatcgagaagcccacctacgccaccaagtggcccatccgccacggcatcgtggaggactgggacctgatggagcgcttcatggagcaggtgatcttcaagtacctgcgggcagagcctgaggaccactacttcctgctgacagagccccccctgaacaccccagaaaatcgggagtacacagctgagatcatgtttgagagcttcaacgtgcccggcctgtacatcgctgtgcaggccgtgctggccctggccgcctcctggaccagccggcaggtgggggagaggaccctgaccggcaccgtcatcgacagcggagatggagtgacccacgtgattcctgtggccgagggctacgtgattggcagctgcatcaagcacatccccatcgccggccgggacatcacctacttcatccagcagctgctgcgggaccgggaggtgggcatccccccagagcagagcctggagacagccaaggctgtgaaggagcgctacagctatgtgtgcccagacctggtgaaggagttcaacaagtatgacacagatggcagcaagtggatcaagcagtacacaggcatcaatgccatcagcaagaaggagttcagcattgatgtgggctatgagcgcttcctgggccctgagatcttcttccaccctgagtttgccaacccagacttcacccagcccatcagcgaggtggtggatgaagtcatccagaactgccccattgatgtgcggcggcccctgtacaagaacatcgtgctgagcggcggcagcaccatgttccgggactttggaagaaggctgcagagggacctgaagaggacagtggatgcccggctgaagctgtctgaggagctgagcggcggccgcctgaagcccaagcccattgatgtgcaggtgatcacccaccacatgcagagatatgctgtgtggtttggaggctccatgctggccagcaccccagagttctaccaggtgtgccacaccaagaaggactatgaggagatcggccccagcatctgccgccacaaccctgtgtttggagtgatgtcctag

SEQ ID NO: 18365 - DNA, 1104 bp, Artificial Sequence
  Description of Artificial Sequence: Synthetic coding sequence
atgaagggcgtggatgacctggacttcttcatcggagatgaggccatcgagaagcccacctacgccaccaagtggcccatcagacatggaattgtggaggactgggacctgatggagcgcttcatggagcaggtgatcttcaagtacctgcgggcagagcctgaggaccactacttcctgctgacagagccccccctgaacaccccagagaaccgggagtacacagctgagatcatgtttgagagcttcaacgtgcccggcctgtacatcgctgtgcaggccgtgctggccctggccgcctcctggaccagccggcaggtgggggagaggaccctgactggaacagtgattgattctggagatggagtgacccacgtgattcctgtggccgagggctacgtgattggcagctgcatcaagcacatccccatcgccggccgggacatcacctacttcatccagcagctgctgcgggaccgggaggtgggcatccccccagagcagagcctggagacagccaaggctgtgaaggagcgctacagctatgtgtgcccagacctggtgaaggagttcaacaagtatgacacagatggcagcaagtggatcaagcagtacacaggcatcaatgccatcagcaagaaggagttcagcattgatgtgggctatgagcgcttcctgggccctgagatcttcttccaccctgagtttgccaacccagacttcacccagcccatcagcgaggtggtggatgaggtgatccagaactgccccattgatgtgagaagacccctgtacaagaacatcgtgctgagcggcggcagcaccatgttccgggactttggccggcggctgcagagggacctgaagaggacagtggatgcccggctgaagctgtctgaggagctgagcggcggccgcctgaagcccaagcccattgatgtgcaggtgatcacccaccacatgcagagatatgctgtgtggtttggaggctccatgctggccagcaccccagagttctaccaggtgtgccacaccaagaaggactatgaggagatcggccccagcatctgccgccacaaccctgtgtttggagtgatgtcctag

SEQ ID NO: 18366 - DNA, 1071 bp, Artificial Sequence
  Description of Artificial Sequence: Synthetic coding sequence
atgctggagatccagaaccacagcctgagcagcctgccctggcccatccgccacggcatcgtggaggactgggacctgatggagcgcttcatggagcaggtgatcttcaagtacctgcgggcagagcctgaggaccactacttcctgctgacagagccccccctgaacaccccagaaaatcgggagtacacagctgagatcatgtttgagagcttcaacgtgcccggcctgtacatcgctgtgcaggccgtgctggccctggccgcctcctggaccagccggcaggtgggggagaggaccctgaccggcaccgtcatcgacagcggagatggagtgacccacgtgattcctgtggccgagggctacgtgattggcagctgcatcaagcacatccccatcgccggccgggacatcacctacttcatccagcagctgctgcgggaccgggaggtgggcatccccccagagcagagcctggagacagccaaggctgtgaaggagcgctacagctatgtgtgcccagacctggtgaaggagttcaacaagtatgacacagatggcagcaagtggatcaagcagtacacaggcatcaatgccatcagcaagaaggagttcagcattgatgtgggctatgagcgcttcctgggccctgagatcttcttccaccctgagtttgccaacccagacttcacccagcccatcagcgaggtggtggatgaagtcatccagaactgccccattgatgtgcggcggcccctgtacaagaacatcgtgctgagcggcggcagcaccatgttccgggactttggaagaaggctgcagagggacctgaagaggacagtggatgcccggctgaagctgtctgaggagctgagcggcggccgcctgaagcccaagcccattgatgtgcaggtgatcacccaccacatgcagagatatgctgtgtggtttggaggctccatgctggccagcaccccagagttctaccaggtgtgccacaccaagaaggactatgaggagatcggccccagcatctgccgccacaaccctgtgtttggagtgatgtcctag

SEQ ID NO: 18367 - DNA, 870 bp, Artificial Sequence
  Description of Artificial Sequence: Synthetic coding sequence
atgtttgagagcttcaacgtgcccggcctgtacatcgctgtgcaggccgtgctggccctggccgcctcctggaccagccggcaggtgggggagaggaccctgactggaacagtgattgattctggagatggagtgacccacgtgattcctgtggccgagggctacgtgattggcagctgcatcaagcacatccccatcgccggccgggacatcacctacttcatccagcagctgctgcgggaccgggaggtgggcatccccccagagcagagcctggagacagccaaggctgtgaaggagcgctacagctatgtgtgcccagacctggtgaaggagttcaacaagtatgacacagatggcagcaagtggatcaagcagtacacaggcatcaatgccatcagcaagaaggagttcagcattgatgtgggctatgagcgcttcctgggccctgagatcttcttccaccctgagtttgccaacccagacttcacccagcccatcagcgaggtggtggatgaggtgatccagaactgccccattgatgtgagaagacccctgtacaagaacatcgtgctgagcggcggcagcaccatgttccgggactttggccggcggctgcagagggacctgaagaggacagtggatgcccggctgaagctgtctgaggagctgagcggcggccgcctgaagcccaagcccattgatgtgcaggtgatcacccaccacatgcagagatatgctgtgtggtttggaggctccatgctggccagcaccccagagttctaccaggtgtgccacaccaagaaggactatgaggagatcggccccagcatctgccgccacaaccctgtgtttggagtgatgtcctag

SEQ ID NO: 18368 - DNA, 1749 bp, Artificial Sequence
  Description of Artificial Sequence: Synthetic coding sequence
attgatattgaatccatggacacagacaaggatgacccccacggccgcctggagtacacagagcaccagggccgcatcaagaatgcccgggaggcccacagccagatcgagaagagaagaagagacaagatgaacagcttcattgatgagctggccagcctggtgcccacctgcaatgccatgagcaggaagctggacaagctgactgtgctgaggatggctgtgcagcacatgaagaccctgcggggggccaccaacccctacacagaggccaactacaagcccaccttcctgagtgatgatgagctgaagcacctgatcctgcgggctgctgatggcttcctgtttgtggtgggctgtgaccggggcaagatcctgtttgtgtctgagagcgtcttcaagatcctgaactacagccagaatgacctgattggccagagcctgtttgactacctgcaccccaaggacatcgccaaggtgaaggagcagctgagcagcagtgacacagccccccgggagcggctgattgatgccaagacaggcctgcctgtgaagacagacatcaccccaggccccagccggctgtgcagcggggcccggcgctccttcttctgcaggatgaagtgcaaccggcccagcgtgaaggtggaggacaaggacttccccagcacctgcagcaagaagaaggctgacaggaagagcttctgcaccatccacagcacaggctacctgaagtcctggccacccaccaagatgggcctggatgaggacaatgaaccagacaatgaaggctgcaacctgagctgcctggtggccatcggccgcctgcacagccacgtggtgccccagcctgtgaatggagagatccgggtgaagtccatggagtatgtgtccagacatgccattgatggcaagtttgtgtttgtggaccagagggccacagccatcctggcctacctgccccaggagctgctgggcaccagctgctatgagtacttccaccaggatgacatcggccacctggccgagtgccaccggcaggtgctgcagacccgggagaagatcaccaccaactgctacaagttcaagatcaaggatggcagcttcatcaccctgcggagccgctggttctccttcatgaacccctggaccaaggaggtggagtacatcgtgtccaccaacacagtggtgctggccaacgtgctggagggcggggaccccaccttcccccagctgacagccagcccccacagcatggacagcatgctgcccagcggggagggcggccccaagaggacccaccccaccgtgcccggcatccctgggggcacccgggccggggccggcaagattggaaggatgattgctgaggagatcatggagatccaccgcatccggggcagcagccccagcagctgtggcagcagccccctgaacatcaccagcaccccacctccagatgccagcagccctgggggcaagaagatcctgaatggaggcaccccagacatccccagcagcggcctgctgagcggccaggcccaggagaaccctggctacccctacagcgacagcagcagcatcctgggggagaacccccacatcggcatcgacatgattgacaatgaccagggcagcagcagccccagcaatgatgaggccgccatggctgtgatcatgagcctgctggaggctgatgctggcctgggcggccctgtggacttcagtgacctgccctggcccctgtag

SEQ ID NO: 18369 - DNA, 1527 bp, Artificial Sequence
  Description of Artificial Sequence: Synthetic coding sequence
atggctgaccagaggatggacatcagcagcaccatcagtgacttcatgagccctggccccacagacctgctgagcagcagcctgggcaccagcggcgtggactgcaacaggaagaggaagggcagcagcacagactaccaggagagcatggacacagacaaggatgacccccacggccgcctggagtacacagagcaccagggccgcatcaagaatgcccgggaggcccacagccagatcgagaagagaagaagagacaagatgaacagcttcattgatgagctggccagcctggtgcccacctgcaatgccatgagcaggaagctggacaagctgactgtgctgaggatggctgtgcagcacatgaagaccctgcggggggccaccaacccctacacagaggccaactacaagcccaccttcctgagtgatgatgagctgaagcacctgatcctgcgggctgctgatggcttcctgtttgtggtgggctgtgaccggggcaagatcctgtttgtgtctgagagcgtcttcaagatcctgaactacagccagaatgacctgattggccagagcctgtttgactacctgcaccccaaggacatcgccaaggtgaaggagcagctgagcagcagtgacacagccccccgggagcggctgattgatgccaagacaggcctgcctgtgaagacagacatcaccccaggccccagccggctgtgcagcggggcccggcgctccttcttctgcaggatgaagtgcaaccggcccagcgtgaaggtggaggacaaggacttccccagcacctgcagcaagaagaaggtgctgcagacccgggagaagatcaccaccaactgctacaagttcaagatcaaggatggcagcttcatcaccctgcggagccgctggttctccttcatgaacccctggaccaaggaggtggagtacatcgtgtccaccaacacagtggtgctggccaacgtgctggagggcggggaccccaccttcccccagctgacagccagcccccacagcatggacagcatgctgcccagcggggagggcggccccaagaggacccaccccaccgtgcccggcatccctgggggcacccgggccggggccggcaagattggaaggatgattgctgaggagatcatggagatccaccgcatccggggcagcagccccagcagctgtggcagcagccccctgaacatcaccagcaccccacctccagatgccagcagccctgggggcaagaagatcctgaatggaggcaccccagacatccccagcagcggcctgctgagcggccaggcccaggagaaccctggctacccctacagcgacagcagcagcatcctgggggagaacccccacatcggcatcgacatgattgacaatgaccagggcagcagcagccccagcaatgatgaggccgccatggctgtgatcatgagcctgctggaggctgatgctggcctgggcggccctgtggacttcagtgacctgccctggcccctgtag

SEQ ID NO: 18370 - DNA, 1878 bp, Artificial Sequence
  Description of Artificial Sequence: Synthetic coding sequence
atggctgaccagaggatggacatcagcagcaccatcagtgacttcatgagccctggccccacagacctgctgagcagcagcctgggcaccagcggcgtggactgcaacaggaagaggaagggcagcagcacagactaccaggagagcatggacacagacaaggatgacccccacggccgcctggagtacacagagcaccagggccgcatcaagaatgcccgggaggcccacagccagatcgagaagagaagaagagacaagatgaacagcttcattgatgagctggccagcctggtgcccacctgcaatgccatgagcaggaagctggacaagctgactgtgctgaggatggctgtgcagcacatgaagaccctgcggggggccaccaacccctacacagaggccaactacaagcccaccttcctgagtgatgatgagctgaagcacctgatcctgcgggctgctgatggcttcctgtttgtggtgggctgtgaccggggcaagatcctgtttgtgtctgagagcgtcttcaagatcctgaactacagccagaatgacctgattggccagagcctgtttgactacctgcaccccaaggacatcgccaaggtgaaggagcagctgagcagcagtgacacagccccccgggagcggctgattgatgccaagacaggcctgcctgtgaagacagacatcaccccaggccccagccggctgtgcagcggggcccggcgctccttcttctgcaggatgaagtgcaaccggcccagcgtgaaggtggaggacaaggacttccccagcacctgcagcaagaagaaggacaggaagagcttctgcaccatccacagcacaggctacctgaagtcctggccacccaccaagatgggcctggatgaagataatgaaccagacaatgaaggctgcaacctgagctgcctggtggccatcggccgcctgcacagccacgtggtgccccagcctgtgaatggagagatccgggtgaagtccatggagtatgtgtccagacatgccattgatggcaagtttgtgtttgtggaccagagggccacagccatcctggcctacctgccccaggagctgctgggcaccagctgctatgagtacttccaccaggatgacatcggccacctggccgagtgccaccggcaggtgctgcagacccgggagaagatcaccaccaactgctacaagttcaagatcaaggatggcagcttcatcaccctgcggagccgctggttctccttcatgaacccctggaccaaggaggtggagtacatcgtgtccaccaacacagtggtgctggccaacgtgctggagggcggggaccccaccttcccccagctgacagccagcccccacagcatggacagcatgctgcccagcggggagggcggccccaagaggacccaccccaccgtgcccggcatccctgggggcaccagggctggagctgggaagattggccgcatgattgctgaggagatcatggagatccaccgcatccggggcagcagccccagcagctgtggcagcagccccctgaacatcaccagcaccccacctccagatgccagcagccctgggggcaagaagatcctgaatggaggcaccccagacatccccagcagcggcctgctgagcggccaggcccaggagaaccctggctacccctacagcgacagcagcagcatcctgggggagaacccccacatcggcatcgacatgattgacaatgaccagggcagcagcagccccagcaatgatgaagctgccatggccgtcatcatgagcctgctggaggctgatgctggcctgggcggccctgtggacttcagtgacctgccctggcccctgtag

SEQ ID NO: 18371 - DNA, 1581 bp, Artificial Sequence
  Description of Artificial Sequence: Synthetic coding sequence
atggctgaccagaggatggacatcagcagcaccatcagtgacttcatgagccctggccccacagacctgctgagcagcagcctgggcaccagcggcgtggactgcaacaggaagaggaagggcagcagcacagactaccaggagagcatggacacagacaaggatgacccccacggccgcctggagtacacagagcaccagggccgcatcaagaatgcccgggaggcccacagccagatcgagaagagaagaagagacaagatgaacagcttcattgatgagctggccagcctggtgcccacctgcaatgccatgagcaggaagctggacaagctgactgtgctgaggatggctgtgcagcacatgaagaccctgcggggggccaccaacccctacacagaggccaactacaagcccaccttcctgagtgatgatgagctgaagcacctgatcctgcgggctgctgatggcttcctgtttgtggtgggctgtgaccggggcaagatcctgtttgtgtctgagagcgtcttcaagatcctgaactacagccagaatgacctgattggccagagcctgtttgactacctgcaccccaaggacatcgccaaggtgaaggagcagctgagcagcagtgacacagccccccgggagcggctgattgatgccaagacaggcctgcctgtgaagacagacatcaccccaggccccagccggctgtgcagcggggcccggcgctccttcttctgcaggatgaagtgcaaccggcccagcgtgaaggtggaggacaaggacttccccagcacctgcagcaagaagaaggctgacaggaagagcttctgcaccatccacagcacaggctacctgaagtcctggccacccaccaagatgggcctggatgaggacaatgaaccagacaatgaaggctgcaacctgagctgcctggtggccatcggccgcctgcacagccacgtggtgccccagcctgtgaatggagagatccgggtgaagtccatggagtatgtgtccagacatgccattgatggcaagtttgtgtttgtggaccagagggccacagccatcctggcctacctgccccaggagctgctgggcaccagctgctatgagtacttccaccaggatgacatcggccacctggccgagtgccaccggcaggtgctgcagacccgggagaagatcaccaccaactgctacaagttcaagatcaaggatggcagcttcatcaccctgcggagccgctggttctccttcatgaacccctggaccaaggaggtggagtacatcgtgtccaccaacacagtggtgctgagccgggtggacaccggccacctgggccaggtggagtggtgcaccgtgctgagcaggccagacagccgcttcctgattgctggcatgttcacagagcccacctcctggaaggccggcacccagcccagccacagcagccagcaccccccaacagcctggacagcctgctgccccctggagaaggtggcccagaggggccccacccccctcttccagggcttccagggcgagcccggcctgggccaggagaagtag

SEQ ID NO: 18372 - DNA, 1878 bp, Artificial Sequence; identical to SEQ ID NO: 18370
  Description of Artificial Sequence: Synthetic coding sequence

SEQ ID NO: 18373 - DNA, 1752 bp, Artificial Sequence
  Description of Artificial Sequence: Synthetic coding sequence
atgatcaacatcgagagcatggacacagacaaggatgacccccacggccgcctggagtacacagagcaccagggccgcatcaagaatgcccgggaggcccacagccagatcgagaagagaagaagagacaagatgaacagcttcattgatgagctggccagcctggtgcccacctgcaatgccatgagcaggaagctggacaagctgactgtgctgaggatggctgtgcagcacatgaagaccctgcggggggccaccaacccctacacagaggccaactacaagcccaccttcctgagtgatgatgagctgaagcacctgatcctgcgggcagcagatggcttcctgtttgtggtgggctgtgaccggggcaagatcctgtttgtgtctgagagcgtcttcaagatcctgaactacagccagaatgacctgattggccagagcctgtttgactacctgcaccccaaggacatcgccaaggtgaaggagcagctgagcagcagtgacacagccccccgggagcggctgattgatgccaagacaggcctgcctgtgaagacagacatcaccccaggccccagccggctgtgcagcggggcccggcgctccttcttctgcaggatgaagtgcaaccggcccagcgtgaaggtggaggacaaggacttccccagcacctgcagcaagaagaaggctgacaggaagagcttctgcaccatccacagcacaggctacctgaagtcctggccacccaccaagatgggcctggatgaagataatgaaccagacaatgaaggctgcaacctgagctgcctggtggccatcggccgcctgcacagccacgtggtgccccagcctgtgaatggagagatccgggtgaagtccatggagtatgtgtccagacatgccattgatggcaagtttgtgtttgtggaccagagggccacagccatcctggcctacctgccccaggagctgctgggcaccagctgctatgagtacttccaccaggatgacatcggccacctggccgagtgccaccggcaggtgctgcagacccgggagaagatcaccaccaactgctacaagttcaagatcaaggatggcagcttcatcaccctgcggagccgctggttctccttcatgaacccctggaccaaggaggtggagtacatcgtgtccaccaacacagtggtgctggccaacgtgctggagggcggggaccccaccttcccccagctgacagccagcccccacagcatggacagcatgctgcccagcggggagggcggccccaagaggacccaccccaccgtgcccggcatccctgggggcaccagggctggagctgggaagattggccgcatgattgctgaggagatcatggagatccaccgcatccggggcagcagccccagcagctgtggcagcagccccctgaacatcaccagcaccccacctccagatgccagcagccctgggggcaagaagatcctgaatggaggcaccccagacatccccagcagcggcctgctgagcggccaggcccaggagaaccctggctacccctacagcgacagcagcagcatcctgggggagaacccccacatcggcatcgacatgattgacaatgaccagggcagcagcagccccagcaatgatgaagctgccatggccgtcatcatgagcctgctggaggctgatgctggcctgggcggccctgtggacttcagtgacctgccctggcccctgtag

SEQ ID NO: 18374 - DNA, 1881 bp, Artificial Sequence
  Description of Artificial Sequence: Synthetic coding sequence
atggctgaccagaggatggacatcagcagcaccatcagtgacttcatgagccctggccccacagacctgctgagcagcagcctgggcaccagcggcgtggactgcaacaggaagaggaagggcagcagcacagactaccaggagagcatggacacagacaaggatgacccccacggccgcctggagtacacagagcaccagggccgcatcaagaatgcccgggaggcccacagccagatcgagaagagaagaagagacaagatgaacagcttcattgatgagctggccagcctggtgcccacctgcaatgccatgagcaggaagctggacaagctgactgtgctgaggatggctgtgcagcacatgaagaccctgcggggggccaccaacccctacacagaggccaactacaagcccaccttcctgagtgatgatgagctgaagcacctgatcctgcgggctgctgatggcttcctgtttgtggtgggctgtgaccggggcaagatcctgtttgtgtctgagagcgtcttcaagatcctgaactacagccagaatgacctgattggccagagcctgtttgactacctgcaccccaaggacatcgccaaggtgaaggagcagctgagcagcagtgacacagccccccgggagcggctgattgatgccaagacaggcctgcctgtgaagacagacatcaccccaggccccagccggctgtgcagcggggcccggcgctccttcttctgcaggatgaagtgcaaccggcccagcgtgaaggtggaggacaaggacttccccagcacctgcagcaagaagaaggctgacaggaagagcttctgcaccatccacagcacaggctacctgaagtcctggccacccaccaagatgggcctggatgaggacaatgaaccagacaatgaaggctgcaacctgagctgcctggtggccatcggccgcctgcacagccacgtggtgccccagcctgtgaatggagagatccgggtgaagtccatggagtatgtgtccagacatgccattgatggcaagtttgtgtttgtggaccagagggccacagccatcctggcctacctgccccaggagctgctgggcaccagctgctatgagtacttccaccaggatgacatcggccacctggccgagtgccaccggcaggtgctgcagacccgggagaagatcaccaccaactgctacaagttcaagatcaaggatggcagcttcatcaccctgcggagccgctggttctccttcatgaacccctggaccaaggaggtggagtacatcgtgtccaccaacacagtggtgctggccaacgtgctggagggcggggaccccaccttcccccagctgacagccagcccccacagcatggacagcatgctgcccagcggggagggcggccccaagaggacccaccccaccgtgcccggcatccctgggggcacccgggccggggccggcaagattggaaggatgattgctgaggagatcatggagatccaccgcatccggggcagcagccccagcagctgtggcagcagccccctgaacatcaccagcaccccacctccagatgccagcagccctgggggcaagaagatcctgaatggaggcaccccagacatccccagcagcggcctgctgagcggccaggcccaggagaaccctggctacccctacagcgacagcagcagcatcctgggggagaacccccacatcggcatcgacatgattgacaatgaccagggcagcagcagccccagcaatgatgaggccgccatggctgtgatcatgagcctgctggaggctgatgctggcctgggcggccctgtggacttcagtgacctgccctggcccctgtag

SEQ ID NO: 18375 - DNA, 1749 bp, Artificial Sequence
  Description of Artificial Sequence: Synthetic coding sequence
atgatcaacatcgagagcatggacacagacaaggatgacccccacggccgcctggagtacacagagcaccagggccgcatcaagaatgcccgggaggcccacagccagatcgagaagagaagaagagacaagatgaacagcttcattgatgagctggccagcctggtgcccacctgcaatgccatgagcaggaagctggacaagctgactgtgctgaggatggctgtgcagcacatgaagaccctgcggggggccaccaacccctacacagaggccaactacaagcccaccttcctgagtgatgatgagctgaagcacctgatcctgcgggcagcagatggcttcctgtttgtggtgggctgtgaccggggcaagatcctgtttgtgtctgagagcgtcttcaagatcctgaactacagccagaatgacctgattggccagagcctgtttgactacctgcaccccaaggacatcgccaaggtgaaggagcagctgagcagcagtgacacagccccccgggagcggctgattgatgccaagacaggcctgcctgtgaagacagacatcaccccaggccccagccggctgtgcagcggggcccggcgctccttcttctgcaggatgaagtgcaaccggcccagcgtgaaggtggaggacaaggacttccccagcacctgcagcaagaagaaggacaggaagagcttctgcaccatccacagcacaggctacctgaagtcctggccacccaccaagatgggcctggatgaggacaatgaaccagacaatgaaggctgcaacctgagctgcctggtggccatcggccgcctgcacagccacgtggtgccccagcctgtgaatggagagatccgggtgaagtccatggagtatgtgtccagacatgccattgatggcaagtttgtgtttgtggaccagagggccacagccatcctggcctacctgccccaggagctgctgggcaccagctgctatgagtacttccaccaggatgacatcggccacctggccgagtgccaccggcaggtgctgcagacccgggagaagatcaccaccaactgctacaagttcaagatcaaggatggcagcttcatcaccctgcggagccgctggttctccttcatgaacccctggaccaaggaggtggagtacatcgtgtccaccaacacagtggtgctggccaacgtgctggagggcggggaccccaccttcccccagctgacagccagcccccacagcatggacagcatgctgcccagcggggagggcggccccaagaggacccaccccaccgtgcccggcatccctgggggcacccgggccggggccggcaagattggaaggatgattgctgaggagatcatggagatccaccgcatccggggcagcagccccagcagctgtggcagcagccccctgaacatcaccagcaccccacctccagatgccagcagccctgggggcaagaagatcctgaatggaggcaccccagacatccccagcagcggcctgctgagcggccaggcccaggagaaccctggctacccctacagcgacagcagcagcatcctgggggagaacccccacatcggcatcgacatgattgacaatgaccagggcagcagcagccccagcaatgatgaggccgccatggctgtgatcatgagcctgctggaggctgatgctggcctgggcggccctgtggacttcagtgacctgccctggcccctgtag

SEQ ID NO: 18376 - DNA, 219 bp, Artificial Sequence
  Description of Artificial Sequence: Synthetic coding sequence
atgatcaacatcgagagcatggacacagacaaggatgacccccacggccgcctggagtacacagagcaccagggccgcatcaagaatgcccgggaggcccacagccagatcgagaagagaagaagagacaagatgaacagcttcattgatgagctggccagcctggtgcccacctgcaatgccatgagcaggaagctggacaagctgactgtgctgtag

SEQ ID NO: 18377 - DNA, 231 bp, Artificial Sequence
  Description of Artificial Sequence: Synthetic coding sequence
atggctgaccagaggatggacatcagcagcaccatcagtgacttcatgagccctggccccacagacctgctgagcagcagcctgggcaccagcggcgtggactgcaacaggaagaggaagggcagcagcacagactaccaggagagcatggacacagacaaggatgacccccacggccgcctggagtacacagagcaccagggccgcatcaagaatgcccgggaggcctag

SEQ ID NO: 18378 - DNA, 72 bp, Artificial Sequence
  Description of Artificial Sequence: Synthetic coding sequence
atggctgaccagaggatggacatcagcagcaccatcagtgacttcatgagccctggccccacagacctgtag

SEQ ID NO: 18379 - DNA, 408 bp, Artificial Sequence
  Description of Artificial Sequence: Synthetic coding sequence
atggctgaccagaggatggacatcagcagcaccatcagtgacttcatgagccctggccccacagacctgctgagcagcagcctgggcaccagcggcgtggactgcaacaggaagaggaagggcagcagcacagactaccaggagagcatggacacagacaaggatgacccccacggccgcctggagtacacagagcaccagggccgcatcaagaatgcccgggaggcccacagccagatcgagaagagaagaagagacaagatgaacagcttcattgatgagctggccagcctggtgcccacctgcaatgccatgagcaggaagctggacaagctgactgtgctgaggatggctgtgcagcacatgaagaccctgcggggggccaccaacccctacacagaggcctag

SEQ ID NO: 18380 - DNA, 141 bp, Artificial Sequence
  Description of Artificial Sequence: Synthetic coding sequence
atgatcaacatcgagagcatggacacagacaaggatgacccccacggccgcctggagtacacagagcaccagggccgcatcaagaatgcccgggaggcccacagccagatcgagaagagaagaagagacaagatgaactag

SEQ ID NO: 18381 - DNA, 426 bp, Artificial Sequence
  Description of Artificial Sequence: Synthetic coding sequence
atgatcaacatcgagagcatggacacagacaaggatgacccccacggccgcctggagtacacagagcaccagggccgcatcaagaatgcccgggaggcccacagccagatcgagaagagaagaagagacaagatgaacagcttcattgatgagctggccagcctggtgcccacctgcaatgccatgagcaggaagctggacaagctgactgtgctgaggatggctgtgcagcacatgaagaccctgcggggggccaccaacccctacacagaggccaactacaagcccaccttcctgagtgatgatgagctgaagcacctgatcctgcgggcagcagatggcttcctgtttgtggtgggctgtgaccggggcaagatcctgtttgtgtctgagagcgtcttcaagatcctgaactacagccagtag

SEQ ID NO: 18382 - DNA, 306 bp, Artificial Sequence
  Description of Artificial Sequence: Synthetic coding sequence
atggctgaccagaggatggacatcagcagcaccatcagtgacttcatgagccctggccccacagacctgctgagcagcagcctgggcaccagcggcgtggactgcaacaggaagaggaagggcagcagcacagactaccaggagagcatggacacagacaaggatgacccccacggccgcctggagtacacagagcaccagggccgcatcaagaatgcccgggaggcccacagccagatcgagaagagaagaagagacaagatgaacagcttcattgatgagctggccagcctggtgcccacctag

SEQ ID NO: 18383 - DNA, 180 bp, Artificial Sequence
  Description of Artificial Sequence: Synthetic coding sequence
atggctgaccagaggatggacatcagcagcaccatcagtgacttcatgagccctggccccacagacctgctgagcagcagcctgggcaccagcggcgtggactgcaacaggaagaggaagggcagcagcacagactaccaggagagcatggacacagacaaggatgacccccacggctag

SEQ ID NO: 18384 - DNA, 1683 bp, Artificial Sequence
  Description of Artificial Sequence: Synthetic coding sequence
atggagcccctgcagcagcagcagcagcagcagcagcagcagcagaagcagccccacctggcccccctgcagatggatgcccgggagaagcagggccagcagatgagggaggcccagttcctgtatgcccagaagctggtgacccagcccaccctgctgagcgccacagctggccggcccagcggcagcacccccctgggccccctggcccgggtgcccccaacagctgctgtggcccaggtgtttgagcggggcaacatgaacagcgagcctgaggaggaggatggcggcctggaggatgaagatggagatgatgaggtggccgaggtggccgagaaggagacccaggccgccagcaagtacttccacgtgcagaaggtggcccggcaggacccccgggtggcccccatgagcaacctgctgcctgcccctggcctgccccctcatggccagcaggccaaggaggaccacaccaaggatgccagcaaggccagccccagcgtgtccacagctggccagcccaactggaacctggatgagcagctgaagcagaatggaggcctggcctggagcgatgatgctgatggcggccggggccgggagatcagccgggactttgccaagctgtatgagctggatggagaccctgagaggaaggagttcctggatgacctgtttgtgttcatgcagaagaggggcacccccatcaaccgcatccccatcatggccaagcagatcctggacctgtacatgctgtacaagctggtgacagagaagggcggcctggtggagatcatcaacaagaagatctggagggagatcaccaagggcctgaacctgcccaccagcatcaccagcgctgccttcaccctgcggacccagtacatgaagtacctgtatgcctatgaatgtgagaagaaggccctgagcagccctgctgagctgcaggccgccattgatggcaacagaagagagggcagaagacccagctacagcagcagcctgtttggctacagccctgctgctgccacagctgctgctgctgctggggccccagccctgctgagcccccccaagatccgcttccccatcctgggcctgggcagcagcagcggcaccaacaccagcagcccccgcatcagccctgccaccaccctgaggaaaggagatggagcccctgtgaccaccgtgcctgtgcccaaccggctggccgtgcctgtgaccctggccagccagcaggccggcaccaggacagctgccctggagcagctgcgggagcggctggagagcggggagcctgctgagaagaaggccagccggctgtctgaggaggagcagaggctggtgcagcaggccttccagaggaacttcttctccatggcccggcagctgcccatgaagatccgcatcaatggccgggaggacagagctgaggccagcgctgctgccctgaacctgaccaccagcagcatcggcagcatcaacatgtctgtggacattgatggcaccacctacgccggcgtgctgtttgcccagaagcctgtggtgcacctgatcaccggcagcgccccccagagcctgggcagcagcgccagcagcagcagcagcagccactgcagccccagccccaccagcagccggggcaccccatctgctgagcccagcacctcctggagcctgtag

SEQ ID NO: 18385 - DNA, 1335 bp, Artificial Sequence
  Description of Artificial Sequence: Synthetic coding sequence
atggagcccctgcagcagcagcagcagcagcagcagcagcagcagaagcagccccacctggcccccctgcagatggatgcccgggagaagcagggccagcagatgagggaggcccagttcctgtatgcccagaagctggtgacccagcccaccctgctgagcgccacagctggccggcccagcggcagcacccccctgggccccctggcccgggtgcccccaacagctgctgtggcccaggtgtttgagcggggcaacatgaacagcgagcctgaggaggaggatggcggcctggaggatgaagatggagatgatgaggtggccgaggtggccgagaaggagacccaggccgccagcaagtacttccacgtgcagaaggtggcccggcaggacccccgggtggcccccatgagcaacctgctgcctgcccctggcctgccccctcatggccagcaggccaaggaggaccacaccaaggatgccagcaaggccagccccagcgtgtccacagctggccagcccaactggaacctggatgagcagctgaagcagaatggaggcctggcctggagcgatgatgctgatggcggccggggccgggagatcagccgggactttgccaagctgtatgagctggatggagaccctgagaggaaggagttcctggatgacctgtttgtgttcatgcagaagaggggcacccccatcaaccgcatccccatcatggccaagcagatcctggacctgtacatgctgtacaagctggtgacagagaagggcggcctggtggagatcatcaacaagaagatctggagggagatcaccaagggcctgaacctgcccaccagcatcaccagcgctgccttcaccctgcggacccagtacatgaagtacctgtatgcctatgaatgtgagaagaaggccctgagcagccctgctgagctgcaggccgccattgatggcaacagaagagagggcagaagacccagctacagcagcagcctgtttggctacagccctgctgctgccacagctgctgctgctgctggggccccagccctgctgagcccccccaagatccgcttccccatcctgggcctgggcagcagcagcggcaccaacaccagcagcccccgcatcagccctgccaccaccctgaggaaaggagatggagcccctgtgaccaccgtgcctgtgcccaaccggctggccgtgcctgtgaccctggccagccagcaggccggcaccaggacagctgccctggagcagctgcgggagcggctggagagcggggagcctgctgagaagaaggccagcggcacctggtgccagtag

SEQ ID NO: 18386 - DNA, 1413 bp, Artificial Sequence
  Description of Artificial Sequence: Synthetic coding sequence
atggagcccctgcagcagcagcagcagcagcagcagcagcagcagaagcagccccacctggcccccctgcagatggatgcccgggagaagcagggccagcagatgagggaggcccagttcctgtatgcccagaagctggtgacccagcccaccctgctgagcgccacagctggccggcccagcggcagcacccccctgggccccctggcccgggtgcccccaacagctgctgtggcccaggtgtttgagcggggcaacatgaacagcgagcctgaggaggaggatggcggcctggaggatgaagatggagatgatgaggtggccgaggtggccgagaaggagacccaggccgccagcaagtacttccacgtgcagaaggtggcccggcaggacccccgggtggcccccatgagcaacctgctgcctgcccctggcctgccccctcatggccagcaggccaaggaggaccacaccaaggatgccagcaaggccagccccagcgtgtccacagctggccagcccaactggaacctggatgagcagctgaagcagaatggaggcctggcctggagcgatgatgctgatggcggccggggccgggagatcagccgggactttgccaagctgtatgagctggatggagaccctgagaggaaggagttcctggatgacctgtttgtgttcatgcagaagaggggcacccccatcaaccgcatccccatcatggccaagcagatcctggacctgtacatgctgtacaagctggtgacagagaagggcggcctggtggagatcatcaacaagaagatctggagggagatcaccaagggcctgaacctgcccaccagcatcaccagcgctgccttcaccctgcggacccagtacatgaagtacctgtatgcctatgaatgtgagaagaaggccctgagcagccctgctgagctgcaggccgccattgatggcaacagaagagagggcagaagacccagctacagcagcagcctgtttggctacagccctgctgctgccacagctgctgctgctgctggggccccagccctgctgagcccccccaagatccgcttccccatcctgggcctgggcagcagcagcggcaccaacaccagcagcccccgcatcagccctgccaccaccctgaggaaaggagatggagcccctgtgaccaccgtgcctgtgcccaaccggctggccgtgcctgtgaccctggccagccagcaggccggcaccaggacagctgccctggagcagctgcgggagcggctggagagcggggagcctgctgagaagaaggccagccggctgtctgaggaggagcagaggctggtgcagcaggccttccagaggaacttcttctccatggcccggcagctgagcatcctgtatgtgttctag

SEQ ID NO: 18387 - DNA, 7935 bp, Artificial Sequence
  Description of Artificial Sequence: Synthetic coding sequence
atgggagagcacggcctggagctggcctccatgatcccagccctgcgggagctgggcagcgccaccccagaggagtacaacacagtggtgcagaagccccggcagatcctgtgccagttcatcgaccgcatcctgacagatgtgaatgtggtggccgtggagctggtgaagaagacagacagccagcccacctctgtgatgctgctggacttcatccagcacatcatgaagagcagccccctgatgtttgtgaatgtgtctggcagccatgaggccaagggcagctgcatcgagttcagcaactggatcatcacccggctgctgagaattgctgccacccccagctgccacctgctgcacaagaagatctgtgaggtgatctgcagcctgctcttcctgttcaagagcaagagccctgccatcttcggcgtgctgaccaaggagctgctgcagctgtttgaggacctggtgtacctgcacagaagaaatgtgatgggccatgctgtggagtggcctgtggtgatgagccgcttcctgagccagctggatgagcacatgggctacctgcagagcgcccccctgcagctgatgtccatgcagaacctggagttcatcgaggtgaccctgctgatggtgctgacccgcatcatcgccatcgtgttcttccggcggcaggagctgctgctgtggcagatcggctgtgtgctgctggagtatggcagccccaagatcaagagcctggccatctccttcctgacagagctgttccagctgggcggcctgcctgcccagcctgccagcaccttcttcagcagcttcctggagctgctgaagcacctggtggagatggacacagaccagctgaagctgtatgaggagcccctgagcaagctgatcaagaccctcttcccctttgaagctgaggcctacagaaatattgagcctgtgtacctgaacatgctgctggagaagctgtgtgtgatgtttgaagatggagtgctgatgaggctgaagagtgacctgctgaaggccgccctgtgccacctgctgcagtacttcctgaagtttgtgcctgctggctatgaaagtgccctgcaggtgaggaaggtgtatgtgaggaacatctgcaaggccctgctggatgtgctgggcatcgaggtggatgctgagtacctgctgggccccctgtatgctgccctgaagatggagagcatggagatcatcgaggagatccagtgccagacccagcaggagaacctgagcagcaacagtgatggcatcagccccaagagaagaaggctgagcagcagcctgaaccccagcaagagggcccccaagcagacagaggagatcaagcacgtggacatgaaccagaagagcatcctgtggagcgccctgaagcagaaggccgagagcctgcagatcagcctggagtacagcggcctgaagaaccctgtgattgagatgctggagggcattgctgtggtgctgcagctgacagccctgtgcaccgtgcactgcagccaccagaacatgaactgcaggaccttcaaggactgccagcacaagagcaagaagaagcccagcgtggtgatcacctggatgagcctggacttctacaccaaggtgctgaagagctgccgcagcctgctggagagcgtgcagaagctggacctggaggccaccatcgacaaggtggtgaagatctatgatgccctgatctacatgcaggtgaacagcagctttgaggaccacatcctggaggacctgtgtggcatgctgagcctgccctggatctacagccacagtgatgatggctgcctgaagctgaccacctttgctgccaacctgctgaccctgagctgccgcatcagtgacagctacagcccccaggcccagagccgctgtgtgttcctgctgaccctcttcccccggcgcatcttcctggagtggaggacagctgtgtacaactgggccctgcagagcagccatgaggtgatccgggccagctgtgtgtctggcttcttcatcctgctgcagcagcagaacagctgcaacagagtgcccaagatcctgattgacaaggtgaaggatgacagcgacatcgtgaagaaggagtttgccagcatcctgggccagctggtgtgcaccctgcacggcatgttctacctgaccagcagcctgacagagcccttcagcgagcacggccacgtggacctcttctgcaggaacctgaaggccaccagccagcacgagtgcagcagcagccagctgaaggcctctgtgtgcaagcccttcctgttcctgctgaagaagaagatccccagccctgtgaagctggccttcatcgacaacctgcaccacctgtgcaagcacctggacttcagagaagatgaaacagatgtgaaggctgtgctgggcaccctgctgaacctgatggaggaccctgacaaggatgtgcgggtggccttcagcggcaacatcaagcacatcctggagagcctggacagtgaagatggcttcatcaaggagctgtttgtgctgaggatgaaggaggcctacacccacgcccagatcagcagaaataatgagctgaaggacaccctcatcctgaccactggagacatcggccgggccgccaagggggacctggtgccctttgccctgctgcacctgctgcactgcctgctgagcaagagcgcctctgtgtctggggccgcctacacagagatccgggccctggtggccgccaagtctgtgaagctgcagagcttcttcagccagtacaagaagcccatctgccagttcctggtggagagcctgcacagcagccagatgacagccctgcccaacaccccctgccagaatgctgatgtgaggaagcaggatgtggcccaccagcgggagatggccctgaacaccctgtctgagatcgccaacgtgtttgacttcccagacctgaaccgcttcctgaccaggaccctgcaggtgctgctgcctgacctggccgccaaggccagccctgctgccagcgccctgatccgcaccctgggcaagcagctgaatgtgaacagaagagagatcctgatcaacaacttcaagtacatcttcagccacctggtgtgcagctgcagcaaggatgagctggagcgggccctgcactacctgaagaatgaaacagaaattgagctgggcagcctgctgcggcaggacttccagggcctgcacaatgagctgctgctgagaattggagagcactaccagcaggtgttcaacggcctgagcatcctggccagctttgccagcagtgatgacccctaccagggcccccgggacatcatcagccctgagctgatggctgactacctgcagcccaagctgctgggcatcctggccttcttcaacatgcagctgctgagcagctctgtgggcatcgaggacaagaagatggccctgaacagcctgatgagcctgatgaagctgatgggccccaagcacgtgtcctctgtgcgggtgaagatgatgaccaccctgaggacaggcctgcgcttcaaggatgacttccctgagctgtgctgccgggcctgggactgctttgtgcgctgcctggaccacgcctgcctgggcagcctgctgagccacgtgattgtggccctgctgcccctcatccacatccagcccaaggagacagctgccatcttccactacctgatcatcgagaacagagatgctgtgcaggacttcctgcacgagatctacttcctgcctgaccaccctgagctgaagaagatcaaggctgtgctgcaggagtacaggaaggagaccagcgagagcacagacctgcagaccaccctgcagctgtccatgaaggccatccagcatgaaaatgtggatgtgcgcatccacgccctgaccagcctgaaggagaccctgtacaagaaccaggagaagctgatcaagtatgccacagattctgaaacagtggagcccatcatcagccagctggtgacagtgctgctgaagggctgccaggatgccaacagccaggcccggctgctgtgtggggagtgcctgggggagctgggcgccatcgaccccggccgcctggacttcagcaccacagagacccagggcaaggacttcacctttgtgactggagtggaggacagcagctttgcctacggcctgctgatggagctgacccgggcctacctggcctatgctgacaacagccgggcccaggacagcgctgcctatgccatccaggagctgctgagcatctatgactgccgggagatggagaccaacggccctggccaccagctgtggaggcgcttccctgagcacgtgcgggagatcctggagccccacctgaacacccgctacaagagcagccagaagagcacagactggagcggcgtgaagaagcccatctacctgagcaagctgggcagcaactttgctgagtggagcgcctcctgggccggctacctgatcaccaaggtgagacatgacctggccagcaagatcttcacctgctgcagcatcatgatgaagcatgacttcaaggtgaccatctacctgctgccccacatcctggtgtatgtgctgctgggctgcaaccaggaggaccagcaggaggtgtatgcagagatcatggctgtgctgaagcatgatgaccagcacaccatcaacacccaggacatcgccagtgacctgtgccagctgagcacccagaccgtcttctccatgctggaccacctgacccagtgggcccggcacaagttccaggccctgaaggccgagaagtgcccccacagcaagagcaacagaaacaaggtggacagcatggtgtccacagtggactatgaggactaccagagcgtgacccgcttcctggacctgatcccccaggacaccctggccgtggccagcttccgcagcaaggcctacaccagggctgtgatgcactttgagagcttcatcacagagaagaagcagaacatccaggagcacctgggcttcctgcagaagctgtatgctgccatgcatgagccagatggagtggccggcgtgtctgccatcaggaaggccgagcccagcctgaaggagcagatcctggagcacgagagcctgggcctgctgagagatgccacagcctgctatgaccgggccatccagctggagccagaccagatcatccactaccatggagtggtgaagtccatgctgggcctgggccagctgagcaccgtcatcacccaggtgaatggagtgcacgccaacagaagtgagtggacagatgagctgaacacctacagagtggaggccgcctggaagctgagccagtgggacctggtggagaactacctggccgcagatggcaagagcaccacctggagcgtgcggctgggccagctgctgctgagcgccaagaagagggacatcacagccttctatgacagcctgaagctggtgcgggcagagcagatcgtgcccctgtctgctgccagctttgagcggggcagctaccagaggggctatgagtacatcgtgcggctgcacatgctgtgtgagctggagcacagcatcaagcccctcttccagcacagccctggggacagcagccaggaggacagcctgaactgggtggcccggctggagatgacccagaacagctaccgggccaaggagcccatcctggccctgcggcgggccctgctgagcctgaacaagaggccagactacaatgagatggtgggggagtgctggctgcagagcgcccgggtggccaggaaggccggccaccaccagacagcctacaatgccctgctgaatgctggggagagccggctggccgagctgtatgtggagcgggccaagtggctgtggagcaaaggagatgtgcaccaggccctgattgtgctgcagaagggcgtggagctgtgcttcccagaaaatgagaccccacctgagggcaagaacatgctgattcatggccgggccatgctgctggtgggccgcttcatggaggagacagccaactttgagagcaatgccatcatgaagaagtacaaggatgtgacagcctgcctgcctgagtgggaggatggccacttctacctggccaagtactatgacaagctgatgcccatggtgacagacaacaagatggagaagcagggcgacctgatccgctacatcgtgctgcacttcggccgcagcctgcagtatggcaaccagttcatctaccagagcatgcccaggatgctgaccctgtggctggactatggcaccaaggcctatgagtgggagaaggccggccgcagtgacagagtgcagatgagaaatgacctgggcaagatcaacaaggtgatcacagagcacaccaactacctggccccctaccagttcctgacagccttcagccagctgatcagccgcatctgccacagccatgatgaggtgtttgtggtgctgatggagatcatcgccaaggtgttcctggcctacccccagcaggccatgtggatgatgacagctgtgtccaagagcagctaccccatgagggtgaaccgctgcaaggagatcctgaacaaggccatccacatgaagaagagcctggagaagtttgtgggagatgccacccggctgacagacaagctgctggagctgtgcaacaagcctgtggatggcagcagcagcaccctgtccatgagcacccacttcaagatgctgaagaagctggtggaggaggccaccttcagcgagatcctgatccccctgcagagcgtgatgatccccaccctgcccagcatcctgggcacccacgccaaccacgccagccatgagcccttccctggccactgggcctacatcgccggctttgatgacatggtggagatcctggccagcctgcagaagcccaagaagatcagcctgaagggcagtgatggcaagttctacatcatgatgtgcaagcccaaggatgacctgaggaaggactgccgcctgatggagttcaacagcctcatcaacaagtgcctgaggaaggatgctgagagcagaagaagagagctgcacatccgcacctacgccgtcatccccctgaatgatgaatgtggcatcatcgagtgggtgaacaacacagctggcctgcggcccatcctgaccaagctgtacaaggagaagggcgtgtacatgaccgggaaggagctgcggcagtgcatgctgcccaagtctgctgccctgtctgagaagctgaaggtgttccgggagttcctgctgcccaggcacccccccatcttccacgagtggttcctgcggaccttcccagaccccacctcctggtacagcagccgcagcgcctactgccgcagcacagctgtgatgtccatggtgggctacatcctgggcctgggggacagacatggagagaacatcctgtttgacagcctgactggagaatgtgtgcacgtggacttcaactgcctcttcaacaagggggagacctttgaggtgcctgagatcgtgcccttccggctgacccacaacatggtgaatggcatgggccccatgggcacagagggcctcttcagaagagcctgtgaggtgaccatgaggctgatgagggaccagcgggagcccctgatgtctgtgctgaagaccttcctgcatgaccccctggtggagtggagcaagcctgtgaagggccacagcaaggcccccctgaatgagaccggggaggtggtgaatgagaaggccaagacccacgtgctggacatcgagcagaggctgcagggcgtcatcaagaccaggaacagagtgacaggcctgcccctgagcattgagggccacgtgcactacctgatccaggaggccacagatgagaacctgctgtgccagatgtacctgggctggaccccctacatgtag

SEQ ID NO: 18388 - DNA, 7743 bp, Artificial Sequence
  Description of Artificial Sequence: Synthetic coding sequence
atgggagagcacggcctggagctggcctccatgatcccagccctgcgggagctgggcagcgccaccccagaggagtacaacacagtggtgcagaagccccggcagatcctgtgccagttcatcgaccgcatcctgacagatgtgaatgtggtggccgtggagctggtgaagaagacagacagccagcccacctctgtgatgctgctggacttcatccagcacatcatgaagagcagccccctgatgtttgtgaatgtgtctggcagccatgaggccaagggcagctgcatcgagttcagcaactggatcatcacccggctgctgagaattgctgccacccccagctgccacctgctgcacaagaagatctgtgaggtgatctgcagcctgctcttcctgttcaagagcaagagccctgccatcttcggcgtgctgaccaaggagctgctgcagctgtttgaggacctggtgtacctgcacagaagaaatgtgatgggccatgctgtggagtggcctgtggtgatgagccgcttcctgagccagctggatgagcacatgggctacctgcagagcgcccccctgcagctgatgtccatgcagaacctggagttcatcgaggtgaccctgctgatggtgctgacccgcatcatcgccatcgtgttcttccggcggcaggagctgctgctgtggcagatcggctgtgtgctgctggagtatggcagccccaagatcaagagcctggccatctccttcctgacagagctgttccagctgggcggcctgcctgcccagcctgccagcaccttcttcagcagcttcctggagctgctgaagcacctggtggagatggacacagaccagctgaagctgtatgaggagcccctgagcaagctgatcaagaccctcttcccctttgaagctgaggcctacagaaatattgagcctgtgtacctgaacatgctgctggagaagctgtgtgtgatgtttgaagatggagtgctgatgaggctgaagagtgacctgctgaaggccgccctgtgccacctgctgcagtacttcctgaagtttgtgcctgctggctatgaaagtgccctgcaggtgaggaaggtgtatgtgaggaacatctgcaaggccctgctggatgtgctgggcatcgaggtggatgctgagtacctgctgggccccctgtatgctgccctgaagatggagagcatggagatcatcgaggagatccagtgccagacccagcaggagaacctgagcagcaacagtgatggcatcagccccaagagaagaaggctgagcagcagcctgaaccccagcaagagggcccccaagcagacagaggacaggaccttcaaggactgccagcacaagagcaagaagaagcccagcgtggtgatcacctggatgagcctggacttctacaccaaggtgctgaagagctgccgcagcctgctggagagcgtgcagaagctggacctggaggccaccatcgacaaggtggtgaagatctatgatgccctgatctacatgcaggtgaacagcagctttgaggaccacatcctggaggacctgtgtggcatgctgagcctgccctggatctacagccacagtgatgatggctgcctgaagctgaccacctttgctgccaacctgctgaccctgagctgccgcatcagtgacagctacagcccccaggcccagagccgctgtgtgttcctgctgaccctcttcccccggcgcatcttcctggagtggaggacagctgtgtacaactgggccctgcagagcagccatgaggtgatccgggccagctgtgtgtctggcttcttcatcctgctgcagcagcagaacagctgcaacagagtgcccaagatcctgattgacaaggtgaaggatgacagcgacatcgtgaagaaggagtttgccagcatcctgggccagctggtgtgcaccctgcacggcatgttctacctgaccagcagcctgacagagcccttcagcgagcacggccacgtggacctcttctgcaggaacctgaaggccaccagccagcacgagtgcagcagcagccagctgaaggcctctgtgtgcaagcccttcctgttcctgctgaagaagaagatccccagccctgtgaagctggccttcatcgacaacctgcaccacctgtgcaagcacctggacttcagagaagatgaaacagatgtgaaggctgtgctgggcaccctgctgaacctgatggaggaccctgacaaggatgtgcgggtggccttcagcggcaacatcaagcacatcctggagagcctggacagtgaagatggcttcatcaaggagctgtttgtgctgaggatgaaggaggcctacacccacgcccagatcagcagaaataatgagctgaaggacaccctcatcctgaccactggagacatcggccgggccgccaagggggacctggtgccctttgccctgctgcacctgctgcactgcctgctgagcaagagcgcctctgtgtctggggccgcctacacagagatccgggccctggtggccgccaagtctgtgaagctgcagagcttcttcagccagtacaagaagcccatctgccagttcctggtggagagcctgcacagcagccagatgacagccctgcccaacaccccctgccagaatgctgatgtgaggaagcaggatgtggcccaccagcgggagatggccctgaacaccctgtctgagatcgccaacgtgtttgacttcccagacctgaaccgcttcctgaccaggaccctgcaggtgctgctgcctgacctggccgccaaggccagccctgctgccagcgccctgatccgcaccctgggcaagcagctgaatgtgaacagaagagagatcctgatcaacaacttcaagtacatcttcagccacctggtgtgcagctgcagcaaggatgagctggagcgggccctgcactacctgaagaatgaaacagaaattgagctgggcagcctgctgcggcaggacttccagggcctgcacaatgagctgctgctgagaattggagagcactaccagcaggtgttcaacggcctgagcatcctggccagctttgccagcagtgatgacccctaccagggcccccgggacatcatcagccctgagctgatggctgactacctgcagcccaagctgctgggcatcctggccttcttcaacatgcagctgctgagcagctctgtgggcatcgaggacaagaagatggccctgaacagcctgatgagcctgatgaagctgatgggccccaagcacgtgtcctctgtgcgggtgaagatgatgaccaccctgaggacaggcctgcgcttcaaggatgacttccctgagctgtgctgccgggcctgggactgctttgtgcgctgcctggaccacgcctgcctgggcagcctgctgagccacgtgattgtggccctgctgcccctcatccacatccagcccaaggagacagctgccatcttccactacctgatcatcgagaacagagatgctgtgcaggacttcctgcacgagatctacttcctgcctgaccaccctgagctgaagaagatcaaggctgtgctgcaggagtacaggaaggagaccagcgagagcacagacctgcagaccaccctgcagctgtccatgaaggccatccagcatgaaaatgtggatgtgcgcatccacgccctgaccagcctgaaggagaccctgtacaagaaccaggagaagctgatcaagtatgccacagattctgaaacagtggagcccatcatcagccagctggtgacagtgctgctgaagggctgccaggatgccaacagccaggcccggctgctgtgtggggagtgcctgggggagctgggcgccatcgaccccggccgcctggacttcagcaccacagagacccagggcaaggacttcacctttgtgactggagtggaggacagcagctttgcctacggcctgctgatggagctgacccgggcctacctggcctatgctgacaacagccgggcccaggacagcgctgcctatgccatccaggagctgctgagcatctatgactgccgggagatggagaccaacggccctggccaccagctgtggaggcgcttccctgagcacgtgcgggagatcctggagccccacctgaacacccgctacaagagcagccagaagagcacagactggagcggcgtgaagaagcccatctacctgagcaagctgggcagcaactttgctgagtggagcgcctcctgggccggctacctgatcaccaaggtgagacatgacctggccagcaagatcttcacctgctgcagcatcatgatgaagcatgacttcaaggtgaccatctacctgctgccccacatcctggtgtatgtgctgctgggctgcaaccaggaggaccagcaggaggtgtatgcagagatcatggctgtgctgaagcatgatgaccagcacaccatcaacacccaggacatcgccagtgacctgtgccagctgagcacccagaccgtcttctccatgctggaccacctgacccagtgggcccggcacaagttccaggccctgaaggccgagaagtgcccccacagcaagagcaacagaaacaaggtggacagcatggtgtccacagtggactatgaggactaccagagcgtgacccgcttcctggacctgatcccccaggacaccctggccgtggccagcttccgcagcaaggcctacaccagggctgtgatgcactttgagagcttcatcacagagaagaagcagaacatccaggagcacctgggcttcctgcagaagctgtatgctgccatgcatgagccagatggagtggccggcgtgtctgccatcaggaaggccgagcccagcctgaaggagcagatcctggagcacgagagcctgggcctgctgagagatgccacagcctgctatgaccgggccatccagctggagccagaccagatcatccactaccatggagtggtgaagtccatgctgggcctgggccagctgagcaccgtcatcacccaggtgaatggagtgcacgccaacagaagtgagtggacagatgagctgaacacctacagagtggaggccgcctggaagctgagccagtgggacctggtggagaactacctggccgcagatggcaagagcaccacctggagcgtgcggctgggccagctgctgctgagcgccaagaagagggacatcacagccttctatgacagcctgaagctggtgcgggcagagcagatcgtgcccctgtctgctgccagctttgagcggggcagctaccagaggggctatgagtacatcgtgcggctgcacatgctgtgtgagctggagcacagcatcaagcccctcttccagcacagccctggggacagcagccaggaggacagcctgaactgggtggcccggctggagatgacccagaacagctaccgggccaaggagcccatcctggccctgcggcgggccctgctgagcctgaacaagaggccagactacaatgagatggtgggggagtgctggctgcagagcgcccgggtggccaggaaggccggccaccaccagacagcctacaatgccctgctgaatgctggggagagccggctggccgagctgtatgtggagcgggccaagtggctgtggagcaaaggagatgtgcaccaggccctgattgtgctgcagaagggcgtggagctgtgcttcccagaaaatgagaccccacctgagggcaagaacatgctgattcatggccgggccatgctgctggtgggccgcttcatggaggagacagccaactttgagagcaatgccatcatgaagaagtacaaggatgtgacagcctgcctgcctgagtgggaggatggccacttctacctggccaagtactatgacaagctgatgcccatggtgacagacaacaagatggagaagcagggcgacctgatccgctacatcgtgctgcacttcggccgcagcctgcagtatggcaaccagttcatctaccagagcatgcccaggatgctgaccctgtggctggactatggcaccaaggcctatgagtgggagaaggccggccgcagtgacagagtgcagatgagaaatgacctgggcaagatcaacaaggtgatcacagagcacaccaactacctggccccctaccagttcctgacagccttcagccagctgatcagccgcatctgccacagccatgatgaggtgtttgtggtgctgatggagatcatcgccaaggtgttcctggcctacccccagcaggccatgtggatgatgacagctgtgtccaagagcagctaccccatgagggtgaaccgctgcaaggagatcctgaacaaggccatccacatgaagaagagcctggagaagtttgtgggagatgccacccggctgacagacaagctgctggagctgtgcaacaagcctgtggatggcagcagcagcaccctgtccatgagcacccacttcaagatgctgaagaagctggtggaggaggccaccttcagcgagatcctgatccccctgcagagcgtgatgatccccaccctgcccagcatcctgggcacccacgccaaccacgccagccatgagcccttccctggccactgggcctacatcgccggctttgatgacatggtggagatcctggccagcctgcagaagcccaagaagatcagcctgaagggcagtgatggcaagttctacatcatgatgtgcaagcccaaggatgacctgaggaaggactgccgcctgatggagttcaacagcctcatcaacaagtgcctgaggaaggatgctgagagcagaagaagagagctgcacatccgcacctacgccgtcatccccctgaatgatgaatgtggcatcatcgagtgggtgaacaacacagctggcctgcggcccatcctgaccaagctgtacaaggagaagggcgtgtacatgaccgggaaggagctgcggcagtgcatgctgcccaagtctgctgccctgtctgagaagctgaaggtgttccgggagttcctgctgcccaggcacccccccatcttccacgagtggttcctgcggaccttcccagaccccacctcctggtacagcagccgcagcgcctactgccgcagcacagctgtgatgtccatggtgggctacatcctgggcctgggggacagacatggagagaacatcctgtttgacagcctgactggagaatgtgtgcacgtggacttcaactgcctcttcaacaagggggagacctttgaggtgcctgagatcgtgcccttccggctgacccacaacatggtgaatggcatgggccccatgggcacagagggcctcttcagaagagcctgtgaggtgaccatgaggctgatgagggaccagcgggagcccctgatgtctgtgctgaagaccttcctgcatgaccccctggtggagtggagcaagcctgtgaagggccacagcaaggcccccctgaatgagaccggggaggtggtgaatgagaaggccaagacccacgtgctggacatcgagcagaggctgcagggcgtcatcaagaccaggaacagagtgacaggcctgcccctgagcattgagggccacgtgcactacctgatccaggaggccacagatgagaacctgctgtgccagatgtacctgggctggaccccctacatgtag

SEQ ID NO: 18389 - DNA, 9171 bp, Artificial Sequence
  Description of Artificial Sequence: Synthetic coding sequence
atgagcctggtgctgaatgacctgctgatctgctgccggcagctggagcatgaccgggccacagagaggaagaaggaggtggagaagttcaagaggctcatccgggaccctgagaccatcaagcacctggacagacacagcgacagcaagcagggcaagtacctgaactgggatgctgtgttccgcttcctgcagaagtacatccagaaggagacagaatgtctgagaattgccaagcccaacgtgtctgccagcacccaggccagccggcagaagaagatgcaggagatcagcagcctggtgaagtacttcatcaagtgtgccaacagaagagccccccggctgaagtgccaggagctgctgaactacatcatggacacagtgaaggacagcagcaatggagccatctatggagctgactgcagcaacatcctgctgaaggacatcctgtctgtgaggaagtactggtgtgagatcagccagcagcagtggctggagctgttctctgtgtacttccggctgtacctgaagcccagccaggatgtgcaccgggtgctggtggcccgcatcatccatgctgtgaccaagggctgctgcagccagacagatggcctgaacagcaagttcctggacttcttcagcaaggccatccagtgtgcccggcaggagaagagcagcagcggcctgaaccacatcctggccgccctgaccatcttcctgaagaccctggccgtgaacttccgcatccgggtgtgtgagctgggagatgagatcctgcccaccctgctgtacatctggacccagcaccggctgaatgacagcctgaaggaggtgatcatcgagctgttccagctgcagatctacatccaccaccccaagggggccaagacccaggagaagggggcctatgagagcaccaagtggaggagcatcctgtacaacctgtatgacctgctggtgaatgagatcagccacatcggcagccggggcaagtacagcagcggcttcagaaatattgctgtgaaggaaaatctcatcgagctgatggctgacatctgccaccaggtgttcaatgaagacaccaggagcctggagatcagccagagctacaccaccacccagcgggagagcagtgactacagcgtgccctgcaagaggaagaagattgagctgggctgggaggtgatcaaggaccacctgcagaagagccagaatgactttgacctggtgccctggctgcagatcgccacccagctgatcagcaagtacccagccagcctgcccaactgtgagctgagccccctgctgatgatcctgagccagctgctgccccagcagagacatggagagaggaccccctacgtgctgcgctgcctgacagaggtggccctgtgccaggacaagaggagcaacctggagagcagccagaagagtgacctgctgaagctgtggaacaagatctggtgcatcaccttccggggcatcagcagcgagcagatccaggctgaaaattttggcctgctgggcgccatcatccagggcagcctggtggaggtggaccgggagttctggaagctgttcaccggcagcgcctgccggcccagctgcccagctgtgtgctgcctgaccctggccctgaccaccagcatcgtgcccggcaccgtgaagatgggcatcgagcagaacatgtgtgaggtgaacagaagcttcagcctgaaggagagcatcatgaagtggctgctcttctaccagctggagggggacctggagaacagcacagaggtgccccccatcctgcacagcaacttcccccacctggtgctggagaagatcctggtgtccctgaccatgaagaactgcaaggccgccatgaacttcttccagagcgtgcctgaatgtgagcaccaccagaaggacaaggaggagctgtccttcagcgaggtggaggagctgttcctgcagaccacctttgacaagatggacttcctgaccatcgtgcgggagtgtggcatcgagaagcaccagagcagcatcggcttctctgtgcaccagaacctgaaggagagcctggaccgctgcctgctgggcctgtctgagcagctgctgaacaactacagcagcgagatcaccaacagcgagaccctggtgcgctgcagccggctgctggtgggcgtgctgggctgctactgctacatgggcgtgattgctgaggaggaggcctacaagtctgagctgttccagaaggccaagagcctgatgcagtgtgccggggagagcatcaccctcttcaagaacaagaccaatgaggagttcagaattggcagcctgaggaacatgatgcagctgtgcacccgctgcctgagcaactgcaccaagaagagccccaacaagatcgccagcggcttcttcctgcggctgctgaccagcaagctgatgaatgacattgctgacatctgcaagagcctggccagcttcatcaagaagccctttgacagaggagaggtggagagcatggaggatgacaccaatggaaacctgatggaggtggaggaccagagctccatgaacctcttcaatgactacccagacagctctgtgtctgatgccaatgagcccggggagagccagagcaccatcggggccatcaaccccctggccgaggagtacctgagcaagcaggacctgctcttcctggacatgctgaagttcctgtgcctgtgtgtgaccacagcccagaccaacacagtgtccttccgggctgctgacatccggaggaagctgctgatgctgattgacagcagcaccctggagcccaccaagagcctgcacctgcacatgtacctgatgctgctgaaggagctgcctggagaggagtaccccctgcccatggaggatgtgctggagctgctgaagcccctgagcaatgtgtgcagcctgtacagaagagaccaggatgtgtgcaagaccatcctgaaccacgtgctgcacgtggtgaagaacctgggccagagcaacatggacagcgagaacaccagagatgcccagggccagttcctgaccgtcatcggggccttctggcacctgaccaaggagaggaagtacatcttctctgtgaggatggccctggtgaactgcctgaagaccctgctggaggccgacccctacagcaagtgggccatcctgaatgtgatgggcaaggacttccctgtgaatgaggtgttcacccagttcctggccgacaaccaccaccaggtgaggatgctggccgctgagagcatcaacagactcttccaggacaccaagggggacagcagccggctgctgaaggccctgcccctgaagctgcagcagacagcctttgaaaatgcctacctgaaggcccaggagggcatgagggagatgagccacagcgcagaaaatcctgagaccctggatgagatctacaacaggaagtctgtgctgctgaccctgattgctgtggtgctgagctgcagccccatctgtgagaagcaggccctgtttgccctgtgcaagtctgtgaaggaaaatggcctggagccccacctggtgaagaaggtgctggagaaggtgtctgagaccttcggctaccgccgcctggaggacttcatggccagccacctggactacctggtgctggagtggctgaacctgcaggacacagagtacaacctgagcagcttccccttcatcctgctgaactacaccaacatcgaggacttctaccgcagctgctacaaggtgctgatcccccacctggtgatccgcagccactttgatgaggtgaagagcatcgccaaccagatccaggaggactggaagagcctgctgacagactgcttccccaagatcctggtgaacatcctgccctactttgcctatgagggcacccgggacagcggcatggcccagcagcgggagacagccaccaaggtgtatgacatgctgaagtctgagaacctgctgggcaagcagattgaccacctgttcatcagcaacctgcctgagatcgtggtggagctgctgatgaccctgcacgagcccgccaacagcagcgccagccagagcacagacctgtgtgacttcagcggggacctggaccctgcccccaaccccccccacttccccagccacgtgatcaaggccacctttgcctacatcagcaactgccacaagaccaagctgaagagcatcctggagatcctgagcaagagcccagacagctaccagaagatcctgctggccatctgtgagcaggccgctgagaccaacaacgtgtacaagaagcaccgcatcctgaagatctaccacctgtttgtgtccctgctgctgaaggacatcaagagcggcctgggcggggcctgggcctttgtgctgagagatgtgatctacaccctcatccactacatcaaccagaggcccagctgcatcatggatgtgtccctgcggagcttcagcctgtgctgtgacctgctgagccaggtgtgccagacagctgtgacctactgcaaggatgccctggagaaccacctgcacgtgattgtgggcaccctcatccccctggtgtatgagcaggtggaggtgcagaagcaggtgctggacctgctgaagtacctggtgattgacaacaaggacaatgaaaatctctacatcaccatcaagctgctggaccccttcccagaccacgtggtgttcaaggacctgcgcatcacccagcagaagatcaagtacagccggggccccttcagcctgctggaggagatcaaccacttcctgtctgtgtctgtgtatgatgccctgcccctgacccggctggagggcctgaaggacctgcggcggcagctggagctgcacaaggaccagatggtggacatcatgagggccagccaggacaacccccaggacggcatcatggtgaagctggtggtgaacctgctgcagctgagcaagatggccatcaaccacactggagagaaggaggtgctggaggccgtgggcagctgcctgggggaggtgggccccatcgacttcagcaccatcgccatccagcacagcaaggatgccagctacaccaaggccctgaagctgtttgaggacaaggagctgcagtggaccttcatcatgctgacctacctgaacaacaccctggtggaggactgtgtgaaggtgcgctctgctgctgtgacctgcctgaagaacatcctggccaccaagacaggccacagcttctgggagatctacaagatgaccacagaccccatgctggcctacctgcagcccttccgcaccagcaggaagaagttcctggaggtgcccaggtttgacaaggagaacccctttgagggcctggatgacatcaacctgtggatccccctgtctgagaaccacgacatctggatcaagaccctgacctgtgccttcctggacagcggcggcaccaagtgtgagatcctgcagctgctgaagcccatgtgtgaggtgaagacagacttctgccagacagtgctgccctacctgattcatgacatcctgctgcaggacaccaatgaatcctggaggaacctgctgagcacccacgtgcagggcttcttcaccagctgcctgcggcacttcagccagaccagccgcagcaccaccccagccaacctggacagcgagagcgagcacttcttccgctgctgcctggacaagaagagccagaggaccatgctggccgtggtggactacatgaggcggcagaagaggcccagcagcggcaccatcttcaatgatgccttctggctggacctgaactacctggaggtggccaaggtggcccagagctgtgccgcccacttcaccgccctgctgtatgcagagatctatgctgacaagaagtccatggatgaccaggagaagaggagcctggcctttgaggagggcagccagaacaccaccatcagcagcctgtctgagaagagcaaggaggagaccggcatcagcctgcaggacctgctgctggagatctaccgcagcatcggggagccagacagcctgtatggctgcggcggcggcaagatgctgcagcccatcacccggctgcggacctatgagcacgaggccatgtggggcaaggccctggtgacctatgacctggagacagccatccccagcagcacccggcaggccggcatcatccaggccctgcagaacctgggcctgtgccacatcctgtctgtgtacctgaagggcctggactatgagaacaaggactggtgcccagagctggaggagctgcactaccaggccgcctggaggaacatgcagtgggaccactgcacctctgtgtccaaggaggtggagggcaccagctaccacgagagcctgtacaatgccctgcagagcctgcgggaccgggagttcagcaccttctatgagagcctgaagtatgcccgggtgaaggaggtggaggagatgtgcaagaggagcctggagagcgtgtacagcctgtaccccaccctgagccggctgcaggccatcggggagctggagagcattggagagctgttcagccgctctgtgacccaccggcagctgtctgaggtgtacatcaagtggcagaagcacagccagctgctgaaggacagcgacttctccttccaggagcccatcatggccctgaggacagtcatcctggagatcctgatggagaaggagatggacaacagccagcgggagtgcatcaaggacatcctgaccaagcacctggtggagctgagcatcctggcccggaccttcaagaacacccagctgcctgagcgggccatcttccagatcaagcagtacaacagcgtgtcctgtggggtgtctgagtggcagctggaggaggcccaggtgttctgggccaagaaggagcagagcctggccctgagcatcctgaagcagatgatcaagaagctggatgccagctgtgccgccaacaaccccagcctgaagctgacctacacagagtgcctgcgggtgtgtggcaactggctggccgagacctgcctggagaacccagctgtgatcatgcagacctacctggagaaggctgtggaggtggccggcaactatgatggagagagcagtgatgagctgagaaatggcaagatgaaggccttcctgagcctggcccgcttcagtgacacccagtaccagagaattgagaactacatgaagagcagcgagtttgagaacaagcaggccctgctgaagagggccaaggaggaggtgggcctgctgcgggagcacaagatccagaccaaccgctacacagtgaaggtgcagcgggagctggagctggatgagctggccctgcgggccctgaaggaggacaggaagcgcttcctgtgcaaggctgtggagaactacatcaactgcctgctgagcggggaggagcatgacatgtgggtgttccggctgtgcagcctgtggctggagaacagcggcgtgtctgaggtgaatggcatgatgaagagagatggcatgaagatccccacctacaagttcctgcccctgatgtaccagctggccgccaggatgggcaccaagatgatgggcggcctgggcttccacgaggtgctgaacaacctgatcagccgcatctccatggaccacccccaccacaccctcttcatcatcctggccctggccaatgccaacagagatgagttcctgaccaagccagaggtggcccggcgcagccgcatcaccaagaatgtgcccaagcagagcagccagctggatgaggacagaacagaagctgccaaccgcatcatctgcaccatccgcagccggcggccccagatggtgcgctctgtggaggccctgtgtgatgcctacatcatcctggccaacctggatgccacccagtggaagacccagaggaagggcatcaacatcccagctgaccagcccatcaccaagctgaagaacctggaggatgtggtggtgcccaccatggagatcaaggtggaccacactggagaatatggcaacctggtgaccatccagagcttcaaggccgagttccggctggccggcggcgtgaacctgcccaagatcatcgactgtgtgggcagtgatggcaaggagcggcggcagctggtgaagggcagagatgacctgcggcaggatgctgtgatgcagcaggtgttccagatgtgcaacaccctgctgcagaggaacacagagaccaggaagaggaagctgaccatctgcacctacaaggtggtgcccctgagccagaggtctggagtgctggagtggtgcacaggaacagtgcccatcggggagttcctggtgaacaatgaagatggagcccacaagcgctaccggcccaatgacttcagcgccttccagtgccagaagaagatgatggaggtgcagaagaagagctttgaggagaagtatgaggtgttcatggatgtgtgccagaacttccagcctgtgttccgctacttctgcatggagaagttcctggaccctgccatctggtttgagaagaggctggcctacaccaggtctgtggccaccagcagcatcgtgggctacatcctgggcctgggggacagacatgtgcagaacatcctgatcaatgagcagagcgctgagctggtgcacatcgacctgggcgtggcctttgagcagggcaagatcctgcccaccccagagaccgtgcccttccggctgacccgggacatcgtggatggcatgggcatcactggagtggagggcgtcttccgccgctgctgtgagaagaccatggaggtgatgaggaacagccaggagaccctgctgaccatcgtggaggtgctgctgtatgaccccctgtttgactggaccatgaaccccctgaaggccctgtacctgcagcagaggccagaagatgaaacagagctgcaccccaccctgaatgctgatgaccaggagtgcaagaggaacctgagtgacatcgaccagagcttcaacaaggtggccgagcgggtgctgatgaggctgcaggagaagctgaagggcgtggaggagggcaccgtgctgtctgtgggcggccaggtgaacctgctgatccagcaggccatcgaccccaagaacctgagccgcctcttccctggctggaaggcctgggtgtag

SEQ ID NO: 18390 - DNA, 417 bp, Artificial Sequence
  Description of Artificial Sequence: Synthetic coding sequence
atgaccctgcacgagcccgccaacagcagcgccagccagagcacagacctgtgtgacttcagcggggacctggaccctgcccccaaccccccccacttccccagccacgtgatcaaggccacctttgcctacatcagcaactgccacaagaccaagctgaagagcatcctggagatcctgagcaagagcccagacagctaccagaagatcctgctggccatctgtgagcaggccgctgagaccaacaacgtgtacaagaagcaccgcatcctgaagatctaccacctgtttgtgtccctgctgctgaaggacatcaagagcggcctgggcggggcctgggcctttgtgctgagagatgtgatctacaccctcatccactacatcaaccagaggaagctgaccatcttcagccagtag

SEQ ID NO: 18391 - DNA, 9171 bp, Artificial Sequence; identical to SEQ ID NO: 18389
  Description of Artificial Sequence: Synthetic coding sequence

SEQ ID NO: 18392 - DNA, 4110 bp, Artificial Sequence
  Description of Artificial Sequence: Synthetic coding sequence
atgagcctggtgctgaatgacctgctgatctgctgccggcagctggagcatgaccgggccacagagaggaagaaggaggtggagaagttcaagaggctcatccgggaccctgagaccatcaagcacctggacagacacagcgacagcaagcagggcaagtacctgaactgggatgctgtgttccgcttcctgcagaagtacatccagaaggagacagaatgtctgagaattgccaagcccaacgtgtctgccagcacccaggccagccggcagaagaagatgcaggagatcagcagcctggtgaagtacttcatcaagtgtgccaacagaagagccccccggctgaagtgccaggagctgctgaactacatcatggacacagtgaaggacagcagcaatggagccatctatggagctgactgcagcaacatcctgctgaaggacatcctgtctgtgaggaagtactggtgtgagatcagccagcagcagtggctggagctgttctctgtgtacttccggctgtacctgaagcccagccaggatgtgcaccgggtgctggtggcccgcatcatccatgctgtgaccaagggctgctgcagccagacagatggcctgaacagcaagttcctggacttcttcagcaaggccatccagtgtgcccggcaggagaagagcagcagcggcctgaaccacatcctggccgccctgaccatcttcctgaagaccctggccgtgaacttccgcatccgggtgtgtgagctgggagatgagatcctgcccaccctgctgtacatctggacccagcaccggctgaatgacagcctgaaggaggtgatcatcgagctgttccagctgcagatctacatccaccaccccaagggggccaagacccaggagaagggggcctatgagagcaccaagtggaggagcatcctgtacaacctgtatgacctgctggtgaatgagatcagccacatcggcagccggggcaagtacagcagcggcttcagaaatattgctgtgaaggaaaatctcatcgagctgatggctgacatctgccaccaggtgttcaatgaagacaccaggagcctggagatcagccagagctacaccaccacccagcgggagagcagtgactacagcgtgccctgcaagaggaagaagattgagctgggctgggaggtgatcaaggaccacctgcagaagagccagaatgactttgacctggtgccctggctgcagatcgccacccagctgatcagcaagtacccagccagcctgcccaactgtgagctgagccccctgctgatgatcctgagccagctgctgccccagcagagacatggagagaggaccccctacgtgctgcgctgcctgacagaggtggccctgtgccaggacaagaggagcaacctggagagcagccagaagagtgacctgctgaagctgtggaacaagatctggtgcatcaccttccggggcatcagcagcgagcagatccaggctgaaaattttggcctgctgggcgccatcatccagggcagcctggtggaggtggaccgggagttctggaagctgttcaccggcagcgcctgccggcccagctgcccagctgtgtgctgcctgaccctggccctgaccaccagcatcgtgcccggcaccgtgaagatgggcatcgagcagaacatgtgtgaggtgaacagaagcttcagcctgaaggagagcatcatgaagtggctgctcttctaccagctggagggggacctggagaacagcacagaggtgccccccatcctgcacagcaacttcccccacctggtgctggagaagatcctggtgtccctgaccatgaagaactgcaaggccgccatgaacttcttccagagcgtgcctgaatgtgagcaccaccagaaggacaaggaggagctgtccttcagcgaggtggaggagctgttcctgcagaccacctttgacaagatggacttcctgaccatcgtgcgggagtgtggcatcgagaagcaccagagcagcatcggcttctctgtgcaccagaacctgaaggagagcctggaccgctgcctgctgggcctgtctgagcagctgctgaacaactacagcagcgagatcaccaacagcgagaccctggtgcgctgcagccggctgctggtgggcgtgctgggctgctactgctacatgggcgtgattgctgaggaggaggcctacaagtctgagctgttccagaaggccaagagcctgatgcagtgtgccggggagagcatcaccctcttcaagaacaagaccaatgaggagttcagaattggcagcctgaggaacatgatgcagctgtgcacccgctgcctgagcaactgcaccaagaagagccccaacaagatcgccagcggcttcttcctgcggctgctgaccagcaagctgatgaatgacattgctgacatctgcaagagcctggccagcttcatcaagaagccctttgacagaggagaggtggagagcatggaggatgacaccaatggaaacctgatggaggtggaggaccagagctccatgaacctcttcaatgactacccagacagctctgtgtctgatgccaatgagcccggggagagccagagcaccatcggggccatcaaccccctggccgaggagtacctgagcaagcaggacctgctcttcctggacatgctgaagttcctgtgcctgtgtgtgaccacagcccagaccaacacagtgtccttccgggctgctgacatccggaggaagctgctgatgctgattgacagcagcaccctggagcccaccaagagcctgcacctgcacatgtacctgatgctgctgaaggagctgcctggagaggagtaccccctgcccatggaggatgtgctggagctgctgaagcccctgagcaatgtgtgcagcctgtacagaagagaccaggatgtgtgcaagaccatcctgaaccacgtgctgcacgtggtgaagaacctgggccagagcaacatggacagcgagaacaccagagatgcccagggccagttcctgaccgtcatcggggccttctggcacctgaccaaggagaggaagtacatcttctctgtgaggatggccctggtgaactgcctgaagaccctgctggaggccgacccctacagcaagtgggccatcctgaatgtgatgggcaaggacttccctgtgaatgaggtgttcacccagttcctggccgacaaccaccaccaggtgaggatgctggccgctgagagcatcaacagactcttccaggacaccaagggggacagcagccggctgctgaaggccctgcccctgaagctgcagcagacagcctttgaaaatgcctacctgaaggcccaggagggcatgagggagatgagccacagcgcagaaaatcctgagaccctggatgagatctacaacaggaagtctgtgctgctgaccctgattgctgtggtgctgagctgcagccccatctgtgagaagcaggccctgtttgccctgtgcaagtctgtgaaggaaaatggcctggagccccacctggtgaagaaggtgctggagaaggtgtctgagaccttcggctaccgccgcctggaggacttcatggccagccacctggactacctggtgctggagtggctgaacctgcaggacacagagtacaacctgagcagcttccccttcatcctgctgaactacaccaacatcgaggacttctaccgcagctgctacaaggtgctgatcccccacctggtgatccgcagccactttgatgaggtgaagagcatcgccaaccagatccaggaggactggaagagcctgctgacagactgcttccccaagatcctggtgaacatcctgccctactttgcctatgagggcacccgggacagcggcatggcccagcagcgggagacagccaccaaggtgtatgacatgctgaagtctgagaacctgctgggcaagcagattgaccacctgttcatcagcaacctgcctgagatcgtggtggagctgctgatgaccctgcacgagcccgccaacagcagcgccagccagagcacagacctgtgtgacttctcctag

SEQ ID NO: 18393 - DNA, 282 bp, Artificial Sequence
  Description of Artificial Sequence: Synthetic coding sequence
atgagcctggtgctgaatgacctgctgatctgctgccggcagctggagcatgaccgggccacagagaggaagaaggaggtggagaagttcaagaggctcatccgggaccctgagaccatcaagcacctggacagacacagcgacagcaagcagggcaagtacctgaactgggatgctgtgttccgcttcctgcagaagtacatccagaaggagacagaatgtctgagaattgccaagcccaacgtgtctgccagcacccaggccagccggcagaagaagtag

SEQ ID NO: 18394 - DNA, 921 bp, Artificial Sequence
  Description of Artificial Sequence: Synthetic coding sequence
atggagagcatcttccacgagaagcagcccagcggcaacatggatgattctggcttcttcagcatccaggtgatcagcaatgccctgaaggtgtggggcctggagctgatcctcttcaacagccctgagtaccagaggctgagaattgaccccatcaatgaaagaagcttcatctgcaactacaaggagcactggttcaccgtgaggaagctgggcaagcagtggttcaacctgaacagcctgctgactggacctgagctgatcagtgacacctacctggccctcttcctggcccagctgcagcaggagggctacagcatctttgtggtgaagggggacctgcctgactgtgaggccgaccagctgctgcagatgatccgggtgcagcagatgcaccggcccaagctgattggagaggagctggcccagctgaaggagcagagggtgcacaagacagacctggagcgggtgctggaggccaatgatggcagcggcatgctggatgaagatgaggaggacctgcagagggccctggccctgagccggcaggagattgacatggaggatgaggaggccgacctgcggcgggccatccagctgtccatgcagggcagcagcaggaacatcagccaggacatgacccagaccagcggcaccaacctgaccagcgaggagctgaggaagagaagagaggcctactttgagaagcagcagcagaagcagcagcagcagcagcagcagcagcagcagggcgacctgagcggccagagcagccacccctgtgagaggcctgccaccagcagcggggccctgggcagtgacctgggagatgccatgtctgaggaggacatgctgcaggccgctgtgaccatgagcctggagaccgtgagaaatgacctgaagacagagggcaagaagtag

SEQ ID NO: 18395 - DNA, 1110 bp, Artificial Sequence
  Description of Artificial Sequence: Synthetic coding sequence
atggagagcatcttccacgagaagcaggagggcagcctgtgtgcccagcactgcctgaacaacctgctgcagggcgagtacttcagccctgtggagctgagcagcatcgcccaccagctggatgaggaggagaggatgaggatggccgagggcggcgtgaccagcgaggactaccgcaccttcctgcagcagcccagcggcaacatggatgacagcggcttcttcagcatccaggtgatcagcaatgccctgaaggtgtggggcctggagctgatcctcttcaacagccctgagtaccagaggctgagaattgaccccatcaatgaaagaagcttcatctgcaactacaaggagcactggttcaccgtgaggaagctgggcaagcagtggttcaacctgaacagcctgctgaccggccctgagctgatcagtgacacctacctggccctcttcctggcccagctgcagcaggagggctacagcatctttgtggtgaagggggacctgcctgactgtgaggccgaccagctgctgcagatgatccgggtgcagcagatgcaccggcccaagctgattggagaggagctggcccagctgaaggagcagagggtgcacaagacagacctggagcgggtgctggaggccaatgatggcagcggcatgctggatgaagatgaggaggacctgcagagggccctggccctgagccggcaggagattgacatggaggatgaggaggccgacctgcggcgggccatccagctgtccatgcagggcagcagcaggaacatcagccaggacatgacccagaccagcggcaccaacctgaccagcgaggagctgaggaagaggcgggaggcctactttgagaaggaccagcacttccacatcctgaagcagcagcagaagcagcagcagcagcagcagcagcagcagcagggcgacctgagcggccagagcagccacccctgtgagaggcctgccaccagcagcggggccctgggcagtgacctgggagatgccatgtctgaggaggacatgctgcaggccgctgtgaccatgagcctggagaccgtgagaaatgacctgaagacagagggcaagaagtag

SEQ ID NO: 18396 - DNA, 1086 bp, Artificial Sequence
  Description of Artificial Sequence: Synthetic coding sequence
atggagagcatcttccacgagaagcaggagggcagcctgtgtgcccagcactgcctgaacaacctgctgcagggcgagtacttcagccctgtggagctgagcagcatcgcccaccagctggatgaggaggagaggatgaggatggccgagggcggcgtgaccagcgaggactaccgcaccttcctgcagcagcccagcggcaacatggatgacagcggcttcttcagcatccaggtgatcagcaatgccctgaaggtgtggggcctggagctgatcctcttcaacagccctgagtaccagaggctgagaattgaccccatcaatgaaagaagcttcatctgcaactacaaggagcactggttcaccgtgaggaagctgggcaagcagtggttcaacctgaacagcctgctgaccggccctgagctgatcagtgacacctacctggccctcttcctggcccagctgcagcaggagggctacagcatctttgtggtgaagggggacctgcctgactgtgaggccgaccagctgctgcagatgatccgggtgcagcagatgcaccggcccaagctgattggagaggagctggcccagctgaaggagcagagggtgcacaagacagacctggagcgggtgctggaggccaatgatggcagcggcatgctggatgaagatgaggaggacctgcagagggccctggccctgagccggcaggagattgacatggaggatgaggaggccgacctgcggcgggccatccagctgtccatgcagggcagcagcaggaacatcagccaggacatgacccagaccagcggcaccaacctgaccagcgaggagctgaggaagaggcgggaggcctactttgagaagcagcagcagaagcagcagcagcagcagcagcagcagcagcagggcgacctgagcggccagagcagccacccctgtgagaggcctgccaccagcagcggggccctgggcagtgacctgggagatgccatgtctgaggaggacatgctgcaggccgctgtgaccatgagcctggagaccgtgagaaatgacctgaagacagagggcaagaagtag

SEQ ID NO: 18397 - DNA, 1101 bp, Artificial Sequence
  Description of Artificial Sequence: Synthetic coding sequence
atggagagcatcttccacgagaagcaggagggcagcctgtgtgcccagcactgcctgaacaacctgctgcagggcgagtacttcagccctgtggagctgagcagcatcgcccaccagctggatgaggaggagaggatgaggatggccgagggcggcgtgaccagcgaggactaccgcaccttcctgcagcagcccagcggcaacatggatgacagcggcttcttcagcatccaggtgatcagcaatgccctgaaggtgtggggcctggagctgatcctcttcaacagccctgagtaccagaggctgagaattgaccccatcaatgaaagaagcttcatctgcaactacaaggagcactggttcaccgtgaggaagctgggcaagcagtggttcaacctgaacagcctgctgaccggccctgagctgatcagtgacacctacctggccctcttcctggcccagctgcagcaggagggctacagcatctttgtggtgaagggggacctgcctgactgtgaggccgaccagctgctgcagatgatccgggtgcagcagatgcaccggcccaagctgattggagaggagctggcccagctgaaggagcagagggtgcacaagacagacctggagcgggtgctggaggccaatgatggcagcggcatgctggatgaagatgaggaggacctgcagagggccctggccctgagccggcaggagattgacatggaggatgaggaggccgacctgcggcgggccatccagctgtccatgcagggcagcagcaggaacatcagccaggacatgacccagaccagcggcaccaacctgaccagcgaggagctgaggaagaggcgggaggcctactttgaaaatgactactttgacagccagcagcagaagcagcagcagcagcagcagcagcagcagcagggcgacctgagcggccagagcagccacccctgtgagaggcctgccaccagcagcggggccctgggcagtgacctgggagatgccatgtctgaggaggacatgctgcaggccgctgtgaccatgagcctggagaccgtgagaaatgacctgaagacagagggcaagaagtag

SEQ ID NO: 18398 - DNA, 1065 bp, Artificial Sequence
  Description of Artificial Sequence: Synthetic coding sequence
atggagagcatcttccacgagaagcaggagggcagcctgtgtgcccagcactgcctgaacaacctgctgcagggcgagtacttcagccctgtggagctgagcagcatcgcccaccagctggatgaggaggagaggatgaggatggccgagggcggcgtgaccagcgaggactaccgcaccttcctgcaggtgatcagcaatgccctgaaggtgtggggcctggagctgatcctcttcaacagccctgagtaccagaggctgagaattgaccccatcaatgaaagaagcttcatctgcaactacaaggagcactggttcaccgtgaggaagctgggcaagcagtggttcaacctgaacagcctgctgactggacctgagctgatcagtgacacctacctggccctcttcctggcccagctgcagcaggagggctacagcatctttgtggtgaagggggacctgcctgactgtgaggccgaccagctgctgcagatgatccgggtgcagcagatgcaccggcccaagctgattggagaggagctggcccagctgaaggagcagagggtgcacaagacagacctggagcgggtgctggaggccaatgatggcagcggcatgctggatgaagatgaggaggacctgcagagggccctggccctgagccggcaggagattgacatggaggatgaggaggccgacctgcggcgggccatccagctgtccatgcagggcagcagcaggaacatcagccaggacatgacccagaccagcggcaccaacctgaccagcgaggagctgaggaagagaagagaggcctactttgagaaggaccagcacttccacatcctgaagcagcagcagaagcagcagcagcagcagcagcagcagcagcagggcgacctgagcggccagagcagccacccctgtgagaggcctgccaccagcagcggggccctgggcagtgacctgggagatgccatgtctgaggaggacatgctgcaggccgctgtgaccatgagcctggagaccgtgagaaatgacctgaagacagagggcaagaagtag

SEQ ID NO: 18399 - DNA, 1113 bp, Artificial Sequence
  Description of Artificial Sequence: Synthetic coding sequence
atggagagcatcttccacgagaagcaggagggcagcctgtgtgcccagcactgcctgaacaacctgctgcagggcgagtacttcagccctgtggagctgagcagcatcgcccaccagctggatgaggaggagaggatgaggatggccgagggcggcgtgaccagcgaggactaccgcaccttcctgcagcagcccagcggcaacatggatgacagcggcttcttcagcatccaggtgatcagcaatgccctgaaggtgtggggcctggagctgatcctcttcaacagccctgagtaccagaggctgagaattgaccccatcaatgaaagaagcttcatctgcaactacaaggagcactggttcaccgtgaggaagctgggcaagcagtggttcaacctgaacagcctgctgaccggccctgagctgatcagtgacacctacctggccctcttcctggcccagctgcagcaggagggctacagcatctttgtggtgaagggggacctgcctgactgtgaggccgaccagctgctgcagatgatccgggtgcagcagatgcaccggcccaagctgattggagaggagctggcccagctgaaggagcagagggtgcacaagacagacctggagcgggtgctggaggccaatgatggcagcggcatgctggatgaagatgaggaggacctgcagagggccctggccctgagccggcaggagattgacatggaggatgaggaggccgacctgcggcgggccatccagctgtccatgcagggcagcagcaggaacatcagccaggacatgacccagaccagcggcaccaacctgaccagcgaggagctgaggaagaggcgggaggcctactttgagaagacagagagccgctctgtggcccaggcccagcagcagaagcagcagcagcagcagcagcagcagcagcagggcgacctgagcggccagagcagccacccctgtgagaggcctgccaccagcagcggggccctgggcagtgacctgggagatgccatgtctgaggaggacatgctgcaggccgctgtgaccatgagcctggagaccgtgagaaatgacctgaagacagagggcaagaagtag

SEQ ID NO: 18400 - DNA, 1041 bp, Artificial Sequence
  Description of Artificial Sequence: Synthetic coding sequence
atggagagcatcttccacgagaagcaggagggcagcctgtgtgcccagcactgcctgaacaacctgctgcagggcgagtacttcagccctgtggagctgagcagcatcgcccaccagctggatgaggaggagaggatgaggatggccgagggcggcgtgaccagcgaggactaccgcaccttcctgcaggtgatcagcaatgccctgaaggtgtggggcctggagctgatcctcttcaacagccctgagtaccagaggctgagaattgaccccatcaatgaaagaagcttcatctgcaactacaaggagcactggttcaccgtgaggaagctgggcaagcagtggttcaacctgaacagcctgctgactggacctgagctgatcagtgacacctacctggccctcttcctggcccagctgcagcaggagggctacagcatctttgtggtgaagggggacctgcctgactgtgaggccgaccagctgctgcagatgatccgggtgcagcagatgcaccggcccaagctgattggagaggagctggcccagctgaaggagcagagggtgcacaagacagacctggagcgggtgctggaggccaatgatggcagcggcatgctggatgaagatgaggaggacctgcagagggccctggccctgagccggcaggagattgacatggaggatgaggaggccgacctgcggcgggccatccagctgtccatgcagggcagcagcaggaacatcagccaggacatgacccagaccagcggcaccaacctgaccagcgaggagctgaggaagagaagagaggcctactttgagaagcagcagcagaagcagcagcagcagcagcagcagcagcagcagggcgacctgagcggccagagcagccacccctgtgagaggcctgccaccagcagcggggccctgggcagtgacctgggagatgccatgtctgaggaggacatgctgcaggccgctgtgaccatgagcctggagaccgtgagaaatgacctgaagacagagggcaagaagtag

SEQ ID NO: 18401 - DNA, 1095 bp, Artificial Sequence
  Description of Artificial Sequence: Synthetic coding sequence
atggagagcatcttccacgagaagcaggagggcagcctgtgtgcccagcactgcctgaacaacctgctgcagggcgagtacttcagccctgtggagctgagcagcatcgcccaccagctggatgaggaggagaggatgaggatggccgagggcggcgtgaccagcgaggactaccgcaccttcctgcagcagcccagcggcaacatggatgacagcggcttcttcagcatccaggtgatcagcaatgccctgaaggtgtggggcctggagctgatcctcttcaacagccctgagtaccagaggctgagaattgaccccatcaatgaaagaagcttcatctgcaactacaaggagcactggttcaccgtgaggaagctgggcaagcagtggttcaacctgaacagcctgctgaccggccctgagctgatcagtgacacctacctggccctcttcctggcccagctgcagcaggagggctacagcatctttgtggtgaagggggacctgcctgactgtgaggccgaccagctgctgcagatgatccgggtgcagcagatgcaccggcccaagctgattggagaggagctggcccagctgaaggagcagagggtgcacaagacagacctggagcgggtgctggaggccaatgatggcagcggcatgctggatgaagatgaggaggacctgcagagggccctggccctgagccggcaggagattgacatggaggatgaggaggccgacctgcggcgggccatccagctgtccatgcagggcagcagcaggaacatcagccaggacatgacccagaccagcggcaccaacctgaccagcgaggagctgaggaagaggcgggaggcctactttgagaagcagcagcagaagcagcagcagcagcagcagcagcagcagcagggcgacctgagcggccagagcagccacccctgtgagaggcctgccaccagcagcggggccctgggcagtgacctgggcaaggcctgcagccccttcatcatgtttgccaccttcaccctgtacctgacctatgagctgcacgtgatctttgccctgcactacagcagcttccccctgtag

SEQ ID NO: 18402 - DNA, 1119 bp, Artificial Sequence
  Description of Artificial Sequence: Synthetic coding sequence
atggagagcatcttccacgagaagcaggagggcagcctgtgtgcccagcactgcctgaacaacctgctgcagggcgagtacttcagccctgtggagctgagcagcatcgcccaccagctggatgaggaggagaggatgaggatggccgagggcggcgtgaccagcgaggactaccgcaccttcctgcagcagcccagcggcaacatggatgacagcggcttcttcagcatccaggtgatcagcaatgccctgaaggtgtggggcctggagctgatcctcttcaacagccctgagtaccagaggctgagaattgaccccatcaatgaaagaagcttcatctgcaactacaaggagcactggttcaccgtgaggaagctgggcaagcagtggttcaacctgaacagcctgctgaccggccctgagctgatcagtgacacctacctggccctcttcctggcccagctgcagcaggagggctacagcatctttgtggtgaagggggacctgcctgactgtgaggccgaccagctgctgcagatgatccgggtgcagcagatgcaccggcccaagctgattggagaggagctggcccagctgaaggagcagagggtgcacaagacagacctggagcgggtgctggaggccaatgatggcagcggcatgctggatgaagatgaggaggacctgcagagggccctggccctgagccggcaggagattgacatggaggatgaggaggccgacctgcggcgggccatccagctgtccatgcagggcagcagcaggaacatcagccaggacatgacccagaccagcggcaccaacctgaccagcgaggagctgaggaagaggcgggaggcctactttgagaagtttggccggccccggcgggctgactgcctgcggcagcagcagaagcagcagcagcagcagcagcagcagcagcagggcgacctgagcggccagagcagccacccctgtgagaggcctgccaccagcagcggggccctgggcagtgacctgggagatgccatgtctgaggaggacatgctgcaggccgctgtgaccatgagcctggagaccgtgagaaatgacctgaagacagagggcaagaagtag

SEQ ID NO: 18403 - DNA, 1128 bp, Artificial Sequence
  Description of Artificial Sequence: Synthetic coding sequence
gacagcgtgtccaagaagaagcaggagggcagcctgtgtgcccagcactgcctgaacaacctgctgcagggcgagtacttcagccctgtggagctgagcagcatcgcccaccagctggatgaggaggagaggatgaggatggccgagggcggcgtgaccagcgaggactaccgcaccttcctgcagcagcccagcggcaacatggatgattctggcttcttcagcatccaggtgatcagcaatgccctgaaggtgtggggcctggagctgatcctcttcaacagccctgagtaccagaggctgagaattgaccccatcaatgaaagaagcttcatctgcaactacaaggagcactggttcaccgtgaggaagctgggcaagcagtggttcaacctgaacagcctgctgactggacctgagctgatcagtgacacctacctggccctcttcctggcccagctgcagcaggagggctacagcatctttgtggtgaagggggacctgcctgactgtgaggccgaccagctgctgcagatgatccgggtgcagcagatgcaccggcccaagctgattggagaggagctggcccagctgaaggagcagagggtgcacaagacagacctggagcgggtgctggaggccaatgatggcagcggcatgctggatgaagatgaggaggacctgcagagggccctggccctgagccggcaggagattgacatggaggatgaggaggccgacctgcggcgggccatccagctgtccatgcagggcagcagcaggaacatcagccaggacatgacccagaccagcggcaccaacctgaccagcgaggagctgaggaagagaagagaggcctactttgagaagaagttcaccgccaacagaacagaccagcacttccacatcctgaagcagcagcagaagcagcagcagcagcagcagcagcagcagcagggcgacctgagcggccagagcagccacccctgtgagaggcctgccaccagcagcggggccctgggcagtgacctgggagatgccatgtctgaggaggacatgctgcaggccgctgtgaccatgagcctggagaccgtgagaaatgacctgaagacagagggcaagaagtag

SEQ ID NO: 18404 - DNA, 1125 bp, Artificial Sequence
  Description of Artificial Sequence: Synthetic coding sequence
atggagagcatcttccacgagaagcaggagggcagcctgtgtgcccagcactgcctgaacaacctgctgcagggcgagtacttcagccctgtggagctgagcagcatcgcccaccagctggatgaggaggagaggatgaggatggccgagggcggcgtgaccagcgaggactaccgcaccttcctgcagcagcccagcggcaacatggatgacagcggcttcttcagcatccaggtgatcagcaatgccctgaaggtgtggggcctggagctgatcctcttcaacagccctgagtaccagaggctgagaattgaccccatcaatgaaagaagcttcatctgcaactacaaggagcactggttcaccgtgaggaagctgggcaagcagtggttcaacctgaacagcctgctgaccggccctgagctgatcagtgacacctacctggccctcttcctggcccagctgcagcaggagggctacagcatctttgtggtgaagggggacctgcctgactgtgaggccgaccagctgctgcagatgatccgggtgcagcagatgcaccggcccaagctgattggagaggagctggcccagctgaaggagcagagggtgcacaagacagacctggagcgggtgctggaggccaatgatggcagcggcatgctggatgaagatgaggaggacctgcagagggccctggccctgagccggcaggagattgacatggaggatgaggaggccgacctgcggcgggccatccagctgtccatgcagggcagcagcaggaacatcagccaggacatgacccagaccagcggcaccaacctgaccagcgaggagctgaggaagaggcgggaggcctactttgagaaggtgttcttcaagaacctgcagcagatcggccgggcccggcagcagcagaagcagcagcagcagcagcagcagcagcagcagggcgacctgagcggccagagcagccacccctgtgagaggcctgccaccagcagcggggccctgggcagtgacctgggagatgccatgtctgaggaggacatgctgcaggccgctgtgaccatgagcctggagaccgtgagaaatgacctgaagacagagggcaagaagtag

SEQ ID NO: 18405 - DNA, 1113 bp, Artificial Sequence
  Description of Artificial Sequence: Synthetic coding sequence
atggagagcatcttccacgagaagcaggagggcagcctgtgtgcccagcactgcctgaacaacctgctgcagggcgagtacttcagccctgtggagctgagcagcatcgcccaccagctggatgaggaggagaggatgaggatggccgagggcggcgtgaccagcgaggactaccgcaccttcctgcagcagcccagcggcaacatggatgacagcggcttcttcagcatccaggtgatcagcaatgccctgaaggtgtggggcctggagctgatcctcttcaacagccctgagtaccagaggctgagaattgaccccatcaatgaaagaagcttcatctgcaactacaaggagcactggttcaccgtgaggaagctgggcaagcagtggttcaacctgaacagcctgctgaccggccctgagctgatcagtgacacctacctggccctcttcctggcccagctgcagcaggagggctacagcatctttgtggtgaagggggacctgcctgactgtgaggccgaccagctgctgcagatgatccgggtgcagcagatgcaccggcccaagctgattggagaggagctggcccagctgaaggagcagagggtgcacaagacagacctggagcgggtgctggaggccaatgatggcagcggcatgctggatgaagatgaggaggacctgcagagggccctggccctgagccggcaggagattgacatggaggatgaggaggccgacctgcggcgggccatccagctgtccatgcagggcagcagcaggaacatcagccaggacatgacccagaccagcggcaccaacctgaccagcgaggagctgaggaagaggcgggaggcctactttgagaagatctacttcacctttgagtgcttccggcagcagcagaagcagcagcagcagcagcagcagcagcagcagggcgacctgagcggccagagcagccacccctgtgagaggcctgccaccagcagcggggccctgggcagtgacctgggagatgccatgtctgaggaggacatgctgcaggccgctgtgaccatgagcctggagaccgtgagaaatgacctgaagacagagggcaagaagtag

SEQ ID NO: 18406 - DNA, 1134 bp, Artificial Sequence
  Description of Artificial Sequence: Synthetic coding sequence
atggagagcatcttccacgagaagcaggagggcagcctgtgtgcccagcactgcctgaacaacctgctgcagggcgagtacttcagccctgtggagctgagcagcatcgcccaccagctggatgaggaggagaggatgaggatggccgagggcggcgtgaccagcgaggactaccgcaccttcctgcagcagcccagcggcaacatggatgacagcggcttcttcagcatccaggtgatcagcaatgccctgaaggtgtggggcctggagctgatcctcttcaacagccctgagtaccagaggctgagaattgaccccatcaatgaaagaagcttcatctgcaactacaaggagcactggttcaccgtgaggaagctgggcaagcagtggttcaacctgaacagcctgctgaccggccctgagctgatcagtgacacctacctggccctcttcctggcccagctgcagcaggagggctacagcatctttgtggtgaagggggacctgcctgactgtgaggccgaccagctgctgcagatgatccgggtgcagcagatgcaccggcccaagctgattggagaggagctggcccagctgaaggagcagagggtgcacaagacagacctggagcgggtgctggaggccaatgatggcagcggcatgctggatgaagatgaggaggacctgcagagggccctggccctgagccggcaggagattgacatggaggatgaggaggccgacctgcggcgggccatccagctgtccatgcagggcagcagcaggaacatcagccaggacatgacccagaccagcggcaccaacctgaccagcgaggagctgaggaagaggcgggaggcctactttgagaaggtgttcttcaagaacctgcagcagaaccagcacttccacatcctgaagcagcagcagaagcagcagcagcagcagcagcagcagcagcagggcgacctgagcggccagagcagccacccctgtgagaggcctgccaccagcagcggggccctgggcagtgacctgggagatgccatgtctgaggaggacatgctgcaggccgctgtgaccatgagcctggagaccgtgagaaatgacctgaagacagagggcaagaagtag

SEQ ID NO: 18407 - DNA, 549 bp, Artificial Sequence
  Description of Artificial Sequence: Synthetic coding sequence
atgatccgggtgcagcagatgcaccggcccaagctgattggagaggagctggcccagctgaaggagcagagggtgcacaagacagacctggagcgggtgctggaggccaatgatggcagcggcatgctggatgaagatgaggaggacctgcagagggccctggccctgagccggcaggagattgacatggaggatgaggaggccgacctgcggcgggccatccagctgtccatgcagggcagcagcaggaacatcagccaggacatgacccagaccagcggcaccaacctgaccagcgaggagctgaggaagagaagagaggcctactttgagaagcagcagcagaagcagcagcagcagcagcagcagcagcagcagggcgacctgagcggccagagcagccacccctgtgagaggcctgccaccagcagcggggccctgggcagtgacctgggagatgccatgtctgaggaggacatgctgcaggccgctgtgaccatgagcctggagaccgtgagaaatgacctgaagacagagggcaagaagtag

SEQ ID NO: 18408 - DNA, 3306 bp, Artificial Sequence
  Description of Artificial Sequence: Synthetic coding sequence
atgtctgccaaggccatcagcgagcagacaggcaaggagctgctgtacaagttcatctgcaccaccagcgccatccagaaccgcttcaagtatgcccgggtgaccccagacacagactgggcccggctgctgcaggaccacccctggctgctgagccagaacctggtggtgaagccagaccagctgatcaagagaagaggcaagctgggcctggtgggcgtgaacctgaccctggatggagtgaagtcctggctgaagccccggctgggccaggaggccaccgtgggcaaggccaccggcttcctgaagaacttcctgattgagccctttgtgccccacagccaggccgaggagttctacgtgtgcatctatgccacccgggagggggactatgtgctcttccaccacgagggcggcgtggatgtgggagatgtggatgccaaggcccagaagctgctggtgggcgtggatgagaagctgaaccctgaggacatcaagaagcacctgctggtgcacgcccctgaggacaagaaggagatcctggccagcttcatcagcggcctcttcaacttctatgaagatctctacttcacctacctggagatcaaccccctggtggtgaccaaggatggagtgtatgtgctggacctggccgccaaggtggatgccacagctgactacatctgcaaggtgaagtggggagacatcgagttccccccacccttcggccgggaggcctacccagaggaggcctacatcgctgacctggatgccaagagcggggccagcctgaagctgaccctgctgaaccccaagggccgcatctggaccatggtggccggcggcggggcctctgtggtgtacagcgacaccatctgtgacctgggcggcgtgaatgagctggccaactacggggagtacagcggggcccccagcgagcagcagacctatgactatgccaagaccatcctgagcctgatgacccgggagaagcacccagatggcaagatcctgatcatcggcggcagcatcgccaacttcaccaacgtggccgccaccttcaagggcatcgtgcgggccatccgggactaccagggccccctgaaggagcacgaggtgaccatctttgtgcggcggggcggccccaactaccaggagggcctgcgggtgatgggagaggtgggcaagaccaccggcatccccatccacgtgtttggaacagagacccacatgacagccatcgtgggcatggccctgggccaccggcccatccccaaccagcccccaacagctgcccacacagccaacttcctgctgaatgccagcggcagcaccagcaccccagcccccagcaggacagccagcttcagcgagagcagagcagatgaggtggccccagccaagaaggccaagccagccatgccccaggacagcgtgcccagccccaggagcctgcagggcaagagcaccaccctcttcagccgccacaccaaggccatcgtgtggggcatgcagaccagggctgtgcagggcatgctggactttgattatgtgtgcagcagagatgagcccagcgtggccgccatggtgtaccccttcaccggggaccacaagcagaagttctactggggccacaaggagatcctgatccctgtgttcaagaacatggctgatgccatgaggaagcaccctgaggtggatgtgctgatcaactttgccagcctgcggagcgcctatgacagcaccatggagaccatgaactatgcccagatccgcaccatcgccatcatcgccgagggcatccctgaggccctgaccaggaagctgatcaagaaggctgaccagaagggcgtgaccatcatcggccctgccaccgtgggcggcatcaagccaggctgcttcaagattggcaacacaggaggcatgctggacaacatcctggccagcaagctgtaccggcccggctctgtggcctacgtgagccgcagcggcggcatgagcaatgagctgaacaacatcatcagcaggaccacagatggagtgtatgagggcgtggccatcggcggggaccgctacccaggcagcaccttcatggaccacgtgctgcgctaccaggacaccccaggagtgaagatgattgtggtgctgggggagattggaggaacagaggagtacaagatctgccggggcatcaaggagggccgcctgaccaagcccatcgtgtgctggtgcatcggcacctgtgccaccatgttcagcagcgaggtgcagtttggacatgctggggcctgtgccaaccaggccagcgagacagctgtggccaagaaccaggccctgaaggaggccggcgtgtttgtgcccaggagctttgatgagctgggggagatcatccagagcgtgtatgaggacctggtggccaatggagtcatcgtgcctgcccaggaggtgcccccacccaccgtgcccatggactacagctgggcccgggagctgggcctcatcaggaagccagccagcttcatgaccagcatctgtgatgagcggggccaggagctgatctatgccggcatgcccatcacagaggtgttcaaggaggagatgggcattggaggagtgctgggcctgctgtggttccagaagaggctgcccaagtacagctgccagttcatcgagatgtgcctgatggtgacagctgaccacggccctgctgtgtctggggcccacaacaccatcatctgtgcccgggccggcaaggacctggtgagcagcctgaccagcggcctgctgaccatcggggacagatttggaggagccctggatgctgctgccaagatgttcagcaaggcctttgacagcggcatcatccccatggagtttgtgaacaagatgaagaaggagggcaagctgatcatgggcatcggccaccgggtgaagagcatcaacaacccagacatgagggtgcagatcctgaaggactatgtgcggcagcacttccctgccacccccctgctggactatgccctggaggtggagaagatcaccaccagcaagaagcccaacctgatcctgaatgtggatggcctgattggagtggcctttgtggacatgctgaggaactgtggcagcttcacccgggaggaggctgatgagtacatcgacatcggggccctgaatggcatctttgtgctgggccgctccatgggcttcatcggccactacctggaccagaagaggctgaagcagggcctgtaccgccacccctgggatgacatctcctatgtgctgcctgagcacatgtccatgtag

SEQ ID NO: 18409 - DNA, 3276 bp, Artificial Sequence
  Description of Artificial Sequence: Synthetic coding sequence
atgtctgccaaggccatcagcgagcagacaggcaaggagctgctgtacaagttcatctgcaccaccagcgccatccagaaccgcttcaagtatgcccgggtgaccccagacacagactgggcccggctgctgcaggaccacccctggctgctgagccagaacctggtggtgaagccagaccagctgatcaagagaagaggcaagctgggcctggtgggcgtgaacctgaccctggatggagtgaagtcctggctgaagccccggctgggccaggaggccaccgtgggcaaggccaccggcttcctgaagaacttcctgattgagccctttgtgccccacagccaggccgaggagttctacgtgtgcatctatgccacccgggagggggactatgtgctcttccaccacgagggcggcgtggatgtgggagatgtggatgccaaggcccagaagctgctggtgggcgtggatgagaagctgaaccctgaggacatcaagaagcacctgctggtgcacgcccctgaggacaagaaggagatcctggccagcttcatcagcggcctcttcaacttctatgaagatctctacttcacctacctggagatcaaccccctggtggtgaccaaggatggagtgtatgtgctggacctggccgccaaggtggatgccacagctgactacatctgcaaggtgaagtggggagacatcgagttccccccacccttcggccgggaggcctacccagaggaggcctacatcgctgacctggatgccaagagcggggccagcctgaagctgaccctgctgaaccccaagggccgcatctggaccatggtggccggcggcggggcctctgtggtgtacagcgacaccatctgtgacctgggcggcgtgaatgagctggccaactacggggagtacagcggggcccccagcgagcagcagacctatgactatgccaagaccatcctgagcctgatgacccgggagaagcacccagatggcaagatcctgatcatcggcggcagcatcgccaacttcaccaacgtggccgccaccttcaagggcatcgtgcgggccatccgggactaccagggccccctgaaggagcacgaggtgaccatctttgtgcggcggggcggccccaactaccaggagggcctgcgggtgatgggagaggtgggcaagaccaccggcatccccatccacgtgtttggaacagagacccacatgacagccatcgtgggcatggccctgggccaccggcccatccccaaccagcccccaacagctgcccacacagccaacttcctgctgaatgccagcggcagcaccagcaccccagcccccagcaggacagccagcttcagcgagagcagagcagatgaggtggccccagccaagaaggccaagccagccatgccccagggcaagagcaccaccctcttcagccgccacaccaaggccatcgtgtggggcatgcagaccagggctgtgcagggcatgctggactttgattatgtgtgcagcagagatgagcccagcgtggccgccatggtgtaccccttcaccggggaccacaagcagaagttctactggggccacaaggagatcctgatccctgtgttcaagaacatggctgatgccatgaggaagcaccctgaggtggatgtgctgatcaactttgccagcctgcggagcgcctatgacagcaccatggagaccatgaactatgcccagatccgcaccatcgccatcatcgccgagggcatccctgaggccctgaccaggaagctgatcaagaaggctgaccagaagggcgtgaccatcatcggccctgccaccgtgggcggcatcaagccaggctgcttcaagattggcaacacaggaggcatgctggacaacatcctggccagcaagctgtaccggcccggctctgtggcctacgtgagccgcagcggcggcatgagcaatgagctgaacaacatcatcagcaggaccacagatggagtgtatgagggcgtggccatcggcggggaccgctacccaggcagcaccttcatggaccacgtgctgcgctaccaggacaccccaggagtgaagatgattgtggtgctgggggagattggaggaacagaggagtacaagatctgccggggcatcaaggagggccgcctgaccaagcccatcgtgtgctggtgcatcggcacctgtgccaccatgttcagcagcgaggtgcagtttggacatgctggggcctgtgccaaccaggccagcgagacagctgtggccaagaaccaggccctgaaggaggccggcgtgtttgtgcccaggagctttgatgagctgggggagatcatccagagcgtgtatgaggacctggtggccaatggagtcatcgtgcctgcccaggaggtgcccccacccaccgtgcccatggactacagctgggcccgggagctgggcctcatcaggaagccagccagcttcatgaccagcatctgtgatgagcggggccaggagctgatctatgccggcatgcccatcacagaggtgttcaaggaggagatgggcattggaggagtgctgggcctgctgtggttccagaagaggctgcccaagtacagctgccagttcatcgagatgtgcctgatggtgacagctgaccacggccctgctgtgtctggggcccacaacaccatcatctgtgcccgggccggcaaggacctggtgagcagcctgaccagcggcctgctgaccatcggggacagatttggaggagccctggatgctgctgccaagatgttcagcaaggcctttgacagcggcatcatccccatggagtttgtgaacaagatgaagaaggagggcaagctgatcatgggcatcggccaccgggtgaagagcatcaacaacccagacatgagggtgcagatcctgaaggactatgtgcggcagcacttccctgccacccccctgctggactatgccctggaggtggagaagatcaccaccagcaagaagcccaacctgatcctgaatgtggatggcctgattggagtggcctttgtggacatgctgaggaactgtggcagcttcacccgggaggaggctgatgagtacatcgacatcggggccctgaatggcatctttgtgctgggccgctccatgggcttcatcggccactacctggaccagaagaggctgaagcagggcctgtaccgccacccctgggatgacatctcctatgtgctgcctgagcacatgtccatgtag

SEQ ID NO: 18410 - DNA, 3276 bp, Artificial Sequence; identical to SEQ ID NO: 18409
  Description of Artificial Sequence: Synthetic coding sequence

SEQ ID NO: 18411 - DNA, 3468 bp, Artificial Sequence
  Description of Artificial Sequence: Synthetic coding sequence
atgggcgccggcaagagccctgctggccctggccagaagccagaccccgggaagctgcctgctgctggggtgctgcgcatcctgcggggcagcagcggcctgtggaagaagaggcgggcccggaccagcgctgagaccggccgggccggcctgtctgctgccatgtctgccaaggccatcagcgagcagacaggcaaggagctgctgtacaagttcatctgcaccaccagcgccatccagaaccgcttcaagtatgcccgggtgaccccagacacagactgggcccggctgctgcaggaccacccctggctgctgagccagaacctggtggtgaagccagaccagctgatcaagagaagaggcaagctgggcctggtgggcgtgaacctgaccctggatggagtgaagtcctggctgaagccccggctgggccaggaggccaccgtgggcaaggccaccggcttcctgaagaacttcctgattgagccctttgtgccccacagccaggccgaggagttctacgtgtgcatctatgccacccgggagggggactatgtgctcttccaccacgagggcggcgtggatgtgggagatgtggatgccaaggcccagaagctgctggtgggcgtggatgagaagctgaaccctgaggacatcaagaagcacctgctggtgcacgcccctgaggacaagaaggagatcctggccagcttcatcagcggcctcttcaacttctatgaagatctctacttcacctacctggagatcaaccccctggtggtgaccaaggatggagtgtatgtgctggacctggccgccaaggtggatgccacagctgactacatctgcaaggtgaagtggggagacatcgagttccccccacccttcggccgggaggcctacccagaggaggcctacatcgctgacctggatgccaagagcggggccagcctgaagctgaccctgctgaaccccaagggccgcatctggaccatggtggccggcggcggggcctctgtggtgtacagcgacaccatctgtgacctgggcggcgtgaatgagctggccaactacggggagtacagcggggcccccagcgagcagcagacctatgactatgccaagaccatcctgagcctgatgacccgggagaagcacccagatggcaagatcctgatcatcggcggcagcatcgccaacttcaccaacgtggccgccaccttcaagggcatcgtgcgggccatccgggactaccagggccccctgaaggagcacgaggtgaccatctttgtgcggcggggcggccccaactaccaggagggcctgcgggtgatgggagaggtgggcaagaccaccggcatccccatccacgtgtttggaacagagacccacatgacagccatcgtgggcatggccctgggccaccggcccatccccaaccagcccccaacagctgcccacacagccaacttcctgctgaatgccagcggcagcaccagcaccccagcccccagcaggacagccagcttcagcgagagcagagcagatgaggtggccccagccaagaaggccaagccagccatgccccaggacagcgtgcccagccccaggagcctgcagggcaagagcaccaccctcttcagccgccacaccaaggccatcgtgtggggcatgcagaccagggctgtgcagggcatgctggactttgattatgtgtgcagcagagatgagcccagcgtggccgccatggtgtaccccttcaccggggaccacaagcagaagttctactggggccacaaggagatcctgatccctgtgttcaagaacatggctgatgccatgaggaagcaccctgaggtggatgtgctgatcaactttgccagcctgcggagcgcctatgacagcaccatggagaccatgaactatgcccagatccgcaccatcgccatcatcgccgagggcatccctgaggccctgaccaggaagctgatcaagaaggctgaccagaagggcgtgaccatcatcggccctgccaccgtgggcggcatcaagccaggctgcttcaagattggcaacacaggaggcatgctggacaacatcctggccagcaagctgtaccggcccggctctgtggcctacgtgagccgcagcggcggcatgagcaatgagctgaacaacatcatcagcaggaccacagatggagtgtatgagggcgtggccatcggcggggaccgctacccaggcagcaccttcatggaccacgtgctgcgctaccaggacaccccaggagtgaagatgattgtggtgctgggggagattggaggaacagaggagtacaagatctgccggggcatcaaggagggccgcctgaccaagcccatcgtgtgctggtgcatcggcacctgtgccaccatgttcagcagcgaggtgcagtttggacatgctggggcctgtgccaaccaggccagcgagacagctgtggccaagaaccaggccctgaaggaggccggcgtgtttgtgcccaggagctttgatgagctgggggagatcatccagagcgtgtatgaggacctggtggccaatggagtcatcgtgcctgcccaggaggtgcccccacccaccgtgcccatggactacagctgggcccgggagctgggcctcatcaggaagccagccagcttcatgaccagcatctgtgatgagcggggccaggagctgatctatgccggcatgcccatcacagaggtgttcaaggaggagatgggcattggaggagtgctgggcctgctgtggttccagaagaggctgcccaagtacagctgccagttcatcgagatgtgcctgatggtgacagctgaccacggccctgctgtgtctggggcccacaacaccatcatctgtgcccgggccggcaaggacctggtgagcagcctgaccagcggcctgctgaccatcggggacagatttggaggagccctggatgctgctgccaagatgttcagcaaggcctttgacagcggcatcatccccatggagtttgtgaacaagatgaagaaggagggcaagctgatcatgggcatcggccaccgggtgaagagcatcaacaacccagacatgagggtgcagatcctgaaggactatgtgcggcagcacttccctgccacccccctgctggactatgccctggaggtggagaagatcaccaccagcaagaagcccaacctgatcctgaatgtggatggcctgattggagtggcctttgtggacatgctgaggaactgtggcagcttcacccgggaggaggctgatgagtacatcgacatcggggccctgaatggcatctttgtgctgggccgctccatgggcttcatcggccactacctggaccagaagaggctgaagcagggcctgtaccgccacccctgggatgacatctcctatgtgctgcctgagcacatgtccatgtag

SEQ ID NO: 18412 - DNA, 2493 bp, Artificial Sequence
  Description of Artificial Sequence: Synthetic coding sequence
atgtctgccaaggccatcagcgagcagacaggcaaggagctgctgtacaagttcatctgcaccaccagcgccatccagaaccgcttcaagtatgcccgggtgaccccagacacagactgggcccggctgctgcaggaccacccctggctgctgagccagaacctggtggtgaagccagaccagctgatcaagagaagaggcaagctgggcctggtgggcgtgaacctgaccctggatggagtgaagtcctggctgaagccccggctgggccaggaggccaccggcatcgtgcgggccatccgggactaccagggccccctgaaggagcacgaggtgaccatctttgtgagaagaggaggccccaactaccaggagggcctgcgggtgatgggagaggtgggcaagaccaccggcatccccatccacgtgtttggaacagagacccacatgacagccatcgtgggcatggccctgggccaccggcccatccccaaccagcccccaacagctgcccacacagccaacttcctgctgaatgccagcggcagcaccagcaccccagcccccagcaggacagccagcttcagcgagagcagagcagatgaggtggccccagccaagaaggccaagccagccatgccccagggcaagagcaccaccctcttcagccgccacaccaaggccatcgtgtggggcatgcagaccagggctgtgcagggcatgctggactttgattatgtgtgcagcagagatgagcccagcgtggccgccatggtgtaccccttcaccggggaccacaagcagaagttctactggggccacaaggagatcctgatccctgtgttcaagaacatggctgatgccatgaggaagcaccctgaggtggatgtgctgatcaactttgccagcctgcggagcgcctatgacagcaccatggagaccatgaactatgcccagatccgcaccatcgccatcatcgccgagggcatccctgaggccctgaccaggaagctgatcaagaaggctgaccagaagggcgtgaccatcatcggccctgccaccgtgggcggcatcaagccaggctgcttcaagattggcaacacaggaggcatgctggacaacatcctggccagcaagctgtacagacctggctctgtggcctacgtgagccgcagcggcggcatgagcaatgagctgaacaacatcatcagcaggaccacagatggagtgtatgaaggagtggccatcggcggggaccgctacccaggcagcaccttcatggaccacgtgctgcgctaccaggacaccccaggagtgaagatgattgtggtgctgggggagatcggcggcacagaggagtacaagatctgccggggcatcaaggagggccgcctgaccaagcccatcgtgtgctggtgcatcggcacctgtgccaccatgttcagcagcgaggtgcagtttggacatgctggggcctgtgccaaccaggccagcgagacagctgtggccaagaaccaggccctgaaggaggccggcgtgtttgtgcccaggagctttgatgagctgggggagatcatccagagcgtgtatgaggacctggtggccaacggggtgattgtgcctgcccaggaggtgcccccacccaccgtgcccatggactacagctgggcccgggagctgggcctcatcaggaagccagccagcttcatgaccagcatctgtgatgagcggggccaggagctgatctatgccggcatgcccatcacagaggtgttcaaggaggagatgggcatcggcggcgtgctgggcctgctgtggttccagaagaggctgcccaagtacagctgccagttcatcgagatgtgcctgatggtgacagctgaccacggccctgctgtgtctggggcccacaacaccatcatctgtgcccgggccggcaaggacctggtgagcagcctgaccagcggcctgctgaccatcggggacagatttggaggagccctggatgctgctgccaagatgttcagcaaggcctttgattctggcatcatccccatggagtttgtgaacaagatgaagaaggagggcaagctgatcatgggcatcggccaccgggtgaagagcatcaacaacccagacatgagggtgcagatcctgaaggactatgtgcggcagcacttccctgccacccccctgctggactatgccctggaggtggagaagatcaccaccagcaagaagcccaacctgatcctgaatgtggatggcctcatcggcgtggcctttgtggacatgctgaggaactgtggcagcttcacccgggaggaggctgatgagtacattgatattggagccctgaatggcatctttgtgctgggccgctccatgggcttcatcggccactacctggaccagaagaggctgaagcagggcctgtaccgccacccctgggatgacatctcctatgtgctgcctgagcacatgtccatgtag

SEQ ID NO: 18413 - DNA, 1512 bp, Artificial Sequence
  Description of Artificial Sequence: Synthetic coding sequence
atgagcagcatcctggaggagcgcatcctgggcgctgacacctctgtggacctggaggagaccggccgggtgctgagcattggagatggcatcgcccgggtgcacggcctgagaaatgtgcaggccgaggagatggtggagttcagcagcggcctgaagggcatgagcctgaacctggagccagacaacgtgggcgtggtggtgtttggaaatgacaagctgatcaaggagggggacatcgtgaagaggactggagccatcgtggatgtgcctgtgggggaggagctgctgggccgggtggtggatgccctgggcaatgccattgatggcaagggccccatcggcagcaagacccggcggcgggtgggcctgaaggcccctggcatcatcccccgcatctctgtgcgggagcccatgcagacaggcatcaaggctgtggacagcctggtgcccatcggccggggccagcgggagctgatcattggagaccggcagacaggcaagaccagcatcgccatcgacaccatcatcaaccagaagcgcttcaatgatggcagtgatgagaagaagaagctgtactgcatctacgtggccatcggccagaagaggagcacagtggcccagctggtgaagaggctgacagatgctgatgccatgaagtacaccatcgtggtgtctgccacagccagtgatgctgcccccctgcagtacctggccccctacagcggctgcagcatgggagagtacttccgggacaatggcaagcacgccctgatcatctatgatgacctgagcaagcaggccgtggcctaccggcagatgagcctgctgctgcggcggcccccaggccgggaggcctacccaggagatgtgttctacctgcacagccggctgctggagcgggccgccaagatgaatgatgcctttggaggcggcagcctgacagccctgcccgtcatcgagacccaggccggagatgtgtctgcctacatccccaccaacgtcatcagcatcacagatggccagatcttcctggagacagagctgttctacaagggcatccggcctgccatcaacgtgggcctgtctgtgtcccgggtgggcagcgctgcccagacccgggccatgaagcaggtggccggcaccatgaagctggagctggcccagtaccgggaggtggccgcctttgcccagtttggaagtgacctggatgctgccacccagcagctgctgagccggggcgtgcggctgacagagctgctgaagcagggccagtacagccccatggccatcgaggagcaggtggccgtcatctatgctggggtgcggggctacctggacaagctggagcccagcaagatcaccaagtttgaaaatgccttcctgagccacgtggtgtcccagcaccaggccctgctgggcaccatccgggcagatggcaagatcagcgagcagagtgatgccaagctgaaggagatcgtgaccaacttcctggccggctttgaggcctag

SEQ ID NO: 18414 - DNA, 177 bp, Artificial Sequence
  Description of Artificial Sequence: Synthetic coding sequence
atgctgtctgtgcgggtggccgctgctgtggtgcgggccctgccccggcgggccggcctggtgtccagaaatgccctgggcagcagcttcatcgccgccaggaacttccacgccagcaacacccacctgcagaagacaggcaagctgctcttcctgagcctgcggaggacctactag

SEQ ID NO: 18415 - DNA, 1596 bp, Artificial Sequence
  Description of Artificial Sequence: Synthetic coding sequence
atgctgtctgtgcgggtggccgctgctgtggtgcgggccctgccccggcgggccggcctggtgtccagaaatgccctgggcagcagcttcatcgccgccaggaacttccacgccagcaacacccacctgcagaagacaggaacagctgagatgagcagcatcctggaggagcgcatcctgggcgctgacacctctgtggacctggaggagaccggccgggtgctgagcattggagatggcatcgcccgggtgcacggcctgagaaatgtgcaggccgaggagatggtggagttcagcagcggcctgaagggcatgagcctgaacctggagccagacaacgtgggcgtggtggtgtttggaaatgacaagctgatcaaggagggggacatcgtgaagaggactggagccatcgtggatggccccatcggcagcaagacccggcggcgggtgggcctgaaggcccctggcatcatcccccgcatctctgtgcgggagcccatgcagacaggcatcaaggctgtggacagcctggtgcccatcggccggggccagcgggagctgatcattggagaccggcagacaggcaagaccagcatcgccatcgacaccatcatcaaccagaagcgcttcaatgatggcagtgatgagaagaagaagctgtactgcatctacgtggccatcggccagaagaggagcacagtggcccagctggtgaagaggctgacagatgctgatgccatgaagtacaccatcgtggtgtctgccacagccagtgatgctgcccccctgcagtacctggccccctacagcggctgcagcatgggagagtacttccgggacaatggcaagcacgccctgatcatctatgatgacctgagcaagcaggccgtggcctaccggcagatgagcctgctgctgcggcggcccccaggccgggaggcctacccaggagatgtgttctacctgcacagccggctgctggagcgggccgccaagatgaatgatgcctttggaggcggcagcctgacagccctgcccgtcatcgagacccaggccggagatgtgtctgcctacatccccaccaacgtcatcagcatcacagatggccagatcttcctggagacagagctgttctacaagggcatccggcctgccatcaacgtgggcctgtctgtgtcccgggtgggcagcgctgcccagacccgggccatgaagcaggtggccggcaccatgaagctggagctggcccagtaccgggaggtggccgcctttgcccagtttggaagtgacctggatgctgccacccagcagctgctgagccggggcgtgcggctgacagagctgctgaagcagggccagtacagccccatggccatcgaggagcaggtggccgtcatctatgctggggtgcggggctacctggacaagctggagcccagcaagatcaccaagtttgaaaatgccttcctgagccacgtggtgtcccagcaccaggccctgctgggcaccatccgggcagatggcaagatcagcgagcagagtgatgccaagctgaaggagatcgtgaccaacttcctggccggctttgaggcctag

SEQ ID NO: 18416 - DNA, 1662 bp, Artificial Sequence
  Description of Artificial Sequence: Synthetic coding sequence
atgctgtctgtgcgggtggccgctgctgtggtgcgggccctgccccggcgggccggcctggtgtccagaaatgccctgggcagcagcttcatcgccgccaggaacttccacgccagcaacacccacctgcagaagacaggaacagctgagatgagcagcatcctggaggagcgcatcctgggcgctgacacctctgtggacctggaggagaccggccgggtgctgagcattggagatggcatcgcccgggtgcacggcctgagaaatgtgcaggccgaggagatggtggagttcagcagcggcctgaagggcatgagcctgaacctggagccagacaacgtgggcgtggtggtgtttggaaatgacaagctgatcaaggagggggacatcgtgaagaggactggagccatcgtggatgtgcctgtgggggaggagctgctgggccgggtggtggatgccctgggcaatgccattgatggcaagggccccatcggcagcaagacccggcggcgggtgggcctgaaggcccctggcatcatcccccgcatctctgtgcgggagcccatgcagacaggcatcaaggctgtggacagcctggtgcccatcggccggggccagcgggagctgatcattggagaccggcagacaggcaagaccagcatcgccatcgacaccatcatcaaccagaagcgcttcaatgatggcagtgatgagaagaagaagctgtactgcatctacgtggccatcggccagaagaggagcacagtggcccagctggtgaagaggctgacagatgctgatgccatgaagtacaccatcgtggtgtctgccacagccagtgatgctgcccccctgcagtacctggccccctacagcggctgcagcatgggagagtacttccgggacaatggcaagcacgccctgatcatctatgatgacctgagcaagcaggccgtggcctaccggcagatgagcctgctgctgcggcggcccccaggccgggaggcctacccaggagatgtgttctacctgcacagccggctgctggagcgggccgccaagatgaatgatgcctttggaggcggcagcctgacagccctgcccgtcatcgagacccaggccggagatgtgtctgcctacatccccaccaacgtcatcagcatcacagatggccagatcttcctggagacagagctgttctacaagggcatccggcctgccatcaacgtgggcctgtctgtgtcccgggtgggcagcgctgcccagacccgggccatgaagcaggtggccggcaccatgaagctggagctggcccagtaccgggaggtggccgcctttgcccagtttggaagtgacctggatgctgccacccagcagctgctgagccggggcgtgcggctgacagagctgctgaagcagggccagtacagccccatggccatcgaggagcaggtggccgtcatctatgctggggtgcggggctacctggacaagctggagcccagcaagatcaccaagtttgaaaatgccttcctgagccacgtggtgtcccagcaccaggccctgctgggcaccatccgggcagatggcaagatcagcgagcagagtgatgccaagctgaaggagatcgtgaccaacttcctggccggctttgaggcctag

SEQ ID NO: 18417 - DNA, 1662 bp, Artificial Sequence; identical to SEQ ID NO: 18416
  Description of Artificial Sequence: Synthetic coding sequence

SEQ ID NO: 18418 - DNA, 1512 bp, Artificial Sequence; identical to SEQ ID NO: 18413
  Description of Artificial Sequence: Synthetic coding sequence

SEQ ID NO: 18419 - DNA, 3843 bp, Artificial Sequence
  Description of Artificial Sequence: Synthetic coding sequence
atggacctggagggggacagaaatggaggagccaagaagaagaacttcttcaagctgaacaacaagtctgagaaggacaagaaggagaagaagcccaccgtgtctgtgttctccatgttccgctacagcaactggctggacaagctgtacatggtggtgggcaccctggccgccatcatccatggagctggcctgcccctgatgatgctggtgtttggagagatgacagacatctttgccaatgccggcaacctggaggacctgatgagcaacatcaccaacagaagtgacatcaatgacaccggcttcttcatgaacctggaggaggacatgaccaggtatgcctactactacagcggcattggagctggggtgctggtggccgcctacatccaggtgtccttctggtgcctggccgccggccggcagatccacaagatcaggaagcagttcttccacgccatcatgaggcaggagatcggctggtttgatgtgcatgatgtgggggagctgaacacccggctgacagatgatgtgtccaagatcaatgaaggcatcggggacaagattggcatgttcttccagagcatggccaccttcttcaccggcttcatcgtgggcttcacccggggctggaagctgaccctggtgatcctggccatcagccctgtgctgggcctgtctgctgctgtgtgggccaagatcctgagcagcttcacagacaaggagctgctggcctatgccaaggccggggctgtggccgaggaggtgctggccgccatcagaacagtgattgcctttggaggccagaagaaggagctggagcgctacaacaagaacctggaggaggccaagagaattggcatcaagaaggccatcacagccaacatcagcattggagctgccttcctgctgatctatgccagctatgccctggccttctggtacggcaccaccctggtgctgtctggagagtacagcatcggccaggtgctgactgtgttcttctctgtgctgattggagccttctctgtgggccaggccagccccagcattgaggcctttgccaatgcccggggagctgcctatgagatcttcaagatcatcgacaacaagcccagcattgacagctacagcaagagcggccacaagccagacaacatcaagggcaacctggagttcagaaatgtgcacttctcctaccccagcaggaaggaggtgaagatcctgaagggcctgaacctgaaggtgcagagcggccagacagtggccctggtgggcaacagcggctgcggcaagagcaccaccgtgcagctgatgcagaggctgtatgaccccacagagggcatggtgtctgtggatggccaggacatccgcaccatcaacgtgcgcttcctgcgggagatcatcggcgtggtgtcccaggagcctgtgctgtttgccaccaccatcgccgagaacatccgctatggaagagaaaatgtgaccatggatgaaattgagaaggctgtgaaggaggccaatgcctatgacttcatcatgaagctgccccacaagtttgacaccctggtgggggagcggggggcccagctgagcggcggccagaagcagagaattgccatcgcccgggccctggtgaggaaccccaagatcctgctgctggatgaggccaccagcgccctggacacagaaagtgaagctgtggtgcaggtggccctggacaaggccaggaagggccgcaccaccatcgtgattgcccaccggctgagcacagtgagaaatgctgatgtgattgctggctttgatgatggagtcatcgtggagaagggcaaccatgatgagctgatgaaggagaagggcatctacttcaagctggtgaccatgcagacagctggaaatgaggtggagctggagaatgctgctgatgagagcaagtcagaaattgatgccctggagatgagcagcaatgacagccgcagcagcctcatcaggaagaggagcaccaggagatctgtgcggggcagccaggcccaggacaggaagctgagcaccaaggaggccctggatgagagcatcccccctgtgtccttctggaggatcatgaagctgaacctgacagagtggccctactttgtggtgggcgtcttctgtgccatcatcaatggaggcctgcagcctgcctttgccatcatcttcagcaagatcatcggggtcttcaccagaattgatgatcctgagaccaagaggcagaacagcaacctcttcagcctgctcttcctggccctgggcatcatctccttcatcaccttcttcctgcagggcttcaccttcggcaaggccggggagatcctgaccaagaggctgcgctacatggtgttccgctccatgctgcggcaggatgtgtcctggtttgatgaccccaagaacaccactggagccctgaccacccggctggccaatgatgctgcccaggtgaagggggccatcggcagccggctggccgtcatcacccagaacatcgccaacctgggcaccggcatcatcatctccttcatctacggctggcagctgaccctgctgctgctggccatcgtgcccatcatcgccatcgccggcgtggtggagatgaagatgctgagcggccaggccctgaaggacaagaaggagctggagggcagcggcaagatcgccacagaggccatcgagaacttcagaacagtggtgtccctgacccaggagcagaagtttgagcacatgtatgcccagagcctgcaggtgccctacagaaacagcctgaggaaggcccacatcttcggcatcaccttctccttcacccaggccatgatgtacttctcctatgccggctgcttccgctttggagcctacctggtggcccacaagctgatgagctttgaagatgtgctgctggtgttttctgctgtggtgtttggagccatggctgtgggccaggtgtcctcctttgccccagactatgccaaggccaagatctctgctgcccacatcatcatgatcatcgagaagacccccctgattgacagctacagcacagagggcctgatgcccaacaccctggagggcaatgtgacctttggagaggtggtgttcaactaccccaccaggccagacatccctgtgctgcagggcctgagcctggaggtgaagaagggccagaccctggccctggtgggcagcagcggctgtgggaagagcacagtggtgcagctgctggagcgcttctatgaccccctggccggcaaggtgctgctggatggcaaggagatcaagaggctgaatgtgcagtggctgcgggcccacctgggcatcgtgtcccaggagcccatcctgtttgactgcagcattgctgaaaatattgcctatggagacaacagccgggtggtgtcccaggaggagatcgtgcgggccgccaaggaggccaacatccacgccttcatcgagagcctgcccaacaagtacagcaccaaggtgggggacaagggcacccagctgagcggcggccagaagcagagaattgccatcgcccgggccctggtgcggcagccccacatcctgctgctggatgaggccaccagcgccctggacacagagagcgagaaggtggtgcaggaggccctggacaaggcccgggagggccgcacctgcatcgtcatcgcccaccggctgagcaccatccagaatgctgacctgattgtggtgttccagaatggccgggtgaaggagcacggcacccaccagcagctgctggcccagaagggcatctacttctccatggtgtctgtgcaggccggcaccaagaggcagtag

SEQ ID NO: 18420 - DNA, 69 bp, Artificial Sequence
  Description of Artificial Sequence: Synthetic coding sequence
atggacctggagggggacagaaatggaggagccaagaagaagaacttcttcaagctgaacaacaagtag

SEQ ID NO: 18421 - DNA, 147 bp, Artificial Sequence
  Description of Artificial Sequence: Synthetic coding sequence
atggacctggagggggacagaaatggaggagccaagaagaagaacttcttcaagctgaacaacaagtctgagaaggacaagaaggagaagaagcccaccgtgtctgtgttctccatgttccgctacagcaactggctggacaagtag

SEQ ID NO: 18422 - DNA, 3186 bp, Artificial Sequence
  Description of Artificial Sequence: Synthetic coding sequence
gccctgagccctgtgatgggcgtgtctgctggctactggcccaagatcctgagcagcttcacagacaaggagctgctggcctatgccaaggccggggctgtggccgaggaggtgctggccgccatccgcaccgtcatcgccttcggcggccagaagaaggagctggagcgctacaacaagaacctggaggaggccaagagaattggcatcaagaaggccatcacagccaacatcagcatcggggccgccttcctgctgatctatgccagctatgccctggccttctggtacggcaccaccctggtgctgagcggggagtacagcatcggccaggtgctgaccgtcttcttctctgtgctgattggagccttctctgtgggccaggccagccccagcattgaggcctttgccaatgcccggggggccgcctatgagatcttcaagatcatcgacaacaagcccagcattgacagctacagcaagagcggccacaagccagacaacatcaagggcaacctggagttcagaaatgtgcacttctcctaccccagcaggaaggaggtgaagatcctgaagggcctgaacctgaaggtgcagagcggccagacagtggccctggtgggcaacagcggctgtgggaagagcaccaccgtgcagctgatgcagaggctgtatgaccccacagagggcatggtgtctgtggatggccaggacatccgcaccatcaacgtgcgcttcctgcgggagatcattggagtggtgtcccaggagcctgtgctgtttgccaccaccatcgccgagaacatccgctatggccgggagaatgtgaccatggatgaaattgagaaggctgtgaaggaggccaatgcctatgacttcatcatgaagctgccccacaagtttgacaccctggtgggggagcggggggcccagctgagcggcggccagaagcagagaattgccatcgcccgggccctggtgaggaaccccaagatcctgctgctggatgaggccaccagcgccctggacacagagagcgaggccgtggtgcaggtggccctggacaaggccaggaaaggaagaaccaccatcgtcatcgcccaccggctgagcacagtgagaaatgctgatgtgattgctggctttgatgatggagtgattgtggagaagggcaaccatgatgagctgatgaaggagaagggcatctacttcaagctggtgaccatgcagacagctggaaatgaggtggagctggagaatgctgctgatgagagcaagtcagaaattgatgccctggagatgagcagcaatgacagccgcagcagcctcatcaggaagaggagcacccggcgctctgtgcggggcagccaggcccaggacaggaagctgagcaccaaggaggccctggatgagagcatcccccctgtgtccttctggaggatcatgaagctgaacctgacagagtggccctactttgtggtgggcgtcttctgtgccatcatcaatggaggcctgcagcctgcctttgccatcatcttcagcaagatcattggagtcttcaccagaattgatgatcctgagaccaagaggcagaacagcaacctcttcagcctgctcttcctggccctgggcatcatctccttcatcaccttcttcctgcagggcttcaccttcggcaaggccggggagatcctgaccaagaggctgcgctacatggtgttccgctccatgctgcggcaggatgtgtcctggtttgatgaccccaagaacaccaccggggccctgaccacccggctggccaatgatgctgcccaggtgaagggggccatcggcagccggctggccgtcatcacccagaacatcgccaacctgggcaccggcatcatcatctccttcatctacggctggcagctgaccctgctgctgctggccatcgtgcccatcatcgccatcgccggcgtggtggagatgaagatgctgagcggccaggccctgaaggacaagaaggagctggagggcagcggcaagatcgccacagaggccatcgagaacttcagaacagtggtgtccctgacccaggagcagaagtttgagcacatgtatgcccagagcctgcaggtgccctacagaaacagcctgaggaaggcccacatcttcggcatcaccttctccttcacccaggccatgatgtacttctcctatgccggctgcttccgctttggagcctacctggtggcccacaagctgatgagctttgaagatgtgctgctggtgttttctgctgtggtgtttggagccatggctgtgggccaggtgagcagctttgccccagactatgccaaggccaagatctctgctgcccacatcatcatgatcatcgagaagacccccctgattgacagctacagcacagagggcctgatgcccaacaccctggagggcaatgtgaccttcggggaggtggtgttcaactaccccaccaggccagacatccctgtgctgcagggcctgagcctggaggtgaagaagggccagaccctggccctggtgggcagcagcggctgcggcaagagcacagtggtgcagctgctggagcgcttctatgaccccctggccggcaaggtgctgctggatggcaaggagatcaagaggctgaatgtgcagtggctgcgggcccacctgggcatcgtgtcccaggagcccatcctgtttgactgcagcattgctgagaacatcgcctacggggacaacagccgggtggtgtcccaggaggagatcgtgcgggccgccaaggaggccaacatccacgccttcatcgagagcctgcccaacaagtacagcaccaaggtgggggacaagggcacccagctgagcggcggccagaagcagagaattgccatcgcccgggccctggtgcggcagccccacatcctgctgctggatgaggccaccagcgccctggacacagaaagtgagaaggtggtgcaggaggccctggacaaggcccgggagggccgcacctgcatcgtgattgcccaccggctgagcaccatccagaatgctgacctgattgtggtgttccagaatggccgggtgaaggagcacggcacccaccagcagctgctggcccagaagggcatctacttctccatggtgtctgtgcaggccggcaccaagaggcagtag

SEQ ID NO: 18423 - DNA, 3651 bp, Artificial Sequence
  Description of Artificial Sequence: Synthetic coding sequence
atggacctggagggggacagaaatggaggagccaagaagaagaacttcttcaagctgaacaacaagtctgagaaggacaagaaggagaagaagcccaccgtgtctgtgttctccatgttccgctacagcaactggctggacaagctgtacatggtggtgggcaccctggccgccatcatccatggagctggcctgcccctgatgatgctggtgtttggagagatgacagacatctttgccaatgccggcaacctggaggacctgatgagcaacatcaccaacagaagtgacatcaatgacaccggcttcttcatgaacctggaggaggacatgaccagtgatgtgtccaagatcaatgaaggcatcggggacaagattggcatgttcttccagagcatggccaccttcttcaccggcttcatcgtgggcttcacccggggctggaagctgaccctggtgatcctggccatcagccctgtgctgggcctgtctgctgctgtgtgggccaagatcctgagcagcttcacagacaaggagctgctggcctatgccaaggccggggctgtggccgaggaggtgctggccgccatcagaacagtgattgcctttggaggccagaagaaggagctggagcgctacaacaagaacctggaggaggccaagagaattggcatcaagaaggccatcacagccaacatcagcattggagctgccttcctgctgatctatgccagctatgccctggccttctggtacggcaccaccctggtgctgtctggagagtacagcatcggccaggtgctgactgtgttcttctctgtgctgattggagccttctctgtgggccaggccagccccagcattgaggcctttgccaatgcccggggagctgcctatgagatcttcaagatcatcgacaacaagcccagcattgacagctacagcaagagcggccacaagccagacaacatcaagggcaacctggagttcagaaatgtgcacttctcctaccccagcaggaaggaggtgaagatcctgaagggcctgaacctgaaggtgcagagcggccagacagtggccctggtgggcaacagcggctgcggcaagagcaccaccgtgcagctgatgcagaggctgtatgaccccacagagggcatggtgtctgtggatggccaggacatccgcaccatcaacgtgcgcttcctgcgggagatcatcggcgtggtgtcccaggagcctgtgctgtttgccaccaccatcgccgagaacatccgctatggaagagaaaatgtgaccatggatgaaattgagaaggctgtgaaggaggccaatgcctatgacttcatcatgaagctgccccacaagtttgacaccctggtgggggagcggggggcccagctgagcggcggccagaagcagagaattgccatcgcccgggccctggtgaggaaccccaagatcctgctgctggatgaggccaccagcgccctggacacagaaagtgaagctgtggtgcaggtggccctggacaaggccaggaagggccgcaccaccatcgtgattgcccaccggctgagcacagtgagaaatgctgatgtgattgctggctttgatgatggagtcatcgtggagaagggcaaccatgatgagctgatgaaggagaagggcatctacttcaagctggtgaccatgcagacagctggaaatgaggtggagctggagaatgctgctgatgagagcaagtcagaaattgatgccctggagatgagcagcaatgacagccgcagcagcctcatcaggaagaggagcaccaggagatctgtgcggggcagccaggcccaggacaggaagctgagcaccaaggaggccctggatgagagcatcccccctgtgtccttctggaggatcatgaagctgaacctgacagagtggccctactttgtggtgggcgtcttctgtgccatcatcaatggaggcctgcagcctgcctttgccatcatcttcagcaagatcatcggggtcttcaccagaattgatgatcctgagaccaagaggcagaacagcaacctcttcagcctgctcttcctggccctgggcatcatctccttcatcaccttcttcctgcagggcttcaccttcggcaaggccggggagatcctgaccaagaggctgcgctacatggtgttccgctccatgctgcggcaggatgtgtcctggtttgatgaccccaagaacaccactggagccctgaccacccggctggccaatgatgctgcccaggtgaagggggccatcggcagccggctggccgtcatcacccagaacatcgccaacctgggcaccggcatcatcatctccttcatctacggctggcagctgaccctgctgctgctggccatcgtgcccatcatcgccatcgccggcgtggtggagatgaagatgctgagcggccaggccctgaaggacaagaaggagctggagggcagcggcaagatcgccacagaggccatcgagaacttcagaacagtggtgtccctgacccaggagcagaagtttgagcacatgtatgcccagagcctgcaggtgccctacagaaacagcctgaggaaggcccacatcttcggcatcaccttctccttcacccaggccatgatgtacttctcctatgccggctgcttccgctttggagcctacctggtggcccacaagctgatgagctttgaagatgtgctgctggtgttttctgctgtggtgtttggagccatggctgtgggccaggtgtcctcctttgccccagactatgccaaggccaagatctctgctgcccacatcatcatgatcatcgagaagacccccctgattgacagctacagcacagagggcctgatgcccaacaccctggagggcaatgtgacctttggagaggtggtgttcaactaccccaccaggccagacatccctgtgctgcagggcctgagcctggaggtgaagaagggccagaccctggccctggtgggcagcagcggctgtgggaagagcacagtggtgcagctgctggagcgcttctatgaccccctggccggcaaggtgctgctggatggcaaggagatcaagaggctgaatgtgcagtggctgcgggcccacctgggcatcgtgtcccaggagcccatcctgtttgactgcagcattgctgaaaatattgcctatggagacaacagccgggtggtgtcccaggaggagatcgtgcgggccgccaaggaggccaacatccacgccttcatcgagagcctgcccaacaagtacagcaccaaggtgggggacaagggcacccagctgagcggcggccagaagcagagaattgccatcgcccgggccctggtgcggcagccccacatcctgctgctggatgaggccaccagcgccctggacacagagagcgagaaggtggtgcaggaggccctggacaaggcccgggagggccgcacctgcatcgtcatcgcccaccggctgagcaccatccagaatgctgacctgattgtggtgttccagaatggccgggtgaaggagcacggcacccaccagcagctgctggcccagaagggcatctacttctccatggtgtctgtgcaggccggcaccaagaggcagtag

SEQ ID NO: 18424 - DNA, 4401 bp, Artificial Sequence
  Description of Artificial Sequence: Synthetic coding sequence
atggccctgcggggcttctgcagcgcagatggcagtgaccccctgtgggactggaatgtgacctggaacaccagcaacccagacttcaccaagtgcttccagaacacagtgctggtgtgggtgccctgcttctacctgtgggcctgcttccccttctacttcctgtacctgagcagacatgaccggggctacatccagatgacccccctgaacaagaccaagacagccctgggcttcctgctgtggatcgtgtgctgggccgacctcttctacagcttctgggagaggagccggggcatcttcctggcccctgtgttcctggtgagccccaccctgctgggcatcaccatgctgctggccaccttcctgatccagctggagaggaggaagggcgtgcagagcagcggcatcatgctgaccttctggctggtggccctggtgtgtgccctggccatcctgcggagcaagatcatgacagccctgaaggaggatgcccaggtggacctcttccgggacatcaccttctacgtgtacttcagcctgctgctgatccagctggtgctgagctgcttcagtgacaggagccccctcttcagcgagaccatccatgaccccaacccctgcccagagagcagcgccagcttcctgagccgcatcaccttctggtggatcaccggcctcatcgtgcggggctaccggcagcccctggagggcagtgacctgtggagcctgaacaaggaggacaccagcgagcaggtggtgcctgtgctggtgaagaactggaagaaggaatgtgccaagaccaggaagcagcctgtgaaggtggtgtacagcagcaaggaccctgcccagcccaaggagagcagcaaggtggatgccaatgaggaggtggaggccctgattgtgaagagcccccagaaggagtggaaccccagcctcttcaaggtgctgtacaagaccttcggcccctacttcctgatgtccttcttcttcaaggccatccatgacctgatgatgttttctggcccccagatcctgaagctgctgatcaagtttgtgaatgacaccaaggccccagactggcagggctacttctacacagtgctgctgtttgtgacagcctgcctgcagaccctggtgctgcaccagtacttccacatctgctttgtgtctggcatgaggatcaagacagctgtgattggagctgtgtacaggaaggccctggtgatcaccaacagcgccaggaagagcagcacagtgggggagatcgtgaacctgatgtctgtggatgcccagcgcttcatggacctggccacctacatcaacatgatctggagcgcccccctgcaggtgatcctggccctgtacctgctgtggctgaacctgggccccagcgtgctggccggcgtggccgtgatggtgctgatggtgcctgtgaatgctgtgatggccatgaagaccaagacctaccaggtggcccacatgaagagcaaggacaaccgcatcaagctgatgaatgagatcctgaatggcatcaaggtgctgaagctgtatgcctgggagctggccttcaaggacaaggtgctggccatccggcaggaggagctgaaggtgctgaagaagagcgcctacctgtctgctgtgggcaccttcacctgggtgtgcacccccttcctggtggccctgtgcacctttgctgtgtatgtgaccattgatgagaacaacatcctggatgcccagacagcctttgtgtccctggccctcttcaacatcctgcgcttccccctgaacatcctgcccatggtgatcagcagcatcgtgcaggcctctgtgtccctgaagaggctgcgcatcttcctgagccatgaggagctggagccagacagcattgaaagaagacctgtgaaggatggcggcggcaccaacagcatcaccgtgagaaatgccaccttcacctgggcccggagtgacccccccaccctgaatggcatcaccttcagcatccctgagggcgccctggtggccgtggtgggccaggtgggctgtgggaagagcagcctgctgagcgccctgctggccgagatggacaaggtggagggccacgtggccatcaagggctctgtggcctacgtgccccagcaggcctggatccagaatgacagcctgcgggagaacatcctgtttggctgccagctggaggagccctactacagaagtgtcatccaggcctgtgccctgctgcctgacctggagatcctgcccagcggggacagaacagaaattggagagaagggcgtgaacctgagcggcggccagaagcagagggtgtccctggcccgggctgtgtacagcaatgctgacatctacctgtttgatgaccccctgtctgctgtggatgcccacgtgggcaagcacatctttgaaaatgtgattggccccaagggcatgctgaagaacaagacccgcatcctggtgacccacagcatgagctacctgccccaggtggatgtgatcatcgtgatgtctgggggcaagatcagcgagatgggcagctaccaggagctgctggccagagatggagcctttgctgagttcctgcggacctacgccagcacagagcaggagcaggatgctgaggagaatggagtgactggagtgtctggccctgggaaggaggccaagcagatggagaatggcatgctggtgacagattctgctgggaagcagctgcagaggcagctgagcagcagcagcagctacagcggggacatcagccgccaccacaacagcacagctgagctgcagaaggccgaggccaagaaggaggagacctggaagctgatggaggccgacaaggcccagacaggccaggtgaagctgtctgtgtactgggactacatgaaggccatcggcctcttcatctccttcctgagcatcttcctgttcatgtgcaaccacgtgtctgccctggccagcaactactggctgagcctgtggacagatgaccccatcgtgaatggcacccaggagcacaccaaggtgcggctgtctgtgtatggagccctgggcatcagccagggcattgctgtgtttggctacagcatggctgtgtccattggaggcatcctggccagccgctgcctgcacgtggacctgctgcacagcatcctgcggagccccatgtccttctttgagaggaccccatctggcaacctggtgaaccgcttcagcaaggagctggacacagtggacagcatgatccctgaggtgatcaagatgttcatgggcagcctcttcaacgtcatcggggcctgcatcgtcatcctgctggccacccccatcgccgccatcatcatcccccccctgggcctcatctacttctttgtgcagcgcttctacgtggccagcagccggcagctgaagaggctggagagcgtgagccgcagccctgtgtacagccacttcaatgagaccctgctgggcgtgtctgtcatccgggcctttgaggagcaggagcgcttcatccaccagagcgacctgaaggtggatgagaaccagaaggcctactaccccagcatcgtggccaaccgctggctggccgtgcggctggagtgtgtgggcaactgcatcgtgctgtttgctgccctgtttgctgtgatcagccgccacagcctgtctgctggcctggtgggcctgtctgtgtcctacagcctgcaggtgaccacctacctgaactggctggtgaggatgagcagcgagatggagaccaacatcgtggccgtggagcggctgaaggagtacagcgagacagagaaggaggccccctggcagatccaggagacagccccacccagctcctggccccaggtgggccgggtggagttcaggaactactgcctgcgctaccgggaggacctggactttgtgctgcggcacatcaacgtgaccatcaatggaggagagaaggtgggcatcgtgggccgcactggagctgggaagagcagcctgaccctgggcctcttccgcatcaatgaatctgctgagggggagatcatcattgatggcatcaacatcgccaagattggcctgcatgacctgcgcttcaagatcaccatcatcccccaggaccctgtgctcttcagcggcagcctgaggatgaacctggaccccttcagccagtacagtgatgaggaggtgtggaccagcctggagctggcccacctgaaggactttgtgtctgccctgcctgacaagctggaccatgaatgtgccgagggcggggagaacctgcgggtgattgtgctggacaagggggagatccaggagtatggagcccccagcgacctgctgcagcagaggggcctcttctacagcatggccaaggatgctggcctggtgtag

SEQ ID NO: 18425 - DNA, 4428 bp, Artificial Sequence
  Description of Artificial Sequence: Synthetic coding sequence
atggccctgcggggcttctgcagcgcagatggcagtgaccccctgtgggactggaatgtgacctggaacaccagcaacccagacttcaccaagtgcttccagaacacagtgctggtgtgggtgccctgcttctacctgtgggcctgcttccccttctacttcctgtacctgagcagacatgaccggggctacatccagatgacccccctgaacaagaccaagacagccctgggcttcctgctgtggatcgtgtgctgggccgacctcttctacagcttctgggagaggagccggggcatcttcctggcccctgtgttcctggtgagccccaccctgctgggcatcaccatgctgctggccaccttcctgatccagctggagaggaggaagggcgtgcagagcagcggcatcatgctgaccttctggctggtggccctggtgtgtgccctggccatcctgcggagcaagatcatgacagccctgaaggaggatgcccaggtggacctcttccgggacatcaccttctacgtgtacttcagcctgctgctgatccagctggtgctgagctgcttcagtgacaggagccccctcttcagcgagaccatccatgaccccaacccctgcccagagagcagcgccagcttcctgagccgcatcaccttctggtggatcaccggcctcatcgtgcggggctaccggcagcccctggagggcagtgacctgtggagcctgaacaaggaggacaccagcgagcaggtggtgcctgtgctggtgaagaactggaagaaggaatgtgccaagaccaggaagcagcctgtgaaggtggtgtacagcagcaaggaccctgcccagcccaaggagagcagcaaggtggatgccaatgaggaggtggaggccctgattgtgaagagcccccagaaggagtggaaccccagcctcttcaaggtgctgtacaagaccttcggcccctacttcctgatgtccttcttcttcaaggccatccatgacctgatgatgttttctggcccccagatcctgaagctgctgatcaagtttgtgaatgacaccaaggccccagactggcagggctacttctacacagtgctgctgtttgtgacagcctgcctgcagaccctggtgctgcaccagtacttccacatctgctttgtgtctggcatgaggatcaagacagctgtgattggagctgtgtacaggaaggccctggtgatcaccaacagcgccaggaagagcagcacagtgggggagatcgtgaacctgatgtctgtggatgcccagcgcttcatggacctggccacctacatcaacatgatctggagcgcccccctgcaggtgatcctggccctgtacctgctgtggctgaacctgggccccagcgtgctggccggcgtggccgtgatggtgctgatggtgcctgtgaatgctgtgatggccatgaagaccaagacctaccaggtggcccacatgaagagcaaggacaaccgcatcaagctgatgaatgagatcctgaatggcatcaaggtgctgaagctgtatgcctgggagctggccttcaaggacaaggtgctggccatccggcaggaggagctgaaggtgctgaagaagagcgcctacctgtctgctgtgggcaccttcacctgggtgtgcacccccttcctggtggccctgtgcacctttgctgtgtatgtgaccattgatgagaacaacatcctggatgcccagacagcctttgtgtccctggccctcttcaacatcctgcgcttccccctgaacatcctgcccatggtgatcagcagcatcgtgcaggcctctgtgtccctgaagaggctgcgcatcttcctgagccatgaggagctggagccagacagcattgaaagaagacctgtgaaggatggcggcggcaccaacagcatcaccgtgagaaatgccaccttcacctgggcccggagtgacccccccaccctgaatggcatcaccttcagcatccctgagggcgccctggtggccgtggtgggccaggtgggctgtgggaagagcagcctgctgagcgccctgctggccgagatggacaaggtggagggccacgtggccatcaagggctctgtggcctacgtgccccagcaggcctggatccagaatgacagcctgcgggagaacatcctgtttggctgccagctggaggagccctactacagaagtgtcatccaggcctgtgccctgctgcctgacctggagatcctgcccagcggggacagaacagaaattggagagaagacccgcatcctggtgacccacagcatgagctacctgccccaggtggatgtgatcatcgtgatgtctgggggcaagatcagcgagatgggcagctaccaggagctgctggccagagatggagcctttgctgagttcctgcggacctacgccagcacagagcaggagcaggatgctgaggagaatggagtgactggagtgtctggccctgggaaggaggccaagcagatggagaatggcatgctggtgacagattctgctgggaagcagctgcagaggcagctgagcagcagcagcagctacagcggggacatcagccgccaccacaacagcacagctgagctgcagaaggccgaggccaagaaggaggagacctggaagctgatggaggccgacaaggcccagacaggccaggtgaagctgtctgtgtactgggactacatgaaggccatcggcctcttcatctccttcctgagcatcttcctgttcatgtgcaaccacgtgtctgccctggccagcaactactggctgagcctgtggacagatgaccccatcgtgaatggcacccaggagcacaccaaggtgcggctgtctgtgtatggagccctgggcatcagccagggcattgctgtgtttggctacagcatggctgtgtccattggaggcatcctggccagccgctgcctgcacgtggacctgctgcacagcatcctgcggagccccatgtccttctttgagaggaccccatctggcaacctggtgaaccgcttcagcaaggagctggacacagtggacagcatgatccctgaggtgatcaagatgttcatgggcagcctcttcaacgtcatcggggcctgcatcgtcatcctgctggccacccccatcgccgccatcatcatcccccccctgggcctcatctacttctttgtgcagcgcttctacgtggccagcagccggcagctgaagaggctggagagcgtgagccgcagccctgtgtacagccacttcaatgagaccctgctgggcgtgtctgtcatccgggcctttgaggagcaggagcgcttcatccaccagagcgacctgaaggtggatgagaaccagaaggcctactaccccagcatcgtggccaaccgctggctggccgtgcggctggagtgtgtgggcaactgcatcgtgctgtttgctgccctgtttgctgtgatcagccgccacagcctgtctgctggcctggtgggcctgtctgtgtcctacagcctgcaggtgaccacctacctgaactggctggtgaggatgagcagcgagatggagaccaacatcgtggccgtggagcggctgaaggagtacagcgagacagagaaggaggccccctggcagatccaggagacagccccacccagctcctggccccaggtgggccgggtggagttcaggaactactgcctgcgctaccgggaggacctggactttgtgctgcggcacatcaacgtgaccatcaatggaggagagaaggtgggcatcgtgggccgcactggagctgggaagagcagcctgaccctgggcctcttccgcatcaatgaatctgctgagggggagatcatcattgatggcatcaacatcgccaagattggcctgcatgacctgcgcttcaagatcaccatcatcccccaggaccctgtgctcttcagcggcagcctgaggatgaacctggaccccttcagccagtacagtgatgaggaggtgtggaccagcctggagctggcccacctgaaggactttgtgtctgccctgcctgacaagctggaccatgaatgtgccgagggcggggagaacctgtctgtgggccagaggcagctggtgtgcctggcccgggccctgctgaggaagaccaagatcctggtgctggatgaggccacagctgctgtggacctggagacagatgacctgatccagagcaccatccgcacccagtttgaggactgcaccgtgctgaccatcgcccaccggctgaacaccatcatggactacaccagggtcatcgtgctggacaagggggagatccaggagtatggagcccccagcgacctgctgcagcagaggggcctcttctacagcatggccaaggatgctggcctggtgtag

SEQ ID NO: 18426 - DNA, 4251 bp, Artificial Sequence
  Description of Artificial Sequence: Synthetic coding sequence
atggccctgcggggcttctgcagcgcagatggcagtgaccccctgtgggactggaatgtgacctggaacaccagcaacccagacttcaccaagtgcttccagaacacagtgctggtgtgggtgccctgcttctacctgtgggcctgcttccccttctacttcctgtacctgagcagacatgaccggggctacatccagatgacccccctgaacaagaccaagacagccctgggcttcctgctgtggatcgtgtgctgggccgacctcttctacagcttctgggagaggagccggggcatcttcctggcccctgtgttcctggtgagccccaccctgctgggcatcaccatgctgctggccaccttcctgatccagctggagaggaggaagggcgtgcagagcagcggcatcatgctgaccttctggctggtggccctggtgtgtgccctggccatcctgcggagcaagatcatgacagccctgaaggaggatgcccaggtggacctcttccgggacatcaccttctacgtgtacttcagcctgctgctgatccagctggtgctgagctgcttcagtgacaggagccccctcttcagcgagaccatccatgaccccaacccctgcccagagagcagcgccagcttcctgagccgcatcaccttctggtggatcaccggcctcatcgtgcggggctaccggcagcccctggagggcagtgacctgtggagcctgaacaaggaggacaccagcgagcaggtggtgcctgtgctggtgaagaactggaagaaggaatgtgccaagaccaggaagcagcctgtgaaggtggtgtacagcagcaaggaccctgcccagcccaaggagagcagcaaggtggatgccaatgaggaggtggaggccctgattgtgaagagcccccagaaggagtggaaccccagcctcttcaaggtgctgtacaagaccttcggcccctacttcctgatgtccttcttcttcaaggccatccatgacctgatgatgttttctggcccccagatcctgaagctgctgatcaagtttgtgaatgacaccaaggccccagactggcagggctacttctacacagtgctgctgtttgtgacagcctgcctgcagaccctggtgctgcaccagtacttccacatctgctttgtgtctggcatgaggatcaagacagctgtgattggagctgtgtacaggaaggccctggtgatcaccaacagcgccaggaagagcagcacagtgggggagatcgtgaacctgatgtctgtggatgcccagcgcttcatggacctggccacctacatcaacatgatctggagcgcccccctgcaggtgatcctggccctgtacctgctgtggctgaacctgggccccagcgtgctggccggcgtggccgtgatggtgctgatggtgcctgtgaatgctgtgatggccatgaagaccaagacctaccaggtggcccacatgaagagcaaggacaaccgcatcaagctgatgaatgagatcctgaatggcatcaaggtgctgaagctgtatgcctgggagctggccttcaaggacaaggtgctggccatccggcaggaggagctgaaggtgctgaagaagagcgcctacctgtctgctgtgggcaccttcacctgggtgtgcacccccttcctggtggccctgtgcacctttgctgtgtatgtgaccattgatgagaacaacatcctggatgcccagacagcctttgtgtccctggccctcttcaacatcctgcgcttccccctgaacatcctgcccatggtgatcagcagcatcgtgcaggcctctgtgtccctgaagaggctgcgcatcttcctgagccatgaggagctggagccagacagcattgaaagaagacctgtgaaggatggcggcggcaccaacagcatcaccgtgagaaatgccaccttcacctgggcccggagtgacccccccaccctgaatggcatcaccttcagcatccctgagggcgccctggtggccgtggtgggccaggtgggctgtgggaagagcagcctgctgagcgccctgctggccgagatggacaaggtggagggccacgtggccatcaagacccgcatcctggtgacccacagcatgagctacctgccccaggtggatgtgatcatcgtgatgtctgggggcaagatcagcgagatgggcagctaccaggagctgctggccagagatggagcctttgctgagttcctgcggacctacgccagcacagagcaggagcaggatgctgaagaaaatggagtgactggagtgtctggccctgggaaggaggccaagcagatggagaatggcatgctggtgacagacagcgctgggaagcagctgcagaggcagctgagcagcagcagcagctacagcggggacatcagccgccaccacaacagcacagctgagctgcagaaggccgaggccaagaaggaggagacctggaagctgatggaggccgacaaggcccagacaggccaggtgaagctgtctgtgtactgggactacatgaaggccatcggcctcttcatctccttcctgagcatcttcctgttcatgtgcaaccacgtgtctgccctggccagcaactactggctgagcctgtggacagatgaccccatcgtgaatggcacccaggagcacaccaaggtgcggctgtctgtgtatggagccctgggcatcagccagggcattgctgtgtttggctacagcatggctgtgtccatcggcggcatcctggccagccgctgcctgcacgtggacctgctgcacagcatcctgcggagccccatgtccttctttgagaggacccccagcggcaacctggtgaaccgcttcagcaaggagctggacacagtggacagcatgatccctgaggtgatcaagatgttcatgggcagcctcttcaacgtgattggagcctgcatcgtcatcctgctggccacccccatcgccgccatcatcatcccccccctgggcctcatctacttctttgtgcagcgcttctacgtggccagcagccggcagctgaagaggctggagagcgtgagccgcagccctgtgtacagccacttcaatgagaccctgctgggcgtgtctgtcatccgggcctttgaggagcaggagcgcttcatccaccagagcgacctgaaggtggatgagaaccagaaggcctactaccccagcatcgtggccaaccgctggctggccgtgcggctggagtgtgtgggcaactgcatcgtgctgtttgctgccctgtttgctgtgatcagccgccacagcctgtctgctggcctggtgggcctgtctgtgtcctacagcctgcaggtgaccacctacctgaactggctggtgaggatgagcagcgagatggagaccaacatcgtggccgtggagcggctgaaggagtacagcgagacagagaaggaggccccctggcagatccaggagacagccccacccagctcctggccccaggtgggccgggtggagttcaggaactactgcctgcgctaccgggaggacctggactttgtgctgcggcacatcaacgtgaccatcaatggaggagagaaggtgggcatcgtgggccgcactggagctgggaagagcagcctgaccctgggcctcttccgcatcaatgaatctgctgagggggagatcatcattgatggcatcaacatcgccaagattggcctgcatgacctgcgcttcaagatcaccatcatcccccaggaccctgtgctcttcagcggcagcctgaggatgaacctggaccccttcagccagtacagtgatgaggaggtgtggaccagcctggagctggcccacctgaaggactttgtgtctgccctgcctgacaagctggaccatgaatgtgccgagggcggggagaacctgtctgtgggccagaggcagctggtgtgcctggcccgggccctgctgaggaagaccaagatcctggtgctggatgaggccacagctgctgtggacctggagacagatgacctgatccagagcaccatccgcacccagtttgaggactgcaccgtgctgaccatcgcccaccggctgaacaccatcatggactacaccagggtgattgtgctggacaagggggagatccaggagtatggagcccccagcgacctgctgcagcagaggggcctcttctacagcatggccaaggatgctggcctggtgtag

SEQ ID NO: 18427 - DNA, 4419 bp, Artificial Sequence
  Description of Artificial Sequence: Synthetic coding sequence
atggccctgcggggcttctgcagcgcagatggcagtgaccccctgtgggactggaatgtgacctggaacaccagcaacccagacttcaccaagtgcttccagaacacagtgctggtgtgggtgccctgcttctacctgtgggcctgcttccccttctacttcctgtacctgagcagacatgaccggggctacatccagatgacccccctgaacaagaccaagacagccctgggcttcctgctgtggatcgtgtgctgggccgacctcttctacagcttctgggagaggagccggggcatcttcctggcccctgtgttcctggtgagccccaccctgctgggcatcaccatgctgctggccaccttcctgatccagctggagaggaggaagggcgtgcagagcagcggcatcatgctgaccttctggctggtggccctggtgtgtgccctggccatcctgcggagcaagatcatgacagccctgaaggaggatgcccaggtggacctcttccgggacatcaccttctacgtgtacttcagcctgctgctgatccagctggtgctgagctgcttcagtgacaggagccccctcttcagcgagaccatccatgaccccaacccctgcccagagagcagcgccagcttcctgagccgcatcaccttctggtggatcaccggcctcatcgtgcggggctaccggcagcccctggagggcagtgacctgtggagcctgaacaaggaggacaccagcgagcaggtggtgcctgtgctggtgaagaactggaagaaggaatgtgccaagaccaggaagcagcctgtgaaggtggtgtacagcagcaaggaccctgcccagcccaaggagagcagcaaggtggatgccaatgaggaggtggaggccctgattgtgaagagcccccagaaggagtggaaccccagcctcttcaaggtgctgtacaagaccttcggcccctacttcctgatgtccttcttcttcaaggccatccatgacctgatgatgttttctggcccccagatcctgaagctgctgatcaagtttgtgaatgacaccaaggccccagactggcagggctacttctacacagtgctgctgtttgtgacagcctgcctgcagaccctggtgctgcaccagtacttccacatctgctttgtgtctggcatgaggatcaagacagctgtgattggagctgtgtacaggaaggccctggtgatcaccaacagcgccaggaagagcagcacagtgggggagatcgtgaacctgatgtctgtggatgcccagcgcttcatggacctggccacctacatcaacatgatctggagcgcccccctgcaggtgatcctggccctgtacctgctgtggctgaacctgggccccagcgtgctggccggcgtggccgtgatggtgctgatggtgcctgtgaatgctgtgatggccatgaagaccaagacctaccaggtggcccacatgaagagcaaggacaaccgcatcaagctgatgaatgagatcctgaatggcatcaaggtgctgaagctgtatgcctgggagctggccttcaaggacaaggtgctggccatccggcaggaggagctgaaggtgctgaagaagagcgcctacctgtctgctgtgggcaccttcacctgggtgtgcacccccttcctggtggccctgtgcacctttgctgtgtatgtgaccattgatgagaacaacatcctggatgcccagacagcctttgtgtccctggccctcttcaacatcctgcgcttccccctgaacatcctgcccatggtgatcagcagcatcgtgcaggcctctgtgtccctgaagaggctgcgcatcttcctgagccatgaggagctggagccagacagcattgaaagaagacctgtgaaggatggcggcggcaccaacagcatcaccgtgagaaatgccaccttcacctgggcccggagtgacccccccaccctgaatggcatcaccttcagcatccctgagggcgccctggtggccgtggtgggccaggtgggctgtgggaagagcagcctgctgagcgccctgctggccgagatggacaaggtggagggccacgtggccatcaagggcgtgaacctgagcggcggccagaagcagagggtgtccctggcccgggctgtgtacagcaatgctgacatctacctgtttgatgaccccctgtctgctgtggatgcccacgtgggcaagcacatctttgaaaatgtcatcggccccaagggcatgctgaagaacaagacccgcatcctggtgacccacagcatgagctacctgccccaggtggatgtgatcatcgtgatgtctgggggcaagatcagcgagatgggcagctaccaggagctgctggccagagatggagcctttgctgagttcctgcggacctacgccagcacagagcaggagcaggatgctgaagaaaatggagtgactggagtgtctggccctgggaaggaggccaagcagatggagaatggcatgctggtgacagacagcgctgggaagcagctgcagaggcagctgagcagcagcagcagctacagcggggacatcagccgccaccacaacagcacagctgagctgcagaaggccgaggccaagaaggaggagacctggaagctgatggaggccgacaaggcccagacaggccaggtgaagctgtctgtgtactgggactacatgaaggccatcggcctcttcatctccttcctgagcatcttcctgttcatgtgcaaccacgtgtctgccctggccagcaactactggctgagcctgtggacagatgaccccatcgtgaatggcacccaggagcacaccaaggtgcggctgtctgtgtatggagccctgggcatcagccagggcattgctgtgtttggctacagcatggctgtgtccatcggcggcatcctggccagccgctgcctgcacgtggacctgctgcacagcatcctgcggagccccatgtccttctttgagaggacccccagcggcaacctggtgaaccgcttcagcaaggagctggacacagtggacagcatgatccctgaggtgatcaagatgttcatgggcagcctcttcaacgtgattggagcctgcatcgtcatcctgctggccacccccatcgccgccatcatcatcccccccctgggcctcatctacttctttgtgcagcgcttctacgtggccagcagccggcagctgaagaggctggagagcgtgagccgcagccctgtgtacagccacttcaatgagaccctgctgggcgtgtctgtcatccgggcctttgaggagcaggagcgcttcatccaccagagcgacctgaaggtggatgagaaccagaaggcctactaccccagcatcgtggccaaccgctggctggccgtgcggctggagtgtgtgggcaactgcatcgtgctgtttgctgccctgtttgctgtgatcagccgccacagcctgtctgctggcctggtgggcctgtctgtgtcctacagcctgcaggtgaccacctacctgaactggctggtgaggatgagcagcgagatggagaccaacatcgtggccgtggagcggctgaaggagtacagcgagacagagaaggaggccccctggcagatccaggagacagccccacccagctcctggccccaggtgggccgggtggagttcaggaactactgcctgcgctaccgggaggacctggactttgtgctgcggcacatcaacgtgaccatcaatggaggagagaaggtgggcatcgtgggccgcactggagctgggaagagcagcctgaccctgggcctcttccgcatcaatgaatctgctgagggggagatcatcattgatggcatcaacatcgccaagattggcctgcatgacctgcgcttcaagatcaccatcatcccccaggaccctgtgctcttcagcggcagcctgaggatgaacctggaccccttcagccagtacagtgatgaggaggtgtggaccagcctggagctggcccacctgaaggactttgtgtctgccctgcctgacaagctggaccatgaatgtgccgagggcggggagaacctgtctgtgggccagaggcagctggtgtgcctggcccgggccctgctgaggaagaccaagatcctggtgctggatgaggccacagctgctgtggacctggagacagatgacctgatccagagcaccatccgcacccagtttgaggactgcaccgtgctgaccatcgcccaccggctgaacaccatcatggactacaccagggtgattgtgctggacaagggggagatccaggagtatggagcccccagcgacctgctgcagcagaggggcctcttctacagcatggccaaggatgctggcctggtgtag

SEQ ID NO: 18428 - DNA, 4626 bp, Artificial Sequence
  Description of Artificial Sequence: Synthetic coding sequence
atggccctgcggggcttctgcagcgcagatggcagtgaccccctgtgggactggaatgtgacctggaacaccagcaacccagacttcaccaagtgcttccagaacacagtgctggtgtgggtgccctgcttctacctgtgggcctgcttccccttctacttcctgtacctgagcagacatgaccggggctacatccagatgacccccctgaacaagaccaagacagccctgggcttcctgctgtggatcgtgtgctgggccgacctcttctacagcttctgggagaggagccggggcatcttcctggcccctgtgttcctggtgagccccaccctgctgggcatcaccatgctgctggccaccttcctgatccagctggagaggaggaagggcgtgcagagcagcggcatcatgctgaccttctggctggtggccctggtgtgtgccctggccatcctgcggagcaagatcatgacagccctgaaggaggatgcccaggtggacctcttccgggacatcaccttctacgtgtacttcagcctgctgctgatccagctggtgctgagctgcttcagtgacaggagccccctcttcagcgagaccatccatgaccccaacccctgcccagagagcagcgccagcttcctgagccgcatcaccttctggtggatcaccggcctcatcgtgcggggctaccggcagcccctggagggcagtgacctgtggagcctgaacaaggaggacaccagcgagcaggtggtgcctgtgctggtgaagaactggaagaaggaatgtgccaagaccaggaagcagcctgtgaaggtggtgtacagcagcaaggaccctgcccagcccaaggagagcagcaaggtggatgccaatgaggaggtggaggccctgattgtgaagagcccccagaaggagtggaaccccagcctcttcaaggtgctgtacaagaccttcggcccctacttcctgatgtccttcttcttcaaggccatccatgacctgatgatgttttctggcccccagatcctgaagctgctgatcaagtttgtgaatgacaccaaggccccagactggcagggctacttctacacagtgctgctgtttgtgacagcctgcctgcagaccctggtgctgcaccagtacttccacatctgctttgtgtctggcatgaggatcaagacagctgtgattggagctgtgtacaggaaggccctggtgatcaccaacagcgccaggaagagcagcacagtgggggagatcgtgaacctgatgtctgtggatgcccagcgcttcatggacctggccacctacatcaacatgatctggagcgcccccctgcaggtgatcctggccctgtacctgctgtggctgaacctgggccccagcgtgctggccggcgtggccgtgatggtgctgatggtgcctgtgaatgctgtgatggccatgaagaccaagacctaccaggtggcccacatgaagagcaaggacaaccgcatcaagctgatgaatgagatcctgaatggcatcaaggtgctgaagctgtatgcctgggagctggccttcaaggacaaggtgctggccatccggcaggaggagctgaaggtgctgaagaagagcgcctacctgtctgctgtgggcaccttcacctgggtgtgcacccccttcctggtggccctgtgcacctttgctgtgtatgtgaccattgatgagaacaacatcctggatgcccagacagcctttgtgtccctggccctcttcaacatcctgcgcttccccctgaacatcctgcccatggtgatcagcagcatcgtgcaggcctctgtgtccctgaagaggctgcgcatcttcctgagccatgaggagctggagccagacagcattgaaagaagacctgtgaaggatggcggcggcaccaacagcatcaccgtgagaaatgccaccttcacctgggcccggagtgacccccccaccctgaatggcatcaccttcagcatccctgagggcgccctggtggccgtggtgggccaggtgggctgtgggaagagcagcctgctgagcgccctgctggccgagatggacaaggtggagggccacgtggccatcaagggctctgtggcctacgtgccccagcaggcctggatccagaatgacagcctgcgggagaacatcctgtttggctgccagctggaggagccctactacagaagtgtcatccaggcctgtgccctgctgcctgacctggagatcctgcccagcggggacagaacagaaattggagagaagggcgtgaacctgagcggcggccagaagcagagggtgtccctggcccgggctgtgtacagcaatgctgacatctacctgtttgatgaccccctgtctgctgtggatgcccacgtgggcaagcacatctttgaaaatgtgattggccccaagggcatgctgaagaacaagacccgcatcctggtgacccacagcatgagctacctgccccaggtggatgtgatcatcgtgatgtctgggggcaagatcagcgagatgggcagctaccaggagctgctggccagagatggagcctttgctgagttcctgcggacctacgccagcacagagcaggagcaggatgctgaggagaatggcagcacagtgatggatgaggaggaggccggcgtgactggagtgtctggccctgggaaggaggccaagcagatggagaatggcatgctggtgacagattctgctgggaagcagctgcagaggcagctgagcagcagcagcagctacagcggggacatcagccgccaccacaacagcacagctgagctgcagaaggccgaggccaagaaggaggagacctggaagctgatggaggccgacaaggcccagacaggccaggtgaagctgtctgtgtactgggactacatgaaggccatcggcctcttcatctccttcctgagcatcttcctgttcatgtgcaaccacgtgtctgccctggccagcaactactggctgagcctgtggacagatgaccccatcgtgaatggcacccaggagcacaccaaggtgcggctgtctgtgtatggagccctgggcatcagccagggcattgctgtgtttggctacagcatggctgtgtccattggaggcatcctggccagccgctgcctgcacgtggacctgctgcacagcatcctgcggagccccatgtccttctttgagaggaccccatctggcaacctggtgaaccgcttcagcaaggagctggacacagtggacagcatgatccctgaggtgatcaagatgttcatgggcagcctcttcaacgtcatcggggcctgcatcgtcatcctgctggccacccccatcgccgccatcatcatcccccccctgggcctcatctacttctttgtgcagcgcttctacgtggccagcagccggcagctgaagaggctggagagcgtgagccgcagccctgtgtacagccacttcaatgagaccctgctgggcgtgtctgtcatccgggcctttgaggagcaggagcgcttcatccaccagagcgacctgaaggtggatgagaaccagaaggcctactaccccagcatcgtggccaaccgctggctggccgtgcggctggagtgtgtgggcaactgcatcgtgctgtttgctgccctgtttgctgtgatcagccgccacagcctgtctgctggcctggtgggcctgtctgtgtcctacagcctgcaggtgaccacctacctgaactggctggtgaggatgagcagcgagatggagaccaacatcgtggccgtggagcggctgaaggagtacagcgagacagagaaggaggccccctggcagatccaggagacagccccacccagctcctggccccaggtgggccgggtggagttcaggaactactgcctgcgctaccgggaggacctggactttgtgctgcggcacatcaacgtgaccatcaatggaggagagaaggtgggcatcgtgggccgcactggagctgggaagagcagcctgaccctgggcctcttccgcatcaatgaatctgctgagggggagatcatcattgatggcatcaacatcgccaagattggcctgcatgacctgcgcttcaagatcaccatcatcccccaggaccctgtgctcttcagcggcagcctgaggatgaacctggaccccttcagccagtacagtgatgaggaggtgtggaccagcctggagctggcccacctgaaggactttgtgtctgccctgcctgacaagctggaccatgaatgtgccgagggcggggagaacctgtctgtgggccagaggcagctggtgtgcctggcccgggccctgctgaggaagaccaagatcctggtgctggatgaggccacagctgctgtggacctggagacagatgacctgatccagagcaccatccgcacccagtttgaggactgcaccgtgctgaccatcgcccaccggctgaacaccatcatggactacaccagggtcatcgtgctggacaagggggagatccaggagtatggagcccccagcgacctgctgcagcagaggggcctcttctacagcatggccaaggatgctggcctggtgtag

SEQ ID NO: 18429 - DNA, 4596 bp, Artificial Sequence
  Description of Artificial Sequence: Synthetic coding sequence
atggccctgcggggcttctgcagcgcagatggcagtgaccccctgtgggactggaatgtgacctggaacaccagcaacccagacttcaccaagtgcttccagaacacagtgctggtgtgggtgccctgcttctacctgtgggcctgcttccccttctacttcctgtacctgagcagacatgaccggggctacatccagatgacccccctgaacaagaccaagacagccctgggcttcctgctgtggatcgtgtgctgggccgacctcttctacagcttctgggagaggagccggggcatcttcctggcccctgtgttcctggtgagccccaccctgctgggcatcaccatgctgctggccaccttcctgatccagctggagaggaggaagggcgtgcagagcagcggcatcatgctgaccttctggctggtggccctggtgtgtgccctggccatcctgcggagcaagatcatgacagccctgaaggaggatgcccaggtggacctcttccgggacatcaccttctacgtgtacttcagcctgctgctgatccagctggtgctgagctgcttcagtgacaggagccccctcttcagcgagaccatccatgaccccaacccctgcccagagagcagcgccagcttcctgagccgcatcaccttctggtggatcaccggcctcatcgtgcggggctaccggcagcccctggagggcagtgacctgtggagcctgaacaaggaggacaccagcgagcaggtggtgcctgtgctggtgaagaactggaagaaggaatgtgccaagaccaggaagcagcctgtgaaggtggtgtacagcagcaaggaccctgcccagcccaaggagagcagcaaggtggatgccaatgaggaggtggaggccctgattgtgaagagcccccagaaggagtggaaccccagcctcttcaaggtgctgtacaagaccttcggcccctacttcctgatgtccttcttcttcaaggccatccatgacctgatgatgttttctggcccccagatcctgaagctgctgatcaagtttgtgaatgacaccaaggccccagactggcagggctacttctacacagtgctgctgtttgtgacagcctgcctgcagaccctggtgctgcaccagtacttccacatctgctttgtgtctggcatgaggatcaagacagctgtgattggagctgtgtacaggaaggccctggtgatcaccaacagcgccaggaagagcagcacagtgggggagatcgtgaacctgatgtctgtggatgcccagcgcttcatggacctggccacctacatcaacatgatctggagcgcccccctgcaggtgatcctggccctgtacctgctgtggctgaacctgggccccagcgtgctggccggcgtggccgtgatggtgctgatggtgcctgtgaatgctgtgatggccatgaagaccaagacctaccaggtggcccacatgaagagcaaggacaaccgcatcaagctgatgaatgagatcctgaatggcatcaaggtgctgaagctgtatgcctgggagctggccttcaaggacaaggtgctggccatccggcaggaggagctgaaggtgctgaagaagagcgcctacctgtctgctgtgggcaccttcacctgggtgtgcacccccttcctggtggccctgtgcacctttgctgtgtatgtgaccattgatgagaacaacatcctggatgcccagacagcctttgtgtccctggccctcttcaacatcctgcgcttccccctgaacatcctgcccatggtgatcagcagcatcgtgcaggcctctgtgtccctgaagaggctgcgcatcttcctgagccatgaggagctggagccagacagcattgaaagaagacctgtgaaggatggcggcggcaccaacagcatcaccgtgagaaatgccaccttcacctgggcccggagtgacccccccaccctgaatggcatcaccttcagcatccctgagggcgccctggtggccgtggtgggccaggtgggctgtgggaagagcagcctgctgagcgccctgctggccgagatggacaaggtggagggccacgtggccatcaagggctctgtggcctacgtgccccagcaggcctggatccagaatgacagcctgcgggagaacatcctgtttggctgccagctggaggagccctactacagaagtgtcatccaggcctgtgccctgctgcctgacctggagatcctgcccagcggggacagaacagaaattggagagaagggcgtgaacctgagcggcggccagaagcagagggtgtccctggcccgggctgtgtacagcaatgctgacatctacctgtttgatgaccccctgtctgctgtggatgcccacgtgggcaagcacatctttgaaaatgtgattggccccaagggcatgctgaagaacaagacccgcatcctggtgacccacagcatgagctacctgccccaggtggatgtgatcatcgtgatgtctgggggcaagatcagcgagatgggcagctaccaggagctgctggccagagatggagcctttgctgagttcctgcggacctacgccagcacagagcaggagcaggatgctgaggagaatggagtgactggagtgtctggccctgggaaggaggccaagcagatggagaatggcatgctggtgacagattctgctgggaagcagctgcagaggcagctgagcagcagcagcagctacagcggggacatcagccgccaccacaacagcacagctgagctgcagaaggccgaggccaagaaggaggagacctggaagctgatggaggccgacaaggcccagacaggccaggtgaagctgtctgtgtactgggactacatgaaggccatcggcctcttcatctccttcctgagcatcttcctgttcatgtgcaaccacgtgtctgccctggccagcaactactggctgagcctgtggacagatgaccccatcgtgaatggcacccaggagcacaccaaggtgcggctgtctgtgtatggagccctgggcatcagccagggcattgctgtgtttggctacagcatggctgtgtccattggaggcatcctggccagccgctgcctgcacgtggacctgctgcacagcatcctgcggagccccatgtccttctttgagaggaccccatctggcaacctggtgaaccgcttcagcaaggagctggacacagtggacagcatgatccctgaggtgatcaagatgttcatgggcagcctcttcaacgtcatcggggcctgcatcgtcatcctgctggccacccccatcgccgccatcatcatcccccccctgggcctcatctacttctttgtgcagcgcttctacgtggccagcagccggcagctgaagaggctggagagcgtgagccgcagccctgtgtacagccacttcaatgagaccctgctgggcgtgtctgtcatccgggcctttgaggagcaggagcgcttcatccaccagagcgacctgaaggtggatgagaaccagaaggcctactaccccagcatcgtggccaaccgctggctggccgtgcggctggagtgtgtgggcaactgcatcgtgctgtttgctgccctgtttgctgtgatcagccgccacagcctgtctgctggcctggtgggcctgtctgtgtcctacagcctgcaggtgaccacctacctgaactggctggtgaggatgagcagcgagatggagaccaacatcgtggccgtggagcggctgaaggagtacagcgagacagagaaggaggccccctggcagatccaggagacagccccacccagctcctggccccaggtgggccgggtggagttcaggaactactgcctgcgctaccgggaggacctggactttgtgctgcggcacatcaacgtgaccatcaatggaggagagaaggtgggcatcgtgggccgcactggagctgggaagagcagcctgaccctgggcctcttccgcatcaatgaatctgctgagggggagatcatcattgatggcatcaacatcgccaagattggcctgcatgacctgcgcttcaagatcaccatcatcccccaggaccctgtgctcttcagcggcagcctgaggatgaacctggaccccttcagccagtacagtgatgaggaggtgtggaccagcctggagctggcccacctgaaggactttgtgtctgccctgcctgacaagctggaccatgaatgtgccgagggcggggagaacctgtctgtgggccagaggcagctggtgtgcctggcccgggccctgctgaggaagaccaagatcctggtgctggatgaggccacagctgctgtggacctggagacagatgacctgatccagagcaccatccgcacccagtttgaggactgcaccgtgctgaccatcgcccaccggctgaacaccatcatggactacaccagggtcatcgtgctggacaagggggagatccaggagtatggagcccccagcgacctgctgcagcagaggggcctcttctacagcatggccaaggatgctggcctggtgtag

SEQ ID NO: 18430 - DNA, 3648 bp, Artificial Sequence
  Description of Artificial Sequence: Synthetic coding sequence
atgtccttcttcttcaaggccatccatgacctgatgatgttttctggcccccagatcctgaagctgctgatcaagtttgtgaatgacaccaaggccccagactggcagggctacttctacacagtgctgctgtttgtgacagcctgcctgcagaccctggtgctgcaccagtacttccacatctgctttgtgtctggcatgaggatcaagacagctgtgattggagctgtgtacaggaaggccctggtgatcaccaacagcgccaggaagagcagcacagtgggggagatcgtgaacctgatgtctgtggatgcccagcgcttcatggacctggccacctacatcaacatgatctggagcgcccccctgcaggtgatcctggccctgtacctgctgtggctgaacctgggccccagcgtgctggccggcgtggccgtgatggtgctgatggtgcctgtgaatgctgtgatggccatgaagaccaagacctaccaggtggcccacatgaagagcaaggacaaccgcatcaagctgatgaatgagatcctgaatggcatcaaggtgctgaagctgtatgcctgggagctggccttcaaggacaaggtgctggccatccggcaggaggagctgaaggtgctgaagaagagcgcctacctgtctgctgtgggcaccttcacctgggtgtgcacccccttcctggtggccctgtgcacctttgctgtgtatgtgaccattgatgagaacaacatcctggatgcccagacagcctttgtgtccctggccctcttcaacatcctgcgcttccccctgaacatcctgcccatggtgatcagcagcatcgtgcaggcctctgtgtccctgaagaggctgcgcatcttcctgagccatgaggagctggagccagacagcattgaaagaagacctgtgaaggatggcggcggcaccaacagcatcaccgtgagaaatgccaccttcacctgggcccggagtgacccccccaccctgaatggcatcaccttcagcatccctgagggcgccctggtggccgtggtgggccaggtgggctgtgggaagagcagcctgctgagcgccctgctggccgagatggacaaggtggagggccacgtggccatcaagggctctgtggcctacgtgccccagcaggcctggatccagaatgacagcctgcgggagaacatcctgtttggctgccagctggaggagccctactacagaagtgtcatccaggcctgtgccctgctgcctgacctggagatcctgcccagcggggacagaacagaaattggagagaagggcgtgaacctgagcggcggccagaagcagagggtgtccctggcccgggctgtgtacagcaatgctgacatctacctgtttgatgaccccctgtctgctgtggatgcccacgtgggcaagcacatctttgaaaatgtgattggccccaagggcatgctgaagaacaagacccgcatcctggtgacccacagcatgagctacctgccccaggtggatgtgatcatcgtgatgtctgggggcaagatcagcgagatgggcagctaccaggagctgctggccagagatggagcctttgctgagttcctgcggacctacgccagcacagagcaggagcaggatgctgaggagaatggcagcacagtgatggatgaggaggaggccggcgtgactggagtgtctggccctgggaaggaggccaagcagatggagaatggcatgctggtgacagattctgctgggaagcagctgcagaggcagctgagcagcagcagcagctacagcggggacatcagccgccaccacaacagcacagctgagctgcagaaggccgaggccaagaaggaggagacctggaagctgatggaggccgacaaggcccagacaggccaggtgaagctgtctgtgtactgggactacatgaaggccatcggcctcttcatctccttcctgagcatcttcctgttcatgtgcaaccacgtgtctgccctggccagcaactactggctgagcctgtggacagatgaccccatcgtgaatggcacccaggagcacaccaaggtgcggctgtctgtgtatggagccctgggcatcagccagggcattgctgtgtttggctacagcatggctgtgtccattggaggcatcctggccagccgctgcctgcacgtggacctgctgcacagcatcctgcggagccccatgtccttctttgagaggaccccatctggcaacctggtgaaccgcttcagcaaggagctggacacagtggacagcatgatccctgaggtgatcaagatgttcatgggcagcctcttcaacgtcatcggggcctgcatcgtcatcctgctggccacccccatcgccgccatcatcatcccccccctgggcctcatctacttctttgtgcagcgcttctacgtggccagcagccggcagctgaagaggctggagagcgtgagccgcagccctgtgtacagccacttcaatgagaccctgctgggcgtgtctgtcatccgggcctttgaggagcaggagcgcttcatccaccagagcgacctgaaggtggatgagaaccagaaggcctactaccccagcatcgtggccaaccgctggctggccgtgcggctggagtgtgtgggcaactgcatcgtgctgtttgctgccctgtttgctgtgatcagccgccacagcctgtctgctggcctggtgggcctgtctgtgtcctacagcctgcaggtgaccacctacctgaactggctggtgaggatgagcagcgagatggagaccaacatcgtggccgtggagcggctgaaggagtacagcgagacagagaaggaggccccctggcagatccaggagacagccccacccagctcctggccccaggtgggccgggtggagttcaggaactactgcctgcgctaccgggaggacctggactttgtgctgcggcacatcaacgtgaccatcaatggaggagagaaggtgggcatcgtgggccgcactggagctgggaagagcagcctgaccctgggcctcttccgcatcaatgaatctgctgagggggagatcatcattgatggcatcaacatcgccaagattggcctgcatgacctgcgcttcaagatcaccatcatcccccaggaccctgtgctcttcagcggcagcctgaggatgaacctggaccccttcagccagtacagtgatgaggaggtgtggaccagcctggagctggcccacctgaaggactttgtgtctgccctgcctgacaagctggaccatgaatgtgccgagggcggggagaacctgtctgtgggccagaggcagctggtgtgcctggcccgggccctgctgaggaagaccaagatcctggtgctggatgaggccacagctgctgtggacctggagacagatgacctgatccagagcaccatccgcacccagtttgaggactgcaccgtgctgaccatcgcccaccggctgaacaccatcatggactacaccagggtcatcgtgctggacaagggggagatccaggagtatggagcccccagcgacctgctgcagcagaggggcctcttctacagcatggccaaggatgctggcctggtgtag

SEQ ID NO: 18431 - DNA, 1968 bp, Artificial Sequence
  Description of Artificial Sequence: Synthetic coding sequence
atgagcagcagcaatgtggaggtgttcatccctgtgtcccagggcaacaccaacggcttccctgccacagccagcaatgacctgaaggccttcacagagggcgctgtgctgtccttccacaacatctgctacagagtgaagctgaagagcggcttcctgccctgcaggaagcctgtggagaaggagatcctgagcaacatcaatggcatcatgaagccaggcctgaatgccatcctgggccccaccggcggcggcaagagcagcctgctggatgtgctggccgccaggaaggaccccagcggcctgtctggagatgtgctgatcaatggagcccccaggcctgccaacttcaagtgcaacagcggctacgtggtgcaggatgatgtggtgatgggcaccctgactgtgcgggagaacctgcagttctctgctgccctgcggctggccaccaccatgaccaaccacgagaagaatgaaagaatcaacagagtcatccaggagctgggcctggacaaggtggccgacagcaaggtgggcacccagttcatccggggcgtgtctggaggagagaggaagaggaccagcatcggcatggagctgatcacagaccccagcatcctcttcctggatgagcccaccaccggcctggacagcagcacagccaatgctgtgctgctgctgctgaagaggatgagcaagcagggccgcaccatcatcttcagcatccaccagccccgctacagcatcttcaagctgtttgacagcctgaccctgctggccagcggccgcctgatgtttcatggccctgcccaggaggccctgggctactttgaatctgctggctaccactgtgaggcctacaacaacccagctgacttcttcctggacatcatcaatggagacagcacagctgtggccctgaaccgggaggaggacttcaaggccacagagatcatcgagcccagcaagcaggacaagcccctgattgagaagctggccgagatctacgtgaacagcagcttctacaaggagaccaaggccgagctgcaccagctgtctggaggagagaagaagaagaagatcaccgtcttcaaggagatctcctacaccaccagcttctgccaccagctgcgctgggtgtccaagaggagcttcaagaacctgctgggcaacccccaggccagcatcgcccagatcatcgtgacagtggtgctgggcctggtgattggagccatctacttcggcctgaagaatgacagcacaggcatccagaacagagctggggtgctcttcttcctgaccaccaaccagtgcttcagctctgtgtctgctgtggagctgtttgtggtggagaagaagctgttcatccacgagtacatcagcggctactacagagtgagcagctacttcctgggcaagctgctgagtgacctgctgcccatgaggatgctgcccagcatcatcttcacctgcatcgtgtacttcatgctgggcctgaagcccaaggcagatgccttctttgtgatgatgttcaccctgatgatggtggcctacagcgccagctccatggccctggccatcgctgctggccagagcgtggtgtctgtggccaccctgctgatgaccatctgctttgtgttcatgatgatcttcagcggcctgctggtgaacctgaccaccatcgcctcctggctgtcctggctgcagtacttcagcatccccaggtatggcttcaccgccctgcagcacaatgagttcctgggccagaacttctgccccggcctgaatgccaccggcaacaacccctgcaactatgccacctgcacaggagaggagtacctggtgaagcagggcatcgacctgagcccctggggcctgtggaagaaccacgtggccctggcctgcatgatcgtcatcttcctgaccatcgcctacctgaagctgctcttcctgaagaagtacagctag

SEQ ID NO: 18432 - DNA, 1836 bp, Artificial Sequence
  Description of Artificial Sequence: Synthetic coding sequence
atgagcagcagcaatgtggaggtgttcatccctgtgtcccagggcaacaccaacggcttccctgccacagccagcaatgacctgaaggccttcacagagggcgctgtgctgtccttccacaacatctgctacagagtgaagctgaagagcggcttcctgccctgcaggaagcctgtggagaaggagatcctgagcaacatcaatggcatcatgaagccaggcctgaatgccatcctgggccccaccggcggcggcaagagcagcctgctggatgtgctggccgccaggaaggaccccagcggcctgtctggagatgtgctgatcaatggagcccccaggcctgccaacttcaagtgcaacagcggctacgtggtgcaggatgatgtggtgatgggcaccctgactgtgcgggagaacctgcagttctctgctgccctgcggctggccaccaccatgaccaaccacgagaagaatgaaagaatcaacagagtcatccaggagctgggcctggacaaggtggccgacagcaaggtgggcacccagttcatccggggcgtgtctggaggagagaggaagaggaccagcatcggcatggagctgatcacagaccccagcatcctcttcctggatgagcccaccaccggcctggacagcagcacagccaatgctgtgctgctgctgctgaagaggatgagcaagcagggccgcaccatcatcttcagcatccaccagccccgctacagcatcttcaagctgtttgacagcctgaccctgctggccagcggccgcctgatgtttcatggccctgcccaggaggccctgggctactttgaatctgctggctaccactgtgaggcctacaacaacccagctgacttcttcctggacatcatcaatggagacagcacagctgtggccctgaaccgggaggaggacttcaaggccacagagatcatcgagcccagcaagcaggacaagcccctgattgagaagctggccgagatctacgtgaacagcagcttctacaaggagaccaaggccgagctgcaccagctgtctggaggagagaagaagaagaagatcaccgtcttcaaggagatctcctacaccaccagcttctgccaccagctgcgctgggtgtccaagaggagcttcaagaacctgctgggcaacccccaggccagcatcgcccagatcatcgtgacagtggtgctgggcctggtgattggagccatctacttcggcctgaagaatgacagcacaggcatccagaacagagctggggtgctcttcttcctgaccaccaaccagtgcttcagctctgtgtctgctgtggagctgtttgtggtggagaagaagctgttcatccacgagtacatcagcggctactacagagtgagcagctacttcctgggcaagctgctgagtgacctgctgcccatgaggatgctgcccagcatcatcttcacctgcatcgtgtacttcatgctgggcctgaagcccaaggcagatgccttctttgtgatgatgttcaccctgatgatggtggcctacagcgccagctccatggccctggccatcgctgctggccagagcgtggtgtctgtggccaccctgctgatgaccatctgctttgtgttcatgatggtgtgctggagcatcagccagcccctgcacctgggctgccacggcttcagcaccagcgccttccatgacatggacctgcggctgtgcagcatcatgaacttctgggacaagaccagcgcccaggacagcatgcagcaggagaccatcctggtgaccatgcagcacgtgctggccaagaacatctggtag

SEQ ID NO: 18433 - DNA, 1212 bp, Artificial Sequence
  Description of Artificial Sequence: Synthetic coding sequence
atggacaggagcaaggagaactgcatcagcggccctgtgaaggccacagcccctgtgggcggccccaagagggtgctggtgacccagcagttcccctgccagaaccccctgcctgtgaacagcggccaggcccagagggtgctgtgccccagcaacagcagccagaggatccccctgcaggcccagaagctggtgagcagccacaagcctgtgcagaaccagaagcagaagcagctgcaggccacctctgtgccccaccctgtgtcccggcccctgaacaacacccagaagagcaagcagcccctgcccagcgcccctgagaacaaccctgaggaggagctggccagcaagcagaagaatgaggagagcaagaagaggcagtgggccctggaggactttgaaattggccggcccctgggcaagggcaagtttggaaatgtgtacctggcccgggagaagcagagcaagttcatcctggccctgaaggtgctcttcaaggcccagctggagaaggccggcgtggagcaccagctgcggcgggaggtggagatccagagccacctgcggcaccccaacatcctgcggctgtatggctacttccatgatgccaccagggtgtacctgatcctggagtatgcccccctgggcaccgtgtaccgggagctgcagaagctgagcaagtttgatgagcagaggacagccacctacatcacagagctggccaatgccctgagctactgccacagcaagagggtcatccaccgggacatcaagccagagaacctgctgctgggcagcgctggggagctgaagattgctgactttggctggagcgtgcacgcccccagcagcaggaggaccaccctgtgtggcaccctggactacctgcccccagagatgattgagggccgcatgcatgatgagaaggtggacctgtggagcctgggcgtgctgtgctatgagttcctggtgggcaagcccccatttgaggccaacacctaccaggagacctacaagaggatcagccgggtggagttcaccttcccagactttgtgacagaaggagcccgggacctgatcagccggctgctgaagcacaaccccagccagaggcccatgctgcgggaggtgctggagcacccctggatcacagccaacagcagcaagcccagcaactgccagaacaaggagagcgccagcaagcagagctag

SEQ ID NO: 18434 - DNA, 1212 bp, Artificial Sequence; identical to SEQ ID NO: 18433
  Description of Artificial Sequence: Synthetic coding sequence

SEQ ID NO: 18435 - DNA, 1212 bp, Artificial Sequence; identical to SEQ ID NO: 18433
  Description of Artificial Sequence: Synthetic coding sequence

SEQ ID NO: 18436 - DNA, 1044 bp, Artificial Sequence
  Description of Artificial Sequence: Synthetic coding sequence
atggacaggagcaaggagaactgcatcagcggccctgtgaaggccacagcccctgtgggcggccccaagagggtgctggtgacccagcagttcccctgccagaaccccctgcctgtgaacagcggccaggcccagagggtgctgtgccccagcaacagcagccagaggatccccctgcaggcccagaagctggtgagcagccacaagcctgtgcagaaccagaagcagaagcagctgcaggccacctctgtgccccaccctgtgtcccggcccctgaacaacacccagaagagcaagcagcccctgcccagcgcccctgagaacaaccctgaggaggagctggccagcaagcagaagaatgaggagagcaagaagaggcagtgggccctggaggactttgaaattggccggcccctgggcaagggcaagtttggaaatgtgtacctggcccgggagaagcagagcaagttcatcctggccctgaaggtgctcttcaaggcccagctggagaaggccggcgtggagcaccagctgcggcgggaggtggagatccagagccacctgcggcaccccaacatcctgcggctgtatggctacttccatgatgccaccagggtgtacctgatcctggagtatgcccccctgggcaccgtgtaccgggagctgcagaagctgagcaagtttgatgagcagaggacagccacctacatcacagagctggccaatgccctgagctactgccacagcaagagggtcatccaccgggacatcaagccagagaacctgctgctgggcagcgctggggagctgaagattgctgactttggctggagcgtgcacgcccccagcagcaggaggaccaccctgtgtggcaccctggactacctgcccccagagatgattgagggccgcatgcatgatgagaaggtggacctgtggagcctgggcgtgctgtgctatgagttcctggtgggcaagcccccatttgaggccaacacctaccaggagacctacaagaggatcagccgggtgagaagaaattag

SEQ ID NO: 18437 - DNA, 1212 bp, Artificial Sequence; identical to SEQ ID NO: 18433
  Description of Artificial Sequence: Synthetic coding sequence

SEQ ID NO: 18438 - DNA, 1212 bp, Artificial Sequence; identical to SEQ ID NO: 18433
  Description of Artificial Sequence: Synthetic coding sequence

SEQ ID NO: 18439 - DNA, 1212 bp, Artificial Sequence; identical to SEQ ID NO: 18433
  Description of Artificial Sequence: Synthetic coding sequence

SEQ ID NO: 18440 - DNA, 1212 bp, Artificial Sequence; identical to SEQ ID NO: 18433
  Description of Artificial Sequence: Synthetic coding sequence

SEQ ID NO: 18441 - DNA, 1212 bp, Artificial Sequence; identical to SEQ ID NO: 18433
  Description of Artificial Sequence: Synthetic coding sequence

SEQ ID NO: 18442 - DNA, 570 bp, Artificial Sequence
  Description of Artificial Sequence: Synthetic coding sequence
atggacaggagcaaggagaactgcatcagcggccctgtgaaggccacagcccctgtgggcggccccaagagggtgctggtgacccagcagttcccctgccagaaccccctgcctgtgaacagcggccaggcccagagggtgctgtgccccagcaacagcagccagaggatccccctgcaggcccagaagctggtgagcagccacaagcctgtgcagaaccagaagcagaagcagctgcaggccacctctgtgccccaccctgtgtcccggcccctgaacaacacccagaagagcaagcagcccctgcccagcgcccctgagaacaaccctgaggaggagctggccagcaagcagaagaatgaggagagcaagaagaggcagtgggccctggaggactttgaaattggccggcccctgggcaagggcaagtttggaaatgtgtacctggcccgggagaagcagagcaagttcatcctggccctgaaggtgctcttcaaggcccagctggagaaggccggcgtggagcaccagctgcggcgggaggtggagatccagagccacctgaggtag

SEQ ID NO: 18443 - DNA, 444 bp, Artificial Sequence
  Description of Artificial Sequence: Synthetic coding sequence
atggacaggagcaaggagaactgcatcagcggccctgtgaaggccacagcccctgtgggcggccccaagagggtgctggtgacccagcagttcccctgccagaaccccctgcctgtgaacagcggccaggcccagagggtgctgtgccccagcaacagcagccagaggatccccctgcaggcccagaagctggtgagcagccacaagcctgtgcagaaccagaagcagaagcagctgcaggccacctctgtgccccaccctgtgtcccggcccctgaacaacacccagaagagcaagcagcccctgcccagcgcccctgagaacaaccctgaggaggagctggccagcaagcagaagaatgaggagagcaagaagaggcagtgggccctggaggactttgaaattggccggcccctgggcaagggcaagtttggaaatgtgtag

SEQ ID NO: 18444 - DNA, 816 bp, Artificial Sequence
  Description of Artificial Sequence: Synthetic coding sequence
atggacaggagcaaggagaactgcatcagcggccctgtgaaggccacagcccctgtgggcggccccaagagggtgctggtgacccagcagttcccctgccagaaccccctgcctgtgaacagcggccaggcccagagggtgctgtgccccagcaacagcagccagaggatccccctgcaggcccagaagctggtgagcagccacaagcctgtgcagaaccagaagcagaagcagctgcaggccacctctgtgccccaccctgtgtcccggcccctgaacaacacccagaagagcaagcagcccctgcccagcgcccctgagaacaaccctgaggaggagctggccagcaagcagaagaatgaggagagcaagaagaggcagtgggccctggaggactttgaaattggccggcccctgggcaagggcaagtttggaaatgtgtacctggcccgggagaagcagagcaagttcatcctggccctgaaggtgctcttcaaggcccagctggagaaggccggcgtggagcaccagctgcggcgggaggtggagatccagagccacctgcggcaccccaacatcctgcggctgtatggctacttccatgatgccaccagggtgtacctgatcctggagtatgcccccctgggcaccgtgtaccgggagctgcagaagctgagcaagtttgatgagcagaggacagccacctacatcacagagctggccaatgccctgagctactgccacagcaagagggtcatccaccgggacatcaagccagagaacctgctgctgggcagcgctggggagctgaagtag

SEQ ID NO: 18445 - DNA, 240 bp, Artificial Sequence
  Description of Artificial Sequence: Synthetic coding sequence
atggacaggagcaaggagaactgcatcagcggccctgtgaaggccacagcccctgtgggcggccccaagagggtgctggtgacccagcagttcccctgccagaaccccctgcctgtgaacagcggccaggcccagagggtgctgtgccccagcaacagcagccagaggatccccctgcaggcccagaagctggtgagcagccacaagcctgtgcagaaccagaagcagaagcagctgtag

SEQ ID NO: 18446 - DNA, 321 bp, Artificial Sequence
  Description of Artificial Sequence: Synthetic coding sequence
atggacaggagcaaggagaactgcatcagcggccctgtgaaggccacagcccctgtgggcggccccaagagggtgctggtgacccagcagttcccctgccagaaccccctgcctgtgaacagcggccaggcccagagggtgctgtgccccagcaacagcagccagaggatccccctgcaggcccagaagctggtgagcagccacaagcctgtgcagaaccagaagcagaagcagctgcaggccacctctgtgccccaccctgtgtcccggcccctgaacaacacccagaagagcaagcagcccctgcccagcgccccctag

SEQ ID NO: 18447 - DNA, 1035 bp, Artificial Sequence
  Description of Artificial Sequence: Synthetic coding sequence
atggcccagaaggaaaattcctacccctggccctacggccggcagacagcccccagcggcctgagcaccctgccccagagggtgctgaggaaggagcctgtgaccccatctgccctggtgctgatgagccgcagcaatgtgcagcccacagctgcccctggccagaaggtgatggagaacagcagcggcaccccagacatcctgaccaggcacttcaccattgatgactttgaaattggccggcccctgggcaagggcaagtttggaaatgtgtacctggcccgggagaagaagagccacttcatcgtggccctgaaggtgctcttcaagagccagatcgagaaggagggcgtggagcaccagctgcggcgggagattgagatccaggcccacctgcaccaccccaacatcctgcggctgtacaactacttctatgacagaagacgcatctacctgatcctggagtatgcccccagaggagagctgtacaaggagctgcagaagagctgcacctttgatgagcagaggacagccaccatcatggaggagctggctgatgccctgatgtactgccacggcaagaaggtgatccaccgggacatcaagccagagaacctgctgctgggcctgaagggggagctgaagattgctgactttggctggagcgtgcacgcccccagcctgcggaggaagaccatgtgtggcaccctggactacctgcccccagagatgattgagggccgcatgcacaatgagaaggtggacctgtggtgcattggagtgctgtgctatgagctgctggtgggcaaccccccatttgaaagtgccagccacaatgagacctacagaagaattgtgaaggtggacctgaagtttcctgcctctgtgcccatgggcgcccaggacctgatcagcaagctgctgcggcacaaccccagcgagcggctgcccctggcccaggtgtctgcccacccctgggtgcgggccaacagccggcgggtgctgccccccagcgccctgcagagcgtggcctag

SEQ ID NO: 18448 - DNA, 912 bp, Artificial Sequence
  Description of Artificial Sequence: Synthetic coding sequence
atgagccgcagcaatgtgcagcccacagctgcccctggccagaaggtgatggagaacagcagcggcaccccagacatcctgaccaggcacttcaccattgatgactttgagatcggccggcccctgggcaagggcaagtttggaaatgtgtacctggcccgggagaagaagagccacttcatcgtggccctgaaggtgctcttcaagagccagatcgagaaggagggcgtggagcaccagctgcggcgggagattgagatccaggcccacctgcaccaccccaacatcctgcggctgtacaactacttctatgacagaagacgcatctacctgatcctggagtatgcccccagaggagagctgtacaaggagctgcagaagagctgcacctttgatgagcagaggacagccaccatcatggaggagctggctgatgccctgatgtactgccacggcaagaaggtgatccaccgggacatcaagccagagaacctgctgctgggcctgaagggggagctgaagattgctgactttggctggagcgtgcacgcccccagcctgcggaggaagaccatgtgtggcaccctggactacctgcccccagagatgattgagggccgcatgcacaatgagaaggtggacctgtggtgcatcggcgtgctgtgctatgagctgctggtgggcaaccccccatttgagagcgccagccacaatgagacctaccgccgcatcgtgaaggtggacctgaagtttcctgcctctgtgcccatgggcgcccaggacctgatcagcaagctgctgcggcacaaccccagcgagcggctgcccctggcccaggtgtctgcccacccctgggtgcgggccaacagcagaagagtgctgcccccatctgccctgcagagcgtggcctag

SEQ ID NO: 18449 - DNA, 1035 bp, Artificial Sequence; identical to SEQ ID NO: 18447
  Description of Artificial Sequence: Synthetic coding sequence

SEQ ID NO: 18450 - DNA, 930 bp, Artificial Sequence
  Description of Artificial Sequence: Synthetic coding sequence
atgagcagccccagggctgtggtgcagctgggcaaggcccagcctgctggggaggagctggccacagccaaccagacagcccagcagcccagcagccctgccatgaggcggctgactgtggatgactttgaaattggccggcccctgggcaagggcaagtttggaaatgtgtacctggcccggctgaaggagagccacttcatcgtggccctgaaggtgctcttcaagagccagatcgagaaggagggcctggagcaccagctgcggcgggagattgagatccaggcccacctgcagcaccccaacatcctgcggctgtacaactacttccatgatgcccggcgggtgtacctgatcctggagtatgcccccagaggagagctgtacaaggagctgcagaagtctgagaagctggatgagcagaggacagccaccatcatcgaggagctggctgatgccctgacctactgccacgacaagaaggtgatccaccgggacatcaagccagagaacctgctgctgggcttccggggggaggtgaagattgctgactttggctggagcgtgcacacccccagcctgcggaggaagaccatgtgtggcaccctggactacctgcccccagagatgattgagggccgcacctatgatgagaaggtggacctgtggtgcattggagtgctgtgctatgagctgctggtgggctaccccccatttgaaagtgccagccacagcgagacctaccgccgcatcctgaaggtggatgtgcgcttccccctgtccatgcccctgggcgcccgggacctgatcagccggctgctgcgctaccagcccctggagcggctgcccctggcccagatcctgaagcacccctgggtgcaggcccacagccggcgggtgctgcccccctgtgcccagatggccagctag

SEQ ID NO: 18451 - DNA, 873 bp, Artificial Sequence
  Description of Artificial Sequence: Synthetic coding sequence
atggccacagccaaccagacagcccagcagcccagcagccctgccatgaggcggctgactgtggatgactttgagatcggccggcccctgggcaagggcaagtttggaaatgtgtacctggcccggctgaaggagagccacttcatcgtggccctgaaggtgctcttcaagagccagatcgagaaggagggcctggagcaccagctgcggcgggagattgagatccaggcccacctgcagcaccccaacatcctgcggctgtacaactacttccatgatgccaggagagtgtacctgatcctggagtatgcccccagaggagagctgtacaaggagctgcagaagtctgagaagctggatgagcagaggacagccaccatcatcgaggagctggctgatgccctgacctactgccacgacaagaaggtgatccaccgggacatcaagccagagaacctgctgctgggcttccggggggaggtgaagattgctgactttggctggagcgtgcacacccccagcctgcggaggaagaccatgtgtggcaccctggactacctgcccccagagatgattgagggccgcacctatgatgagaaggtggacctgtggtgcatcggcgtgctgtgctatgagctgctggtgggctaccccccatttgagagcgccagccacagcgagacctaccgccgcatcctgaaggtggatgtgcgcttccccctgtccatgcccctgggcgcccgggacctgatcagccggctgctgcgctaccagcccctggagcggctgcccctggcccagatcctgaagcacccctgggtgcaggcccacagcagaagagtgctgcccccctgtgcccagatggccagctag

SEQ ID NO: 18452 - DNA, 828 bp, Artificial Sequence
  Description of Artificial Sequence: Synthetic coding sequence
atgaggcggctgactgtggatgactttgaaattggccggcccctgggcaagggcaagtttggaaatgtgtacctggcccggctgaaggagagccacttcatcgtggccctgaaggtgctcttcaagagccagatcgagaaggagggcctggagcaccagctgcggcgggagattgagatccaggcccacctgcagcaccccaacatcctgcggctgtacaactacttccatgatgcccggcgggtgtacctgatcctggagtatgcccccagaggagagctgtacaaggagctgcagaagtctgagaagctggatgagcagaggacagccaccatcatcgaggagctggctgatgccctgacctactgccacgacaagaaggtgatccaccgggacatcaagccagagaacctgctgctgggcttccggggggaggtgaagattgctgactttggctggagcgtgcacacccccagcctgcggaggaagaccatgtgtggcaccctggactacctgcccccagagatgattgagggccgcacctatgatgagaaggtggacctgtggtgcattggagtgctgtgctatgagctgctggtgggctaccccccatttgaaagtgccagccacagcgagacctaccgccgcatcctgaaggtggatgtgcgcttccccctgtccatgcccctgggcgcccgggacctgatcagccggctgctgcgctaccagcccctggagcggctgcccctggcccagatcctgaagcacccctgggtgcaggcccacagccggcgggtgctgcccccctgtgcccagatggccagctag

SEQ ID NO: 18453 - DNA, 2589 bp, Artificial Sequence
  Description of Artificial Sequence: Synthetic coding sequence
atgaacatccaggagcagggcttccccctggacctgggcgccagcttcacagaagatgcccccaggcctcctgtgcctggagaggagggggagctggtgtccacagaccccaggcctgccagctacagcttctgcagcggcaagggcgtgggcatcaagggggagaccagcacagccaccccccggcggagtgacctggacctgggctatgagcctgagggcagcgccagccccaccccaccctacctgaagtgggccgagagcctgcacagcctgctggatgaccaggacggcatcagcctcttccgcaccttcctgaagcaggagggctgtgccgacctgctggacttctggtttgcctgcaccggcttcaggaagctggagccctgtgacagcaatgaggagaagaggctgaagctggcccgggccatctacaggaagtacatcctggacaacaatggaattgtgtcccggcagaccaagccagccaccaagagcttcatcaagggctgcatcatgaagcagctgattgatcctgccatgtttgaccaggcccagacagagatccaggccaccatggaggagaacacctaccccagcttcctgaagagtgacatctacctggagtacaccaggactggaagtgagagccccaaggtgtgcagcgaccagagcagcggcagcggcaccgggaagggcatcagcggctacctgcccaccctgaatgaagatgaggagtggaagtgtgaccaggacatggatgaagatgatggaagagatgctgcccctcctggccgcctgccccagaagctgctgctggagacagctgccccccgggtgagcagcagccgccgctacagcgagggccgggagttccgctatggctcctggagggagcctgtgaacccctactacgtgaatgccggctacgccctggccccagccaccagcgccaatgattctgagcagcagagcctgagcagtgatgctgacaccctgagcctgacagacagctctgtggatggcatccccccctaccgcatcaggaagcagcacagaagagagatgcaggagagcgtgcaggtgaatggccgggtgcccctgccccacatccccaggacctacagagtgcccaaggaggtgcgggtggagccccagaagtttgctgaggagctgatccaccggctggaggccgtgcagaggacccgggaggccgaggagaagctggaggagcggctgaagagggtgaggatggaggaggagggagaagatggagaccccagcagcggccccccaggcccctgccacaagctgcccccagccccagcctggcaccacttccccccaagatgtgtggacatgggctgtgccggcctgagagatgcccatgaagaaaatcctgagagcatcctggatgagcacgtgcagagggtgctgcggaccccaggccggcagagccctggccctggccacaggagcccagacagcggccacgtggccaagatgcctgtggccctgggcggggccgccagcggccacggcaagcacgtgcccaagagcggggccaagctggatgctgctggcctgcaccaccaccgccacgtgcaccaccacgtgcaccacagcacagcccggcccaaggagcaggtggaggccgaggccacccggcgggcccagagcagctttgcctggggcctggagccccacagccatggagcccggagccggggctacagcgagagcgtgggcgccgccccaaatgccagtgatggcctggcccacagcggcaaggtgggcgtggcctgcaagagaaatgccaagaaggccgagagcggcaagagcgccagcacagaggtgcctggggcctctgaagatgctgagaagaaccagaagatcatgcagtggatcattgaaggagagaaggagatcagccgccacagaagaactggacatggcagcagcggcaccaggaagccccagccccatgagaacagccggcccctgagcctggagcacccctgggccggcccccagctgcggacctctgtgcagcccagccacctgttcatccaggaccccaccatgccaccccacccagcccccaaccccctgacccagctggaggaggcccggcggcggctggaggaggaggagaagagggccagccgggcccccagcaagcagcgctacgtgcaggaggtgatgaggcggggccgggcctgtgtgcggcctgcctgtgcccctgtgctgcacgtggtgcctgctgtgtctgacatggagctgtctgaaacagagaccaggagccagaggaaggtgggcggcggcagcgcccagccctgtgacagcatcgtggtggcctactacttctgtggggagcccatcccctaccgcaccctggtgcggggccgggctgtgaccctgggccagttcaaggagctgctgaccaagaagggcagctaccgctactacttcaagaaggtgtctgatgaatttgactgtggggtggtgtttgaggaggtgcgggaggatgaagctgtgctgcctgtgtttgaggagaagatcatcggcaaggtggagaaggtggactag

SEQ ID NO: 18454 - DNA, 2481 bp, Artificial Sequence
  Description of Artificial Sequence: Synthetic coding sequence
atgaacatccaggagcagggcttccccctggacctgggcgccagcttcacagaagatgcccccaggcctcctgtgcctggagaggagggggagctggtgtccacagaccccaggcctgccagctacagcttctgcagcggcaagggcgtgggcatcaagggggagaccagcacagccaccccccggcggagtgacctggacctgggctatgagcctgagggcagcgccagccccaccccaccctacctgaagtgggccgagagcctgcacagcctgctggatgaccaggacggcatcagcctcttccgcaccttcctgaagcaggagggctgtgccgacctgctggacttctggtttgcctgcaccggcttcaggaagctggagccctgtgacagcaatgaggagaagaggctgaagctggcccgggccatctacaggaagtacatcctggacaacaatggaattgtgtcccggcagaccaagccagccaccaagagcttcatcaagggctgcatcatgaagcagctgattgatcctgccatgtttgaccaggcccagacagagatccaggccaccatggaggagaacacctaccccagcttcctgaagagtgacatctacctggagtacaccaggactggaagtgagagccccaaggtgtgcagcgaccagagcagcggcagcggcaccgggaagggcatcagcggctacctgcccaccctgaatgaagatgaggagtggaagtgtgaccaggacatggatgaagatgatggaagagatgctgcccctcctggccgcctgccccagaagctgctgctggagacagctgccccccgggtgagcagcagccgccgctacagcgagggccgggagttccgctatggctcctggagggagcctgtgaacccctactacgtgaatgccggctacgccctggccccagccaccagcgccaatgattctgagcagcagagcctgagcagtgatgctgacaccctgagcctgacagacagctctgtggatggcatccccccctaccgcatcaggaagcagcacagaagagagatgcaggagagcgtgcaggtgaatggccgggtgcccctgccccacatccccaggacctacagagtgcccaaggaggtgcgggtggagccccagaagtttgctgaggagctgatccaccggctggaggccgtgcagaggacccgggaggccgaggagaagctggaggagcggctgaagagggtgaggatggaggaggagggagaagatggagaccccagcagcggccccccaggcccctgccacaagctgcccccagccccagcctggcaccacttccccccaagatgtgtggacatgggctgtgccggcctgagagatgcccatgaagaaaatcctgagagcatcctggatgagcacgtgcagagggtgctgcggaccccaggccggcagagccctggccctggccacaggagcccagacagcggccacgtggccaagatgcctgtggccctgggcggggccgccagcggccacggcaagcacgtgcccaagagcggggccaagctggatgctgctggcctgcaccaccaccgccacgtgcaccaccacgtgcaccacagcacagcccggcccaaggagcaggtggaggccgaggccacccggcgggcccagagcagctttgcctggggcctggagccccacagccatggagcccggagccggggctacagcgagagcgtgggcgccgccccaaatgccagtgatggcctggcccacagcggcaaggtgggcgtggcctgcaagagaaatgccaagaaggccgagagcggcaagagcgccagcacagaggtgcctggggcctctgaagatgctgagaagaaccagaagatcatgcagtggatcattgaaggagagaaggagatcagccgccacagaagaactggacatggcagcagcggcaccaggaagccccagccccatgagaacagccggcccctgagcctggagcacccctgggccggcccccagctgcggacctctgtgcagcccagccacctgttcatccaggaccccaccatgccaccccacccagcccccaaccccctgacccagctggaggaggcccggcggcggctggaggaggaggagaagagggccagccgggcccccagcaagcagaggaccaggagccagaggaaggtgggcggcggcagcgcccagccctgtgacagcatcgtggtggcctactacttctgtggggagcccatcccctaccgcaccctggtgcggggccgggctgtgaccctgggccagttcaaggagctgctgaccaagaagggcagctaccgctactacttcaagaaggtgtctgatgaatttgactgtggggtggtgtttgaggaggtgcgggaggatgaagctgtgctgcctgtgtttgaggagaagatcatcggcaaggtggagaaggtggactag

SEQ ID NO: 18455 - DNA, 309 bp, Artificial Sequence
  Description of Artificial Sequence: Synthetic coding sequence
tgactggaggaggaggagaagagggccagccgggcccccagcaagcagaggaccaggagccagaggaaggtgggcggcggcagcgcccagccctgtgacagcatcgtggtggcctactacttctgtggggagcccatcccctaccgcaccctggtgcggggccgggctgtgaccctgggccagttcaaggagctgctgaccaagaagggcagctaccggccccccagccacctgcgctgctgcctgctgacagccctgctgacctctgtgctgcagatcctgctgcaggagagcgagcggcgggtgtag

SEQ ID NO: 18456 - DNA, 1824 bp, Artificial Sequence
  Description of Artificial Sequence: Synthetic coding sequence
atggtgtgcaccaggaagaccaagaccctggtgtccacctgtgtgatcctgagcggcatgaccaacatcatctgcctgctgtatgtgggctgggtgaccaactacatcgcctctgtgtatgtgcggggccaggagcccgccccagacaagaagctggaggaggacaagggggacaccctgaagatcatcgagcggctggaccacctggagaatgtcatcaagcagcacatccaggaggccccagccaagccagaggaggccgaggccgagcccttcacagacagcagcctgtttgcccactggggccaggagctgagccctgagggccggcgggtggccctgaagcagttccagtactacggctacaatgcctacctgagtgaccggctgcccctggaccggcccctgcctgacctgcggcccagcggctgcaggaacctgtccttcccagacagcctgcctgaggtgtccatcgtgttcatctttgtgaatgaggccctgtctgtgctgctgcggagcatccacagcgccatggagaggaccccaccccacctgctgaaggagatcatcctggtggatgacaacagcagcaatgaggagctgaaggagaagctgacagaatatgtggacaaggtgaacagccagaagccaggcttcatcaaggtggtgcgccacagcaagcaggagggcctcatccgcagccgggtgtctggctggagggctgccacagcccctgtggtggccctgtttgatgcccacgtggagttcaacgtgggctgggccgagcctgtgctgacccgcatcaaggagaacaggaagaggatcatcagccccagctttgacaacatcaagtatgacaactttgaaattgaggagtaccccctggccgcccagggctttgactgggagctgtggtgccgctacctgaacccccccaaggcctggtggaagctggagaacagcacagcccccatccgcagccctgccctgattggctgcttcatcgtggaccggcagtacttccaggagatcggcctgctggatgagggcatggaggtgtatggaggagaaaatgtggagctgggcatccgggtgtggcagtgtggcggctctgtggaggtgctgccctgcagccgcatcgcccacatcgagcgggcccacaagccctacacagaggacctgacagcccacgtgagaagaaatgccctgcgggtggccgaggtgtggatggatgagttcaagagccacgtgtacatggcctggaacatcccccaggaggacagcggcatcgacatcggggacatcacagccaggaaggccctgaggaagcagctgcagtgcaagaccttccgctggtacctggtgtctgtgtacccagagatgaggatgtacagcgacatcatcgcctacggcgtgctgcagaacagcctgaagacagacctgtgcctggaccagggccctgacacagaaaatgtgcccatcatgtacatctgccacggcatgaccccccagaatgtgtactacaccagcagccagcagatccacgtgggcatcctgagccccaccgtggatgatgatgacaaccgctgcctggtggatgtgaacagccggccccggctgattgagtgcagctatgccaaggccaagaggatgaagctgcactggcagttcagccagggcggccccatccagaacaggaagagcaagcgctgcctggagctgcaggagaacagcgacctggagtttggcttccagctggtgctgcagaagtgcagcggccagcactggagcatcaccaacgtgctgcggagcctggccagctag

SEQ ID NO: 18457 - DNA, 1710 bp, Artificial Sequence
  Description of Artificial Sequence: Synthetic coding sequence
atgagcacctacagcaccttccctgctggggtgcctgtgtctgagaggagcctggcccgggccggcttctactacacaggagtgaatgacaaggtgaagtgcttctgctgcggcctgatgctggacaactggaagctgggggacagccccatccagaagcacaagcagctgtaccccagctgcagcttcatccagaacctggtgtctgccagcctgggcagcaccagcaagaacaccagccccatgagaaattcctttgcccacagcctgagccccaccctggagcacagcagcctcttcagcggcagctacagcagcctgagccccaaccccctgaacagcagagctgtggaggacatcagcagcagcaggaccaacccctacagctatgccatgagcacagaggaggcccgcttcctgacctaccacatgtggcccctgaccttcctgagccccagcgagctggcccgggccggcttctactacatcggccctggggacagagtggcctgctttgcctgtggcggcaagctgagcaactgggagcccaaggatgatgccatgtctgagcaccggcggcacttccccaactgccccttcctggagaacagcctggagaccctgcgcttcagcatcagcaacctgtccatgcagacccatgctgccaggatgaggaccttcatgtactggcccagctctgtgcctgtgcagcctgagcagctggccagcgctggcttctactacgtgggcagaaatgatgatgtgaagtgcttctgctgtgatggcggcctgcgctgctgggagagcggagatgacccctgggtggagcacgccaagtggttcccccgctgtgagttcctgatccgcatgaagggccaggagtttgtggatgagatccagggccgctacccccacctgctggagcagctgctgagcaccagtgacaccactggagaggagaatgctgacccccccatcatccactttggacctggagagagcagcagtgaagatgctgtgatgatgaacacccctgtggtgaagagcgccctggagatgggcttcaacagagacctggtgaagcagacagtgcagagcaagatcctgaccactggagagaactacaagacagtgaatgacatcgtgtctgccctgctgaatgcagaagatgagaagcgggaggaggagaaggagaagcaggccgaggagatggccagtgatgacctgagcctcatcaggaagaacaggatggccctcttccagcagctgacctgtgtgctgcccatcctggacaacctgctgaaggccaacgtcatcaacaagcaggagcatgacatcatcaagcagaagacccagatccccctgcaggcccgggagctgattgacaccatcctggtgaagggaaatgctgctgccaacatcttcaagaactgcctgaaggagattgacagcaccctgtacaagaacctgtttgtggacaagaacatgaagtacatccccacagaagatgtgtctggcctgagcctggaggagcagctgcggcggctgcaggaggagaggacctgcaaggtgtgcatggacaaggaggtgtctgtggtgttcatcccctgtggccacctggtggtgtgccaggagtgtgcccccagcctgaggaagtgccccatctgccggggcatcatcaagggcaccgtgaggaccttcctgtcctag

SEQ ID NO: 18458 - DNA, 1794 bp, Artificial Sequence
  Description of Artificial Sequence: Synthetic coding sequence
atggaggacagcaccatcctgagtgactggaccaacagcaacaagcagaagatgaagtatgacttcagctgtgagctgtacaggatgagcacctacagcaccttccctgctggggtgcctgtgtctgagaggagcctggcccgggccggcttctactacacaggagtgaatgacaaggtgaagtgcttctgctgcggcctgatgctggacaactggaagctgggggacagccccatccagaagcacaagcagctgtaccccagctgcagcttcatccagaacctggtgtctgccagcctgggcagcaccagcaagaacaccagccccatgagaaattcctttgcccacagcctgagccccaccctggagcacagcagcctcttcagcggcagctacagcagcctgagccccaaccccctgaacagcagagctgtggaggacatcagcagcagcaggaccaacccctacagctatgccatgagcacagaggaggcccgcttcctgacctaccacatgtggcccctgaccttcctgagccccagcgagctggcccgggccggcttctactacatcggccctggggacagagtggcctgctttgcctgtggcggcaagctgagcaactgggagcccaaggatgatgccatgtctgagcaccggcggcacttccccaactgccccttcctggagaacagcctggagaccctgcgcttcagcatcagcaacctgtccatgcagacccatgctgccaggatgaggaccttcatgtactggcccagctctgtgcctgtgcagcctgagcagctggccagcgctggcttctactacgtgggcagaaatgatgatgtgaagtgcttctgctgtgatggcggcctgcgctgctgggagagcggagatgacccctgggtggagcacgccaagtggttcccccgctgtgagttcctgatccgcatgaagggccaggagtttgtggatgagatccagggccgctacccccacctgctggagcagctgctgagcaccagtgacaccactggagaggagaatgctgacccccccatcatccactttggacctggagagagcagcagtgaagatgctgtgatgatgaacacccctgtggtgaagagcgccctggagatgggcttcaacagagacctggtgaagcagacagtgcagagcaagatcctgaccactggagagaactacaagacagtgaatgacatcgtgtctgccctgctgaatgcagaagatgagaagcgggaggaggagaaggagaagcaggccgaggagatggccagtgatgacctgagcctcatcaggaagaacaggatggccctcttccagcagctgacctgtgtgctgcccatcctggacaacctgctgaaggccaacgtcatcaacaagcaggagcatgacatcatcaagcagaagacccagatccccctgcaggcccgggagctgattgacaccatcctggtgaagggaaatgctgctgccaacatcttcaagaactgcctgaaggagattgacagcaccctgtacaagaacctgtttgtggacaagaacatgaagtacatccccacagaagatgtgtctggcctgagcctggaggagcagctgcggcggctgcaggaggagaggacctgcaaggtgtgcatggacaaggaggtgtctgtggtgttcatcccctgtggccacctggtggtgtgccaggagtgtgcccccagcctgaggaagtgccccatctgccggggcatcatcaagggcaccgtgaggaccttcctgtcctag

SEQ ID NO: 18459 - DNA, 1605 bp, Artificial Sequence
  Description of Artificial Sequence: Synthetic coding sequence
atgcacaagacagccagccagaggctcttccctggccccagctaccagaacatcaagagcatcatggaggacagcaccatcctgagtgactggaccaacagcaacaagcagaagatgaagtatgacttcagctgtgagctgtacaggatgagcacctacagcaccttccctgctggggtgcctgtgtctgagaggagcctggcccgggccggcttctactacacaggagtgaatgacaaggtgaagtgcttctgctgcggcctgatgctggacaactggaagctgggggacagccccatccagaagcacaagcagctgtaccccagctgcagcttcatccagaacctggtgtctgccagcctgggcagcaccagcaagaacaccagccccatgaggaacagctttgcccacagcctgagccccaccctggagcacagcagcctcttcagcggcagctacagcagcctgagccccaaccccctgaacagcagagctgtggaggacatcagcagcagcaggaccaacccctacagctatgccatgagcacagaggaggcccgcttcctgacctaccacatgtggcccctgaccttcctgagccccagcgagctggcccgggccggcttctactacatcggccctggggacagagtggcctgctttgcctgtggcggcaagctgagcaactgggagcccaaggatgatgccatgtctgagcacagaagacacttccccaactgccccttcctggagaacagcctggagaccctgcgcttcagcatcagcaacctgtccatgcagacccacgccgccaggatgaggaccttcatgtactggcccagctctgtgcctgtgcagcctgagcagctggccagcgctggcttctactacgtgggcagaaatgatgatgtgaagtgcttctgctgtgatggcggcctgcgctgctgggagagcggagatgacccctgggtggagcacgccaagtggttcccccgctgtgagttcctgatccgcatgaagggccaggagtttgtggatgagatccagggccgctacccccacctgctggagcagctgctgagcaccagtgacaccaccggggaggagaatgctgacccccccatcatccacttcggccctggagagagcagcagtgaagatgctgtgatgatgaacacccctgtggtgaagagcgccctggagatgggcttcaacagagacctggtgaagcagacagtgcagagcaagatcctgaccaccggggagaactacaagacagtgaatgacatcgtgtctgccctgctgaatgcagaagatgagaagcgggaggaggagaaggagaagcaggccgaggagatggccagtgatgacctgagcctcatcaggaagaacaggatggccctcttccagcagctgacctgtgtgctgcccatcctggacaacctgctgaaggccaacgtcatcaacaagcaggagcatgacatcatcaagcagaagacccagatccccctgcaggcccgggagctgattgacaccatcctggtgaagggaaatgctgctgccaacatcttcaagaactgcctgaaggtgaagcagcgcttctag

SEQ ID NO: 18460 - DNA, 1815 bp, Artificial Sequence
  Description of Artificial Sequence: Synthetic coding sequence
atgaacatcgtggagaacagcatcttcctgagcaacctgatgaagagcgccaacacctttgagctgaagtatgacctgagctgtgagctgtacaggatgagcacctacagcaccttccctgctggggtgcctgtgtctgagaggagcctggcccgggccggcttctactacacaggagtgaatgacaaggtgaagtgcttctgctgcggcctgatgctggacaactggaagagaggagacagccccacagagaagcacaagaagctgtaccccagctgccgctttgtgcagagcctgaacagcgtgaacaacctggaggccaccagccagcccaccttccccagctctgtgaccaacagcacccacagcctgctgcccggcacagaaaattctggctacttccggggcagctacagcaacagccccagcaaccctgtgaacagccgggccaaccaggacttcagcgccctgatgaggagcagctaccactgtgccatgaacaatgaaaatgcccggctgctgaccttccagacctggcccctgaccttcctgagccccacagacctggccaaggccggcttctactacatcggccctggggacagagtggcctgctttgcctgtggcggcaagctgagcaactgggagcccaaggacaatgccatgtctgagcacctgcggcacttccccaagtgccccttcatcgagaaccagctgcaggacaccagccgctacacagtgagcaacctgtccatgcagacccacgccgcccgcttcaagaccttcttcaactggcccagctctgtgctggtgaaccctgagcagctggccagcgctggcttctactacgtgggcaacagtgatgatgtgaagtgcttctgctgtgatggcggcctgcgctgctgggagagcggagatgacccctgggtgcagcacgccaagtggttcccccgctgtgagtacctgatccgcatcaagggccaggagttcatccggcaggtgcaggccagctacccccacctgctggagcagctgctgagcaccagtgacagccctggagatgaaaatgctgagagcagcatcatccactttgagcccggggaggaccacagtgaagatgccatcatgatgaacacccctgtgatcaatgctgctgtggagatgggcttcagccgcagcctggtgaagcagacagtgcagaggaagatcctggccaccggggagaactaccgcctggtgaatgacctggtgctggacctgctgaatgcagaagatgagatccgggaggaggagcgggagcgggccacagaggagaaggagagcaatgacctgctgctgatcaggaagaacaggatggccctcttccagcacctgacctgtgtgatccccatcctggacagcctgctgacagctggcatcatcaatgagcaggagcatgatgtgatcaagcagaagacccagaccagcctgcaggcccgggagctgattgacaccatcctggtgaagggcaacattgctgccaccgtcttcaggaacagcctgcaggaggccgaggccgtgctgtatgagcacctgtttgtgcagcaggacatcaagtacatccccacagaagatgtgtctgacctgcctgtggaggagcagctgcggcggctgcaggaggagaggacctgcaaggtgtgcatggacaaggaggtgtccatcgtgttcatcccctgtggccacctggtggtgtgcaaggactgtgcccccagcctgaggaaatgtcccatctgccgcagcaccatcaagggcaccgtgaggaccttcctgtcctag

SEQ ID NO: 18461 - DNA, 1815 bp, Artificial Sequence; identical to SEQ ID NO: 18460
  Description of Artificial Sequence: Synthetic coding sequence

SEQ ID NO: 18462 - DNA, 498 bp, Artificial Sequence
  Description of Artificial Sequence: Synthetic coding sequence
atgggcgcccccaccctgcccccagcctggcagcccttcctgaaggaccaccgcatcagcaccttcaagaactggcccttcctggagggctgtgcctgcaccccagagaggatggccgaggccggcttcatccactgccccacagaaaatgaaccagacctggcccagtgcttcttctgcttcaaggagctggagggctgggagccagatgatgaccccatcggccctggcaccgtggcctatgcctgcaacaccagcaccctgggcggccggggcggccgcatcacccgggaggagcacaagaagcacagcagcggctgtgccttcctgtctgtgaagaagcagtttgaggagctgaccctgggggagttcctgaagctggaccgggagcgggccaagaacaagatcgccaaggagaccaacaacaagaagaaggagtttgaggagacagctgagaaggtgagaagagccatcgagcagctggccgccatggactag

SEQ ID NO: 18463 - DNA, 429 bp, Artificial Sequence
  Description of Artificial Sequence: Synthetic coding sequence
atgggcgcccccaccctgcccccagcctggcagcccttcctgaaggaccaccgcatcagcaccttcaagaactggcccttcctggagggctgtgcctgcaccccagagaggatggccgaggccggcttcatccactgccccacagaaaatgaaccagacctggcccagtgcttcttctgcttcaaggagctggagggctgggagccagatgatgaccccatcgaggagcacaagaagcacagcagcggctgtgccttcctgtctgtgaagaagcagtttgaggagctgaccctgggggagttcctgaagctggaccgggagcgggccaagaacaagatcgccaaggagaccaacaacaagaagaaggagtttgaggagacagctgagaaggtgcggcgggccatcgagcagctggccgccatggactag

SEQ ID NO: 18464 - DNA, 414 bp, Artificial Sequence
  Description of Artificial Sequence: Synthetic coding sequence
atgggcgcccccaccctgcccccagcctggcagcccttcctgaaggaccaccgcatcagcaccttcaagaactggcccttcctggagggctgtgcctgcaccccagagaggatggccgaggccggcttcatccactgccccacagaaaatgaaccagacctggcccagtgcttcttctgcttcaaggagctggagggctgggagccagatgatgaccccatgcagaggaagcccaccatccggaggaagaacctgaggaagctgcggaggaaatgtgctgtgcccagcagctcctggctgccctggattgaggccagcggccgcagctgcctggtgcctgagtggctgcaccacttccagggcctcttccctggggccaccagcctgcctgtgggccccctggccatgtcctag

SEQ ID NO: 18465 - DNA, 432 bp, Artificial Sequence
  Description of Artificial Sequence: Synthetic coding sequence
atgggcgcccccaccctgcccccagcctggcagcccttcctgaaggaccaccgcatcagcaccttcaagaactggcccttcctggagggctgtgcctgcaccccagagaggatggccgaggccggcttcatccactgccccacagaaaatgaaccagacctggcccagtgcttcttctgcttcaaggagctggagggctgggagccagatgatgaccccatcggccctggcaccgtggcctatgcctgcaacaccagcaccctgggcggccggggcggccgcatcacccgggaggagcacaagaagcacagcagcggctgtgccttcctgtctgtgaagaagcagtttgaggagctgaccctgggggagttcctgaagctggaccgggagcgggccaagaacaagattgaaagagccctgctggccgagtag

SEQ ID NO: 18466 - DNA, 14574 bp, Artificial Sequence
  Description of Artificial Sequence: Synthetic coding sequence
atggtgactggaggaggagctgcccctcctggcaccgtgacagagcccctgcccagcgtgattgtgctgtctgctggcaggaagatggctgctgctgctgctgctgccagcggccctggctgcagcagcgctgctggagctggagctgctggggtgtctgagtggctggtgctgagagatggctgcatgcactgtgatgctgatggcctgcacagcctgagctaccacccagccctgaatgccatcctggccgtgaccagccggggcaccatcaaggtgattgatggcaccagcggggccaccctgcaggccagcgccctgagcgccaagccaggcggccaggtgaagtgccagtacatctctgctgtggacaaggtgatctttgtggatgattatgctgtgggctgcaggaaggacctgaatggcatcctgctgctggacacagccctgcagacccctgtgtccaagcaggatgatgtggtgcagctggagctgcctgtgacagaggcccagcagctgctgagcgcctgcctggagaaggtggacatcagcagcacagagggctatgacctcttcatcacccagctgaaggatggcctgaagaacaccagccatgaaacagctgccaaccacaaggtggccaagtgggccaccgtgaccttccacctgccccaccacgtgctgaagagcatcgccagcgccatcgtgaatgagctgaagaagatcaaccagaatgtggccgccctgcctgtggccagctctgtgatggaccggctgagctacctgctgcccagcgcccggcctgagctgggcgtgggccctggccgctctgtggacaggagcctgatgtacagcgaggccaacagaagagagaccttcacctcctggccccacgtgggctaccgctgggcccagcctgaccccatggcccaggccggcttctaccaccagcctgccagcagtggagatgaccgggccatgtgcttcacctgcagcgtgtgcctggtgtgctgggagcccacagatgagccctggagcgagcacgagcggcacagccccaactgcccctttgtgaagggggagcacacccagaatgtgcccctgtctgtgaccctggccaccagccctgcccagttcccctgcacagatggaacagaccgcatcagctgctttggaagtggcagctgcccccacttcctggccgccgccaccaagaggggcaagatctgcatctgggatgtgtccaagctgatgaaggtgcacctgaagtttgagatcaatgcctatgaccctgccatcgtgcagcagctgatcctgagcggggaccccagcagtggagtggacagccggcggcccaccctggcctggctggaggacagcagcagctgcagcgacatccccaagctggagggggacagtgatgacctgctggaggacagcgacagcgaggagcacagcagaagtgacagcgtgacaggccacaccagccagaaggaggccatggaggtgtccctggacatcacagccctgagcatcctgcagcagcctgagaagctgcagtgggagatcgtggccaacgtgctggaggacacagtgaaggacctggaggagctgggcgccaacccctgcctgaccaacagcaagtctgagaagaccaaggagaagcaccaggagcagcacaacatccccttcccctgcctgctggccggcggcctgctgacctacaagagccctgccaccagccccatcagcagcaacagccacaggagcctggatggcctgagcaggacccagggcgagagcatcagcgagcagggcagcacagacaatgaaagctgcaccaacagcgagctgaacagccccctggtgcggaggaccctgcctgtgctgctgctgtacagcatcaaggagagtgatgagaaggccggcaagatcttcagccagatgaacaacatcatgagcaagagcctgcatgatgatggcttcaccgtgccccagatcatcgagatggagctggacagccaggagcagctgctgctgcaggacccccctgtgacctacatccagcagtttgctgatgctgctgccaacctgaccagcccagattctgagaagtggaacagcgtcttccccaagccaggcaccctggtgcagtgcctgcggctgcccaagtttgctgaggaggagaacctgtgcatcgacagcatcaccccctgtgctgatggcatccacctgctggtgggcctgcggacctgccctgtggagagcctgagcgccatcaaccaggtggaggccctgaacaacctgaacaagctgaacagcgccctgtgcaacagaagaaaaggagagctggagagcaacctggccgtggtgaatggagccaacatcagcgtcatccagcacgagagccctgcagatgtgcagacccccctcatcatccagcctgagcagagaaatgtgtctgggggctacctggtgctgtacaagatgaactatgccacccgcatcgtgaccctggaggaggagcccatcaagatccagcacatcaaggacccccaggacaccatcaccagcctcatcctgctgcccccagacatcctggacaacagagaagatgactgtgaggagcccatcgaggacatgcagctgaccagcaagaatggatttgagcgggagaagaccagtgacatcagcaccctgggccacctggtgatcaccacccagggcggctacgtgaagatcctggacctgagcaactttgagatcctggccaaggtggagccccccaagaaggagggcacagaggagcaggacacctttgtgtctgtcatctactgcagcggcacagaccggctgtgtgcctgcaccaagggcggggagctgcacttcctgcagatcggcggcacctgtgatgacattgatgaggccgacatcctggtggatggcagcctgagcaagggcatcgagcccagcagcgagggcagcaagcccctgagcaaccccagcagccctggcatctctggagtggacctgctggtggaccagcccttcaccctggagatcctgaccagcctggtggagctgaccaggtttgagaccctgaccccccgcttcagcgccaccgtgcccccctgctgggtggaggtgcagcaggagcagcagcagaggaggcacccccagcacctgcaccagcagcaccacggagatgctgcccagcacaccaggacctggaagctgcagacagacagcaacagctgggatgaacatgtgtttgagctggtgctgcccaaggcctgcatggtgggccacgtggacttcaagtttgtgctgaacagcaacatcaccaacatcccccagatccaggtgaccctgctgaagaacaaggcccctggcctgggcaaggtgaatgccctgaacatcgaggtggagcagaatggcaagcccagcctggtggacctgaatgaggagatgcagcacatggatgtggaggagagccagtgcctgcggctgtgccccttcctggaggaccacaaggaggacatcctgtgtggccctgtgtggctggccagcggcctggacctgagcggccacgccggcatgctgaccctgaccagccccaagctggtgaagggcatggccggcggcaagtaccgctccttcctgattcatgtgaaggctgtgaatgaaagaggaacagaggagatctgcaatggaggcatgaggcctgtggtgcggctgcccagcctgaagcaccagagcaacaagggctacagcctggccagcctgctggccaaggtggccgccggcaaggagaagagcagcaatgtgaagaatgaaaacaccagcggcaccaggaagtctgagaacctgcggggctgtgacctgctgcaggaggtgtctgtgaccatccgccgcttcaagaagaccagcatcagcaaggagcgggtgcagagatgtgccatgctgcagttcagcgagttccacgagaagctggtgaacaccctgtgcaggaagacagatgatggccagatcacagaacatgcccagagcctggtgctggacaccctgtgctggctggccggcgtgcacagcaatggacctggcagcagcaaggagggcaatgaaaacctgctgagcaagaccaggaagttcctgagtgacatcgtgcgggtgtgcttctttgaggccggccgcagcatcgcccacaagtgtgcccgcttcctggccctgtgcatcagcaatggaaaatgtgacccctgccagcctgccttcggccctgtgctgctgaaggccctgctggacaacatgtccttcctgcctgctgccaccaccggcggctctgtgtactggtactttgtgctgctgaactacgtgaaggatgaggacctggccggctgcagcacagcctgtgccagcctgctgacagctgtgtcccggcagctgcaggaccggctgacccccatggaggccctgctgcagaccaggtatggcctgtacagcagcccctttgatcctgtgctgtttgacctggagatgagcggcagcagctgcaagaatgtgtacaacagcagcattggagtgcagagtgatgaaattgacctgagtgatgtgctgtctggaaatggcaaggtgagcagctgcacagctgctgagggcagcttcaccagcctgaccggcctgctggaggtggagcccctgcacttcacctgtgtgtccaccagtgatggcaccagaattgaaagagatgatgccatgagcagctttggagtgaccccagctgtgggcggcctgagcagcggcaccgtgggggaggccagcacagccctgagcagcgctgcccaggtggccctgcagagcctgagccacgccatggccagcgctgagcagcagctgcaggtgctgcaggagaagcagcagcagctgctgaagctgcagcagcagaaggccaagctggaggccaagctgcaccagaccacagctgctgctgctgctgctgccagcgctgtgggccctgtgcacaacagcgtgcccagcaaccctgtggccgcccctggcttcttcatccaccccagtgatgtgattcctcccacccccaagaccacccccctcttcatgaccccacccctgaccccaccaaatgaagctgtgtctgtggtgatcaatgctgagctggcccagctgtttcctggctctgtgattgatcctcctgctgtgaacctggccgcccacaacaagaacagcaacaagagcaggatgaaccccctgggcagcggcctggccctggccatcagccacgccagccacttcctgcagcccccaccccaccagagcatcatcatcgagaggatgcacagcggggccaggagatttgtgaccctggactttggccggcccatcctgctgacagatgtgctgatccccacctgtggggacctggccagcctgagcattgacatctggaccctgggggaggaggtggatggaagaaggctggtggtggccacagacatcagcacccacagcctcatcctgcatgacctgatccccccacctgtgtgccgcttcatgaagatcaccgtgattggccgctatggcagcaccaatgcccgggccaagatccccctgggcttctactacggccacacctacatcctgccctgggagagcgagctgaagctgatgcatgaccccctgaagggggagggggagagcgccaaccagcctgagattgaccagcacctggccatgatggtggccctgcaggaggacatccagtgccgctacaacctggcctgccaccggctggagaccctgctgcagagcattgacctgccccccctgaacagcgccaacaatgcccagtacttcctgaggaagccagacaaggctgtggaggaggacagcagggtcttcagcgcctaccaggactgcatccagctgcagctgcagctgaacctggcccacaatgctgtgcagaggctgaaggtggccctgggcgccagcaggaagatgctgtctgagaccagcaaccctgaggacctgatccagaccagcagcacagagcagctgcggaccatcatccgctacctgctggacaccctgctgagcctgctgcacgccagcaatggccacagcgtgcctgctgtgctgcagagcaccttccacgcccaggcctgtgaggagctgttcaagcacctgtgcatcagcggcacccccaagatccggctgcacacaggcctgctgctggtgcagctgtgtggcggggagcgctggtggggccagttcctgagcaatgtgctgcaggagctgtacaacagcgagcagctgctgatcttcccccaggacagagtcttcatgctgctgagctgcatcggccagaggagcctgagcaacagcggcgtgctggagagcctgctgaacctgctggacaacctgctgagccccctgcagccccagctgcccatgcacagaagaacagaaggagtgctggacatccccatgatctcctgggtggtgatgctggtgtcccggctgctggactatgtggccaccgtggaggatgaagctgctgctgccaagaagcccctgaatggaaaccagtggagcttcatcaacaacaacctgcacacccagagcctgaacagaagcagcaagggcagcagcagcctggaccggctgtacagcaggaagatcaggaagcagctggtgcaccacaagcagcagctgaacctgctgaaggccaagcagaaggccctggtggagcagatggagaaggagaagatccagagcaacaagggcagcagctacaagctgctggtggagcaggccaagctgaagcaggccaccagcaagcacttcaaggacctgatccggctgcggaggacagctgagtggagccgcagcaacctggacacagaggtgaccacagccaaggagagccctgagattgagcccctgcccttcaccctggcccacgagcgctgcatctctgtggtgcagaagctggtgctcttcctgctgtccatggacttcacctgccacgccgacctgctgctgtttgtgtgcaaggtgctggccagaattgccaatgccacccggcccaccatccacctgtgtgagatcgtgaatgagccccagctggagcggctgctgctgctgctggtgggcacagacttcaacagaggagacatctcctggggcggggcctgggcccagtacagcctgacctgcatgctgcaggacatcctggccggggagctgctggcccctgtggccgctgaggccatggaggagggcaccgtgggagatgatgtgggcgccacagctggggacagtgatgacagcctgcagcagagctctgtgcagctgctggagaccattgatgagcccctgacccatgacatcactggagccccacccctgagcagcctggagaaggacaaggagattgacctggagctgctgcaggacctgatggaggtggacatcgaccccctggacatcgacctggagaaggaccccctggccgccaaggtgttcaagcccatcagcagcacctggtatgactactggggcgctgactatggcacctacaactacaacccctacatcggcggcctgggcatccctgtggccaagcccccagccaacacagagaagaatggcagccagacagtgtctgtgtctgtgtcccaggccctggatgcccggctggaggtgggcctggagcagcaggccgagctgatgctgaagatgatgagcaccctggaggccgacagcatcctgcaggccctgaccaacaccagccccaccctgagccagagccccaccggcacagatgacagcctgctgggcggcctgcaggccgccaaccagaccagccagctgatcatccagctgagctctgtgcccatgctgaatgtgtgcttcaacaagctgttctccatgctgcaggtgcaccacgtgcagctggagagcctgctgcagctgtggctgaccctgagcctgaacagcagcagcacaggcaacaaggaaaatggagctgacatcttcctgtacaatgccaaccgcatccctgtgatcagcctgaaccaggccagcatcaccagcttcctgactgtgctggcctggtaccccaacaccctgctgcggacctggtgcctggtgctgcacagcctgaccctgatgaccaacatgcagctgaacagcggcagcagcagcgccatcggcacccaggagagcacagcccacctgctggtgtctgaccccaacctgatccacgtgctggtgaagttcctgagcggcaccagcccccacggcaccaaccagcacagcccccaggtgggccccacagccacccaggccatgcaggagttcctgacccggctgcaggtgcacctgagcagcacctgcccccagatcttcagcgagttcctgctgaagctgatccacatcctgagcacagagcggggggccttccagacaggccagggccccctggatgcccaggtgaagctgctggagttcaccctggagcagaactttgaggtggtgtctgtgtccaccatctctgctgtgattgagagcgtgaccttcctggtgcaccactacatcacctgcagcgacaaggtgatgagccgcagcggcagtgacagctctgtgggcgcccgggcctgctttggaggcctgtttgccaacctgatccggcctggagatgccaaggctgtgtgtggggagatgacccgggaccagctgatgtttgacctgctgaagctggtgaacatcctggtgcagctgcccctgagcggcaaccgggagtacagcgcccgggtgtctgtgaccaccaacaccacagattctgtgtctgatgaggagaaggtgtctgggggcaaggatggaaatggcagcagcacctctgtgcagggcagccctgcctacgtggccgacctggtgctggccaaccagcagatcatgagccagatcctgagcgccctgggcctgtgcaacagcagcgccatggccatgatcatcggggccagcggcctgcacctgaccaagcatgagaacttccacggcggcctggatgccatctctgtgggagatggcctcttcaccatcctgaccaccctgagcaagaaggccagcacagtgcacatgatgctgcagcccatcctgacctacatggcctgtggctacatgggccggcagggcagcctggccacctgccagctgtctgagcccctgctgtggttcatcctgcgggtgctggacaccagtgatgccctgaaggccttccatgacatgggcggcgtgcagctgatctgcaacaacatggtgaccagcacccgggccatcgtgaacacagcccgctccatggtgtccaccatcatgaagttcctggacagcggccccaacaaggctgtggacagcaccctgaagacccgcatcctggccagcgagccagacaatgctgagggcatccacaactttgcccccctgggcaccatcaccagcagcagccccacagcccagcctgctgaggtgctgctgcaggccaccccaccccaccggcgggcccggtctgctgcctggagctacatcttcctgcctgaggaggcctggtgtgacctgaccatccacctgcctgctgctgtgctgctgaaggagatccacatccagccccacctggccagcctggccacctgccccagctctgtgtctgtggaggtgtctgcagatggagtgaacatgctgcccctgagcacccctgtggtgaccagcggcctgacctacatcaagatccagctggtgaaggccgaggtggccagcgctgtgtgcctgcggctgcaccggcccagagatgccagcaccctgggcctgagccagatcaagctgctgggcctgacagccttcggcaccaccagcagcgccaccgtgaacaaccccttcctgcccagcgaggaccaggtgtccaagaccagcatcggctggctgcggctgctgcaccactgcctgacccacatcagtgacctggagggcatgatggccagcgctgctgcccccacagccaacctgctgcagacctgtgccgccctgctgatgagcccctactgcggcatgcacagccccaacatcgaggtggtgctggtgaagattggcctgcagagcacccgcatcggcctgaagctgattgacatcctgctgaggaactgtgccgccagcggcagtgaccccacagacctgaacagccccctgctgtttggccgcctgaatggcctgagcagtgacagcaccatcgacatcctgtaccagctgggcaccacccaggaccccggcaccaaggaccgcatccaggccctgctgaagtgggtgtctgacagcgcccgggtggccgccatgaagaggagcggccgcatgaactacatgtgccccaacagcagcacagtggagtatggcctgctgatgcccagccccagccacctgcactgtgtggccgccatcctgtggcacagctatgagctgctggtggagtatgacctgcctgccctgctggaccaggagctgtttgagctgctcttcaactggagcatgagcctgccctgcaacatggtgctgaagaaggctgtggacagcctgctgtgcagcatgtgccacgtgcaccccaactacttcagcctgctgatgggctggatgggcatcaccccacctcctgtgcagtgccaccaccggctgtccatgacagatgacagcaagaagcaggacctgagcagcagcctgacagatgacagcaagaatgcccaggcccccctggccctgacagagagccacctggccaccctggccagcagcagccagagccctgaggccatcaagcagctgctggacagcggcctgcccagcctgctggtgcgcagcctggccagcttctgcttcagccacatcagcagcagcgagagcatcgcccagagcattgacatcagccaggacaagctgcggcggcaccacgtgccccagcagtgcaacaagatgcccatcacagctgacctggtggcccccatcctgcgcttcctgacagaggtgggcaacagccacatcatgaaggactggctgggcggcagcgaggtgaaccccctgtggacagccctgctcttcctgctgtgccacagcggcagcaccagcggcagccacaacctgggcgcccagcagaccagcgcccggagcgccagcctgagcagcgctgccaccaccggcctgaccacccagcagaggacagccattgaaaatgccaccgtggccttcttcctgcagtgcatcagctgccaccccaacaaccagaagctgatggcccaggtgctgtgtgagctgttccagaccagcccccagaggggcaacctgcccaccagcggcaacatcagcggcttcatcagaagactcttcctgcagctgatgctggaggatgagaaggtgaccatgttcctgcagagcccctgccccctgtacaagggccgcatcaatgccaccagccacgtgatccagcaccccatgtatggagctggccacaagttccgcaccctgcacctgcctgtgtccaccaccctgagtgatgtgctggacagagtgtctgacacccccagcatcacagccaagctgatcagcgagcagaaggatgacaaggagaagaagaaccacgaggagaaggagaaggtgaaggcagaaaatggcttccaggacaactacagcgtggtggtggccagcggcctgaagagccagagcaagagagctgtgtctgccaccccacccaggcctcccagccggcggggccgcaccatcccagacaagattggcagcaccagcggggctgaggccgccaacaagatcatcaccgtgcctgtgttccacctgttccacaagctgctggccggccagcccctgcctgctgagatgaccctggcccagctgctgaccctgctgtatgacaggaagctgccccagggctaccgcagcattgacctgactgtgaagctgggcagcagggtcatcacagaccccagcctgagcaagacagacagctacaagaggctgcaccctgagaaggaccatggagacctgctggccagctgcccagaagatgaggccctgaccccaggagatgagtgcatggatggcatcctggatgagagcctgctggagacctgccccatccagagccccctgcaggtgtttgctggcatgggcggcctggccctgattgctgagcggctgcccatgctgtacccagaggtgatccagcaggtgtctgcccctgtggtgaccagcaccacccaggagaagcccaaggacagcgaccagtttgagtgggtgaccatcgagcagagcggggagctggtgtatgaggcccctgagaccgtggccgctgagcccccacccatcaagtctgctgtgcagaccatgagccccatcccagcccacagcctggccgccttcggcctcttcctgcggctgcccggctatgcagaggtgctgctgaaggagaggaagcacgcccagtgcctgctgcggctggtgctgggcgtgacagatgatggagagggcagccacatcctgcagagccccagcgccaacgtgctgcccaccctgcccttccacgtgctgcggagcctcttcagcaccacccccctgaccacagatgatggagtgctgctgcggaggatggccctggagattggagccctgcacctgatcctggtgtgcctgagcgccctgagccaccacagcccccgggtgcccaacagctctgtgaaccagacagagccccaggtgagcagcagccacaaccccaccagcacagaggagcagcagctgtactgggccaagggcactggatttggaacaggcagcacagccagcggctgggatgtggagcaggccctgaccaagcagaggctggaggaggagcacgtgacctgcctgctgcaggtgctggccagctacatcaaccctgtgagcagcgctgtgaatggagaggcccagagcagccatgagacccggggccagaacagcaatgccctgcccagcgtgctgctggagctgctgagccagagctgcctgatcccagccatgagcagctacctgagaaatgattctgtgctggacatggcccggcacgtgcccctgtaccgggccctgctggagctgctgcgggccatcgccagctgtgccgccatggtgcccctgctgctgcccctgagcacagaaaatggagaggaggaggaggagcagagcgagtgccagacctctgtgggcaccctgctggccaagatgaagacctgtgtggacacctacaccaaccggctgcggagcaagcgggagaatgtgaagacaggagtgaagccagatgccagtgaccaggagcctgagggcctgaccctgctggtgcctgacatccagaagacagctgagatcgtgtatgctgccaccaccagcctgcggcaggccaaccaggagaagaagctgggggagtacagcaagaaggccgccatgaagcccaagcccctgtctgtgctgaagagcctggaggagaagtatgtggccgtgatgaagaagctgcagtttgacacctttgagatggtgtctgaagatgaagatggcaagctgggcttcaaggtgaactaccactacatgagccaggtgaagaatgccaatgatgccaacagcgctgcccgggcccggcggctggcccaggaggccgtgaccctgagcaccagcctgcccctgagcagcagcagctctgtgtttgtgcgctgtgatgaggagcggctggacatcatgaaggtgctgatcaccggccctgctgacaccccctatgccaacggctgctttgaatttgatgtgtacttcccccaggactaccccagcagcccccccctggtgaacctggagaccaccggcggccacagcgtgcgcttcaaccccaacctgtacaatgatggcaaggtgtgcctgagcatcctgaacacctggcacggccggcctgaggagaagtggaacccccagaccagcagcttcctgcaggtgctggtgtctgtgcagagcctcatcctggtggccgagccctacttcaatgaacctggctatgaaagaagccggggcaccccatctggcacccagagcagccgggagtatgatggcaacatccggcaggccaccgtgaagtgggccatgctggagcagatccggaaccccagcccctgcttcaaggaggtgatccacaagcacttctacctgaagagggtggagatcatggcccagtgtgaggagtggattgctgacatccagcagtacagcagtgacaagagggtgggccgcaccatgagccaccacgccgccgccctgaagaggcacacagcccagctgcgggaggagctgctgaagctgccctgcccagagggcctggaccctgacacagatgatgcccctgaggtgtgccgggccaccaccggggctgaggagaccctgatgcatgaccaggtgaagcccagcagcagcaaggagctgcccagcgacttccagctgtag

SEQ ID NO: 18467 - DNA, 1566 bp, Artificial Sequence
  Description of Artificial Sequence: Synthetic coding sequence
atgagcctgagccgctctgaggagatgcaccggctgacagaaaatgtgtacaagaccatcatggagcagttcaaccccagcctgaggaacttcatcgccatgggcaagaactatgagaaggccctggccggcgtgacctacgccgccaagggctactttgatgccctggtgaagatgggagagctggccagcgagagccagggcagcaaggagctgggagatgtgctcttccagatggccgaggtgcaccggcagatccagaaccagctggaggagatgctgaagagcttccacaatgagctgctgacccagctggagcagaaggtggagctggacagccgctacctgtctgctgccctgaagaagtaccagacagagcagaggagcaaaggagatgccctggacaagtgccaggccgagctgaagaagctgaggaagaagagccagggcagcaagaacccccagaagtacagcgacaaggagctgcagtacattgatgccatcagcaacaagcagggcgagctggagaactacgtgtctgatggctacaagacagccctgacagaggagcggcggcgcttctgcttcctggtggagaagcagtgtgctgtggccaagaacagcgctgcctaccacagcaagggcaaggagctgctggcccagaagctgcccctgtggcagcaggcctgtgccgaccccagcaagatccctgagagagctgtgcagctgatgcagcaggtggccagcaatggagccaccctgcccagcgccctgagcgccagcaagagcaacctggtgatcagtgaccccatccctggggccaagcccctgcctgtgcccccagagctggccccctttgtgggccgcatgtctgcccaggagagcacccccatcatgaatggagtgactggaccagatggagaggactacagcccctgggccgacaggaaggccgcccagcccaagagcctgagccccccccagagccagagcaagctgagtgacagctacagcaacaccctgcctgtgaggaagtctgtgacccccaagaacagctatgccaccacagagaacaagaccctgcccaggagcagctccatggctgctggcctggagagaaatggccgcatgagggtgaaggccatcttcagccacgccgccggggacaacagcaccctgctgtccttcaaggagggggacctgatcaccctgctggtgcctgaggccagagatggctggcactatggagagagcgagaagaccaagatgaggggctggttccccttctcctacaccagggtgctggacagtgatggcagtgaccggctgcacatgagcctgcagcagggcaagagcagcagcactggaaacctgctggacaaggatgacctggccatccccccaccagactatggagctgccagccgggccttccctgcccagacagccagcggcttcaagcagaggccctacagcgtggccgtgcctgccttcagccagggcctggatgattatggagcccgctccatgagcagcggcagcggcaccctggtgtccacagtgtag

SEQ ID NO: 18468 - DNA, 1659 bp, Artificial Sequence
  Description of Artificial Sequence: Synthetic coding sequence
atgagcctgagccgctctgaggagatgcaccggctgacagaaaatgtgtacaagaccatcatggagcagttcaaccccagcctgaggaacttcatcgccatgggcaagaactatgagaaggccctggccggcgtgacctacgccgccaagggctactttgatgccctggtgaagatgggagagctggccagcgagagccagggcagcaaggagctgggagatgtgctcttccagatggccgaggtgcaccggcagatccagaaccagctggaggagatgctgaagagcttccacaatgagctgctgacccagctggagcagaaggtggagctggacagccgctacctgtctgctgccctgaagaagtaccagacagagcagaggagcaaaggagatgccctggacaagtgccaggccgagctgaagaagctgaggaagaagagccagggcagcaagaacccccagaagtacagcgacaaggagctgcagtacattgatgccatcagcaacaagcagggcgagctggagaactacgtgtctgatggctacaagacagccctgacagaggagcggcggcgcttctgcttcctggtggagaagcagtgtgctgtggccaagaacagcgctgcctaccacagcaagggcaaggagctgctggcccagaagctgcccctgtggcagcaggcctgtgccgaccccagcaagatccctgagagagctgtgcagctgatgcagcaggtggccagcaatggagccaccctgcccagcgccctgagcgccagcaagagcaacctggtgatcagtgaccccatccctggggccaagcccctgcctgtgcccccagagctggccccctttgtgggccgcatgtctgcccaggagagcacccccatcatgaatggagtgactggaccagatggagaggactacagcccctgggccgacaggaaggccgcccagcccaagagcctgagccccccccagagccagagcaagctgagtgacagctacagcaacaccctgcctgtgaggaagtctgtgacccccaagaacagctatgccaccacagagaacaagaccctgcccaggagcagctccatggctgctggcctggagagaaatggccgcatgagggtgaaggccatcttcagccacgccgccggggacaacagcaccctgctgtccttcaaggagggggacctgatcaccctgctggtgcctgaggccagagatggctggcactatggagagagcgagaagaccaagatgaggggctggttccccttctcctacaccagggtgctggacagtgatggcagtgaccggctgcacatgagcctgcagcagggcaagagcagcagcactggaaacctgctggacaaggatgacctggccatccccccaccagactatggagctgccagccgggccttccctgcccagacagccagcggcttcaagcagaggccctacagcgtggccgtgcctgccttcagccagggcctggatgattatggagcccgctccatgagcaggaacccctttgcccacgtgcagctgaagcccaccgtgaccaatgacagatgtgacctgagcgcccagggccctgagggccgggagcacggagatggcagcgcccggaccctggccggccgctag

SEQ ID NO: 18469 - DNA, 1371 bp, Artificial Sequence
  Description of Artificial Sequence: Synthetic coding sequence
atggccgaggtgcaccggcagatccagaaccagctggaggagatgctgaagagcttccacaatgagctgctgacccagctggagcagaaggtggagctggacagccgctacctgtctgctgccctgaagaagtaccagacagagcagaggagcaaaggagatgccctggacaagtgccaggccgagctgaagaagctgaggaagaagagccagggcagcaagaacccccagaagtacagcgacaaggagctgcagtacattgatgccatcagcaacaagcagggcgagctggagaactacgtgtctgatggctacaagacagccctgacagaggagcggcggcgcttctgcttcctggtggagaagcagtgtgctgtggccaagaacagcgctgcctaccacagcaagggcaaggagctgctggcccagaagctgcccctgtggcagcaggcctgtgccgaccccagcaagatccctgagagagctgtgcagctgatgcagcaggtggccagcaatggagccaccctgcccagcgccctgagcgccagcaagagcaacctggtgatcagtgaccccatccctggggccaagcccctgcctgtgcccccagagctggccccctttgtgggccgcatgtctgcccaggagagcacccccatcatgaatggagtgactggaccagatggagaggactacagcccctgggccgacaggaaggccgcccagcccaagagcctgagccccccccagagccagagcaagctgagtgacagctacagcaacaccctgcctgtgaggaagtctgtgacccccaagaacagctatgccaccacagagaacaagaccctgcccaggagcagctccatggctgctggcctggagagaaatggccgcatgagggtgaaggccatcttcagccacgccgccggggacaacagcaccctgctgtccttcaaggagggggacctgatcaccctgctggtgcctgaggccagagatggctggcactatggagagagcgagaagaccaagatgaggggctggttccccttctcctacaccagggtgctggacagtgatggcagtgaccggctgcacatgagcctgcagcagggcaagagcagcagcactggaaacctgctggacaaggatgacctggccatccccccaccagactatggagctgccagccgggccttccctgcccagacagccagcggcttcaagcagaggccctacagcgtggccgtgcctgccttcagccagggcctggatgattatggagcccgctccatgagcaggaacccctttgcccacgtgcagctgaagcccaccgtgaccaatgacagaagtgcccccctgctgtcctag

SEQ ID NO: 18470 - DNA, 1128 bp, Artificial Sequence
  Description of Artificial Sequence: Synthetic coding sequence
atgctgctgcctgagggccagaggcagagggccctgggcttcggcaccgtgaccagcacctacagccctgtgggccagtacattgatgccatcagcaacaagcagggcgagctggagaactacgtgtctgatggctacaagacagccctgacagaggagcggcggcgcttctgcttcctggtggagaagcagtgtgctgtggccaagaacagcgctgcctaccacagcaagggcaaggagctgctggcccagaagctgcccctgtggcagcaggcctgtgccgaccccagcaagatccctgagagagctgtgcagctgatgcagcaggtggccagcaatggagccaccctgcccagcgccctgagcgccagcaagagcaacctggtgatcagtgaccccatccctggggccaagcccctgcctgtgcccccagagctggccccctttgtgggccgcatgtctgcccaggagagcacccccatcatgaatggagtgacaggcccagatggagaggactacagcccctgggccgacaggaaggccgcccagcccaagagcctgagccccccccagagccagagcaagctgagtgacagctacagcaacaccctgcctgtgaggaagtctgtgacccccaagaacagctatgccaccacagagaacaagaccctgcccaggagcagctccatggccgccggcctggagagaaatggaaggatgagggtgaaggccatcttcagccatgctgctggggacaacagcaccctgctgtccttcaaggagggggacctgatcaccctgctggtgcctgaggccagagatggctggcactacggggagagcgagaagaccaagatgaggggctggttccccttctcctacaccagggtgctggacagtgatggcagtgaccggctgcacatgagcctgcagcagggcaagagcagcagcacaggcaacctgctggacaaggatgacctggccatccccccaccagactatggagctgccagccgggccttccctgcccagacagccagcggcttcaagcagaggccctacagcgtggccgtgcctgccttcagccagggcctggatgattatggagcccgctccatgagcaggtag

SEQ ID NO: 18471 - DNA, 1605 bp, Artificial Sequence
  Description of Artificial Sequence: Synthetic coding sequence
atgagcctgagccgctctgaggagatgcaccggctgacagaaaatgtgtacaagaccatcatggagcagttcaaccccagcctgaggaacttcatcgccatgggcaagaactatgagaaggccctggccggcgtgacctacgccgccaagggctactttgatgccctggtgaagatgggagagctggccagcgagagccagggcagcaaggagctgggagatgtgctcttccagatggccgaggtgcaccggcagatccagaaccagctggaggagatgctgaagagcttccacaatgagctgctgacccagctggagcagaaggtggagctggacagccgctacctgtctgctgccctgaagaagtaccagacagagcagaggagcaaaggagatgccctggacaagtgccaggccgagctgaagaagctgaggaagaagagccagggcagcaagaacccccagaagtacagcgacaaggagctgcagtacattgatgccatcagcaacaagcagggcgagctggagaactacgtgtctgatggctacaagacagccctgacagaggagcggcggcgcttctgcttcctggtggagaagcagtgtgctgtggccaagaacagcgctgcctaccacagcaagggcaaggagctgctggcccagaagctgcccctgtggcagcaggcctgtgccgaccccagcaagatccctgagagagctgtgcagctgatgcagcaggtggccagcaatggagccaccctgcccagcgccctgagcgccagcaagagcaacctggtgatcagtgaccccatccctggggccaagcccctgcctgtgcccccagagctggccccctttgtgggccgcatgtctgcccaggagagcacccccatcatgaatggagtgactggaccagatggagaggactacagcccctgggccgacaggaaggccgcccagcccaagagcctgagccccccccagagccagagcaagctgagtgacagctacagcaacaccctgcctgtgaggaagtctgtgacccccaagaacagctatgccaccacagagaacaagaccctgcccaggagcagctccatggctgctggcctggagagaaatggccgcatgagggtgaaggccatcttcagccacgccgccggggacaacagcaccctgctgtccttcaaggagggggacctgatcaccctgctggtgcctgaggccagagatggctggcactatggagagagcgagaagaccaagatgaggggctggttccccttctcctacaccagggtgctggacagtgatggcagtgaccggctgcacatgagcctgcagcagggcaagagcagcagcactggaaacctgctggacaaggatgacctggccatccccccaccagactatggagctgccagccgggccttccctgcccagacagccagcggcttcaagcagaggccctacagcgtggccgtgcctgccttcagccagggcctggatgattatggagcccgctccatgagcaggaacccctttgcccacgtgcagctgaagcccaccgtgaccaatgacagaagtgcccccctgctgtcctag

SEQ ID NO: 18472 - DNA, 1563 bp, Artificial Sequence
  Description of Artificial Sequence: Synthetic coding sequence
atgagcctgagccgctctgaggagatgcaccggctgacagaaaatgtgtacaagaccatcatggagcagttcaaccccagcctgaggaacttcatcgccatgggcaagaactatgagaaggccctggccggcgtgacctacgccgccaagggctactttgatgccctggtgaagatgggagagctggccagcgagagccagggcagcaaggagctgggagatgtgctcttccagatggccgaggtgcaccggcagatccagaaccagctggaggagatgctgaagagcttccacaatgagctgctgacccagctggagcagaaggtggagctggacagccgctacctgtctgctgccctgaagaagtaccagacagagcagaggagcaaaggagatgccctggacaagtgccaggccgagctgaagaagctgaggaagaagagccagggcagcaagaacccccagaagtacagcgacaaggagctgcagtacattgatgccatcagcaacaagcagggcgagctggagaactacgtgtctgatggctacaagacagccctgacagaggagcggcggcgcttctgcttcctggtggagaagcagtgtgctgtggccaagaacagcgctgcctaccacagcaagggcaaggagctgctggcccagaagctgcccctgtggcagcaggcctgtgccgaccccagcaagatccctgagagagctgtgcagctgatgcagcaggtggccagcaatggagccaccctgcccagcgccctgagcgccagcaagagcaacctggtgatcagtgaccccatccctggggccaagcccctgcctgtgcccccagagctggccccctttgtgggccgcatgtctgcccaggagagcacccccatcatgaatggagtgactggaccagatggagaggactacagcccctgggccgacaggaaggccgcccagcccaagagcctgagccccccccagagccagagcaagctgagtgacagctacagcaacaccctgcctgtgaggaagtctgtgacccccaagaacagctatgccaccacagagaacaagaccctgcccaggagcagctccatggctgctggcctggagagaaatggccgcatgagggtgaaggccatcttcagccacgccgccggggacaacagcaccctgctgtccttcaaggagggggacctgatcaccctgctggtgcctgaggccagagatggctggcactatggagagagcgagaagaccaagatgaggggctggttccccttctcctacaccagggtgctggacagtgatggcagtgaccggctgcacatgagcctgcagcagggcaagagcagcagcactggaaacctgctggacaaggatgacctggccatccccccaccagactatggagctgccagccgggccttccctgcccagacagccagcggcttcaagcagaggccctacagcgtggccgtgcctgccttcagccagggcctggatgattatggagcccgctccatgagcagcgcagatgtggaggtggcccgcttctag

SEQ ID NO: 18473 - DNA, 720 bp, Artificial Sequence
  Description of Artificial Sequence: Synthetic coding sequence
atggcccacgccggccgcacaggctatgacaaccgggagatcgtgatgaagtacatccactacaagctgagccagaggggctatgagtgggatgctggagatgtgggcgccgcccctcctggggccgccccagcccctggcatcttcagcagccagcccggccacaccccccaccctgctgccagccgggaccctgtggcccggaccagccccctgcagaccccagctgcccctggagctgctgctggccctgccctgagccctgtgccccctgtggtgcacctgaccctgcggcaggccggagatgacttcagccgccgctacagaagagactttgctgagatgagcagccagctgcacctgacccccttcaccgcccggggccgctttgccaccgtggtggaggagctgttcagagatggagtgaactggggcagaattgtggccttctttgaatttggaggagtgatgtgtgtggagagcgtgaaccgggagatgagccccctggtggacaacatcgccctgtggatgacagagtacctgaacagacacctgcacacctggatccaggacaatggaggctgggatgcctttgtggagctgtatggccccagcatgaggcccctgtttgacttctcctggctgagcctgaagaccctgctgagcctggccctggtgggcgcctgcatcaccctgggcgcctacctgggccacaagtag

SEQ ID NO: 18474 - DNA, 720 bp, Artificial Sequence; identical to SEQ ID NO: 18473
  Description of Artificial Sequence: Synthetic coding sequence

SEQ ID NO: 18475 - DNA, 618 bp, Artificial Sequence
  Description of Artificial Sequence: Synthetic coding sequence
atggcccacgccggccgcacaggctatgacaaccgggagatcgtgatgaagtacatccactacaagctgagccagaggggctatgagtgggatgctggagatgtgggcgccgcccctcctggggccgccccagcccctggcatcttcagcagccagcccggccacaccccccaccctgctgccagccgggaccctgtggcccggaccagccccctgcagaccccagctgcccctggagctgctgctggccctgccctgagccctgtgccccctgtggtgcacctgaccctgcggcaggccggagatgacttcagccgccgctacagaagagactttgctgagatgagcagccagctgcacctgacccccttcaccgcccggggccgctttgccaccgtggtggaggagctgttcagagatggagtgaactggggcagaattgtggccttctttgaatttggaggagtgatgtgtgtggagagcgtgaaccgggagatgagccccctggtggacaacatcgccctgtggatgacagagtacctgaacagacacctgcacacctggatccaggacaatggaggctgggtgggcgccctgggagatgtgtccctgggctag

SEQ ID NO: 18476 - DNA, 1578 bp, Artificial Sequence
  Description of Artificial Sequence: Synthetic coding sequence
atgaaggccctgattgctgccctgctgctgatcaccctgcagtacagctgtgctgtgagccccacagactgcagcgctgtggagcctgaggccgagaaggccctggacctgatcaacaagagaagaagagatggctacctgttccagctgctgagaattgctgatgcccacctggacagagtggagaacaccaccgtgtactacctggtgctggatgtgcaggagagtgactgcagcgtgctgagcaggaagtactggaatgactgtgagcccccagacagcagaagacccagcgagatcgtcatcggccagtgcaaggtgattgccaccaggcacagccatgagagccaggacctgcgggtcatcgacttcaactgcaccaccagctctgtgtcctctgccctggccaacaccaaggacagccctgtgctgattgacttctttgaggacacagagcgctacaggaagcaggccaacaaggccctggagaagtacaaggaggagaatgatgactttgccagcttccgggtggaccgcatcgagcgggtggcccgggtgcggggcggggagggcaccggctactttgtggacttctctgtgaggaactgccccaggcaccacttccccaggcaccccaacgtgtttggcttctgcagagctgacctcttctatgatgtggaggccctggacctggagagccccaagaacctggtgatcaactgtgaggtgtttgacccccaggagcacgagaacatcaatggagtgcccccccacctgggccaccccttccactggggcggccacgagaggagcagcaccaccaagccacccttcaagccccacggcagccgggaccaccaccacccccacaagccccatgaacatggccccccacctcctccagatgagcgggaccacagccacggcccccccctgccccagggccccccacccctgctgcccatgagctgcagcagctgccagcacgccaccttcggcaccaatggagcccagaggcacagccacaacaacaacagcagtgacctgcacccccacaagcaccacagccatgagcagcacccccacggccaccacccccacgcccaccacccccatgaacatgacacccaccggcagcacccccacggccaccacccccacggccaccacccccacggccaccacccccacggccaccacccccacggccaccacccccactgccacgacttccaggactatggcccctgtgaccccccaccccacaaccagggccactgctgccacggccacggccccccacctggccacctgcggcggcggggccctgggaagggcccccggcccttccactgccggcagatcggctctgtgtaccgcctgccccccctgaggaagggggaggtgctgcccctgcctgaggccaacttccccagcttccccctgccccaccacaagcaccccctgaagccagacaaccagcccttcccccagagcgtgtctgagagctgccctgggaagttcaagagcggcttcccccaggtgtccatgttcttcacccacaccttccccaagtag

SEQ ID NO: 18477 - DNA, 2121 bp, Artificial Sequence
  Description of Artificial Sequence: Synthetic coding sequence
atggccagccctgctgacagctgcatccagttcaccaggcatgccagtgatgtgctgctgaacctgaaccggctgcggagccgggacatcctgacagatgtggtgattgtggtgtcccgggagcagttccgggcccacaagacagtgctgatggcctgcagcggcctcttctacagcatcttcacagaccagctgaagtgcaacctgagcgtcatcaacctggaccctgagatcaaccctgagggcttctgcatcctgctggacttcatgtacaccagccggctgaacctgcgggagggcaacatcatggctgtgatggccacagccatgtacctgcagatggagcacgtggtggacacctgcaggaagttcatcaaggccagcgaggccgagatggtgtctgccatcaagccaccccgggaggagttcctgaacagcaggatgctgatgccccaggacatcatggcctaccggggccgggaggtggtggagaacaacctgcccctgcggagcgcccctggctgtgagagccgggcctttgcccccagcctgtacagcggcctgagcaccccaccagccagctacagcatgtacagccacctgcctgtgagcagcctgctcttcagtgatgaggagttcagagatgtgaggatgcctgtggccaaccccttccccaaggagcgggccctgccctgtgacagcgcccggcctgtgcctggagagtacagccggcccaccctggaggtgagccccaacgtgtgccacagcaacatctacagccccaaggagaccatccctgaggaggcccggagtgacatgcactacagcgtggccgagggcctgaagccagctgcccccagcgccagaaatgccccctacttcccctgtgacaaggccagcaaggaggaggagcggcccagcagtgaagatgagatcgccctgcactttgagcccccaaatgcccccctgaacaggaagggcctggtgagcccccagagcccccagaagagtgactgccagcccaacagccccacagagagctgcagcagcaagaatgcctgcatcctgcaggccagcggcagccccccagccaagagccccacagaccccaaggcctgcaactggaagaagtacaagttcatcgtgctgaacagcctgaaccagaatgccaagccagagggccctgagcaggccgagctgggccgcctgagcccccgggcctacacagcccccccagcctgccagccccccatggagcctgagaacctggacctgcagagccccaccaagctgagcgccagcggggaggacagcaccatcccccaggccagccggctgaacaacatcgtgaacagatccatgacaggcagccccaggagcagcagcgagagccacagccccctgtacatgcacccccccaagtgcaccagctgtggcagccagagcccccagcacgccgagatgtgcctgcacacagctggccccaccttccctgaggagatgggagagacccagagcgagtacagcgacagcagctgtgaaaatggagccttcttctgcaatgaatgtgactgccgcttcagcgaggaggccagcctgaagaggcacaccctgcagacccacagcgacaagccctacaagtgtgaccgctgccaggccagcttccgctacaagggcaacctggccagccacaagacagtgcacactggagagaagccctaccgctgcaacatctgtggggcccagttcaacagacctgccaacctgaagacccacacccgcatccacagcggggagaagccctacaagtgtgagacctgtggggccaggtttgtgcaggtggcccacctgcgggcccacgtgctgatccacactggagagaagccctacccctgtgagatctgtggcacccgcttccgccacctgcagaccctgaagagccacctgcgcatccacactggagagaagccctaccactgtgagaagtgcaacctgcacttccgccacaagagccagctgcggctgcacctgcggcagaagcatggagccatcaccaacaccaaggtgcagtacagagtgtctgccacagacctgcccccagagctgcccaaggcctgctag

SEQ ID NO: 18478 - DNA, 369 bp, Artificial Sequence
  Description of Artificial Sequence: Synthetic coding sequence
atggccagccctgctgacagctgcatccagttcaccaggcatgccagtgatgtgctgctgaacctgaaccggctgcggagccgggacatcctgacagatgtggtgattgtggtgtcccgggagcagttccgggcccacaagacagtgctgatggcctgcagcggcctcttctacagcatcttcacagaccagctgaagtgcaacctgagcgtcatcaacctggaccctgagatcaaccctgagggcttctgcatcctgctggacttcatgtacaccagccggctgaacctgcgggagggcaacatcatggctgtgatggccacagccatgtacctgcagatggagcacgtggtggacacctgcaggtag

SEQ ID NO: 18479 - DNA, 315 bp, Artificial Sequence
  Description of Artificial Sequence: Synthetic coding sequence
atggccagccctgctgacagctgcatccagttcaccaggcatgccagtgatgtgctgctgaacctgaaccggctgcggagccgggacatcctgacagatgtggtgattgtggtgtcccgggagcagttccgggcccacaagacagtgctgatggcctgcagcggcctcttctacagcatcttcacagaccagctgaagtgcaacctgagcgtcatcaacctggaccctgagatcaaccctgagggcttctgcatcctgctggacttcatgtacaccagccggctgaacctgcgggagggcaacatcatggcctag

SEQ ID NO: 18480 - DNA, 1953 bp, Artificial Sequence
  Description of Artificial Sequence: Synthetic coding sequence
atggccagccctgctgacagctgcatccagttcaccaggcatgccagtgatgtgctgctgaacctgaaccggctgcggagccgggacatcctgacagatgtggtgattgtggtgtcccgggagcagttccgggcccacaagacagtgctgatggcctgcagcggcctcttctacagcatcttcacagaccagctgaagtgcaacctgagcgtcatcaacctggaccctgagatcaaccctgagggcttctgcatcctgctggacttcatgtacaccagccggctgaacctgcgggagggcaacatcatggctgtgatggccacagccatgtacctgcagatggagcacgtggtggacacctgcaggaagttcatcaaggccagcgaggccgagatggtgtctgccatcaagccaccccgggaggagttcctgaacagcaggatgctgatgccccaggacatcatggcctaccggggccgggaggtggtggagaacaacctgcccctgcggagcgcccctggctgtgagagccgggcctttgcccccagcctgtacagcggcctgagcaccccaccagccagctacagcatgtacagccacctgcctgtgagcagcctgctcttcagtgatgaggagttcagagatgtgaggatgcctgtggccaaccccttccccaaggagcgggccctgccctgtgacagcgcccggcctgtgcctggagagtacagccggcccaccctggaggtgagccccaacgtgtgccacagcaacatctacagccccaaggagaccatccctgaggaggcccggagtgacatgcactacagcgtggccgagggcctgaagccagctgcccccagcgccagaaatgccccctacttcccctgtgacaaggccagcaaggaggaggagcggcccagcagtgaagatgagatcgccctgcactttgagcccccaaatgcccccctgaacaggaagggcctggtgagcccccagagcccccagaagagtgactgccagcccaacagccccacagagagctgcagcagcaagaatgcctgcatcctgcaggccagcggcagccccccagccaagagccccacagaccccaaggcctgcaactggaagaagtacaagttcatcgtgctgaacagcctgaaccagaatgccaagccagagggccctgagcaggccgagctgggccgcctgagcccccgggcctacacagcccccccagcctgccagccccccatggagcctgagaacctggacctgcagagccccaccaagctgagcgccagcggggaggacagcaccatcccccaggccagccggctgaacaacatcgtgaacagatccatgacaggcagccccaggagcagcagcgagagccacagccccctgtacatgcacccccccaagtgcaccagctgtggcagccagagcccccagcacgccgagatgtgcctgcacacagctggccccaccttccctgaggagatgggagagacccagagcgagtacagcgacagcagctgtggggagaagccctaccgctgcaacatctgtggggcccagttcaacagacctgccaacctgaagacccacacccgcatccacagcggggagaagccctacaagtgtgagacctgtggggccaggtttgtgcaggtggcccacctgcgggcccacgtgctgatccacactggagagaagccctacccctgtgagatctgtggcacccgcttccgccacctgcagaccctgaagagccacctgcgcatccacactggagagaagccctaccactgtgagaagtgcaacctgcacttccgccacaagagccagctgcggctgcacctgcggcagaagcatggagccatcaccaacaccaaggtgcagtacagagtgtctgccacagacctgcccccagagctgcccaaggcctgctag

SEQ ID NO: 18481 - DNA, 306 bp, Artificial Sequence
  Description of Artificial Sequence: Synthetic coding sequence
atgaagtttggcatgggcagcgcccaggcctgcccctgccaggtgccccgggccgccagcaccacctgggtgccctgccagatctgtgagaccagaggagctgctgctgccccacccctgaccctggagggccctgtgcagagccaccacggcaccccagccctgacccagggcccccagagccccagagatggagcccagctgggcgcctgcaccaggcctgtggatgtgcgggacagcggcggccggcccctgcccccaccagacaccctggccagcgctggggacttcctgtgcaccatgtag

SEQ ID NO: 18482 - DNA, 396 bp, Artificial Sequence
  Description of Artificial Sequence: Synthetic coding sequence
atgaagtttggcatgggcagcgcccaggcctgcccctgccaggtgccccgggccgccagcaccacctgggtgccctgccagatctgtggcccccagcccagcctgagcctggccgagcagcacctggagagccctgtgcccagcgcccctggggccctggccggcggccccacccaggccgcccctggggtgcggggggaggaggagcagtgggcccgggagattggagcccagctgcggaggatggctgatgacctgaatgcccagtatgaaagaagacggcaggaggagcagcagaggcaccggcccagcccctggagggtgctgtacaacctgatcatgggcctgctgcccctgccccggggccaccgggcccctgagatggagcccaactag

SEQ ID NO: 18483 - DNA, 582 bp, Artificial Sequence
  Description of Artificial Sequence: Synthetic coding sequence
atggcccgggcccggcaggagggcagcagccctgagcctgtggagggcctggccagagatggcccccggcccttccccctgggccgcctggtgcccagcgctgtgtcctgtggcctgtgtgagcccggcctggccgccgccccagctgcccccaccctgctgcctgctgcctacctgtgtgcccccacagcccctcctgctgtgacagctgccctgggcggcagccgctggccaggcggccccaggagccggccccggggccccaggccagatggcccccagcccagcctgagcctggccgagcagcacctggagagccctgtgcccagcgcccctggggccctggccggcggccccacccaggccgcccctggggtgcggggggaggaggagcagtgggcccgggagattggagcccagctgcggaggatggctgatgacctgaatgcccagtatgaaagaagacggcaggaggagcagcagaggcaccggcccagcccctggagggtgctgtacaacctgatcatgggcctgctgcccctgccccggggccaccgggcccctgagatggagcccaactag

SEQ ID NO: 18484 - DNA, 786 bp, Artificial Sequence
  Description of Artificial Sequence: Synthetic coding sequence
atgaagtttggcatgggcagcgcccaggcctgcccctgccaggtgccccgggccgccagcaccacctgggtgccctgccagatctgtggcccccgggagagacatggccccaggacccctgggggccagctgcccggggcccggcggggccctggcccccggcggcctgcccccctgcctgcccggcccccaggggccctgggctctgtgctgcggcccctgcgggcccggcccggctgccggccccggcggccccaccctgctgcccgctgcctgcccctgcggccccaccggcccaccaggaggcaccggcggcctgggggcttccccctggcctggggcagcccccagcctgcccccaggcctgcccctggccgcagcagcgccctggccctggccggcggggccgcccctggggtggcccgggcccagaggcctgggggcagcggcggccgcagccaccctgggggccctggcagcccccggggcggcggcaccgtgggccctggggaccggggccctgctgctgctgatggcggccggccccagaggacagtgcgggctgctgagaccagaggagctgctgctgccccacccctgaccctggagggccctgtgcagagccaccacggcaccccagccctgacccagggcccccagagccccagagatggagcccagctgggcgcctgcaccaggcctgtggatgtgcgggacagcggcggccggcccctgcccccaccagacaccctggccagcgctggggacttcctgtgcaccatgtag

SEQ ID NO: 18485 - DNA, 1308 bp, Artificial Sequence
  Description of Artificial Sequence: Synthetic coding sequence
atgctgtgtggcttccaggaggatgccaccccacctcctccaccccggccccggcggctgcaccggcggctgcccaggcctgaggaggtgggcatgctgagcctgcccccaggcctgctgactgtgtctggcagcgctgctgctgctgatgctgtgcccctgcggcctggggactgggccggcgtgtccacagctgacagaggagagcgggcccccctgggccctgccttctgtgacctggccgtgagccccaccagccctgcctggagaggagaagaagatgagggcgccaaggccagcagcggggacatcggcagcctggactaccaggagtttgtggtggacatcgagagccggctgaggatggagggcgtggagctgaaggaggagtggcaggatgaggacttccccatccccctgcctgaagatgacagcattgaggccgacatcctggccatcaccggccctgaggaccagcccggcagcctggaggtgaatggaaacaaggtgaggaagaagctgatggccccagacatcagcctgaccctggaccccagtgatggctctgtgctgagtgatgacctggatgagagcggggagattgacctggatggcctggacacccccagcgagaacagcaatgaatttgagtgggaggatgacctgcccaagcccaagaccacagaggtgatcaggaagggcagcatcacagagtacacagctgctgaggagaaggaggatggaagacgctggaggatgttccgcatcggggagcaggaccaccgggtggacatgaaggccatcgagccctacaagaaggtgatcagccatggaggctactatggagatggcctgaatgccatcgtggtgtttgctgtgtgcttcatgcctgagagcagccagcccaactaccgctacctgatggacaacctcttcaagtatgtgattggcaccctggagctgctggtggccgagaactacatgattgtgtacctgaatggagccaccaccaggaggaagatgcccagcctgggctggctgaggaagtgctaccagcagattgaccggcggctgaggaagaacctgaagagcctcatcatcgtgcaccccagctggttcatccgcaccctgctggccgtgacccggcccttcatcagcagcaagttcagccagaagatccgctacgtgttcaacctggccgagctggccgagctggtgcccatggagtatgtgggcatccctgagtgcatcaagcaggtggaccaggagctgaatggcaagcaggatgagcccaagaatgagcagtag

SEQ ID NO: 18486 - DNA, 1131 bp, Artificial Sequence
  Description of Artificial Sequence: Synthetic coding sequence
atggagccctgccccagcagcgcccccccacccttctacccaggagtgggggaggtggccggcctgcgctggttcagcatctatgaccagaggcccagctggtaccgcaccaagaagctgggcctgctggacatcggcagcctggactaccaggagtttgtggtggacatcgagagccggctgaggatggagggcgtggagctgaaggaggagtggcaggatgaggacttccccatccccctgcctgaagatgacagcattgaagctgacatcctggccatcactggacctgaggaccagcccggcagcctggaggtgaatggaaacaaggtgaggaagaagctgatggccccagacatcagcctgaccctggaccccagtgatggctctgtgctgagtgatgacctggatgaaagtggagaaattgacctggatggcctggacaccccatctgagaacagcaatgaatttgagtgggaggatgacctgcccaagcccaagaccacagaggtgatcaggaagggcagcatcacagagtacacagctgctgaggagaaggaggatggccgccgctggaggatgttcagaattggagagcaggaccaccgggtggacatgaaggccatcgagccctacaagaaggtgatcagccacggcggctactatggagatggcctgaatgccatcgtggtgtttgctgtgtgcttcatgcctgagagcagccagcccaactaccgctacctgatggacaacctcttcaagtatgtgattggcaccctggagctgctggtggccgagaactacatgattgtgtacctgaatggagccaccaccaggaggaagatgcccagcctgggctggctgaggaagtgctaccagcagattgaccggcggctgaggaagaacctgaagagcctcatcatcgtgcaccccagctggttcatccgcaccctgctggccgtgacccggcccttcatcagcagcaagttcagccagaagatccgctacgtgttcaacctggccgagctggccgagctggtgcccatggagtatgtgggcatccctgagtgcatcaagcaggtggaccaggagctgaatggcaagcaggatgagcccaagaatgagcagtag

SEQ ID NO: 18487 - DNA, 939 bp, Artificial Sequence
  Description of Artificial Sequence: Synthetic coding sequence
atggccaaggtgttctccttcatcctggtgaccacagccctgaccatgggccgggagatcagcgccctggaggactgtgcccaggagcagatgaggctgcgggcccaggtgcggctgctggagaccagggtgaagcagcagcaggtgaagatcaagcagctgctgcaggagaatgaggtgcagttcctggacaagggagatgagaacacagtcatcgacctgggcagcaagaggcagtatgctgactgcagcgagatcttcaatgatggctacaagctgagcggcttctacaagatcaagcccctgcagagccctgctgagttctctgtgtactgtgacatgtctgatggcggcggctggacagtcatccagaggagaagtgatggcagcgagaacttcaacagaggctggaaggactatgaaaatggcttcggcaactttgtgcagaagcatggagagtactggctgggcaacaagaacctgcacttcctgaccacccaggaggactacaccctgaagattgacctggccgactttgagaagaacagccgctatgcccagtacaagaacttcaaggtgggagatgagaagaacttctatgagctgaacatcggggagtacagcggcacagctggggacagcctggccggcaacttccaccctgaggtgcagtggtgggccagccaccagaggatgaagttcagcacctgggaccgggaccatgacaactatgagggcaactgtgccgaggaggaccagagcggctggtggttcaaccgctgccacagcgccaacctgaatggagtgtactacagcggcccctacacagccaagacagacaatggaattgtgtggtacacctggcacggctggtggtacagcctgaagtctgtggtgatgaagatccggcccaatgacttcatccccaacgtcatctag

SEQ ID NO: 18488 - DNA, 660 bp, Artificial Sequence
  Description of Artificial Sequence: Synthetic coding sequence
atgagcagccacctggtggagcccccaccacccctgcacaacaacaacaacaactgtgaagaaaatgagcagagcctgcccccacctgctggcctgaacagctcctgggtggagctgcccatgaacagcagcaatggaaatgacaatggaaatggcaagaatggaggcctggagcacgtgcccagcagcagcagcatccacaacggggacatggagaagatcctgctggatgcccagcacgagagcggccagagcagcagccggggcagcagccactgtgacagccccagcccccaggaggatggccagatcatgtttgatgtggagatgcacaccagccgggaccacagcagccagagcgaggaggaggtggtggagggggagaaggaggtggaggccctgaagaagtctgctgactgggtgtctgactggagcagcaggcctgagaacatcccccccaaggagttccacttccgccaccccaagaggtctgtgtccctgtccatgaggaagagcggggccatgaagaagggcggcatcttctctgctgagttcctgaaggtgttcatccccagcctcttcctgagccacgtgctggccctgggcctgggcatctacatcggcaagaggctgagcaccccatctgccagcacctactag

SEQ ID NO: 18489 - DNA, 540 bp, Artificial Sequence
  Description of Artificial Sequence: Synthetic coding sequence
atgaacagcagcaatggaaatgacaatggaaatggcaagaatggaggcctggagcacgtgcccagcagcagcagcatccacaacggggacatggagaagatcctgctggatgcccagcacgagagcggccagagcagcagccggggcagcagccactgtgacagccccagcccccaggaggatggccagatcatgtttgatgtggagatgcacaccagccgggaccacagcagccagagcgaggaggaggtggtggagggggagaaggaggtggaggccctgaagaagtctgctgactgggtgtctgactggagcagcaggcctgagaacatcccccccaaggagttccacttccgccaccccaagaggtctgtgtccctgtccatgaggaagagcggggccatgaagaagggcggcatcttctctgctgagttcctgaaggtgttcatccccagcctcttcctgagccacgtgctggccctgggcctgggcatctacatcggcaagaggctgagcaccccatctgccagcacctactag

SEQ ID NO: 18490 - DNA, 540 bp, Artificial Sequence; identical to SEQ ID NO: 18489
  Description of Artificial Sequence: Synthetic coding sequence

SEQ ID NO: 18491 - DNA, 540 bp, Artificial Sequence; identical to SEQ ID NO: 18489
  Description of Artificial Sequence: Synthetic coding sequence

SEQ ID NO: 18492 - DNA, 636 bp, Artificial Sequence
  Description of Artificial Sequence: Synthetic coding sequence
atggccagcggccagggccctggccccccccggcaggagtgtggggagcccgccctgcccagcgccagcgaggagcaggtggcccaggacacagaggaggtgttccgctcctatgtgttctaccgccaccagcaggagcaggaggccgagggcgtggccgccccagctgaccctgagatggtgaccctgcccctgcagcccagcagcaccatgggccaggtgggccggcagctggccatcattggagatgacatcaacagaagatatgattctgagttccagaccatgctgcagcacctgcagcccacagcagaaaatgcctatgagtacttcaccaagatcgccaccagcctgtttgaaagtggcatcaactggggccgggtggtggccctgctgggcttcggctaccgcctggccctgcacgtgtaccagcacggcctgaccggcttcctgggccaggtgaccaggtttgtggtggacttcatgctgcaccactgcatcgcccgctggatcgcccagagaggaggctgggtggccgccctgaacctgggcaatggccccatcctgaatgtgctggtggtgctgggcgtggtgctgctgggccagtttgtggtgcggcgcttcttcaagagctag

SEQ ID NO: 18493 - DNA, 576 bp, Artificial Sequence
  Description of Artificial Sequence: Synthetic coding sequence
atggccagcggccagggccctggccccccccggcaggagtgtggggagcccgccctgcccagcgccagcgaggagcaggtggcccaggacacagaggaggtgttccgctcctatgtgttctaccgccaccagcagcagcccagcagcaccatgggccaggtgggccggcagctggccatcattggagatgacatcaacagaagatatgattctgagttccagaccatgctgcagcacctgcagcccacagcagaaaatgcctatgagtacttcaccaagatcgccaccagcctgtttgaaagtggcatcaactggggccgggtggtggccctgctgggcttcggctaccgcctggccctgcacgtgtaccagcacggcctgaccggcttcctgggccaggtgaccaggtttgtggtggacttcatgctgcaccactgcatcgcccgctggatcgcccagagaggaggctgggtggccgccctgaacctgggcaatggccccatcctgaatgtgctggtggtgctgggcgtggtgctgctgggccagtttgtggtgcggcgcttcttcaagagctag

SEQ ID NO: 18494 - DNA, 636 bp, Artificial Sequence; identical to SEQ ID NO: 18492
  Description of Artificial Sequence: Synthetic coding sequence

SEQ ID NO: 18495 - DNA, 462 bp, Artificial Sequence
  Description of Artificial Sequence: Synthetic coding sequence
atggccagcggccagggccctggccccccccggcaggagtgtggggagcccgccctgcccagcgccagcgaggagcaggtggcccaggacacagaggaggtgttccgctcctatgtgttctaccgccaccagcaggagcaggaggccgagggcgtggccgccccagctgaccctgagatggtgaccctgcccctgcagcccagcagcaccatgggccaggtgggccggcagctggccatcattggagatgacatcaacagaagatatgattctgagttccagaccatgctgcagcacctgcagcccacagcagaaaatgcctatgagtacttcaccaagatcgccaccaggcctgctgccacccccacagcctgcctgcgggtggccagcattggagctgtgtggtggctgttctgggccagcgccaccgtgtggccctacaccagcacctccatggcctag

SEQ ID NO: 18496 - DNA, 507 bp, Artificial Sequence
  Description of Artificial Sequence: Synthetic coding sequence
atgttccagatccctgagtttgagcccagcgagcaggaggacagcagcagcgctgagcggggcctgggccccagccctgctggagatggccccagcggcagcggcaagcaccaccggcaggcccctggcctgctgtgggatgccagccaccagcaggagcagcccaccagcagcagccaccacggcggggccggggctgtggagatccgcagccgccacagcagctacccagctggaacagaagatgatgagggcatgggagaggagcccagccccttccggggccgcagccgcagcgccccacccaacctgtgggccgcccagagatatggccgggagctgcggaggatgtctgatgaatttgtggacagcttcaagaagggcctgccccggcccaagtctgctggaacagccacccagatgaggcagagcagctcctggaccagggtcttccagagctggtgggacaggaacctgggccggggcagcagcgcccccagccagtag

SEQ ID NO: 18497 - DNA, 507 bp, Artificial Sequence; identical to SEQ ID NO: 18496
  Description of Artificial Sequence: Synthetic coding sequence

SEQ ID NO: 18498 - DNA, 450 bp, Artificial Sequence
  Description of Artificial Sequence: Synthetic coding sequence
atgttccagatccctgagtttgagcccagcgagcaggaggacagcagcagcgctgagcggggcctgggccccagccctgctggagatggccccagcggcagcggcaagcaccaccggcaggcccctggcctgctgtgggatgccagccaccagcaggagcagcccaccagcagcagccaccacggcggggccggggctgtggagatccgcagccgccacagcagctacccagctggaacagaagatgatgagggcatgggagaggagcccagccccttccggggccgcagccgcagcgccccacccaacctgtgggccgcccagagatatggccgggagctgcggaggatgtctgatgaatttgtggacagcttcaagaagggcctgccccggcccaagtctgctggaacagccacccagatgaggcagagcagccggcggctgaggtag

SEQ ID NO: 18499 - DNA, 591 bp, Artificial Sequence
  Description of Artificial Sequence: Synthetic coding sequence
atgaacagaagccaggaggtgaccagagatgaggagagcaccaggtctgaggaggtgacccgggaggagatggctgctgctggcctgactgtgacagtgacccacagcaatgagaagcatgacctgcacgtgaccagccagcagggcagcagcgagcctgtggtgcaggacctggcccaggtggtggaggaggtgattggagtgccccagagcttccagaagctgatcttcaagggcaagagcctgaaggagatggagacccccctgagcgccctgggcatccaggacggctgccgggtgatgctgattggcaagaagaacagcccccaggaggaggtggagctgaagaagctgaagcacctggagaagtctgtggagaagattgctgaccagctggaggagctgaacaaggagctgaccggcatccagcagggcttcctgcccaaggacctgcaggccgaggccctgtgcaagctggacagaagagtgaaggccaccatcgagcagttcatgaagatcctggaggagattgacaccctcatcctgcctgagaacttccccaccctgaccctggtgctgaatgagaagtag

SEQ ID NO: 18500 - DNA, 693 bp, Artificial Sequence
  Description of Artificial Sequence: Synthetic coding sequence
atgaacagaagccaggaggtgaccagagatgaggagagcaccaggtctgaggaggtgacccgggaggagatggctgctgctggcctgactgtgacagtgacccacagcaatgagaagcatgacctgcacgtgaccagccagcagggcagcagcgagcctgtggtgcaggacctggcccaggtggtggaggaggtgattggagtgccccagagcttccagaagctgatcttcaagggcaagagcctgaaggagatggagacccccctgagcgccctgggcatccaggacggctgccgggtgatgctgattggcaagaagaacagcccccaggaggaggtggagctgaagaagctgaagcacctggagaagtctgtggagaagattgctgaccagctggaggagctgaacaaggagctgaccggcatccagcagggcttcctgcccaaggacctgcaggccgaggccctgtgcaagctggacagaagagtgaaggccaccatcgagcagttcatgaagatcctggaggagattgacaccctcatcctgcctgagaacttcaaggacagccggctgaagaggaagggcctggtgaagaaggtgcaggccttcctggccgagtgtgacacagtggagcagaacatctgccaggagacagagcggctgcagagcaccaactttgccctggccgagtag

SEQ ID NO: 18501 - DNA, 1038 bp, Artificial Sequence
  Description of Artificial Sequence: Synthetic coding sequence
ctggcccagagaggaggagcccggcggcccaggggggaccgggagcggctgggcagccggctgcgggccctgcggcccggccgggagccccggcagagcgagcccccagcccagaggggccccccacccagcggccggcccccagcccggagcacagccagcggccatgaccggcccaccagaggagctgctgctggggcccggcggcccaggatgaagaagaagacccggcggcgcagcaccaggtctgaggagctgaccaggtctgaggagctgaccctgtctgaggaggccacctggagcgaggaggccacccagagcgaggaggccacccagggcgaggagatgaacagaagccaggaggtgaccagagatgaggagagcaccaggtctgaggaggtgacccgggaggagatggctgctgctggcctgactgtgacagtgacccacagcaatgagaagcatgacctgcacgtgaccagccagcagggcagcagcgagcctgtggtgcaggacctggcccaggtggtggaggaggtgattggagtgccccagagcttccagaagctgatcttcaagggcaagagcctgaaggagatggagacccccctgagcgccctgggcatccaggacggctgccgggtgatgctgattggcaagaagaacagcccccaggaggaggtggagctgaagaagctgaagcacctggagaagtctgtggagaagattgctgaccagctggaggagctgaacaaggagctgaccggcatccagcagggcttcctgcccaaggacctgcaggccgaggccctgtgcaagctggaccggcgggtgaaggccaccatcgagcagttcatgaagatcctggaggagattgacaccctcatcctgcctgagaacttcaaggacagccggctgaagaggaagggcctggtgaagaaggtgcaggccttcctggctgaatgtgacacagtggagcagaacatctgccaggagacagagcggctgcagagcaccaactttgccctggccgagtag

SEQ ID NO: 18502 - DNA, 1728 bp, Artificial Sequence
  Description of Artificial Sequence: Synthetic coding sequence
atgtctgctgccacccacagccccatgatgcaggtggccagcggaaatggagaccgggaccccctgcccccaggctgggagatcaagattgacccccagacaggctggcccttctttgtggaccacaacagcaggaccaccacctggaatgacccccgggtgcccagcgagggccccaaggagacccccagcagcgccaacggccccagccgggagggcagccggctgcccccagcccgggagggccaccctgtgtacccccagctgcggcccggctacatccccatccctgtgctgcacgagggcgctgagaaccggcaggtgcaccccttccacgtgtacccccagcccggcatgcagcgcttcagaacagaggccgctgctgctgccccccagaggagccagagccccctgcggggcatgcctgagaccacccagcctgacaagcagtgtggccaggtggccgctgctgctgctgcccagcccccagccagccacggccctgagaggagccagagccctgctgccagtgactgcagcagcagcagcagcagcgccagcctgcccagcagcggccgcagcagcctgggcagccaccagctgccccggggctacatcagcatccctgtgatccacgagcagaatgtgaccaggcctgctgcccagcccagcttccaccaggcccagaagacccactacccagcccagcagggcgagtaccagacccaccagcctgtgtaccacaagatccagggagatgactgggagccccggcccctgcgggccgccagccccttccgcagctctgtgcagggcgccagcagccgggagggcagccctgcccggagcagcacccccctgcacagccccagccccatccgggtgcacacagtggtggaccggccccagcagcccatgacccaccgggagacagcccctgtgtcccagcctgagaacaagccagagagcaagccaggccctgtgggccctgagctgcccccaggccacatccccatccaggtgatcaggaaggaggtggacagcaagcctgtgtcccagaagcccccacctccttctgagaaggtggaggtgaaggtgcccccagcccctgtgccctgccccccacccagccctggccccagcgctgtgcccagcagccccaagtctgtggccacagaggagcgggccgcccccagcacagccccagctgaggccaccccacccaagccaggagaggccgaggccccacccaagcaccctggggtgctgaaggtggaggccatcctggagaaggtgcagggcctggagcaggccgtggacaactttgagggcaagaagacagacaagaagtacctgatgattgaggagtacctgaccaaggagctgctggccctggacagcgtggaccctgagggccgggcagatgtgcggcaggccaggagagatggagtgaggaaggtgcagaccatcctggagaagctggagcagaaggccattgatgtgcccggccaggtgcaggtgtatgagctgcagcccagcaacctggaggccgaccagcccctgcaggccatcatggagatgggcgctgtggccgctgacaagggcaagaagaatgctggaaatgctgaggacccccacacagagacccagcagcctgaggccacagctgctgccaccagcaaccccagctccatgacagacaccccaggcaacccagctgccccctag

SEQ ID NO: 18503 - DNA, 978 bp, Artificial Sequence
  Description of Artificial Sequence: Synthetic coding sequence
atgcaggagacccccagcagcgccaacggccccagccgggagggcagccggctgcccccagcccgggagggccaccctgtgtacccccagctgcggcccggctacatccccatccctgtgctgcacgagggcgctgagaaccggcaggtgcaccccttccacgtgtacccccagcccggcatgcagcgcttcagaacagaggccgctgctgctgccccccagaggagccagagccccctgcggggcatgcctgagaccacccagcctgacaagcagtgtggccaggtggccgctgctgctgctgcccagcccccagccagccacggccctgagaggagccagagccctgctgccagtgactgcagcagcagcagcagcagcgccagcctgcccagcagcggccgcagcagcctgggcagccaccagctgccccggggctacatcagcatccctgtgatccacgagcagaatgtgaccaggcctgctgcccagcccagcttccaccaggcccagaagacccactacccagcccagcagggcgagtaccagacccaccagcctgtgtaccacaagatccagggagatgactgggagccccggcccctgcgggccgccagccccttccgcagctctgtgcagggcgccagcagccgggagggcagccctgcccggagcagcacccccctgcacagccccagccccatccgggtgcacacagtggtggaccggccccagcccatgacccaccgggagacagcccctgtgtcccagcctgagaacaagccagagagcaagccaggccctgtgggccctgagctgcccccaggccacatccccatccaggtgatcaggaaggaggtggacagcaagcctgtgtcccagaagcccccaccacccagcgagaaggtggaggtgaaggtgcccccagcccctgtgccctgccccccacccagccctggccccagcgctgtgccctag

SEQ ID NO: 18504 - DNA, 657 bp, Artificial Sequence
  Description of Artificial Sequence: Synthetic coding sequence
atggatggcagcggggagcagccccggggcggcggccccaccagcagcgagcagatcatgaagacaggagccctgctgctgcagggcttcatccaggacagagctggccgcatgggcggggaggcccctgagctggccctggaccctgtgccccaggatgccagcaccaagaagctgtctgaatgtctgaagagaattggagatgagctggacagcaacatggagctgcagaggatgattgctgctgtggacacagacagcccccgggaggtgttcttccgggtggccgctgacatgttcagtgatggcaacttcaactggggccgggtggtggccctcttctactttgccagcaagctggtgctgaaggccctgtgcaccaaggtgcctgagctgatccgcaccatcatgggctggaccctggacttcctgcgggagcggctgctgggctggatccaggaccagggcggctgggtgcggctgctgaagccaccccacccccaccaccgggccctgaccacagccccagccccacccagcctgcccccagccacccccctgggcccctgggccttctggagccgcagccagtggtgccccctgcccatcttccgcagcagtgatgtggtgtacaatgccttcagcctgcgggtgtag

SEQ ID NO: 18505 - DNA, 579 bp, Artificial Sequence
  Description of Artificial Sequence: Synthetic coding sequence
atggatggcagcggggagcagccccggggcggcggccccaccagcagcgagcagatcatgaagacaggagccctgctgctgcagggcttcatccaggacagagctggccgcatgggcggggaggcccctgagctggccctggaccctgtgccccaggatgccagcaccaagaagctgtctgaatgtctgaagagaattggagatgagctggacagcaacatggagctgcagaggatgattgctgctgtggacacagacagcccccgggaggtgttcttccgggtggccgctgacatgttcagtgatggcaacttcaactggggccgggtggtggccctcttctactttgccagcaagctggtgctgaaggccctgtgcaccaaggtgcctgagctgatccgcaccatcatgggctggaccctggacttcctgcgggagcggctgctgggctggatccaggaccagggcggctgggatggcctgctgagctacttcggcacccccacctggcagacagtgaccatctttgtggccggcgtgctgacagccagcctgaccatctggaagaagatgggctag

SEQ ID NO: 18506 - DNA, 432 bp, Artificial Sequence
  Description of Artificial Sequence: Synthetic coding sequence
atggatggcagcggggagcagccccggggcggcggccccaccagcagcgagcagatcatgaagacaggagccctgctgctgcagggcatgattgctgctgtggacacagacagcccccgggaggtgttcttccgggtggccgctgacatgttcagtgatggcaacttcaactggggccgggtggtggccctcttctactttgccagcaagctggtgctgaaggccctgtgcaccaaggtgcctgagctgatccgcaccatcatgggctggaccctggacttcctgcgggagcggctgctgggctggatccaggaccagggcggctgggatggcctgctgagctacttcggcacccccacctggcagacagtgaccatctttgtggccggcgtgctgacagccagcctgaccatctggaagaagatgggctag

SEQ ID NO: 18507 - DNA, 126 bp, Artificial Sequence
  Description of Artificial Sequence: Synthetic coding sequence
atggatggcagcggggagcagccccggggcggcgtgagcagccgcatcgagcagggcgagtggggcggccgccaccccagctggccctggacccgctgcctgaggatgaggcctcccaggagctag

SEQ ID NO: 18508 - DNA, 540 bp, Artificial Sequence
  Description of Artificial Sequence: Synthetic coding sequence
atggatggcagcggggagcagccccggggcggcggccccaccagcagcgagcagatcatgaagacaggagccctgctgctgcagggcttcatccaggacagagctggccgcatgggcggggaggcccctgagctggccctggaccctgtgccccaggatgccagcaccaagaagctgtctgaatgtctgaagagaattggagatgagctggacagcaacatggagctgcagaggatgattgctgctgtggacacagacagcccccgggaggtgttcttccgggtggccgctgacatgttcagtgatggcaacttcaactggggccgggtggtggccctcttctactttgccagcaagctggtgctgaaggccctgtgcaccaaggtgcctgagctgatccgcaccatcatgggctggaccctggacttcctgcgggagcggctgctgggctggatccaggaccagggcggctggacagtgaccatctttgtggccggcgtgctgacagccagcctgaccatctggaagaagatgggctag

SEQ ID NO: 18509 - DNA, 495 bp, Artificial Sequence
  Description of Artificial Sequence: Synthetic coding sequence
atggatggcagcggggagcagccccggggcggcggccccaccagcagcgagcagatcatgaagacaggagccctgctgctgcagggcttcatccaggacagagctggccgcatgggcggggaggcccctgagctggccctggaccctgtgccccaggatgccagcaccaagaagctgtctgaatgtctgaagagaattggagatgagctggacagcaacatggagctgcagaggatgattgctgctgtggacacagacagcccccgggaggtgttcttccgggtggccgctgacatgttcagtgatggcaacttcaactggggccgggtggtggccctcttctactttgccagcaagctggtgctgaaggccggcgtgaagtggagggacctgggcagcctgcagcccctgcccccaggcttcaagcgcttcacctgcctgagcatccccaggtcctgggactaccggccctgtgccccccgctgcagaaattag

SEQ ID NO: 18510 - DNA, 1806 bp, Artificial Sequence
  Description of Artificial Sequence: Synthetic coding sequence
atggcctatgatgacagcgtgaagaaggaggactgctttgatggagaccacacctttgaggacatcggcctggccgccggccgcagccagcgggagaagaagaggagctacaaggacttcctgcgggaggaggaggagattgctgcccaggtgaggaacagcagcaagaagaagctgaaggacagcgagctgtacttcctgggcacagacacccacaagaagaagaggaagcacagcagtgatgactactactatggagacatcagcagcctggagagcagccagaagaagaagaagaagagcagcccccagagcacagacacagccatggacctgctgaaggccatcaccagccccctggccgccggcagcaagcccagcaagaagacaggagagaagagcagcggcagcagcagccacagcgagagcaagaaggagcaccacaggaagaaggtgtctggcagcagcggggagctgcccctggaggatggcggcagccacaagagcaagaagatgaagcccctgtatgtgaacacagagaccctgaccctgcgggagccagatggcctgaagatgaagctgatcctgagccccaaggagaagggcagcagctctgtggatgaggagagcttccagtaccccagccagcaggccaccgtgaagaagagcagcaagaagagcgccagagatgagcagggcgccctgctgctgggccacgagctgcagagcttcctgaagacagccaggaagaagcacaagagcagcagtgatgcccacagcagccctggccctgagggctgcggcagtgatgccagccagtttgctgagagccacagcgccaacctggacctgagcggcctggagcccatcctggtggagagtgacagcagcagcggcggggagctggaggccggggagctggtgattgatgacagctaccgggagatcaagaagaagaagaagagcaagaagagcaagaagaagaaggacaaggagaagcacaaggagaagaggcacagcaagagcaagaggagcctgggcctgtctgctgtgcctgtgggggaggtgacagtgaccagcggccccccacccagcatcccctatgctggggccgccgccccacccctgcccctgcccggcctgcacacagatggccacagcgagaagaagaagaagaaggaggagaaggacaaggagcgggagcggggggagaagcccaagaagaagaacatgtctgcctaccaggtgttctgcaaggagtacagagtgaccatcgtggccgaccaccctggcatcgactttggagagctgagcaagaagctggccgaggtgtggaagcagctgcctgagaaggacaagctgatctggaagcagaaggcccagtacctgcagcacaagcagaacaaggccgaggccaccaccgtgaagaggaaggccagcagcagcgagggctccatgaaggtgaaggccagctctgtgggcgtgctgagcccccagaagaagagcccccccaccaccatgctgctgcctgccagccctgccaaggcccctgagacagagcccattgatgtggccgcccacctgcagctgctgggggagagcctgagcctcatcggccaccggctgcaggagacagagggcatggtggccgtgtctggcagcctgtctgtgctgctggacagcatcatctgtgccctgggccccctggcctgcctgaccacccagctgcctgagctgaatggctgccccaagcaggtgctgagcaacaccctggacaacatcgcctacatcatgcctggcctgtag

SEQ ID NO: 18511 - DNA, 702 bp, Artificial Sequence
  Description of Artificial Sequence: Synthetic coding sequence
atgagccagagcaaccgggagctggtggtggacttcctgagctacaagctgagccagaagggctacagctggagccagttcagtgatgtggaggagaacagaacagaggcccctgagggcacagaaagtgagatggagaccccatctgccatcaatggaaaccccagctggcacctggccgacagccctgctgtgaatggagccaccggccacagcagcagcctggatgcccgggaggtgatccccatggctgctgtgaagcaggccctgcgggaggccggagatgaatttgagctgcgctaccgccgggccttcagtgacctgaccagccagctgcacatcaccccaggcacagcctaccagagctttgagcaggtggtgaatgagctgttcagagatggagtgaactggggccgcatcgtggccttcttctcctttggaggagccctgtgtgtggagagcgtggacaaggagatgcaggtgctggtgtccagaattgctgcctggatggccacctacctgaatgaccacctggagccctggatccaggagaatggaggctgggacacctttgtggagctgtatggcaacaatgctgctgctgagagcaggaagggccaggagcgcttcaaccgctggttcctgaccggcatgacagtggccggcgtggtgctgctgggcagcctcttcagcaggaagtag

SEQ ID NO: 18512 - DNA, 513 bp, Artificial Sequence
  Description of Artificial Sequence: Synthetic coding sequence
atgagccagagcaaccgggagctggtggtggacttcctgagctacaagctgagccagaagggctacagctggagccagttcagtgatgtggaggagaacagaacagaggcccctgagggcacagaaagtgagatggagaccccatctgccatcaatggaaaccccagctggcacctggccgacagccctgctgtgaatggagccaccggccacagcagcagcctggatgcccgggaggtgatccccatggctgctgtgaagcaggccctgcgggaggccggagatgaatttgagctgcgctaccgccgggccttcagtgacctgaccagccagctgcacatcaccccaggcacagcctaccagagctttgagcaggacacctttgtggagctgtatggcaacaatgctgctgctgagagcaggaagggccaggagcgcttcaaccgctggttcctgaccggcatgacagtggccggcgtggtgctgctgggcagcctcttcagcaggaagtag

SEQ ID NO: 18513 - DNA, 702 bp, Artificial Sequence; identical to SEQ ID NO: 18511
  Description of Artificial Sequence: Synthetic coding sequence

SEQ ID NO: 18514 - DNA, 567 bp, Artificial Sequence
  Description of Artificial Sequence: Synthetic coding sequence
atgagccagagcaaccgggagctggtggtggacttcctgagctacaagctgagccagaagggctacagctggagccagttcagtgatgtggaggagaacagaacagaggcccctgagggcacagaaagtgagatggagaccccatctgccatcaatggaaaccccagctggcacctggccgacagccctgctgtgaatggagccaccggccacagcagcagcctggatgcccgggaggtgatccccatggctgctgtgaagcaggccctgcgggaggccggagatgaatttgagctgcgctaccgccgggccttcagtgacctgaccagccagctgcacatcaccccaggcacagcctaccagagctttgagcaggtggtgaatgagctgttcagagatggagtgaactggggccgcatcgtggccttcttctcctttggaggagccctgtgtgtggagagcgtggacaaggagatgcaggtgctggtgtccagaattgctgcctggatggccacctacctgaatgaccacctggagccctggatccaggagaatggaggctggtag

SEQ ID NO: 18515 - DNA, 702 bp, Artificial Sequence; identical to SEQ ID NO: 18511
  Description of Artificial Sequence: Synthetic coding sequence

SEQ ID NO: 18516 - DNA, 567 bp, Artificial Sequence; identical to SEQ ID NO: 18514
  Description of Artificial Sequence: Synthetic coding sequence

SEQ ID NO: 18517 - DNA, 147 bp, Artificial Sequence
  Description of Artificial Sequence: Synthetic coding sequence
atgagccagagcaaccgggagctggtggtggacttcctgagctacaagctgagccagaagggctacagctggagccagttcagtgatgtggaggagaacagaacagaggcccctgagggcacagaaagtgagatggagaccccctag

SEQ ID NO: 18518 - DNA, 546 bp, Artificial Sequence
  Description of Artificial Sequence: Synthetic coding sequence
atgagccagagcaaccgggagctggtggtggacttcctgagctacaagctgagccagaagggctacagctggagccagttcagtgatgtggaggagaacagaacagaggcccctgagggcacagaaagtgagatggagaccccatctgccatcaatggaaaccccagctggcacctggccgacagccctgctgtgaatggagccaccggccacagcagcagcctggatgcccgggaggtgatccccatggctgctgtgaagcaggccctgcgggaggccggagatgaatttgagctgcgctaccgccgggccttcagtgacctgaccagccagctgcacatcaccccaggcacagcctaccagagctttgagcaggtggtgaatgagctgttcagagatggagtgaactggggccgcatcgtggccttcttctcctttggaggagccctgtgtgtggagagcgtggacaaggagatgcaggtgctggtgtccagaattgctgcctggatggccacctacctgaatgaccacctggagccctggtag

SEQ ID NO: 18519 - DNA, 618 bp, Artificial Sequence
  Description of Artificial Sequence: Synthetic coding sequence
atgagccagagcaaccgggagctggtggtggacttcctgagctacaagctgagccagaagggctacagctggagccagttcagtgatgtggaggagaacagaacagaggcccctgagggcacagaaagtgagatggagaccccatctgccatcaatggaaaccccagctggcacctggccgacagccctgctgtgaatggagccaccggccacagcagcagcctggatgcccgggaggtgatccccatggctgctgtgaagcaggccctgcgggaggccggagatgaatttgagctgcgctaccgccgggccttcagtgacctgaccagccagctgcacatcaccccaggcacagcctaccagagctttgagcaggtggtgaatgagctgttcagagatggagtgaactggggccgcatcgtggccttcttctcctttggaggagccctgtgtgtggagagcgtggacaaggagatgcaggtgctggtgtccagaattgctgcctggatggccacctacctgaatgaccacctggagccctggatccaggagaatggaggctgggacacctttgtggagctgtatggcaacaatgctgctgctgagagcaggaagtag

SEQ ID NO: 18520 - DNA, 567 bp, Artificial Sequence; identical to SEQ ID NO: 18514
  Description of Artificial Sequence: Synthetic coding sequence

SEQ ID NO: 18521 - DNA, 615 bp, Artificial Sequence
  Description of Artificial Sequence: Synthetic coding sequence
atggtggaccagctgcgggagaggaccaccatggctgaccccctgcgggagaggacagagctgctgctggccgactacctgggctactgtgcccgggagcccggcaccccagagcccgcccccagcaccccagaggccgctgtgctgcggtctgctgctgcccggctgcggcagatccacaggagcttcttcagcgcctacctgggctacccaggcaacagatttgagctggtggccctgatggctgacagcgtgctgagtgacagccctggccccacctggggccgggtggtgaccctggtgacctttgctggcaccctgctggagcggggccccctggtgacagcccgctggaagaagtggggcttccagccccggctgaaggagcaggagggagatgtggcccgggactgccagaggctggtggccctgctgagcagccggctgatgggccagcaccgggcctggctgcaggcccagggcggctgggatggcttctgccacttcttccgcacccccttccccctggccttctggaggaagcagctggtgcaggccttcctgagctgcctgctgaccacagccttcatctacctgtggacccggctgctgtag

SEQ ID NO: 18522 - DNA, 417 bp, Artificial Sequence
  Description of Artificial Sequence: Synthetic coding sequence
atggccaagcagcccagtgatgtgtccagtgaatgtgaccgggagggccggcagctgcagcctgctgagaggcctccccagctgcggcctggggcccccaccagcctgcagacagagccccaggacaggagccctgcccccatgagctgtgacaagagcacccagacccccagccccccctgccaggccttcaaccactacctgagcgccatggcctccatgaggcaggccgagcctgctgacatgaggcctgagatctggatcgcccaggagctgcggagaattggagatgagttcaatgcctactatgcccggcgggtcttcctgaacaactaccaggccgctgaggaccaccccaggatggtgatcctgcggctgctgcgctacatcgtgcggctggtgtggaggatgcactag

SEQ ID NO: 18523 - DNA, 339 bp, Artificial Sequence
  Description of Artificial Sequence: Synthetic coding sequence
atggccaagcagcccagtgatgtgtccagtgaatgtgaccgggagggccggcagctgcagcctgctgagaggcctccccagctgcggcctggggcccccaccagcctgcagacagagccccaggacaggagccctgcccccatgagctgtgacaagagcacccagacccccagccccccctgccaggccttcaaccactacctgagcgccatggtggtgatcctggaggacatcggggacctgagcctgtgcttcggcttcatcttcaccggcctggacctgtatggccaccaccacagccaggacacagagcagctgaaccacaaggacttctcctag

SEQ ID NO: 18524 - DNA, 519 bp, Artificial Sequence
  Description of Artificial Sequence: Synthetic coding sequence
atggccaagcagcccagtgatgtgtccagtgaatgtgaccgggagggccggcagctgcagcctgctgagaggcctccccagctgcggcctggggcccccaccagcctgcagacagagccccagggcaaccctgagggcaaccacggcggggagggggacagctgcccccacggcagcccccagggccccctggcccccccagccagccctggcccctttgccaccaggagccccctcttcatcttcatgaggaggagcagcctgctgagccgcagcagcagcggctacttctcctttgacacagacaggagccctgcccccatgagctgtgacaagagcacccagacccccagccccccctgccaggccttcaaccactacctgagcgccatggcctccatgaggcaggccgagcctgctgacatgaggcctgagatctggatcgcccaggagctgcggagaattggagatgagttcaatgcctactatgcccggaggatgcccctgcccccagactag

SEQ ID NO: 18525 - DNA, 219 bp, Artificial Sequence
  Description of Artificial Sequence: Synthetic coding sequence
atggccaagcagcccagtgatgtgtccagtgaatgtgaccgggagggccggcagctgcagcctgctgagaggcctccccagctgcggcctggggcccccaccagcctgcagacagagccccagggcaaccctgagggcaaccacggcggggagggggacagctgcccccacggcagcccccagggccccctggcccccccagccagccctggcccctag

SEQ ID NO: 18526 - DNA, 258 bp, Artificial Sequence
  Description of Artificial Sequence: Synthetic coding sequence
atggccaagcagcccagtgatgtgtccagtgaatgtgaccgggagggccggcagctgcagcctgctgagaggcctccccagctgcggcctggggcccccaccagcctgcagacagagccccaggcctccatgaggcaggccgagcctgctgacatgaggcctgagatctggatcgcccaggagctgcggagaattggagatgagttcaatgcctactatgcccggcggctggccaagctgctggccagcagcacctag

SEQ ID NO: 18527 - DNA, 597 bp, Artificial Sequence
  Description of Artificial Sequence: Synthetic coding sequence
atggccaagcagcccagtgatgtgtccagtgaatgtgaccgggagggccggcagctgcagcctgctgagaggcctccccagctgcggcctggggcccccaccagcctgcagacagagccccagggcaaccctgagggcaaccacggcggggagggggacagctgcccccacggcagcccccagggccccctggcccccccagccagccctggcccctttgccaccaggagccccctcttcatcttcatgaggaggagcagcctgctgagccgcagcagcagcggctacttctcctttgacacagacaggagccctgcccccatgagctgtgacaagagcacccagacccccagccccccctgccaggccttcaaccactacctgagcgccatggcctccatgaggcaggccgagcctgctgacatgaggcctgagatctggatcgcccaggagctgcggagaattggagatgagttcaatgcctactatgcccggcgggtcttcctgaacaactaccaggccgctgaggaccaccccaggatggtgatcctgcggctgctgcgctacatcgtgcggctggtgtggaggatgcactag

SEQ ID NO: 18528 - DNA, 369 bp, Artificial Sequence
  Description of Artificial Sequence: Synthetic coding sequence
atggccaagcagcccagtgatgtgtccagtgaatgtgaccgggagggccggcagctgcagcctgctgagaggcctccccagctgcggcctggggcccccaccagcctgcagacagagccccagggcaaccctgagggcaaccacggcggggagggggacagctgcccccacggcagcccccagggccccctggcccccccagccagccctggcccctttgccaccaggagccccctcttcatcttcatgaggaggagcagcctgctgagccgcagcagcagcggctacttctcctttgacacagacaggagccctgcccccatgagctgtgacaagagcacccagacccccagccccccctgccagtag

SEQ ID NO: 18529 - DNA, 222 bp, Artificial Sequence
  Description of Artificial Sequence: Synthetic coding sequence
atgaggcaggccgagcctgctgacatgaggcctgagatctggatcgcccaggagctgcggagaattggagatgagttcaatgcctactatgcccggcgggtgatgatgttcagcctgcctgccttcctgctgacccccagccccagcaccctgtacttcttcaagaagacagtgaccagctgcaactacatgctgatcctggagatgatcaccgtggcctag

SEQ ID NO: 18530 - DNA, 243 bp, Artificial Sequence
  Description of Artificial Sequence: Synthetic coding sequence
atggccaagcagcccagtgatgtgtccagtgaatgtgaccgggagggccggcagctgcagcctgctgagaggcctccccagctgcggcctggggcccccaccagcctgcagacagagccccaggacaggagccctgcccccatgagctgtgacaagagcacccagacccccagccccccctgccaggccttcaaccactacctgagcgccatggtgcgggagattgaggaggtggtggtgtag

SEQ ID NO: 18531 - DNA, 408 bp, Artificial Sequence
  Description of Artificial Sequence: Synthetic coding sequence
atggccaagcagcccagtgatgtgtccagtgaatgtgaccgggagggccggcagctgcagcctgctgagaggcctccccagctgcggcctggggcccccaccagcctgcagacagagccccagggcaaccctgagggcaaccacggcggggagggggacagctgcccccacggcagcccccagggccccctggcccccccagccagccctggcccctttgccaccaggagccccctcttcatcttcatgaggaggagcagcctgctgagccgcagcagcagcggctacttctcctttgacacagacaggagccctgcccccatgagctgtgacaagagcacccagacccccagccccccctgccaggccttcaaccactacctgagcgccatggccaactgggactag

SEQ ID NO: 18532 - DNA, 423 bp, Artificial Sequence
  Description of Artificial Sequence: Synthetic coding sequence
atggccaagcagcccagtgatgtgtccagtgaatgtgaccgggagggccggcagctgcagcctgctgagaggcctccccagctgcggcctggggcccccaccagcctgcagacagagccccagggcaaccctgagggcaaccacggcggggagggggacagctgcccccacggcagcccccagggccccctggcccccccagccagccctggcccctttgccaccaggagccccctcttcatcttcatgaggaggagcagcctgctgagccgcagcagcagcggctacttctcctttgacacagacaggagccctgcccccatgagctgtgacaagagcacccagacccccagccccccctgccaggccttcaaccactacctgagcgccatggtgcgggagattgaggaggtggtggtgtag

SEQ ID NO: 18533 - DNA, 291 bp, Artificial Sequence
  Description of Artificial Sequence: Synthetic coding sequence
aagcagcccagtgatgtgtccagtgaatgtgaccgggagggccggcagctgcagcctgctgagaggcctccccagctgcggcctggggcccccaccagcctgcagacagagccccaggacaggagccctgcccccatgagctgtgacaagagcacccagacccccagccccccctgccaggccttcaaccactacctgagcgccatggatgacagcgctggcagcagcctgagaattgccctgcaccgggaggtgcagtggcccctgaagtggctggccaagagcagctag

SEQ ID NO: 18534 - DNA, 249 bp, Artificial Sequence
  Description of Artificial Sequence: Synthetic coding sequence
atggccaagcagcccagtgatgtgtccagtgaatgtgaccgggagggccggcagctgcagcctgctgagaggcctccccagctgcggcctggggcccccaccagcctgcagacagagccccaggcctccatgaggcaggccgagcctgctgacatgaggcctgagatctggatcgcccaggagctgcggagaattggagatgagttcaatgcctactatgcccggaggatgcccctgcccccagactag

SEQ ID NO: 18535 - DNA, 582 bp, Artificial Sequence
  Description of Artificial Sequence: Synthetic coding sequence
atggccaccccagccagcgccccagacacccgggccctggtggccgactttgtgggctacaagctgcggcagaagggctacgtgtgtggggccggccctggagagggccctgctgctgaccccctgcaccaggccatgagagctgctggagatgaatttgagacccgcttccggaggaccttcagtgacctggccgcccagctgcacgtgaccccaggcagcgcccagcagcgcttcacccaggtgtctgatgagctgttccagggcggccccaactggggccgcctggtggccttctttgtgtttggagctgccctgtgtgccgagagcgtgaacaaggagatggagcccctggtgggccaggtgcaggagtggatggtggcctacctggagacccagctggccgactggatccacagcagcggcggctgggccgagttcaccgccctgtatggagatggagccctggaggaggcccggcggctgcgggagggcaactgggcctctgtgaggacagtgctgactggagctgtggccctgggcgccctggtgacagtgggcgccttctttgccagcaagtag

SEQ ID NO: 18536 - DNA, 156 bp, Artificial Sequence
  Description of Artificial Sequence: Synthetic coding sequence
atggccaccccagccagcgccccagacacccgggccctggtggccgactttgtgggctacaagctgcggcagaagggctacgtgtgtggggccggccctggagagggccctgctgctgaccccctgcaccaggccatgagagctgctggggactag

SEQ ID NO: 18537 - DNA, 219 bp, Artificial Sequence
  Description of Artificial Sequence: Synthetic coding sequence
atggccaccccagccagcgccccagacacccgggccctggtggccgactttgtgggctacaagctgcggcagaagggctacgtgtgtggggccggccctggagagggccctgctgctgaccccctgcaccaggccatgagagctgctggagatgaatttgagacccgcttccggaggaccttcagtgacctggccgcccagctgcacgtgaccccctag

SEQ ID NO: 18538 - DNA, 450 bp, Artificial Sequence
  Description of Artificial Sequence: Synthetic coding sequence
atggccaccccagccagcgccccagacacccgggccctggtggccgactttgtgggctacaagctgcggcagaagggctacgtgtgtggggccggccctggagagggccctgctgctgaccccctgcaccaggccatgagagctgctggagatgaatttgagacccgcttccggaggaccttcagtgacctggccgcccagctgcacgtgaccccaggcagcgcccagcagcgcttcacccaggtgtctgatgagctgttccagggcggccccaactggggccgcctggtggccttctttgtgtttggagctgccctgtgtgccgagagcgtgaacaaggagatggagcccctggtgggccaggtgcaggagtggatggtggcctacctggagacccagctggccgactggatccacagcagcggcggctgggccgagttcaccgcctag

SEQ ID NO: 18539 - DNA, 435 bp, Artificial Sequence
  Description of Artificial Sequence: Synthetic coding sequence
atggccaccccagccagcgccccagacacccgggccctggtggccgactttgtgggctacaagctgcggcagaagggctacgtgtgtggggccggccctggagagggccctgctgctgaccccctgcaccaggccatgagagctgctggagatgaatttgagacccgcttccggaggaccttcagtgacctggccgcccagctgcacgtgaccccaggcagcgcccagcagcgcttcacccaggtgtctgatgagctgttccagggcggccccaactggggccgcctggtggccttctttgtgtttggagctgccctgtgtgccgagagcgtgaacaaggagatggagcccctggtgggccaggtgcaggagtggatggtggcctacctggagacccagctggccgactggatccacagcagcggcggctggtag

SEQ ID NO: 18540 - DNA, 528 bp, Artificial Sequence
  Description of Artificial Sequence: Synthetic coding sequence
atgacagactgtgaatttggctacatctaccgcctggcccaggactacctgcagtgtgtgctgcagatcccccagcccggcagcggccccagcaagaccagccgggtgctgcagaatgtggccttctctgtgcagaaggaggtggagaagaacctgaagagctgcctggacaacgtgaatgtggtgtctgtggacacagcccggaccctcttcaaccaggtgatggagaaggagtttgaagatggcatcatcaactggggcagaattgtgaccatctttgcctttgagggcatcctgatcaagaagctgctgcggcagcagatcgccccagatgtggacacctacaaggagatctcctactttgtggccgagttcatcatgaacaacacaggagagtggatccggcagaatggaggctgggagaatggatttgtgaagaagtttgagcccaagagcggctggatgaccttcctggaggtgacaggcaagatctgtgagatgctgagcctgctgaagcagtactgctag

SEQ ID NO: 18541 - DNA, 492 bp, Artificial Sequence
  Description of Artificial Sequence: Synthetic coding sequence
atgacagactgtgaatttggctacatctaccgcctggcccaggactacctgcagtgtgtgctgcagatcccccagcccggcagcggccccagcaagaccagccgggtgctgcagaatgtggccttctctgtgcagaaggaggtggagaagaacctgaagagctgcctggacaacgtgaatgtggtgtctgtggacacagcccggaccctcttcaaccaggtgatggagaaggagtttgaagatggcatcatcaactggggcagaattgtgaccatctttgcctttgagggcatcctgatcaagaagctgctgcggcagcagatcgccccagatgtggacacctacaaggagatctcctactttgtggccgagttcatcatgaacaacacaggagagtggatccggcagaatggaggctggggcaagtggcacaaccacacccccatgctggtggagagcgtggcccacaagaagaggaagatggccctgtag

SEQ ID NO: 18542 - DNA, 726 bp, Artificial Sequence
  Description of Artificial Sequence: Synthetic coding sequence
atgtgcagcggggccggcgtgatgatggcccgctgggccgcccggggccgggccggctggaggagcacagtgcgcatcctgagccccctgggccactgtgagcccggggtgagccgcagctgcagagctgcccaggccatggactgtgaggtgaacaacggcagcagcctgagagatgagtgcatcaccaacctgctggtgtttggcttcctgcagagctgcagcgacaacagcttccggcgggagctggatgccctgggccacgagctgcctgtgctggccccccagtgggagggctatgatgagctgcagacagatggcaacagaagcagccacagccggctgggccgcatcgaggccgacagcgagagccaggaggacatcatccggaacatcgcccggcacctggcccaggtgggggacagcatggacaggagcatccccccaggcctggtgaatggcctggccctgcagctgaggaacaccagccgctcagaagaagatagaaacagagacctggccacagccctggagcagctgctgcaggcctacccccgggacatggagaaggagaagaccatgctggtgctggccctgctgctggccaagaaggtggccagccacacccccagcctgctgagagatgtgttccacaccaccgtgaacttcatcaaccagaacctgcggacctacgtgcgcagcctggccagaaatggcatggactag

SEQ ID NO: 18543 - DNA, 414 bp, Artificial Sequence
  Description of Artificial Sequence: Synthetic coding sequence
atggactgtgaggtgaacaacggcagcagcctgagagatgagtgcatcaccaacctgctggtgtttggcttcctgcagagctgcagcgacaacagcttccggcgggagctggatgccctgggccacgagctgcctgtgctggccccccagtgggagggctatgatgagctgcagacagatggcaacagaagcagccacagccggctgggccgcatcgaggccggggccagtgacaacaacacagccagcgctgaggaggagacagaggccgccggctctgtggccgtggagcggggcctgcatggagctgccaccgtcatcctgaaggtgaagaagaccagcagcggcatcctgcccggcaccagccccaggtctggaacagcctggacagtggccagcctgcgggcctggtag

SEQ ID NO: 18544 - DNA, 300 bp, Artificial Sequence
  Description of Artificial Sequence: Synthetic coding sequence
atggacaggagcatccccccaggcctggtgaatggcctggccctgcagctgaggaacaccagccgctcagaagaagatagaaacagagacctggccacagccctggagcagctgctgcaggcctacccccgggacatggagaaggagaagaccatgctggtgctggccctgctgctggccaagaaggtggccagccacacccccagcctgctgagagatgtgttccacaccaccgtgaacttcatcaaccagaacctgcggacctacgtgcgcagcctggccagaaatggcatggactag

SEQ ID NO: 18545 - DNA, 300 bp, Artificial Sequence; identical to SEQ ID NO: 18544
  Description of Artificial Sequence: Synthetic coding sequence

SEQ ID NO: 18546 - DNA, 588 bp, Artificial Sequence
  Description of Artificial Sequence: Synthetic coding sequence
atggactgtgaggtgaacaacggcagcagcctgagagatgagtgcatcaccaacctgctggtgtttggcttcctgcagagctgcagcgacaacagcttccggcgggagctggatgccctgggccacgagctgcctgtgctggccccccagtgggagggctatgatgagctgcagacagatggcaacagaagcagccacagccggctgggccgcatcgaggccgacagcgagagccaggaggacatcatccggaacatcgcccggcacctggcccaggtgggggacagcatggacaggagcatccccccaggcctggtgaatggcctggccctgcagctgaggaacaccagccgctcagaagaagatagaaacagagacctggccacagccctggagcagctgctgcaggcctacccccgggacatggagaaggagaagaccatgctggtgctggccctgctgctggccaagaaggtggccagccacacccccagcctgctgagagatgtgttccacaccaccgtgaacttcatcaaccagaacctgcggacctacgtgcgcagcctggccagaaatggcatggactag

SEQ ID NO: 18547 - DNA, 588 bp, Artificial Sequence; identical to SEQ ID NO: 18546
  Description of Artificial Sequence: Synthetic coding sequence

SEQ ID NO: 18548 - DNA, 1353 bp, Artificial Sequence
  Description of Artificial Sequence: Synthetic coding sequence
atggaggagccccagaagagctatgtgaacaccatggacctggagagagatgagcccctgaagagcacaggcccccagatctctgtgtctgagttcagctgccactgctgctatgacatcctggtgaaccccaccaccctgaactgtggccacagcttctgccgccactgcctggccctgtggtgggccagcagcaagaagacagaatgtcctgagtgccgggagaagtgggagggcttccccaaggtgtccatcctgctgagagatgccatcgagaagctgttcccagatgccatccggctgcgctttgaggacatccagcagaacaatgacatcgtgcagagcctggccgccttccagaagtatggaaatgaccagatccccctggcccccaacacaggccgggccaaccagcagatgggcggcggcttcttcagcggcgtgctgacagccctgactggagtggccgtggtgctgctggtgtaccactggagcagccgggagagcgagcatgacctgctggtgcacaaggctgtggccaagtggacagctgaggaggtggtgctgtggctggagcagctgggcccctgggccagcctgtaccgggagcgcttcctgtctgagcgggtgaatggccgcctgctgctgaccctgacagaggaggagttcagcaagaccccctacaccatcgagaacagcagccaccggcgggccatcctgatggagctggagcgggtgaaggccctgggcgtgaagccaccccagaacctgtgggagtacaaggctgtgaaccctggccgcagcctcttcctgctgtatgccctgaagagcagcccccggctgagcctgctgtacctgtacctgtttgactacacagacaccttcctgcccttcatccacaccatctgccccctgcaggaggacagcagcggggaggacatcgtgaccaagctgctggacctgaaggagcccacctggaagcagtggagggagttcctggtgaagtacagcttcctgccctaccagctgattgctgagtttgcctgggactggctggaggtgcactactggaccagccgcttcctgatcatcaatgccatgctgctgtctgtgctggagctgttctccttctggaggatctggagccgctctgagctgaagacagtgccccagaggatgtggagccacttctggaaggtgtccacccagggcctgtttgtggccatgttctggcccctcatcccccagtttgtgtgcaactgcctcttctactgggccctgtacttcaaccccatcatcaacatcgacctggtggtgaaggagctgcggcggctggagacccaggtgctgtag

SEQ ID NO: 18549 - DNA, 969 bp, Artificial Sequence
  Description of Artificial Sequence: Synthetic coding sequence
atggtgggcatcttcaaggaaaataggatgagcaggatgcagaggaagatgggccgcttcccccagagccagtacagcccccaggtggtgctgctggtgtaccactggagcagccgggagagcgagcatgacctgctggtgcacaaggctgtggccaagtggacagctgaggaggtggtgctgtggctggagcagctgggcccctgggccagcctgtaccgggagcgcttcctgtctgagcgggtgaatggccgcctgctgctgaccctgacagaggaggagttcagcaagaccccctacaccatcgagaacagcagccaccggcgggccatcctgatggagctggagcgggtgaaggccctgggcgtgaagccaccccagaacctgtgggagtacaaggctgtgaaccctggccgcagcctcttcctgctgtatgccctgaagagcagcccccggctgagcctgctgtacctgtacctgtttgactacacagacaccttcctgcccttcatccacaccatctgccccctgcaggaggacagcagcggggaggacatcgtgaccaagctgctggacctgaaggagcccacctggaagcagtggagggagttcctggtgaagtacagcttcctgccctaccagctgattgctgagtttgcctgggactggctggaggtgcactactggaccagccgcttcctgatcatcaatgccatgctgctgtctgtgctggagctgttctccttctggaggatctggagccgctctgagctgaagacagtgccccagaggatgtggagccacttctggaaggtgtccacccagggcctgtttgtggccatgttctggcccctcatcccccagtttgtgtgcaactgcctcttctactgggccctgtacttcaaccccatcatcaacatcgacctggtggtgaaggagctgcggcggctggagacccaggtgctgtag

SEQ ID NO: 18550 - DNA, 4254 bp, Artificial Sequence
  Description of Artificial Sequence: Synthetic coding sequence
atggctgctgtgccccagaacaacctgcaggagcagctggagcggcacagcgcccggaccctgaacaacaagctgagcctgagcaagcccaagttcagcggcttcaccttcaagaagaagaccagcagtgacaacaacgtgtctgtgaccaacgtgtctgtggccaagacccctgtgctgaggaacaaggatgtgaatgtgacagaggacttctccttcagcgagcccctgcccaacaccaccaaccagcagagggtgaaggacttcttcaagaatgccccagctggccaggagacccagaggggcggcagcaagagcctgctgcctgacttcctgcagacccccaaggaggtggtgtgcaccacccagaacacccccaccgtgaagaagagccgggacacagccctgaagaagctggagttcagcagcagcccagacagcctgagcaccatcaatgactgggatgacatggatgactttgacaccagcgagaccagcaagagctttgtgaccccaccccagagccactttgtgcgggtgtccacagcccagaagagcaagaagggcaagaggaacttcttcaaggcccagctgtacaccaccaacacagtgaagacagacctgcccccacccagcagcgagagcgagcagattgacctgacagaggagcagaaggatgacagcgagtggctgagcagtgatgtgatctgcattgatgatggccccatcgccgaggtgcacatcaatgaagatgcccaggagagtgacagcctgaagacccacctggaggatgagcgggacaacagcgagaagaagaagaacctggaggaggccgagctgcacagcacagagaaggtgccctgcattgaatttgatgatgatgattatgacacagactttgtgccccccagccctgaggagatcatcagcgccagcagcagcagcagcaagtgcctgagcaccctgaaggacctggacaccagtgacaggaaggaggatgtgctgagcaccagcaaggacctgctgagcaagccagagaagatgtccatgcaggagctgaaccctgagaccagcacagactgtgatgcccggcagatcagcctgcagcagcagctgatccacgtgatggagcacatctgcaagctgattgacaccatcccagatgacaagctgaagctgctggactgtggaaatgagctgctgcagcagaggaacatccggaggaagctgctgacagaggtggacttcaacaagagtgatgccagcctgctgggcagcctgtggagatacagaccagacagcctggatggccccatggagggggacagctgccccaccggcaacagcatgaaggagctgaacttcagccacctgcccagcaacagcgtgtcccctggggactgcctgctgaccaccaccctgggcaagacaggcttcagcgccaccaggaagaacctgtttgagcggcccctcttcaacacccacctgcagaagagctttgtgagcagcaactgggccgagaccccccggctgggcaagaagaatgaaagcagctacttccctggaaatgtgctgaccagcacagctgtgaaggaccagaacaagcacacagccagcatcaatgacctggagcgggagacccagcccagctatgacatcgacaactttgatattgatgactttgatgatgatgatgactgggaggacatcatgcacaacctggccgccagcaagagcagcacagctgcctaccagcccatcaaggagggccggcccatcaagtctgtgtctgagcggctgagcagcgccaagacagactgcctgcctgtgagcagcacagcccagaacatcaacttcagcgagagcatccagaactacacagacaagagcgcccagaacctggccagcaggaacctgaagcatgagcgcttccagagcctgtccttcccccacaccaaggagatgatgaagatcttccacaagaagtttggcctgcacaacttccgcaccaaccagctggaggccatcaatgctgccctgctgggggaggactgcttcatcctgatgcccactggaggcggcaagagcctgtgctaccagctgcctgcctgtgtgtccccaggagtgacagtggtgatcagccccctgcggagcctcatcgtggaccaggtgcagaagctgaccagcctggacatcccagccacctacctgaccggggacaagacagacagcgaggccaccaacatctacctgcagctgagcaagaaggaccccatcatcaagctgctgtatgtgaccccagagaagatctgtgccagcaacagactcatcagcaccctggagaacctgtatgaaaggaagctgctggccaggtttgtgattgatgaggcccactgtgtgtcccagtggggccatgacttccggcaggactacaagaggatgaacatgctgcggcagaagttccccagcgtgcctgtgatggccctgacagccacagccaacccccgggtgcagaaggacatcctgacccagctgaagatcctgcggccccaggtgttctccatgtccttcaacagacacaacctgaagtactacgtgctgcccaagaagcccaagaaggtggcctttgactgcctggagtggatcaggaagcaccacccctatgacagcggcatcatctactgcctgagccggcgggagtgtgacaccatggctgacaccctgcagagagatggcctggccgccctggcctaccacgccggcctgagtgacagcgccagagatgaggtgcagcagaagtggatcaaccaggacggctgccaggtgatctgtgccaccatcgccttcggcatgggcatcgacaagccagatgtgcgcttcgtcatccacgccagcctgcccaagtctgtggagggctactaccaggagagcggccgggccggcagagatggagagatcagccactgcctgctcttctacacctaccatgatgtgacccggctgaagaggctcatcatgatggagaaggatggcaaccaccacacccgggagacccacttcaacaacctgtacagcatggtgcactactgtgagaacatcacagaatgtcgccgcatccagctgctggcctactttggagaaaatggcttcaacccagacttctgcaagaagcacccagatgtgtcctgtgacaactgctgcaagaccaaggactacaagaccagagatgtgacagatgatgtgaagagcatcgtgcgctttgtgcaggagcacagcagcagccagggcatgaggaacatcaagcacgtgggccccagcggccgcttcaccatgaacatgctggtggacatcttcctgggcagcaagagcgccaagatccagagcggcatctttggaaaaggaagtgcctacagccgccacaatgctgagcggctcttcaagaagctgatcctggacaagatcctggatgaagatctctacatcaatgccaatgaccaggccatcgcctacgtgatgctgggcaacaaggcccagacagtgctgaatggaaacctgaaggtggacttcatggagacagagaacagcagctctgtgaagaagcagaaggccctggtggccaaggtgtcccagcgggaggagatggtgaagaagtgcctgggggagctgacagaggtgtgcaagagcctgggcaaggtgtttggagtgcactacttcaacatcttcaacacagtgaccctgaagaagctggccgagagcctgagcagtgaccctgaggtgctgctgcagattgatggagtgacagaggacaagctggagaagtacggggctgaggtgatctctgtgctgcagaagtacagcgagtggaccagccctgctgaggacagcagccctggcatcagcctgagcagcagccggggccctggccgctctgctgctgaggagctggatgaggagatccctgtgagcagccactactttgccagcaagaccagaaatgaaaggaagaggaagaagatgcctgccagccagaggagcaagaggaggaagacagccagcagcggcagcaaggccaagggcggcagcgccacctgcaggaagatcagcagcaagaccaagagcagcagcatcatcggcagcagcagcgccagccacaccagccaggccaccagcggggccaacagcaagctgggcatcatggccccacccaagcccatcaaccggcccttcctgaagcccagctatgccttctcctag

SEQ ID NO: 18551 - DNA, 3144 bp, Artificial Sequence
  Description of Artificial Sequence: Synthetic coding sequence
atgtccatgcaggagctgaaccctgagaccagcacagactgtgatgcccggcagatcagcctgcagcagcagctgattcatgtgatggagcacatctgcaagctgattgacaccatcccagatgacaagctgaagctgctggactgtggaaatgagctgctgcagcagaggaacatccggaggaagctgctgacagaggtggacttcaacaagagtgatgccagcctgctgggcagcctgtggagatacagaccagacagcctggatggccccatggagggggacagctgccccactggaaacagcatgaaggagctgaacttcagccacctgcccagcaacagcgtgtcccctggggactgcctgctgaccaccaccctgggcaagacaggcttcagcgccaccaggaagaacctgtttgagcggcccctcttcaacacccacctgcagaagagctttgtgagcagcaactgggccgagaccccccggctgggcaagaagaatgaaagcagctacttccctggaaatgtgctgaccagcacagctgtgaaggaccagaacaagcacacagccagcatcaatgacctggagcgggagacccagcccagctatgacatcgacaactttgatattgatgactttgatgatgatgatgactgggaggacatcatgcacaacctggccgccagcaagagcagcacagctgcctaccagcccatcaaggagggccggcccatcaagtctgtgtctgagcggctgagcagcgccaagacagactgcctgcctgtgagcagcacagcccagaacatcaacttcagcgagagcatccagaactacacagacaagagcgcccagaacctggccagcaggaacctgaagcatgagcgcttccagagcctgtccttcccccacaccaaggagatgatgaagatcttccacaagaagtttggcctgcacaacttccgcaccaaccagctggaggccatcaatgctgccctgctgggggaggactgcttcatcctgatgcccaccggcggcggcaagagcctgtgctaccagctgcctgcctgtgtgtcccctggggtgacagtggtgatcagccccctgcggagcctgattgtggaccaggtgcagaagctgaccagcctggacatcccagccacctacctgactggagacaagacagattctgaggccaccaacatctacctgcagctgagcaagaaggaccccatcatcaagctgctgtatgtgaccccagagaagatctgtgccagcaacagactcatcagcaccctggagaacctgtatgaaaggaagctgctggccaggtttgtgattgatgaggcccactgtgtgtcccagtggggccatgacttccggcaggactacaagaggatgaacatgctgcggcagaagttccccagcgtgcctgtgatggccctgacagccacagccaacccccgggtgcagaaggacatcctgacccagctgaagatcctgcggccccaggtgttctccatgtccttcaacagacacaacctgaagtactacgtgctgcccaagaagcccaagaaggtggcctttgactgcctggagtggatcaggaagcaccacccctatgattctggcatcatctactgcctgagcagaagagaatgtgacaccatggctgacaccctgcagaagtggatcaaccaggacggctgccaggtgatctgtgccaccatcgccttcggcatgggcatcgacaagccagatgtgcgcttcgtcatccacgccagcctgcccaagtctgtggagggctactaccaggagagcggccgggccggcagagatggagagatcagccactgcctgctcttctacacctaccatgatgtgacccggctgaagaggctcatcatgatggagaaggatggcaaccaccacacccgggagacccacttcaacaacctgtacagcatggtgcactactgtgagaacatcacagaatgtcgccgcatccagctgctggcctactttggagaaaatggcttcaacccagacttctgcaagaagcacccagatgtgtcctgtgacaactgctgcaagaccaaggactacaagaccagagatgtgacagatgatgtgaagagcatcgtgcgctttgtgcaggagcacagcagcagccagggcatgaggaacatcaagcacgtgggccccagcggccgcttcaccatgaacatgctggtggacatcttcctgggcagcaagagcgccaagatccagagcggcatctttggaaaaggaagtgcctacagccgccacaatgctgagcggctcttcaagaagctgatcctggacaagatcctggatgaagatctctacatcaatgccaatgaccaggccatcgcctacgtgatgctgggcaacaaggcccagacagtgctgaatggaaacctgaaggtggacttcatggagacagagaacagcagctctgtgaagaagcagaaggccctggtggccaaggtgtcccagcgggaggagatggtgaagaagtgcctgggggagctgacagaggtgtgcaagagcctgggcaaggtgtttggagtgcactacttcaacatcttcaacacagtgaccctgaagaagctggccgagagcctgagcagtgaccctgaggtgctgctgcagattgatggagtgacagaggacaagctggagaagtacggggctgaggtgatctctgtgctgcagaagtacagcgagtggaccagccctgctgaggacagcagccctggcatcagcctgagcagcagccggggccctggccgctctgctgctgaggagctggatgaggagatccctgtgagcagccactactttgccagcaagaccagaaatgaaaggaagaggaagaagatgcctgccagccagaggagcaagaggaggaagacagccagcagcggcagcaaggccaagggcggcagcgccacctgcaggaagatcagcagcaagaccaagagcagcagcatcatcggcagcagcagcgccagccacaccagccaggccaccagcggggccaacagcaagctgggcatcatggccccacccaagcccatcaaccggcccttcctgaagcccagctatgccttctcctag

SEQ ID NO: 18552 - DNA, 1560 bp, Artificial Sequence
  Description of Artificial Sequence: Synthetic coding sequence
atgaacatgctgcggcagaagttccccagcgtgcctgtgatggccctgacagccacagccaacccccgggtgcagaaggacatcctgacccagctgaagatcctgcggccccaggtgttctccatgtccttcaacagacacaacctgaagtactacgtgctgcccaagaagcccaagaaggtggcctttgactgcctggagtggatcaggaagcaccacccctatgattctggcatcatctactgcctgagcagaagagaatgtgacaccatggctgacaccctgcagagagatggcctggccgccctggcctaccacgccggcctgagtgacagcgccagagatgaggtgcagcagaagtggatcaaccaggacggctgccaggtgatctgtgccaccatcgccttcggcatgggcatcgacaagccagatgtgcgctttgtgatccacgccagcctgcccaagtctgtggagggctactaccaggagagcggccgggccggcagagatggagagatcagccactgcctgctcttctacacctaccatgatgtgacccggctgaagaggctcatcatgatggagaaggatggcaaccaccacacccgggagacccacttcaacaacctgtacagcatggtgcactactgtgagaacatcacagagtgccgccgcatccagctgctggcctactttggagaaaatggcttcaacccagacttctgcaagaagcacccagatgtgtcctgtgacaactgctgcaagaccaaggactacaagaccagagatgtgacagatgatgtgaagagcatcgtgcgctttgtgcaggagcacagcagcagccagggcatgaggaacatcaagcacgtgggccccagcggccgcttcaccatgaacatgctggtggacatcttcctgggcagcaagagcgccaagatccagagcggcatctttgggaagggcagcgcctacagccgccacaatgctgagcggctcttcaagaagctgatcctggacaagatcctggatgaggacctgtacatcaatgccaatgaccaggccatcgcctacgtgatgctgggcaacaaggcccagacagtgctgaatggaaacctgaaggtggacttcatggagacagagaacagcagctctgtgaagaagcagaaggccctggtggccaaggtgtcccagcgggaggagatggtgaagaagtgcctgggggagctgacagaggtgtgcaagagcctgggcaaggtgtttggagtgcactacttcaacatcttcaacacagtgaccctgaagaagctggccgagagcctgagcagtgaccctgaggtgctgctgcagattgatggagtgacagaggacaagctggagaagtatggagctgaggtgatctctgtgctgcagaagtacagcgagtggaccagccctgctgaggacagcagccctggcatcagcctgagcagcagccggggccctggccgctctgctgctgaggagctggatgaggagatccctgtgagcagccactactttgccagcaagaccaggaactag

SEQ ID NO: 18553 - DNA, 981 bp, Artificial Sequence
  Description of Artificial Sequence: Synthetic coding sequence
atgcacaggaccacccgcatcaagatcacagagctgaacccccacctgatgtgtgtgctgtgtggcggctacttcattgatgccaccaccatcattgaatgtctgcacagcttctgcaagacctgcatcgtgcgctacctggagaccagcaagtactgccccatctgtgatgtgcaggtgcacaagacccggcccctgctgaacatccgcagtgacaagaccctgcaggacatcgtgtacaagctggtgcccggcctcttcaagaatgagatgaagagaagaagagacttctatgctgcccaccccagcgcagatgctgccaacggcagcaatgaagatagaggagaggtggctgatgaggacaagaggatcatcacagatgatgagatcatcagcctgagcattgagttctttgaccagaaccggctggacaggaaggtgaacaaggacaaggagaagagcaaggaggaggtgaatgacaagcgctacctgcgctgcccagctgccatgacagtgatgcacctgaggaagttcctgcggagcaagatggacatccccaacaccttccagattgatgtgatgtatgaggaggagcccctgaaggactactacaccctgatggacatcgcctacatctacacctggaggagaaatggccccctgcccctgaagtacagagtgcggcccacctgcaagaggatgaagatcagccaccagagagatggcctgaccaatgctggggagctggagagtgacagcggcagtgacaaggccaacagccctgctgggggcatccccagcaccagcagctgcctgcccagccccagcacccctgtgcagagcccccacccccagttcccccacatcagcagcaccatgaatggcaccagcaacagccccagcggcaaccaccagagcagctttgccaaccggcccaggaagagctctgtgaatggcagcagcgccaccagcagtggatag

SEQ ID NO: 18554 - DNA, 717 bp, Artificial Sequence
  Description of Artificial Sequence: Synthetic coding sequence
atgtgtgtgctgtgtggcggctacttcattgatgccaccaccatcattgaatgtctgcacagcttctgcaagacctgcatcgtgcgctacctggagaccagcaagtactgccccatctgtgatgtgcaggtgcacaagacccggcccctgctgaacatccggctggacaggaaggtgaacaaggacaaggagaagagcaaggaggaggtgaatgacaagcgctacctgcgctgcccagctgccatgacagtgatgcacctgaggaagttcctgcggagcaagatggacatccccaacaccttccagattgatgtgatgtatgaggaggagcccctgaaggactactacaccctgatggacatcgcctacatctacacctggaggagaaatggccccctgcccctgaagtacagagtgcggcccacctgcaagaggatgaagatcagccaccagagagatggcctgaccaatgctggggagctggagagtgacagcggcagtgacaaggccaacagccctgctgggggcatccccagcaccagcagctgcctgcccagccccagcacccctgtgcagagcccccacccccagttcccccacatcagcagcaccatgaatggcaccagcaacagccccagcggcaaccaccagagcagctttgccaaccggcccaggaagagctctgtgaatggcagcagcgccaccagcagtggatag

SEQ ID NO: 18555 - DNA, 318 bp, Artificial Sequence
  Description of Artificial Sequence: Synthetic coding sequence
atgcacaggaccacccgcatcaagatcacagagctgaacccccacctgatgtgtgtgctgtgtggcggctacttcattgatgccaccaccatcattgaatgtctgcacagcttctgcaagacctgcatcgtgcgctacctggagaccagcaagtactgccccatctgtgatgtgcaggtgcacaagacccggcccctgctgaacatccgcagtgacaagaccctgcaggacatcgtgtacaagctggtgcccggcctcttcaagaatgagatgaagagaagaagagacttctatgctgcccaccccagcgctgactag

SEQ ID NO: 18556 - DNA, 624 bp, Artificial Sequence
  Description of Artificial Sequence: Synthetic coding sequence
atgcacaggaccacccgcatcaagatcacagagctgaacccccacctgatgtgtgtgctgtgtggcggctacttcattgatgccaccaccatcattgaatgtctgcacagcttctgcaagacctgcatcgtgcgctacctggagaccagcaagtactgccccatctgtgatgtgcaggtgcacaagacccggcccctgctgaacatccgcagtgacaagaccctgcaggacatcgtgtacaagctggtgcccggcctcttcaagaatgagatgaagagaagaagagacttctatgctgcccaccccagcgcagatgctgccaacggcagcaatgaagatagaggagaggtggctgatgaggacaagaggatcatcacagatgatgagatcatcagcctgagcattgagttctttgaccagaaccggctggacaggaaggtgaacaaggacaaggagaagagcaaggaggaggtgaatgacaagcgctacctgcgctgcccagctgccatgacagtgatgcacctgaggaagttcctgcggagcaagatggacatccccaacaccttccagattgatgtgatgtatgaggaggagcccctgaaggactactacaccctgatgtag

SEQ ID NO: 18557 - DNA, 453 bp, Artificial Sequence
  Description of Artificial Sequence: Synthetic coding sequence
atgcacaggaccacccgcatcaagatcacagagctgaacccccacctgatgtgtgtgctgtgtggcggctacttcattgatgccaccaccatcattgaatgtctgcacagcttctgcaagacctgcatcgtgcgctacctggagaccagcaagtactgccccatctgtgatgtgcaggtgcacaagacccggcccctgctgaacatccgcagtgacaagaccctgcaggacatcgtgtacaagctggtgcccggcctcttcaagaatgagatgaagagaagaagagacttctatgctgcccaccccagcgcagatgctgccaacggcagcaatgaagatagaggagaggtggctgatgaggacaagaggatcatcacagatgatgagatcatcagcctgagcattgagttctttgaccagaaccggctggacaggaaggtgaacaaggactag

SEQ ID NO: 18558 - DNA, 555 bp, Artificial Sequence
  Description of Artificial Sequence: Synthetic coding sequence
tacttcattgatgccaccaccatcatcgagtgcctgcacagcttctgcaagacctgcatcgtgcgctacctggagaccagcaagtactgccccatctgtgatgtgcaggtgcacaagacccggcccctgctgaacatccggctggacaggaaggtgaacaaggacaaggagaagagcaaggaggaggtgaatgacaagcgctacctgcgctgcccagctgccatgacagtgatgcacctgaggaagttcctgcggagcaagatggacatccccaacaccttccagattgatgtgatgtatgaggaggagcccctgaaggactactacaccctgatggacatcgcctacatctacacctggaggagaaatggccccctgcccctgaagtacagagtgcggcccacctgcaagaggatgaagatcagccaccagagagatggcctgaccaatgctggggagctggagagtgacagcggcagtgacaaggccaacagccctgctgggggcatccccagcaccagcagctgcctgcccagccccagcacccctgtgtag

SEQ ID NO: 18559 - DNA, 279 bp, Artificial Sequence
  Description of Artificial Sequence: Synthetic coding sequence
atgcacaggaccacccgcatcaagatcacagagctgaacccccacctgatgtgtgtgctgtgtggcggctacttcattgatgccaccaccatcattgaatgtctgcacagcttctgcaagacctgcatcgtgcgctacctggagaccagcaagtactgccccatctgtgatgtgcaggtgcacaagacccggcccctgctgaacatccgcagtgacaagaccctgcaggacatcgtgtacaagctggtgcccggcctcttcaccgccaacggcagctag

SEQ ID NO: 18560 - DNA, 2193 bp, Artificial Sequence
  Description of Artificial Sequence: Synthetic coding sequence
atgcctggggtggcccggctgcccctgctgctgggcctgctgctgctgcccaggcctggccggcccctggacctggccgactacacctatgacctggccgaggaggatgacagcgagcccctgaactacaaggacccctgcaaggccgccgccttcctgggggacatcgccctggatgaggaggacctgcgggccttccaggtgcagcaggccgtggacctgcggcggcacacagccaggaagagcagcatcaaggctgctgtgcccggcaacaccagcacccccagctgccagagcaccaacggccagccccagagaggagcctgtggccgctggaggggccgcagccgcagcagaagagctgccaccagcaggcctgagcgggtgtggccagatggagtcatcccctttgtgattggaggcaacttcaccggcagccagagagctgtgttccggcaggccatgaggcactgggagaagcacacctgtgtgaccttcctggagaggacagatgaggacagctacatcgtgttcacctaccggccctgtggctgctgcagctatgtgggcagaagaggaggcggcccccaggccatcagcatcggcaagaactgtgacaagtttggcatcgtggtgcatgagctgggccacgtggtgggcttctggcatgagcacaccaggccagaccgggacagacatgtgtccatcgtgcgggagaacatccagcccggccaggagtacaacttcctgaagatggagccccaggaggtggagagcctgggggagacctatgactttgacagcatcatgcactacgccaggaacaccttcagccggggcatcttcctggacaccatcgtgcccaagtatgaggtgaatggagtgaagccacccatcggccagaggacccggctgagcaaaggagacatcgcccaggccaggaagctgtacaagtgcccagcctgtggggagaccctgcaggacagcacaggcaacttcagcagccctgagtaccccaacggctacagcgcccacatgcactgtgtgtggaggatctctgtgaccccaggagagaagatcatcctgaacttcaccagcctggacctgtaccgcagccggctgtgctggtatgactatgtggaggtgagagatggcttctggaggaaggcccccctgcggggccgcttctgtggcagcaagctgcctgagcccatcgtgtccacagacagccggctgtgggtggagttccgcagcagcagcaactgggtgggcaagggcttctttgctgtgtatgaggccatctgtggaggagatgtgaagaaggactatggccacatccagagccccaactacccagatgactaccggcccagcaaggtgtgcatctggaggatccaggtgtctgagggcttccacgtgggcctgaccttccagagctttgaaattgaaagacatgacagctgtgcctatgactacctggaggtgagagatggccacagcgagagcagcaccctcatcggccgctactgcggctatgagaagccagatgacatcaagagcaccagcagccggctgtggctgaagtttgtgtctgatggcagcatcaacaaggccggctttgctgtgaacttcttcaaggaggtggatgagtgcagccggcccaacagaggaggctgtgagcagcgctgcctgaacaccctgggcagctacaagtgcagctgtgaccccggctatgagctggccccagacaagagaagatgtgaggccgcctgtggcggcttcctgaccaagctgaatggcagcatcaccagccctggctggcccaaggagtacccacccaacaagaactgcatctggcagctggtggcccccacccagtaccgcatcagcctgcagtttgacttctttgaaacagagggcaatgatgtgtgcaagtatgactttgtggaggtgcgcagcggcctgacagctgacagcaagctgcacggcaagttctgtggcagcgagaagccagaggtgatcaccagccagtacaacaacatgagggtggagttcaagagtgacaacacagtgtccaagaagggcttcaaggcccacttcttcagcgagaagaggcctgccctgcagcccccccggggccggccccaccagctgaagttccgggtgcagaagaggaacagaacaccccagtag

SEQ ID NO: 18561 - DNA, 2961 bp, Artificial Sequence
  Description of Artificial Sequence: Synthetic coding sequence
atgcctggggtggcccggctgcccctgctgctgggcctgctgctgctgcccaggcctggccggcccctggacctggccgactacacctatgacctggccgaggaggatgacagcgagcccctgaactacaaggacccctgcaaggccgccgccttcctgggggacatcgccctggatgaggaggacctgcgggccttccaggtgcagcaggccgtggacctgcggcggcacacagccaggaagagcagcatcaaggctgctgtgcccggcaacaccagcacccccagctgccagagcaccaacggccagccccagagaggagcctgtggccgctggaggggccgcagccgcagcagaagagctgccaccagcaggcctgagcgggtgtggccagatggagtcatcccctttgtgattggaggcaacttcaccggcagccagagagctgtgttccggcaggccatgaggcactgggagaagcacacctgtgtgaccttcctggagaggacagatgaggacagctacatcgtgttcacctaccggccctgtggctgctgcagctatgtgggcagaagaggaggcggcccccaggccatcagcatcggcaagaactgtgacaagtttggcatcgtggtgcatgagctgggccacgtggtgggcttctggcatgagcacaccaggccagaccgggacagacatgtgtccatcgtgcgggagaacatccagcccggccaggagtacaacttcctgaagatggagccccaggaggtggagagcctgggggagacctatgactttgacagcatcatgcactacgccaggaacaccttcagccggggcatcttcctggacaccatcgtgcccaagtatgaggtgaatggagtgaagccacccatcggccagaggacccggctgagcaaaggagacatcgcccaggccaggaagctgtacaagtgcccagcctgtggggagaccctgcaggacagcacaggcaacttcagcagccctgagtaccccaacggctacagcgcccacatgcactgtgtgtggaggatctctgtgaccccaggagagaagatcatcctgaacttcaccagcctggacctgtaccgcagccggctgtgctggtatgactatgtggaggtgagagatggcttctggaggaaggcccccctgcggggccgcttctgtggcagcaagctgcctgagcccatcgtgtccacagacagccggctgtgggtggagttccgcagcagcagcaactgggtgggcaagggcttctttgctgtgtatgaggccatctgtggaggagatgtgaagaaggactatggccacatccagagccccaactacccagatgactaccggcccagcaaggtgtgcatctggaggatccaggtgtctgagggcttccacgtgggcctgaccttccagagctttgaaattgaaagacatgacagctgtgcctatgactacctggaggtgagagatggccacagcgagagcagcaccctcatcggccgctactgcggctatgagaagccagatgacatcaagagcaccagcagccggctgtggctgaagtttgtgtctgatggcagcatcaacaaggccggctttgctgtgaacttcttcaaggaggtggatgagtgcagccggcccaacagaggaggctgtgagcagcgctgcctgaacaccctgggcagctacaagtgcagctgtgaccccggctatgagctggccccagacaagagaagatgtgaggccgcctgtggcggcttcctgaccaagctgaatggcagcatcaccagccctggctggcccaaggagtacccacccaacaagaactgcatctggcagctggtggcccccacccagtaccgcatcagcctgcagtttgacttctttgaaacagagggcaatgatgtgtgcaagtatgactttgtggaggtgcgcagcggcctgacagctgacagcaagctgcacggcaagttctgtggcagcgagaagccagaggtgatcaccagccagtacaacaacatgagggtggagttcaagagtgacaacacagtgtccaagaagggcttcaaggcccacttcttcagtgacaaggatgagtgcagcaaggacaatggaggctgccagcaggactgtgtgaacaccttcggcagctatgagtgccagtgccgcagcggctttgtgctgcatgacaacaagcatgactgcaaggaggccggctgtgaccacaaggtgaccagcaccagcggcaccatcaccagccccaactggccagacaagtaccccagcaagaaggagtgcacctgggccatcagcagcaccccaggccaccgggtgaagctgaccttcatggagatggacatcgagagccagccagaatgtgcctatgaccacctggaggtgtttgatggaagagatgccaaggcccctgtgctgggccgcttctgtggcagcaagaagccagagcctgtgctggccaccggcagcaggatgttcctgcgcttctacagcgacaacagcgtgcagaggaagggcttccaggccagccacgccacagaatgtggcggccaggtgcgggcagatgtgaagaccaaggacctgtacagccacgcccagtttggagacaacaactacccaggaggagtggactgtgagtgggtgattgtggccgaggagggctacggcgtggagctggtgttccagacctttgaggtggaggaggagacagactgtggctatgactacatggagctgtttgatggctatgacagcacagccccccggctgggccgctactgcggcagcggccccccagaggaggtgtacagcgctggggacagcgtgctggtgaagttccacagtgatgacaccatcaccaagaagggcttccacctgcgctacaccagcaccaagttccaggacaccctgcacagcaggaagtag

SEQ ID NO: 18562 - DNA, 909 bp, Artificial Sequence
  Description of Artificial Sequence: Synthetic coding sequence
atgcctggggtggcccggctgcccctgctgctgggcctgctgctgctgcccaggcctggccggcccctggacctggccgactacacctatgacctggccgaggaggatgacagcgagcccctgaactacaaggacccctgcaaggccgccgccttcctgggggacatcgccctggatgaggaggacctgcgggccttccaggtgcagcaggccgtggacctgcggcggcacacagccaggaagagcagcatcaaggctgctgtgcccggcaacaccagcacccccagctgccagagcaccaacggccagccccagagaggagcctgtggccgctggaggggccgcagccgcagcagaagagctgccaccagcaggcctgagcgggtgtggccagatggagtcatcccctttgtgattggaggcaacttcaccggcagccagagagctgtgttccggcaggccatgaggcactgggagaagcacacctgtgtgaccttcctggagaggacagatgaggacagctacatcgtgttcacctaccggccctgtggctgctgcagctatgtgggcagaagaggaggcggcccccaggccatcagcatcggcaagaactgtgacaagtttggcatcgtggtgcatgagctgggccacgtggtgggcttctggcatgagcacaccaggccagaccgggacagacatgtgtccatcgtgcgggagaacatccagcccggggtgctgcacagcagcctgctgctgctgagctgtggcagcagaaatggagccagcttcccctgcagcctggagagcagcatccaccaggccctgtgctggacaggcctcttcctgcggcccagccccttcccccggctgcccctggccgcccccaggaccctgcgggccggcgtgtag

SEQ ID NO: 18563 - DNA, 1869 bp, Artificial Sequence
  Description of Artificial Sequence: Synthetic coding sequence
atgcctggggtggcccggctgcccctgctgctgggcctgctgctgctgcccaggcctggccggcccctggacctggccgactacacctatgacctggccgaggaggatgacagcgagcccctgaactacaaggacccctgcaaggccgccgccttcctgggggacatcgccctggatgaggaggacctgcgggccttccaggtgcagcaggccgtggacctgcggcggcacacagccaggaagagcagcatcaaggctgctgtgcccggcaacaccagcacccccagctgccagagcaccaacggccagccccagagaggagcctgtggccgctggaggggccgcagccgcagcagaagagctgccaccagcaggcctgagcgggtgtggccagatggagtcatcccctttgtgattggaggcaacttcaccggcagccagagagctgtgttccggcaggccatgaggcactgggagaagcacacctgtgtgaccttcctggagaggacagatgaggacagctacatcgtgttcacctaccggccctgtggctgctgcagctatgtgggcagaagaggaggcggcccccaggccatcagcatcggcaagaactgtgacaagtttggcatcgtggtgcatgagctgggccacgtggtgggcttctggcatgagcacaccaggccagaccgggacagacatgtgtccatcgtgcgggagaacatccagcccggccaggagtacaacttcctgaagatggagccccaggaggtggagagcctgggggagacctatgactttgacagcatcatgcactacgccaggaacaccttcagccggggcatcttcctggacaccatcgtgcccaagtatgaggtgaatggagtgaagccacccatcggccagaggacccggctgagcaaaggagacatcgcccaggccaggaagctgtacaagtgcccagcctgtggggagaccctgcaggacagcacaggcaacttcagcagccctgagtaccccaacggctacagcgcccacatgcactgtgtgtggaggatctctgtgaccccaggagagaagatcatcctgaacttcaccagcctggacctgtaccgcagccggctgtgctggtatgactatgtggaggtgagagatggcttctggaggaaggcccccctgcggggccgcttctgtggcagcaagctgcctgagcccatcgtgtccacagacagccggctgtgggtggagttccgcagcagcagcaactgggtgggcaagggcttctttgctgtgtatgaggccatctgtggaggagatgtgaagaaggactatggccacatccagagccccaactacccagatgactaccggcccagcaaggtgtgcatctggaggatccaggtgtctgagggcttccacgtgggcctgaccttccagagctttgaaattgaaagacatgacagctgtgcctatgactacctggaggtgagagatggccacagcgagagcagcaccctcatcggccgctactgcggctatgagaagccagatgacatcaagagcaccagcagccggctgtggctgaagtttgtgtctgatggcagcatcaacaaggccggctttgctgtgaacttcttcaaggaggtggatgagtgcagccggcccaacagaggaggctgtgagcagcgctgcctgaacaccctgggcagctacaagtgcagctgtgaccccggctatgagctggccccagacaagagaagatgtgagggctgctatgacctgcaggtgggcaagcccctgctgtgggacagacactgcttccggctgagcacccacggccctgagatgctgggcacagccctgcggggctag

SEQ ID NO: 18564 - DNA, 2472 bp, Artificial Sequence
  Description of Artificial Sequence: Synthetic coding sequence
atgcctggggtggcccggctgcccctgctgctgggcctgctgctgctgcccaggcctggccggcccctggacctggccgactacacctatgacctggccgaggaggatgacagcgagcccctgaactacaaggacccctgcaaggccgccgccttcctgggggacatcgccctggatgaggaggacctgcgggccttccaggtgcagcaggccgtggacctgcggcggcacacagccaggaagagcagcatcaaggctgctgtgcccggcaacaccagcacccccagctgccagagcaccaacggccagccccagagaggagcctgtggccgctggaggggccgcagccgcagcagaagagctgccaccagcaggcctgagcgggtgtggccagatggagtcatcccctttgtgattggaggcaacttcaccggcagccagagagctgtgttccggcaggccatgaggcactgggagaagcacacctgtgtgaccttcctggagaggacagatgaggacagctacatcgtgttcacctaccggccctgtggctgctgcagctatgtgggcagaagaggaggcggcccccaggccatcagcatcggcaagaactgtgacaagtttggcatcgtggtgcatgagctgggccacgtggtgggcttctggcatgagcacaccaggccagaccgggacagacatgtgtccatcgtgcgggagaacatccagcccggccaggagtacaacttcctgaagatggagccccaggaggtggagagcctgggggagacctatgactttgacagcatcatgcactacgccaggaacaccttcagccggggcatcttcctggacaccatcgtgcccaagtatgaggtgaatggagtgaagccacccatcggccagaggacccggctgagcaaaggagacatcgcccaggccaggaagctgtacaagtgcccagcctgtggggagaccctgcaggacagcacaggcaacttcagcagccctgagtaccccaacggctacagcgcccacatgcactgtgtgtggaggatctctgtgaccccaggagagaagatcatcctgaacttcaccagcctggacctgtaccgcagccggctgtgctggtatgactatgtggaggtgagagatggcttctggaggaaggcccccctgcggggccgcttctgtggcagcaagctgcctgagcccatcgtgtccacagacagccggctgtgggtggagttccgcagcagcagcaactgggtgggcaagggcttctttgctgtgtatgaggccatctgtggaggagatgtgaagaaggactatggccacatccagagccccaactacccagatgactaccggcccagcaaggtgtgcatctggaggatccaggtgtctgagggcttccacgtgggcctgaccttccagagctttgaaattgaaagacatgacagctgtgcctatgactacctggaggtgagagatggccacagcgagagcagcaccctcatcggccgctactgcggctatgagaagccagatgacatcaagagcaccagcagccggctgtggctgaagtttgtgtctgatggcagcatcaacaaggccggctttgctgtgaacttcttcaaggaggtggatgagtgcagccggcccaacagaggaggctgtgagcagcgctgcctgaacaccctgggcagctacaagtgcagctgtgaccccggctatgagctggccccagacaagagaagatgtgaggccgcctgtggcggcttcctgaccaagctgaatggcagcatcaccagccctggctggcccaaggagtacccacccaacaagaactgcatctggcagctggtggcccccacccagtaccgcatcagcctgcagtttgacttctttgaaacagagggcaatgatgtgtgcaagtatgactttgtggaggtgcgcagcggcctgacagctgacagcaagctgcacggcaagttctgtggcagcgagaagccagaggtgatcaccagccagtacaacaacatgagggtggagttcaagagtgacaacacagtgtccaagaagggcttcaaggcccacttcttctctgtgctggagggcgctggggacagacacagccacctgagcggcctggagctgctgctgtgcccccacgccctggtggacacagtgcctgcccctccttctgccctgcacggggacacccacgcccacacccacacccacgtgcacacccactgccccatcgcccaggagacctgccggggcccccccctgggcgccagccggctgagcccccagggccctggccacctgaccctggccccccaggagggcagctacctggacttctgggacacccacagaggagaccccaagcccaggagaagaaggaagagcctgaagaccttcagcctgaccccagccaccttccggggcatctgggccctgtag

SEQ ID NO: 18565 - DNA, 2193 bp, Artificial Sequence; identical to SEQ ID NO: 18560
  Description of Artificial Sequence: Synthetic coding sequence

SEQ ID NO: 18566 - DNA, 1509 bp, Artificial Sequence
  Description of Artificial Sequence: Synthetic coding sequence
atgctgctgcggtctgctgggaagctgaatgtgggcaccaagaaggaggatggagagagcacagcccccaccccccggcccaaggtgctgcgctgcaagtgccaccaccactgcccagaggacagcgtgaacaacatctgcagcacagatggctactgcttcaccatgattgaagaagatgacagcggcctgcctgtggtgaccagcggctgcctgggcctggagggcagtgacttccagtgccgggacacccccatcccccaccagaggaggagcattgagtgctgcacagaaagaaatgaatgcaacaaggacctgcaccccaccctgccccccctgaagaacagagactttgtggatggccccatccaccaccgggccctgctgatctctgtgacagtgtgcagcctgctgctggtgctgatcatcctcttctgctacttccgctacaagaggcaggagacccggccccgctacagcatcggcctggagcaggatgagacctacatccccccaggagagagcctgcgggacctgattgagcagagccagagcagcggcagcggcagcggcctgcccctgctggtgcagaggaccatcgccaagcagatccagatggtgaagcagatcggcaagggccgctatggagaggtgtggatgggcaagtggagaggagagaaggtggccgtgaaggtgttcttcaccacagaggaggcctcctggttccgggagacagagatctaccagacagtgctgatgagacatgagaacatcctgggcttcatcgctgctgacatcaagggcaccggctcctggacccagctgtacctgatcacagactaccatgaaaatggcagcctgtatgactacctgaagagcaccaccctggatgccaagtccatgctgaagctggcctacagctctgtgtctggcctgtgccacctgcacacagagatcttcagcacccagggcaagccagccatcgcccaccgggacctgaagagcaagaacatcctggtgaagaagaatggcacctgctgcatcgctgacctgggcctggccgtgaagttcatcagtgacaccaatgaggtggacatcccccccaacaccagggtgggcaccaagcgctacatgcctcctgaggtgctggatgagagcctgaacagaaaccacttccagagctacatcatggctgacatgtacagctttggcctcatcctgtgggaggtggcccggcgctgtgtgtctgggggcatcgtggaggagtaccagctgccctaccatgacctggtgcccagcgaccccagctatgaggacatgagagaaattgtgtgcatcaagaagctgcggcccagcttccccaaccgctggagcagtgatgaatgtctgcggcagatgggcaagctgatgacagagtgctgggcccacaacccagccagccggctgacagccctgcgggtgaagaagaccctggccaagatgtctgagagccaggacatcaagctgtag

SEQ ID NO: 18567 - DNA, 1509 bp, Artificial Sequence; identical to SEQ ID NO: 18566
  Description of Artificial Sequence: Synthetic coding sequence

SEQ ID NO: 18568 - DNA, 1599 bp, Artificial Sequence
  Description of Artificial Sequence: Synthetic coding sequence
atgggctggctggaggagctgaactggcagctgcacatcttcctgctgatcctgctgtccatgcacacccgggccaacttcctggacaacatgctgctgcggtctgctgggaagctgaatgtgggcaccaagaaggaggatggagagagcacagcccccaccccccggcccaaggtgctgcgctgcaagtgccaccaccactgcccagaggacagcgtgaacaacatctgcagcacagatggctactgcttcaccatgattgaagaagatgacagcggcctgcctgtggtgaccagcggctgcctgggcctggagggcagtgacttccagtgccgggacacccccatcccccaccagaggaggagcattgagtgctgcacagaaagaaatgaatgcaacaaggacctgcaccccaccctgccccccctgaagaacagagactttgtggatggccccatccaccaccgggccctgctgatctctgtgacagtgtgcagcctgctgctggtgctgatcatcctcttctgctacttccgctacaagaggcaggagacccggccccgctacagcatcggcctggagcaggatgagacctacatccccccaggagagagcctgcgggacctgattgagcagagccagagcagcggcagcggcagcggcctgcccctgctggtgcagaggaccatcgccaagcagatccagatggtgaagcagatcggcaagggccgctatggagaggtgtggatgggcaagtggagaggagagaaggtggccgtgaaggtgttcttcaccacagaggaggcctcctggttccgggagacagagatctaccagacagtgctgatgagacatgagaacatcctgggcttcatcgctgctgacatcaagggcaccggctcctggacccagctgtacctgatcacagactaccatgaaaatggcagcctgtatgactacctgaagagcaccaccctggatgccaagtccatgctgaagctggcctacagctctgtgtctggcctgtgccacctgcacacagagatcttcagcacccagggcaagccagccatcgcccaccgggacctgaagagcaagaacatcctggtgaagaagaatggcacctgctgcatcgctgacctgggcctggccgtgaagttcatcagtgacaccaatgaggtggacatcccccccaacaccagggtgggcaccaagcgctacatgcctcctgaggtgctggatgagagcctgaacagaaaccacttccagagctacatcatggctgacatgtacagctttggcctcatcctgtgggaggtggcccggcgctgtgtgtctgggggcatcgtggaggagtaccagctgccctaccatgacctggtgcccagcgaccccagctatgaggacatgagagaaattgtgtgcatcaagaagctgcggcccagcttccccaaccgctggagcagtgatgaatgtctgcggcagatgggcaagctgatgacagagtgctgggcccacaacccagccagccggctgacagccctgcgggtgaagaagaccctggccaagatgtctgagagccaggacatcaagctgtag

SEQ ID NO: 18569 - DNA, 345 bp, Artificial Sequence
  Description of Artificial Sequence: Synthetic coding sequence
atgctgctgcggtctgctgggaagctgaatgtgggcaccaagaaggaggatggagagagcacagcccccaccccccggcccaaggtgctgcgctgcaagtgccaccaccactgcccagaggacagcgtgaacaacatctgcagcacagatggctactgcttcaccatgattgaagaagatgacagcggcctgcctgtggtgaccagcggctgcctgggcctggagggcagtgacttccagtgccgggtgaggaccctgcccttcctgatcaaggaggaccagctgaatgctgcccagaagggcaccaacgtcatcaagacctacaccctgcactgcctgcactag

SEQ ID NO: 18570 - DNA, 378 bp, Artificial Sequence
  Description of Artificial Sequence: Synthetic coding sequence
atgctgctgcggtctgctgggaagctgaatgtgggcaccaagaaggaggatggagagagcacagcccccaccccccggcccaaggtgctgcgctgcaagtgccaccaccactgcccagaggacagcgtgaacaacatctgcagcacagatggctactgcttcaccatgattgaagaagatgacagcggcctgcctgtggtgaccagcggctgcctgggcctggagggcagtgacttccagtgccgggacacccccatcccccaccagaggaggagcattgagtgctgcacagaaagaaatgaatgcaacaaggacctgcaccccaccctgccccccctgaagaacagagactttgtggatggccccatccaccactag

SEQ ID NO: 18571 - DNA, 1509 bp, Artificial Sequence; identical to SEQ ID NO: 18566
  Description of Artificial Sequence: Synthetic coding sequence

SEQ ID NO: 18572 - DNA, 1509 bp, Artificial Sequence; identical to SEQ ID NO: 18566
  Description of Artificial Sequence: Synthetic coding sequence

SEQ ID NO: 18573 - DNA, 1509 bp, Artificial Sequence; identical to SEQ ID NO: 18566
  Description of Artificial Sequence: Synthetic coding sequence

SEQ ID NO: 18574 - DNA, 4755 bp, Artificial Sequence
  Description of Artificial Sequence: Synthetic coding sequence
atgaggggccaggccgccgcccctggccctgtgtggatcctggcccccctgctgctgctgctgctgctgctgggccggcgggcccgggctgctgctggagcagatgctggccctggccctgagccctgtgccaccctggtgcagggcaagttcttcggctacttctctgctgctgctgtgtttcctgccaatgccagccgctgctcctggaccctgagaaatccagacccccggcgctacaccctgtacatgaaggtggccaaggcccctgtgccctgcagcggccctggccgggtgaggacctaccagtttgacagcttcctggagagcaccaggacctacctgggcgtggagagctttgatgaggtgctgcggctgtgtgaccccagcgcccccctggccttcctgcaggccagcaagcagttcctgcagatgaggcggcagcagcccccccagcatgatggcctgcggccccgggccggccccccaggccccacagatgacttctctgtggagtacctggtggtgggcaacagaaaccccagccgggccgcctgccagatgctgtgccgctggctggatgcctgcctggccggcagccgcagcagccacccctgtggcatcatgcagaccccctgtgcctgcctgggcggggaggccggcggccctgctgctggccccctggcccccagaggagatgtgtgcctgagagatgctgtggccggcggccctgagaactgcctgaccagcctgacccaggaccggggcggccacggggccactggaggctggaagctgtggagcctgtggggcgagtgcacccgggactgtggcggcggcctgcagaccaggaccaggacctgcctgcctgcccctggggtggagggcggcggctgtgaaggagtgctggaggagggccggcagtgcaaccgggaggcctgtggccctgctggccgcaccagcagccgcagccagagcctgcggagcacagatgcccggcggcgggaggagctgggagatgagctgcagcagtttggcttccctgccccccagacaggagaccctgctgctgaggagtggagcccctggagcgtgtgcagcagcacctgtggggagggctggcagaccaggacccgcttctgtgtgagcagcagctacagcacccagtgcagcggccccctgcgggagcagaggctgtgcaacaacagcgctgtgtgccctgtgcatggagcctgggatgagtggagcccctggagcctgtgcagcagcacctgtggccggggcttccgggacaggaccaggacctgccggcccccccagtttggaggcaacccctgtgagggccctgagaagcagaccaagttctgcaacatcgccctgtgccccggccgggctgtggatggcaactggaatgagtggagctcctggagcgcctgcagcgccagctgcagccagggccggcagcagaggaccagagaatgtaatggccccagctatggaggagctgagtgccagggccactgggtggagacccgggactgcttcctgcagcagtgccctgtggatggcaagtggcaggcctgggcctcctggggcagctgcagcgtgacctgtggggccggcagccagaggcgggagcgggtgtgcagcggccccttcttcggcggggccgcctgccagggcccccaggatgagtaccggcagtgtggcacccagcgctgcccagagccccatgagatctgtgatgaggacaactttggagctgtgatctggaaggagaccccagctggggaggtggccgctgtgcgctgccccagaaatgccaccggcctcatcctgcggcgctgtgagctggatgaggagggcatcgcctactgggagccccccacctacatccgctgtgtgtccattgactacagaaacatccagatgatgacccgggagcacctggccaaggcccagaggggcctgcccggggagggcgtgtctgaggtgatccagaccctggtggagatcagccaggacggcaccagctacagcggggacctgctgagcaccattgatgtgctgaggaacatgacagagatcttccggcgggcctactacagccccaccccaggagatgtgcagaactttgtgcagatcctgagcaacctgctggccgaggagaacagagacaagtgggaggaggcccagctggccggccccaatgccaaggagctgttccggctggtggaggactttgtggatgtgattggcttcaggatgaaggacctgagagatgcctaccaggtgacagacaacctggtgctgagcatccacaagctgcctgccagcggggccacagacatctccttccccatgaagggctggagggccaccggggactgggccaaggtgcctgaggacagagtgacagtgtccaagagcgtcttcagcacaggcctgacagaagcagatgaggcctctgtgtttgtggtgggcaccgtgctgtacagaaacctgggcagcttcctggccctgcagaggaacaccaccgtgctgaacagcaaggtgatctctgtgacagtgaagcccccacccaggagcctgcggacccccctggagattgaatttgcccacatgtacaacggcaccaccaaccagacctgcatcctgtgggatgaaacagatgtgcccagcagcagcgccccaccccagctgggcccctggagctggaggggctgcaggacagtgcccctggatgccctgcggacccgctgcctgtgtgaccggctgagcacctttgccatcctggcccagctgtctgcagatgccaacatggagaaggccaccctgcccagcgtgaccctcatcgtgggctgcggcgtgagcagcctgaccctgctgatgctggtgatcatctacgtgtctgtgtggagatacatccgctctgagaggagcgtcatcctgatcaacttctgcctgagcatcatcagcagcaatgccctgatcctgattggccagacccagaccaggaacaaggtggtgtgcaccctggtggccgccttcctgcacttcttcttcctgagcagcttctgctgggtgctgacagaggcctggcagagctacatggctgtgacaggccacctgaggaacagactcatcaggaagcgcttcctgtgcctgggctggggcctgcctgccctggtggtggccatctctgtgggcttcaccaaggccaagggctacagcaccatgaactactgctggctgagcctggagggcggcctgctgtatgcctttgtgggccctgctgctgctgtggtgctggtgaacatggtgattggcatcctggtgttcaacaagctggtgtccaaggatggcatcacagacaagaagctgaaggagcgggccggggccagcctgtggagcagctgtgtggtgctgcccctgctggccctgacctggatgtctgctgtgctggccgtgacagaccggcgcagcgccctcttccagatcctgtttgctgtgtttgacagcctggagggcttcgtcatcgtgatggtgcactgcatcctgcggcgggaggtgcaggatgctgtgaagtgccgggtggtggaccggcaggaggagggcaatggagacagcggcggcagcttccagaatggccacgcccagctgatgacagactttgagaaggatgtggacctggcctgccgctctgtgctgaacaaggacattgctgcctgcaggacagccaccatcaccggcaccctgaagaggcccagcctgcctgaggaggagaagctgaagctggcccacgccaagggcccccccaccaacttcaacagcctgcctgccaacgtgtccaagctgcacctgcacggcagcccccgctacccaggcggccccctgcctgacttccccaaccacagcctgaccctgaagagggacaaggcccccaagagcagctttgtgggagatggagacatcttcaagaagctggacagcgagctgagccgggcccaggagaaggccctggacaccagctatgtgatcctgcccacagccacagccaccctgcggcccaagcccaaggaggagcccaagtacagcatccacatcgaccagatgccccagaccaggctcatccacctgagcacagcccctgaggccagcctgcctgcccggagcccccccagccggcagccccccagcggcggccccccagaggcccccccagcccagcccccacctcctcctcctcctcctcctcctccaccccagcagcccctgcccccaccacccaacctggagcccgccccacccagcctgggggaccccggggagcctgctgcccaccctggccccagcacaggccccagcaccaagaatgaaaatgtggccaccctgtctgtgagcagcctggagaggaggaagagccgctatgcagagctggactttgagaagatcatgcacaccaggaagaggcaccaggacatgttccaggacctgaacaggaagctgcagcacgccgctgagaaggacaaggaggtgctgggccctgacagcaagccagagaagcagcagacccccaacaagaggccctgggagagcctgaggaaggcccacggcacccccacctgggtgaagaaggagctggagcccctgcagcccagccccctggagctgcggtctgtggagtgggagaggtctggggccaccatccccctggtgggccaggacatcatcgacctgcagacagaggtgtag

SEQ ID NO: 18575 - DNA, 4755 bp, Artificial Sequence; identical to SEQ ID NO: 18574
  Description of Artificial Sequence: Synthetic coding sequence

SEQ ID NO: 18576 - DNA, 2334 bp, Artificial Sequence
  Description of Artificial Sequence: Synthetic coding sequence
atgccagacaaccggcagcccaggaaccggcagccccgcatccgctctggaaatgagcccaggtctgccccagccatggagccagatggccgcggggcctgggcccacagcagagctgccctggaccggctggagaagctgctgcgctgcagccgctgcaccaacatcctgcgggagcctgtgtgcctgggcggctgtgagcacatcttctgcagcaactgtgtgtctgactgcattggaacaggctgccctgtgtgctacaccccagcctggatccaggacctgaagatcaaccggcagctggacagcatgatccagctgtgcagcaagctgaggaacctgctgcatgacaatgagctgagtgacctgaaggaggacaagcccaggaagagcctcttcaatgatgctggcaacaagaagaacagcatcaagatgtggttcagccccaggagcaagaaggtgcgctacgtggtgtccaaggcctctgtgcagacccagcctgccatcaagaaggatgccagcgcccagcaggacagctatgaatttgtgagccccagccccccagcagatgtgtctgagcgggccaagaaggccagcgcccggagcggcaagaagcagaagaagaagaccctggccgagatcaaccagaagtggaacctggaggccgagaaggaggatggagaatttgacagcaaggaggagagcaagcagaagctggtgtccttctgcagccagcccagcgtcatcagcagcccccagatcaatggagaaattgacctgctggccagcggcagcctgacagaaagtgagtgcttcggcagcctgacagaggtgtccctgcccctggccgagcagatcgagagcccagacaccaagagcagaaatgaggtggtgaccccagagaaggtgtgcaagaactacctgaccagcaagaagagcctgcccctggagaacaacgggaagaggggccaccacaaccggctgagcagccccatcagcaagcgctgcaggaccagcatcctgagcaccagcggggactttgtgaagcagacagtgcccagcgagaacatccccctgcctgaatgtagcagcccccccagctgcaagaggaaggtgggcggcaccagcggcaggaagaacagcaacatgtctgatgagttcatcagcctgagccctggcaccccacccagcaccctgagcagcagcagctacagaagagtgatgagcagccccagcgccatgaagctgctgcccaacatggctgtgaagaggaaccacagaggagagaccctgctgcacatcgccagcatcaagggggacatccccagcgtggagtacctgctgcagaatggaagtgaccccaacgtgaaggaccacgccggctggacccccctgcacgaggcctgcaaccacggccacctgaaggtggtggagctgctgctgcagcacaaggccctggtgaacaccaccggctaccagaatgacagccccctgcatgatgctgccaagaatggccacgtggacatcgtgaagctgctgctgtcctatggagccagcagaaatgctgtgaacatcttcggcctgcggcctgtggactacacagatgatgagagcatgaagagcctgctgctgctgcctgagaagaatgaaagcagcagcgccagccactgcagcgtgatgaacacaggccagaggagagatggccccctggtgctgattggcagcggcctgagcagcgagcagcagaagatgctgtctgagctggccgtcatcctgaaggccaagaagtacacagaatttgacagcacagtgacccacgtggtggtgcctggagatgctgtgcagagcaccctgaagtgcatgctgggcatcctgaatggctgctggatcctgaagtttgagtgggtgaaggcctgcctgcggaggaaggtgtgtgagcaggaggagaagtatgagatccctgagggcccccggcgcagccggctgaaccgggagcagctgctgcccaagctgtttgatggctgctacttctacctgtggggcaccttcaagcaccaccccaaggacaacctgatcaagctggtgacagctgggggcggccagatcctgagcaggaagcccaagccagacagtgatgtgacccagaccatcaacacagtggcctaccacgcccggccagacagcgaccagcgcttctgcacccagtacatcatctatgaggacctgtgcaactaccaccctgagcgggtgcggcagggcaaggtgtggaaggcccccagctcctggttcatcgactgtgtgatgagctttgagctgctgcccctggacagctag

SEQ ID NO: 18577 - DNA, 1704 bp, Artificial Sequence
  Description of Artificial Sequence: Synthetic coding sequence
atgtggttcagccccaggagcaagaaggtgcgctacgtggtgtccaaggcctctgtgcagacccagcctgccatcaagaaggatgccagcgcccagcaggacagctatgaatttgtgagccccagccccccagcagatgtgtctgagcgggccaagaaggccagcgcccggagcggcaagaagcagaagaagaagaccctggccgagatcaaccagaagtggaacctggaggccgagaaggaggatggagaatttgacagcaaggaggagagcaagcagaagctggtgtccttctgcagccagcccagcgtcatcagcagcccccagatcaatggagaaattgacctgctggccagcggcagcctgacagaaagtgagtgcttcggcagcctgacagaggtgtccctgcccctggccgagcagatcgagagcccagacaccaagagcagaaatgaggtggtgaccccagagaaggtgtgcaagaactacctgaccagcaagaagagcctgcccctggagaacaacgggaagaggggccaccacaaccggctgagcagccccatcagcaagcgctgcaggaccagcatcctgagcaccagcggggactttgtgaagcagacagtgcccagcgagaacatccccctgcctgaatgtagcagcccccccagctgcaagaggaaggtgggcggcaccagcggcaggaagaacagcaacatgtctgatgagttcatcagcctgagccctggcaccccacccagcaccctgagcagcagcagctacagaagagtgatgagcagccccagcgccatgaagctgctgcccaacatggctgtgaagaggaaccacagaggagagaccctgctgcacatcgccagcatcaagggggacatccccagcgtggagtacctgctgcagaatggaagtgaccccaacgtgaaggaccacgccggctggacccccctgcacgaggcctgcaaccacggccacctgaaggtggtggagctgctgctgcagcacaaggccctggtgaacaccaccggctaccagaatgacagccccctgcatgatgctgccaagaatggccacgtggacatcgtgaagctgctgctgtcctatggagccagcagaaatgctgtgaacatcttcggcctgcggcctgtggactacacagatgatgagagcatgaagagcctgctgctgctgcctgagaagaatgaaagcagcagcgccagccactgcagcgtgatgaacacaggccagaggagagatggccccctggtgctgattggcagcggcctgagcagcgagcagcagaagatgctgtctgagctggccgtcatcctgaaggccaagaagtacacagaatttgacagcacagtgacccacgtggtggtgcctggagatgctgtgcagagcaccctgaagtgcatgctgggcatcctgaatggctgctggatcctgaagtttgagtgggtgaaggcctgcctgcggaggaaggtgtgtgagcaggaggagaagtatgagatccctgagggcccccggcgcagccggctgaaccgggagcactgccagagctgcctgatggatgccaccagcatctgtggggagcccagcaacaccatccagaggaccaccctgctgagcagcagcctgcaggtgggcgcccggagctctgtggagagccccagccagacagtgacctag

SEQ ID NO: 18578 - DNA, 3750 bp, Artificial Sequence
  Description of Artificial Sequence: Synthetic coding sequence
atgagctccatgtggagcgagtacaccatcggcggcgtgaagatctacttcccctacaaggcctaccccagccagctggccatgatgaacagcatcctgcggggcctgaacagcaagcagcactgcctgctggagagccccaccggcagcggcaagagcctggccctgctgtgcagcgccctggcctggcagcagagcctgagcggcaagccagcagatgaaggagtgtctgagaaggccgaggtgcagctgagctgctgctgtgcctgccacagcaaggacttcaccaacaatgacatgaaccagggcaccagccgccacttcaactaccccagcaccccacccagcgagagaaatggcaccagcagcacctgccaggacagccctgagaagaccaccctggccgccaagctgagcgccaagaagcaggccagcatctacagagatgaaaatgatgacttccaggtggagaagaagaggatccggcccctggagaccacccagcagatcaggaagaggcactgcttcggcacagaggtgcacaacctggatgccaaggtggacagcggcaagacagtgaagctgaacagccccctggagaagatcaacagcttcagcccccagaagcccccaggccactgcagccgctgctgctgcagcaccaagcagggcaacagccaggagagcagcaacaccatcaagaaggaccacacaggcaagagcaagatccccaagatctacttcggcaccaggacccacaagcagatcgcccagatcacccgggagctgcggaggacagcctacagcggcgtgcccatgaccatcctgagcagccgggaccacacctgtgtgcaccctgaggtggtgggcaacttcaacagaaatgagaagtgcatggagctgctggatggcaagaatggcaagagctgctacttctaccacggcgtgcacaagatcagtgaccagcacaccctgcagaccttccagggcatgtgcaaggcctgggacatcgaggagctggtgtccctgggcaagaagctgaaggcctgcccctactacacagcccgggagctgatccaggatgctgacatcatcttctgcccctacaactacctgctggatgcccagatccgggagagcatggacctgaacctgaaggagcaggtggtgatcctggatgaggcccacaacatcgaggactgtgcccgggagagcgccagctacagcgtgacagaggtgcagctgcgctttgccagagatgagctggacagcatggtgaacaacaacatcaggaagaaggaccacgagcccctgcgggctgtgtgctgcagcctcatcaactggctggaggccaatgctgagtacctggtggagcgggactatgaaagtgcctgcaagatctggagcggaaatgagatgctgctgaccctgcacaagatgggcatcaccacagccaccttccccatcctgcagggccacttctctgctgtgctgcagaaggaggagaagatcagccccatctacggcaaggaggaggcccgggaggtgcctgtgatcagcgccagcacccagatcatgctgaagggcctcttcatggtgctggactacctgttccggcagaacagcagatttgctgatgactacaagatcgccatccagcagacctacagctggaccaaccagattgacatcagtgacaagaatggcctgctggtgctgcccaagaacaagaagaggagccggcagaagacagctgtgcacgtgctgaacttctggtgcctgaacccagctgtggccttcagtgacatcaacgggaaggtgcagaccatcgtgctgaccagcggcaccctgagccccatgaagagcttcagcagcgagctgggcgtgaccttcaccatccagctggaggccaaccacatcatcaagaacagccaggtgtgggtgggcaccatcggcagcggccccaagggcaggaacctgtgtgccaccttccagaacacagagacctttgagttccaggatgaggtgggcgccctgctgctgtctgtgtgccagacagtgtcccagggcatcctgtgcttcctgcccagctacaagctgctggagaagctgaaggagcgctggctgagcacaggcctgtggcacaacctggagctggtgaagacagtcatcgtggagccccagggcggggagaagaccaactttgatgagctgctgcaggtgtactatgatgccatcaagtacaagggggagaaggatggagccctgctggtggccgtgtgccggggcaaggtgtctgagggcctggacttcagtgatgacaatgcccgggccgtcatcaccatcggcatccccttccccaacgtgaaggacctgcaggtggagctgaagaggcagtacaatgaccaccacagcaagctgcggggcctgctgcccggccggcagtggtatgagatccaggcctaccgggccctgaaccaggccctgggccgctgcatccgccacagaaatgactggggcgccctgatcctggtggatgaccgcttcaggaacaaccccagccgctacatcagcggcctgagcaagtgggtgcggcagcagatccagcaccacagcacctttgagagcgccctggagagcctggccgagttcagcaagaagcaccagaaggtgctgaatgtgtccatcaaggacaggaccaacatccaggacaatgaaagcaccctggaggtgaccagcctgaagtacagcaccagcccctacctgctggaggccgccagccacctgagccctgagaactttgtggaggatgaggccaagatctgtgtgcaggagctgcagtgccccaagatcatcaccaagaacagccccctgcccagcagcatcatcagcaggaaggagaagaatgaccctgtgttcctggaggaggccggcaaggccgagaagatcgtcatcagccgcagcaccagccccaccttcaacaagcagaccaagagggtgtcctggagcagcttcaacagcctgggccagtacttcaccgggaagatccccaaggccaccccagagctgggcagcagtgaaaattctgccagcagccccccacgcttcaagacagagaagatggagagcaagacagtgctgcccttcacagacaagtgtgagagcagcaacctgactgtgaacaccagctttggcagctgcccccagagcgagaccatcatcagcagcctgaagattgatgccaccctgaccaggaagaaccacagcgagcaccccctgtgcagcgaggaggccctggaccctgacatcgagctgagcctggtgtctgaggaggacaagcagagcaccagcaacagagactttgaaacagaagcagaagatgagagcatctacttcaccccagagctgtatgaccctgaggacacagatgaggagaagaatgacctggccgagacagaccggggcaaccggctggccaacaacagcgactgcatcctggccaaggacctgtttgagatccgcaccatcaaggaggtggacagcgcccgggaggtgaaggccgaggactgcatcgacaccaagctgaatggcatcctgcacatcgaggagagcaagattgatgacattgatggaaatgtgaagaccacctggatcaatgagctggagctgggcaagacccatgaaattgagatcaagaacttcaagcccagccccagcaagaacaagggcatgtttcctggcttcaagtag

SEQ ID NO: 18579 - DNA, 945 bp, Artificial Sequence
  Description of Artificial Sequence: Synthetic coding sequence
atggccagccgcagcaagagaagagctgtggagagcggcgtgccccagcccccagacccccctgtgcagagagatgaggaggaggagaaggaggtggagaatgaagatgaagatgatgatgacagcgacaaggagaaggatgaagaagatgaggtgattgatgaggaggtgaacattgaatttgaggcctacagcctgagtgacaatgactatgatggcatcaagaagctgctgcagcagctgttcctgaaggcccctgtgaacacagctgagctgacagacctgctgatccagcagaaccacatcggcagcgtcatcaagcagacagatgtgtctgaggacagcaatgatgacatggatgaagatgaggtgtttggcttcatcagcctgctgaacctgacagagaggaagggcacccagtgtgtggagcagatccaggagctggtgctgcgcttctgtgagaagaactgtgagaagtccatggtggagcagctggacaagttcctgaatgacaccaccaagcctgtgggcctgctgctgtctgagcgcttcatcaacgtgcccccccagatcgccctgcccatgtaccagcagctgcagaaggagctggccggggcccacaggaccaacaagccctgtgggaagtgctacttctacctgctgatcagcaagacctttgtggaggccggcaagaacaacagcaagaagaagcccagcaacaagaagaaggccgccctgatgtttgccaatgctgaggaggagttcttctatgagaaggccatcctgaagttcaactacagcgtgcaggaggagagtgacacctgcctgggcggcaagtggagctttgatgatgtgcccatgacccccctgaggacagtgatgctgatccctggggacaagatgaatgagatcatggacaagctgaaggagtacctgtctgtgtag

SEQ ID NO: 18580 - DNA, 879 bp, Artificial Sequence
  Description of Artificial Sequence: Synthetic coding sequence
atggccagccgcagcaagagaagagctgtggagagcggcgtgccccagcccccagacccccctgtgcagagagatgaggaggaggagaaggaggtggagaatgaagatgaagatgatgatgacagcgacaaggagaaggatgaagaagatgaggtgattgatgaggaggtgaacattgaatttgaggcctacagcctgagtgacaatgactatgatggcatcaagaagctgctgcagcagctgttcctgaaggcccctgtgaacacagctgagctgacagacctgctgatccagcagaaccacatcggcagcgtcatcaagcagacagatgtgtctgaggacagcaatgatgacatggatgaagatgaggtgtttggcttcatcagcctgctgaacctgacagagaggaagggcacccagtgtgtggagcagatccaggagctggtgctgcgcttctgtgagaagaactgtgagaagtccatggtggagcagctggacaagttcctgaatgacaccaccaagcctgtgggcctgctgctgtctgagcgcttcatcaacgtgcccccccagatcgccctgcccatgtaccagcagctgcagaaggagctggccggggcccacaggaccaacaagccctgtgggaagtgctacttctacctgctgatcagcaagacctttgtggaggccggcaagaacaacagcaagaagaagcccagcaacaagaagaaggccgccctgatgtttgccaatgctgaggaggagttcttctatgaggagcagggcaagccagaggtgctgggcggccctgacacccggcggggcctggagcctgtgcccatccagcacaacggctggagcgtgccccctgtgctggagtag

SEQ ID NO: 18581 - DNA, 969 bp, Artificial Sequence
  Description of Artificial Sequence: Synthetic coding sequence
atggccagccgcagcaagagaagagctgtggagagcggcgtgccccagcccccagacccccctgtgcagagagatgaggaggaggagaaggaggtggagaatgaagatgaagatgatgatgacagcgacaaggagaaggatgaagaagatgaggtgattgatgaggaggtgaacattgaatttgaggcctacagcctgagtgacaatgactatgatggcatcaagaagctgctgcagcagctgttcctgaaggcccctgtgaacacagctgagctgacagacctgctgatccagcagaaccacatcggcagcgtcatcaagcagacagatgtgtctgaggacagcaatgatgacatggatgaagatgaggtgtttggcttcatcagcctgctgaacctgacagagaggaagggcacccagtgtgtggagcagatccaggagctggtgctgcgcttctgtgagaagaactgtgagaagtccatggtggagcagctggacaagttcctgaatgacaccaccaagcctgtgggcctgctgctgtctgagcgcttcatcaacgtgcccccccagatcgccctgcccatgtaccagcagctgcagaaggagctggccggggcccacaggaccaacaagccctgtgggaagtgctacttctacctgctgatcagcaagacctttgtggaggccggcaagaacaacagcaagaagaagcccagcaacaagaagaaggccgccctgatgtttgccaatgctgaggaggagttcttctatgaggagcagggcaagccagaggtgctgggcggccctgacacccggcggggcctggagcctgtgcccatccagcacaatggaggcagccggggccaggtgacagccctggtgtccctgaaggccggcctcatccagagccgcagcaccctgagtgacttccagggcaccttcatgacagtgggcatcgccctgtcctag

SEQ ID NO: 18582 - DNA, 879 bp, Artificial Sequence
  Description of Artificial Sequence: Synthetic coding sequence
atggccagccgcagcaagagaagagctgtggagagcggcgtgccccagcccccagacccccctgtgcagagagatgaggaggaggagaaggaggtggagaatgaagatgaagatgatgatgacagcgacaaggagaaggatgaagaagatgaggtgattgatgaggaggtgaacattgaatttgaggcctacagcctgagtgacaatgactatgatggcatcaagaagctgctgcagcagctgttcctgaaggcccctgtgaacacagctgagctgacagacctgctgatccagcagaaccacatcggcagcgtcatcaagcagacagatgtgtctgaggacagcaatgatgacatggatgaagatgaggtgtttggcttcatcagcctgctgaacctgacagagaggaagggcacccagtgtgtggagcagatccaggagctggtgctgcgcttctgtgagaagaactgtgagaagtccatggtggagcagctggacaagttcctgaatgacaccaccaagcctgtgggcctgctgctgtctgagcgcttcatcaacgtgcccccccagatcgccctgcccatgtaccagcagctgcagaaggagctggccggggcccacaggaccaacaagccctgtgggaagtgctacttctacctgctgatcagcaagacctttgtggaggccggcaagaacaacagcaagaagaagcccagcaacaagaagaaggccgccctgatgtttgccaatgctgaggaggagttcttctatgagaaggccatcctgaagttcaactacagcgtgcaggaggagagtgacacctgcctgggcggcaagtggagctttgatgactggagcgtgccccctgtgctggagtag

SEQ ID NO: 18583 - DNA, 789 bp, Artificial Sequence
  Description of Artificial Sequence: Synthetic coding sequence
atggccagccgcagcaagagaagagctgtggagagcggcgtgccccagcccccagacccccctgtgcagagagatgaggaggaggagaaggaggtggagaatgaagatgaagatgatgatgacagcgacaaggagaaggatgaagaagatgaggtgattgatgaggaggtgaacattgaatttgaggcctacagcctgagtgacaatgactatgatggcatcaagaagctgctgcagcagctgttcctgaaggcccctgtgaacacagctgagctgacagacctgctgatccagcagaaccacatcggcagcgtcatcaagggcacccagtgtgtggagcagatccaggagctggtgctgcgcttctgtgagaagaactgtgagaagtccatggtggagcagctggacaagttcctgaatgacaccaccaagcctgtgggcctgctgctgtctgagcgcttcatcaacgtgcccccccagatcgccctgcccatgtaccagcagctgcagaaggagctggccggggcccacaggaccaacaagccctgtgggaagtgctacttctacctgctgatcagcaagacctttgtggaggccggcaagaacaacagcaagaagaagcccagcaacaagaagaaggccgccctgatgtttgccaatgctgaggaggagttcttctatgaggagcagggcaagccagaggtgctgggcggccctgacacccggcggggcctggagcctgtgcccatccagcacaacggctggagcgtgccccctgtgctggagtag

SEQ ID NO: 18584 - DNA, 1398 bp, Artificial Sequence
  Description of Artificial Sequence: Synthetic coding sequence
atggtggaccctgtgggctttgctgaggcctggaaggcccagttcccagacagcgagccccccaggatggagctgcggtctgtgggggacatcgagcaggagctggagcgctgcaaggccagcatccggcggctggagcaggaggtgaaccaggagcgcttcaggatgatctacctgcagaccctgctggccaaggagaagaagagctatgaccggcagcgctggggcttccggcgggccgcccaggccccagatggagccagcgagccccgggccagcgccagccggccccagcctgccccagcagatggagctgaccccccacctgctgaggagcctgaggcccggccagatggagagggcagccctgggaaggcccggcccggcacagcccggcggcctggagctgctgccagcggggagagagatgaccggggccccccagcctctgtggccgccctgcggagcaactttgagcgcatcagaaaaggacatggccagcccggggctgatgctgagaagcccttctacgtgaatgtggagttccaccacgagcggggcctggtgaaggtgaatgacaaggaggtgtctgaccgcatcagcagcctgggcagccaggccatgcagatggagaggaagaagagccagcacggggccggcagctctgtgggagatgccagcaggcctccctaccggggccgcagcagcgagagcagctgtggggtggatggagactatgaagatgctgagctgaacccccgcttcctgaaggacaacctgattgatgccaacggcggcagcaggcctccctggccacccctggagtaccagccctaccagagcatctacgtgggcggcatgatggagggggagggcaagggccccctgctgcggagccagagcaccagcgagcaggagaagaggctgacctggcccaggaggagctacagccccaggagctttgaggactgtggcggcggctacaccccagactgcagcagcaatgaaaacctgaccagcagcgaggaggacttcagcagcggccagagcagccgggtgagccccagccccaccacctacaggatgttccgggacaagagccgcagccccagccagaacagccagcagagctttgacagcagcagcccccccaccccccagtgccacaagaggcaccgccactgccctgtggtggtgtctgaggccaccatcgtgggcgtgaggaagacaggccagatctggcccaatgatggagagggcgccttccatggagagcaccctggagctgctgaggaggtgttccagaagctgctgcctgacatcagaggagctgctgatgctgaccagctggtgtgtgagaccccagactgcccccagcacagcgctgaccaccagtag

SEQ ID NO: 18585 - DNA, 1377 bp, Artificial Sequence
  Description of Artificial Sequence: Synthetic coding sequence
atggtggaccctgtgggctttgctgaggcctggaaggcccagttcccagacagcgagccccccaggatggagctgcggtctgtgggggacatcgagcaggagctggagcgctgcaaggccagcatccggcggctggagcaggaggtgaaccaggagcgcttcaggatgatctacctgcagaccctgctggccaaggagaagaagagctatgaccggcagcgctggggcttccggcgggccgcccaggccccagatggagccagcgagccccgggccagcgccagccggccccagcctgccccagcagatggagctgaccccccacctgctgaggagcctgaggcccggccagatggagagggcagccctgggaaggcccggcccggcacagcccggcggcctggagctgctgccagcggggagagagatgaccggggccccccagcctctgtggccgccctgcggagcaactttgagcgcatcagaaaaggacatggccagcccggggctgatgctgagaagcccttctacgtgaatgtggagttccaccacgagcggggcctggtgaaggtgaatgacaaggaggtgtctgaccgcatcagcagcctgggcagccaggccatgcagatggagaggaagaagagccagcacggggccggcagctctgtgggagatgccagcaggcctccctaccggggccgcagcagcgagagcagctgtggggtggatggagactatgaagatgctgagctgaacccccgcttcctgaaggacaacctgattgatgccaacggcggcagcaggcctccctggccacccctggagtaccagccctaccagagcatctacgtgggcggcatgatggagggggagggcaagggccccctgctgcggagccagagcaccagcgagcaggagaagaggctgacctggcccaggaggagctacagccccaggagctttgaggactgtggcggcggctacaccccagactgcagcagcaatgaaaacctgaccagcagcgaggaggacttcagcagcggccagagcagccgggtgagccccagccccaccacctacaggatgttccgggacaagagccgcagccccagccagaacagccagcagagctttgacagcagcagcccccccaccccccagtgccacaagaggcaccgccactgccctgtggtggtgtctgaggccaccatcgtgggcgtgaggaagacaggccagatctggcccaatgatggagagggcgccttccatggagatgctgatggcagctttggcaccccacctggctacggctgcctgtgcctgcctgcctggcccagcggctgcacagctgccacagcccgggtgaccaggagctag

SEQ ID NO: 18586 - DNA, 3816 bp, Artificial Sequence
  Description of Artificial Sequence: Synthetic coding sequence
atggtggaccctgtgggctttgctgaggcctggaaggcccagttcccagacagcgagccccccaggatggagctgcggtctgtgggggacatcgagcaggagctggagcgctgcaaggccagcatccggcggctggagcaggaggtgaaccaggagcgcttcaggatgatctacctgcagaccctgctggccaaggagaagaagagctatgaccggcagcgctggggcttccggcgggccgcccaggccccagatggagccagcgagccccgggccagcgccagccggccccagcctgccccagcagatggagctgaccccccacctgctgaggagcctgaggcccggccagatggagagggcagccctgggaaggcccggcccggcacagcccggcggcctggagctgctgccagcggggagagagatgaccggggccccccagcctctgtggccgccctgcggagcaactttgagcgcatcagaaaaggacatggccagcccggggctgatgctgagaagcccttctacgtgaatgtggagttccaccacgagcggggcctggtgaaggtgaatgacaaggaggtgtctgaccgcatcagcagcctgggcagccaggccatgcagatggagaggaagaagagccagcacggggccggcagctctgtgggagatgccagcaggcctccctaccggggccgcagcagcgagagcagctgtggggtggatggagactatgaagatgctgagctgaacccccgcttcctgaaggacaacctgattgatgccaacggcggcagcaggcctccctggccacccctggagtaccagccctaccagagcatctacgtgggcggcatgatggagggggagggcaagggccccctgctgcggagccagagcaccagcgagcaggagaagaggctgacctggcccaggaggagctacagccccaggagctttgaggactgtggcggcggctacaccccagactgcagcagcaatgaaaacctgaccagcagcgaggaggacttcagcagcggccagagcagccgggtgagccccagccccaccacctacaggatgttccgggacaagagccgcagccccagccagaacagccagcagagctttgacagcagcagcccccccaccccccagtgccacaagaggcaccgccactgccctgtggtggtgtctgaggccaccatcgtgggcgtgaggaagacaggccagatctggcccaatgatggagagggcgccttccatggagatgctgatggcagctttggcaccccacctggctacggctgtgccgctgacagagctgaggagcagaggaggcaccaggacggcctgccctacattgatgacagccccagcagcagcccccacctgagcagcaagggccggggcagcagagatgccctggtgtctggggccctggagagcaccaaggccagcgagctggacctggagaagggcctggagatgaggaagtgggtgctgagcggcatcctggccagcgaggagacctacctgagccacctggaggccctgctgctgcccatgaagcccctgaaggccgccgccaccaccagccagcctgtgctgaccagccagcagatcgagaccatcttcttcaaggtgcctgagctgtatgagatccacaaggagttctatgatggcctcttcccccgggtgcagcagtggagccaccagcagagggtgggggacctcttccagaagctggccagccagctgggcgtgtaccgggcctttgtggacaactacggcgtggccatggagatggccgagaagtgctgccaggccaatgcccagtttgctgagatcagcgagaacctgcgggcccggagcaacaaggatgccaaggaccccaccaccaagaacagcctggagaccctgctgtacaagcctgtggacagagtgaccaggagcaccctggtgctgcatgacctgctgaagcacaccccagccagccacccagaccaccccctgctgcaggatgccctgcgcatcagccagaacttcctgagcagcatcaatgaggagatcaccccccggcggcagagcatgacagtgaagaagggggagcaccggcagctgctgaaggacagcttcatggtggagctggtggagggcgccaggaagctgcggcacgtgttcctgttcacagacctgctgctgtgcaccaagctgaagaagcagagcggcggcaagacccagcagtatgactgcaagtggtacatccccctgacagacctgtccttccagatggtggatgagctggaggccgtgcccaacatccccctggtgcctgatgaggagctggatgccctgaagatcaagatcagccagatcaagaatgacatccagcgggagaagagggccaacaagggcagcaaggccacagagcggctgaagaagaagctgtctgagcaggagagcctgctgctgctgatgagccccagcatggccttccgggtgcacagcagaaatggcaagagctacaccttcctgatcagcagtgactatgaaagagctgagtggagggagaacatccgggagcagcagaagaagtgcttccgctccttcagcctgacctctgtggagctgcagatgctgaccaacagctgtgtgaagctgcagacagtgcacagcatccccctgaccatcaacaaggaggatgatgagagccctggcctgtatggcttcctgaatgtcatcgtgcacagcgccaccggcttcaagcagagcagcaacctgtactgcaccctggaggtggacagctttggctactttgtgaacaaggccaagaccagggtgtacagagacacagctgagcccaactggaatgaggagtttgaaattgagctggagggcagccagaccctgcgcatcctgtgctatgagaagtgctacaacaagaccaagatccccaaggaggatggagagagcacagaccggctgatgggcaagggccaggtgcagctggacccccaggccctgcaggaccgggactggcagaggacagtcatcgccatgaatggaattgaggtgaagctgtctgtgaagttcaacagccgggagttcagcctgaagaggatgcccagcaggaagcagacaggagtgtttggagtgaagattgctgtggtgaccaagcgggagaggagcaaggtgccctacatcgtgcggcagtgtgtggaggagattgaaagaagaggcatggaggaggtgggcatctacagagtgtctggagtggccacagacatccaggccctgaaggccgcctttgatgtgaacaacaaggatgtgtctgtgatgatgtctgagatggatgtgaatgccatcgccggcaccctgaagctgtacttccgggagctgcctgagcccctcttcacagatgagttctaccccaactttgctgagggcatcgccctgagtgaccctgtggccaaggagagctgcatgctgaacctgctgctgagcctgcctgaggccaacctgctgaccttcctgttcctgctggaccacctgaagagggtggccgagaaggaggccgtgaacaagatgagcctgcacaacctggccaccgtgtttggccccaccctgctgcggcccagcgagaaggagagcaagctgcctgccaaccccagccagcccatcaccatgacagacagctggagcctggaggtgatgagccaggtgcaggtgctgctgtacttcctgcagctggaggccatcccagccccagacagcaagaggcagagcatcctcttcagcacagaggtgtag

SEQ ID NO: 18587 - DNA, 2811 bp, Artificial Sequence
  Description of Artificial Sequence: Synthetic coding sequence
cccagcgccccccgggtgtccacagtgggcctgctgtgcagcggggccggcccccacctgtgcccctgtgccgaggagggcaccggcggcctggagagccagggcgagatcatccccagccggggcagcaggaagccagatggagtgtctggcagcagaagactcttcagcagcctgtgcaagagccaggagggcagcaggaaagaatgtctgaggaagcaccggcggctgggccctgccatgcctgtgagcagccctggcttccctggccccctggcccggtctgagcaccacctggacacagctgccctgcagacaggccagaggagcagcgctggcaccaagatgggctgccccaccctgatgaccaggcctccccaccggcccaccagcgctgcccgggccggggccgccggcatgcgctggagccgggagccctggagccccctgaagaggtctgagctggacctggagaagggcctggagatgaggaagtgggtgctgagcggcatcctggccagcgaggagacctacctgagccacctggaggccctgctgctgcccatgaagcccctgaaggctgctgccaccaccagccagcctgtgctgaccagccagcagatcgagaccatcttcttcaaggtgcctgagctgtatgagatccacaaggagttctatgatggcctcttcccccgggtgcagcagtggagccaccagcagagggtgggggacctcttccagaagctggccagccagctgggcgtgtaccgggcctttgtggacaactatggagtggccatggagatggccgagaagtgctgccaggccaatgcccagtttgctgagatcagcgagaacctgcgggcccggagcaacaaggatgccaaggaccccaccaccaagaacagcctggagaccctgctgtacaagcctgtggacagagtgaccaggagcaccctggtgctgcatgacctgctgaagcacaccccagccagccacccagaccaccccctgctgcaggatgccctgcgcatcagccagaacttcctgagcagcatcaatgaggagatcaccccccggcggcagagcatgacagtgaagaagggggagcaccggcagctgctgaaggacagcttcatggtggagctggtggagggcgccaggaagctgcggcacgtgttcctgttcacagacctgctgctgtgcaccaagctgaagaagcagagcggcggcaagacccagcagtatgactgcaagtggtacatccccctgacagacctgtccttccagatggtggatgagctggaggccgtgcccaacatccccctggtgcctgatgaggagctggatgccctgaagatcaagatcagccagatcaagaatgacatccagcgggagaagagggccaacaagggcagcaaggccacagagcggctgaagaagaagctgtctgagcaggagagcctgctgctgctgatgagccccagcatggccttccgggtgcacagcagaaatggcaagagctacaccttcctgatcagcagtgactatgagcgggcagagtggagggagaacatccgggagcagcagaagaagtgcttccgctccttcagcctgacctctgtggagctgcagatgctgaccaacagctgtgtgaagctgcagacagtgcacagcatccccctgaccatcaacaaggaggatgatgagagccctggcctgtatggcttcctgaatgtgattgtgcacagcgccaccggcttcaagcagagcagcaacctgtactgcaccctggaggtggacagctttggctactttgtgaacaaggccaagaccagggtgtacagagacacagctgagcccaactggaatgaggagtttgaaattgagctggagggcagccagaccctgcgcatcctgtgctatgagaagtgctacaacaagaccaagatccccaaggaggatggagagagcacagaccggctgatgggcaagggccaggtgcagctggacccccaggccctgcaggaccgggactggcagaggacagtgattgccatgaatggcatcgaggtgaagctgtctgtgaagttcaacagccgggagttcagcctgaagaggatgcccagcaggaagcagacaggagtgtttggagtgaagattgctgtggtgaccaagcgggagaggagcaaggtgccctacatcgtgcggcagtgtgtggaggagattgaaagaagaggcatggaggaggtgggcatctacagagtgtctggagtggccacagacatccaggccctgaaggccgcctttgatgtgaacaacaaggatgtgtctgtgatgatgtctgagatggatgtgaatgccatcgccggcaccctgaagctgtacttccgggagctgcctgagcccctcttcacagatgagttctaccccaactttgctgagggcatcgccctgagtgaccctgtggccaaggagagctgcatgctgaacctgctgctgagcctgcctgaggccaacctgctgaccttcctgttcctgctggaccacctgaagagggtggccgagaaggaggccgtgaacaagatgagcctgcacaacctggccaccgtgtttggccccaccctgctgcggcccagcgagaaggagagcaagctgcctgccaaccccagccagcccatcaccatgacagacagctggagcctggaggtgatgagccaggtgcaggtgctgctgtacttcctgcagctggaggccatcccagccccagacagcaagaggcagagcatcctcttcagcacagaggtgtag

SEQ ID NO: 18588 - DNA, 3684 bp, Artificial Sequence
  Description of Artificial Sequence: Synthetic coding sequence
atggtggaccctgtgggctttgctgaggcctggaaggcccagttcccagacagcgagccccccaggatggagctgcggtctgtgggggacatcgagcaggagctggagcgctgcaaggccagcatccggcggctggagcaggaggtgaaccaggagcgcttcaggatgatctacctgcagaccctgctggccaaggagaagaagagctatgaccggcagcgctggggcttccggcgggccgcccaggccccagatggagccagcgagccccgggccagcgccagccggccccagcctgccccagcagatggagctgaccccccacctgctgaggagcctgaggcccggccagatggagagggcagccctgggaaggcccggcccggcacagcccggcggcctggagctgctgccagcggggagagagatgaccggggccccccagcctctgtggccgccctgcggagcaactttgagcgcatcagaaaaggacatggccagcccggggctgatgctgagaagcccttctacgtgaatgtggagttccaccacgagcggggcctggtgaaggtgaatgacaaggaggtgtctgaccgcatcagcagcctgggcagccaggccatgcagatggagaggaagaagagccagcacggggccggcagctctgtgggagatgccagcaggcctccctaccggggccgcagcagcgagagcagctgtggggtggatggagactatgaagatgctgagctgaacccccgcttcctgaaggacaacctgattgatgccaacggcggcagcaggcctccctggccacccctggagtaccagccctaccagagcatctacgtgggcggcatgatggagggggagggcaagggccccctgctgcggagccagagcaccagcgagcaggagaagaggctgacctggcccaggaggagctacagccccaggagctttgaggactgtggcggcggctacaccccagactgcagcagcaatgaaaacctgaccagcagcgaggaggacttcagcagcggccagagcagccgggtgagccccagccccaccacctacaggatgttccgggacaagagccgcagccccagccagaacagccagcagagctttgacagcagcagcccccccaccccccagtgccacaagaggcaccgccactgccctgtggtggtgtctgaggccaccatcgtgggcgtgaggaagacaggccagatctggcccaatgatggagagggcgccttccatggagatgctgatggcagctttggcaccccacctggctacggctgtgccgctgacagagctgaggagcagaggaggcaccaggacggcctgccctacattgatgacagccccagcagcagcccccacctgagcagcaagggccggggcagcagagatgccctggtgtctggggccctggagagcaccaaggccagcgagctggacctggagaagggcctggagatgaggaagtgggtgctgagcggcatcctggccagcgaggagacctacctgagccacctggaggccctgctgctgcccatgaagcccctgaaggccgccgccaccaccagccagcctgtgctgaccagccagcagatcgagaccatcttcttcaaggtgcctgagctgtatgagatccacaaggagttctatgatggcctcttcccccgggtgcagcagtggagccaccagcagagggtgggggacctcttccagaagctggccagccagctgggcgtgtaccgggcctttgtggacaactacggcgtggccatggagatggccgagaagtgctgccaggccaatgcccagtttgctgagatcagcgagaacctgcgggcccggagcaacaaggatgccaaggaccccaccaccaagaacagcctggagaccctgctgtacaagcctgtggacagagtgaccaggagcaccctggtgctgcatgacctgctgaagcacaccccagccagccacccagaccaccccctgctgcaggatgccctgcgcatcagccagaacttcctgagcagcatcaatgaggagatcaccccccggcggcagagcatgacagtgaagaagggggagcaccggcagctgctgaaggacagcttcatggtggagctggtggagggcgccaggaagctgcggcacgtgttcctgttcacagacctgctgctgtgcaccaagctgaagaagcagagcggcggcaagacccagcagtatgactgcaagtggtacatccccctgacagacctgtccttccagatggtggatgagctggaggccgtgcccaacatccccctggtgcctgatgaggagctggatgccctgaagatcaagatcagccagatcaagaatgacatccagcgggagaagagggccaacaagggcagcaaggccacagagcggctgaagaagaagctgtctgagcaggagagcctgctgctgctgatgagccccagcatggccttccgggtgcacagcagaaatggcaagagctacaccttcctgatcagcagtgactatgaaagagctgagtggagggagaacatccgggagcagcagaagaagtgcttccgctccttcagcctgacctctgtggagctgcagatgctgaccaacagctgtgtgaagctgcagacagtgcacagcatccccctgaccatcaacaaggaggatgatgagagccctggcctgtatggcttcctgaatgtcatcgtgcacagcgccaccggcttcaagcagagcagcaacctgtactgcaccctggaggtggacagctttggctactttgtgaacaaggccaagaccagggtgtacagagacacagctgagcccaactggaatgagctggacccccaggccctgcaggaccgggactggcagaggacagtcatcgccatgaatggaattgaggtgaagctgtctgtgaagttcaacagccgggagttcagcctgaagaggatgcccagcaggaagcagacaggagtgtttggagtgaagattgctgtggtgaccaagcgggagaggagcaaggtgccctacatcgtgcggcagtgtgtggaggagattgaaagaagaggcatggaggaggtgggcatctacagagtgtctggagtggccacagacatccaggccctgaaggccgcctttgatgtgaacaacaaggatgtgtctgtgatgatgtctgagatggatgtgaatgccatcgccggcaccctgaagctgtacttccgggagctgcctgagcccctcttcacagatgagttctaccccaactttgctgagggcatcgccctgagtgaccctgtggccaaggagagctgcatgctgaacctgctgctgagcctgcctgaggccaacctgctgaccttcctgttcctgctggaccacctgaagagggtggccgagaaggaggccgtgaacaagatgagcctgcacaacctggccaccgtgtttggccccaccctgctgcggcccagcgagaaggagagcaagctgcctgccaaccccagccagcccatcaccatgacagacagctggagcctggaggtgatgagccaggtgcaggtgctgctgtacttcctgcagctggaggccatcccagccccagacagcaagaggcagagcatcctcttcagcacagaggtgtag

SEQ ID NO: 18589 - DNA, 1404 bp, Artificial Sequence
  Description of Artificial Sequence: Synthetic coding sequence
atggtggaccctgtgggctttgctgaggcctggaaggcccagttcccagacagcgagccccccaggatggagctgcggtctgtgggggacatcgagcaggagctggagcgctgcaaggccagcatccggcggctggagcaggaggtgaaccaggagcgcttcaggatgatctacctgcagaccctgctggccaaggagaagaagagctatgaccggcagcgctggggcttccggcgggccgcccaggccccagatggagccagcgagccccgggccagcgccagccggccccagcctgccccagcagatggagctgaccccccacctgctgaggagcctgaggcccggccagatggagagggcagccctgggaaggcccggcccggcacagcccggcggcctggagctgctgccagcggggagagagatgaccggggccccccagcctctgtggccgccctgcggagcaactttgagcgcatcagaaaaggacatggccagcccggggctgatgctgagaagcccttctacgtgaatgtggagttccaccacgagcggggcctggtgaaggtgaatgacaaggaggtgtctgaccgcatcagcagcctgggcagccaggccatgcagatggagaggaagaagagccagcacggggccggcagctctgtgggagatgccagcaggcctccctaccggggccgcagcagcgagagcagctgtggggtggatggagactatgaagatgctgagctgaacccccgcttcctgaaggacaacctgattgatgccaacggcggcagcaggcctccctggccacccctggagtaccagccctaccagagcatctacgtgggcggcatgatggagggggagggcaagggccccctgctgcggagccagagcaccagcgagcaggagaagaggctgacctggcccaggaggagctacagccccaggagctttgaggactgtggcggcggctacaccccagactgcagcagcaatgaaaacctgaccagcagcgaggaggacttcagcagcggccagagcagccgggtgagccccagccccaccacctacaggatgttccgggacaagagccgcagccccagccagaacagccagcagagctttgacagcagcagcccccccaccccccagtgccacaagaggcaccgccactgccctgtggtggtgtctgaggccaccatcgtgggcgtgaggaagacaggccagatctggcccaatgatggagagggcgccttccatggagatgctgtgctgaagacagaggtgccccaccagggcgtgcggcgggcccggctgagcctggaggccctgggggaggaccccagcttcctgtttcctgccagtgatggccccaggcacagcagcacctggtag

SEQ ID NO: 18590 - DNA, 1365 bp, Artificial Sequence
  Description of Artificial Sequence: Synthetic coding sequence
atggtggaccctgtgggctttgctgaggcctggaaggcccagttcccagacagcgagccccccaggatggagctgcggtctgtgggggacatcgagcaggagctggagcgctgcaaggccagcatccggcggctggagcaggaggtgaaccaggagcgcttcaggatgatctacctgcagaccctgctggccaaggagaagaagagctatgaccggcagcgctggggcttccggcgggccgcccaggccccagatggagccagcgagccccgggccagcgccagccggccccagcctgccccagcagatggagctgaccccccacctgctgaggagcctgaggcccggccagatggagagggcagccctgggaaggcccggcccggcacagcccggcggcctggagctgctgccagcggggagagagatgaccggggccccccagcctctgtggccgccctgcggagcaactttgagcgcatcagaaaaggacatggccagcccggggctgatgctgagaagcccttctacgtgaatgtggagttccaccacgagcggggcctggtgaaggtgaatgacaaggaggtgtctgaccgcatcagcagcctgggcagccaggccatgcagatggagaggaagaagagccagcacggggccggcagctctgtgggagatgccagcaggcctccctaccggggccgcagcagcgagagcagctgtggggtggatggagactatgaagatgctgagctgaacccccgcttcctgaaggacaacctgattgatgccaacggcggcagcaggcctccctggccacccctggagtaccagccctaccagagcatctacgtgggcggcatgatggagggggagggcaagggccccctgctgcggagccagagcaccagcgagcaggagaagaggctgacctggcccaggaggagctacagccccaggagctttgaggactgtggcggcggctacaccccagactgcagcagcaatgaaaacctgaccagcagcgaggaggacttcagcagcggccagagcagccgggtgagccccagccccaccacctacaggatgttccgggacaagagccgcagccccagccagaacagccagcagagctttgacagcagcagcccccccaccccccagtgccacaagaggcaccgccactgccctgtggtggtgtctgaggccaccatcgtgggcgtgaggaagacaggccagatctggcccaatgatggagagggcgccttccatggagatgctgatggcagctttggcaccccacctggctacggctgtgccgccggccggcccccccacctgacagagctgcctgtgcagcaccagtag

SEQ ID NO: 18591 - DNA, 4704 bp, Artificial Sequence
  Description of Artificial Sequence: Synthetic coding sequence
atgaatgtggagaaggccgagttctgcaacaagagcaagcagcccggcctggcccggagccagcacaaccgctgggccggcagcaaggagacctgcaatgacaggaggacccccagcacagagaagaaggtggacctgaatgctgaccccctgtgtgagaggaaggagtggaacaagcagaagctgccctgcagcgagaacccccgggacacagaagatgtgccctggatcaccctgaacagcagcatccagaaggtgaatgagtggttcagcagaagtgatgagctgctgggcagtgatgacagccatgatggagagagcgagagcaatgccaaggtggctgatgtgctggatgtgctgaatgaggtggatgagtacagcggcagcagcgagaagattgacctgctggccagtgacccccatgaggccctgatctgcaagtctgagcgggtgcacagcaagtctgtggagagcaacatcgaggacaagatctttgggaagacctacaggaagaaggccagcctgcccaacctgagccacgtgacagaaaatctcatcattggagcctttgtgacagagccccagatcatccaggagcggcccctgaccaacaagctgaagaggaagaggcggcccaccagcggcctgcaccctgaggacttcatcaagaaggctgacctggccgtgcagaagaccccagagatgatcaaccagggcaccaaccagacagagcagaatggccaggtgatgaacatcaccaacagcggccacgagaacaagaccaagggggacagcatccagaatgagaagaaccccaaccccatcgagagcctggagaaggagagcgccttcaagaccaaggccgagcccatcagcagcagcatcagcaacatggagctggagctgaacatccacaacagcaaggcccccaagaagaaccggctgcggaggaagagcagcaccaggcacatccacgccctggagctggtggtgtccaggaacctgagcccccccaactgcacagagctgcagattgacagctgcagcagcagcgaggagatcaagaagaagaagtacaaccagatgcctgtgcgccacagcaggaacctgcagctgatggagggcaaggagcccgccaccggggccaagaagagcaacaagcccaatgagcagaccagcaagagacatgacagcgacaccttccctgagctgaagctgaccaatgcccctggcagcttcaccaagtgcagcaacaccagcgagctgaaggagtttgtgaaccccagcctgccccgggaggagaaggaggagaagctggagaccgtgaaggtgagcaacaatgctgaggaccccaaggacctgatgctgtctggagagcgggtgctgcagacagagaggtctgtggagagcagcagcatcagcctggtgcctggaacagattatggcacccaggagagcatcagcctgctggaggtgtccaccctgggcaaggccaagacagagcccaacaagtgtgtgtcccagtgtgccgcctttgagaaccccaagggcctcatccacggctgcagcaaggacaacagaaatgacacagagggcttcaagtaccccctgggccacgaggtgaaccacagccgggagaccagcattgagatggaggagagcgagctggatgcccagtacctgcagaacaccttcaaggtgtccaagaggcagagctttgcccccttcagcaaccctggaaatgctgaggaggagtgtgccaccttcagcgcccacagcggcagcctgaagaagcagagccccaaggtgacctttgaatgtgagcagaaggaggagaaccagggcaagaatgaaagcaacatcaagcctgtgcagacagtgaacatcacagctggcttccctgtggtgggccagaaggacaagcctgtggacaatgccaagtgcagcatcaagggcggcagccgcttctgcctgagcagccagttcagaggaaatgaaacaggcctcatcacccccaacaagcacggcctgctgcagaacccctaccgcatccccccactcttccccatcaagagctttgtgaagaccaagtgcaagaagaacctgctggaggagaactttgaggagcacagcatgagccctgagcgggagatgggaaatgaaaacatccccagcacagtgtccaccatcagcaggaacaacatcagagaaaatgtgttcaaggaggccagcagcagcaacatcaatgaggtgggcagcagcaccaatgaggtgggcagcagcatcaatgaaattggcagcagtgatgagaacatccaggccgagctgggcaggaacagaggccccaagctgaatgccatgctgcggctgggcgtgctgcagcctgaggtgtacaagcagagcctgcccggcagcaactgcaagcaccctgagatcaagaagcaggagtatgaggaggtggtgcagacagtgaacacagacttcagcccctacctgatcagtgacaacctggagcagcccatgggcagcagccacgccagccaggtgtgcagcgagaccccagatgacctgctggatgatggagagatcaaggaggacaccagctttgctgaaaatgacatcaaggagagcagcgctgtgttcagcaagtctgtgcagaagggggagctgagccgcagccccagccccttcacccacacccacctggcccagggctacagaagaggagccaagaagctggagagcagcgaggagaacctgagcagtgaagatgaggagctgccctgcttccagcacctgctgtttgggaaggtgaacaacatccccagccagagcaccaggcacagcacagtggccacagagtgcctgagcaagaacacagaggagaacctgctgagcctgaagaacagcctgaatgactgcagcaaccaggtgatcctggccaaggccagccaggagcaccacctgtctgaggagaccaagtgcagcgccagcctcttcagcagccagtgcagcgagctggaggacctgacagccaacaccaacacccaggaccccttcctgattggcagcagcaagcagatgaggcaccagagcgagagccagggcgtgggcctgagtgacaaggagctggtgtctgatgatgaggagcggggcaccggcctggaggagaacaaccaggaggagcagagcatggacagcaacctgggggaggccgccagcggctgtgagagcgagacctctgtgtctgaggactgcagcggcctgagcagccagagcgacatcctgaccacccagcagagggacaccatgcagcacaacctgatcaagctgcagcaggagatggccgagctggaggccgtgctggagcagcacggcagccagcccagcaacagctaccccagcatcatcagtgacagcagcgccctggaggacctgagaaatcctgagcagagcaccagcgagaaggctgtgctgaccagccagaagagcagcgagtaccccatcagccagaaccctgagggcctgtctgctgacaagtttgaggtgtctgctgacagcagcaccagcaagaacaaggagcccggggtggagaggagcagccccagcaagtgccccagcctggatgaccgctggtacatgcacagctgcagcggcagcctgcagaacagaaactaccccagccaggaggagctgatcaaggtggtggatgtggaggagcagcagctggaggagagcggcccccatgacctgacagagaccagctacctgccccggcaggacctggagggcaccccctacctggagagcggcatcagcctcttcagtgatgatcctgagagtgaccccagtgaagatcgggcccctgagagcgcccgggtgggcaacatccccagcagcaccagcgccctgaaggtgccccagctgaaggtggccgagagcgcccagagccctgctgctgcccacaccacagacacagctggctacaatgccatggaggagagcgtgtcccgggagaagccagagctgacagccagcacagagcgggtgaacaagaggatgtccatggtggtgtctggcctgaccccagaggagttcatgctggtgtacaagtttgccaggaagcaccacatcaccctgaccaacctgatcacagaggagaccacccacgtggtgatgaagacagatgctgagtttgtgtgtgagaggaccctgaagtacttcctgggcattgctgggggcaagtgggtggtgtcctacttctgggtgacccagagcatcaaggagaggaagatgctgaatgaacatgactttgaggtgagaggagatgtggtgaatggaagaaaccaccagggccccaagagggcccgggagagccaggacaggaagatcttccggggcctggagatctgctgctacggccccttcaccaacatgcccacagaccagctggagtggatggtgcagctgtgtggggcctctgtggtgaaggagctgagcagcttcaccctgggcaccggggtgcaccccatcgtggtggtgcagccagatgcctggacagaagataatggcttccacgccatcggccagatgtgtgaggcccctgtggtgacccgggagtgggtgctggacagcgtggccctgtaccagtgccaggagctggacacctacctgatcccccagatcccccacagccactactag

SEQ ID NO: 18592 - DNA, 4875 bp, Artificial Sequence
  Description of Artificial Sequence: Synthetic coding sequence
atggacctgagcgccctgcgggtggaggaggtgcagaatgtcatcaatgccatgcagaagatcctggagtgccccatctgcctggagctgatcaaggagcctgtgtccaccaagtgtgaccacatcttctgcaagttctgcatgctgaagctgctgaaccagaagaagggccccagccagtgccccctgtgcaagaatgacatcaccaagaggagcctgcaggagagcacccgcttcagccagctggtggaggagctgctgaagatcatctgtgccttccagctggacaccggcctggagtatgccaacagctacaactttgccaagaaggagaacaacagccctgagcacctgaaggatgaggtgtccatcatccagagcatgggctacagaaacagagccaagaggctgctgcagagcgagcctgagaaccccagcctgcaggagaccagcctgtctgtgcagctgagcaacctgggcaccgtgaggaccctgcggaccaagcagaggatccagccccagaagacctctgtgtacatcgagctgggcagtgacagcagcgaggacacagtgaacaaggccacctactgcagcgtgggggaccaggagctgctgcagatcaccccccagggcaccagagatgagatcagcctggacagcgccaagaaggccgcctgtgagttcagcgagacagatgtgaccaacacagagcaccaccagcccagcaacaatgacctgaacaccacagagaagagagctgctgagcggcaccctgagaagtaccagggcagctctgtgagcaacctgcacgtggagccctgtggcaccaacacccacgccagcagcctgcagcacgagaacagcagcctgctgctgaccaaggacaggatgaatgtggagaaggccgagttctgcaacaagagcaagcagcccggcctggcccggagccagcacaaccgctgggccggcagcaaggagacctgcaatgacaggaggacccccagcacagagaagaaggtggacctgaatgctgaccccctgtgtgagaggaaggagtggaacaagcagaagctgccctgcagcgagaacccccgggacacagaagatgtgccctggatcaccctgaacagcagcatccagaaggtgaatgagtggttcagcagaagtgatgagctgctgggcagtgatgacagccatgatggagagagcgagagcaatgccaaggtggctgatgtgctggatgtgctgaatgaggtggatgagtacagcggcagcagcgagaagattgacctgctggccagtgacccccatgaggccctgatctgcaagtctgagcgggtgcacagcaagtctgtggagagcaacatcgaggacaagatctttgggaagacctacaggaagaaggccagcctgcccaacctgagccacgtgacagaaaatctcatcattggagcctttgtgacagagccccagatcatccaggagcggcccctgaccaacaagctgaagaggaagaggcggcccaccagcggcctgcaccctgaggacttcatcaagaaggctgacctggccgtgcagaagaccccagagatgatcaaccagggcaccaaccagacagagcagaatggccaggtgatgaacatcaccaacagcggccacgagaacaagaccaagggggacagcatccagaatgagaagaaccccaaccccatcgagagcctggagaaggagagcgccttcaagaccaaggccgagcccatcagcagcagcatcagcaacatggagctggagctgaacatccacaacagcaaggcccccaagaagaaccggctgcggaggaagagcagcaccaggcacatccacgccctggagctggtggtgtccaggaacctgagcccccccaactgcacagagctgcagattgacagctgcagcagcagcgaggagatcaagaagaagaagtacaaccagatgcctgtgcgccacagcaggaacctgcagctgatggagggcaaggagcccgccaccggggccaagaagagcaacaagcccaatgagcagaccagcaagagacatgacagcgacaccttccctgagctgaagctgaccaatgcccctggcagcttcaccaagtgcagcaacaccagcgagctgaaggagtttgtgaaccccagcctgccccgggaggagaaggaggagaagctggagaccgtgaaggtgagcaacaatgctgaggaccccaaggacctgatgctgtctggagagcgggtgctgcagacagagaggtctgtggagagcagcagcatcagcctggtgcctggaacagattatggcacccaggagagcatcagcctgctggaggtgtccaccctgggcaaggccaagacagagcccaacaagtgtgtgtcccagtgtgccgcctttgagaaccccaagggcctcatccacggctgcagcaaggacaacagaaatgacacagagggcttcaagtaccccctgggccacgaggtgaaccacagccgggagaccagcattgagatggaggagagcgagctggatgcccagtacctgcagaacaccttcaaggtgtccaagaggcagagctttgcccccttcagcaaccctggaaatgctgaggaggagtgtgccaccttcagcgcccacagcggcagcctgaagaagcagagccccaaggtgacctttgaatgtgagcagaaggaggagaaccagggcaagaatgaaagcaacatcaagcctgtgcagacagtgaacatcacagctggcttccctgtggtgggccagaaggacaagcctgtggacaatgccaagtgcagcatcaagggcggcagccgcttctgcctgagcagccagttcagaggaaatgaaacaggcctcatcacccccaacaagcacggcctgctgcagaacccctaccgcatccccccactcttccccatcaagagctttgtgaagaccaagtgcaagaagaacctgctggaggagaactttgaggagcacagcatgagccctgagcgggagatgggaaatgaaaacatccccagcacagtgtccaccatcagcaggaacaacatcagagaaaatgtgttcaaggaggccagcagcagcaacatcaatgaggtgggcagcagcaccaatgaggtgggcagcagcatcaatgaaattggcagcagtgatgagaacatccaggccgagctgggcaggaacagaggccccaagctgaatgccatgctgcggctgggcgtgctgcagcctgaggtgtacaagcagagcctgcccggcagcaactgcaagcaccctgagatcaagaagcaggagtatgaggaggtggtgcagacagtgaacacagacttcagcccctacctgatcagtgacaacctggagcagcccatgggcagcagccacgccagccaggtgtgcagcgagaccccagatgacctgctggatgatggagagatcaaggaggacaccagctttgctgaaaatgacatcaaggagagcagcgctgtgttcagcaagtctgtgcagaagggggagctgagccgcagccccagccccttcacccacacccacctggcccagggctacagaagaggagccaagaagctggagagcagcgaggagaacctgagcagtgaagatgaggagctgccctgcttccagcacctgctgtttgggaaggtgaacaacatccccagccagagcaccaggcacagcacagtggccacagagtgcctgagcaagaacacagaggagaacctgctgagcctgaagaacagcctgaatgactgcagcaaccaggtgatcctggccaaggccagccaggagcaccacctgtctgaggagaccaagtgcagcgccagcctcttcagcagccagtgcagcgagctggaggacctgacagccaacaccaacacccaggaccccttcctgattggcagcagcaagcagatgaggcaccagagcgagagccagggcgtgggcctgagtgacaaggagctggtgtctgatgatgaggagcggggcaccggcctggaggagaacaaccaggaggagcagagcatggacagcaacctgggggaggccgccagcggctgtgagagcgagacctctgtgtctgaggactgcagcggcctgagcagccagagcgacatcctgaccacccagcagagggacaccatgcagcacaacctgatcaagctgcagcaggagatggccgagctggaggccgtgctggagcagcacggcagccagcccagcaacagctaccccagcatcatcagtgacagcagcgccctggaggacctgagaaatcctgagcagagcaccagcgagaaggatgctgagtttgtgtgtgagaggaccctgaagtacttcctgggcattgctgggggcaagtgggtggtgtcctacttctgggtgacccagagcatcaaggagaggaagatgctgaatgaacatgactttgaggtgagaggagatgtggtgaatggaagaaaccaccagggccccaagagggcccgggagagccaggacaggaagatcttccggggcctggagatctgctgctacggccccttcaccaacatgcccacagaccagctggagtggatggtgcagctgtgtggggcctctgtggtgaaggagctgagcagcttcaccctgggcactggagtgcaccccatcgtggtggtgcagccagatgcctggacagaggacaatggcttccacgccatcggccagatgtgtgaggcccctgtggtgacccgggagtgggtgctggacagcgtggccctgtaccagtgccaggagctggacacctacctgatcccccagatcccccacagccactactag

SEQ ID NO: 18593 - DNA, 2043 bp, Artificial Sequence
  Description of Artificial Sequence: Synthetic coding sequence
atggacctgagcgccctgcgggtggaggaggtgcagaatgtcatcaatgccatgcagaagatcctggagtgccccatctgcctggagctgatcaaggagcctgtgtccaccaagtgtgaccacatcttctgcaagttctgcatgctgaagctgctgaaccagaagaagggccccagccagtgccccctgtgcaagaatgacatcaccaagaggagcctgcaggagagcacccgcttcagccagctggtggaggagctgctgaagatcatctgtgccttccagctggacaccggcctggagtatgccaacagctacaactttgccaagaaggagaacaacagccctgagcacctgaaggatgaggtgtccatcatccagagcatgggctacagaaacagagccaagaggctgctgcagagcgagcctgagaaccccagcctgcaggagaccagcctgtctgtgcagctgagcaacctgggcaccgtgaggaccctgcggaccaagcagaggatccagccccagaagacctctgtgtacatcgagctgggggaggccgccagcggctgtgagagcgagacctctgtgtctgaggactgcagcggcctgagcagccagagcgacatcctgaccacccagcagagggacaccatgcagcacaacctgatcaagctgcagcaggagatggccgagctggaggccgtgctggagcagcacggcagccagcccagcaacagctaccccagcatcatcagtgacagcagcgccctggaggacctgaggaaccctgagcagagcaccagcgagaaggctgtgctgaccagccagaagagcagcgagtaccccatcagccagaaccctgagggcctgtctgctgacaagtttgaggtgtctgctgacagcagcaccagcaagaacaaggagcccggggtggagaggagcagccccagcaaatgtcccagcctggatgaccgctggtacatgcacagctgcagcggcagcctgcagaacagaaactaccccagccaggaggagctgatcaaggtggtggatgtggaggagcagcagctggaggagagcggcccccatgacctgacagagaccagctacctgccccggcaggacctggagggcaccccctacctggagagcggcatcagcctcttcagtgatgatcctgagagtgaccccagcgaggaccgggcccctgagagcgcccgggtgggcaacatccccagcagcaccagcgccctgaaggtgccccagctgaaggtggccgagagcgcccagagccctgctgctgcccacaccacagacacagctggctacaatgccatggaggagagcgtgtcccgggagaagccagagctgacagccagcacagagcgggtgaacaagaggatgtccatggtggtgtctggcctgaccccagaggagttcatgctggtgtacaagtttgccaggaagcaccacatcaccctgaccaacctgatcacagaggagaccacccacgtggtgatgaagacagatgctgagtttgtgtgtgagaggaccctgaagtacttcctgggcattgctgggggcaagtgggtggtgtcctacttctgggtgacccagagcatcaaggagaggaagatgctgaatgaacatgactttgaggtgagaggagatgtggtgaatggaagaaaccaccagggccccaagagggcccgggagagccaggacaggaagatcttccggggcctggagatctgctgctacggccccttcaccaacatgcccacagaccagctggagtggatggtgcagctgtgtggggcctctgtggtgaaggagctgagcagcttcaccctgggcactggagtgcaccccatcgtggtggtgcagccagatgcctggacagaggacaatggcttccacgccatcggccagatgtgtgaggcccctgtggtgacccgggagtgggtgctggacagcgtggccctgtaccagtgccaggagctggacacctacctgatcccccagatcccccacagccactactag

SEQ ID NO: 18594 - DNA, 2166 bp, Artificial Sequence
  Description of Artificial Sequence: Synthetic coding sequence
atggacctgagcgccctgcgggtggaggaggtgcagaatgtcatcaatgccatgcagaagatcctggagtgccccatctgcctggagctgatcaaggagcctgtgtccaccaagtgtgaccacatcttctgcaagttctgcatgctgaagctgctgaaccagaagaagggccccagccagtgccccctgtgcaagaatgacatcaccaagaggagcctgcaggagagcacccgcttcagccagctggtggaggagctgctgaagatcatctgtgccttccagctggacaccggcctggagtatgccaacagctacaactttgccaagaaggagaacaacagccctgagcacctgaaggatgaggtgtccatcatccagagcatgggctacagaaacagagccaagaggctgctgcagagcgagcctgagaaccccagcctgcaggagaccagcctgtctgtgcagctgagcaacctgggcaccgtgaggaccctgcggaccaagcagaggatccagccccagaagacctctgtgtacatcgagctgggcagtgacagcagcgaggacacagtgaacaaggccacctactgcagcgtgggggaccaggagctgctgcagatcaccccccagggcaccagagatgagatcagcctggacagcgccaagaagggggaggccgccagcggctgtgagagcgagacctctgtgtctgaggactgcagcggcctgagcagccagagcgacatcctgaccacccagcagagggacaccatgcagcacaacctgatcaagctgcagcaggagatggccgagctggaggccgtgctggagcagcacggcagccagcccagcaacagctaccccagcatcatcagtgacagcagcgccctggaggacctgagaaatcctgagcagagcaccagcgagaaggctgtgctgaccagccagaagagcagcgagtaccccatcagccagaaccctgagggcctgtctgctgacaagtttgaggtgtctgctgacagcagcaccagcaagaacaaggagcccggggtggagaggagcagccccagcaagtgccccagcctggatgaccgctggtacatgcacagctgcagcggcagcctgcagaacagaaactaccccagccaggaggagctgatcaaggtggtggatgtggaggagcagcagctggaggagagcggcccccatgacctgacagagaccagctacctgccccggcaggacctggagggcaccccctacctggagagcggcatcagcctcttcagtgatgatcctgagagtgaccccagtgaagatcgggcccctgagagcgcccgggtgggcaacatccccagcagcaccagcgccctgaaggtgccccagctgaaggtggccgagagcgcccagagccctgctgctgcccacaccacagacacagctggctacaatgccatggaggagagcgtgtcccgggagaagccagagctgacagccagcacagagcgggtgaacaagaggatgtccatggtggtgtctggcctgaccccagaggagttcatgctggtgtacaagtttgccaggaagcaccacatcaccctgaccaacctgatcacagaggagaccacccacgtggtgatgaagacagatgctgagtttgtgtgtgagaggaccctgaagtacttcctgggcattgctgggggcaagtgggtggtgtcctacttctgggtgacccagagcatcaaggagaggaagatgctgaatgaacatgactttgaggtgagaggagatgtggtgaatggaagaaaccaccagggccccaagagggcccgggagagccaggacaggaagatcttccggggcctggagatctgctgctacggccccttcaccaacatgcccacagaccagctggagtggatggtgcagctgtgtggggcctctgtggtgaaggagctgagcagcttcaccctgggcaccggggtgcaccccatcgtggtggtgcagccagatgcctggacagaagataatggcttccacgccatcggccagatgtgtgaggcccctgtggtgacccgggagtgggtgctggacagcgtggccctgtaccagtgccaggagctggacacctacctgatcccccagatcccccacagccactactag

SEQ ID NO: 18595 - DNA, 4797 bp, Artificial Sequence
  Description of Artificial Sequence: Synthetic coding sequence
atggacctgagcgccctgcgggtggaggaggtgcagaatgtcatcaatgccatgcagaagatcctggagtgccccatctgcctggagctgatcaaggagcctgtgtccaccaagtgtgaccacatcttctgcaagttctgcatgctgaagctgctgaaccagaagaagggccccagccagtgccccctgtgcaagaatgacatcaccaagaggagcctgcaggagagcacccgcttcagccagctggtggaggagctgctgaagatcatctgtgccttccagctggacaccggcctggagtatgccaacagctacaactttgccaagaaggagaacaacagccctgagcacctgaaggatgaggtgtccatcatccagagcatgggctacagaaacagagccaagaggctgctgcagagcgagcctgagaaccccagcctgcaggagaccagcctgtctgtgcagctgagcaacctgggcaccgtgaggaccctgcggaccaagcagaggatccagccccagaagacctctgtgtacatcgagctgggcagtgacagcagcgaggacacagtgaacaaggccacctactgcagcgtgggggaccaggagctgctgcagatcaccccccagggcaccagagatgagatcagcctggacagcgccaagaaggccgcctgtgagttcagcgagacagatgtgaccaacacagagcaccaccagcccagcaacaatgacctgaacaccacagagaagagagctgctgagcggcaccctgagaagtaccagggcagctctgtgagcaacctgcacgtggagccctgtggcaccaacacccacgccagcagcctgcagcacgagaacagcagcctgctgctgaccaaggacaggatgaatgtggagaaggccgagttctgcaacaagagcaagcagcccggcctggcccggagccagcacaaccgctgggccggcagcaaggagacctgcaatgacaggaggacccccagcacagagaagaaggtggacctgaatgctgaccccctgtgtgagaggaaggagtggaacaagcagaagctgccctgcagcgagaacccccgggacacagaagatgtgccctggatcaccctgaacagcagcatccagaaggtgaatgagtggttcagcagaagtgatgagctgctgggcagtgatgacagccatgatggagagagcgagagcaatgccaaggtggctgatgtgctggatgtgctgaatgaggtggatgagtacagcggcagcagcgagaagattgacctgctggccagtgacccccatgaggccctgatctgcaagtctgagcgggtgcacagcaagtctgtggagagcaacatcgaggacaagatctttgggaagacctacaggaagaaggccagcctgcccaacctgagccacgtgacagaaaatctcatcattggagcctttgtgacagagccccagatcatccaggagcggcccctgaccaacaagctgaagaggaagaggcggcccaccagcggcctgcaccctgaggacttcatcaagaaggctgacctggccgtgcagaagaccccagagatgatcaaccagggcaccaaccagacagagcagaatggccaggtgatgaacatcaccaacagcggccacgagaacaagaccaagggggacagcatccagaatgagaagaaccccaaccccatcgagagcctggagaaggagagcgccttcaagaccaaggccgagcccatcagcagcagcatcagcaacatggagctggagctgaacatccacaacagcaaggcccccaagaagaaccggctgcggaggaagagcagcaccaggcacatccacgccctggagctggtggtgtccaggaacctgagcccccccaactgcacagagctgcagattgacagctgcagcagcagcgaggagatcaagaagaagaagtacaaccagatgcctgtgcgccacagcaggaacctgcagctgatggagggcaaggagcccgccaccggggccaagaagagcaacaagcccaatgagcagaccagcaagagacatgacagcgacaccttccctgagctgaagctgaccaatgcccctggcagcttcaccaagtgcagcaacaccagcgagctgaaggagtttgtgaaccccagcctgccccgggaggagaaggaggagaagctggagaccgtgaaggtgagcaacaatgctgaggaccccaaggacctgatgctgtctggagagcgggtgctgcagacagagaggtctgtggagagcagcagcatcagcctggtgcctggaacagattatggcacccaggagagcatcagcctgctggaggtgtccaccctgggcaaggccaagacagagcccaacaagtgtgtgtcccagtgtgccgcctttgagaaccccaagggcctcatccacggctgcagcaaggacaacagaaatgacacagagggcttcaagtaccccctgggccacgaggtgaaccacagccgggagaccagcattgagatggaggagagcgagctggatgcccagtacctgcagaacaccttcaaggtgtccaagaggcagagctttgcccccttcagcaaccctggaaatgctgaggaggagtgtgccaccttcagcgcccacagcggcagcctgaagaagcagagccccaaggtgacctttgaatgtgagcagaaggaggagaaccagggcaagaatgaaagcaacatcaagcctgtgcagacagtgaacatcacagctggcttccctgtggtgggccagaaggacaagcctgtggacaatgccaagtgcagcatcaagggcggcagccgcttctgcctgagcagccagttcagaggaaatgaaacaggcctcatcacccccaacaagcacggcctgctgcagaacccctaccgcatccccccactcttccccatcaagagctttgtgaagaccaagtgcaagaagaacctgctggaggagaactttgaggagcacagcatgagccctgagcgggagatgggaaatgaaaacatccccagcacagtgtccaccatcagcaggaacaacatcagagaaaatgtgttcaaggaggccagcagcagcaacatcaatgaggtgggcagcagcaccaatgaggtgggcagcagcatcaatgaaattggcagcagtgatgagaacatccaggccgagctgggcaggaacagaggccccaagctgaatgccatgctgcggctgggcgtgctgcagcctgaggtgtacaagcagagcctgcccggcagcaactgcaagcaccctgagatcaagaagcaggagtatgaggaggtggtgcagacagtgaacacagacttcagcccctacctgatcagtgacaacctggagcagcccatgggcagcagccacgccagccaggtgtgcagcgagaccccagatgacctgctggatgatggagagatcaaggaggacaccagctttgctgaaaatgacatcaaggagagcagcgctgtgttcagcaagtctgtgcagaagggggagctgagccgcagccccagccccttcacccacacccacctggcccagggctacagaagaggagccaagaagctggagagcagcgaggagaacctgagcagtgaagatgaggagctgccctgcttccagcacctgctgtttgggaaggtgaacaacatccccagccagagcaccaggcacagcacagtggccacagagtgcctgagcaagaacacagaggagaacctgctgagcctgaagaacagcctgaatgactgcagcaaccaggtgatcctggccaaggccagccaggagcaccacctgtctgaggagaccaagtgcagcgccagcctcttcagcagccagtgcagcgagctggaggacctgacagccaacaccaacacccaggaccccttcctgattggcagcagcaagcagatgaggcaccagagcgagagccagggcgtgggcctgagtgacaaggagctggtgtctgatgatgaggagcggggcaccggcctggaggagaacaaccaggaggagcagagcatggacagcaacctgggggaggccgccagcggctgtgagagcgagacctctgtgtctgaggactgcagcggcctgagcagccagagcgacatcctgaccacccagcagagggacaccatgcagcacaacctgatcaagctgcagcaggagatggccgagctggaggccgtgctggagcagcacggcagccagcccagcaacagctaccccagcatcatcagtgacagcagcgccctggaggacctgagaaatcctgagcagagcaccagcgagaagggcgtgacccagagcatcaaggagaggaagatgctgaatgaacatgactttgaggtgagaggagatgtggtgaatggaagaaaccaccagggccccaagagggcccgggagagccaggacaggaagatcttccggggcctggagatctgctgctacggccccttcaccaacatgcccacagaccagctggagtggatggtgcagctgtgtggggcctctgtggtgaaggagctgagcagcttcaccctgggcactggagtgcaccccatcgtggtggtgcagccagatgcctggacagaggacaatggcttccacgccatcggccagatgtgtgaggcccctgtggtgacccgggagtgggtgctggacagcgtggccctgtaccagtgccaggagctggacacctacctgatcccccagatcccccacagccactactag

SEQ ID NO: 18596 - DNA, 5592 bp, Artificial Sequence
  Description of Artificial Sequence: Synthetic coding sequence
atggacctgagcgccctgcgggtggaggaggtgcagaatgtcatcaatgccatgcagaagatcctggagtgccccatctgcctggagctgatcaaggagcctgtgtccaccaagtgtgaccacatcttctgcaagttctgcatgctgaagctgctgaaccagaagaagggccccagccagtgccccctgtgcaagaatgacatcaccaagaggagcctgcaggagagcacccgcttcagccagctggtggaggagctgctgaagatcatctgtgccttccagctggacaccggcctggagtatgccaacagctacaactttgccaagaaggagaacaacagccctgagcacctgaaggatgaggtgtccatcatccagagcatgggctacagaaacagagccaagaggctgctgcagagcgagcctgagaaccccagcctgcaggagaccagcctgtctgtgcagctgagcaacctgggcaccgtgaggaccctgcggaccaagcagaggatccagccccagaagacctctgtgtacatcgagctgggcagtgacagcagcgaggacacagtgaacaaggccacctactgcagcgtgggggaccaggagctgctgcagatcaccccccagggcaccagagatgagatcagcctggacagcgccaagaaggccgcctgtgagttcagcgagacagatgtgaccaacacagagcaccaccagcccagcaacaatgacctgaacaccacagagaagagagctgctgagcggcaccctgagaagtaccagggcagctctgtgagcaacctgcacgtggagccctgtggcaccaacacccacgccagcagcctgcagcacgagaacagcagcctgctgctgaccaaggacaggatgaatgtggagaaggccgagttctgcaacaagagcaagcagcccggcctggcccggagccagcacaaccgctgggccggcagcaaggagacctgcaatgacaggaggacccccagcacagagaagaaggtggacctgaatgctgaccccctgtgtgagaggaaggagtggaacaagcagaagctgccctgcagcgagaacccccgggacacagaagatgtgccctggatcaccctgaacagcagcatccagaaggtgaatgagtggttcagcagaagtgatgagctgctgggcagtgatgacagccatgatggagagagcgagagcaatgccaaggtggctgatgtgctggatgtgctgaatgaggtggatgagtacagcggcagcagcgagaagattgacctgctggccagtgacccccatgaggccctgatctgcaagtctgagcgggtgcacagcaagtctgtggagagcaacatcgaggacaagatctttgggaagacctacaggaagaaggccagcctgcccaacctgagccacgtgacagaaaatctcatcattggagcctttgtgacagagccccagatcatccaggagcggcccctgaccaacaagctgaagaggaagaggcggcccaccagcggcctgcaccctgaggacttcatcaagaaggctgacctggccgtgcagaagaccccagagatgatcaaccagggcaccaaccagacagagcagaatggccaggtgatgaacatcaccaacagcggccacgagaacaagaccaagggggacagcatccagaatgagaagaaccccaaccccatcgagagcctggagaaggagagcgccttcaagaccaaggccgagcccatcagcagcagcatcagcaacatggagctggagctgaacatccacaacagcaaggcccccaagaagaaccggctgcggaggaagagcagcaccaggcacatccacgccctggagctggtggtgtccaggaacctgagcccccccaactgcacagagctgcagattgacagctgcagcagcagcgaggagatcaagaagaagaagtacaaccagatgcctgtgcgccacagcaggaacctgcagctgatggagggcaaggagcccgccaccggggccaagaagagcaacaagcccaatgagcagaccagcaagagacatgacagcgacaccttccctgagctgaagctgaccaatgcccctggcagcttcaccaagtgcagcaacaccagcgagctgaaggagtttgtgaaccccagcctgccccgggaggagaaggaggagaagctggagaccgtgaaggtgagcaacaatgctgaggaccccaaggacctgatgctgtctggagagcgggtgctgcagacagagaggtctgtggagagcagcagcatcagcctggtgcctggaacagattatggcacccaggagagcatcagcctgctggaggtgtccaccctgggcaaggccaagacagagcccaacaagtgtgtgtcccagtgtgccgcctttgagaaccccaagggcctcatccacggctgcagcaaggacaacagaaatgacacagagggcttcaagtaccccctgggccacgaggtgaaccacagccgggagaccagcattgagatggaggagagcgagctggatgcccagtacctgcagaacaccttcaaggtgtccaagaggcagagctttgcccccttcagcaaccctggaaatgctgaggaggagtgtgccaccttcagcgcccacagcggcagcctgaagaagcagagccccaaggtgacctttgaatgtgagcagaaggaggagaaccagggcaagaatgaaagcaacatcaagcctgtgcagacagtgaacatcacagctggcttccctgtggtgggccagaaggacaagcctgtggacaatgccaagtgcagcatcaagggcggcagccgcttctgcctgagcagccagttcagaggaaatgaaacaggcctcatcacccccaacaagcacggcctgctgcagaacccctaccgcatccccccactcttccccatcaagagctttgtgaagaccaagtgcaagaagaacctgctggaggagaactttgaggagcacagcatgagccctgagcgggagatgggaaatgaaaacatccccagcacagtgtccaccatcagcaggaacaacatcagagaaaatgtgttcaaggaggccagcagcagcaacatcaatgaggtgggcagcagcaccaatgaggtgggcagcagcatcaatgaaattggcagcagtgatgagaacatccaggccgagctgggcaggaacagaggccccaagctgaatgccatgctgcggctgggcgtgctgcagcctgaggtgtacaagcagagcctgcccggcagcaactgcaagcaccctgagatcaagaagcaggagtatgaggaggtggtgcagacagtgaacacagacttcagcccctacctgatcagtgacaacctggagcagcccatgggcagcagccacgccagccaggtgtgcagcgagaccccagatgacctgctggatgatggagagatcaaggaggacaccagctttgctgaaaatgacatcaaggagagcagcgctgtgttcagcaagtctgtgcagaagggggagctgagccgcagccccagccccttcacccacacccacctggcccagggctacagaagaggagccaagaagctggagagcagcgaggagaacctgagcagtgaagatgaggagctgccctgcttccagcacctgctgtttgggaaggtgaacaacatccccagccagagcaccaggcacagcacagtggccacagagtgcctgagcaagaacacagaggagaacctgctgagcctgaagaacagcctgaatgactgcagcaaccaggtgatcctggccaaggccagccaggagcaccacctgtctgaggagaccaagtgcagcgccagcctcttcagcagccagtgcagcgagctggaggacctgacagccaacaccaacacccaggaccccttcctgattggcagcagcaagcagatgaggcaccagagcgagagccagggcgtgggcctgagtgacaaggagctggtgtctgatgatgaggagcggggcaccggcctggaggagaacaaccaggaggagcagagcatggacagcaacctgggggaggccgccagcggctgtgagagcgagacctctgtgtctgaggactgcagcggcctgagcagccagagcgacatcctgaccacccagcagagggacaccatgcagcacaacctgatcaagctgcagcaggagatggccgagctggaggccgtgctggagcagcacggcagccagcccagcaacagctaccccagcatcatcagtgacagcagcgccctggaggacctgagaaatcctgagcagagcaccagcgagaaggctgtgctgaccagccagaagagcagcgagtaccccatcagccagaaccctgagggcctgtctgctgacaagtttgaggtgtctgctgacagcagcaccagcaagaacaaggagcccggggtggagaggagcagccccagcaagtgccccagcctggatgaccgctggtacatgcacagctgcagcggcagcctgcagaacagaaactaccccagccaggaggagctgatcaaggtggtggatgtggaggagcagcagctggaggagagcggcccccatgacctgacagagaccagctacctgccccggcaggacctggagggcaccccctacctggagagcggcatcagcctcttcagtgatgatcctgagagtgaccccagtgaagatcgggcccctgagagcgcccgggtgggcaacatccccagcagcaccagcgccctgaaggtgccccagctgaaggtggccgagagcgcccagagccctgctgctgcccacaccacagacacagctggctacaatgccatggaggagagcgtgtcccgggagaagccagagctgacagccagcacagagcgggtgaacaagaggatgtccatggtggtgtctggcctgaccccagaggagttcatgctggtgtacaagtttgccaggaagcaccacatcaccctgaccaacctgatcacagaggagaccacccacgtggtgatgaagacagatgctgagtttgtgtgtgagaggaccctgaagtacttcctgggcattgctgggggcaagtgggtggtgtcctacttctgggtgacccagagcatcaaggagaggaagatgctgaatgaacatgactttgaggtgagaggagatgtggtgaatggaagaaaccaccagggccccaagagggcccgggagagccaggacaggaagatcttccggggcctggagatctgctgctacggccccttcaccaacatgcccacagaccagctggagtggatggtgcagctgtgtggggcctctgtggtgaaggagctgagcagcttcaccctgggcaccggggtgcaccccatcgtggtggtgcagccagatgcctggacagaagataatggcttccacgccatcggccagatgtgtgaggcccctgtggtgacccgggagtgggtgctggacagcgtggccctgtaccagtgccaggagctggacacctacctgatcccccagatcccccacagccactactag

SEQ ID NO: 18597 - DNA, 2139 bp, Artificial Sequence
  Description of Artificial Sequence: Synthetic coding sequence
atgctgaagctgctgaaccagaagaagggccccagccagtgccccctgtgcaagaatgacatcaccaagaggagcctgcaggagagcacccgcttcagccagctggtggaggagctgctgaagatcatctgtgccttccagctggacaccggcctggagtatgccaacagctacaactttgccaagaaggagaacaacagccctgagcacctgaaggatgaggtgtccatcatccagagcatgggctacagaaacagagccaagaggctgctgcagagcgagcctgagaaccccagcctgcaggagaccagcctgtctgtgcagctgagcaacctgggcaccgtgaggaccctgcggaccaagcagaggatccagccccagaagacctctgtgtacatcgagctgggcagtgacagcagtgaagatactgtgaacaaggccacctactgcagcgtgggggaccaggagctgctgcagatcaccccccagggcaccagagatgagatcagcctggacagcgccaagaaggccgcctgtgagttcagcgagacagatgtgaccaacacagagcaccaccagcccagcaacaatgacctgaacaccacagagaagagagctgctgagcggcaccctgagaagtaccagggcgaggccgccagcggctgtgagagcgagacctctgtgtctgaggactgcagcggcctgagcagccagagcgacatcctgaccacccagcagagggacaccatgcagcacaacctgatcaagctgcagcaggagatggccgagctggaggccgtgctggagcagcacggcagccagcccagcaacagctaccccagcatcatcagtgacagcagcgccctggaggacctgagaaatcctgagcagagcaccagcgagaaggtgctgaccagccagaagagcagcgagtaccccatcagccagaaccctgagggcctgtctgctgacaagtttgaggtgtctgctgacagcagcaccagcaagaacaaggagcccggggtggagaggagcagccccagcaaatgtcccagcctggatgaccgctggtacatgcacagctgcagcggcagcctgcagaacagaaactaccccagccaggaggagctgatcaaggtggtggatgtggaggagcagcagctggaggagagcggcccccatgacctgacagagaccagctacctgccccggcaggacctggagggcaccccctacctggagagcggcatcagcctcttcagtgatgatcctgagagtgaccccagcgaggaccgggcccctgagagcgcccgggtgggcaacatccccagcagcaccagcgccctgaaggtgccccagctgaaggtggccgagagcgcccagagccctgctgctgcccacaccacagacacagctggctacaatgccatggaggagagcgtgtcccgggagaagccagagctgacagccagcacagagcgggtgaacaagaggatgtccatggtggtgtctggcctgaccccagaggagttcatgctggtgtacaagtttgccaggaagcaccacatcaccctgaccaacctgatcacagaggagaccacccacgtggtgatgaagacagatgctgagtttgtgtgtgagaggaccctgaagtacttcctgggcattgctgggggcaagtgggtggtgtcctacttctgggtgacccagagcatcaaggagaggaagatgctgaatgaacatgactttgaggtgagaggagatgtggtgaatggaagaaaccaccagggccccaagagggcccgggagagccaggacaggaagatcttccggggcctggagatctgctgctacggccccttcaccaacatgcccacagaccagctggagtggatggtgcagctgtgtggggcctctgtggtgaaggagctgagcagcttcaccctgggcactggagtgcaccccatcgtggtggtgcagccagatgcctggacagaggacaatggcttccacgccatcggccagatgtgtgaggcccctgtggtgacccgggagtgggtgctggacagcgtggccctgtaccagtgccaggagctggacacctacctgatcccccagatcccccacagccactactag

SEQ ID NO: 18598 - DNA, 5655 bp, Artificial Sequence
  Description of Artificial Sequence: Synthetic coding sequence
atggacctgagcgccctgcgggtggaggaggtgcagaatgtcatcaatgccatgcagaagatcctggagtgccccatctgcctggagctgatcaaggagcctgtgtccaccaagtgtgaccacatcttctgcaagttctgcatgctgaagctgctgaaccagaagaagggccccagccagtgccccctgtgcaagaatgacatcaccaagaggagcctgcaggagagcacccgcttcagccagctggtggaggagctgctgaagatcatctgtgccttccagctggacaccggcctggagtatgccaacagctacaactttgccaagaaggagaacaacagccctgagcacctgaaggatgaggtgtccatcatccagagcatgggctacagaaacagagccaagaggctgctgcagagcgagcctgagaaccccagcctgcaggagaccagcctgtctgtgcagctgagcaacctgggcaccgtgaggaccctgcggaccaagcagaggatccagccccagaagacctctgtgtacatcgagctgggcagtgacagcagcgaggacacagtgaacaaggccacctactgcagcgtgggggaccaggagctgctgcagatcaccccccagggcaccagagatgagatcagcctggacagcgccaagaaggccgcctgtgagttcagcgagacagatgtgaccaacacagagcaccaccagcccagcaacaatgacctgaacaccacagagaagagagctgctgagcggcaccctgagaagtaccagggcagctctgtgagcaacctgcacgtggagccctgtggcaccaacacccacgccagcagcctgcagcacgagaacagcagcctgctgctgaccaaggacaggatgaatgtggagaaggccgagttctgcaacaagagcaagcagcccggcctggcccggagccagcacaaccgctgggccggcagcaaggagacctgcaatgacaggaggacccccagcacagagaagaaggtggacctgaatgctgaccccctgtgtgagaggaaggagtggaacaagcagaagctgccctgcagcgagaacccccgggacacagaagatgtgccctggatcaccctgaacagcagcatccagaaggtgaatgagtggttcagcagaagtgatgagctgctgggcagtgatgacagccatgatggagagagcgagagcaatgccaaggtggctgatgtgctggatgtgctgaatgaggtggatgagtacagcggcagcagcgagaagattgacctgctggccagtgacccccatgaggccctgatctgcaagtctgagcgggtgcacagcaagtctgtggagagcaacatcgaggacaagatctttgggaagacctacaggaagaaggccagcctgcccaacctgagccacgtgacagaaaatctcatcattggagcctttgtgacagagccccagatcatccaggagcggcccctgaccaacaagctgaagaggaagaggcggcccaccagcggcctgcaccctgaggacttcatcaagaaggctgacctggccgtgcagaagaccccagagatgatcaaccagggcaccaaccagacagagcagaatggccaggtgatgaacatcaccaacagcggccacgagaacaagaccaagggggacagcatccagaatgagaagaaccccaaccccatcgagagcctggagaaggagagcgccttcaagaccaaggccgagcccatcagcagcagcatcagcaacatggagctggagctgaacatccacaacagcaaggcccccaagaagaaccggctgcggaggaagagcagcaccaggcacatccacgccctggagctggtggtgtccaggaacctgagcccccccaactgcacagagctgcagattgacagctgcagcagcagcgaggagatcaagaagaagaagtacaaccagatgcctgtgcgccacagcaggaacctgcagctgatggagggcaaggagcccgccaccggggccaagaagagcaacaagcccaatgagcagaccagcaagagacatgacagcgacaccttccctgagctgaagctgaccaatgcccctggcagcttcaccaagtgcagcaacaccagcgagctgaaggagtttgtgaaccccagcctgccccgggaggagaaggaggagaagctggagaccgtgaaggtgagcaacaatgctgaggaccccaaggacctgatgctgtctggagagcgggtgctgcagacagagaggtctgtggagagcagcagcatcagcctggtgcctggaacagattatggcacccaggagagcatcagcctgctggaggtgtccaccctgggcaaggccaagacagagcccaacaagtgtgtgtcccagtgtgccgcctttgagaaccccaagggcctcatccacggctgcagcaaggacaacagaaatgacacagagggcttcaagtaccccctgggccacgaggtgaaccacagccgggagaccagcattgagatggaggagagcgagctggatgcccagtacctgcagaacaccttcaaggtgtccaagaggcagagctttgcccccttcagcaaccctggaaatgctgaggaggagtgtgccaccttcagcgcccacagcggcagcctgaagaagcagagccccaaggtgacctttgaatgtgagcagaaggaggagaaccagggcaagaatgaaagcaacatcaagcctgtgcagacagtgaacatcacagctggcttccctgtggtgggccagaaggacaagcctgtggacaatgccaagtgcagcatcaagggcggcagccgcttctgcctgagcagccagttcagaggaaatgaaacaggcctcatcacccccaacaagcacggcctgctgcagaacccctaccgcatccccccactcttccccatcaagagctttgtgaagaccaagtgcaagaagaacctgctggaggagaactttgaggagcacagcatgagccctgagcgggagatgggaaatgaaaacatccccagcacagtgtccaccatcagcaggaacaacatcagagaaaatgtgttcaaggaggccagcagcagcaacatcaatgaggtgggcagcagcaccaatgaggtgggcagcagcatcaatgaaattggcagcagtgatgagaacatccaggccgagctgggcaggaacagaggccccaagctgaatgccatgctgcggctgggcgtgctgcagcctgaggtgtacaagcagagcctgcccggcagcaactgcaagcaccctgagatcaagaagcaggagtatgaggaggtggtgcagacagtgaacacagacttcagcccctacctgatcagtgacaacctggagcagcccatgggcagcagccacgccagccaggtgtgcagcgagaccccagatgacctgctggatgatggagagatcaaggaggacaccagctttgctgaaaatgacatcaaggagagcagcgctgtgttcagcaagtctgtgcagaagggggagctgagccgcagccccagccccttcacccacacccacctggcccagggctacagaagaggagccaagaagctggagagcagcgaggagaacctgagcagtgaagatgaggagctgccctgcttccagcacctgctgtttgggaaggtgaacaacatccccagccagagcaccaggcacagcacagtggccacagagtgcctgagcaagaacacagaggagaacctgctgagcctgaagaacagcctgaatgactgcagcaaccaggtgatcctggccaaggccagccaggagcaccacctgtctgaggagaccaagtgcagcgccagcctcttcagcagccagtgcagcgagctggaggacctgacagccaacaccaacacccaggaccccttcctgattggcagcagcaagcagatgaggcaccagagcgagagccagggcgtgggcctgagtgacaaggagctggtgtctgatgatgaggagcggggcaccggcctggaggagaacaaccaggaggagcagagcatggacagcaacctgggggaggccgccagcggctgtgagagcgagacctctgtgtctgaggactgcagcggcctgagcagccagagcgacatcctgaccacccagcagagggacaccatgcagcacaacctgatcaagctgcagcaggagatggccgagctggaggccgtgctggagcagcacggcagccagcccagcaacagctaccccagcatcatcagtgacagcagcgccctggaggacctgagaaatcctgagcagagcaccagcgagaaggacagccacatccacggccagaggaacaacagcatgttcagcaagaggccccgggagcacatctctgtgctgaccagccagaagagcagcgagtaccccatcagccagaaccctgagggcctgtctgctgacaagtttgaggtgtctgctgacagcagcaccagcaagaacaaggagcccggggtggagaggagcagccccagcaaatgtcccagcctggatgaccgctggtacatgcacagctgcagcggcagcctgcagaacagaaactaccccagccaggaggagctgatcaaggtggtggatgtggaggagcagcagctggaggagagcggcccccatgacctgacagagaccagctacctgccccggcaggacctggagggcaccccctacctggagagcggcatcagcctcttcagtgatgatcctgagagtgaccccagcgaggaccgggcccctgagagcgcccgggtgggcaacatccccagcagcaccagcgccctgaaggtgccccagctgaaggtggccgagagcgcccagagccctgctgctgcccacaccacagacacagctggctacaatgccatggaggagagcgtgtcccgggagaagccagagctgacagccagcacagagcgggtgaacaagaggatgtccatggtggtgtctggcctgaccccagaggagttcatgctggtgtacaagtttgccaggaagcaccacatcaccctgaccaacctgatcacagaggagaccacccacgtggtgatgaagacagatgctgagtttgtgtgtgagaggaccctgaagtacttcctgggcattgctgggggcaagtgggtggtgtcctacttctgggtgacccagagcatcaaggagaggaagatgctgaatgaacatgactttgaggtgagaggagatgtggtgaatggaagaaaccaccagggccccaagagggcccgggagagccaggacaggaagatcttccggggcctggagatctgctgctacggccccttcaccaacatgcccacagaccagctggagtggatggtgcagctgtgtggggcctctgtggtgaaggagctgagcagcttcaccctgggcactggagtgcaccccatcgtggtggtgcagccagatgcctggacagaggacaatggcttccacgccatcggccagatgtgtgaggcccctgtggtgacccgggagtgggtgctggacagcgtggccctgtaccagtgccaggagctggacacctacctgatcccccagatcccccacagccactactag

SEQ ID NO: 18599 - DNA, 192 bp, Artificial Sequence
  Description of Artificial Sequence: Synthetic coding sequence
atggacctgagcgccctgcgggtggaggaggtgcagaatgtcatcaatgccatgcagaagatcctggagtgccccatctgcctggagctgatcaaggagcctgtgtccaccaagtgtgaccacatcttctgcaagttctgcatgctgaagctgctgaaccagaagaagggccccagccagtgccccctgtag

SEQ ID NO: 18600 - DNA, 192 bp, Artificial Sequence; identical to SEQ ID NO: 18599
  Description of Artificial Sequence: Synthetic coding sequence

SEQ ID NO: 18601 - DNA, 2100 bp, Artificial Sequence
  Description of Artificial Sequence: Synthetic coding sequence
atggacctgagcgccctgcgggtggaggaggtgcagaatgtcatcaatgccatgcagaagatcctggagtgccccatctgcctggagctgatcaaggagcctgtgtccaccaagtgtgaccacatcttctgcaagttctgcatgctgaagctgctgaaccagaagaagggccccagccagtgccccctgtgcaagaatgacatcaccaagaggagcctgcaggagagcacccgcttcagccagctggtggaggagctgctgaagatcatctgtgccttccagctggacaccggcctggagtatgccaacagctacaactttgccaagaaggagaacaacagccctgagcacctgaaggatgaggtgtccatcatccagagcatgggctacagaaacagagccaagaggctgctgcagagcgagcctgagaaccccagcctgcaggagaccagcctgtctgtgcagctgagcaacctgggcaccgtgaggaccctgcggaccaagcagaggatccagccccagaagacctctgtgtacatcgagctgggcagtgacagcagcgaggacacagtgaacaaggccacctactgcagcgtgggggaccaggagctgctgcagatcaccccccagggcaccagagatgagatcagcctggacagcgccaagaaggccgcctgtgagttcagcgagacagatgtgaccaacacagagcaccaccagcccagcaacaatgacctgaacaccacagagaagagagctgctgagcggcaccctgagaagtaccagggcgaggccgccagcggctgtgagagcgagacctctgtgtctgaggactgcagcggcctgagcagccagagcgacatcctgaccacccagcagagggacaccatgcagcacaacctgatcaagctgcagcaggagatggccgagctggaggccgtgctggagcagcacggcagccagcccagcaacagctaccccagcatcatcagtgacagcagcgccctggaggacctgaggaaccctgagcagagcaccagcgagaaggtgctgaccagccagaagagcagcgagtaccccatcagccagaaccctgagggcctgtctgctgacaagtttgaggtgtctgctgacagcagcaccagcaagaacaaggagcccggggtggagaggagcagccccagcaagtgccccagcctggatgaccgctggtacatgcacagctgcagcggcagcctgcagaacagaaactaccccagccaggaggagctgatcaaggtggtggatgtggaggagcagcagctggaggagagcggcccccatgacctgacagagaccagctacctgccccggcaggacctggagggcaccccctacctggagagcggcatcagcctcttcagtgatgatcctgagagtgaccccagtgaagatcgggcccctgagagcgcccgggtgggcaacatccccagcagcaccagcgccctgaaggtgccccagctgaaggtggccgagagcgcccagagccctgctgctgcccacaccacagacacagctggctacaatgccatggaggagagcgtgtcccgggagaagccagagctgacagccagcacagagcgggtgaacaagaggatgtccatggtggtgtctggcctgaccccagaggagttcatgctggtgtacaagtttgccaggaagcaccacatcaccctgaccaacctgatcacagaggagaccacccacgtggtgatgaagacagatgctgagtttgtgtgtgagaggaccctgaagtacttcctgggcattgctgggggcaagtgggtggtgtcctacttctgggtgacccagagcatcaaggagaggaagatgctgaatgaacatgactttgaggtgagaggagatgtggtgaatggaagaaaccaccagggccccaagagggcccgggagagccaggacaggaagatcttccggggcctggagatctgctgctacggccccttcaccaacatgcccaccggctgcccccccaactgtggctgtgccgcccgctgcctggaccggggccagtggctgccctgcaactgggcagatgtgtag

SEQ ID NO: 18602 - DNA, 1950 bp, Artificial Sequence
  Description of Artificial Sequence: Synthetic coding sequence
atggacctgagcgccctgcgggtggaggaggtgcagaatgtcatcaatgccatgcagaagatcctggagtgccccatctgcctggagctgatcaaggagcctgtgtccaccaagtgtgaccacatcttctgcaagttctgcatgctgaagctgctgaaccagaagaagggccccagccagtgccccctgtgcaagaatgacatcaccaagaggagcctgcaggagagcacccgcttcagccagctggtggaggagctgctgaagatcatctgtgccttccagctggacaccggcctggagtatgccaacagctacaactttgccaagaaggagaacaacagccctgagcacctgaaggatgaggtgtccatcatccagagcatgggctacagaaacagagccaagaggctgctgcagagcgagcctgagaaccccagcctgcaggagaccagcctgtctgtgcagctgagcaacctgggcaccgtgaggaccctgcggaccaagcagaggatccagccccagaagacctctgtgtacatcgagctgggcagtgacagcagcgaggacacagtgaacaaggccacctactgcagcgtgggggaccaggagctgctgcagatcaccccccagggcaccagagatgagatcagcctggacagcgccaagaaggccgcctgtgagttcagcgagacagatgtgaccaacacagagcaccaccagcccagcaacaatgacctgaacaccacagagaagagagctgctgagcggcaccctgagaagtaccagggcagctctgtgagcaacctgcacgtggagccctgtggcaccaacacccacgccagcagcctgcagcacgagaacagcagcctgctgctgaccaaggacaggatgaatgtggagaaggccgagttctgcaacaagagcaagcagcccggcctggcccggagccagcacaaccgctgggccggcagcaaggagacctgcaatgacaggaggacccccagcacagagaagaaggtggacctgaatgctgaccccctgtgtgagaggaaggagtggaacaagcagaagctgccctgcagcgagaacccccgggacacagaagatgtgccctggatcaccctgaacagcagcatccagaaggtgaatgagtggttcagcagaagtgatgagctgctgggcagtgatgacagccatgatggagagagcgagagcaatgccaaggtggctgatgtgctggatgtgctgaatgaggtggatgagtacagcggcagcagcgagaagattgacctgctggccagtgacccccatgaggccctgatctgcaagtctgagcgggtgcacagcaagtctgtggagagcaacatcgaggacaagatctttgggaagacctacaggaagaaggccagcctgcccaacctgagccacgtgacagaaaatctcatcattggagcctttgtgacagagccccagatcatccaggagcggcccctgaccaacaagctgaagaggaagaggcggcccaccagcggcctgcaccctgaggacttcatcaagaaggctgacctggccgtgcagaagaccccagagatgatcaaccagggcaccaaccagacagagcagaatggccaggtgatgaacatcaccaacagcggccacgagaacaagaccaagggggacagcatccagaatgagaagaaccccaaccccatcgagagcctggagaaggagagcgccttcaagaccaaggccgagcccatcagcagcagcatcagcaacatggagctggagctgaacatccacaacagcaaggcccccaagaagaaccggctgcggaggaagagcagcaccaggcacatccacgccctggagctggtggtgtccaggaacctgagcccccccaactgcacagagctgcagattgacagctgcagcagcagcgaggagtag

SEQ ID NO: 18603 - DNA, 5658 bp, Artificial Sequence
  Description of Artificial Sequence: Synthetic coding sequence
atggacctgagcgccctgcgggtggaggaggtgcagaatgtcatcaatgccatgcagaagatcctggagtgccccatctgcctggagctgatcaaggagcctgtgtccaccaagtgtgaccacatcttctgcaagttctgcatgctgaagctgctgaaccagaagaagggccccagccagtgccccctgtgcaagaatgacatcaccaagaggagcctgcaggagagcacccgcttcagccagctggtggaggagctgctgaagatcatctgtgccttccagctggacaccggcctggagtatgccaacagctacaactttgccaagaaggagaacaacagccctgagcacctgaaggatgaggtgtccatcatccagagcatgggctacagaaacagagccaagaggctgctgcagagcgagcctgagaaccccagcctgcaggagaccagcctgtctgtgcagctgagcaacctgggcaccgtgaggaccctgcggaccaagcagaggatccagccccagaagacctctgtgtacatcgagctgggcagtgacagcagcgaggacacagtgaacaaggccacctactgcagcgtgggggaccaggagctgctgcagatcaccccccagggcaccagagatgagatcagcctggacagcgccaagaaggccgcctgtgagttcagcgagacagatgtgaccaacacagagcaccaccagcccagcaacaatgacctgaacaccacagagaagagagctgctgagcggcaccctgagaagtaccagggcagctctgtgagcaacctgcacgtggagccctgtggcaccaacacccacgccagcagcctgcagcacgagaacagcagcctgctgctgaccaaggacaggatgaatgtggagaaggccgagttctgcaacaagagcaagcagcccggcctggcccggagccagcacaaccgctgggccggcagcaaggagacctgcaatgacaggaggacccccagcacagagaagaaggtggacctgaatgctgaccccctgtgtgagaggaaggagtggaacaagcagaagctgccctgcagcgagaacccccgggacacagaagatgtgccctggatcaccctgaacagcagcatccagaaggtgaatgagtggttcagcagaagtgatgagctgctgggcagtgatgacagccatgatggagagagcgagagcaatgccaaggtggctgatgtgctggatgtgctgaatgaggtggatgagtacagcggcagcagcgagaagattgacctgctggccagtgacccccatgaggccctgatctgcaagtctgagcgggtgcacagcaagtctgtggagagcaacatcgaggacaagatctttgggaagacctacaggaagaaggccagcctgcccaacctgagccacgtgacagaaaatctcatcattggagcctttgtgacagagccccagatcatccaggagcggcccctgaccaacaagctgaagaggaagaggcggcccaccagcggcctgcaccctgaggacttcatcaagaaggctgacctggccgtgcagaagaccccagagatgatcaaccagggcaccaaccagacagagcagaatggccaggtgatgaacatcaccaacagcggccacgagaacaagaccaagggggacagcatccagaatgagaagaaccccaaccccatcgagagcctggagaaggagagcgccttcaagaccaaggccgagcccatcagcagcagcatcagcaacatggagctggagctgaacatccacaacagcaaggcccccaagaagaaccggctgcggaggaagagcagcaccaggcacatccacgccctggagctggtggtgtccaggaacctgagcccccccaactgcacagagctgcagattgacagctgcagcagcagcgaggagatcaagaagaagaagtacaaccagatgcctgtgcgccacagcaggaacctgcagctgatggagggcaaggagcccgccaccggggccaagaagagcaacaagcccaatgagcagaccagcaagagacatgacagcgacaccttccctgagctgaagctgaccaatgcccctggcagcttcaccaagtgcagcaacaccagcgagctgaaggagtttgtgaaccccagcctgccccgggaggagaaggaggagaagctggagaccgtgaaggtgagcaacaatgctgaggaccccaaggacctgatgctgtctggagagcgggtgctgcagacagagaggtctgtggagagcagcagcatcagcctggtgcctggaacagattatggcacccaggagagcatcagcctgctggaggtgtccaccctgggcaaggccaagacagagcccaacaagtgtgtgtcccagtgtgccgcctttgagaaccccaagggcctcatccacggctgcagcaaggacaacagaaatgacacagagggcttcaagtaccccctgggccacgaggtgaaccacagccgggagaccagcattgagatggaggagagcgagctggatgcccagtacctgcagaacaccttcaaggtgtccaagaggcagagctttgcccccttcagcaaccctggaaatgctgaggaggagtgtgccaccttcagcgcccacagcggcagcctgaagaagcagagccccaaggtgacctttgaatgtgagcagaaggaggagaaccagggcaagaatgaaagcaacatcaagcctgtgcagacagtgaacatcacagctggcttccctgtggtgggccagaaggacaagcctgtggacaatgccaagtgcagcatcaagggcggcagccgcttctgcctgagcagccagttcagaggaaatgaaacaggcctcatcacccccaacaagcacggcctgctgcagaacccctaccgcatccccccactcttccccatcaagagctttgtgaagaccaagtgcaagaagaacctgctggaggagaactttgaggagcacagcatgagccctgagcgggagatgggaaatgaaaacatccccagcacagtgtccaccatcagcaggaacaacatcagagaaaatgtgttcaaggaggccagcagcagcaacatcaatgaggtgggcagcagcaccaatgaggtgggcagcagcatcaatgaaattggcagcagtgatgagaacatccaggccgagctgggcaggaacagaggccccaagctgaatgccatgctgcggctgggcgtgctgcagcctgaggtgtacaagcagagcctgcccggcagcaactgcaagcaccctgagatcaagaagcaggagtatgaggaggtggtgcagacagtgaacacagacttcagcccctacctgatcagtgacaacctggagcagcccatgggcagcagccacgccagccaggtgtgcagcgagaccccagatgacctgctggatgatggagagatcaaggaggacaccagctttgctgaaaatgacatcaaggagagcagcgctgtgttcagcaagtctgtgcagaagggggagctgagccgcagccccagccccttcacccacacccacctggcccagggctacagaagaggagccaagaagctggagagcagcgaggagaacctgagcagtgaagatgaggagctgccctgcttccagcacctgctgtttgggaaggtgaacaacatccccagccagagcaccaggcacagcacagtggccacagagtgcctgagcaagaacacagaggagaacctgctgagcctgaagaacagcctgaatgactgcagcaaccaggtgatcctggccaaggccagccaggagcaccacctgtctgaggagaccaagtgcagcgccagcctcttcagcagccagtgcagcgagctggaggacctgacagccaacaccaacacccaggaccccttcctgattggcagcagcaagcagatgaggcaccagagcgagagccagggcgtgggcctgagtgacaaggagctggtgtctgatgatgaggagcggggcaccggcctggaggagaacaaccaggaggagcagagcatggacagcaacctgggggaggccgccagcggctgtgagagcgagacctctgtgtctgaggactgcagcggcctgagcagccagagcgacatcctgaccacccagcagagggacaccatgcagcacaacctgatcaagctgcagcaggagatggccgagctggaggccgtgctggagcagcacggcagccagcccagcaacagctaccccagcatcatcagtgacagcagcgccctggaggacctgagaaatcctgagcagagcaccagcgagaaggacagccacatccacggccagaggaacaacagcatgttcagcaagaggccccgggagcacatctctgctgtgctgaccagccagaagagcagcgagtaccccatcagccagaaccctgagggcctgtctgctgacaagtttgaggtgtctgctgacagcagcaccagcaagaacaaggagcccggggtggagaggagcagccccagcaagtgccccagcctggatgaccgctggtacatgcacagctgcagcggcagcctgcagaacagaaactaccccagccaggaggagctgatcaaggtggtggatgtggaggagcagcagctggaggagagcggcccccatgacctgacagagaccagctacctgccccggcaggacctggagggcaccccctacctggagagcggcatcagcctcttcagtgatgatcctgagagtgaccccagtgaagatcgggcccctgagagcgcccgggtgggcaacatccccagcagcaccagcgccctgaaggtgccccagctgaaggtggccgagagcgcccagagccctgctgctgcccacaccacagacacagctggctacaatgccatggaggagagcgtgtcccgggagaagccagagctgacagccagcacagagcgggtgaacaagaggatgtccatggtggtgtctggcctgaccccagaggagttcatgctggtgtacaagtttgccaggaagcaccacatcaccctgaccaacctgatcacagaggagaccacccacgtggtgatgaagacagatgctgagtttgtgtgtgagaggaccctgaagtacttcctgggcattgctgggggcaagtgggtggtgtcctacttctgggtgacccagagcatcaaggagaggaagatgctgaatgaacatgactttgaggtgagaggagatgtggtgaatggaagaaaccaccagggccccaagagggcccgggagagccaggacaggaagatcttccggggcctggagatctgctgctacggccccttcaccaacatgcccacagaccagctggagtggatggtgcagctgtgtggggcctctgtggtgaaggagctgagcagcttcaccctgggcaccggggtgcaccccatcgtggtggtgcagccagatgcctggacagaagataatggcttccacgccatcggccagatgtgtgaggcccctgtggtgacccgggagtgggtgctggacagcgtggccctgtaccagtgccaggagctggacacctacctgatcccccagatcccccacagccactactag

SEQ ID NO: 18604 - DNA, 669 bp, Artificial Sequence
  Description of Artificial Sequence: Synthetic coding sequence
atggacctgagcgccctgcgggtggaggaggtgcagaatgtcatcaatgccatgcagaagatcctggagtgccccatctgcctggagctgatcaaggagcctgtgtccaccaagtgtgaccacatcttctgcaagttctgcatgctgaagctgctgaaccagaagaagggccccagccagtgccccctgtgcaagaatgacatcaccaagaggagcctgcaggagagcacccgcttcagccagctggtggaggagctgctgaagatcatctgtgccttccagctggacaccggcctggagtatgccaacagctacaactttgccaagaaggagaacaacagccctgagcacctgaaggatgaggtgtccatcatccagagcatgggctacagaaacagagccaagaggctgctgcagagcgagcctgagaaccccagcctggagaccagcctgtctgtgcagctgagcaacctgggcaccgtgaggaccctgcggaccaagcagaggatccagccccagaagacctctgtgtacatcgagctgggcagtgacagcagtgaagatactgtgaacaaggccacctactgcagcgtgggggaccaggagctgctgcagatcaccccccagggcaccagagatgagatcagcctggacagcgccaagaagtag

SEQ ID NO: 18605 - DNA, 1869 bp, Artificial Sequence
  Description of Artificial Sequence: Synthetic coding sequence
atggacctgagcgccctgcgggtggaggaggtgcagaatgtcatcaatgccatgcagaagatcctggagtgccccatctgcctggagctgatcaaggagcctgtgtccaccaagtgtgaccacatcttctgcaagagcctgcaggagagcacccgcttcagccagctggtggaggagctgctgaagatcatctgtgccttccagctggacaccggcctggagtatgccaacagctacaactttgccaagaaggagaacaacagccctgagcacctgaaggatgaggtgtccatcatccagagcatgggctacagaaacagagccaagaggctgctgcagagcgagcctgagaaccccagcctgcaggagaccagcctgtctgtgcagctgagcaacctgggcaccgtgaggaccctgcggaccaagcagaggatccagccccagaagacctctgtgtacatcgagctgggcagtgacagcagcgaggacacagtgaacaaggccacctactgcagcgtgggggaccaggagctgctgcagatcaccccccagggcaccagagatgagatcagcctggacagcgccaagaaggccgcctgtgagttcagcgagacagatgtgaccaacacagagcaccaccagcccagcaacaatgacctgaacaccacagagaagagagctgctgagcggcaccctgagaagtaccagggcagctctgtgagcaacctgcacgtggagccctgtggcaccaacacccacgccagcagcctgcagcacgagaacagcagcctgctgctgaccaaggacaggatgaatgtggagaaggccgagttctgcaacaagagcaagcagcccggcctggcccggagccagcacaaccgctgggccggcagcaaggagacctgcaatgacaggaggacccccagcacagagaagaaggtggacctgaatgctgaccccctgtgtgagaggaaggagtggaacaagcagaagctgccctgcagcgagaacccccgggacacagaagatgtgccctggatcaccctgaacagcagcatccagaaggtgaatgagtggttcagcagaagtgatgagctgctgggcagtgatgacagccatgatggagagagcgagagcaatgccaaggtggctgatgtgctggatgtgctgaatgaggtggatgagtacagcggcagcagcgagaagattgacctgctggccagtgacccccatgaggccctgatctgcaagtctgagcgggtgcacagcaagtctgtggagagcaacatcgaggacaagatctttgggaagacctacaggaagaaggccagcctgcccaacctgagccacgtgacagaaaatctcatcattggagcctttgtgacagagccccagatcatccaggagcggcccctgaccaacaagctgaagaggaagaggcggcccaccagcggcctgcaccctgaggacttcatcaagaaggctgacctggccgtgcagaagaccccagagatgatcaaccagggcaccaaccagacagagcagaatggccaggtgatgaacatcaccaacagcggccacgagaacaagaccaagggggacagcatccagaatgagaagaaccccaaccccatcgagagcctggagaaggagagcgccttcaagaccaaggccgagcccatcagcagcagcatcagcaacatggagctggagctgaacatccacaacagcaaggcccccaagaagaaccggctgcggaggaagagcagcaccaggcacatccacgccctggagctggtggtgtccaggaacctgagcccccccaactgcacagagctgcagattgacagctgcagcagcagcgagtag

SEQ ID NO: 18606 - DNA, 1872 bp, Artificial Sequence
  Description of Artificial Sequence: Synthetic coding sequence
atggacctgagcgccctgcgggtggaggaggtgcagaatgtcatcaatgccatgcagaagatcctggagtgccccatctgcctggagctgatcaaggagcctgtgtccaccaagtgtgaccacatcttctgcaagttctgcatgctgaagctgctgaaccagaagaagggccccagccagtgccccctgtgcaagaatgacatcaccaagaggagcctgcaggagagcacccgcttcagccagctggtggaggagctgctgaagatcatctgtgccttccagctggacaccggcctggagtatgccaacagctacaactttgccaagaaggagaacaacagccctgagcacctgaaggatgaggtgtccatcatccagagcatgggctacagaaacagagccaagaggctgctgcagagcgagcctgagaaccccagcctggagaccagcctgtctgtgcagctgagcaacctgggcaccgtgaggaccctgcggaccaagcagaggatccagccccagaagacctctgtgtacatcgagctgggcagtgacagcagtgaagatactgtgaacaaggccacctactgcagcgtgggggaccaggagctgctgcagatcaccccccagggcaccagagatgagatcagcctggacagcgccaagaaggccgcctgtgagttcagcgagacagatgtgaccaacacagagcaccaccagcccagcaacaatgacctgaacaccacagagaagagagctgctgagcggcaccctgagaagtaccagggcgaggccgccagcggctgtgagagcgagacctctgtgtctgaggactgcagcggcctgagcagccagagcgacatcctgaccacccagcagagggacaccatgcagcacaacctgatcaagctgcagcaggagatggccgagctggaggccgtgctggagcagcacggcagccagcccagcaacagctaccccagcatcatcagtgacagcagcgccctggaggacctgagaaatcctgagcagagcaccagcgagaaggctgtgctgaccagccagaagagcagcgagtaccccatcagccagaaccctgagggcctgtctgctgacaagtttgaggtgtctgctgacagcagcaccagcaagaacaaggagcccggggtggagaggagcagccccagcaagtgccccagcctggatgaccgctggtacatgcacagctgcagcggcagcctgcagaacagaaactaccccagccaggaggagctgatcaaggtggtggatgtggaggagcagcagctggaggagagcggcccccatgacctgacagagaccagctacctgccccggcaggacctggagggcaccccctacctggagagcggcatcagcctcttcagtgatgatcctgagagtgaccccagtgaagatcgggcccctgagagcgcccgggtgggcaacatccccagcagcaccagcgccctgaaggtgccccagctgaaggtggccgagagcgcccagagccctgctgctgcccacaccacagacacagctggctacaatgccatggaggagagcgtgtcccgggagaagccagagctgacagccagcacagagcgggtgaacaagaggatgtccatggtggtgtctggcctgaccccagaggagttcatgctggtgtacaagtttgccaggaagcaccacatcaccctgaccaacctgatcacagaggagaccacccacgtggtgatgaagacagatgctgagtttgtgtgtgagaggaccctgaagtacttcctgggcattgctgggggcaagtgggtggtgtcctacttctgggtgacccagagcatcaaggagaggaagtag

SEQ ID NO: 18607 - DNA, 1497 bp, Artificial Sequence
  Description of Artificial Sequence: Synthetic coding sequence
gagctgctgaagatcatctgtgccttccagctggacaccggcctggagtatgccaacagctacaactttgccaagaaggagaacaacagccctgagcacctgaaggatgaggtgtccatcatccagagcatgggctacagaaacagagccaagaggctgctgcagagcgagcctgagaaccccagcctggagaccagcctgtctgtgcagctgagcaacctgggcaccgtgaggaccctgcggaccaagcagaggatccagccccagaagacctctgtgtacatcgagctggccgcctgtgagttcagcgagacagatgtgaccaacacagagcaccaccagcccagcaacaatgacctgaacaccacagagaagagagctgctgagcggcaccctgagaagtaccagggcgaggccgccagcggctgtgagagcgagacctctgtgtctgaggactgcagcggcctgagcagccagagcgacatcctgaccacccagcagagggacaccatgcagcacaacctgatcaagctgcagcaggagatggccgagctggaggccgtgctggagcagcacggcagccagcccagcaacagctaccccagcatcatcagtgacagcagcgccctggaggacctgaggaaccctgagcagagcaccagcgagaaggctgtgctgaccagccagaagagcagcgagtaccccatcagccagaaccctgagggcctgtctgctgacaagtttgaggtgtctgctgacagcagcaccagcaagaacaaggagcccggggtggagaggagcagccccagcaaatgtcccagcctggatgaccgctggtacatgcacagctgcagcggcagcctgcagaacagaaactaccccagccaggaggagctgatcaaggtggtggatgtggaggagcagcagctggaggagagcggcccccatgacctgacagagaccagctacctgccccggcaggacctggagggcaccccctacctggagagcggcatcagcctcttcagtgatgatcctgagagtgaccccagcgaggaccgggcccctgagagcgcccgggtgggcaacatccccagcagcaccagcgccctgaaggtgccccagctgaaggtggccgagagcgcccagagccctgctgctgcccacaccacagacacagctggctacaatgccatggaggagagcgtgtcccgggagaagccagagctgacagccagcacagagcgggtgaacaagaggatgtccatggtggtgtctggcctgaccccagaggagttcatgctggtgtacaagtttgccaggaagcaccacatcaccctgaccaacctgatcacagaggagaccacccacgtggtgatgaagacagatgctgagtttgtgtgtgagaggaccctgaagtacttcctgggcattgctgggggcaagtgggtggtgtcctacttctgggtgacccagagcatcaaggagaggaagtag

SEQ ID NO: 18608 - DNA, 297 bp, Artificial Sequence
  Description of Artificial Sequence: Synthetic coding sequence
atggacctgagcgccctgcgggtggaggaggtgcagaatgtcatcaatgccatgcagaagatcctggagtgccccatctgcctggagctgatcaaggagcctgtgtccaccaagtgtgaccacatcttctgcaagagcctgcaggagagcacccgcttcagccagctggtggaggagctgctgaagatcatctgtgccttccagctggacaccggcctggagtatgccaacagctacaactttgccaagaaggagaacaacagccctgagcacctgaaggatgaggtgtccatctag

SEQ ID NO: 18609 - DNA, 2280 bp, Artificial Sequence
  Description of Artificial Sequence: Synthetic coding sequence
atggacctgagcgccctgcgggtggaggaggtgcagaatgtcatcaatgccatgcagaagatcctggagtgccccatctgcctggagctgatcaaggagcctgtgtccaccaagtgtgaccacatcttctgcaagttctgcatgctgaagctgctgaaccagaagaagggccccagccagtgccccctgtgcaagaatgacatcaccaagaggagcctgcaggagagcacccgcttcagccagctggtggaggagctgctgaagatcatctgtgccttccagctggacaccggcctggagtatgccaacagctacaactttgccaagaaggagaacaacagccctgagcacctgaaggatgaggtgtccatcatccagagcatgggctacagaaacagagccaagaggctgctgcagagcgagcctgagaaccccagcctgcaggagaccagcctgtctgtgcagctgagcaacctgggcaccgtgaggaccctgcggaccaagcagaggatccagccccagaagacctctgtgtacatcgagctgggcagtgacagcagcgaggacacagtgaacaaggccacctactgcagcgtgggggaccaggagctgctgcagatcaccccccagggcaccagagatgagatcagcctggacagcgccaagaaggccgcctgtgagttcagcgagacagatgtgaccaacacagagcaccaccagcccagcaacaatgacctgaacaccacagagaagagagctgctgagcggcaccctgagaagtaccagggcgaggccgccagcggctgtgagagcgagacctctgtgtctgaggactgcagcggcctgagcagccagagcgacatcctgaccacccagcagagggacaccatgcagcacaacctgatcaagctgcagcaggagatggccgagctggaggccgtgctggagcagcacggcagccagcccagcaacagctaccccagcatcatcagtgacagcagcgccctggaggacctgaggaaccctgagcagagcaccagcgagaaggtgctgaccagccagaagagcagcgagtaccccatcagccagaaccctgagggcctgtctgctgacaagtttgaggtgtctgctgacagcagcaccagcaagaacaaggagcccggggtggagaggagcagccccagcaagtgccccagcctggatgaccgctggtacatgcacagctgcagcggcagcctgcagaacagaaactaccccagccaggaggagctgatcaaggtggtggatgtggaggagcagcagctggaggagagcggcccccatgacctgacagagaccagctacctgccccggcaggacctggagggcaccccctacctggagagcggcatcagcctcttcagtgatgatcctgagagtgaccccagtgaagatcgggcccctgagagcgcccgggtgggcaacatccccagcagcaccagcgccctgaaggtgccccagctgaaggtggccgagagcgcccagagccctgctgctgcccacaccacagacacagctggctacaatgccatggaggagagcgtgtcccgggagaagccagagctgacagccagcacagagcgggtgaacaagaggatgtccatggtggtgtctggcctgaccccagaggagttcatgctggtgtacaagtttgccaggaagcaccacatcaccctgaccaacctgatcacagaggagaccacccacgtggtgatgaagacagatgctgagtttgtgtgtgagaggaccctgaagtacttcctgggcattgctgggggcaagtgggtggtgtcctacttctgggtgacccagagcatcaaggagaggaagatgctgaatgaacatgactttgaggtgagaggagatgtggtgaatggaagaaaccaccagggccccaagagggcccgggagagccaggacaggaagatcttccggggcctggagatctgctgctacggccccttcaccaacatgcccacagaccagctggagtggatggtgcagctgtgtggggcctctgtggtgaaggagctgagcagcttcaccctgggcaccggggtgcaccccatcgtggtggtgcagccagatgcctggacagaagataatggcttccacgccatcggccagatgtgtgaggcccctgtggtgacccgggagtgggtgctggacagcgtggccctgtaccagtgccaggagctggacacctacctgatcccccagatcccccacagccactactag

SEQ ID NO: 18610 - DNA, 180 bp, Artificial Sequence
  Description of Artificial Sequence: Synthetic coding sequence
atggacctgagcgccctgcgggtggaggaggtgcagaatgtcatcaatgccatgcagaagatcctggagtgccccatctgcctggagctgatcaaggagcctgtgtccaccaagtgtgaccacatcttctgcaaggtgctgctgtgctgccccagctggagcacagtggtgcgctcctag

SEQ ID NO: 18611 - DNA, 5451 bp, Artificial Sequence
  Description of Artificial Sequence: Synthetic coding sequence
atgctgaagctgctgaaccagaagaagggccccagccagtgccccctgtgcaagaatgacatcaccaagaggagcctgcaggagagcacccgcttcagccagctggtggaggagctgctgaagatcatctgtgccttccagctggacaccggcctggagtatgccaacagctacaactttgccaagaaggagaacaacagccctgagcacctgaaggatgaggtgtccatcatccagagcatgggctacagaaacagagccaagaggctgctgcagagcgagcctgagaaccccagcctgcaggagaccagcctgtctgtgcagctgagcaacctgggcaccgtgaggaccctgcggaccaagcagaggatccagccccagaagacctctgtgtacatcgagctgggcagtgacagcagtgaagatactgtgaacaaggccacctactgcagcgtgggggaccaggagctgctgcagatcaccccccagggcaccagagatgagatcagcctggacagcgccaagaaggccgcctgtgagttcagcgagacagatgtgaccaacacagagcaccaccagcccagcaacaatgacctgaacaccacagagaagagagctgctgagcggcaccctgagaagtaccagggcagctctgtgagcaacctgcacgtggagccctgtggcaccaacacccacgccagcagcctgcagcacgagaacagcagcctgctgctgaccaaggacaggatgaatgtggagaaggccgagttctgcaacaagagcaagcagcccggcctggcccggagccagcacaaccgctgggccggcagcaaggagacctgcaatgacaggaggacccccagcacagagaagaaggtggacctgaatgctgaccccctgtgtgagaggaaggagtggaacaagcagaagctgccctgcagcgagaacccccgggacacagaagatgtgccctggatcaccctgaacagcagcatccagaaggtgaatgagtggttcagcagaagtgatgagctgctgggcagtgatgacagccatgatggagagagcgagagcaatgccaaggtggctgatgtgctggatgtgctgaatgaggtggatgagtacagcggcagcagcgagaagattgacctgctggccagtgacccccatgaggccctgatctgcaagtctgagcgggtgcacagcaagtctgtggagagcaacatcgaggacaagatctttgggaagacctacaggaagaaggccagcctgcccaacctgagccacgtgacagagaacctgatcatcggggcctttgtgacagagccccagatcatccaggagcggcccctgaccaacaagctgaagaggaagagaagacccaccagcggcctgcaccctgaggacttcatcaagaaggctgacctggccgtgcagaagaccccagagatgatcaaccagggcaccaaccagacagagcagaatggccaggtgatgaacatcaccaacagcggccacgagaacaagaccaagggggacagcatccagaatgagaagaaccccaaccccatcgagagcctggagaaggagagcgccttcaagaccaaggccgagcccatcagcagcagcatcagcaacatggagctggagctgaacatccacaacagcaaggcccccaagaagaaccggctgcggaggaagagcagcaccaggcacatccacgccctggagctggtggtgtccaggaacctgagcccccccaactgcacagagctgcagattgacagctgcagcagcagcgaggagatcaagaagaagaagtacaaccagatgcctgtgcgccacagcaggaacctgcagctgatggagggcaaggagcccgccactggagccaagaagagcaacaagcccaatgagcagaccagcaagagacatgacagcgacaccttccctgagctgaagctgaccaatgcccctggcagcttcaccaagtgcagcaacaccagcgagctgaaggagtttgtgaaccccagcctgccccgggaggagaaggaggagaagctggagaccgtgaaggtgagcaacaatgctgaggaccccaaggacctgatgctgagcggggagcgggtgctgcagacagagaggtctgtggagagcagcagcatcagcctggtgcccggcacagattatggcacccaggagagcatcagcctgctggaggtgtccaccctgggcaaggccaagacagagcccaacaagtgtgtgtcccagtgtgccgcctttgagaaccccaagggcctcatccacggctgcagcaaggacaacagaaatgacacagagggcttcaagtaccccctgggccacgaggtgaaccacagccgggagaccagcattgagatggaggagagcgagctggatgcccagtacctgcagaacaccttcaaggtgtccaagaggcagagctttgcccccttcagcaaccctggaaatgctgaggaggagtgtgccaccttcagcgcccacagcggcagcctgaagaagcagagccccaaggtgacctttgaatgtgagcagaaggaggagaaccagggcaagaatgaaagcaacatcaagcctgtgcagacagtgaacatcacagctggcttccctgtggtgggccagaaggacaagcctgtggacaatgccaagtgcagcatcaagggcggcagccgcttctgcctgagcagccagttcagaggaaatgagaccggcctcatcacccccaacaagcacggcctgctgcagaacccctaccgcatccccccactcttccccatcaagagctttgtgaagaccaagtgcaagaagaacctgctggaggagaactttgaggagcacagcatgagccctgagcgggagatgggaaatgaaaacatccccagcacagtgtccaccatcagcaggaacaacatccgggagaatgtgttcaaggaggccagcagcagcaacatcaatgaggtgggcagcagcaccaatgaggtgggcagcagcatcaatgagatcggcagcagtgatgagaacatccaggccgagctgggcaggaacagaggccccaagctgaatgccatgctgcggctgggcgtgctgcagcctgaggtgtacaagcagagcctgcccggcagcaactgcaagcaccctgagatcaagaagcaggagtatgaggaggtggtgcagacagtgaacacagacttcagcccctacctgatcagtgacaacctggagcagcccatgggcagcagccacgccagccaggtgtgcagcgagaccccagatgacctgctggatgatggagagatcaaggaggacaccagctttgctgaaaatgacatcaaggagagcagcgctgtgttcagcaagtctgtgcagaagggggagctgagccgcagccccagccccttcacccacacccacctggcccagggctaccgccgcggggccaagaagctggagagcagcgaggagaacctgagcagtgaagatgaggagctgccctgcttccagcacctgctgtttgggaaggtgaacaacatccccagccagagcaccaggcacagcacagtggccacagaatgtctgagcaagaacacagaggagaacctgctgagcctgaagaacagcctgaatgactgcagcaaccaggtgatcctggccaaggccagccaggagcaccacctgtctgaggagaccaagtgcagcgccagcctcttcagcagccagtgcagcgagctggaggacctgacagccaacaccaacacccaggaccccttcctgattggcagcagcaagcagatgaggcaccagagcgagagccagggcgtgggcctgagtgacaaggagctggtgtctgatgatgaggagcggggcaccggcctggaggagaacaaccaggaggagcagagcatggacagcaacctgggggaggccgccagcggctgtgagagcgagacctctgtgtctgaggactgcagcggcctgagcagccagagcgacatcctgaccacccagcagagggacaccatgcagcacaacctgatcaagctgcagcaggagatggccgagctggaggccgtgctggagcagcacggcagccagcccagcaacagctaccccagcatcatcagtgacagcagcgccctggaggacctgaggaaccctgagcagagcaccagcgagaaggctgtgctgaccagccagaagagcagcgagtaccccatcagccagaaccctgagggcctgtctgctgacaagtttgaggtgtctgctgacagcagcaccagcaagaacaaggagcccggggtggagaggagcagccccagcaaatgtcccagcctggatgaccgctggtacatgcacagctgcagcggcagcctgcagaacagaaactaccccagccaggaggagctgatcaaggtggtggatgtggaggagcagcagctggaggagagcggcccccatgacctgacagagaccagctacctgccccggcaggacctggagggcaccccctacctggagagcggcatcagcctcttcagtgatgatcctgagagtgaccccagcgaggaccgggcccctgagagcgcccgggtgggcaacatccccagcagcaccagcgccctgaaggtgccccagctgaaggtggccgagagcgcccagagccctgctgctgcccacaccacagacacagctggctacaatgccatggaggagagcgtgtcccgggagaagccagagctgacagccagcacagagcgggtgaacaagaggatgtccatggtggtgtctggcctgaccccagaggagttcatgctggtgtacaagtttgccaggaagcaccacatcaccctgaccaacctgatcacagaggagaccacccacgtggtgatgaagacagatgctgagtttgtgtgtgagaggaccctgaagtacttcctgggcattgctgggggcaagtgggtggtgtcctacttctgggtgacccagagcatcaaggagaggaagatgctgaatgaacatgactttgaggtgagaggagatgtggtgaatggaagaaaccaccagggccccaagagggcccgggagagccaggacaggaagatcttccggggcctggagatctgctgctacggccccttcaccaacatgcccacagaccagctggagtggatggtgcagctgtgtggggcctctgtggtgaaggagctgagcagcttcaccctgggcactggagtgcaccccatcgtggtggtgcagccagatgcctggacagaggacaatggcttccacgccatcggccagatgtgtgaggcccctgtggtgacccgggagtgggtgctggacagcgtggccctgtaccagtgccaggagctggacacctacctgatcccccagatcccccacagccactactag

SEQ ID NO: 18612 - DNA, 1719 bp, Artificial Sequence
  Description of Artificial Sequence: Synthetic coding sequence
atgctgaagctgctgaaccagaagaagggccccagccagtgccccctgtgcaagaatgacatcaccaagaggagcctgcaggagagcacccgcttcagccagctggtggaggagctgctgaagatcatctgtgccttccagctggacaccggcctggagtatgccaacagctacaactttgccaagaaggagaacaacagccctgagcacctgaaggatgaggtgtccatcatccagagcatgggctacagaaacagagccaagaggctgctgcagagcgagcctgagaaccccagcctgcaggagaccagcctgtctgtgcagctgagcaacctgggcaccgtgaggaccctgcggaccaagcagaggatccagccccagaagacctctgtgtacatcgagctgggcagtgacagcagtgaagatactgtgaacaaggccacctactgcagcgtgggggaccaggagctgctgcagatcaccccccagggcaccagagatgagatcagcctggacagcgccaagaaggccgcctgtgagttcagcgagacagatgtgaccaacacagagcaccaccagcccagcaacaatgacctgaacaccacagagaagagagctgctgagcggcaccctgagaagtaccagggcgaggccgccagcggctgtgagagcgagacctctgtgtctgaggactgcagcggcctgagcagccagagcgacatcctgaccacccagcagagggacaccatgcagcacaacctgatcaagctgcagcaggagatggccgagctggaggccgtgctggagcagcacggcagccagcccagcaacagctaccccagcatcatcagtgacagcagcgccctggaggacctgagaaatcctgagcagagcaccagcgagaaggctgtgctgaccagccagaagagcagcgagtaccccatcagccagaaccctgagggcctgtctgctgacaagtttgaggtgtctgctgacagcagcaccagcaagaacaaggagcccggggtggagaggagcagccccagcaagtgccccagcctggatgaccgctggtacatgcacagctgcagcggcagcctgcagaacagaaactaccccagccaggaggagctgatcaaggtggtggatgtggaggagcagcagctggaggagagcggcccccatgacctgacagagaccagctacctgccccggcaggacctggagggcaccccctacctggagagcggcatcagcctcttcagtgatgatcctgagagtgaccccagtgaagatcgggcccctgagagcgcccgggtgggcaacatccccagcagcaccagcgccctgaaggtgccccagctgaaggtggccgagagcgcccagagccctgctgctgcccacaccacagacacagctggctacaatgccatggaggagagcgtgtcccgggagaagccagagctgacagccagcacagagcgggtgaacaagaggatgtccatggtggtgtctggcctgaccccagaggagttcatgctggtgtacaagtttgccaggaagcaccacatcaccctgaccaacctgatcacagaggagaccacccacgtggtgatgaagacagatgctgagtttgtgtgtgagaggaccctgaagtacttcctgggcattgctgggggcaagtgggtggtgtcctacttctgggtgacccagagctag

SEQ ID NO: 18613 - DNA, 1422 bp, Artificial Sequence
  Description of Artificial Sequence: Synthetic coding sequence
atggacctgagcgccctgcgggtggaggaggtgcagaatgtcatcaatgccatgcagaagatcctggagtgccccatctgcctggagctgatcaaggagcctgtgtccaccaagtgtgaccacatcttctgcaagttctgcatgctgaagctgctgaaccagaagaagggccccagccagtgccccctgtgcaagaatgacatcaccaagaggagcctgcaggagagcacccgcttcagccagctggtggaggagctgctgaagatcatctgtgccttccagctggacaccggcctggagtatgccaacagctacaactttgccaagaaggagaacaacagccctgagcacctgaaggatgaggtgtccatcatccagagcatgggctacagaaacagagccaagaggctgctgcagagcgagcctgagaaccccagcctgcaggagaccagcctgtctgtgcagctgagcaacctgggcaccgtgaggaccctgcggaccaagcagaggatccagccccagaagacctctgtgtacatcgagctgggcagtgacagcagcgaggacacagtgaacaaggccacctactgcagcgtgggggaccaggagctgctgcagatcaccccccagggcaccagagatgagatcagcctggacagcgccaagaaggccgcctgtgagttcagcgagacagatgtgaccaacacagagcaccaccagcccagcaacaatgacctgaacaccacagagaagagagctgctgagcggcaccctgagaagtaccagggcagctctgtgagcaacctgcacgtggagccctgtggcaccaacacccacgccagcagcctgcagcacgagaacagcagcctgctgctgaccaaggacaggatgaatgtggagaaggccgagttctgcaacaagagcaagcagcccggcctggcccggagccagcacaaccgctgggccggcagcaaggagacctgcaatgacaggaggacccccagcacagagaagaaggtggacctgaatgctgaccccctgtgtgagaggaaggagtggaacaagcagaagctgccctgcagcgagaacccccgggacacagaagatgtgccctggatcaccctgaacagcagcatccagaaggtgaatgagtggttcagcagaagtgatgagctgctgggcagtgatgacagccatgatggagagagcgagagcaatgccaaggtggctgatgtgctggatgtgctgaatgaggtggatgagtacagcggcagcagcgagaagattgacctgctggccagtgacccccatgaggccctgatctgcaagtctgagcgggtgcacagcaagtctgtggagagcaacatcgaggacaagatctttgggaagacctacaggaagaaggccagcctgcccaactag

SEQ ID NO: 18614 - DNA, 534 bp, Artificial Sequence
  Description of Artificial Sequence: Synthetic coding sequence
atgaatgtggagaaggccgagttctgcaacaagagcaagcagcccggcctggcccggagccagcacaaccgctgggccggcagcaaggagacctgcaatgacaggaggacccccagcacagagaagaaggtggacctgaatgctgaccccctgtgtgagaggaaggagtggaacaagcagaagctgccctgcagcgagaacccccgggacacagaagatgtgccctggatcaccctgaacagcagcatccagaaggtgaatgagtggttcagcagaagtgatgagctgctgggcagtgatgacagccatgatggagagagcgagagcaatgccaaggtggctgatgtgctggatgtgctgaatgaggtggatgagtacagcggcagcagcgagaagattgacctgctggccagtgacccccatgaggccctgatctgcaagtctgagcgggtgcacagcaagtctgtggagagcaacatcgaggacaagatctttgggaagacctacaggaagaaggccagcctgcccaactag

SEQ ID NO: 18615 - DNA, 10257 bp, Artificial Sequence
  Description of Artificial Sequence: Synthetic coding sequence
atgcccatcggcagcaaggagcggcccaccttctttgagatcttcaagacccgctgcaacaaggctgacctgggccccatcagcctgaactggtttgaggagctgagcagcgaggccccaccctacaacagcgagcctgctgaggagagcgagcacaagaacaacaactatgagcccaacctcttcaagaccccccagaggaagcccagctacaaccagctggccagcacccccatcatcttcaaggagcagggcctgaccctgcccctgtaccagagccctgtgaaggagctggacaagttcaagctggacctgggcagaaatgtgcccaacagccgccacaagagcctgaggacagtgaagaccaagatggaccaggctgatgatgtgtcctgccccctgctgaacagctgcctgtctgagagccctgtggtgctgcagtgcacccacgtgaccccccagagggacaagtctgtggtgtgtggcagcctcttccacacccccaagtttgtgaagggccggcagacccccaagcacatcagcgagagcctgggcgctgaggtggaccctgacatgtcctggagcagcagcctggccaccccacccaccctgagcagcacagtgctgattgtgagaaatgaggaggccagcgagaccgtcttcccccatgacaccacagccaacgtgaagagctacttcagcaaccatgatgagagcctgaagaagaatgaccgcttcatcgcctctgtgacagattctgagaacaccaaccagcgggaggccgccagccacggctttgggaagaccagcggcaacagcttcaaggtgaacagctgcaaggaccacatcggcaagtccatgcccaacgtgctggaggatgaggtgtatgagaccgtggtggacaccagtgaagaagattccttcagcctgtgcttcagcaagtgcaggaccaagaacctgcagaaggtgaggaccagcaagaccaggaagaagatcttccacgaggccaatgctgatgaatgtgagaagagcaagaaccaggtgaaggagaagtacagctttgtgtctgaggtggagcccaatgacacagaccccctggacagcaatgtggccaaccagaagccctttgagagcggcagtgacaagatcagcaaggaggtggtgcccagcctggcctgtgagtggagccagctgaccctgagcggcctgaatggagcccagatggagaagatccccctgctgcacatcagcagctgtgaccagaacatcagcgagaaggacctgctggacacagagaacaagaggaagaaggacttcctgaccagcgagaacagcctgccccgcatcagcagcctgcccaagtctgagaagcccctgaatgaggagaccgtggtgaacaagagagatgaggagcagcacctggagagccacacagactgcatcctggccgtgaagcaggccatcagcggcaccagccctgtggccagcagcttccagggcatcaagaagagcatcttccgcatccgggagagccccaaggagaccttcaatgccagcttcagcggccacatgacagaccccaacttcaagaaggagacagaggccagcgagagcggcctggagatccacacagtgtgcagccagaaggaggacagcctgtgccccaacctgattgacaatggctcctggccagccaccaccacccagaacagcgtggccctgaagaatgccggcctcatcagcaccctgaagaagaagaccaacaagttcatctatgccatccatgatgagaccagctacaagggcaagaagatccccaaggaccagaagtctgagctgatcaactgcagcgcccagtttgaggccaatgcctttgaggcccccctgacctttgccaatgctgacagcggcctgctgcacagctctgtgaagaggagctgcagccagaatgacagcgaggagcccaccctgagcctgaccagcagctttggcaccatcctgaggaagtgcagcagaaatgagacctgcagcaacaacacagtcatcagccaggacctggactacaaggaggccaagtgcaacaaggagaagctgcagctgttcatcaccccagaggccgacagcctgagctgcctgcaggagggccagtgtgaaaatgaccccaagagcaagaaggtgtctgacatcaaggaggaggtgctggccgccgcctgccaccctgtgcagcacagcaaggtggagtacagcgacacagacttccagagccagaagagcctgctgtatgaccatgaaaatgccagcaccctcatcctgacccccaccagcaaggatgtgctgagcaacctggtgatgatcagccggggcaaggagagctacaagatgtctgacaagctgaagggcaacaactatgaaagtgatgtggagctgaccaagaacatccccatggagaagaaccaggatgtgtgtgccctgaatgaaaactacaagaatgtggagctgctgcccccagagaagtacatgagggtggccagccccagcaggaaggtgcagttcaaccagaacaccaacctgcgggtcatccagaagaaccaggaggagaccaccagcatcagcaagatcaccgtgaacccagattctgaggagctgttcagtgacaatgaaaacaactttgtgttccaggtggccaatgaaagaaacaacctggccctgggcaacaccaaggagctgcacgagacagacctgacctgtgtgaatgagcccatcttcaagaacagcaccatggtgctgtatggagacacaggagacaagcaggccacccaggtgtccatcaagaaggacctggtgtatgtgctggccgaggagaacaagaacagcgtgaagcagcacatcaagatgaccctgggccaggacctgaagagtgacatcagcctgaacatcgacaagatccctgagaagaacaatgactacatgaacaagtgggccggcctgctgggccccatcagcaaccacagctttggaggcagcttcagaacagccagcaacaaggagatcaagctgtctgagcacaacatcaagaagagcaagatgttcttcaaggacatcgaggagcagtaccccaccagcctggcctgtgtggagatcgtgaacaccctggccctggacaaccagaagaagctgagcaagccccagagcatcaacacagtgtctgcccacctgcagagctctgtggtggtgtctgactgcaagaacagccacatcaccccccagatgctgttcagcaagcaggacttcaacagcaaccacaacctgacccccagccagaaggccgagatcacagagctgagcaccatcctggaggagagcggcagccagtttgagttcacccagttcaggaagcccagctacatcctgcagaagagcacctttgaggtgcctgagaaccagatgaccatcctgaagaccaccagcgaggagtgcagagatgctgacctgcacgtgatcatgaatgcccccagcatcggccaggtggacagcagcaagcagtttgagggcaccgtggagatcaagaggaagtttgctggcctgctgaagaatgactgcaacaagagcgccagcggctacctgacagatgaaaatgaggtgggcttccggggcttctacagcgcccacggcaccaagctgaatgtgtccacagaggccctgcagaaggctgtgaagctgttcagtgacatcgagaacatcagcgaggagaccagcgctgaggtgcaccccatcagcctgagcagcagcaagtgccacgacagcgtggtgtccatgttcaagattgagaaccacaatgacaagacagtgtctgagaagaacaacaagtgccagctgatcctgcagaacaacatcgagatgaccaccggcacctttgtggaggagatcacagagaactacaagaggaacacagaaaatgaagacaacaagtacacagctgccagcaggaacagccacaacctggagtttgatggcagtgacagcagcaagaatgacacagtgtgcatccacaaggatgaaacagacctgctcttcacagaccagcacaacatctgcctgaagctgagcggccagttcatgaaggagggcaacacccagatcaaggaggacctgagtgacctgaccttcctggaggtggccaaggcccaggaggcctgccacggcaacaccagcaacaaggagcagctgacagccaccaagacagagcagaacatcaaggactttgagaccagtgacaccttcttccagacagccagcggcaagaacatctctgtggccaaggagagcttcaacaagatcgtgaacttctttgaccagaagccagaggagctgcacaacttcagcctgaacagcgagctgcacagcgacatcaggaagaacaagatggacatcctgtcctatgaggagacagacatcgtgaagcacaagatcctgaaggagagcgtgcctgtgggcactggaaaccagctggtgaccttccagggccagcctgagagagatgagaagatcaaggagcccaccctgctgggcttccacacagccagcggcaagaaggtgaagatcgccaaggagagcctggacaaggtgaagaacctgtttgatgagaaggagcagggcaccagcgagatcaccagcttcagccaccagtgggccaagaccctgaagtaccgggaggcctgcaaggacctggagctggcctgtgagaccatcgagatcacagctgcccccaagtgcaaggagatgcagaacagcctgaacaatgacaagaacctggtgtccattgaaacagtggtgccccccaagctgctgagtgacaacctgtgccggcagacagagaacctgaagaccagcaagagcatcttcctgaaggtgaaggtgcatgaaaatgtggagaaggagacagccaagagccctgccacctgctacaccaaccagagcccctacagcgtgattgaaaattctgccctggccttctacaccagctgcagcaggaagacctctgtgtcccagaccagcctgctggaggccaagaagtggctgcgggagggcatctttgatggccagcctgagcgcatcaacacagctgactatgtgggcaactacctgtatgagaacaacagcaacagcaccatcgccgagaatgacaagaaccacctgtctgagaagcaggacacctacctgagcaacagctccatgagcaacagctacagctaccacagtgatgaggtgtacaatgacagcggctacctgagcaagaacaagctggacagcggcatcgagcctgtgctgaagaatgtggaggaccagaagaacaccagcttcagcaaggtgatcagcaatgtgaaggatgccaatgcctacccccagacagtgaatgaagacatctgtgtggaggagctggtgaccagcagcagcccctgcaagaacaagaatgctgccatcaagctgagcatcagcaacagcaacaactttgaggtgggccccccagccttccgcatcgccagcggcaagatcgtgtgtgtgtcccatgagaccatcaagaaggtgaaggacatcttcacagacagcttcagcaaggtgatcaaggagaacaatgaaaacaagagcaagatctgccagaccaagatcatggccggctgctatgaggccctggatgacagcgaggacatcctgcacaacagcctggacaatgatgagtgcagcacccacagccacaaggtgtttgctgacatccagagcgaggagatcctgcagcacaaccagaacatgagcggcctggagaaggtgtccaagatcagcccctgtgatgtgtccctggagaccagtgacatctgcaagtgcagcatcggcaagctgcacaagtctgtgtcctctgccaacacctgtggcatcttcagcacagccagcggcaagtctgtgcaggtgtctgatgccagcctgcagaatgcccggcaggtgttttctgaaattgaggacagcaccaagcaggtgttcagcaaggtgctcttcaagagcaatgagcacagcgaccagctgacccgggaggagaacacagccatccgcaccccagagcacctgatcagccagaagggcttctcctacaacgtggtgaacagcagcgccttcagcggcttcagcacagccagcggcaagcaggtgtccatcctggagagcagcctgcacaaggtgaagggcgtgctggaggagtttgacctgatcagaacagagcacagcctgcactacagccccaccagccggcagaatgtgtccaagatcctgccccgggtggacaagaggaaccctgagcactgtgtgaacagcgagatggagaagacctgcagcaaggagttcaagctgagcaacaacctgaatgtggagggcggcagcagcgagaacaaccacagcatcaaggtgagcccctacctgagccagttccagcaggacaagcagcagctggtgctgggcaccaaggtgtccctggtggagaacatccacgtgctgggcaaggagcaggccagccccaagaatgtgaagatggagatcggcaagacagagaccttcagtgatgtgcctgtgaagaccaacatcgaggtgtgcagcacctacagcaaggacagcgagaactactttgaaacagaagctgtggagatcgccaaggccttcatggaggatgatgagctgacagacagcaagctgcccagccacgccacccacagcctcttcacctgcccagaaaatgaggagatggtgctgagcaacagcagaattggcaagagaagaggagagcccctcatcctggtgggggagcccagcatcaagaggaacctgctgaatgaatttgaccgcatcatcgagaaccaggagaagagcctgaaggccagcaagagcaccccagatggcaccatcaaggaccggcggctcttcatgcaccacgtgtccctggagcccatcacctgtgtgcccttccgcaccaccaaggagcggcaggagatccagaaccccaacttcaccgcccctggccaggagttcctgagcaagagccacctgtatgagcacctgaccctggagaagagcagcagcaacctggccgtgtctggccaccccttctaccaggtgtctgccaccagaaatgagaagatgaggcacctgatcaccaccggccggcccaccaaggtgtttgtgccccccttcaagaccaagagccacttccaccgggtggagcagtgtgtgaggaacatcaacctggaggagaaccggcagaagcagaacattgatggccacggcagtgatgacagcaagaacaagatcaatgacaatgagatccaccagttcaacaagaacaacagcaaccaggccgtggccgtgaccttcaccaagtgtgaggaggagcccctggacctgatcaccagcctgcagaatgcccgggacatccaggacatgaggatcaagaagaagcagaggcagagggtcttcccccagcccggcagcctgtacctggccaagaccagcaccctgccccgcatcagcctgaaggctgctgtgggcggccaggtgcccagcgcctgcagccacaagcagctgtacacctatggagtgtccaagcactgcatcaagatcaacagcaagaatgctgagagcttccagttccacacagaggactactttgggaaggagagcctgtggacaggcaagggcatccagctggctgatggcggctggctgatccccagcaatgatggcaaggccggcaaggaggagttctaccgggccctgtgtgacaccccaggagtggaccccaagctgatcagccgcatctgggtgtacaaccactaccgctggatcatctggaagctggccgccatggagtgtgccttccccaaggagtttgccaaccgctgcctgagccctgagcgggtgctgctgcagctgaagtaccgctatgacacagaaattgacaggagccgccgcagcgccatcaagaagatcatggagagagatgacacagctgccaagaccctggtgctgtgtgtgtctgacatcatcagcctgagcgccaacatcagcgagaccagcagcaacaagaccagcagcgctgacacccagaaggtggccatcatcgagctgacagatggctggtatgctgtgaaggcccagctggacccccccctgctggccgtgctgaagaatggccgcctgactgtgggccagaagatcatcctgcacggggctgagctggtgggcagcccagatgcctgcacccccctggaggcccctgagagcctgatgctgaagatcagcgccaacagcaccaggcctgcccgctggtacaccaagctgggcttcttcccagacccccggcccttccccctgcccctgagcagcctcttcagtgatggcggcaatgtgggctgtgtggatgtgatcatccagagggcctaccccatccagtggatggagaagaccagcagcggcctgtacatcttcagaaatgaaagagaggaggagaaggaggccgccaagtatgtggaggcccagcagaagaggctggaggccctcttcaccaagatccaggaggagtttgaggagcacgaggagaacaccaccaagccctacctgcccagccgggccctgacccggcagcaggtgcgggccctgcaggatggagctgagctgtatgaagctgtgaagaatgctgctgaccctgcctacctggagggctacttcagcgaggagcagctgcgggccctgaacaaccaccggcagatgctgaatgacaagaagcaggcccagatccagctggagatcaggaaggccatggagagcgctgagcagaaggagcagggcctgagcagagatgtgaccaccgtgtggaagctgcgcatcgtgtcctacagcaagaaggagaaggacagcgtcatcctgagcatctggaggcccagcagtgacctgtacagcctgctgacagagggcaagcgctaccgcatctaccacctggccaccagcaagagcaagagcaagtctgagcgggccaacatccagctggccgccaccaagaagacccagtaccagcagctgcctgtgtctgatgagatcctcttccagatctaccagccccgggagcccctgcacttcagcaagttcctggaccctgacttccagcccagctgcagcgaggtggacctgattggatttgtggtgtctgtggtgaagaagacaggcctggccccctttgtgtacctgagtgatgagtgctacaacctgctggccatcaagttctggattgacctgaatgaagacatcatcaagccccacatgctgattgctgccagcaacctgcagtggaggcctgagagcaagagcggcctgctgaccctgtttgctggggacttcagcgtcttcagcgccagccccaaggagggccacttccaggagaccttcaacaagatgaagaacacagtggagaacatcgacatcctgtgcaatgaagctgagaacaagctgatgcacatcctgcacgccaatgaccccaagtggagcacccccaccaaggactgcaccagcggcccctacacagcccagatcatccctggcactggaaacaagctgctgatgagcagccccaactgtgagatctactaccagagccccctgagcctgtgcatggccaagaggaagtctgtgtccacccctgtgtctgcccagatgaccagcaagagctgcaagggggagaaggagattgatgaccagaagaactgcaagaagaggcgggccctggacttcctgagccggctgcccctgcccccacctgtgagccccatctgcacctttgtgtccccagctgcccagaaggccttccagccccccaggagctgtggcaccaagtatgagacccccatcaagaagaaggagctgaacagcccccagatgacccccttcaagaagttcaatgagatcagcctgctggagagcaacagcattgctgatgaggagctggccctgatcaacacccaggccctgctgagcggcagcactggagagaagcagttcatctctgtgtctgagagcaccaggacagcccccaccagcagcgaggactacctgcggctgaagaggcgctgcaccaccagcctcatcaaggagcaggagagcagccaggccagcacagaagaatgtgagaagaacaagcaggacaccatcaccaccaagaagtacatctag

SEQ ID NO: 18616 - DNA, 1809 bp, Artificial Sequence
  Description of Artificial Sequence: Synthetic coding sequence
atgcccatcggcagcaaggagcggcccaccttctttgagatcttcaagacccgctgcaacaaggccggccccatcagcctgaactggtttgaggagctgagcagcgaggccccaccctacaacagcgagcctgctgaggagagcgagcacaagaacaacaactatgagcccaacctcttcaagaccccccagaggaagcccagctacaaccagctggccagcacccccatcatcttcaaggagcagggcctgaccctgcccctgtaccagagccctgtgaaggagctggacaagttcaagctggacctgggcagaaatgtgcccaacagccgccacaagagcctgaggacagtgaagaccaagatggaccaggctgatgatgtgtcctgccccctgctgaacagctgcctgtctgagagccctgtggtgctgcagtgcacccacgtgaccccccagagggacaagtctgtggtgtgtggcagcctcttccacacccccaagtttgtgaagggccggcagacccccaagcacatcagcgagagcctgggcgctgaggtggaccctgacatgtcctggagcagcagcctggccaccccacccaccctgagcagcacagtgctgattgtgagaaatgaggaggccagcgagaccgtcttcccccatgacaccacagccaacgtgaagagctacttcagcaaccatgatgagagcctgaagaagaatgaccgcttcatcgcctctgtgacagattctgagaacaccaaccagcgggaggccgccagccacggctttgggaagaccagcggcaacagcttcaaggtgaacagctgcaaggaccacatcggcaagtccatgcccaacgtgctggaggatgaggtgtatgagaccgtggtggacaccagtgaagaagattccttcagcctgtgcttcagcaagtgcaggaccaagaacctgcagaaggtgaggaccagcaagaccaggaagaagatcttccacgaggccaatgctgatgaatgtgagaagagcaagaaccaggtgaaggagaagtacagctttgtgtctgaggtggagcccaatgacacagaccccctggacagcaatgtggccaaccagaagccctttgagagcggcagtgacaagatcagcaaggaggtggtgcccagcctggcctgtgagtggagccagctgaccctgagcggcctgaatggagcccagatggagaagatccccctgctgcacatcagcagctgtgaccagaacatcagcgagaaggacctgctggacacagagaacaagaggaagaaggacttcctgaccagcgagaacagcctgccccgcatcagcagcctgcccaagtctgagaagcccctgaatgaggagaccgtggtgaacaagagagatgaggagcagcacctggagagccacacagactgcatcctggccgtgaagcaggccatcagcggcaccagccctgtggccagcagcttccagggcatcaagaagagcatcttccgcatccgggagagccccaaggagaccttcaatgccagcttcagcggccacatgacagaccccaacttcaagaaggagacagaggccagcgagagcggcctggagatccacacagtgtgcagccagaaggaggacagcctgtgccccaacctgattgacaatggctcctggccagccaccaccacccagaacagcgtggccctgaagaatgccggcctcatcagcaccctgaagaagaagaccaacaagttcatctatgccatccatgatgagaccagctacaagggcaagaagtag

SEQ ID NO: 18617 - DNA, 10257 bp, Artificial Sequence; identical to SEQ ID NO: 18615
  Description of Artificial Sequence: Synthetic coding sequence

SEQ ID NO: 18618 - DNA, 2667 bp, Artificial Sequence
  Description of Artificial Sequence: Synthetic coding sequence
atgcactgccctggagaggcccccctggccgccccccggcccacccccaaggacccctgcctgagaaatgtgctggccaaggccctgtatgacaacgtggccgagagcccagatgagctgtccttcaggaagggggacatcatgacagtgctggagcaggacacccagggcctggatggctggtggctgtgcagcctgcacggccggcagggcatcgtgcccggcaaccggctgaagatcctggtgggcatgtatgacaagaagccagctggccctggccctggccccccagccaccccagcccagccccagcccggcctgcacgccccagcccccccagccagccagtacacccccatgctgcccaacacctaccagccccagccagattctgtgtacctggtgcccacccccagcaaggcccagcagggcctgtaccaggtgcccggccccagcccccagttccagagccccccagccaagcagaccagcaccttcagcaagcagaccccccaccaccccttccccagccctgccacagacctgtaccaggtgcccccaggccctgggggccctgcccaggacatctaccaggtgccccccagcgctggcatgggccatgacatctaccaggtgcccccatccatggacaccaggtcctgggagggcaccaagcccccagccaaggtggtggtgcccaccagggtgggccagggctacgtgtatgaggccgcccagcctgagcaggatgaatatgacatccccaggcacctgctggcccctggcccccaggacatctatgatgtgccccctgtgcggggcctgctgcccagccagtatggccaggaggtgtatgacaccccacccatggctgtgaagggccccaacggccgggaccccctgctggaggtgtatgatgtgccccccagcgtggagaagggcctgccccccagcaaccaccacgctgtgtatgatgtgcccccatctgtgtccaaggatgtgcctgatggccccctgctgcgggaggagacctatgatgtgcccccagcctttgccaaggccaagccctttgatcctgcccggacccccctggtgctggccgcccctcctccagacagccccccagcagaagatgtgtatgatgtgcccccaccagccccagacctgtatgatgtgcccccaggcctgcggcggcccggccctggcaccctgtatgatgtgccccgggagcgggtgctgcccccagaggtggctgatggaggagtggtggacagcggcgtgtatgctgtgcccccacctgctgagcgggaggccccagctgagggcaagaggctgagcgccagcagcacaggcagcaccaggagcagccagagcgccagcagcctggaggtggccggccctggccgggagcccctggagctggaggtggccgtggaggccctggcccggctgcagcagggcgtgtctgccaccgtggcccacctgctggacctggccggcagcgctggggccaccggctcctggaggagccccagcgagccccaggagcccctggtgcaggacctgcaggccgctgtggccgctgtgcagagcgctgtgcatgagctgctggagtttgcccggtctgctgtgggcaatgctgcccacaccagtgaccgggccctgcacgccaagctgagccggcagctgcagaagatggaggatgtgcaccagaccctggtggcccacggccaggccctggatgctggccggggcggcagcggggccaccctggaggacctggaccggctggtggcctgcagcagagctgtgcctgaagatgccaagcagctggccagcttcctgcacggcaatgccagcctgctcttccggaggaccaaggccacagcccctggccctgagggcggcggcaccctgcaccccaaccccacagacaagaccagcagcatccagagccggcccctgcccagcccccccaagttcaccagccaggacagcccagatggccagtatgagaacagcgagggcggctggatggaggactatgactatgtgcacctgcagggcaaggaggagtttgagaagacccagaaggagctgctggagaagggcagcatcacccggcagggcaagagccagctggagctgcagcagctgaagcagtttgagcggctggagcaggaggtgtcccggcccatcgaccatgacctggccaactggaccccagcccagcccctggcccctggccgcactggaggcctgggccccagcgaccggcagctgctgctcttctacctggagcagtgtgaggccaacctgaccaccctgaccaatgctgtggatgccttcttcaccgctgtggccaccaaccagccccccaagatctttgtggcccacagcaagtttgtgatcctgagcgcccacaagctggtgttcatcggggacaccctgagccggcaggccaaggccgcagatgtgcgcagccaggtgacccactacagcaacctgctgtgtgacctgctgcggggcatcgtggccaccaccaaggctgctgccctgcagtaccccagccccagcgctgcccaggacatggtggagcgggtgaaggagctgggccacagcacccagcagttcagaagagtgctgggccagctggccgccgcctag

SEQ ID NO: 18619 - DNA, 2613 bp, Artificial Sequence
  Description of Artificial Sequence: Synthetic coding sequence
atgaaccacctgaatgtgctggccaaggccctgtatgacaacgtggccgagagcccagatgagctgtccttcaggaagggggacatcatgacagtgctggagcaggacacccagggcctggatggctggtggctgtgcagcctgcacggccggcagggcatcgtgcccggcaaccggctgaagatcctggtgggcatgtatgacaagaagccagctggccctggccctggccccccagccaccccagcccagccccagcccggcctgcacgccccagcccccccagccagccagtacacccccatgctgcccaacacctaccagccccagccagattctgtgtacctggtgcccacccccagcaaggcccagcagggcctgtaccaggtgcccggccccagcccccagttccagagccccccagccaagcagaccagcaccttcagcaagcagaccccccaccaccccttccccagccctgccacagacctgtaccaggtgcccccaggccctgggggccctgcccaggacatctaccaggtgccccccagcgctggcatgggccatgacatctaccaggtgcccccatccatggacaccaggtcctgggagggcaccaagcccccagccaaggtggtggtgcccaccagggtgggccagggctacgtgtatgaggccgcccagcctgagcaggatgaatatgacatccccaggcacctgctggcccctggcccccaggacatctatgatgtgccccctgtgcggggcctgctgcccagccagtatggccaggaggtgtatgacaccccacccatggctgtgaagggccccaacggccgggaccccctgctggaggtgtatgatgtgccccccagcgtggagaagggcctgccccccagcaaccaccacgctgtgtatgatgtgcccccatctgtgtccaaggatgtgcctgatggccccctgctgcgggaggagacctatgatgtgcccccagcctttgccaaggccaagccctttgatcctgcccggacccccctggtgctggccgcccctcctccagacagccccccagcagaagatgtgtatgatgtgcccccaccagccccagacctgtatgatgtgcccccaggcctgcggcggcccggccctggcaccctgtatgatgtgccccgggagcgggtgctgcccccagaggtggctgatggaggagtggtggacagcggcgtgtatgctgtgcccccacctgctgagcgggaggccccagctgagggcaagaggctgagcgccagcagcacaggcagcaccaggagcagccagagcgccagcagcctggaggtggccggccctggccgggagcccctggagctggaggtggccgtggaggccctggcccggctgcagcagggcgtgtctgccaccgtggcccacctgctggacctggccggcagcgctggggccaccggctcctggaggagccccagcgagccccaggagcccctggtgcaggacctgcaggccgctgtggccgctgtgcagagcgctgtgcatgagctgctggagtttgcccggtctgctgtgggcaatgctgcccacaccagtgaccgggccctgcacgccaagctgagccggcagctgcagaagatggaggatgtgcaccagaccctggtggcccacggccaggccctggatgctggccggggcggcagcggggccaccctggaggacctggaccggctggtggcctgcagcagagctgtgcctgaagatgccaagcagctggccagcttcctgcacggcaatgccagcctgctcttccggaggaccaaggccacagcccctggccctgagggcggcggcaccctgcaccccaaccccacagacaagaccagcagcatccagagccggcccctgcccagcccccccaagttcaccagccaggacagcccagatggccagtatgagaacagcgagggcggctggatggaggactatgactatgtgcacctgcagggcaaggaggagtttgagaagacccagaaggagctgctggagaagggcagcatcacccggcagggcaagagccagctggagctgcagcagctgaagcagtttgagcggctggagcaggaggtgtcccggcccatcgaccatgacctggccaactggaccccagcccagcccctggcccctggccgcactggaggcctgggccccagcgaccggcagctgctgctcttctacctggagcagtgtgaggccaacctgaccaccctgaccaatgctgtggatgccttcttcaccgctgtggccaccaaccagccccccaagatctttgtggcccacagcaagtttgtgatcctgagcgcccacaagctggtgttcatcggggacaccctgagccggcaggccaaggccgcagatgtgcgcagccaggtgacccactacagcaacctgctgtgtgacctgctgcggggcatcgtggccaccaccaaggctgctgccctgcagtaccccagccccagcgctgcccaggacatggtggagcgggtgaaggagctgggccacagcacccagcagttcagaagagtgctgggccagctggccgccgcctag

SEQ ID NO: 18620 - DNA, 2667 bp, Artificial Sequence
  Description of Artificial Sequence: Synthetic coding sequence
atgaaccacctgaatgtgctggccaaggccctgtatgacaacgtggccgagagcccagatgagctgtccttcaggaagggggacatcatgacagtgctggagcaggacacccagggcctggatggctggtggctgtgcagcctgcacggccggcagggcatcgtgcccggcaaccggctgaagatcctggtgggcatgtatgacaagaagccagctggccctggccctggccccccagccaccccagcccagccccagcccggcctgcacgccccagcccccccagccagccagtacacccccatgctgcccaacacctaccagccccagccagattctgtgtacctggtgcccacccccagcaaggcccagcagggcctgtaccaggtgcccggccccagcccccagttccagagccccccagccaagcagaccagcaccttcagcaagcagaccccccaccaccccttccccagccctgccacagacctgtaccaggtgcccccaggccctgggggccctgcccaggacatctaccaggtgccccccagcgctggcatgggccatgacatctaccaggtgcccccatccatggacaccaggtcctgggagggcaccaagcccccagccaaggtggtggtgcccaccagggtgggccagggctacgtgtatgaggccgcccagcctgagcaggatgaatatgacatccccaggcacctgctggcccctggcccccaggacatctatgatgtgccccctgtgcggggcctgctgcccagccagtatggccaggaggtgtatgacaccccacccatggctgtgaagggccccaacggccgggaccccctgctggaggtgtatgatgtgccccccagcgtggagaagggcctgccccccagcaaccaccacgctgtgtccaagtgccagggcaatgcccgggcccggctgcggctgtggggcgtgtgggtgtatgatgtgcccccatctgtgtccaaggatgtgcctgatggccccctgctgcgggaggagacctatgatgtgcccccagcctttgccaaggccaagccctttgatcctgcccggacccccctggtgctggccgcccctcctccagacagccccccagcagaagatgtgtatgatgtgcccccaccagccccagacctgtatgatgtgcccccaggcctgcggcggcccggccctggcaccctgtatgatgtgccccgggagcgggtgctgcccccagaggtggctgatggaggagtggtggacagcggcgtgtatgctgtgcccccacctgctgagcgggaggccccagctgagggcaagaggctgagcgccagcagcacaggcagcaccaggagcagccagagcgccagcagcctggaggtggccggccctggccgggagcccctggagctggaggtggccgtggaggccctggcccggctgcagcagggcgtgtctgccaccgtggcccacctgctggacctggccggcagcgctggggccaccggctcctggaggagccccagcgagccccaggagcccctggtgcaggacctgcaggccgctgtggccgctgtgcagagcgctgtgcatgagctgctggagtttgcccggtctgctgtgggcaatgctgcccacaccagtgaccgggccctgcacgccaagctgagccggcagctgcagaagatggaggatgtgcaccagaccctggtggcccacggccaggccctggatgctggccggggcggcagcggggccaccctggaggacctggaccggctggtggcctgcagcagagctgtgcctgaagatgccaagcagctggccagcttcctgcacggcaatgccagcctgctcttccggaggaccaaggccacagcccctggccctgagggcggcggcaccctgcaccccaaccccacagacaagaccagcagcatccagagccggcccctgcccagcccccccaagttcaccagccaggacagcccagatggccagtatgagaacagcgagggcggctggatggaggactatgactatgtgcacctgcagggcaaggaggagtttgagaagacccagaaggagctgctggagaagggcagcatcacccggcagggcaagagccagctggagctgcagcagctgaagcagtttgagcggctggagcaggaggtgtcccggcccatcgaccatgacctggccaactggaccccagcccagcccctggcccctggccgcactggaggcctgggccccagcgaccggcagctgctgctcttctacctggagcagtgtgaggccaacctgaccaccctgaccaatgctgtggatgccttcttcaccgctgtggccaccaaccagccccccaagatctttgtggcccacagcaagtttgtgatcctgagcgcccacaagctggtgttcatcggggacaccctgagccggcaggccaaggccgcagatgtgcgcagccaggtgacccactacagcaacctgctgtgtgacctgctgcggggcatcgtggccaccaccaaggctgctgccctgcagtaccccagccccagcgctgcccaggacatggtggagcgggtgaaggagctgggccacagcacccagcagttcagaagagtgctgggccagctggccgccgcctag

SEQ ID NO: 18621 - DNA, 2751 bp, Artificial Sequence
  Description of Artificial Sequence: Synthetic coding sequence
atgcctgccaagcccttcctgagctctgtgctgctgtcctggaaggtgctggacttcagcggccctggcccccagggcaccggccagccctgcagctgtggccactgggccgagggccagggcggccccccagagcctgctgggggccccaacgtgctggccaaggccctgtatgacaacgtggccgagagcccagatgagctgtccttcaggaagggggacatcatgacagtgctggagcaggacacccagggcctggatggctggtggctgtgcagcctgcacggccggcagggcatcgtgcccggcaaccggctgaagatcctggtgggcatgtatgacaagaagccagctggccctggccctggccccccagccaccccagcccagccccagcccggcctgcacgccccagcccccccagccagccagtacacccccatgctgcccaacacctaccagccccagccagattctgtgtacctggtgcccacccccagcaaggcccagcagggcctgtaccaggtgcccggccccagcccccagttccagagccccccagccaagcagaccagcaccttcagcaagcagaccccccaccaccccttccccagccctgccacagacctgtaccaggtgcccccaggccctgggggccctgcccaggacatctaccaggtgccccccagcgctggcatgggccatgacatctaccaggtgcccccatccatggacaccaggtcctgggagggcaccaagcccccagccaaggtggtggtgcccaccagggtgggccagggctacgtgtatgaggccgcccagcctgagcaggatgaatatgacatccccaggcacctgctggcccctggcccccaggacatctatgatgtgccccctgtgcggggcctgctgcccagccagtatggccaggaggtgtatgacaccccacccatggctgtgaagggccccaacggccgggaccccctgctggaggtgtatgatgtgccccccagcgtggagaagggcctgccccccagcaaccaccacgctgtgtatgatgtgcccccatctgtgtccaaggatgtgcctgatggccccctgctgcgggaggagacctatgatgtgcccccagcctttgccaaggccaagccctttgatcctgcccggacccccctggtgctggccgcccctcctccagacagccccccagcagaagatgtgtatgatgtgcccccaccagccccagacctgtatgatgtgcccccaggcctgcggcggcccggccctggcaccctgtatgatgtgccccgggagcgggtgctgcccccagaggtggctgatggaggagtggtggacagcggcgtgtatgctgtgcccccacctgctgagcgggaggccccagctgagggcaagaggctgagcgccagcagcacaggcagcaccaggagcagccagagcgccagcagcctggaggtggccggccctggccgggagcccctggagctggaggtggccgtggaggccctggcccggctgcagcagggcgtgtctgccaccgtggcccacctgctggacctggccggcagcgctggggccaccggctcctggaggagccccagcgagccccaggagcccctggtgcaggacctgcaggccgctgtggccgctgtgcagagcgctgtgcatgagctgctggagtttgcccggtctgctgtgggcaatgctgcccacaccagtgaccgggccctgcacgccaagctgagccggcagctgcagaagatggaggatgtgcaccagaccctggtggcccacggccaggccctggatgctggccggggcggcagcggggccaccctggaggacctggaccggctggtggcctgcagcagagctgtgcctgaagatgccaagcagctggccagcttcctgcacggcaatgccagcctgctcttccggaggaccaaggccacagcccctggccctgagggcggcggcaccctgcaccccaaccccacagacaagaccagcagcatccagagccggcccctgcccagcccccccaagttcaccagccaggacagcccagatggccagtatgagaacagcgagggcggctggatggaggactatgactatgtgcacctgcagggcaaggaggagtttgagaagacccagaaggagctgctggagaagggcagcatcacccggcagggcaagagccagctggagctgcagcagctgaagcagtttgagcggctggagcaggaggtgtcccggcccatcgaccatgacctggccaactggaccccagcccagcccctggcccctggccgcactggaggcctgggccccagcgaccggcagctgctgctcttctacctggagcagtgtgaggccaacctgaccaccctgaccaatgctgtggatgccttcttcaccgctgtggccaccaaccagccccccaagatctttgtggcccacagcaagtttgtgatcctgagcgcccacaagctggtgttcatcggggacaccctgagccggcaggccaaggccgcagatgtgcgcagccaggtgacccactacagcaacctgctgtgtgacctgctgcggggcatcgtggccaccaccaaggctgctgccctgcagtaccccagccccagcgctgcccaggacatggtggagcgggtgaaggagctgggccacagcacccagcagttcagaagagtgctgggccagctggccgccgcctag

SEQ ID NO: 18622 - DNA, 2667 bp, Artificial Sequence
  Description of Artificial Sequence: Synthetic coding sequence
atgctgacccaccggccccaggaggccgagcagaggggccgcaccccaggccccagctttgagtggaatgtgctggccaaggccctgtatgacaacgtggccgagagcccagatgagctgtccttcaggaagggggacatcatgacagtgctggagcaggacacccagggcctggatggctggtggctgtgcagcctgcacggccggcagggcatcgtgcccggcaaccggctgaagatcctggtgggcatgtatgacaagaagccagctggccctggccctggccccccagccaccccagcccagccccagcccggcctgcacgccccagcccccccagccagccagtacacccccatgctgcccaacacctaccagccccagccagattctgtgtacctggtgcccacccccagcaaggcccagcagggcctgtaccaggtgcccggccccagcccccagttccagagccccccagccaagcagaccagcaccttcagcaagcagaccccccaccaccccttccccagccctgccacagacctgtaccaggtgcccccaggccctgggggccctgcccaggacatctaccaggtgccccccagcgctggcatgggccatgacatctaccaggtgcccccatccatggacaccaggtcctgggagggcaccaagcccccagccaaggtggtggtgcccaccagggtgggccagggctacgtgtatgaggccgcccagcctgagcaggatgaatatgacatccccaggcacctgctggcccctggcccccaggacatctatgatgtgccccctgtgcggggcctgctgcccagccagtatggccaggaggtgtatgacaccccacccatggctgtgaagggccccaacggccgggaccccctgctggaggtgtatgatgtgccccccagcgtggagaagggcctgccccccagcaaccaccacgctgtgtatgatgtgcccccatctgtgtccaaggatgtgcctgatggccccctgctgcgggaggagacctatgatgtgcccccagcctttgccaaggccaagccctttgatcctgcccggacccccctggtgctggccgcccctcctccagacagccccccagcagaagatgtgtatgatgtgcccccaccagccccagacctgtatgatgtgcccccaggcctgcggcggcccggccctggcaccctgtatgatgtgccccgggagcgggtgctgcccccagaggtggctgatggaggagtggtggacagcggcgtgtatgctgtgcccccacctgctgagcgggaggccccagctgagggcaagaggctgagcgccagcagcacaggcagcaccaggagcagccagagcgccagcagcctggaggtggccggccctggccgggagcccctggagctggaggtggccgtggaggccctggcccggctgcagcagggcgtgtctgccaccgtggcccacctgctggacctggccggcagcgctggggccaccggctcctggaggagccccagcgagccccaggagcccctggtgcaggacctgcaggccgctgtggccgctgtgcagagcgctgtgcatgagctgctggagtttgcccggtctgctgtgggcaatgctgcccacaccagtgaccgggccctgcacgccaagctgagccggcagctgcagaagatggaggatgtgcaccagaccctggtggcccacggccaggccctggatgctggccggggcggcagcggggccaccctggaggacctggaccggctggtggcctgcagcagagctgtgcctgaagatgccaagcagctggccagcttcctgcacggcaatgccagcctgctcttccggaggaccaaggccacagcccctggccctgagggcggcggcaccctgcaccccaaccccacagacaagaccagcagcatccagagccggcccctgcccagcccccccaagttcaccagccaggacagcccagatggccagtatgagaacagcgagggcggctggatggaggactatgactatgtgcacctgcagggcaaggaggagtttgagaagacccagaaggagctgctggagaagggcagcatcacccggcagggcaagagccagctggagctgcagcagctgaagcagtttgagcggctggagcaggaggtgtcccggcccatcgaccatgacctggccaactggaccccagcccagcccctggcccctggccgcactggaggcctgggccccagcgaccggcagctgctgctcttctacctggagcagtgtgaggccaacctgaccaccctgaccaatgctgtggatgccttcttcaccgctgtggccaccaaccagccccccaagatctttgtggcccacagcaagtttgtgatcctgagcgcccacaagctggtgttcatcggggacaccctgagccggcaggccaaggccgcagatgtgcgcagccaggtgacccactacagcaacctgctgtgtgacctgctgcggggcatcgtggccaccaccaaggctgctgccctgcagtaccccagccccagcgctgcccaggacatggtggagcgggtgaaggagctgggccacagcacccagcagttcagaagagtgctgggccagctggccgccgcctag

SEQ ID NO: 18623 - DNA, 2169 bp, Artificial Sequence
  Description of Artificial Sequence: Synthetic coding sequence
atgcagggcaagaatgtgctggccaaggccctgtatgacaacgtggccgagagcccagatgagctgtccttcaggaagggggacatcatgacagtgctggagcaggacacccagggcctggatggctggtggctgtgcagcctgcacggccggcagggcatcgtgcccggcaaccggctgaagatcctggtggtggtgcccaccagggtgggccagggctacgtgtatgaggccgcccagcctgagcaggatgaatatgacatccccaggcacctgctggcccctggcccccaggacatctatgatgtgccccctgtgcggggcctgctgcccagccagtatggccaggaggtgtatgacaccccacccatggctgtgaagggccccaacggccgggaccccctgctggaggtgtatgatgtgccccccagcgtggagaagggcctgccccccagcaaccaccacgctgtgtatgatgtgcccccatctgtgtccaaggatgtgcctgatggccccctgctgcgggaggagacctatgatgtgcccccagcctttgccaaggccaagccctttgatcctgcccggacccccctggtgctggccgcccctcctccagacagccccccagcagaagatgtgtatgatgtgcccccaccagccccagacctgtatgatgtgcccccaggcctgcggcggcccggccctggcaccctgtatgatgtgccccgggagcgggtgctgcccccagaggtggctgatggaggagtggtggacagcggcgtgtatgctgtgcccccacctgctgagcgggaggccccagctgagggcaagaggctgagcgccagcagcacaggcagcaccaggagcagccagagcgccagcagcctggaggtggccggccctggccgggagcccctggagctggaggtggccgtggaggccctggcccggctgcagcagggcgtgtctgccaccgtggcccacctgctggacctggccggcagcgctggggccaccggctcctggaggagccccagcgagccccaggagcccctggtgcaggacctgcaggccgctgtggccgctgtgcagagcgctgtgcatgagctgctggagtttgcccggtctgctgtgggcaatgctgcccacaccagtgaccgggccctgcacgccaagctgagccggcagctgcagaagatggaggatgtgcaccagaccctggtggcccacggccaggccctggatgctggccggggcggcagcggggccaccctggaggacctggaccggctggtggcctgcagcagagctgtgcctgaagatgccaagcagctggccagcttcctgcacggcaatgccagcctgctcttccggaggaccaaggccacagcccctggccctgagggcggcggcaccctgcaccccaaccccacagacaagaccagcagcatccagagccggcccctgcccagcccccccaagttcaccagccaggacagcccagatggccagtatgagaacagcgagggcggctggatggaggactatgactatgtgcacctgcagggcaaggaggagtttgagaagacccagaaggagctgctggagaagggcagcatcacccggcagggcaagagccagctggagctgcagcagctgaagcagtttgagcggctggagcaggaggtgtcccggcccatcgaccatgacctggccaactggaccccagcccagcccctggcccctggccgcactggaggcctgggccccagcgaccggcagctgctgctcttctacctggagcagtgtgaggccaacctgaccaccctgaccaatgctgtggatgccttcttcaccgctgtggccaccaaccagccccccaagatctttgtggcccacagcaagtttgtgatcctgagcgcccacaagctggtgttcatcggggacaccctgagccggcaggccaaggccgcagatgtgcgcagccaggtgacccactacagcaacctgctgtgtgacctgctgcggggcatcgtggccaccaccaaggctgctgccctgcagtaccccagccccagcgctgcccaggacatggtggagcgggtgaaggagctgggccacagcacccagcagttcagaagagtgctgggccagctggccgccgcctag

SEQ ID NO: 18624 - DNA, 2613 bp, Artificial Sequence
  Description of Artificial Sequence: Synthetic coding sequence
atgtctgtgcccaacgtgctggccaaggccctgtatgacaacgtggccgagagcccagatgagctgtccttcaggaagggggacatcatgacagtgctggagcaggacacccagggcctggatggctggtggctgtgcagcctgcacggccggcagggcatcgtgcccggcaaccggctgaagatcctggtgggcatgtatgacaagaagccagctggccctggccctggccccccagccaccccagcccagccccagcccggcctgcacgccccagcccccccagccagccagtacacccccatgctgcccaacacctaccagccccagccagattctgtgtacctggtgcccacccccagcaaggcccagcagggcctgtaccaggtgcccggccccagcccccagttccagagccccccagccaagcagaccagcaccttcagcaagcagaccccccaccaccccttccccagccctgccacagacctgtaccaggtgcccccaggccctgggggccctgcccaggacatctaccaggtgccccccagcgctggcatgggccatgacatctaccaggtgcccccatccatggacaccaggtcctgggagggcaccaagcccccagccaaggtggtggtgcccaccagggtgggccagggctacgtgtatgaggccgcccagcctgagcaggatgaatatgacatccccaggcacctgctggcccctggcccccaggacatctatgatgtgccccctgtgcggggcctgctgcccagccagtatggccaggaggtgtatgacaccccacccatggctgtgaagggccccaacggccgggaccccctgctggaggtgtatgatgtgccccccagcgtggagaagggcctgccccccagcaaccaccacgctgtgtatgatgtgcccccatctgtgtccaaggatgtgcctgatggccccctgctgcgggaggagacctatgatgtgcccccagcctttgccaaggccaagccctttgatcctgcccggacccccctggtgctggccgcccctcctccagacagccccccagcagaagatgtgtatgatgtgcccccaccagccccagacctgtatgatgtgcccccaggcctgcggcggcccggccctggcaccctgtatgatgtgccccgggagcgggtgctgcccccagaggtggctgatggaggagtggtggacagcggcgtgtatgctgtgcccccacctgctgagcgggaggccccagctgagggcaagaggctgagcgccagcagcacaggcagcaccaggagcagccagagcgccagcagcctggaggtggccggccctggccgggagcccctggagctggaggtggccgtggaggccctggcccggctgcagcagggcgtgtctgccaccgtggcccacctgctggacctggccggcagcgctggggccaccggctcctggaggagccccagcgagccccaggagcccctggtgcaggacctgcaggccgctgtggccgctgtgcagagcgctgtgcatgagctgctggagtttgcccggtctgctgtgggcaatgctgcccacaccagtgaccgggccctgcacgccaagctgagccggcagctgcagaagatggaggatgtgcaccagaccctggtggcccacggccaggccctggatgctggccggggcggcagcggggccaccctggaggacctggaccggctggtggcctgcagcagagctgtgcctgaagatgccaagcagctggccagcttcctgcacggcaatgccagcctgctcttccggaggaccaaggccacagcccctggccctgagggcggcggcaccctgcaccccaaccccacagacaagaccagcagcatccagagccggcccctgcccagcccccccaagttcaccagccaggacagcccagatggccagtatgagaacagcgagggcggctggatggaggactatgactatgtgcacctgcagggcaaggaggagtttgagaagacccagaaggagctgctggagaagggcagcatcacccggcagggcaagagccagctggagctgcagcagctgaagcagtttgagcggctggagcaggaggtgtcccggcccatcgaccatgacctggccaactggaccccagcccagcccctggcccctggccgcactggaggcctgggccccagcgaccggcagctgctgctcttctacctggagcagtgtgaggccaacctgaccaccctgaccaatgctgtggatgccttcttcaccgctgtggccaccaaccagccccccaagatctttgtggcccacagcaagtttgtgatcctgagcgcccacaagctggtgttcatcggggacaccctgagccggcaggccaaggccgcagatgtgcgcagccaggtgacccactacagcaacctgctgtgtgacctgctgcggggcatcgtggccaccaccaaggctgctgccctgcagtaccccagccccagcgctgcccaggacatggtggagcgggtgaaggagctgggccacagcacccagcagttcagaagagtgctgggccagctggccgccgcctag

SEQ ID NO: 18625 - DNA, 2607 bp, Artificial Sequence
  Description of Artificial Sequence: Synthetic coding sequence
atggagaatgtgctggccaaggccctgtatgacaacgtggccgagagcccagatgagctgtccttcaggaagggggacatcatgacagtgctggagcaggacacccagggcctggatggctggtggctgtgcagcctgcacggccggcagggcatcgtgcccggcaaccggctgaagatcctggtgggcatgtatgacaagaagccagctggccctggccctggccccccagccaccccagcccagccccagcccggcctgcacgccccagcccccccagccagccagtacacccccatgctgcccaacacctaccagccccagccagattctgtgtacctggtgcccacccccagcaaggcccagcagggcctgtaccaggtgcccggccccagcccccagttccagagccccccagccaagcagaccagcaccttcagcaagcagaccccccaccaccccttccccagccctgccacagacctgtaccaggtgcccccaggccctgggggccctgcccaggacatctaccaggtgccccccagcgctggcatgggccatgacatctaccaggtgcccccatccatggacaccaggtcctgggagggcaccaagcccccagccaaggtggtggtgcccaccagggtgggccagggctacgtgtatgaggccgcccagcctgagcaggatgaatatgacatccccaggcacctgctggcccctggcccccaggacatctatgatgtgccccctgtgcggggcctgctgcccagccagtatggccaggaggtgtatgacaccccacccatggctgtgaagggccccaacggccgggaccccctgctggaggtgtatgatgtgccccccagcgtggagaagggcctgccccccagcaaccaccacgctgtgtatgatgtgcccccatctgtgtccaaggatgtgcctgatggccccctgctgcgggaggagacctatgatgtgcccccagcctttgccaaggccaagccctttgatcctgcccggacccccctggtgctggccgcccctcctccagacagccccccagcagaagatgtgtatgatgtgcccccaccagccccagacctgtatgatgtgcccccaggcctgcggcggcccggccctggcaccctgtatgatgtgccccgggagcgggtgctgcccccagaggtggctgatggaggagtggtggacagcggcgtgtatgctgtgcccccacctgctgagcgggaggccccagctgagggcaagaggctgagcgccagcagcacaggcagcaccaggagcagccagagcgccagcagcctggaggtggccggccctggccgggagcccctggagctggaggtggccgtggaggccctggcccggctgcagcagggcgtgtctgccaccgtggcccacctgctggacctggccggcagcgctggggccaccggctcctggaggagccccagcgagccccaggagcccctggtgcaggacctgcaggccgctgtggccgctgtgcagagcgctgtgcatgagctgctggagtttgcccggtctgctgtgggcaatgctgcccacaccagtgaccgggccctgcacgccaagctgagccggcagctgcagaagatggaggatgtgcaccagaccctggtggcccacggccaggccctggatgctggccggggcggcagcggggccaccctggaggacctggaccggctggtggcctgcagcagagctgtgcctgaagatgccaagcagctggccagcttcctgcacggcaatgccagcctgctcttccggaggaccaaggccacagcccctggccctgagggcggcggcaccctgcaccccaaccccacagacaagaccagcagcatccagagccggcccctgcccagcccccccaagttcaccagccaggacagcccagatggccagtatgagaacagcgagggcggctggatggaggactatgactatgtgcacctgcagggcaaggaggagtttgagaagacccagaaggagctgctggagaagggcagcatcacccggcagggcaagagccagctggagctgcagcagctgaagcagtttgagcggctggagcaggaggtgtcccggcccatcgaccatgacctggccaactggaccccagcccagcccctggcccctggccgcactggaggcctgggccccagcgaccggcagctgctgctcttctacctggagcagtgtgaggccaacctgaccaccctgaccaatgctgtggatgccttcttcaccgctgtggccaccaaccagccccccaagatctttgtggcccacagcaagtttgtgatcctgagcgcccacaagctggtgttcatcggggacaccctgagccggcaggccaaggccgcagatgtgcgcagccaggtgacccactacagcaacctgctgtgtgacctgctgcggggcatcgtggccaccaccaaggctgctgccctgcagtaccccagccccagcgctgcccaggacatggtggagcgggtgaaggagctgggccacagcacccagcagttcagaagagtgctgggccagctggccgccgcctag

SEQ ID NO: 18626 - DNA, 2526 bp, Artificial Sequence
  Description of Artificial Sequence: Synthetic coding sequence
atgacagtgctggagcaggacacccagggcctggatggctggtggctgtgcagcctgcacggccggcagggcatcgtgcccggcaaccggctgaagatcctggtgggcatgtatgacaagaagccagctggccctggccctggccccccagccaccccagcccagccccagcccggcctgcacgccccagcccccccagccagccagtacacccccatgctgcccaacacctaccagccccagcctgacagcgtgtacctggtgcccacccccagcaaggcccagcagggcctgtaccaggtgcccggccccagcccccagttccagagccccccagccaagcagaccagcaccttcagcaagcagaccccccaccaccccttccccagccctgccacagacctgtaccaggtgcccccaggccctgggggccctgcccaggacatctaccaggtgcccccatctgctggcatgggccatgacatctaccaggtgccccccagcatggacaccaggtcctgggagggcaccaagcccccagccaaggtggtggtgcccaccagggtgggccagggctacgtgtatgaagctgcccagcctgagcaggatgaatatgacatccccaggcacctgctggcccctggcccccaggacatctatgatgtgccccctgtgcggggcctgctgcccagccagtatggccaggaggtgtatgacaccccacccatggctgtgaagggccccaacggccgggaccccctgctggaggtgtatgatgtgcccccatctgtggagaagggcctgccccccagcaaccaccacgctgtgtatgatgtgccccccagcgtgtccaaggatgtgcctgatggccccctgctgcgggaggagacctatgatgtgcccccagcctttgccaaggccaagccctttgatcctgcccggacccccctggtgctggccgcccctcctccagacagccccccagcagaagatgtgtatgatgtgcccccaccagccccagacctgtatgatgtgcccccaggcctgcggcggcccggccctggcaccctgtatgatgtgccccgggagcgggtgctgcccccagaggtggctgatggcggcgtggtggacagcggcgtgtatgctgtgcccccacctgctgagcgggaggccccagctgagggcaagaggctgagcgccagcagcacaggcagcaccaggagcagccagagcgccagcagcctggaggtggccggccctggccgggagcccctggagctggaggtggccgtggaggccctggcccggctgcagcagggcgtgtctgccaccgtggcccacctgctggacctggccggcagcgctggggccaccggctcctggaggagccccagcgagccccaggagcccctggtgcaggacctgcaggccgctgtggccgctgtgcagagcgctgtgcatgagctgctggagtttgcccggtctgctgtgggcaatgctgcccacaccagtgaccgggccctgcacgccaagctgagccggcagctgcagaagatggaggatgtgcaccagaccctggtggcccacggccaggccctggatgctggccggggcggcagcggggccaccctggaggacctggaccggctggtggcctgcagcagagctgtgcctgaagatgccaagcagctggccagcttcctgcatggaaatgccagcctgctcttccggaggaccaaggccacagcccctggccctgagggcggcggcaccctgcaccccaaccccacagacaagaccagcagcatccagagccggcccctgcccagcccccccaagttcaccagccaggacagcccagatggccagtatgaaaattctgagggcggctggatggaggactatgactatgtgcacctgcagggcaaggaggagtttgagaagacccagaaggagctgctggagaagggcagcatcacccggcagggcaagagccagctggagctgcagcagctgaagcagtttgagcggctggagcaggaggtgtcccggcccatcgaccatgacctggccaactggaccccagcccagcccctggcccctggccgcactggaggcctgggccccagcgaccggcagctgctgctcttctacctggagcagtgtgaggccaacctgaccaccctgaccaatgctgtggatgccttcttcaccgctgtggccaccaaccagccccccaagatctttgtggcccacagcaagtttgtgatcctgagcgcccacaagctggtgttcatcggggacaccctgagccggcaggccaaggctgctgatgtgcgcagccaggtgacccactacagcaacctgctgtgtgacctgctgcggggcatcgtggccaccaccaaggccgccgccctgcagtaccccagccccagcgctgcccaggacatggtggagcgggtgaaggagctgggccacagcacccagcagttccggcgggtgctgggccagctggccgccgcctag

SEQ ID NO: 18627 - DNA, 741 bp, Artificial Sequence
  Description of Artificial Sequence: Synthetic coding sequence
atgcctgtgcagccccccagcaaggacacagaggagatggaggccgagggggacagcgctgctgagatgaatggagaggaggaggagagcgaggaggagaggagcggcagccagacagaaagtgaggaggagagcagcgagatggatgatgaagattatgaaagaagaagaagtgaatgtgtgtctgagatgctggacctggagaagcagttcagcgagctgaaggagaagctgttccgggagcggctgagccagctgcggctgcggctggaggaggtgggcgctgagcgggcccctgagtacacagagcccctgggcggcctgcagaggagcctgaagatccgcatccaggtggccggcatctacaagggcttctgcctggatgtgatccggaacaagtatgaatgtgagctgcagggcgccaagcagcacctggagagcgagaagctgctgctgtatgacaccctgcagggcgagctgcaggagcgcatccagaggctggaggaggaccggcagagcctggacctgagcagcgagtggtgggatgacaagctgcacgcccggggcagcagccgctcctgggacagcctgccccccagcaagaggaagaaggcccccctggtgtctggcccctacatcgtgtacatgctgcaggagattgacatcctggaggactggacagccatcaagaaggcccgggctgctgtgagcccccagaagaggaagagtgatggcccctag

SEQ ID NO: 18628 - DNA, 873 bp, Artificial Sequence
  Description of Artificial Sequence: Synthetic coding sequence
atgcctgtgcagccccccagcaaggacacagaggagatggaggccgagggggacagcgctgctgagatgaatggagaggaggaggagagcgaggaggagaggagcggcagccagacagaaagtgaggaggagagcagcgagatggatgatgaagattatgaaagaagaagaagtgaatgtgtgtctgagatgctggacctggagaagcagttcagcgagctgaaggagaagctgttccgggagcggctgagccagctgcggctgcggctggaggaggtgggcgctgagcgggcccctgagtacacagagcccctgggcggcctgcagaggagcctgaagatccgcatccaggtggccggcatctacaagggcttctgcctggatgtgatccggaacaagtatgaatgtgagctgcagggcgccaagcagcacctggagagcgagaagctgctgctgtatgacaccctgcagggcgagctgcaggagcgcatccagaggctggaggaggaccggcagagcctggacctgagcagcgagtggtgggatgacaagctgcacgcccggggcagcagccgctcctgggacagcctgccccccagcaagaggaagaaggcccccctggtgtctggcccctacatcgtgtacatgctgcaggagattgacatcctggaggactggacagccatcaagaaggcccgggctgctgtgagcccccagaagaggaagagtgatgacaggaggacccaccggcccctgcgggtgtgcccagcccggctgctgtggtgctgctgggccctgcccctgcacctggccctggcctggaccccacccctgcccagcagcaggcctgcccagctgtggccctggagctag

SEQ ID NO: 18629 - DNA, 735 bp, Artificial Sequence
  Description of Artificial Sequence: Synthetic coding sequence
atgcctgtgcagccccccagcaaggacacagaggagatggaggccgagggggacagcgctgctgagatgaatggagaggaggaggagagcgaggaggagaggagcggcagccagacagaaagtgaggaggagagcagcgagatggatgatgaagattatgaaagaagaagaagtgaatgtgtgtctgagatgctggacctggagaagcagttcagcgagctgaaggagaagctgttccgggagcggctgagccagctgcggctgcggctggaggaggtgggcgctgagcgggcccctgagtacacagagcccctgggcggcctgcagaggagcctgaagatccgcatccaggtggccggcatctacaagggcttctgcctggatgtgatccggaacaagtatgaatgtgagctgcagggcgccaagcagcacctggagagcgagaagctgctgctgtatgacaccctgcagggcgagctgcaggagcgcatccagaggctggaggaggaccggcagagcctggacctgagcagcgagtggtgggatgacaagctgcacgcccggggcagcagccgctcctgggacagcctgccccccagcaagaggaagaaggcccccctggtgtctggcccctacatcgtgtacatgctgcaggagattgacatcctggaggactggacagccatcaagaaggcccgggctgctgtgagcccccagaagaggaagagtgactag

SEQ ID NO: 18630 - DNA, 1494 bp, Artificial Sequence
  Description of Artificial Sequence: Synthetic coding sequence
atggccgagatgggcagcaaaggagtgacagctgggaagatcgccagcaatgtgcagaagaagctgacccgggcccaggagaaggtgctgcagaagctgggcaaggcagatgagaccaaggatgagcagtttgagcagtgtgtgcagaacttcaacaagcagctgacagagggcacccggctgcagaaggacctgcggacctacctggcctctgtgaaggccatgcatgaggccagcaagaagctgaatgaatgtctgcaggaggtgtatgagccagactggccaggaagagatgaggccaacaagattgctgaaaataatgacctgctgtggatggactaccaccagaagctggtggaccaggccctgctgaccatggacacctacctgggccagttcccagacatcaagagccgcatcgccaagaggggcaggaagctggtggactatgacagcgcccggcaccactatgagagcctgcagacagccaagaagaaggatgaggccaagatcgccaaggccgaggaggagctgatcaaggcccagaaggtgtttgaggagatgaatgtggacctgcaggaggagctgcccagcctgtggaacagccgggtgggcttctacgtgaacaccttccagagcattgctggcctggaggagaacttccacaaggagatgagcaagctgaaccagaacctgaatgatgtgctggtgggcctggagaagcagcacggcagcaacaccttcaccgtgaaggcccagcccaggaagaagagcaagctgttcagccggctgcggaggaagaagaacagcgacaatgccccagccaagggcaacaagagccccagccccccagatggcagccctgctgccaccccagagatccgggtgaaccacgagcctgagcctgctggaggagccacccctggggccaccctgcccaagagccccagccagctgaggaaaggacctcctgtgcccccaccacccaagcacacccccagcaaggaggtgaagcaggagcagatcctgagcctgtttgaggacacctttgtgcctgagatctctgtgaccacccccagccagcctgctgaggccagcgaggtggccggcggcacccagcctgctgctggggcccaggagcctggagaaacagctgccagcgaggccgccagcagcagcctgcctgctgtggtggtggagaccttccctgccaccgtgaatggaacagtggagggcggcagcggggccggccgcctggacctgcccccaggcttcatgttcaaggtgcaggcccagcacgactacacagccacagacacagatgagctgcagctgaaggctggagatgtggtgctggtgatccccttccagaaccctgaggagcaggatgagggctggctgatgggcgtgaaggagagtgactggaaccagcacaaggagctggagaagtgccggggcgtcttccctgagaacttcacagagcgggtgccctag

SEQ ID NO: 18631 - DNA, 1782 bp, Artificial Sequence
  Description of Artificial Sequence: Synthetic coding sequence
atggccgagatgggcagcaaaggagtgacagctgggaagatcgccagcaatgtgcagaagaagctgacccgggcccaggagaaggtgctgcagaagctgggcaaggcagatgagaccaaggatgagcagtttgagcagtgtgtgcagaacttcaacaagcagctgacagagggcacccggctgcagaaggacctgcggacctacctggcctctgtgaaggccatgcatgaggccagcaagaagctgaatgaatgtctgcaggaggtgtatgagccagactggccaggaagagatgaggccaacaagattgctgaaaataatgacctgctgtggatggactaccaccagaagctggtggaccaggccctgctgaccatggacacctacctgggccagttcccagacatcaagagccgcatcgccaagaggggcaggaagctggtggactatgacagcgcccggcaccactatgagagcctgcagacagccaagaagaaggatgaggccaagatcgccaagcctgtgtccctgctggagaaggccgccccccagtggtgccagggcaagctgcaggcccacctggtggcccagaccaacctgctgaggaaccaggccgaggaggagctgatcaaggcccagaaggtgtttgaggagatgaatgtggacctgcaggaggagctgcccagcctgtggaacagccgggtgggcttctacgtgaacaccttccagagcattgctggcctggaggagaacttccacaaggagatgagcaagctgaaccagaacctgaatgatgtgctggtgggcctggagaagcagcacggcagcaacaccttcaccgtgaaggcccagcccagcgacaatgccccagccaagggcaacaagagccccagccccccagatggcagccctgctgccaccccagagatccgggtgaaccacgagcctgagcctgctggaggagccacccctggggccaccctgcccaagagccccagccagctgaggaaaggacctcctgtgcccccaccacccaagcacacccccagcaaggaggtgaagcaggagcagatcctgagcctgtttgaggacacctttgtgcctgagatctctgtgaccacccccagccagtttgaggcccctggccccttcagcgagcaggccagcctgctggacctggactttgaccccctgccccctgtgaccagccctgtgaaggcccccaccccatctggccagagcatcccctgggacctgtgggagcccacagagagccctgctggcagcctgcccagcggggagcccagcgctgctgagggcacctttgctgtgtcctggcccagccagacagctgagcccggccctgcccagcctgctgaggccagcgaggtggccggcggcacccagcctgctgctggggcccaggagcctggagaaacagctgccagcgaggccgccagcagcagcctgcctgctgtggtggtggagaccttccctgccaccgtgaatggaacagtggagggcggcagcggggccggccgcctggacctgcccccaggcttcatgttcaaggtgcaggcccagcacgactacacagccacagacacagatgagctgcagctgaaggctggagatgtggtgctggtgatccccttccagaaccctgaggagcaggatgagggctggctgatgggcgtgaaggagagtgactggaaccagcacaaggagctggagaagtgccggggcgtcttccctgagaacttcacagagcgggtgccctag

SEQ ID NO: 18632 - DNA, 1557 bp, Artificial Sequence
  Description of Artificial Sequence: Synthetic coding sequence
atggccgagatgggcagcaaaggagtgacagctgggaagatcgccagcaatgtgcagaagaagctgacccgggcccaggagaaggtgctgcagaagctgggcaaggcagatgagaccaaggatgagcagtttgagcagtgtgtgcagaacttcaacaagcagctgacagagggcacccggctgcagaaggacctgcggacctacctggcctctgtgaaggccatgcatgaggccagcaagaagctgaatgaatgtctgcaggaggtgtatgagccagactggccaggaagagatgaggccaacaagattgctgaaaataatgacctgctgtggatggactaccaccagaagctggtggaccaggccctgctgaccatggacacctacctgggccagttcccagacatcaagagccgcatcgccaagaggggcaggaagctggtggactatgacagcgcccggcaccactatgagagcctgcagacagccaagaagaaggatgaggccaagatcgccaaggccgaggaggagctgatcaaggcccagaaggtgtttgaggagatgaatgtggacctgcaggaggagctgcccagcctgtggaacagccgggtgggcttctacgtgaacaccttccagagcattgctggcctggaggagaacttccacaaggagatgagcaagctgaaccagaacctgaatgatgtgctggtgggcctggagaagcagcacggcagcaacaccttcaccgtgaaggcccagcccagcgacaatgccccagccaagggcaacaagagccccagccccccagatggcagccctgctgccaccccagagatccgggtgaaccacgagcctgagcctgctgggggcgccacccctggggccaccctgcccaagagccccagccagctgaggaagggcccccctgtgcccccaccacccaagcacacccccagcaaggaggtgaagcaggagcagatcctgagcctgtttgaggacacctttgtgcctgagatctctgtgaccacccccagccagcccacagagagccctgctggcagcctgcccagcggggagcccagcgctgctgagggcacctttgctgtgtcctggcccagccagacagctgagcccggccctgcccagcctgctgaggccagcgaggtggccggcggcacccagcctgctgctggggcccaggagcccggggagacagctgccagcgaggccgccagcagcagcctgcctgctgtggtggtggagaccttccctgccaccgtgaatggcaccgtggagggcggcagcggggccggccgcctggacctgcccccaggcttcatgttcaaggtgcaggcccagcacgactacacagccacagacacagatgagctgcagctgaaggctggagatgtggtgctggtgatccccttccagaaccctgaggagcaggatgagggctggctgatgggcgtgaaggagagtgactggaaccagcacaaggagctggagaagtgccggggcgtcttccctgagaacttcacagagcgggtgccctag

SEQ ID NO: 18633 - DNA, 1230 bp, Artificial Sequence
  Description of Artificial Sequence: Synthetic coding sequence
atggccgagatgggcagcaaaggagtgacagctgggaagatcgccagcaatgtgcagaagaagctgacccgggcccaggagaaggtgctgcagaagctgggcaaggcagatgagaccaaggatgagcagtttgagcagtgtgtgcagaacttcaacaagcagctgacagagggcacccggctgcagaaggacctgcggacctacctggcctctgtgaaggccatgcatgaggccagcaagaagctgaatgaatgtctgcaggaggtgtatgagccagactggccaggaagagatgaggccaacaagattgctgaaaataatgacctgctgtggatggactaccaccagaagctggtggaccaggccctgctgaccatggacacctacctgggccagttcccagacatcaagagccgcatcgccaagaggggcaggaagctggtggactatgacagcgcccggcaccactatgagagcctgcagacagccaagaagaaggatgaggccaagatcgccaaggccgaggaggagctgatcaaggcccagaaggtgtttgaggagatgaatgtggacctgcaggaggagctgcccagcctgtggaacagccgggtgggcttctacgtgaacaccttccagagcattgctggcctggaggagaacttccacaaggagatgagcaagctgaaccagaacctgaatgatgtgctggtgggcctggagaagcagcacggcagcaacaccttcaccgtgaaggcccagcccagcgacaatgccccagccaagggcaacaagagccccagccccccagatggcagccctgctgccaccccagagatccgggtgaaccacgagcctgagcctgctgggggcgccacccctggggccaccctgcccaagagccccagccagagcagcctgcctgctgtggtggtggagaccttccctgccaccgtgaatggaacagtggagggcggcagcggggccggccgcctggacctgcccccaggcttcatgttcaaggtgcaggcccagcacgactacacagccacagacacagatgagctgcagctgaaggctggagatgtggtgctggtgatccccttccagaaccctgaggagcaggatgagggctggctgatgggcgtgaaggagagtgactggaaccagcacaaggagctggagaagtgccggggcgtcttccctgagaacttcacagagcgggtgccctag

SEQ ID NO: 18634 - DNA, 1521 bp, Artificial Sequence
  Description of Artificial Sequence: Synthetic coding sequence
atggccgagatgggcagcaaaggagtgacagctgggaagatcgccagcaatgtgcagaagaagctgacccgggcccaggagaaggtgctgcagaagctgggcaaggcagatgagaccaaggatgagcagtttgagcagtgtgtgcagaacttcaacaagcagctgacagagggcacccggctgcagaaggacctgcggacctacctggcctctgtgaaggccatgcatgaggccagcaagaagctgaatgaatgtctgcaggaggtgtatgagccagactggccaggaagagatgaggccaacaagattgctgaaaataatgacctgctgtggatggactaccaccagaagctggtggaccaggccctgctgaccatggacacctacctgggccagttcccagacatcaagagccgcatcgccaagaggggcaggaagctggtggactatgacagcgcccggcaccactatgagagcctgcagacagccaagaagaaggatgaggccaagatcgccaagcctgtgtccctgctggagaaggccgccccccagtggtgccagggcaagctgcaggcccacctggtggcccagaccaacctgctgaggaaccaggccgaggaggagctgatcaaggcccagaaggtgtttgaggagatgaatgtggacctgcaggaggagctgcccagcctgtggaacagccgggtgggcttctacgtgaacaccttccagagcattgctggcctggaggagaacttccacaaggagatgagcaagctgaaccagaacctgaatgatgtgctggtgggcctggagaagcagcacggcagcaacaccttcaccgtgaaggcccagcccagcgacaatgccccagccaagggcaacaagagccccagccccccagatggcagccctgctgccaccccagagatccgggtgaaccacgagcctgagcctgctggaggagccacccctggggccaccctgcccaagagccccagccagcccacagagagccctgctggcagcctgcccagcggggagcccagcgctgctgagggcacctttgctgtgtcctggcccagccagacagctgagcccggccctgcccagcctgctgaggccagcgaggtggccggcggcacccagcctgctgctggggcccaggagcccggggagacagctgccagcgaggccgccagcagcagcctgcctgctgtggtggtggagaccttccctgccaccgtgaatggcaccgtggagggcggcagcggggccggccgcctggacctgcccccaggcttcatgttcaaggtgcaggcccagcacgactacacagccacagacacagatgagctgcagctgaaggctggagatgtggtgctggtgatccccttccagaaccctgaggagcaggatgagggctggctgatgggcgtgaaggagagtgactggaaccagcacaaggagctggagaagtgccggggcgtcttccctgagaacttcacagagcgggtgccctag

SEQ ID NO: 18635 - DNA, 1365 bp, Artificial Sequence
  Description of Artificial Sequence: Synthetic coding sequence
atggccgagatgggcagcaaaggagtgacagctgggaagatcgccagcaatgtgcagaagaagctgacccgggcccaggagaaggtgctgcagaagctgggcaaggcagatgagaccaaggatgagcagtttgagcagtgtgtgcagaacttcaacaagcagctgacagagggcacccggctgcagaaggacctgcggacctacctggcctctgtgaaggccatgcatgaggccagcaagaagctgaatgaatgtctgcaggaggtgtatgagccagactggccaggaagagatgaggccaacaagattgctgaaaataatgacctgctgtggatggactaccaccagaagctggtggaccaggccctgctgaccatggacacctacctgggccagttcccagacatcaagagccgcatcgccaagaggggcaggaagctggtggactatgacagcgcccggcaccactatgagagcctgcagacagccaagaagaaggatgaggccaagatcgccaaggccgaggaggagctgatcaaggcccagaaggtgtttgaggagatgaatgtggacctgcaggaggagctgcccagcctgtggaacagccgggtgggcttctacgtgaacaccttccagagcattgctggcctggaggagaacttccacaaggagatgagcaagctgaaccagaacctgaatgatgtgctggtgggcctggagaagcagcacggcagcaacaccttcaccgtgaaggcccagcccaggaagaagagcaagctgttcagccggctgcggaggaagaagaacagcgacaatgccccagccaagggcaacaagagccccagccccccagatggcagccctgctgccaccccagagatccgggtgaaccacgagcctgagcctgctggaggagccacccctggggccaccctgcccaagagccccagccagcctgctgaggccagcgaggtggccggcggcacccagcctgctgctggggcccaggagcccggggagacagctgccagcgaggccgccagcagcagcctgcctgctgtggtggtggagaccttccctgccaccgtgaatggcaccgtggagggcggcagcggggccggccgcctggacctgcccccaggcttcatgttcaaggtgcaggcccagcacgactacacagccacagacacagatgagctgcagctgaaggctggagatgtggtgctggtgatccccttccagaaccctgaggagcaggatgagggctggctgatgggcgtgaaggagagtgactggaaccagcacaaggagctggagaagtgccggggcgtcttccctgagaacttcacagagcgggtgccctag

SEQ ID NO: 18636 - DNA, 1653 bp, Artificial Sequence
  Description of Artificial Sequence: Synthetic coding sequence
atggccgagatgggcagcaaaggagtgacagctgggaagatcgccagcaatgtgcagaagaagctgacccgggcccaggagaaggtgctgcagaagctgggcaaggcagatgagaccaaggatgagcagtttgagcagtgtgtgcagaacttcaacaagcagctgacagagggcacccggctgcagaaggacctgcggacctacctggcctctgtgaaggccatgcatgaggccagcaagaagctgaatgaatgtctgcaggaggtgtatgagccagactggccaggaagagatgaggccaacaagattgctgaaaataatgacctgctgtggatggactaccaccagaagctggtggaccaggccctgctgaccatggacacctacctgggccagttcccagacatcaagagccgcatcgccaagaggggcaggaagctggtggactatgacagcgcccggcaccactatgagagcctgcagacagccaagaagaaggatgaggccaagatcgccaagcctgtgtccctgctggagaaggccgccccccagtggtgccagggcaagctgcaggcccacctggtggcccagaccaacctgctgaggaaccaggccgaggaggagctgatcaaggcccagaaggtgtttgaggagatgaatgtggacctgcaggaggagctgcccagcctgtggaacagccgggtgggcttctacgtgaacaccttccagagcattgctggcctggaggagaacttccacaaggagatgagcaagctgaaccagaacctgaatgatgtgctggtgggcctggagaagcagcacggcagcaacaccttcaccgtgaaggcccagcccagcgacaatgccccagccaagggcaacaagagccccagccccccagatggcagccctgctgccaccccagagatccgggtgaaccacgagcctgagcctgctggaggagccacccctggggccaccctgcccaagagccccagccagtttgaggcccctggccccttcagcgagcaggccagcctgctggacctggactttgaccccctgccccctgtgaccagccctgtgaaggcccccacccccagcggccagagcatcccctgggacctgtgggagcccacagagagccctgctggcagcctgcccagcggggagcccagcgctgctgagggcacctttgctgtgtcctggcccagccagacagctgagcccggccctgcccagcctgctgaggccagcgaggtggccggcggcacccagcctgctgctggggcccaggagcccggggagacagctgccagcgaggccgccagcagcagcctgcctgctgtggtggtggagaccttccctgccaccgtgaatggcaccgtggagggcggcagcggggccggccgcctggacctgcccccaggcttcatgttcaaggtgcaggcccagcacgactacacagccacagacacagatgagctgcagctgaaggctggagatgtggtgctggtgatccccttccagaaccctgaggagcaggatgagggctggctgatgggcgtgaaggagagtgactggaaccagcacaaggagctggagaagtgccggggcgtcttccctgagaacttcacagagcgggtgccctag

SEQ ID NO: 18637 - DNA, 1449 bp, Artificial Sequence
  Description of Artificial Sequence: Synthetic coding sequence
atggccgagatgggcagcaaaggagtgacagctgggaagatcgccagcaatgtgcagaagaagctgacccgggcccaggagaaggtgctgcagaagctgggcaaggcagatgagaccaaggatgagcagtttgagcagtgtgtgcagaacttcaacaagcagctgacagagggcacccggctgcagaaggacctgcggacctacctggcctctgtgaaggccatgcatgaggccagcaagaagctgaatgaatgtctgcaggaggtgtatgagccagactggccaggaagagatgaggccaacaagattgctgaaaataatgacctgctgtggatggactaccaccagaagctggtggaccaggccctgctgaccatggacacctacctgggccagttcccagacatcaagagccgcatcgccaagaggggcaggaagctggtggactatgacagcgcccggcaccactatgagagcctgcagacagccaagaagaaggatgaggccaagatcgccaaggccgaggaggagctgatcaaggcccagaaggtgtttgaggagatgaatgtggacctgcaggaggagctgcccagcctgtggaacagccgggtgggcttctacgtgaacaccttccagagcattgctggcctggaggagaacttccacaaggagatgagcaagctgaaccagaacctgaatgatgtgctggtgggcctggagaagcagcacggcagcaacaccttcaccgtgaaggcccagcccagcgacaatgccccagccaagggcaacaagagccccagccccccagatggcagccctgctgccaccccagagatccgggtgaaccacgagcctgagcctgctgggggcgccacccctggggccaccctgcccaagagccccagccagctgaggaagggcccccctgtgcccccaccacccaagcacacccccagcaaggaggtgaagcaggagcagatcctgagcctgtttgaggacacctttgtgcctgagatctctgtgaccacccccagccagcctgctgaggccagcgaggtggccggcggcacccagcctgctgctggggcccaggagcccggggagacagctgccagcgaggccgccagcagcagcctgcctgctgtggtggtggagaccttccctgccaccgtgaatggcaccgtggagggcggcagcggggccggccgcctggacctgcccccaggcttcatgttcaaggtgcaggcccagcacgactacacagccacagacacagatgagctgcagctgaaggctggagatgtggtgctggtgatccccttccagaaccctgaggagcaggatgagggctggctgatgggcgtgaaggagagtgactggaaccagcacaaggagctggagaagtgccggggcgtcttccctgagaacttcacagagcgggtgccctag

SEQ ID NO: 18638 - DNA, 1428 bp, Artificial Sequence
  Description of Artificial Sequence: Synthetic coding sequence
atggccgagatgggcagcaaaggagtgacagctgggaagatcgccagcaatgtgcagaagaagctgacccgggcccaggagaaggtgctgcagaagctgggcaaggcagatgagaccaaggatgagcagtttgagcagtgtgtgcagaacttcaacaagcagctgacagagggcacccggctgcagaaggacctgcggacctacctggcctctgtgaaggccatgcatgaggccagcaagaagctgaatgaatgtctgcaggaggtgtatgagccagactggccaggaagagatgaggccaacaagattgctgaaaataatgacctgctgtggatggactaccaccagaagctggtggaccaggccctgctgaccatggacacctacctgggccagttcccagacatcaagagccgcatcgccaagaggggcaggaagctggtggactatgacagcgcccggcaccactatgagagcctgcagacagccaagaagaaggatgaggccaagatcgccaaggccgaggaggagctgatcaaggcccagaaggtgtttgaggagatgaatgtggacctgcaggaggagctgcccagcctgtggaacagccgggtgggcttctacgtgaacaccttccagagcattgctggcctggaggagaacttccacaaggagatgagcaagctgaaccagaacctgaatgatgtgctggtgggcctggagaagcagcacggcagcaacaccttcaccgtgaaggcccagcccagcgacaatgccccagccaagggcaacaagagccccagccccccagatggcagccctgctgccaccccagagatccgggtgaaccacgagcctgagcctgctgggggcgccacccctggggccaccctgcccaagagccccagccagcccacagagagccctgctggcagcctgcccagcggggagcccagcgctgctgagggcacctttgctgtgtcctggcccagccagacagctgagcccggccctgcccagcctgctgaggccagcgaggtggccggcggcacccagcctgctgctggggcccaggagcctggagaaacagctgccagcgaggccgccagcagcagcctgcctgctgtggtggtggagaccttccctgccaccgtgaatggaacagtggagggcggcagcggggccggccgcctggacctgcccccaggcttcatgttcaaggtgcaggcccagcacgactacacagccacagacacagatgagctgcagctgaaggctggagatgtggtgctggtgatccccttccagaaccctgaggagcaggatgagggctggctgatgggcgtgaaggagagtgactggaaccagcacaaggagctggagaagtgccggggcgtcttccctgagaacttcacagagcgggtgccctag

SEQ ID NO: 18639 - DNA, 1320 bp, Artificial Sequence
  Description of Artificial Sequence: Synthetic coding sequence
atggccgagatgggcagcaaaggagtgacagctgggaagatcgccagcaatgtgcagaagaagctgacccgggcccaggagaaggtgctgcagaagctgggcaaggcagatgagaccaaggatgagcagtttgagcagtgtgtgcagaacttcaacaagcagctgacagagggcacccggctgcagaaggacctgcggacctacctggcctctgtgaaggccatgcatgaggccagcaagaagctgaatgaatgtctgcaggaggtgtatgagccagactggccaggaagagatgaggccaacaagattgctgaaaataatgacctgctgtggatggactaccaccagaagctggtggaccaggccctgctgaccatggacacctacctgggccagttcccagacatcaagagccgcatcgccaagaggggcaggaagctggtggactatgacagcgcccggcaccactatgagagcctgcagacagccaagaagaaggatgaggccaagatcgccaaggccgaggaggagctgatcaaggcccagaaggtgtttgaggagatgaatgtggacctgcaggaggagctgcccagcctgtggaacagccgggtgggcttctacgtgaacaccttccagagcattgctggcctggaggagaacttccacaaggagatgagcaagctgaaccagaacctgaatgatgtgctggtgggcctggagaagcagcacggcagcaacaccttcaccgtgaaggcccagcccagcgacaatgccccagccaagggcaacaagagccccagccccccagatggcagccctgctgccaccccagagatccgggtgaaccacgagcctgagcctgctgggggcgccacccctggggccaccctgcccaagagccccagccagcctgctgaggccagcgaggtggccggcggcacccagcctgctgctggggcccaggagcctggagaaacagctgccagcgaggccgccagcagcagcctgcctgctgtggtggtggagaccttccctgccaccgtgaatggaacagtggagggcggcagcggggccggccgcctggacctgcccccaggcttcatgttcaaggtgcaggcccagcacgactacacagccacagacacagatgagctgcagctgaaggctggagatgtggtgctggtgatccccttccagaaccctgaggagcaggatgagggctggctgatgggcgtgaaggagagtgactggaaccagcacaaggagctggagaagtgccggggcgtcttccctgagaacttcacagagcgggtgccctag

SEQ ID NO: 18640 - DNA, 1956 bp, Artificial Sequence
  Description of Artificial Sequence: Synthetic coding sequence
atgggcaagaagcacaagaagcacaagagtgacaagcacctgtatgaggagtatgtggagaagcccctgaagctggtgctgaaggtgggcggcaatgaggtgacagagctgagcacaggcagcagcggccatgacagcagcctgtttgaggacaagaatgaccatgacaagcacaaggacaggaagaggaagaagaggaagaagggggagaagcagatccctggagaggagaagggcaggaagagaagaagagtgaaggaggacaagaagaagagggaccgggacagagtggagaatgaagctgagaaggacctgcagtgccacgcccctgtgcggctggacctgcccccagagaagcccctgaccagcagcctggccaagcaggaggaggtggagcagacccccctgcaggaggccctgaaccagctgatgaggcagctgcagaggaaggaccccagcgccttcttctccttccctgtgacagacttcatcgcccctggctacagcatgatcatcaagcaccccatggacttcagcaccatgaaggagaagatcaagaacaatgactaccagagcattgaggagctgaaggacaacttcaagctgatgtgcaccaatgccatgatctacaacaagccagagaccatctactacaaggccgccaagaagctgctgcacagcggcatgaagatcctgagccaggagcgcatccagagcctgaagcagagcattgacttcatggctgacctgcagaagaccaggaagcagaaggatggaacagacaccagccagagcggagaagatggcggctgctggcagcgggagagagaagattctggagatgctgaggcccacgccttcaagagccccagcaaagaaaacaagaagaaggacaaggacatgctggaggacaagttcaagagcaacaacctggagcgggagcaggagcagctggacagaattgtgaaggagagcggcggcaagctgacccggcggctggtgaacagccagtgtgaatttgagaggaggaagccagatggcaccaccaccctgggcctgctgcaccctgtggaccccatcgtgggggagcccggctactgccctgtgcggctgggcatgaccaccggccgcctgcagagcggcgtgaacaccctgcagggcttcaaggaggacaagaggaacaaggtgacccctgtgctgtacctgaactacggcccctacagcagctatgccccccactatgacagcacctttgccaacatcagcaaggatgacagcgacctgatctacagcacctatggagaagattctgacctgcccagcgacttcagcatccacgagttcctggccacctgccaggactacccctacgtgatggctgacagcctgctggatgtgctgaccaagggcggccacagcaggaccctgcaggagatggagatgagcctgcctgaagatgagggccacaccaggaccctggacacagccaaggagatggagatcacagaggtggagcccccaggccgcctggacagcagcacccaggaccggctgattgccctgaaggctgtgaccaactttggagtgcctgtggaggtgtttgacagcgaggaggccgagatcttccagaagaagctggatgagaccacccggctgctgcgggagctgcaggaggcccagaatgaaaggctgagcacccggcccccacccaacatgatctgcctgctgggccccagctaccgggagatgcacctggccgagcaggtgaccaacaacctgaaggagctggcccagcaggtgacccctggggacatcgtgtccacctatggagtgaggaaggccatgggcatcagcatccccagccctgtgatggagaacaactttgtggacctgacagaggacacagaggagcccaagaagacagatgtggctgaatgtggccctgggggcagctag

SEQ ID NO: 18641 - DNA, 1959 bp, Artificial Sequence
  Description of Artificial Sequence: Synthetic coding sequence
atgggcaagaagcacaagaagcacaagagtgacaagcacctgtatgaggagtatgtggagaagcccctgaagctggtgctgaaggtgggcggcaatgaggtgacagagctgagcacaggcagcagcggccatgacagcagcctgtttgaggacaagaatgaccatgacaagcacaaggacaggaagaggaagaagaggaagaagggggagaagcagatccctggagaggagaagggcaggaagagaagaagagtgaaggaggacaagaagaagagggaccgggacagagtggagaatgaagctgagaaggacctgcagtgccacgcccctgtgcggctggacctgcccccagagaagcccctgaccagcagcctggccaagcaggaggaggtggagcagacccccctgcaggaggccctgaaccagctgatgaggcagctgcagaggaaggaccccagcgccttcttctccttccctgtgacagacttcatcgcccctggctacagcatgatcatcaagcaccccatggacttcagcaccatgaaggagaagatcaagaacaatgactaccagagcattgaggagctgaaggacaacttcaagctgatgtgcaccaatgccatgatctacaacaagccagagaccatctactacaaggccgccaagaagctgctgcacagcggcatgaagatcctgagccaggagcgcatccagagcctgaagcagagcattgacttcatggctgacctgcagaagaccaggaagcagaaggatggaacagacaccagccagagcggagaagatggcggctgctggcagcgggagagagaagattctggagatgctgaggcccacgccttcaagagccccagcaaagaaaacaagaagaaggacaaggacatgctggaggacaagttcaagagcaacaacctggagcgggagcaggagcagctggacagaattgtgaaggagagcggcggcaagctgacccggcggctggtgaacagccagtgtgaatttgagaggaggaagccagatggcaccaccaccctgggcctgctgcaccctgtggaccccatcgtgggggagcccggctactgccctgtgcggctgggcatgaccaccggccgcctgcagagcggcgtgaacaccctgcagggcttcaaggaggacaagaggaacaaggtgacccctgtgctgtacctgaactacggcccctacagcagctatgccccccactatgacagcacctttgccaacatcagcaaggatgacagcgacctgatctacagcacctatggagaagattctgacctgcccagcgacttcagcatccacgagttcctggccacctgccaggactacccctacgtgatggctgacagcctgctggatgtgctgaccaagggcggccacagcaggaccctgcaggagatggagatgagcctgcctgaagatgagggccacaccaggaccctggacacagccaaggagatggagcagatcacagaggtggagcccccaggccgcctggacagcagcacccaggacaggctcatcgccctgaaggctgtgaccaactttggagtgcctgtggaggtgtttgattctgaggaggccgagatcttccagaagaagctggatgagaccacccggctgctgcgggagctgcaggaggcccagaatgaaaggctgagcacccggcccccacccaacatgatctgcctgctgggccccagctaccgggagatgcacctggccgagcaggtgaccaacaacctgaaggagctggcccagcaggtgacccctggggacatcgtgtccacctacggcgtgaggaaggccatgggcatcagcatccccagccctgtgatggagaacaactttgtggacctgacagaggacacagaggagcccaagaagacagatgtggccgagtgtggccctgggggcagctag

SEQ ID NO: 18642 - DNA, 1959 bp, Artificial Sequence; identical to SEQ ID NO: 18641
  Description of Artificial Sequence: Synthetic coding sequence

SEQ ID NO: 18643 - DNA, 1980 bp, Artificial Sequence
  Description of Artificial Sequence: Synthetic coding sequence
atggctgctgtgatcctggagagcatcttcctgaagaggagccagcagaagaagaagaccagccccctgaacttcaagaagaggctcttcctgctgactgtgcacaagctgagctactatgaatatgactttgagcggggccggcggggcagcaagaagggcagcattgatgtggagaagatcacctgtgtggagaccgtggtgcctgagaagaaccccccacctgagcggcagatccccaggagaggagaggagagcagcgagatggagcagatcagcatcatcgagcgcttcccctaccccttccaggtggtgtatgatgagggccccctgtatgtgttcagccccacagaggagctgaggaagcgctggatccaccagctgaagaatgtcatccgctacaacagcgacctggtgcagaagtaccacccctgcttctggattgatggccagtacctgtgctgcagccagacagccaagaatgccatgggctgccagatcctggagaacagaaatggcagcctgaagccaggcagcagccacaggaagaccaagaagcccctgccccccaccccagaggaggaccagatcctgaagaagcccctgcccccagagcctgctgctgcccctgtgtccaccagcgagctgaagaaggtggtggccctgtatgactacatgcccatgaatgccaatgacctgcagctgaggaaaggagatgagtacttcatcctggaggagagcaacctgccctggtggagggcccgggacaagaatggccaggagggctacatccccagcaactacgtgacagaagcagaagattccattgagatgtatgagtggtacagcaagcacatgaccaggagccaggccgagcagctgctgaagcaggagggcaaggagggcggcttcatcgtgcgggacagcagcaaggccggcaagtacacagtgtctgtgtttgccaagagcactggagacccccagggcgtcatccgccactacgtggtgtgcagcaccccccagagccagtactacctggccgagaagcacctgttcagcaccatccctgagctgatcaactaccaccagcacaacagcgctggcctcatcagccggctgaagtaccctgtgtcccagcagaacaagaatgcccccagcacagctggcctgggctacggctcctgggagattgaccccaaggacctgaccttcctgaaggagctgggcaccggccagtttggagtggtgaagtatggcaagtggaggggccagtatgatgtggccatcaagatgatcaaggagggctccatgtctgaagatgagttcatcgaggaggccaaggtgatgatgaacctgagccatgagaagctggtgcagctgtatggagtgtgcaccaagcagaggcccatcttcatcatcacagagtacatggccaacggctgcctgctgaactacctgcgggagatgaggcaccgcttccagacccagcagctgctggagatgtgcaaggatgtgtgtgaggccatggagtacctggagagcaagcagttcctgcaccgggacctggccgccaggaactgcctggtgaatgaccagggcgtggtgaaggtgtctgactttggcctgagccgctacgtgctggatgatgagtacaccagctctgtgggcagcaagtttcctgtgcgctggagccccccagaggtgctgatgtacagcaagttcagcagcaagagtgacatctgggcctttggagtgctgatgtgggagatctacagcctgggcaagatgccctatgagcgcttcaccaacagcgagacagctgagcacatcgcccagggcctgcggctgtaccggccccacctggccagcgagaaggtgtacaccatcatgtacagctgctggcatgagaaggcagatgagcggcccaccttcaagatcctgctgagcaacatcctggatgtgatggatgaggagagctag

SEQ ID NO: 18644 - DNA, 627 bp, Artificial Sequence
  Description of Artificial Sequence: Synthetic coding sequence
gtcatccgccactacgtggtgtgcagcaccccccagagccagtactacctggccgagaagcacctgttcagcaccatccctgagctgatcaactaccaccagcacaacagcgctggcctcatcagcaggacccagcagctgctggagatgtgcaaggatgtgtgtgaggccatggagtacctggagagcaagcagttcctgcaccgggacctggccgccaggaactgcctggtgaatgaccagggcgtggtgaaggtgtctgactttggcctgagccgctacgtgctggatgatgagtacaccagctctgtgggcagcaagtttcctgtgcgctggagccccccagaggtgctgatgtacagcaagttcagcagcaagagtgacatctgggccttcggcgtgctgatgtgggagatctacagcctgggcaagatgccctatgagcgcttcaccaacagcgagacagctgagcacatcgcccagggcctgcggctgtaccggccccacctggccagcgagaaggtgtacaccatcatgtacagctgctggcatgagaaggcagatgagcggcccaccttcaagatcctgctgagcaacatcctggatgtgatggatgaggagagctag

SEQ ID NO: 18645 - DNA, 420 bp, Artificial Sequence
  Description of Artificial Sequence: Synthetic coding sequence
gtcatccgccactacgtggtgtgcagcaccccccagagccagtactacctggccgagaagcacctgttcagcaccatccctgagctgatcaactaccaccagcacaacagcgctggcctcatcagccggctgaagtaccctgtgtcccagcagaacaagaatgcccccagcacagctggcctgggctatggagtgctgatgtgggagatctacagcctgggcaagatgccctatgagcgcttcaccaacagcgagacagctgagcacatcgcccagggcctgcggctgtaccggccccacctggccagcgagaaggtgtacaccatcatgtacagctgctggcatgagaaggcagatgagcggcccaccttcaagatcctgctgagcaacatcctggatgtgatggatgaggagagctag

SEQ ID NO: 18646 - DNA, 705 bp, Artificial Sequence
  Description of Artificial Sequence: Synthetic coding sequence
cgccactacgtggtgtgcagcaccccccagagccagtactacctggccgagaagcacctgttcagcaccatccctgagctgatcaactaccaccagcacaacagcgctggcctcatcagccggctgaagtaccctgtgtcccagcagaacaagaatgcccccagcacagctggcctgggctacggctcctgggagattgaccccaaggacctgaccttcctgaaggagctgggcaccggccagtttggagtggtgaagtatggcaagtggaggggccagtatgatgtggccatcaagatgatcaaggagggctccatgtctgaagatgagttcatcgaggaggccaaggtgatgatgtatgtgctggatgatgagtacaccagctctgtgggcagcaagtttcctgtgcgctggagccccccagaggtgctgatgtacagcaagttcagcagcaagagtgacatctgggccttcggcgtgctgatgtgggagatctacagcctgggcaagatgccctatgagcgcttcaccaacagcgagacagctgagcacatcgcccagggcctgcggctgtaccggccccacctggccagcgagaaggtgtacaccatcatgtacagctgctggcatgagaaggcagatgagcggcccaccttcaagatcctgctgagcaacatcctggatgtgatggatgaggagagctag

SEQ ID NO: 18647 - DNA, 225 bp, Artificial Sequence
  Description of Artificial Sequence: Synthetic coding sequence
gtcatccgccactacgtggtgtgcagcaccccccagagccagtactacctggccgagaagcacctgttcagcaccatccctgagctgatcaactaccaccagcacaacagcgctggcctcatcagccggctgaagtaccctgtgtcccagcagaacaagaatgcccccagcacagctggcctgggctacggcatgtcctggatgatgaacacccaggcccagtag

SEQ ID NO: 18648 - DNA, 1452 bp, Artificial Sequence
  Description of Artificial Sequence: Synthetic coding sequence
atggctgctgtgatcctggagagcatcttcctgaagaggagccagcagaagaagaagaccagccccctgaacttcaagaagaggctcttcctgctgactgtgcacaagctgagctactatgaatatgactttgagcggggccggcggggcagcaagaagggcagcattgatgtggagaagatcacctgtgtggagaccgtggtgcctgagaagaaccccccacctgagcggcagatccccaggagaggagaggagagcagcgagatggagcagatcagcatcatcgagcgcttcccctaccccttccaggtggtgtatgatgagggccccctgtatgtgttcagccccacagaggagctgaggaagcgctggatccaccagctgaagaatgtcatccgctacaacagcgacctggtgcagaagtaccacccctgcttctggattgatggccagtacctgtgctgcagccagacagccaagaatgccatgggctgccagatcctggagaacagaaatggcagcctgaagccaggcagcagccacaggaagaccaagaagcccctgccccccaccccagaggaggaccagatcctgaagaagcccctgcccccagagcctgctgctgcccctgtgtccaccagcgagctgaagaaggtggtggccctgtatgactacatgcccatgaatgccaatgacctgcagctgaggaaaggagatgagtacttcatcctggaggagagcaacctgccctggtggagggcccgggacaagaatggccaggagggctacatccccagcaactacgtgacagaagcagaagattccattgagatgtatgagtggtacagcaagcacatgaccaggagccaggccgagcagctgctgaagcaggagggcaaggagggcggcttcatcgtgcgggacagcagcaaggccggcaagtacacagtgtctgtgtttgccaagagcactggagacccccagggcgtcatccgccactacgtggtgtgcagcaccccccagagccagtactacctggccgccaggaactgcctggtgaatgaccagggcgtggtgaaggtgtctgactttggcctgagccgctacgtgctggatgatgagtacaccagctctgtgggcagcaagtttcctgtgcgctggagccccccagaggtgctgatgtacagcaagttcagcagcaagagtgacatctgggcctttggagtgctgatgtgggagatctacagcctgggcaagatgccctatgagcgcttcaccaacagcgagacagctgagcacatcgcccagggcctgcggctgtaccggccccacctggccagcgagaaggtgtacaccatcatgtacagctgctggcatgagaaggcagatgagcggcccaccttcaagatcctgctgagcaacatcctggatgtgatggatgaggagagctag

SEQ ID NO: 18649 - DNA, 519 bp, Artificial Sequence
  Description of Artificial Sequence: Synthetic coding sequence
gtcatccgccactacgtggtgtgcagcaccccccagagccagtactacctggccgagaagcacctgttcagcaccatccctgagctgatcaactaccaccagcacaacagcgctggcctcatcagccggctgaagtaccctgtgtcccagcagaacaagaatgcccccagcacagctggcctgggctacggctcctgggagattgaccccaaggacctgaccttcctgaaggagctgggcaccggccagtttggagtggtgaagtatggcaagtggaggggccagtatgatgtggccatcaagatgatcaaggagggctccatgtctgaagatgagttcatcgaggaggccaaggtgatgatgaacctgagccatgagaagctggtgcagctgtatggagtgtgcaccaagcagaggcccatcttcatcatcacagagtacatggccaacggctgcctgccctgcaccgtggccggcatgaggaagcagatgtctgtgcccctgagcaagttcttctag

SEQ ID NO: 18650 - DNA, 594 bp, Artificial Sequence
  Description of Artificial Sequence: Synthetic coding sequence
gtcatccgccactacgtggtgtgcagcaccccccagagccagtactacctggccgagaagcacctgttcagcaccatccctgagctgatcaactaccaccagcacaacagcgctggcctcatcagccggctgaagtaccctgtgtcccagcagaacaagaatgcccccagcacagctggcctgggctacggctcctgggagattgaccccaaggacctgaccttcctgaaggagctgggcaccggccagtttggagtggtgaagtatggcaagtggaggggccagtatgatgtggccatcaagatgatcaaggagggctccatgtctgaagatgagttcatcgaggaggccaaggtgatgatgaacctgagccatgagaagctggtgcagctgtatggagtgtgcaccaagcagaggcccatcttcatcatcacagagtacatggccaacggctgcctgctgaactacctgcgggagatgaggcaccgcttccagacccagcagctgctggagatgtgcaaggatgtgtgtgaggccatggagtacctggagagcaagcagttcctgcaccgggacctggtgtgccccggctag

SEQ ID NO: 18651 - DNA, 156 bp, Artificial Sequence
  Description of Artificial Sequence: Synthetic coding sequence
atccgccactacgtggtgtgcagcaccccccagagccagtactacctggccgagaagcacctgttcagcaccatccctgagctgatcaactaccaccagcacaacagcgctggagaagattctgctgctgccagagatgtgcagggctgcctgtag

SEQ ID NO: 18652 - DNA, 891 bp, Artificial Sequence
  Description of Artificial Sequence: Synthetic coding sequence
atgaagaatgaaattgctgctgtggtgttcttcttcacccggctggtgaggaagcatgacaagctgaagaaggaggccgtggagagatttgctgagaagctgaccctcatcctgcaggagaagtacaagaaccactggtacccagagaagcccagcaagggccaggcctaccgctgcatccgggtgaacaagttccagagggtggaccctgatgtgctgaaggcctgtgagaacagctgcatcctgtacagcgacctgggcctgcccaaggagctgaccctgtgggtggacccctgtgaggtgtgctgcagaagagatggagtgagcccctgctggccagactgcagccagaccccagacctggtgatccggcccccctggccacccaaggccctggactacagaagagagcccctgcggcctgccagcagcttcctgatcatgtatggagagaagaacaatgccttcatcgtggccagctttgagaacaaggatgagaacaaggatgagatcagcaggaaggtgacccgggccctggacaaggtgaccagtgactaccacagcggcagcagcagcagtgatgaggagaccagcaaggagatggaggtgaagcccagctctgtgacagctgctgccagccctgtgtaccagatcagcgagctgatcttcccccccctgcccatgtggcaccccctgcccaggaagaagccaggcatgtacagaggaaatggccaccagaaccactacccacctcctgtgcccttcggctaccccaaccagggcaggaagaacaagccctaccggcccatccctgtgacctgggtgcccccacctggcatgcactgtgacaggaaccactggatcaacccccacatgctggccccccactag

SEQ ID NO: 18653 - DNA, 759 bp, Artificial Sequence
  Description of Artificial Sequence: Synthetic coding sequence
atgaagaatgaaattgctgctgtggtgttcttcttcacccggctggtgaggaagcatgacaagctgaagaaggaggccgtggagagatttgctgagaagctgaccctcatcctgcaggagaagtacaagaaccactggtacccagagaagcccagcaagggccaggcctaccgctgcatccgggtgaacaagttccagagggtggaccctgatgtgctgaaggcctgtgagaacagctgcatcctgtacagcgacctgggcctgcccaaggagctgaccctgtgggtggacccctgtgaggtgtgctgccgctatggagagaagaacaatgccttcatcgtggccagctttgagaacaaggatgagaacaaggatgagatcagcaggaaggtgacccgggccctggacaaggtgaccagtgactaccacagcggcagcagcagcagtgatgaggagaccagcaaggagatggaggtgaagcccagctctgtgacagctgctgccagccctgtgtaccagatcagcgagctgatcttcccccccctgcccatgtggcaccccctgcccaggaagaagccaggcatgtacagaggaaatggccaccagaaccactacccacctcctgtgcccttcggctaccccaaccagggcaggaagaacaagccctaccggcccatccctgtgacctgggtgcccccacctggcatgcactgtgacaggaaccactggatcaacccccacatgctggccccccactag

SEQ ID NO: 18654 - DNA, 141 bp, Artificial Sequence
  Description of Artificial Sequence: Synthetic coding sequence
atgaagaatgaaattgctgctgtggtgttcttcttcacccggctggtgaggaagcatgacaagctgaagaaggaggccgtggagagatttgctgagaagctgaccctcatcctgcaggagaagtacaagaaccactggtag

SEQ ID NO: 18655 - DNA, 1560 bp, Artificial Sequence
  Description of Artificial Sequence: Synthetic coding sequence
atgatgtctgaacatgacctggctgatgtggtgcagattgctgtggaggacctgagcccagaccaccctgtggtgctggagaaccacgtggtgacagatgaagatgagcccgccctgaagaggcagaggctggagatcaactgccaggaccccagcatcaagaccatctgcctgcggctggacagcattgaggccaagctgcaggccctggaggccacctgcaagagcctggaggagaagctggacctggtgaccaacaagcagcacagccccatccaggtgcccatggtggccggcagccccctgggcgccacccagacctgcaacaaggtgcgctgtgtggtgccccagaccaccgtcatcctgaacaatgaccggcagaatgccatcgtggccaagatggaggaccccctgagcaacagagccccagacagcctggagaatgtcatcagcaatgctgtgcctggaagacggcagaacaccatcgtggtgaaggtgcccggccaggaggacagccaccatgaagatggagagagcggcagcgaggccagtgacagcgtgagcagctgtggccaggccggcagccagagcatcggcagcaatgtgaccctcatcaccctgaacagcgaggaggactacccaaatggcacctggctgggagatgagaacaaccctgagatgagggtgcgctgtgccatcatccccagcgacatgctgcacatcagcaccaactgcaggacagctgagaagatggccctgaccctgctggactacctgttccaccgggaggtgcaggccgtgagcaacctgagcggccagggcaagcacggcaagaagcagctggaccccctgaccatctacggcatccgctgccacctgttctacaagtttggcatcacagaaagtgactggtaccgcatcaagcagagcattgacagcaagtgcaggacagcctggaggaggaagcagaggggccagagcctggccgtgaagagcttcagcaggaggacccccaacagcagcagctactgccccagcgagcccatgatgagcaccccacctccagccagcgagctgccccagccccagccccagccccaggccctgcactacgccctggccaatgcccagcaggtgcagatccaccagatcggggaggatggccaggtgcaggtgggccacctgcacatcgcccaggtgccccagggcgagcaggtgcagatcacccaggacagcgagggcaacctgcagatccaccacgtgggccaggacggccagctgctggaggccacccgcatcccctgcctgctggcccccagcgtcttcaaggccagcagcggccaggtgctgcagggcgcccagctgattgctgtggccagcagtgaccctgctgctgctggggtggatggcagccccctgcagggcagtgacatccaggtgcagtatgtgcagctggcccctgtgtctgaccacacagctggggcccagacagctgaggccctgcagcccaccctgcagcctgagatgcagctggagcacggggccatccagatccagtag

SEQ ID NO: 18656 - DNA, 1398 bp, Artificial Sequence
  Description of Artificial Sequence: Synthetic coding sequence
atgatgtctgaacatgacctggctgatgtggtgcagattgctgtggaggacctgagcccagaccaccctgtggtgctggagaaccacgtggtgacagatgaagatgagcccgccctgaagaggcagaggctggagatcaactgccaggaccccagcatcaagagcttcctgtacagcatcaaccagaccatctgcctgcggctggacagcattgaggccaagctgcaggccctggaggccacctgcaagagcctggaggagaagctggacctggtgaccaacaagcagcacagccccatccaggtgcccatggtggccggcagccccctgggcgccacccagacctgcaatgctgtgcccggccggcggcagaacaccatcgtggtgaaggtgcccggccaggaggacagccaccatgaagatggagagagcggcagcgaggccagtgacagcgtgagcagctgtggccaggccggcagccagagcatcggcagcaatgtgaccctcatcaccctgaacagcgaggaggactaccccaacggcacctggctgggagatgagaacaaccctgagatgagggtgcgctgtgccatcatccccagcgacatgctgcacatcagcaccaactgcaggacagctgagaagatggccctgaccctgctggactacctgttccaccgggaggtgcaggccgtgagcaacctgagcggccagggcaagcacggcaagaagcagctggaccccctgaccatctacggcatccgctgccacctgttctacaagtttggcatcacagaaagtgactggtaccgcatcaagcagagcattgacagcaaatgtagaacagcctggaggaggaagcagaggggccagagcctggccgtgaagagcttcagcaggaggacccccaacagcagcagctactgccccagcgagcccatgatgagcaccccacctccagccagcgagctgccccagccccagccccagccccaggccctgcactacgccctggccaatgcccagcaggtgcagatccaccagattggagaagatggccaggtgcaggtgatcccccagggccacctgcacatcgcccaggtgccccagggcgagcaggtgcagatcacccaggacagcgagggcaacctgcagatccaccacgtgggccaggacggccaggtgctgcagggcgcccagctgattgctgtggccagcagtgaccctgctgctgctggggtggatggcagccccctgcagggcagtgacatccaggtgcagtatgtgcagctggcccctgtgtctgaccacacagctggggcccagacagctgaggccctgcagcccaccctgcagcctgagatgcagctggagcacggggccatccagatccagtag

SEQ ID NO: 18657 - DNA, 1410 bp, Artificial Sequence
  Description of Artificial Sequence: Synthetic coding sequence
atgatgtctgaacatgacctggctgatgtggtgcagattgctgtggaggacctgagcccagaccaccctgtggtgctggagaaccacgtggtgacagatgaagatgagcccgccctgaagaggcagaggctggagatcaactgccaggaccccagcatcaagagcttcctgtacagcatcaaccagaccatctgcctgcggctggacagcattgaggccaagctgcaggccctggaggccacctgcaagagcctggaggagaagctggacctggtgaccaacaagcagcacagccccatccaggtgcccatggtggccggcagccccctgggcgccacccagacctgcaacaaggtgcgctgtgctgtgcccggccggcggcagaacaccatcgtggtgaaggtgcccggccaggaggacagccaccatgaagatggagagagcggcagcgaggccagtgacagcgtgagcagctgtggccaggccggcagccagagcatcggcagcaatgtgaccctcatcaccctgaacagcgaggaggactaccccaacggcacctggctgggagatgagaacaaccctgagatgagggtgcgctgtgccatcatccccagcgacatgctgcacatcagcaccaactgcaggacagctgagaagatggccctgaccctgctggactacctgttccaccgggaggtgcaggccgtgagcaacctgagcggccagggcaagcacggcaagaagcagctggaccccctgaccatctacggcatccgctgccacctgttctacaagtttggcatcacagaaagtgactggtaccgcatcaagcagagcattgacagcaaatgtagaacagcctggaggaggaagcagaggggccagagcctggccgtgaagagcttcagcaggaggacccccaacagcagcagctactgccccagcgagcccatgatgagcaccccacctccagccagcgagctgccccagccccagccccagccccaggccctgcactacgccctggccaatgcccagcaggtgcagatccaccagattggagaagatggccaggtgcaggtgatcccccagggccacctgcacatcgcccaggtgccccagggcgagcaggtgcagatcacccaggacagcgagggcaacctgcagatccaccacgtgggccaggacggccaggtgctgcagggcgcccagctgattgctgtggccagcagtgaccctgctgctgctggggtggatggcagccccctgcagggcagtgacatccaggtgcagtatgtgcagctggcccctgtgtctgaccacacagctggggcccagacagctgaggccctgcagcccaccctgcagcctgagatgcagctggagcacggggccatccagatccagtag

SEQ ID NO: 18658 - DNA, 1494 bp, Artificial Sequence
  Description of Artificial Sequence: Synthetic coding sequence
atgatgtctgaacatgacctggctgatgtggtgcagattgctgtggaggacctgagcccagaccaccctggaacagagctgtgggacatcgtgctggagaaccacgtggtgacagatgaagatgagcccgccctgaagaggcagaggctggagatcaactgccaggaccccagcatcaagagcttcctgtacagcatcaaccagaccatctgcctgcggctggacagcattgaggccaagctgcaggccctggaggccacctgcaagagcctggaggagaagctggacctggtgaccaacaagcagcacagccccatccaggtgcccatggtggccggcagccccctgggcgccacccagacctgcaacaaggtgcgctgtgctgtgcccggccggcggcagaacaccatcgtggtgaaggtgcccggccaggaggacagccaccatgaagatggagagagcggcagcgaggccagtgacagcgtgagcagctgtggccaggccggcagccagagcatcggcagcaatgtgaccctcatcaccctgaacagcgaggaggactaccccaacggcacctggctgggagatgagaacaaccctgagatgagggtgcgctgtgccatcatccccagcgacatgctgcacatcagcaccaactgcaggacagctgagaagatggccctgaccctgctggactacctgttccaccgggaggtgcaggccgtgagcaacctgagcggccagggcaagcacggcaagaagcagctggaccccctgaccatctacggcatccgctgccacctgttctacaagtttggcatcacagaaagtgactggtaccgcatcaagcagagcattgacagcaaatgtagaacagcctggaggaggaagcagaggggccagagcctggccgtgaagagcttcagcaggaggacccccaacagcagcagctactgccccagcgagcccatgatgagcaccccacctccagccagcgagctgccccagccccagccccagccccaggccctgcactacgccctggccaatgcccagcaggtgcagatccaccagattggagaagatggccaggtgcaggtgatcccccagggccacctgcacatcgcccaggtgccccagggcgagcaggtgcagatcacccaggacagcgagggcaacctgcagatccaccacgtgggccaggacggccagctgctggaggccacccgcatcccctgcctgctggcccccagcgtcttcaaggccagcagcggccaggtgctgcagggcgcccagctgattgctgtggccagcagtgaccctgctgctgctggggtggatggcagccccctgcagggcagtgacatccaggtgcagtatgtgcagctggcccctgtgtctgaccacacagctggggcccagacagctgaggccctgcagcccaccctgcagcctgagatgcagctggagcacggggccatccagatccagtag

SEQ ID NO: 18659 - DNA, 1560 bp, Artificial Sequence; identical to SEQ ID NO: 18655
  Description of Artificial Sequence: Synthetic coding sequence

SEQ ID NO: 18660 - DNA, 1476 bp, Artificial Sequence
  Description of Artificial Sequence: Synthetic coding sequence
atgatgtctgaacatgacctggctgatgtggtgcagattgctgtggaggacctgagcccagaccaccctgtggtgctggagaaccacgtggtgacagatgaagatgagcccgccctgaagaggcagaggctggagatcaactgccaggaccccagcatcaagagcttcctgtacagcatcaaccagaccatctgcctgcggctggacagcattgaggccaagctgcaggccctggaggccacctgcaagagcctggaggagaagctggacctggtgaccaacaagcagcacagccccatccaggtgcccatggtggccggcagccccctgggcgccacccagacctgcaacaaggtgcgctgtgctgtgcccggccggcggcagaacaccatcgtggtgaaggtgcccggccaggaggacagccaccatgaagatggagagagcggcagcgaggccagtgacagcgtgagcagctgtggccaggccggcagccagagcatcggcagcaatgtgaccctcatcaccctgaacagcgaggaggactaccccaacggcacctggctgggagatgagaacaaccctgagatgagggtgcgctgtgccatcatccccagcgacatgctgcacatcagcaccaactgcaggacagctgagaagatggccctgaccctgctggactacctgttccaccgggaggtgcaggccgtgagcaacctgagcggccagggcaagcacggcaagaagcagctggaccccctgaccatctacggcatccgctgccacctgttctacaagtttggcatcacagaaagtgactggtaccgcatcaagcagagcattgacagcaaatgtagaacagcctggaggaggaagcagaggggccagagcctggccgtgaagagcttcagcaggaggacccccaacagcagcagctactgccccagcgagcccatgatgagcaccccacctccagccagcgagctgccccagccccagccccagccccaggccctgcactacgccctggccaatgcccagcaggtgcagatccaccagattggagaagatggccaggtgcaggtgatcccccagggccacctgcacatcgcccaggtgccccagggcgagcaggtgcagatcacccaggacagcgagggcaacctgcagatccaccacgtgggccaggacggccagctgctggaggccacccgcatcccctgcctgctggcccccagcgtcttcaaggccagcagcggccaggtgctgcagggcgcccagctgattgctgtggccagcagtgaccctgctgctgctggggtggatggcagccccctgcagggcagtgacatccaggtgcagtatgtgcagctggcccctgtgtctgaccacacagctggggcccagacagctgaggccctgcagcccaccctgcagcctgagatgcagctggagcacggggccatccagatccagtag

SEQ ID NO: 18661 - DNA, 357 bp, Artificial Sequence
  Description of Artificial Sequence: Synthetic coding sequence
atgatgtctgaacatgacctggctgatgtggtgcagattgctgtggaggacctgagcccagaccaccctgtggtgctggagaaccacgtggtgacagatgaagatgagcccgccctgaagaggcagaggctggagatcaactgccaggaccccagcatcaagagcttcctgtacagcatcaaccagaccatctgcctgcggctggacagcattgaggccaagctgcaggccctggaggccacctgcaagagcctggaggagaagctggacctggtgaccaacaagcagcacagccccatccaggtgcccatggtggccggcagccccctgggcgccacccagacctgcaacaagtag

SEQ ID NO: 18662 - DNA, 87 bp, Artificial Sequence
  Description of Artificial Sequence: Synthetic coding sequence
atgatgtctgaacatgacctggctgatgtggtgcagattgctgtggaggacctgagcccagaccaccctgtggtgctggagaactag

SEQ ID NO: 18663 - DNA, 288 bp, Artificial Sequence
  Description of Artificial Sequence: Synthetic coding sequence
atgatgtctgaacatgacctggctgatgtggtgcagattgctgtggaggacctgagcccagaccaccctgtggtgctggagaaccacgtggtgacagatgaagatgagcccgccctgaagaggcagaggctggagatcaactgccaggaccccagcatcaagagcttcctgtacagcatcaaccagaccatctgcctgcggctggacagcattgaggccaagctgcaggccctggaggccacctgcaagagcctggaggagaagctggacctggtgaccaacaagtag

SEQ ID NO: 18664 - DNA, 372 bp, Artificial Sequence
  Description of Artificial Sequence: Synthetic coding sequence
atgatgtctgaacatgacctggctgatgtggtgcagattgctgtggaggacctgagcccagaccaccctgtggtgctggagaaccacgtggtgacagatgaagatgagcccgccctgaagaggcagaggctggagatcaactgccaggaccccagcatcaagagcttcctgtacagcatcaaccagaccatctgcctgcggctggacagcattgaggccaagctgcaggccctggaggccacctgcaagagcctggaggagaagctggacctggtgaccaacaagcagcacagccccatccaggtgcccatggtggccggcagccccctgggcgccacccagacctgcaacaaggtgcgctgtgtggtgtag

SEQ ID NO: 18665 - DNA, 588 bp, Artificial Sequence
  Description of Artificial Sequence: Synthetic coding sequence
atgatgtctgaacatgacctggctgatgtggtgcagattgctgtggaggacctgagcccagaccaccctggaacagagctgtgggacatcgtgctggagaaccacgtggtgacagatgaagatgagcccgccctgaagaggcagaggctggagatcaactgccaggaccccagcatcaagagcttcctgtacagcatcaaccagaccatctgcctgcggctggacagcattgaggccaagctgcaggccctggaggccacctgcaagagcctggaggagaagctggacctggtgaccaacaagcagcacagccccatccaggtgcccatggtggccggcagccccctgggcgccacccagacctgcaacaaggtgcgctgtgctgtgcccggccggcggcagaacaccatcgtggtgaaggtgcccggccaggaggacagccaccatgaagatggagagagcggcagcgaggccagtgacagcgtgagcagctgtggccaggccggcagccagagcatcggcagcaatgtgaccctcatcaccctgaacagcgaggaggactaccccaacggcacctggctgggctag

SEQ ID NO: 18666 - DNA, 360 bp, Artificial Sequence
  Description of Artificial Sequence: Synthetic coding sequence
atgatgtctgaacatgacctggctgatgtggtgcagattgctgtggaggacctgagcccagaccaccctgtggtgctggagaaccacgtggtgacagatgaagatgagcccgccctgaagaggcagaggctggagatcaactgccaggaccccagcatcaagagcttcctgtacagcatcaaccagaccatctgcctgcggctggacagcattgaggccaagctgcaggccctggaggccacctgcaagagcctggaggagaagctggacctggtgaccaacaagcagcacagccccatccaggtgcccatggtggccggcagccccctgggcgccacccagacctgcaacaaggtgtag

SEQ ID NO: 18667 - DNA, 1401 bp, Artificial Sequence
  Description of Artificial Sequence: Synthetic coding sequence
atgatgtctgaacatgacctggctgatgtggtgcagattgctgtggaggacctgagcccagaccaccctgtggtgctggagaaccacgtggtgacagatgaagatgagcccgccctgaagaggcagaggctggagatcaactgccaggaccccagcatcaagagcttcctgtacagcatcaaccagaccatctgcctgcggctggacagcattgaggccaagctgcaggccctggaggccacctgcaagagcctggaggagaagctggacctggtgaccaacaagcagcacagccccatccaggtgcccatggtggccggcagccccctgggcgccacccagacctgcaacaaggtgcgctgtgctgtgcccggccggcggcagaacaccatcgtggtgaaggtgcccggccaggaggacagccaccatgaagatggagagagcggcagcgaggccagtgacagcgtgagcagctgtggccaggccggcagccagagcatcggcagcaatgtgaccctcatcaccctgaacagcgaggaggactaccccaacggcacctggctgggagatgagaacaaccctgagatgagggtgcgctgtgccatcatccccagcgacatgctgcacatcagcaccaactgcaggacagctgagaagatggccctgaccctgctggactacctgttccaccgggaggtgcaggccgtgagcaacctgagcggccagggcaagcacggcaagaagcagctggaccccctgaccatctacggcatccgctgccacctgttctacaagtttggcatcacagaaagtgactggtaccgcatcaagcagagcattgacagcaaatgtagaacagcctggaggaggaagcagaggggccagagcctggccgtgaagagcttcagcaggaggacccccaacagcagcagctactgccccagcgagcccatgatgagcaccccacctccagccagcgagctgccccagccccagccccagccccaggccctgcactacgccctggccaatgcccagcaggtgcagatccaccagattggagaagatggccaggtgcaggtgggccacctgcacatcgcccaggtgccccagggcgagcaggtgcagatcacccaggacagcgagggcaacctgcagatccaccacgtgggccaggacggccaggtgctgcagggcgcccagctgattgctgtggccagcagtgaccctgctgctgctggggtggatggcagccccctgcagggcagtgacatccaggtgcagtatgtgcagctggcccctgtgtctgaccacacagctggggcccagacagctgaggccctgcagcccaccctgcagcctgagatgcagctggagcacggggccatccagatccagtag

SEQ ID NO: 18668 - DNA, 753 bp, Artificial Sequence
  Description of Artificial Sequence: Synthetic coding sequence
atgggcagccctgagcccacccagggcccccggctgagccccatcctgatcccctacagcggccgccgctacaaggtgggccgggccagcggggccctgtgccaccaggacagcctgccccccatcctggagctgggcctgaccttcctgcgggccagcgctggcttctctgtgcccaccagcagcagctttgccctgcctgagcccctgcggagcctgtgcctgggcaatggagagggcctgggcctgagcctgaccctgactgtgctggcctggatcctgggcctgagcggcaccctgggcgccctggtgctcttcatggtggccaccggcatcttccaggaggccctgtggcacctgctgctgctgtccttctctgtggaggccctgccctgcttcttcttcttccccttcttcctgctgtgccgctgcctgcgggcagagctgcagatccagcagaggctggatggcaccctgagcctggacctgatgaggctggagagtgatggagagaccggctgtgccgctgagagctctgtgctgcagggcgcccagctgattgctgtggccagcagtgaccctgctgctgctggggtggatggcagccccctgcagggcagtgacatccaggtgcagtatgtgcagctggcccctgtgtctgaccacacagctggggcccagacagctgaggccctgcagcccaccctgcagcctgagatgcagctggagcacggggccatccagatccagtag

SEQ ID NO: 18669 - DNA, 1527 bp, Artificial Sequence
  Description of Artificial Sequence: Synthetic coding sequence
atgatgtctgaacatgacctggctgatgtggtgcagattgctgtggaggacctgagcccagaccaccctgtggtgctggagaaccacgtggtgacagatgaagatgagcccgccctgaagaggcagaggctggagatcaactgccaggaccccagcatcaagagcttcctgtacagcatcaaccagaccatctgcctgcggctggacagcattgaggccaagctgcaggccctggaggccacctgcaagagcctggaggagaagctggacctggtgaccaacaagcagcacagccccatccaggtgcccatggtggccggcagccccctgggcgccacccagacctgcaacaaggtgcgctgtgtggtgccccagaccaccgtcatcctgaacaatgaccggcagaatgccatcgtggccaagatggaggaccccctgagcaacagagccccagacagcctggagaatgtcatcagcaatgctgtgcctggaagacggcagaacaccatcgtggtgaaggtgcccggccaggaggacagccaccatgaagatggagagagcggcagcgaggccagtgacagcgtgagcagctgtggccaggccggcagccagagcatcggcagcaatgtgaccctcatcaccctgaacagcgaggaggactacccaaatggcacctggctgggagatgagaacaaccctgagatgagggtgcgctgtgccatcatccccagcgacatgctgcacatcagcaccaactgcaggacagctgagaagatggccctgaccctgctggactacctgttccaccgggaggtgcaggccgtgagcaacctgagcggccagggcaagcacggcaagaagcagctggaccccctgaccatctacggcatccgctgccacctgttctacaagtttggcatcacagaaagtgactggtaccgcatcaagcagagcattgacagcaagtgcaggacagcctggaggaggaagcagaggggccagagcctggccgtgaagagcttcagcaggaggacccccaacagcagcagctactgccccagcgagcccatgatgagcaccccacctccagccagcgagctgccccagccccagccccagccccaggccctgcactacgccctggccaatgcccagcaggtgcagatccaccagatcggggaggatggccaggtgcaggtgatcccccagggccacctgcacatcgcccaggtgccccagggcgagcaggtgcagatcacccaggacagcgagggcaacctgcagatccaccacgtgggccaggacggccaggtgctgcagggcgcccagctgattgctgtggccagcagtgaccctgctgctgctggggtggatggcagccccctgcagggcagtgacatccaggtgcagtatgtgcagctggcccctgtgtctgaccacacagctggggcccagacagctgaggccctgcagcccaccctgcagcctgagatgcagctggagcacggggccatccagatccagtag

SEQ ID NO: 18670 - DNA, 1476 bp, Artificial Sequence; identical to SEQ ID NO: 18660
  Description of Artificial Sequence: Synthetic coding sequence

SEQ ID NO: 18671 - DNA, 3153 bp, Artificial Sequence
  Description of Artificial Sequence: Synthetic coding sequence
atggctgctgtgaagaaggagggcggggccctgtctgaggccatgagcctggagggagatgagtgggagctgagcaaagaaaatgtgcagcccctgcggcagggccgcatcatgagcaccctgcagggcgccctggcccaggagagcgcctgcaacaacaccctgcagcagcagaagagggcctttgaatatgagatccgcttctacacaggaaatgaccccctggatgtgtgggaccgctacatctcctggacagagcagaactacccccagggcggcaaggagagcaacatgagcaccctgctggagagagctgtggaggccctgcagggcgagaagcgctactacagcgacccccgcttcctgaacctgtggctgaagctgggccgcctgtgcaatgagcccctggacatgtacagctacctgcacaaccagggcattggagtgtccctggcccagttctacatctcctgggccgaggagtatgaggcccgggagaacttcaggaaggcagatgccatcttccaggagggcatccagcagaaggccgagcccctggagcggctgcagagccagcaccggcagttccaggcccgggtgtcccggcagaccctgctggccctggagaaggaggaggaggaggaggtgtttgagagctctgtgccccagaggagcaccctggccgagctgaagagcaagggcaagaagacagcccgggcccccatcatccgggtgggcggggccctgaaggcccccagccagaacagaggcctgcagaaccccttcccccagcagatgcagaacaacagccgcatcaccgtgtttgatgaaaatgctgatgaggccagcacagctgagctgagcaagcccaccgtgcagccctggatcgccccacccatgccccgggccaaggaaaatgagctgcaggccggcccctggaacacaggccgcagcctggagcaccggccccggggcaacacagccagcctgattgctgtgcctgctgtgctgcccagcttcaccccctacgtggaggagacagcccggcagcctgtgatgaccccctgcaagattgagcccagcatcaaccacatcctgagcaccaggaagccaggcaaggaggagggggaccccctgcagagggtgcagagccaccagcaggccagcgaggagaagaaggagaagatgatgtactgcaaggagaagatctatgccggcgtgggggagttctcctttgaggagatccgggcagaggtgttcaggaagaagctgaaggagcagcgggaggccgagctgctgaccagcgctgagaagagagctgagatgcagaagcagatcgaggagatggagaagaagctgaaggagatccagaccacccagcaggagaggactggagaccagcaggaggagaccatgcccaccaaggagaccaccaagctgcagatcgccagcgagagccagaagatccctggcatgaccctgagcagctctgtgtgccaggtgaactgctgtgcccgggagaccagcctggccgagaacatctggcaggagcagccccacagcaagggccccagcgtgcccttcagcatctttgatgagttcctgctgtctgagaagaagaacaagagccccccagctgaccccccccgggtgctggcccagaggcggcccctggccgtgctgaagaccagcgagagcatcaccagcaatgaagatgtgtccccagatgtgtgtgatgagttcaccggcatcgagcccctgtctgaagatgccatcatcaccggcttcagaaatgtgaccatctgccccaaccctgaggacacctgtgactttgcccgggccgccaggtttgtgtccacccccttccacgagatcatgagcctgaaggacctgcccagcgaccctgagcggctgctgcctgaggaggacctggatgtgaagaccagcgaggaccagcagacagcctgtggcaccatctacagccagaccctgagcatcaagaagctgagccccatcatcgaggacagccgggaggccacccacagcagcggcttcagcggcagcagcgcctctgtggccagcaccagcagcatcaagtgcctgcagatccctgagaagctggagctgaccaatgagaccagcgagaaccccacccagagcccctggtgcagccagtaccgccggcagctgctgaagagcctgcctgagctgagcgccagcgctgagctgtgcatcgaggaccggcccatgcccaagctggagattgagaaggagattgagctgggcaatgaagactactgcatcaagcgggagtacctgatctgtgaggactacaagctgttctgggtggcccccaggaacagcgctgagctgaccgtcatcaaggtgagcagccagcctgtgccctgggacttctacatcaacctgaagctgaaggagcggctgaatgaagattttgaccacttctgcagctgctaccagtaccaggacggctgcatcgtgtggcaccagtacatcaactgcttcaccctgcaggacctgctgcagcacagcgagtacatcacccatgagatcaccgtgctgatcatctacaacctgctgaccatcgtggagatgctgcacaaggccgagatcgtgcacggggacctgagcccccgctgcctgatcctgaggaaccgcatccatgacccctatgactgcaacaagaacaaccaggccctgaagatcgtggacttctcctacagcgtggacctgcgggtgcagctggatgtgttcaccctgagcggcttcagaacagtgcagatcctggagggccagaagatcctggccaactgcagcagcccctaccaggtggacctgtttggaattgctgacctggcccacctgctgctcttcaaggagcacctgcaggtgttctgggatggcagcttctggaagctgagccagaacatcagcgagctgaaggatggagagctgtggaacaagttctttgtgcgcatcctgaatgccaatgatgaggccaccgtgtctgtgctgggggagctggccgctgagatgaatggagtgtttgacaccaccttccagagccacctgaacaaggccctgtggaaggtgggcaagctgaccagccctggggccctgctcttccagtag

SEQ ID NO: 18672 - DNA, 3195 bp, Artificial Sequence
  Description of Artificial Sequence: Synthetic coding sequence
atggctgctgtgaagaaggagggcggggccctgtctgaggccatgagcctggagggagatgagtgggagctgagcaaagaaaatgtgcagcccctgcggcagggccgcatcatgagcaccctgcagggcgccctggcccaggagagcgcctgcaacaacaccctgcagcagcagaagagggcctttgaatatgagatccgcttctacacaggaaatgaccccctggatgtgtgggaccgctgggtgttcctgttccacaaggacaacagaaacatcaaccgctacatctcctggacagagcagaactacccccagggcggcaaggagagcaacatgagcaccctgctggagagagctgtggaggccctgcagggcgagaagcgctactacagcgacccccgcttcctgaacctgtggctgaagctgggccgcctgtgcaatgagcccctggacatgtacagctacctgcacaaccagggcattggagtgtccctggcccagttctacatctcctgggccgaggagtatgaggcccgggagaacttcaggaaggcagatgccatcttccaggagggcatccagcagaaggccgagcccctggagcggctgcagagccagcaccggcagttccaggcccgggtgtcccggcagaccctgctggccctggagaaggaggaggaggaggaggtgtttgagagctctgtgccccagaggagcaccctggccgagctgaagagcaagggcaagaagacagcccgggcccccatcatccgggtgggcggggccctgaaggcccccagccagaacagaggcctgcagaaccccttcccccagcagatgcagaacaacagccgcatcaccgtgtttgatgaaaatgctgatgaggccagcacagctgagctgagcaagcccaccgtgcagccctggatcgccccacccatgccccgggccaaggaaaatgagctgcaggccggcccctggaacacaggccgcagcctggagcaccggccccggggcaacacagccagcctgattgctgtgcctgctgtgctgcccagcttcaccccctacgtggaggagacagcccggcagcctgtgatgaccccctgcaagattgagcccagcatcaaccacatcctgagcaccaggaagccaggcaaggaggagggggaccccctgcagagggtgcagagccaccagcaggccagcgaggagaagaaggagaagatgatgtactgcaaggagaagatctatgccggcgtgggggagttctcctttgaggagatccgggcagaggtgttcaggaagaagctgaaggagcagcgggaggccgagctgctgaccagcgctgagaagagagctgagatgcagaagcagatcgaggagatggagaagaagctgaaggagatccagaccacccagcaggagaggactggagaccagcaggaggagaccatgcccaccaaggagaccaccaagctgcagatcgccagcgagagccagaagatccctggcatgaccctgagcagctctgtgtgccaggtgaactgctgtgcccgggagaccagcctggccgagaacatctggcaggagcagccccacagcaagggccccagcgtgcccttcagcatctttgatgagttcctgctgtctgagaagaagaacaagagccccccagctgaccccccccgggtgctggcccagaggcggcccctggccgtgctgaagaccagcgagagcatcaccagcaatgaagatgtgtccccagatgtgtgtgatgagttcaccggcatcgagcccctgtctgaagatgccatcatcaccggcttcagaaatgtgaccatctgccccaaccctgaggacacctgtgactttgcccgggccgccaggtttgtgtccacccccttccacgagatcatgagcctgaaggacctgcccagcgaccctgagcggctgctgcctgaggaggacctggatgtgaagaccagcgaggaccagcagacagcctgtggcaccatctacagccagaccctgagcatcaagaagctgagccccatcatcgaggacagccgggaggccacccacagcagcggcttcagcggcagcagcgcctctgtggccagcaccagcagcatcaagtgcctgcagatccctgagaagctggagctgaccaatgagaccagcgagaaccccacccagagcccctggtgcagccagtaccgccggcagctgctgaagagcctgcctgagctgagcgccagcgctgagctgtgcatcgaggaccggcccatgcccaagctggagattgagaaggagattgagctgggcaatgaagactactgcatcaagcgggagtacctgatctgtgaggactacaagctgttctgggtggcccccaggaacagcgctgagctgaccgtcatcaaggtgagcagccagcctgtgccctgggacttctacatcaacctgaagctgaaggagcggctgaatgaagattttgaccacttctgcagctgctaccagtaccaggacggctgcatcgtgtggcaccagtacatcaactgcttcaccctgcaggacctgctgcagcacagcgagtacatcacccatgagatcaccgtgctgatcatctacaacctgctgaccatcgtggagatgctgcacaaggccgagatcgtgcacggggacctgagcccccgctgcctgatcctgaggaaccgcatccatgacccctatgactgcaacaagaacaaccaggccctgaagatcgtggacttctcctacagcgtggacctgcgggtgcagctggatgtgttcaccctgagcggcttcagaacagtgcagatcctggagggccagaagatcctggccaactgcagcagcccctaccaggtggacctgtttggaattgctgacctggcccacctgctgctcttcaaggagcacctgcaggtgttctgggatggcagcttctggaagctgagccagaacatcagcgagctgaaggatggagagctgtggaacaagttctttgtgcgcatcctgaatgccaatgatgaggccaccgtgtctgtgctgggggagctggccgctgagatgaatggagtgtttgacaccaccttccagagccacctgaacaaggccctgtggaaggtgggcaagctgaccagccctggggccctgctcttccagtag

SEQ ID NO: 18673 - DNA, 2802 bp, Artificial Sequence
  Description of Artificial Sequence: Synthetic coding sequence
atggctgctgtgaagaaggagggcggggccctgtctgaggccatgagcctggagggagatgagtgggagctgagcaaagaaaatgtgcagcccctgcggcagggccgcatcatgagcaccctgcagggcgccctggcccaggagagcgcctgcaacaacaccctgcagcagcagaagagggcctttgaatatgagatccgcttctacacaggaaatgaccccctggatgtgtgggaccgctacatctcctggacagagcagaactacccccagggcggcaaggagagcaacatgagcaccctgctggagagagctgtggaggccctgcagggcgagaacttctggaaggcagatgccatcttccaggagggcatccagcagaaggccgagcccctggagcggctgcagagccagcaccggcagttccaggcccgggtgtcccggcagaccctgctggccctggagaaggaggaggaggaggaggtgtttgagagctctgtgccccagaggagcaccctggccgagctgaagagcaagggcaagaagacagcccgggcccccatcatccgggtgggcggggccctgaaggcccccagccagaacagaggcctgcagaaccccttcccccagcagatgcagaacaacagccgcatcaccgtgtttgatgaaaatgctgatgaggccagcacagctgagctgagcaagcccaccgtgcagccctggatcgccccacccatgccccgggccaaggaaaatgagctgcaggccggcccctggaacacaggccgcagcctggagcaccggccccggggcaacacagccagcctgattgctgtgcctgctgtgctgcccagcttcaccccctacgtggaggagacagcccggcagcctgtgatgaccccctgcaagattgagcccagcatcaaccacatcctgagcaccaggaagccaggcaaggaggagggggaccccctgcagagggtgcagagccaccagcaggccagcgaggagaagaaggagaagatgatgtactgcaaggagaagatctatgccggcgtgggggagttctcctttgaggagatccgggcagaggtgttcaggaagaagctgaaggagcagcgggaggccgagctgctgaccagcgctgagaagagagctgagatgcagaagcagatcgaggagatggagaagaagctgaaggagatccagaccacccagcaggagaggactggagaccagcaggaggagaccatgcccaccaaggagaccaccaagctgcagatcgccagcgagagccagaagatccctggcatgaccctgagcagctctgtgtgccaggtgaactgctgtgcccgggagaccagcctggccgagaacatctggcaggagcagccccacagcaaggtgtccctgagcctgggccccagcgtgcccttcagcatctttgatgagttcctgctgtctgagaagaagaacaagagccccccagctgaccccccccgggtgctggcccagaggcggcccctggccgtgctgaagaccagcgagagcatcaccagcaatgaagatgtgtccccagatgtgtgtgatgagttcaccggcatcgagcccctgtctgaagatgccatcatcaccggcttcagaaatgtgaccatctgccccaaccctgaggacacccgggaggccacccacagcagcggcttcagcggcagcagcgcctctgtggccagcaccagcagcatcaagtgcctgcagatccctgagaagctggagctgaccaatgagaccagcgagaaccccacccagagcccctggtgcagccagtaccgccggcagctgctgaagagcctgcctgagctgagcgccagcgctgagctgtgcattgaagatcggcccatgcccaagctggagattgagaaggagattgagctgggcaatgaagactactgcatcaagcgggagtacctgatctgtgaggactacaagctgttctgggtggcccccagaaattctgctgagctgaccgtcatcaaggtgagcagccagcctgtgccctgggacttctacatcaacctgaagctgaaggagcggctgaatgaagattttgaccacttctgcagctgctaccagtaccaggacggctgcatcgtgtggcaccagtacatcaactgcttcaccctgcaggacctgctgcagcacagcgagtacatcacccatgagatcaccgtgctgatcatctacaacctgctgaccatcgtggagatgctgcacaaggccgagatcgtgcatggagacctgagcccccgctgcctgatcctgaggaaccgcatccatgacccctatgactgcaacaagaacaaccaggccctgaagatcgtggacttctcctacagcgtggacctgcgggtgcagctggatgtgttcaccctgagcggcttcagaacagtgcagatcctggagggccagaagatcctggccaactgcagcagcccctaccaggtggacctgtttggaattgctgacctggcccacctgctgctcttcaaggagcacctgcaggtgttctgggatggcagcttctggaagctgagccagaacatcagcgagctgaaggatggagagctgtggaacaagttctttgtgcgcatcctgaatgccaatgatgaggccaccgtgtctgtgctgggggagctggccgctgagatgaatggagtgtttgacaccaccttccagagccacctgaacaaggccctgtggaaggtgggcaagctgaccagccctggggccctgctcttccagtag

SEQ ID NO: 18674 - DNA, 3393 bp, Artificial Sequence
  Description of Artificial Sequence: Synthetic coding sequence
atgctggagatctgcctgaagctggtgggctgcaagagcaagaagggcctgagcagcagcagcagctgctacctggaggaggccctgcagaggcctgtggccagtgactttgagccccagggcctgtctgaggccgcccgctggaacagcaaggagaacctgctggccggccccagtgaaaatgaccccaacctgtttgtggccctgtatgactttgtggccagcggggacaacaccctgagcatcaccaagggggagaagctgcgggtgctgggctacaaccacaacggggagtggtgtgaggcccagaccaagaatggccagggctgggtgcccagcaactacatcacccctgtgaacagcctggagaagcacagctggtaccacggccctgtgtccagaaatgctgctgagtacctgctgagcagcggcatcaatggcagcttcctggtgcgggagagcgagagcagccctggccagaggagcatcagcctgcgctatgagggccgggtgtaccactaccgcatcaacacagccagtgatggcaagctgtatgtgagcagcgagagccgcttcaacaccctggccgagctggtgcaccaccacagcacagtggctgatggcctcatcaccaccctgcactacccagcccccaagaggaacaagcccaccgtgtatggagtgagccccaactatgacaagtgggagatggagaggacagacatcaccatgaagcacaagctgggcggcggccagtatggagaggtgtatgaaggagtgtggaagaagtacagcctgactgtggccgtgaagaccctgaaggaggacaccatggaggtggaggagttcctgaaggaggccgctgtgatgaaggagatcaagcaccccaacctggtgcagctgctgggcgtgtgcacccgggagccccccttctacatcatcacagagttcatgacctacggcaacctgctggactacctgcgggagtgcaaccggcaggaggtgaatgctgtggtgctgctgtacatggccacccagatcagcagcgccatggagtacctggagaagaagaacttcatccaccgggacctggccgccaggaactgcctggtgggggagaaccacctggtgaaggtggccgactttggcctgagccggctgatgactggagacacctacacagcccatgctggggccaagttccccatcaagtggacagcccctgagagcctggcctacaacaagttcagcatcaagagtgatgtgtgggcctttggagtgctgctgtgggagatcgccacctacggcatgagcccctacccaggcatcgacctgagccaggtgtatgagctgctggagaaggactacaggatggagaggcctgagggctgcccagagaaggtgtatgagctgatgagggcctgctggcagtggaaccccagcgaccggcccagctttgctgagatccaccaggcctttgagaccatgttccaggagagcagcatcagtgatgaggtggagaaggagctgggcaagcagggcgtgagaggagctgtgtccaccctgctgcaggcccctgagctgcccaccaagaccaggaccagccggcgggctgctgagcaccgggacaccacagatgtgcctgagatgccccacagcaagggccagggcgagagtgaccccctggaccacgagcctgctgtgagccccctgctgcccaggaaggagcggggccccccagagggcggcctgaatgaagatgagcggctgctgcccaaggacaagaagaccaacctcttcagcgccctgatcaagaagaagaagaagacagcccccaccccacccaagaggagcagcagcttccgggagatggatggccagcctgagaggagaggagctggggaggaggagggccgggacatcagcaatggagccctggccttcacccccctggacacagctgaccctgccaagagccccaagcccagcaatggagctggggtgcccaacggggccctgcgggagagcggcggcagcggcttccgcagcccccacctgtggaagaagagcagcaccctgaccagcagccggctggccaccggggaggaggagggcggcggcagcagcagcaagcgcttcctgcggagctgcagcgccagctgtgtgccccacggggccaaggacacagagtggaggtctgtgaccctgccccgggacctgcagagcacaggccggcagtttgacagcagcaccttcggcggccacaagtctgagaagccagccctgcccaggaagagagctggagaaaatagaagtgaccaggtgacccggggcaccgtgaccccaccaccccggctggtgaagaagaatgaggaggccgcagatgaggtgttcaaggacatcatggagagcagccctggcagcagcccccccaacctgacccccaagcccctgcggcggcaggtgacagtggccccagccagcggcctgccccacaaggaggaggccggcaagggcagcgccctgggcaccccagctgctgctgagcctgtgacccccaccagcaaggccggcagcggggcccctgggggcaccagcaaaggacctgctgaggagagccgggtgcggcggcacaagcacagcagcgagagccctggccgggacaagggcaagctgagccggctgaagccagcccctcctcctcctcctgctgccagcgctgggaaggccggcggcaagcccagccagagccccagccaggaggccgccggggaggccgtgctgggcgccaagaccaaggccaccagcctggtggatgctgtgaacagtgatgctgccaagcccagccagcctggagagggcctgaagaagcctgtgctgcctgccacccccaagccccagagcgccaagcccagcggcacccccatcagccctgcccctgtgcccagcaccctgcccagcgccagcagcgccctggccggggaccagcccagcagcacagccttcatccccctcatcagcaccagggtgtccctgaggaagacccggcagcccccagagcgcatcgccagcggggccatcaccaagggcgtggtgctggacagcacagaggccctgtgcctggccatcagcagaaattctgagcagatggccagccacagcgctgtgctggaggccggcaagaacctgtacaccttctgtgtgtcctatgtggacagcatccagcagatgaggaacaagtttgccttccgggaggccatcaacaagctggagaacaacctgcgggagctgcagatctgcccagccacagctggcagcggccctgctgccacccaggacttcagcaagctgctgagctctgtgaaggagatcagtgacatcgtgcagaggtag

SEQ ID NO: 18675 - DNA, 3450 bp, Artificial Sequence
  Description of Artificial Sequence: Synthetic coding sequence
atgggccagcagcccgggaaggtgctgggggaccagaggcggcccagcctgcctgccctgcacttcatcaagggggccggcaagaaggagagcagccgccacggcggcccccactgcaatgtgtttgtggagcacgaggccctgcagaggcctgtggccagtgactttgagccccagggcctgtctgaggccgcccgctggaacagcaaagaaaacctgctggccggccccagtgaaaatgaccccaacctgtttgtggccctgtatgactttgtggccagcggggacaacaccctgagcatcaccaagggggagaagctgcgggtgctgggctacaaccacaatggagagtggtgtgaggcccagaccaagaatggccagggctgggtgcccagcaactacatcacccctgtgaacagcctggagaagcacagctggtaccacggccctgtgtccagaaatgctgctgagtacctgctgagcagcggcatcaatggcagcttcctggtgcgggagagcgagagcagccctggccagaggagcatcagcctgcgctatgagggccgggtgtaccactaccgcatcaacacagccagtgatggcaagctgtatgtgtcctctgagagccgcttcaacaccctggccgagctggtgcaccaccacagcacagtggctgatggcctcatcaccaccctgcactacccagcccccaagaggaacaagcccaccgtgtatggagtgagccccaactatgacaagtgggagatggagaggacagacatcaccatgaagcacaagctgggcggcggccagtacggggaggtgtatgagggcgtgtggaagaagtacagcctgactgtggccgtgaagaccctgaaggaggacaccatggaggtggaggagttcctgaaggaggccgctgtgatgaaggagatcaagcaccccaacctggtgcagctgctgggcgtgtgcacccgggagccccccttctacatcatcacagagttcatgacctacggcaacctgctggactacctgcgggagtgcaaccggcaggaggtgaatgctgtggtgctgctgtacatggccacccagatcagcagcgccatggagtacctggagaagaagaacttcatccaccgggacctggccgccaggaactgcctggtgggggagaaccacctggtgaaggtggccgactttggcctgagccggctgatgaccggggacacctacacagcccacgccggggccaagttccccatcaagtggacagcccctgagagcctggcctacaacaagttcagcatcaagagtgatgtgtgggccttcggcgtgctgctgtgggagatcgccacctacggcatgagcccctacccaggcatcgacctgagccaggtgtatgagctgctggagaaggactacaggatggagaggcctgagggctgcccagagaaggtgtatgagctgatgagggcctgctggcagtggaaccccagcgaccggcccagctttgctgagatccaccaggcctttgagaccatgttccaggagagcagcatcagtgatgaggtggagaaggagctgggcaagcagggcgtgagaggagctgtgtccaccctgctgcaggcccctgagctgcccaccaagaccaggaccagcagaagagctgctgagcaccgggacaccacagatgtgcctgagatgccccacagcaagggccagggcgagagtgaccccctggaccacgagcctgctgtgagccccctgctgcccaggaaggagcggggccccccagagggcggcctgaatgaagatgagcggctgctgcccaaggacaagaagaccaacctcttcagcgccctgatcaagaagaagaagaagacagcccccaccccacccaagaggagcagcagcttccgggagatggatggccagcctgagaggagaggagctggggaggaggagggccgggacatcagcaatggagccctggccttcacccccctggacacagctgaccctgccaagagccccaagcccagcaatggagctggggtgcccaatggagccctgcgggagagcggcggcagcggcttccgcagcccccacctgtggaagaagagcagcaccctgaccagcagccggctggccactggagaggaggagggcggcggcagcagcagcaagcgcttcctgcggagctgcagcgccagctgtgtgccccatggagccaaggacacagagtggaggtctgtgaccctgccccgggacctgcagagcacaggccggcagtttgacagcagcacctttggaggccacaagtctgagaagccagccctgcccaggaagagagctggggagaacagaagtgaccaggtgacccggggcaccgtgaccccaccaccccggctggtgaagaagaatgaggaggccgcagatgaggtgttcaaggacatcatggagagcagccctggcagcagcccccccaacctgacccccaagcccctgcggcggcaggtgacagtggccccagccagcggcctgccccacaaggaggaggccgggaaaggaagtgccctgggcaccccagctgctgctgagcctgtgacccccaccagcaaggccggcagcggggcccctgggggcaccagcaagggccctgctgaggagagccgggtgagaagacacaagcacagcagcgagagccctggccgggacaagggcaagctgagccggctgaagccagcccctcctcctcctcctgctgccagcgctgggaaggccggcggcaagcccagccagagccccagccaggaggccgccggggaggccgtgctgggcgccaagaccaaggccaccagcctggtggatgctgtgaacagtgatgctgccaagcccagccagcccggggagggcctgaagaagcctgtgctgcctgccacccccaagccccagagcgccaagcccagcggcacccccatcagccctgcccctgtgcccagcaccctgcccagcgccagcagcgccctggccggggaccagcccagcagcacagccttcatccccctcatcagcaccagggtgtccctgaggaagacccggcagcccccagagagaattgccagcggggccatcaccaagggcgtggtgctggacagcacagaggccctgtgcctggccatcagcaggaacagcgagcagatggccagccacagcgctgtgctggaggccggcaagaacctgtacaccttctgtgtgtcctatgtggacagcatccagcagatgaggaacaagtttgccttccgggaggccatcaacaagctggagaacaacctgcgggagctgcagatctgcccagccacagctggcagcggccctgctgccacccaggacttcagcaagctgctgagctctgtgaaggagatcagtgacatcgtgcagaggtag

SEQ ID NO: 18676 - DNA, 195 bp, Artificial Sequence
  Description of Artificial Sequence: Synthetic coding sequence
atgggccagcagcccgggaaggtgctgggggaccagaggcggcccagcctgcctgccctgcacttcatcaagggggccggcaagaaggagagcagccgccacggcggcccccactgcaatgtgtttgtggagcaggccctgcagaggcctgtggccagtgactttgagccccagggcctgtctgaggccgcctag

SEQ ID NO: 18677 - DNA, 486 bp, Artificial Sequence
  Description of Artificial Sequence: Synthetic coding sequence
ggccggcccggccgcagccgggcccggggcggcggggagggcggctggaggggcggcggccgggccggccgggccggccctgagcccggccccagggctggccggggcgtgcctgccccagactgctggaggggcaagatgctggagatctgcctgaagctggtgggctgcaagagcaagaagggcctgagcagcagcagcagctgctacctggaggaggccctgcagaggcctgtggccagtgactttgagccccagggcctgtctgaggccgcccgctggaacagcaaggagaacctgctggccggccccagtgaaaatgaccccaacctgtttgtggccctgtatgactttgtggccagcggggacaacaccctgagcatcaccaagggggagaagctgcgggtgctgggctacaaccacaacggggagtggtgtgaggcccagaccaagaatggccagggctgggtgcccagcaactactag

SEQ ID NO: 18678 - DNA, 2838 bp, Artificial Sequence
  Description of Artificial Sequence: Synthetic coding sequence
ctgcggctgctgcgggagcccctgcagcaccctggccgggtgggcagcagcagcttcaacggcggcagaagagcccaccaccacgcccccctgagcagccccaaggcccagcaggcccactgcctgtggtgtgtgccccagctgcggcaggtgggagatggcacccacggccaccaccacgaggcccagggcggcggccagtacggggaggtgtatgagggcgtgtggaagaagtacagcctgactgtggccgtgaagaccctgaaggaggacaccatggaggtggaggagttcctgaaggaggccgctgtgatgaaggagatcaagcaccccaacctggtgcagctgctgggcgtgtgcacccgggagccccccttctacatcatcacagagttcatgacctacggcaacctgctggactacctgcgggagtgcaaccggcaggaggtgaatgctgtggtgctgctgtacatggccacccagatcagcagcgccatggagtacctggagaagaagaacttcatccaccgggacctggccgccaggaactgcctggtgggggagaaccacctggtgaaggtggccgactttggcctgagccggctgatgaccggggacacctacacagcccacgccggggccaagttccccatcaagtggacagcccctgagagcctggcctacaacaagttcagcatcaagagtgatgtgtgggccttcggcgtgctgctgtgggagatcgccacctacggcatgagcccctacccaggcatcgacctgagccaggtgtatgagctgctggagaaggactacaggatggagaggcctgagggctgcccagagaaggtgtatgagctgatgagggcctgctggcagtggaaccccagcgaccggcccagctttgctgagatccaccaggcctttgagaccatgttccaggagagcagcatcagtgatgaggtggagaaggagctgggcaagcagggcgtgagaggagctgtgtccaccctgctgcaggcccctgagctgcccaccaagaccaggaccagcagaagagctgctgagcaccgggacaccacagatgtgcctgagatgccccacagcaagggccagggcgagagtgaccccctggaccacgagcctgctgtgagccccctgctgcccaggaaggagcggggccccccagagggcggcctgaatgaagatgagcggctgctgcccaaggacaagaagaccaacctcttcagcgccctgatcaagaagaagaagaagacagcccccaccccacccaagaggagcagcagcttccgggagatggatggccagcctgagaggagaggagctggggaggaggagggccgggacatcagcaatggagccctggccttcacccccctggacacagctgaccctgccaagagccccaagcccagcaatggagctggggtgcccaatggagccctgcgggagagcggcggcagcggcttccgcagcccccacctgtggaagaagagcagcaccctgaccagcagccggctggccactggagaggaggagggcggcggcagcagcagcaagcgcttcctgcggagctgcagcgccagctgtgtgccccatggagccaaggacacagagtggaggtctgtgaccctgccccgggacctgcagagcacaggccggcagtttgacagcagcacctttggaggccacaagtctgagaagccagccctgcccaggaagagagctggggagaacagaagtgaccaggtgacccggggcaccgtgaccccaccaccccggctggtgaagaagaatgaggaggccgcagatgaggtgttcaaggacatcatggagagcagccctggcagcagcccccccaacctgacccccaagcccctgcggcggcaggtgacagtggccccagccagcggcctgccccacaaggaggaggccgggaaaggaagtgccctgggcaccccagctgctgctgagcctgtgacccccaccagcaaggccggcagcggggcccctgggggcaccagcaagggccctgctgaggagagccgggtgagaagacacaagcacagcagcgagagccctggccgggacaagggcaagctgagccggctgaagccagcccctcctcctcctcctgctgccagcgctgggaaggccggcggcaagcccagccagagccccagccaggaggccgccggggaggccgtgctgggcgccaagaccaaggccaccagcctggtggatgctgtgaacagtgatgctgccaagcccagccagcccggggagggcctgaagaagcctgtgctgcctgccacccccaagccccagagcgccaagcccagcggcacccccatcagccctgcccctgtgcccagcaccctgcccagcgccagcagcgccctggccggggaccagcccagcagcacagccttcatccccctcatcagcaccagggtgtccctgaggaagacccggcagcccccagagagaattgccagcggggccatcaccaagggcgtggtgctggacagcacagaggccctgtgcctggccatcagcaggaacagcgagcagatggccagccacagcgctgtgctggaggccggcaagaacctgtacaccttctgtgtgtcctatgtggacagcatccagcagatgaggaacaagtttgccttccgggaggccatcaacaagctggagaacaacctgcgggagctgcagatctgcccagccacagctggcagcggccctgctgccacccaggacttcagcaagctgctgagctctgtgaaggagatcagtgacatcgtgcagaggtag

SEQ ID NO: 18679 - DNA, 2649 bp, Artificial Sequence
  Description of Artificial Sequence: Synthetic coding sequence
atgggcccctggagccgcagcctgagcgccctgctgctgctgctgcaggtgtcctcctggctgtgccaggagcctgagccctgccaccctggctttgatgctgagagctacaccttcaccgtgcccaggaggcacctggagcggggccgggtgctgggccgggtgaactttgaggactgcaccggccggcagaggacagcctacttcagcctggacacccgcttcaaggtgggcacagatggagtcatcaccgtgaagaggcccctgcgcttccacaacccccagatccacttcctggtgtatgcctgggacagcacctacaggaagttcagcaccaaggtgaccctgaacacagtgggccaccaccaccggcccccaccccaccaggcctctgtgtctggcatccaggccgagctgctgaccttccccaacagcagccctggcctgcggcggcagaagagggactgggtgattcctcccatcagctgcccagaaaatgagaagggccccttccccaagaacctggtgcagatcaagagcaacaaggacaaggagggcaaggtgttctacagcatcaccggccagggcgctgacaccccacctgtgggcgtcttcatcatcgagcgggagaccggctggctgaaggtgacagagcccctggaccgggagagaattgccacctacaccctcttcagccatgctgtgagcagcaatggaaatgctgtggaggaccccatggagatcctgatcaccgtgacagaccagaatgacaacaagccagagttcacccaggaggtgttcaagggctctgtgatggagggcgccctgcccggcacctctgtgatggaggtgacagccacagatgctgatgatgatgtgaacacctacaatgctgccatcgcctacaccatcctgagccaggaccctgagctgcctgacaagaacatgttcaccatcaacagaaatactggagtcatctctgtggtgaccaccggcctggaccgggagagcttccccacctacaccctggtggtgcaggccgctgacctgcagggcgagggcctgagcaccacagccacagctgtgatcaccgtgacagacaccaatgacaacccccccatcttcaaccccaccacctacaagggccaggtgcctgaaaatgaggccaacgtggtgatcaccaccctgaaggtgacagatgctgatgcccccaacaccccagcctgggaggccgtgtacaccatcctgaatgatgatggcggccagtttgtggtgaccaccaaccctgtgaacaatgatggcatcctgaagacagccaagggcctggactttgaggccaagcagcagtacatcctgcacgtggccgtgaccaacgtggtgccctttgaggtgtccctgaccaccagcacagccaccgtgacagtggatgtgctggatgtgaatgaggcccccatctttgtgcccccagagaagagggtggaggtgtctgaagattttggagtgggccaggagatcaccagctacacagcccaggagccagacaccttcatggagcagaagatcacctaccgcatctggagggacacagccaactggctggagatcaacccagacacaggagccatcagcaccagggctgagctggacagagaagattttgaacatgtgaagaacagcacctacacagccctgatcatcgccacagacaatggcagccctgtggccaccggcaccggcaccctgctgctgatcctgagtgatgtgaatgacaatgcccccatccctgagcccaggaccatcttcttctgtgaaagaaaccccaagccccaggtgatcaacatcattgatgctgacctgccccccaacaccagccccttcaccgctgagctgacccacggggccagcgccaactggaccatccagtacaatgaccccacccaggagagcatcatcctgaagcccaagatggccctggaggtgggggactacaagatcaacctgaagctgatggacaaccagaacaaggaccaggtgaccaccctggaggtgtctgtgtgtgactgtgagggcgccgccggcgtgtgcaggaaggcccagcctgtggaggccggcctgcagatcccagccatcctgggcatcctgggcggcatcctggccctgctgatcctgatcctgctgctgctgctcttcctgcggaggagagctgtggtgaaggagcccctgctgcccccagaagatgacacccgggacaacgtgtactactatgatgaggagggcggcggggaggaggaccaggactttgacctgagccagctgcaccggggcctggatgcccggcctgaggtgaccagaaatgatgtggcccccaccctgatgtctgtgccccgctacctgcccaggcctgccaacccagatgaaattggcaacttcattgatgagaacctgaaggctgctgacacagaccccacagccccaccctatgacagcctgctggtgtttgattatgagggcagcggcagcgaggccgccagcctgagcagcctgaacagcagcgagagtgacaaggaccaggactatgactacctgaatgagtggggcaaccgcttcaagaagctggccgacatgtatggaggaggagaagatgactag

SEQ ID NO: 18680 - DNA, 1944 bp, Artificial Sequence
  Description of Artificial Sequence: Synthetic coding sequence
atgggcccctggagccgcagcctgagcgccctgctgctgctgctgcaggtgtcctcctggctgtgccaggagcctgagccctgccaccctggctttgatgctgagagctacaccttcaccgtgcccaggaggcacctggagcggggccgggtgctgggccgggtgaactttgaggactgcaccggccggcagaggacagcctacttcagcctggacacccgcttcaaggtgggcacagatggagtcatcaccgtgaagaggcccctgcgcttccacaacccccagatccacttcctggtgtatgcctgggacagcacctacaggaagttcagcaccaaggtgaccctgaacacagtgggccaccaccaccggcccccaccccaccaggcctctgtgtctggcatccaggccgagctgctgaccttccccaacagcagccctggcctgcggcggcagaagagggactgggtgattcctcccatcagctgcccagaaaatgagaagggccccttccccaagaacctggtgcagatcaagagcaacaaggacaaggagggcaaggtgttctacagcatcaccggccagggcgctgacaccccacctgtgggcgtcttcatcatcgagcgggagaccggctggctgaaggtgacagagcccctggaccgggagagaattgccacctacaccctcttcagccatgctgtgagcagcaatggaaatgctgtggaggaccccatggagatcctgatcaccgtgacagaccagaatgacaacaagccagagttcacccaggaggtgttcaagggctctgtgatggagggcgccctgcccggcacctctgtgatggaggtgacagccacagatgctgatgatgatgtgaacacctacaatgctgccatcgcctacaccatcctgagccaggaccctgagctgcctgacaagaacatgttcaccatcaacagaaatactggagtcatctctgtggtgaccaccggcctggaccgggagagcttccccacctacaccctggtggtgcaggccgctgacctgcagggcgagggcctgagcaccacagccacagctgtgatcaccgtgacagacaccaatgacaacccccccatcttcaaccccaccacctacaagggccaggtgcctgaaaatgaggccaacgtggtgatcaccaccctgaaggtgacagatgctgatgcccccaacaccccagcctgggaggccgtgtacaccatcctgaatgatgatggcggccagtttgtggtgaccaccaaccctgtgaacaatgatggcatcctgaagacagccaagggcctggactttgaggccaagcagcagtacatcctgcacgtggccgtgaccaacgtggtgccctttgaggtgtccctgaccaccagcacagccaccgtgacagtggatgtgctggatgtgaatgaggcccccatctttgtgcccccagagaagagggtggaggtgtctgaagattttggagtgggccaggagatcaccagctacacagcccaggagccagacaccttcatggagcagaagatcacctaccgcatctggagggacacagccaactggctggagatcaacccagacacaggagccatcagcaccagggctgagctggacagagaagattttgaacatgtgaagaacagcacctacacagccctgatcatcgccacagacaatggcagccctgtggccaccggcaccggcaccctgctgctgatcctgagtgatgtgaatgacaatgcccccatccctgagcccaggaccatcttcttctgtgaaagaaaccccaagccccaggtgatcaacatcattgatgctgacctgccccccaacctggccagccagagcatcggcatcacagacatgagccactgcacctgcccagccccccagctgcctgccatcttctag

SEQ ID NO: 18681 - DNA, 2703 bp, Artificial Sequence
  Description of Artificial Sequence: Synthetic coding sequence
atgggcccctggagccgcagcctgagcgccctgctgctgctgctgcaggtgtcctcctggctgtgccaggagcctgagccctgccaccctggctttgatgctgagagctacaccttcaccgtgcccaggaggcacctggagcggggccgggtgctgggccgggtgaactttgaggactgcaccggccggcagaggacagcctacttcagcctggacacccgcttcaaggtgggcacagatggagtcatcaccgtgaagaggcccctgcgcttccacaacccccagatccacttcctggtgtatgcctgggacagcacctacaggaagttcagcaccaaggtgaccctgaacacagtgggccaccaccaccggcccccaccccaccaggcctctgtgtctggcatccaggccgagctgctgaccttccccaacagcagccctggcctgcggcggcagaagagggactgggtgattcctcccatcagctgcccagaaaatgagaagggccccttccccaagaacctggtgcagatcaagagcaacaaggacaaggagggcaaggtgttctacagcatcaccggccagggcgctgacaccccacctgtgggcgtcttcatcatcgagcgggagaccggctggctgaaggtgacagagcccctggaccgggagagaattgccacctacaccctcttcagccatgctgtgagcagcaatggaaatgctgtggaggaccccatggagatcctgatcaccgtgacagaccagaatgacaacaagccagagttcacccaggaggtgttcaagggctctgtgatggagggcgccctgcccggcacctctgtgatggaggtgacagccacagatgctgatgatgatgtgaacacctacaatgctgccatcgcctacaccatcctgagccaggaccctgagctgcctgacaagaacatgttcaccatcaacagaaatactggagtcatctctgtggtgaccaccggcctggaccgggagagcttccccacctacaccctggtggtgcaggccgctgacctgcagggcgagggcctgagcaccacagccacagctgtgatcaccgtgacagacaccaatgacaacccccccatcttcaaccccaccacctacaagggccaggtgcctgaaaatgaggccaacgtggtgatcaccaccctgaaggtgacagatgctgatgcccccaacaccccagcctgggaggccgtgtacaccatcctgaatgatgatggcggccagtttgtggtgaccaccaaccctgtgaacaatgatggcatcctgaagacagccaagctggcccgctgcaggaactggcacccccacagctgcagctacccctgccccctgggcctggactttgaggccaagcagcagtacatcctgcacgtggccgtgaccaacgtggtgccctttgaggtgtccctgaccaccagcacagccaccgtgacagtggatgtgctggatgtgaatgaggcccccatctttgtgcccccagagaagagggtggaggtgtctgaagattttggagtgggccaggagatcaccagctacacagcccaggagccagacaccttcatggagcagaagatcacctaccgcatctggagggacacagccaactggctggagatcaacccagacacaggagccatcagcaccagggctgagctggacagagaagattttgaacatgtgaagaacagcacctacacagccctgatcatcgccacagacaatggcagccctgtggccaccggcaccggcaccctgctgctgatcctgagtgatgtgaatgacaatgcccccatccctgagcccaggaccatcttcttctgtgaaagaaaccccaagccccaggtgatcaacatcattgatgctgacctgccccccaacaccagccccttcaccgctgagctgacccacggggccagcgccaactggaccatccagtacaatgaccccacccaggagagcatcatcctgaagcccaagatggccctggaggtgggggactacaagatcaacctgaagctgatggacaaccagaacaaggaccaggtgaccaccctggaggtgtctgtgtgtgactgtgagggcgccgccggcgtgtgcaggaaggcccagcctgtggaggccggcctgcagatcccagccatcctgggcatcctgggcggcatcctggccctgctgatcctgatcctgctgctgctgctcttcctgcggaggagagctgtggtgaaggagcccctgctgcccccagaagatgacacccgggacaacgtgtactactatgatgaggagggcggcggggaggaggaccaggactttgacctgagccagctgcaccggggcctggatgcccggcctgaggtgaccagaaatgatgtggcccccaccctgatgtctgtgccccgctacctgcccaggcctgccaacccagatgaaattggcaacttcattgatgagaacctgaaggctgctgacacagaccccacagccccaccctatgacagcctgctggtgtttgattatgagggcagcggcagcgaggccgccagcctgagcagcctgaacagcagcgagagtgacaaggaccaggactatgactacctgaatgagtggggcaaccgcttcaagaagctggccgacatgtatggaggaggagaagatgactag

SEQ ID NO: 18682 - DNA, 2466 bp, Artificial Sequence
  Description of Artificial Sequence: Synthetic coding sequence
atgggcccctggagccgcagcctgagcgccctgctgctgctgctgcaggtgtcctcctggctgtgccaggagcctgagccctgccaccctggctttgatgctgagagctacaccttcaccgtgcccaggaggcacctggagcggggccgggtgctgggccgggtgaactttgaggactgcaccggccggcagaggacagcctacttcagcctggacacccgcttcaaggtgggcacagatggagtcatcaccgtgaagaggcccctgcgcttccacaacccccagatccacttcctggtgtatgcctgggacagcacctacaggaagttcagcaccaaggtgaccctgaacacagtgggccaccaccaccggcccccaccccaccaggcctctgtgtctggcatccaggccgagctgctgaccttccccaacagcagccctggcctgcggcggcagaagagggactgggtgattcctcccatcagctgcccagaaaatgagaagggccccttccccaagaacctggtgcagatcaagagcaacaaggacaaggagggcaaggtgttctacagcatcaccggccagggcgctgacaccccacctgtgggcgtcttcatcatcgagcgggagaccggctggctgaaggtgacagagcccctggaccgggagagaattgccacctacaccctcttcagccatgctgtgagcagcaatggaaatgctgtggaggaccccatggagatcctgatcaccgtgacagaccagaatgacaacaagccagagttcacccaggaggtgttcaagggctctgtgatggagggcgccctgcccggcacctctgtgatggaggtgacagccacagatgctgatgatgatgtgaacacctacaatgctgccatcgcctacaccatcctgagccaggaccctgagctgcctgacaagaacatgttcaccatcaacagaaatactggagtcatctctgtggtgaccaccggcctggaccgggagagcttccccacctacaccctggtggtgcaggccgctgacctgcagggcgagggcctgagcaccacagccacagctgtgatcaccgtgacagacaccaatgacaacccccccatcttcaaccccaccaccggcctggactttgaggccaagcagcagtacatcctgcacgtggccgtgaccaacgtggtgccctttgaggtgtccctgaccaccagcacagccaccgtgacagtggatgtgctggatgtgaatgaggcccccatctttgtgcccccagagaagagggtggaggtgtctgaggactttggagtgggccaggagatcaccagctacacagcccaggagccagacaccttcatggagcagaagatcacctaccgcatctggagggacacagccaactggctggagatcaacccagacaccggggccatcagcaccagggctgagctggaccgggaggactttgagcacgtgaagaacagcacctacacagccctgatcatcgccacagacaatggcagccctgtggccactggaacaggcaccctgctgctgatcctgagtgatgtgaatgacaatgcccccatccctgagcccaggaccatcttcttctgtgagaggaaccccaagccccaggtgatcaacatcattgatgctgacctgccccccaacaccagccccttcaccgctgagctgacccatggagccagcgccaactggaccatccagtacaatgaccccacccaggagagcatcatcctgaagcccaagatggccctggaggtgggggactacaagatcaacctgaagctgatggacaaccagaacaaggaccaggtgaccaccctggaggtgtctgtgtgtgactgtgagggcgctgctggggtgtgcaggaaggcccagcctgtggaggccggcctgcagatcccagccatcctgggcatcctgggcggcatcctggccctgctgatcctgatcctgctgctgctgctcttcctgcggcggcgggctgtggtgaaggagcccctgctgcccccagaagatgacacccgggacaacgtgtactactatgatgaggagggcggcggggaggaggaccaggactttgacctgagccagctgcaccggggcctggatgcccggcctgaggtgaccagaaatgatgtggcccccaccctgatgtctgtgccccgctacctgcccaggcctgccaacccagatgagatcggcaacttcattgatgagaacctgaaggctgctgacacagaccccacagccccaccctatgacagcctgctggtgtttgattatgagggcagcggcagcgaggccgccagcctgagcagcctgaacagcagcgagagtgacaaggaccaggactatgactacctgaatgagtggggcaaccgcttcaagaagctggccgacatgtatggaggaggagaagatgactag

SEQ ID NO: 18683 - DNA, 2391 bp, Artificial Sequence
  Description of Artificial Sequence: Synthetic coding sequence
atgaaggagaactactgcctgcaggccgccctggtgtgcctgggcatgctgtgccacagccacgcctttgcccctgagcggcggggccacctgcggcccagcttccacggccaccacgagaagggcaaggagggccaggtgctgcagaggagcaagaggggctgggtgtggaaccagttctttgtgattgaggagtacacaggccctgaccctgtgctggtgggccgcctgcacagcgacattgattctggagatggcaacatcaagtacatcctgtctggagagggcgccggcaccatctttgtgattgatgacaagagcggcaacatccacgccaccaagaccctggaccgggaggagcgggcccagtacaccctgatggcccaggccgtggaccgggacaccaaccggcccctggagcccccatctgagttcatcgtgaaggtgcaggacatcaatgacaaccccccagagttcctgcacgagacctaccacgccaacgtgcctgagaggagcaatgtgggcaccagcgtcatccaggtgacagccagtgatgctgatgaccccacctacggcaacagcgccaagctggtgtacagcatcctggagggccagccctacttctctgtggaggcccagacaggcatcatcagaacagccctgcccaacatggaccgggaggccaaggaggagtaccacgtggtgatccaggccaaggacatgggcggccacatgggcggcctgagcggcaccaccaaggtgaccatcaccctgacagatgtgaatgacaacccccccaagttcccccagagcgtgtaccagatgtctgtgtctgaggccgctgtgcctggagaggaggtgggccgggtgaaggccaaggaccctgacattggagaaaatggcctggtgacctacaacatcgtggatggagatggcatggagagctttgagatcaccacagattatgagacccaggagggcgtcatcaagctgaagaagcctgtggactttgagaccaagagggcctacagcctgaaggtggaggccgccaacgtgcacatcgaccccaagttcatcagcaatggccccttcaaggacacagtgacagtgaagatctctgtggaggatgctgatgagccccccatgttcctggcccccagctacatccacgaggtgcaggagaatgctgctgctggcaccgtggtgggccgggtgcacgccaaggaccctgatgctgccaacagccccatccgctacagcattgacagacacacagacctggaccgcttcttcaccatcaacccagaagatggcttcatcaagaccaccaagcccctggaccgggaggagacagcctggctgaacatcaccgtgtttgctgctgagatccacaacagacaccaggaggccaaggtgcctgtggccatccgggtgctggatgtgaatgacaatgcccccaagtttgctgccccctatgagggcttcatctgtgagagtgaccagaccaagcccctgagcaaccagcccatcgtgaccatctctgcagatgacaaggatgacacagccaacggcccccgcttcatcttcagcctgcccccagagatcatccacaaccccaacttcaccgtgcgggacaacagagacaacacagctggggtgtatgcccggcggggcggcttcagccggcagaagcaggacctgtacctgctgcccatcgtcatcagtgatggcggcatcccccccatgagcagcaccaacaccctgaccatcaaggtgtgtggctgtgatgtgaatggagccctgctgagctgcaatgctgaggcctacatcctgaatgccggcctgagcactggagccctgattgccatcctggcctgcatcgtcatcctgctggtgattgtggtgctgtttgtgaccctgcggcggcagaagaaggagcccctgattgtgtttgaggaggaggatgtgcgggagaacatcatcacctatgatgatgaaggaggaggagaggaggacacagaggcctttgacatcgccaccctgcagaacccagatggcatcaatggcttcatccccaggaaggacatcaagccagagtaccagtacatgccccggcccggcctgcggcctgcccccaacagcgtggatgtggatgacttcatcaacacccgcatccaggaggccgacaatgaccccacagccccaccctatgacagcatccagatctacggctatgagggccggggctctgtggccggcagcctgagcagcctggagagcgccaccacagacagcgacctggactatgactacctgcagaactggggcccccgcttcaagaagctggccgacctgtatggcagcaaggacacctttgatgatgacagctag

SEQ ID NO: 18684 - DNA, 2082 bp, Artificial Sequence
  Description of Artificial Sequence: Synthetic coding sequence
atgaaggagaactactgcctgcaggccgccctggtgtgcctgggcatgctgtgccacagccacgcctttgcccctgagcggcggggccacctgcggcccagcttccacggccaccacgagaagggcaaggagggccaggtgctgcagaggagcaagaggggctgggtgtggaaccagttctttgtgattgaggagtacacaggccctgaccctgtgctggtgggccgcctgcacagcgacattgattctggagatggcaacatcaagtacatcctgtctggagagggcgccggcaccatctttgtgattgatgacaagagcggcaacatccacgccaccaagaccctggaccgggaggagcgggcccagtacaccctgatggcccaggccgtggaccgggacaccaaccggcccctggagcccccatctgagttcatcgtgaaggtgcaggacatcaatgacaaccccccagagttcctgcacgagacctaccacgccaacgtgcctgagaggagcaatgtgggcaccagcgtcatccaggtgacagccagtgatgctgatgaccccacctacggcaacagcgccaagctggtgtacagcatcctggagggccagccctacttctctgtggaggcccagacaggcatcatcagaacagccctgcccaacatggaccgggaggccaaggaggagtaccacgtggtgatccaggccaaggacatgggcggccacatgggcggcctgagcggcaccaccaaggtgaccatcaccctgacagatgtgaatgacaacccccccaagttcccccagagcgtgtaccagatgtctgtgtctgaggccgctgtgcctggagaggaggtgggccgggtgaaggccaaggaccctgacattggagaaaatggcctggtgacctacaacatcgtggatggagatggcatggagagctttgagatcaccacagattatgagacccaggagggcgtcatcaagctgaagaagcctgtggactttgagaccaagagggcctacagcctgaaggtggaggccgccaacgtgcacatcgaccccaagttcatcagcaatggccccttcaaggacacagtgacagtgaagatctctgtggaggatgctgatgagccccccatgttcctggcccccagctacatccacgaggtgcaggagaatgctgctgctggcaccgtggtgggccgggtgcacgccaaggaccctgatgctgccaacagccccatccgctacagcattgacagacacacagacctggaccgcttcttcaccatcaacccagaagatggcttcatcaagaccaccaagcccctggaccgggaggagacagcctggctgaacatcaccgtgtttgctgctgagatccacaacagacaccaggaggccaaggtgcctgtggccatccgggtgctggatgtgaatgacaatgcccccaagtttgctgccccctatgagggcttcatctgtgagagtgaccagaccaagcccctgagcaaccagcccatcgtgaccatctctgcagatgacaaggatgacacagccaacggcccccgcttcatcttcagcctgcccccagagatcatccacaaccccaacttcaccgtgcgggacaacagagacaacacagctggggtgtatgcccggcggggcggcttcagccggcagaagcaggacctgtacctgctgcccatcgtcatcagtgatggcggcatcccccccatgagcagcaccaacaccctgaccatcaaggtgtgtggctgtgatgtgaatggagccctgctgagctgcaatgctgaggcctacatcctgaatgccggcctgagcactggagccctgattgccatcctggcctgcatcgtcatcctgctgggctgccccagcctgatggagccccccagcccccgggaggacatgaggctgctgtacctgggcttccagctgatgctgttctcctatgtgaaggtgaacagacgcttctgcctgctgggcgtcttcatcaagctgcccttcctgtatgtggtggccacagagagccccaccaccctgaccagcctgtag

SEQ ID NO: 18685 - DNA, 516 bp, Artificial Sequence
  Description of Artificial Sequence: Synthetic coding sequence
atgaaggagaactactgcctgcaggccgccctggtgtgcctgggcatgctgtgccacagccacgcctttgcccctgagcggcggggccacctgcggcccagcttccacggccaccacgagaagggcaaggagggccaggtgctgcagaggagcaagaggggctgggtgtggaaccagttctttgtgattgaggagtacacaggccctgaccctgtgctggtgggccgcctgcacagcgacattgattctggagatggcaacatcaagtacatcctgtctggagagggcgccggcaccatctttgtgattgatgacaagagcggcaacatccacgccaccaagaccctggaccgggaggagcgggcccagtacaccctgatggcccaggccgtggaccgggacaccaacagaaacagcctgagccgcagcaggaccctgatgaccaccctgcggagcagctgcacccggcccatcatgcccacctgcctgcggggccccatgtgggtgaggacatag

SEQ ID NO: 18686 - DNA, 2340 bp, Artificial Sequence
  Description of Artificial Sequence: Synthetic coding sequence
atgggccctggcctggccgcccggcggctgcggccccccagccgggcccctgagatcaccgtcttcagcgcccagaggccctgtgacatccccagctgctgccacctgctgagtgaccagagtgatggctggagcgtgctgcagaagctggccgccagcatccagtgggtgaagaagctgcacagcgacatcgacagcggagatggcaacatcaagtacatcctgagcggggagggcgccggcaccatctttgtgattgatgacaagagcggcaacatccacgccaccaagaccctggaccgggaggagcgggcccagtacaccctgatggcccaggccgtggaccgggacaccaaccggcccctggagccccccagcgagttcatcgtgaaggtgcaggacatcaatgacaaccccccagagttcctgcacgagacctaccacgccaacgtgcctgagaggagcaatgtgggcaccagcgtcatccaggtgacagccagtgatgctgatgaccccacctacggcaacagcgccaagctggtgtacagcatcctggagggccagccctacttctctgtggaggcccagacaggcatcatcagaacagccctgcccaacatggaccgggaggccaaggaggagtaccacgtggtgatccaggccaaggacatgggcggccacatgggcggcctgagcggcaccaccaaggtgaccatcaccctgacagatgtgaatgacaacccccccaagttcccccagagcgtgtaccagatgtctgtgtctgaggccgctgtgcctggagaggaggtgggccgggtgaaggccaaggaccctgacatcggggagaatggcctggtgacctacaacatcgtggatggagatggcatggagagctttgagatcaccacagattatgagacccaggagggcgtcatcaagctgaagaagcctgtggactttgagaccaagagggcctacagcctgaaggtggaggccgccaacgtgcacatcgaccccaagttcatcagcaatggccccttcaaggacacagtgacagtgaagatctctgtggaggatgctgatgagccccccatgttcctggcccccagctacatccacgaggtgcaggagaatgctgctgctggcaccgtggtgggccgggtgcacgccaaggaccctgatgctgccaacagccccatccgctacagcattgacagacacacagacctggaccgcttcttcaccatcaacccagaagatggcttcatcaagaccaccaagcccctggaccgggaggagacagcctggctgaacatcaccgtgtttgctgctgagatccacaacagacaccaggaggccaaggtgcctgtggccatccgggtgctggatgtgaatgacaatgcccccaagtttgctgccccctatgagggcttcatctgtgagagtgaccagaccaagcccctgagcaaccagcccatcgtgaccatctctgcagatgacaaggatgacacagccaacggcccccgcttcatcttcagcctgcccccagagatcatccacaaccccaacttcaccgtgcgggacaacagagacaacacagctggggtgtatgccaggagaggaggcttcagccggcagaagcaggacctgtacctgctgcccatcgtcatcagtgatggcggcatcccccccatgagcagcaccaacaccctgaccatcaaggtgtgtggctgtgatgtgaatggagccctgctgagctgcaatgctgaggcctacatcctgaatgccggcctgagcactggagccctgattgccatcctggcctgcatcgtcatcctgctggtgattgtggtgctgtttgtgaccctgcggcggcagaagaaggagcccctcatcgtgtttgaggaggaggatgtgcgggagaacatcatcacctatgatgatgagggcggcggggaggaggacacagaggcctttgatattgccaccctgcagaacccagatggcatcaatggcttcatccccaggaaggacatcaagccagagtaccagtacatgcccaggcctggcctgcggcctgcccccaacagcgtggatgtggatgacttcatcaacacccgcatccaggaggccgacaatgaccccacagccccaccctatgacagcatccagatctacggctatgagggccggggctctgtggccggcagcctgagcagcctggagagcgccaccacagacagcgacctggactatgactacctgcagaactggggcccccgcttcaagaagctggccgacctgtatggcagcaaggacacctttgatgatgacagctag

SEQ ID NO: 18687 - DNA, 528 bp, Artificial Sequence
  Description of Artificial Sequence: Synthetic coding sequence
atgcagcccaggacccccctggtgctgtgtgtgctgctgagccaggtgctgctgctgaccagcgctgaggacctggactgcaccccaggcttccagcagaaggtgttccacatcaaccagcctgctgagttcatcgaggaccagagcatcctgaacctgaccttcagtgactgcaagggaaatgacaagctgcgctatgaggtgagcagcccctacttcaaggtgaacagtgatggcggcctggtggccctgaggaacatcacagctgtgggcaagaccctgtttgtgcacgcccggacccctcatgctgaggacatggccgagctggtgattgtgggcggcaaggacatccagggcagcctgcaggacatcttcaagtttgcccggaccagccctgtgccccggcagaagaggagcatcgtggtgagccccatcctgatccctgagaaccagaggcagcccttccccagagatgtgggcaagatgaagatctggcaggtgctgtgcctggcccgctggctgacctag

SEQ ID NO: 18688 - DNA, 2142 bp, Artificial Sequence
  Description of Artificial Sequence: Synthetic coding sequence
atgcagcccaggacccccctggtgctgtgtgtgctgctgagccaggtgctgctgctgaccagcgctgaggacctggactgcaccccaggcttccagcagaaggtgttccacatcaaccagcctgctgagttcatcgaggaccagagcatcctgaacctgaccttcagtgactgcaagggaaatgacaagctgcgctatgaggtgagcagcccctacttcaaggtgaacagtgatggcggcctggtggccctgaggaacatcacagctgtgggcaagaccctgtttgtgcacgcccggacccctcatgctgaggacatggccgagctggtgattgtgggcggcaaggacatccagggcagcctgcaggacatcttcaagtttgcccggaccagccctgtgccccggcagaagaggagcatcgtggtgagccccatcctgatccctgagaaccagaggcagcccttccccagagatgtgggcaaggtggtggacagcgacaggcctgagaggagcaagttccggctgaccgggaagggcgtggaccaggagcccaagggcatcttccgcatcaatgaaaatacaggctctgtgtctgtgaccaggaccctggaccgggaggtgattgctgtgtaccagctgtttgtggagaccacagatgtgaatggcaagaccctggagggccctgtgcccctggaggtgattgtcatcgaccagaatgacaaccggcccatcttccgggagggcccctacatcggccacgtgatggagggcagccccaccggcaccaccgtgatgaggatgacagcctttgatgctgatgatcctgccacagacaatgccctgctgcgctacaacatccggcagcagaccccagacaagcccagccccaacatgttctacattgatcctgagaagggggacatcgtgacagtggtgtccccagccctgctggaccgggagaccctggagaaccccaagtatgagctgatcatcgaggcccaggacatggccggcctggatgtgggcctgaccggcacagccacagccaccatcatgattgatgacaagaatgaccacagccccaagttcaccaagaaggagttccaggccaccgtggaggagggcgctgtgggcgtcatcgtgaacctgactgtggaggacaaggatgaccccaccactggagcctggagggctgcctacaccatcatcaatggaaatcctggccagagctttgagatccacaccaacccccagaccaatgaaggcatgctgtctgtggtgaagcccctggactatgagatcagcgccttccacaccctgctgatcaaggtggagaatgaagaccccctggtgcctgatgtgtcctatggccccagcagcacagccaccgtgcacatcaccgtgctggatgtgaatgaaggacctgtgttctacccagaccccatgatggtgacccggcaggaggacctgtctgtgggctctgtgctgctgactgtgaatgccacagatcctgacagcctgcagcaccagaccatccgctacagcgtgtacaaggaccctgctggctggctgaacatcaaccccatcaatggcaccgtggacaccacagctgtgctggaccgggagagcccctttgtggacaacagcgtgtacacagccctcttcctggccatcgacagcggcaaccccccagccaccggcaccggcaccctgctgatcaccctggaggatgtgaatgacaatgcccccttcatctaccccaccgtggccgaggtgtgtgatgatgccaagaacctgtctgtggtgatcctgggcgccagtgacaaggacctgcaccccaacacagaccccttcaagtttgagatccacaagcaggccgtgcctgacaaggtgtggaagatcagcaagatcaacaacacccacgccctggtgtccctgctgcagaacctgaacaaggccaactacaacctgcccatcatggtgacagacagcggcaagccacccatgaccaacatcacagacctgcgggtgcaggtgtgcagctgcaggaacagcaaggtggactgcaatgctgctggggccctgcgcttcagcctgcccagcgtgctgctgctgagcctcttcagcctggcctgcctgtag

SEQ ID NO: 18689 - DNA, 2283 bp, Artificial Sequence
  Description of Artificial Sequence: Synthetic coding sequence
atgaagaccccacctggggccagcagcaggaccaagtgcagccgggagctgcgctccttctgtgccttcagctgcccccgggccaagcagcccacctgcacagcctggttcccccagcaggagcaccccagtgaaaatggcccccagatgcctggccgggaccccccagctgccagcaccatgcaggtgctgctgctgaccagcgctgaggacctggactgcaccccaggcttccagcagaaggtgttccacatcaaccagcctgctgagttcatcgaggaccagagcatcctgaacctgaccttcagtgactgcaagggaaatgacaagctgcgctatgaggtgagcagcccctacttcaaggtgaacagtgatggcggcctggtggccctgaggaacatcacagctgtgggcaagaccctgtttgtgcacgcccggacccctcatgctgaggacatggccgagctggtgattgtgggcggcaaggacatccagggcagcctgcaggacatcttcaagtttgcccggaccagccctgtgccccggcagaagaggagcatcgtggtgagccccatcctgatccctgagaaccagaggcagcccttccccagagatgtgggcaaggtggtggacagcgacaggcctgagaggagcaagttccggctgactggaaaaggagtggaccaggagcccaagggcatcttccgcatcaatgaaaatactggatctgtgtctgtgaccaggaccctggaccgggaggtgattgctgtgtaccagctgtttgtggagaccacagatgtgaatggcaagaccctggagggccctgtgcccctggaggtgattgtgattgaccagaatgacaaccggcccatcttccgggagggcccctacatcggccacgtgatggagggcagccccaccggcaccaccgtgatgaggatgacagcctttgatgctgatgatcctgccacagacaatgccctgctgcgctacaacatccggcagcagaccccagacaagcccagccccaacatgttctacatcgaccctgagaagggggacatcgtgacagtggtgtccccagccctgctggaccgggagaccctggagaaccccaagtatgagctgatcatcgaggcccaggacatggccggcctggatgtgggcctgactggaacagccacagccaccatcatgattgatgacaagaatgaccacagccccaagttcaccaagaaggagttccaggccaccgtggaggagggcgctgtgggcgtgattgtgaacctgactgtggaggacaaggatgaccccaccaccggggcctggagggctgcctacaccatcatcaatggaaatcctggccagagctttgagatccacaccaacccccagaccaatgaaggcatgctgtctgtggtgaagcccctggactatgagatcagcgccttccacaccctgctgatcaaggtggagaatgaagaccccctggtgcctgatgtgtcctatggccccagcagcacagccaccgtgcacatcaccgtgctggatgtgaatgaaggacctgtgttctacccagaccccatgatggtgacccggcaggaggacctgtctgtgggctctgtgctgctgactgtgaatgccacagatcctgacagcctgcagcaccagaccatccgctacagcgtgtacaaggaccctgctggctggctgaacatcaaccccatcaatggaacagtggacaccacagctgtgctggaccgggagagcccctttgtggacaacagcgtgtacacagccctcttcctggccattgattctggcaaccccccagccactggaacaggcaccctgctgatcaccctggaggatgtgaatgacaatgcccccttcatctaccccaccgtggccgaggtgtgtgatgatgccaagaacctgtctgtggtgatcctgggcgccagtgacaaggacctgcaccccaacacagaccccttcaagtttgagatccacaagcaggccgtgcctgacaaggtgtggaagatcagcaagatcaacaacacccacgccctggtgtccctgctgcagaacctgaacaaggccaactacaacctgcccatcatggtgacagattctgggaagccacccatgaccaacatcacagacctgcgggtgcaggtgtgcagctgcaggaacagcaaggtggactgcaatgctgctggggccctgcgcttcagcctgcccagcgtgctgctgctgagcctcttcagcctggcctgcaagtag

SEQ ID NO: 18690 - DNA, 2142 bp, Artificial Sequence
  Description of Artificial Sequence: Synthetic coding sequence
atgcagcccaggacccccctggtgctgtgtgtgctgctgagccaggtgctgctgctgaccagcgctgaggacctggactgcaccccaggcttccagcagaaggtgttccacatcaaccagcctgctgagttcatcgaggaccagagcatcctgaacctgaccttcagtgactgcaagggaaatgacaagctgcgctatgaggtgagcagcccctacttcaaggtgaacagtgatggcggcctggtggccctgaggaacatcacagctgtgggcaagaccctgtttgtgcacgcccggacccctcatgctgaggacatggccgagctggtgattgtgggcggcaaggacatccagggcagcctgcaggacatcttcaagtttgcccggaccagccctgtgccccggcagaagaggagcatcgtggtgagccccatcctgatccctgagaaccagaggcagcccttccccagagatgtgggcaaggtggtggacagcgacaggcctgagaggagcaagttccggctgaccgggaagggcgtggaccaggagcccaagggcatcttccgcatcaatgaaaatacaggctctgtgtctgtgaccaggaccctggaccgggaggtgattgctgtgtaccagctgtttgtggagaccacagatgtgaatggcaagaccctggagggccctgtgcccctggaggtgattgtcatcgaccagaatgacaaccggcccatcttccgggagggcccctacatcggccacgtgatggagggcagccccaccggcaccaccgtgatgaggatgacagcctttgatgctgatgatcctgccacagacaatgccctgctgcgctacaacatccggcagcagaccccagacaagcccagccccaacatgttctacattgatcctgagaagggggacatcgtgacagtggtgtccccagccctgctggaccgggagaccctggagaaccccaagtatgagctgatcatcgaggcccaggacatggccggcctggatgtgggcctgaccggcacagccacagccaccatcatgattgatgacaagaatgaccacagccccaagttcaccaagaaggagttccaggccaccgtggaggagggcgctgtgggcgtcatcgtgaacctgactgtggaggacaaggatgaccccaccactggagcctggagggctgcctacaccatcatcaatggaaatcctggccagagctttgagatccacaccaacccccagaccaatgaaggcatgctgtctgtggtgaagcccctggactatgagatcagcgccttccacaccctgctgatcaaggtggagaatgaagaccccctggtgcctgatgtgtcctatggccccagcagcacagccaccgtgcacatcaccgtgctggatgtgaatgaaggacctgtgttctacccagaccccatgatggtgacccggcaggaggacctgtctgtgggctctgtgctgctgactgtgaatgccacagatcctgacagcctgcagcaccagaccatccgctacagcgtgtacaaggaccctgctggctggctgaacatcaaccccatcaatggcaccgtggacaccacagctgtgctggaccgggagagcccctttgtggacaacagcgtgtacacagccctcttcctggccatcgacagcggcaaccccccagccaccggcaccggcaccctgctgatcaccctggaggatgtgaatgacaatgcccccttcatctaccccaccgtggccgaggtgtgtgatgatgccaagaacctgtctgtggtgatcctgggcgccagtgacaaggacctgcaccccaacacagaccccttcaagtttgagatccacaagcaggccgtgcctgacaaggtgtggaagatcagcaagatcaacaacacccacgccctggtgtccctgctgcagaacctgaacaaggccaactacaacctgcccatcatggtgacagacagcggcaagccacccatgaccaacatcacagacctgcgggtgcaggtgtgcagctgcaggaacagcaaggtggactgcaatgctgctggggccctgcgcttcagcctgcccagcgtgctgctgctgagcctcttcagcctggcctgcaagtag

SEQ ID NO: 18691 - DNA, 573 bp, Artificial Sequence
  Description of Artificial Sequence: Synthetic coding sequence
atgcagcccaggacccccctggtgctgtgtgtgctgctgagccaggtgctgctgctgaccagcgctgaggacctggactgcaccccaggcttccagcagaaggtgttccacatcaaccagcctgctgagttcatcgaggaccagagcatcctgaacctgaccttcagtgactgcaagggaaatgacaagctgcgctatgaggtgagcagcccctacttcaaggtgaacagtgatggcggcctggtggccctgaggaacatcacagctgtgggcaagaccctgtttgtgcacgcccggacccctcatgctgaggacatggccgagctggtgattgtgggcggcaaggacatccagggcagcctgcaggacatcttcaagtttgcccggaccagccctgtgccccggcagaagaggagcatcgtggtgagccccatcctgatccctgagaaccagaggcagcccttccccagagatgtgggcaagaggacccacaaccccatcaacagcgagctgctgctgaatgaaggcatcacagctgacctgaacccctgcatcaccatcctggccatctag

SEQ ID NO: 18692 - DNA, 528 bp, Artificial Sequence; identical to SEQ ID NO: 18687
  Description of Artificial Sequence: Synthetic coding sequence

SEQ ID NO: 18693 - DNA, 2025 bp, Artificial Sequence
  Description of Artificial Sequence: Synthetic coding sequence
atgcagcccaggacccccctggtgctgtgtgtgctgctgagccaggtgctgctgctgaccagcgctgaggacctggactgcaccccaggcttccagcagaaggtgttccacatcaaccagcctgctgagttcatcgaggaccagagcatcctgaacctgaccttcagtgactgcaagggaaatgacaagctgcgctatgaggtgagcagcccctacttcaaggtgaacagtgatggcggcctggtggccctgaggaacatcacagctgtgggcaagaccctgtttgtgcacgcccggacccctcatgctgaggacatggccgagctggtgattgtgggcggcaaggacatccagggcagcctgcaggtggtggacagcgacaggcctgagaggagcaagttccggctgactggaaaaggagtggaccaggagcccaagggcatcttccgcatcaatgaaaatactggatctgtgtctgtgaccaggaccctggaccgggaggtgattgctgtgtaccagctgtttgtggagaccacagatgtgaatggcaagaccctggagggccctgtgcccctggaggtgattgtgattgaccagaatgacaaccggcccatcttccgggagggcccctacatcggccacgtgatggagggcagccccaccggcaccaccgtgatgaggatgacagcctttgatgctgatgatcctgccacagacaatgccctgctgcgctacaacatccggcagcagaccccagacaagcccagccccaacatgttctacatcgaccctgagaagggggacatcgtgacagtggtgtccccagccctgctggaccgggagaccctggagaaccccaagtatgagctgatcatcgaggcccaggacatggccggcctggatgtgggcctgactggaacagccacagccaccatcatgattgatgacaagaatgaccacagccccaagttcaccaagaaggagttccaggccaccgtggaggagggcgctgtgggcgtgattgtgaacctgactgtggaggacaaggatgaccccaccaccggggcctggagggctgcctacaccatcatcaatggaaatcctggccagagctttgagatccacaccaacccccagaccaatgaaggcatgctgtctgtggtgaagcccctggactatgagatcagcgccttccacaccctgctgatcaaggtggagaatgaagaccccctggtgcctgatgtgtcctatggccccagcagcacagccaccgtgcacatcaccgtgctggatgtgaatgaaggacctgtgttctacccagaccccatgatggtgacccggcaggaggacctgtctgtgggctctgtgctgctgactgtgaatgccacagatcctgacagcctgcagcaccagaccatccgctacagcgtgtacaaggaccctgctggctggctgaacatcaaccccatcaatggaacagtggacaccacagctgtgctggaccgggagagcccctttgtggacaacagcgtgtacacagccctcttcctggccattgattctggcaaccccccagccactggaacaggcaccctgctgatcaccctggaggatgtgaatgacaatgcccccttcatctaccccaccgtggccgaggtgtgtgatgatgccaagaacctgtctgtggtgatcctgggcgccagtgacaaggacctgcaccccaacacagaccccttcaagtttgagatccacaagcaggccgtgcctgacaaggtgtggaagatcagcaagatcaacaacacccacgccctggtgtccctgctgcagaacctgaacaaggccaactacaacctgcccatcatggtgacagattctgggaagccacccatgaccaacatcacagacctgcgggtgcaggtgtgcagctgcaggaacagcaaggtggactgcaatgctgctggggccctgcgcttcagcctgcccagcgtgctgctgctgagcctcttcagcctggcctgcaagtag

SEQ ID NO: 18694 - DNA, 1248 bp, Artificial Sequence
  Description of Artificial Sequence: Synthetic coding sequence
atgcagcccaggacccccctggtgctgtgtgtgctgctgagccaggtggccctgctggaccgggagaccctggagaaccccaagtatgagctgatcatcgaggcccaggacatggccggcctggatgtgggcctgaccggcacagccacagccaccatcatgattgatgacaagaatgaccacagccccaagttcaccaagaaggagttccaggccaccgtggaggagggcgctgtgggcgtcatcgtgaacctgactgtggaggacaaggatgaccccaccactggagcctggagggctgcctacaccatcatcaatggaaatcctggccagagctttgagatccacaccaacccccagaccaatgaaggcatgctgtctgtggtgaagcccctggactatgagatcagcgccttccacaccctgctgatcaaggtggagaatgaagaccccctggtgcctgatgtgtcctatggccccagcagcacagccaccgtgcacatcaccgtgctggatgtgaatgaaggacctgtgttctacccagaccccatgatggtgacccggcaggaggacctgtctgtgggctctgtgctgctgactgtgaatgccacagatcctgacagcctgcagcaccagaccatccgctacagcgtgtacaaggaccctgctggctggctgaacatcaaccccatcaatggcaccgtggacaccacagctgtgctggaccgggagagcccctttgtggacaacagcgtgtacacagccctcttcctggccatcgacagcggcaaccccccagccaccggcaccggcaccctgctgatcaccctggaggatgtgaatgacaatgcccccttcatctaccccaccgtggccgaggtgtgtgatgatgccaagaacctgtctgtggtgatcctgggcgccagtgacaaggacctgcaccccaacacagaccccttcaagtttgagatccacaagcaggccgtgcctgacaaggtgtggaagatcagcaagatcaacaacacccacgccctggtgtccctgctgcagaacctgaacaaggccaactacaacctgcccatcatggtgacagacagcggcaagccacccatgaccaacatcacagacctgcgggtgcaggtgtgcagctgcaggaacagcaaggtggactgcaatgctgctggggccctgcgcttcagcctgcccagcgtgctgctgctgagcctcttcagcctggcctgcaagtag

SEQ ID NO: 18695 - DNA, 819 bp, Artificial Sequence
  Description of Artificial Sequence: Synthetic coding sequence
atgcagcccaggacccccctggtgctgtgtgtgctgctgagccaggtgctgctgctgaccagcgctgaggacctggactgcaccccaggcttccagcagaaggtgttccacatcaaccagcctgctgagttcatcgaggaggacctgtctgtgggctctgtgctgctgactgtgaatgccacagatcctgacagcctgcagcaccagaccatccgctacagcgtgtacaaggaccctgctggctggctgaacatcaaccccatcaatggaacagtggacaccacagctgtgctggaccgggagagcccctttgtggacaacagcgtgtacacagccctcttcctggccattgattctggcaaccccccagccactggaacaggcaccctgctgatcaccctggaggatgtgaatgacaatgcccccttcatctaccccaccgtggccgaggtgtgtgatgatgccaagaacctgtctgtggtgatcctgggcgccagtgacaaggacctgcaccccaacacagaccccttcaagtttgagatccacaagcaggccgtgcctgacaaggtgtggaagatcagcaagatcaacaacacccacgccctggtgtccctgctgcagaacctgaacaaggccaactacaacctgcccatcatggtgacagattctgggaagccacccatgaccaacatcacagacctgcgggtgcaggtgtgcagctgcaggaacagcaaggtggactgcaatgctgctggggccctgcgcttcagcctgcccagcgtgctgctgctgagcctcttcagcctggcctgcaagtag

SEQ ID NO: 18696 - DNA, 1212 bp, Artificial Sequence
  Description of Artificial Sequence: Synthetic coding sequence
gtggtgtccccagccctgctggaccgggagaccctggagaaccccaagtatgagctgatcatcgaggcccaggacatggccggcctggatgtgggcctgaccggcacagccacagccaccatcatgattgatgacaagaatgaccacagccccaagttcaccaagaaggagttccaggccaccgtggaggagggcgctgtgggcgtcatcgtgaacctgactgtggaggacaaggatgaccccaccactggagcctggagggctgcctacaccatcatcaatggaaatcctggccagagctttgagatccacaccaacccccagaccaatgaaggcatgctgtctgtggtgaagcccctggactatgagatcagcgccttccacaccctgctgatcaaggtggagaatgaagaccccctggtgcctgatgtgtcctatggccccagcagcacagccaccgtgcacatcaccgtgctggatgtgaatgaaggacctgtgttctacccagaccccatgatggtgacccggcaggaggacctgtctgtgggctctgtgctgctgactgtgaatgccacagatcctgacagcctgcagcaccagaccatccgctacagcgtgtacaaggaccctgctggctggctgaacatcaaccccatcaatggcaccgtggacaccacagctgtgctggaccgggagagcccctttgtggacaacagcgtgtacacagccctcttcctggccatcgacagcggcaaccccccagccaccggcaccggcaccctgctgatcaccctggaggatgtgaatgacaatgcccccttcatctaccccaccgtggccgaggtgtgtgatgatgccaagaacctgtctgtggtgatcctgggcgccagtgacaaggacctgcaccccaacacagaccccttcaagtttgagatccacaagcaggccgtgcctgacaaggtgtggaagatcagcaagatcaacaacacccacgccctggtgtccctgctgcagaacctgaacaaggccaactacaacctgcccatcatggtgacagacagcggcaagccacccatgaccaacatcacagacctgcgggtgcaggtgtgcagctgcaggaacagcaaggtggactgcaatgctgctggggccctgcgcttcagcctgcccagcgtgctgctgctgagcctcttcagcctggcctgcctgtag

SEQ ID NO: 18697 - DNA, 2721 bp, Artificial Sequence
  Description of Artificial Sequence: Synthetic coding sequence
atgtgcagaattgctggggccctgcggaccctgctgcccctgctggccgccctgctgcaggcctctgtggaggccagcggggagatcgccctgtgcaagacaggcttcccagaagatgtgtacagcgctgtgctgagcaaggatgtgcatgagggccagcccctgctgaatgtgaagttcagcaactgcaatggcaagaggaaggtgcagtatgagagcagcgagcctgctgacttcaaggtggatgaagatggcatggtgtatgctgtgcgctccttccccctgagcagcgagcacgccaagttcctgatctatgcccaggacaaggagacccaggagaagtggcaggtggccgtgaagctgagcctgaagcccaccctgacagaggagagcgtgaaggagagcgctgaggtggaggagatcgtgttcccccggcagttcagcaagcacagcggccacctgcagaggcagaagagggactgggtgatcccccccatcaacctgcctgagaacagccggggccccttcccccaggagctggtgcgcatccgcagtgaccgggacaagaacctgagcctgcgctacagcgtgacaggccctggagctgaccagcccccaacaggcatcttcatcatcaaccccatcagcggccagctgtctgtgaccaagcccctggaccgggagcagatcgcccgcttccacctgcgggcccatgctgtggacatcaatggaaaccaggtggagaaccccattgatattgtcatcaacgtcatcgacatgaatgacaacagacctgagttcctgcaccaggtgtggaatggaacagtgcctgagggcagcaagccaggcacctacgtgatgacagtgacagccattgatgctgatgaccccaatgccctgaatggcatgctgcgctaccgcatcgtgtcccaggcccccagcacccccagccccaacatgttcaccatcaacaatgaaacaggagacatcatcaccgtggccgccggcctggaccgggagaaggtgcagcagtacaccctcatcatccaggccacagacatggagggcaaccccacctacggcctgagcaacacagccacagctgtgatcaccgtgacagatgtgaatgacaaccccccagagttcaccgccatgaccttctacggggaggtgcctgaaaatagagtggacatcatcgtggccaacctgactgtgacagacaaggaccagccccacaccccagcctggaatgctgtgtaccgcatctctggaggagaccccaccggccgctttgccatccagacagaccccaacagcaatgatggcctggtgacagtggtgaagcccatcgactttgagaccaacaggatgtttgtgctgactgtggccgctgagaaccaggtgcccctggccaagggcatccagcaccccccccagagcacagccaccgtgtctgtgacagtgattgatgtgaatgaaaacccctactttgcccccaaccccaagatcatccggcaggaggagggcctgcacgccggcaccatgctgaccaccttcaccgcccaggaccctgaccgctacatgcagcagaacatccgctacaccaagctgagtgaccctgccaactggctgaagattgatcctgtgaatggccagatcaccaccatcgctgtgctggaccgggagagccccaacgtgaagaacaacatctacaatgccaccttcctggccagtgacaatggcatcccccccatgagcggcaccggcaccctgcagatctacctgctggacatcaatgacaatgccccccaggtgctgccccaggaggccgagacctgtgagaccccagaccccaacagcatcaacatcacagccctggactatgacatcgaccccaatgccggcccctttgcctttgacctgcccctgagccctgtgaccatcaagaggaactggaccatcacccggctgaatggagactttgcccagctgaacctgaagatcaagttcctggaggccggcatctatgaggtgcccatcatcatcacagattctggcaacccccccaagagcaacatcagcatcctgcgggtgaaggtgtgccagtgtgacagcaatggagactgcacagatgtggacagaattgtgggcgccggcctgggcaccggggccatcatcgccatcctgctgtgcatcatcatcctgctgatcctggtgctgatgtttgtggtgtggatgaagaggcgggacaaggagcggcaggccaagcagctgctgattgatcctgaagatgatgtgcgggacaacatcctgaagtatgatgaggagggcggcggggaggaggaccaggactatgacctgagccagctgcagcagcctgacacagtggagccagatgccatcaagcctgtgggcatccggaggatggatgagcggcccatccacgccgagccccagtaccctgtgcgctctgctgccccccaccctggggacatcggggacttcatcaatgaaggcctgaaggctgctgacaatgaccccacagccccaccctatgacagcctgctggtgtttgattatgagggcagcggcagcacagctggcagcctgagcagcctgaacagcagcagcagcggcggggagcaggactatgactacctgaatgactggggcccccgcttcaagaagctggccgacatgtatggaggaggagatgactag

SEQ ID NO: 18698 - DNA, 2628 bp, Artificial Sequence
  Description of Artificial Sequence: Synthetic coding sequence
atgttcctgctgcggcgctacgtgtgcatcttcacagagaagctgaagaaccaggccgagctgtatgtgttcctgtctgtgaagttcagcaactgcaatggcaagaggaaggtgcagtatgagagcagcgagcctgctgacttcaaggtggatgaagatggcatggtgtatgctgtgcgctccttccccctgagcagcgagcacgccaagttcctgatctatgcccaggacaaggagacccaggagaagtggcaggtggccgtgaagctgagcctgaagcccaccctgacagaggagagcgtgaaggagagcgctgaggtggaggagatcgtgttcccccggcagttcagcaagcacagcggccacctgcagaggcagaagagggactgggtgattcctcccatcaacctgcctgagaacagccggggccccttcccccaggagctggtgcgcatccgcagtgaccgggacaagaacctgagcctgcgctacagcgtgactggacctggagctgaccagccccccaccggcatcttcatcatcaaccccatcagcggccagctgtctgtgaccaagcccctggaccgggagcagatcgcccgcttccacctgcgggcccatgctgtggacatcaatggaaaccaggtggagaaccccatcgacatcgtcatcaacgtgattgacatgaatgacaacagacctgagttcctgcaccaggtgtggaatggcaccgtgcctgagggcagcaagccaggcacctacgtgatgacagtgacagccattgatgctgatgaccccaatgccctgaatggcatgctgcgctacagaattgtgtcccaggcccccagcacccccagccccaacatgttcaccatcaacaatgagaccggggacatcatcaccgtggccgccggcctggaccgggagaaggtgcagcagtacaccctcatcatccaggccacagacatggagggcaaccccacctacggcctgagcaacacagccacagctgtgatcaccgtgacagatgtgaatgacaaccccccagagttcaccgccatgaccttctatggagaggtgcctgagaacagagtggacatcatcgtggccaacctgactgtgacagacaaggaccagccccacaccccagcctggaatgctgtgtaccgcatcagcggcggggaccccaccggccgctttgccatccagacagaccccaacagcaatgatggcctggtgacagtggtgaagcccatcgactttgagaccaacaggatgtttgtgctgactgtggccgctgagaaccaggtgcccctggccaagggcatccagcaccccccccagagcacagccaccgtgtctgtgacagtgattgatgtgaatgaaaacccctactttgcccccaaccccaagatcatccggcaggaggagggcctgcatgctggcaccatgctgaccaccttcaccgcccaggaccctgaccgctacatgcagcagaacatccgctacaccaagctgagtgaccctgccaactggctgaagattgatcctgtgaatggccagatcaccaccatcgctgtgctggaccgggagagccccaacgtgaagaacaacatctacaatgccaccttcctggccagtgacaatggcatcccccccatgtctggaacaggcaccctgcagatctacctgctggacatcaatgacaatgccccccaggtgctgccccaggaggccgagacctgtgagaccccagaccccaacagcatcaacatcacagccctggactatgacatcgaccccaatgccggcccctttgcctttgacctgcccctgagccctgtgaccatcaagaggaactggaccatcacccggctgaatggagactttgcccagctgaacctgaagatcaagttcctggaggccggcatctatgaggtgcccatcatcatcacagacagcggcaacccccccaagagcaacatcagcatcctgcgggtgaaggtgtgccagtgtgacagcaatggagactgcacagatgtggaccgcatcgtgggcgccggcctgggcactggagccatcatcgccatcctgctgtgcatcatcatcctgctgatcctggtgctgatgtttgtggtgtggatgaagagaagagacaaggagcggcaggccaagcagctgctgattgatcctgaagatgatgtgcgggacaacatcctgaagtatgatgaggagggcggcggggaggaggaccaggactatgacctgagccagctgcagcagcctgacacagtggagccagatgccatcaagcctgtgggcatccggaggatggatgagcggcccatccatgctgagccccagtaccctgtgcgctctgctgccccccaccctggggacattggagacttcatcaatgaaggcctgaaggctgctgacaatgaccccacagccccaccctatgacagcctgctggtgtttgattatgagggcagcggcagcacagctggcagcctgagcagcctgaacagcagcagcagtggaggagagcaggactatgactacctgaatgactggggcccccgcttcaagaagctggccgacatgtatggaggaggagatgactag

SEQ ID NO: 18699 - DNA, 2355 bp, Artificial Sequence
  Description of Artificial Sequence: Synthetic coding sequence
atgcagaggctgatgatgctgctggccaccagcggggcctgcctgggcctgctggccgtggccgctgtggccgccgccggggccaacccagcccagagggacacccacagcctgctgcccacccaccggcggcagaagagggactggatctggaaccagatgcacattgatgaggagaagaacaccagcctgccccaccacgtgggcaagatcaagagctctgtgtccaggaagaatgccaagtacctgctgaagggggagtatgtgggcaaggtgttccgggtggatgctgagactggagatgtgtttgccatcgagcggctggaccgggagaacatcagcgagtaccacctgacagctgtgattgtggacaaggacacaggagagaacctggagacccccagcagcttcaccatcaaggtgcatgatgtgaatgacaactggcctgtgttcacccacaggctcttcaatgcctctgtgcctgagagcagcgctgtgggcaccagcgtcatctctgtgacagctgtggatgctgatgaccccaccgtgggggaccacgcctctgtgatgtaccagatcctgaagggcaaggagtactttgccatcgacaacagcggccgcatcatcaccatcaccaagagcctggaccgggagaagcaggcccgctatgaaattgtggtggaggccagagatgcccagggcctgcggggggacagcggcacagccaccgtgctggtgaccctgcaggacatcaatgacaacttccccttcttcacccagaccaagtacacctttgtggtgcctgaggacaccagggtgggcacctctgtgggcagcctgtttgtggaggaccctgatgagccccagaacaggatgaccaagtacagcatcctgcggggggactaccaggatgccttcaccatcgagaccaacccagcccacaatgaaggcatcatcaagcccatgaagcccctggactatgagtacatccagcagtacagcttcatcgtggaggccacagaccccaccatcgacctgcgctacatgagccccccagctggcaacagagcccaggtgatcatcaacatcacagatgtggatgagccccccatcttccagcagcccttctaccacttccagctgaaggagaaccagaagaagcccctcatcggcaccgtgctggccatggaccctgatgctgcccggcacagcatcggctacagcatccggaggaccagtgacaagggccagttcttccgggtgaccaagaagggggacatctacaatgagaaggagctggaccgggaggtgtacccctggtacaacctgactgtggaggccaaggagctggacagcacaggcacccccaccgggaaggagagcatcgtgcaggtgcacatcgaggtgctggatgaaaatgacaatgcccctgagtttgccaagccctaccagcccaaggtgtgtgaaaatgctgtgcacggccagctggtgctgcagatcagcgccatcgacaaggacatcaccccaagaaatgtgaagttcaagttcatcctgaacacagagaacaacttcaccctgacagacaaccacgacaacacagccaacatcaccgtgaagtatggccagtttgaccgggagcacaccaaggtgcacttcctgcctgtggtgatcagtgacaatggcatgcccagcaggacaggcaccagcaccctgactgtggccgtgtgcaagtgcaatgagcagggcgagttcaccttctgtgaggacatggccgcccaggtgggcgtgtccatccaggccgtggtggccatcctgctgtgcatcctgaccatcaccgtcatcaccctgctgatcttcctgcggcggcggctgaggaagcaggcccgggcccacggcaagtctgtgcctgagatccacgagcagctggtgacctatgatgaggagggcggcggggagatggacaccaccagctatgatgtgtctgtgctgaacagcgtgagaagaggaggagccaagccacccaggcctgccctggatgcccggcccagcctgtatgcccaggtgcagaagcccccaagacatgcccctggggcccatggaggccctggagagatggccgccatgattgaggtgaagaaggatgaggccgaccatgatggagatggccccccctatgacaccctgcacatctacggctatgagggcagcgagagcattgctgagagcctgagcagcctgggcacagacagcagtgacagtgatgtggactatgacttcctgaatgactggggcccccgcttcaagatgctggccgagctgtatggcagtgacccccgggaggagctgctgtactag

SEQ ID NO: 18700 - DNA, 2010 bp, Artificial Sequence
  Description of Artificial Sequence: Synthetic coding sequence
atgcagaggctgatgatgctgctggccaccagcggggcctgcctgggcctgctggccgtggccgctgtggccgccgccggggccaacccagcccagagggacacccacagcctgctgcccacccaccggcggcagaagagggactggatctggaaccagatgcacattgatgaggagaagaacaccagcctgccccaccacgtgggcaagatcaagagctctgtgtccaggaagaatgccaagtacctgctgaagggggagtatgtgggcaaggtgttccgggtggatgctgagactggagatgtgtttgccatcgagcggctggaccgggagaacatcagcgagtaccacctgacagctgtgattgtggacaaggacacaggagagaacctggagacccccagcagcttcaccatcaaggtgcatgatgtgaatgacaactggcctgtgttcacccacaggctcttcaatgcctctgtgcctgagagcagcgctgtgggcaccagcgtcatctctgtgacagctgtggatgctgatgaccccaccgtgggggaccacgcctctgtgatgtaccagatcctgaagggcaaggagtactttgccatcgacaacagcggccgcatcatcaccatcaccaagagcctggaccgggagaagcaggcccgctatgaaattgtggtggaggccagagatgcccagggcctgcggggggacagcggcacagccaccgtgctggtgaccctgcaggacatcaatgacaacttccccttcttcacccagaccaagtacacctttgtggtgcctgaggacaccagggtgggcacctctgtgggcagcctgtttgtggaggaccctgatgagccccagaacaggatgaccaagtacagcatcctgcggggggactaccaggatgccttcaccatcgagaccaacccagcccacaatgaaggcatcatcaagcccatgaagcccctggactatgagtacatccagcagtacagcttcatcgtggaggccacagaccccaccatcgacctgcgctacatgagccccccagctggcaacagagcccaggtgatcatcaacatcacagatgtggatgagccccccatcttccagcagcccttctaccacttccagctggtgctgcagatcagcgccatcgacaaggacatcaccccaagaaatgtgaagttcaagttcatcctgaacacagagaacaacttcaccctgacagacaaccacgacaacacagccaacatcaccgtgaagtatggccagtttgaccgggagcacaccaaggtgcacttcctgcctgtggtgatcagtgacaatggcatgcccagcaggacaggcaccagcaccctgactgtggccgtgtgcaagtgcaatgagcagggcgagttcaccttctgtgaggacatggccgcccaggtgggcgtgtccatccaggccgtggtggccatcctgctgtgcatcctgaccatcaccgtcatcaccctgctgatcttcctgcggcggcggctgaggaagcaggcccgggcccacggcaagtctgtgcctgagatccacgagcagctggtgacctatgatgaggagggcggcggggagatggacaccaccagctatgatgtgtctgtgctgaacagcgtgcggcggggcggggccaagccacccaggcctgccctggatgcccggcccagcctgtatgcccaggtgcagaagccacccaggcatgcccctggggcccacggcggccctggagagatggccgccatgattgaggtgaagaaggatgaagctgaccatgatggagatggccccccctatgacaccctgcacatctacggctatgagggcagcgagagcattgctgagagcctgagcagcctgggcacagacagcagtgacagtgatgtggactatgacttcctgaatgactggggcccccgcttcaagatgctggccgagctgtatggcagtgacccccgggaggagctgctgtactag

SEQ ID NO: 18701 - DNA, 672 bp, Artificial Sequence
  Description of Artificial Sequence: Synthetic coding sequence
atgcccagcaggacaggcaccagcaccctgactgtggccgtgtgcaagtgcaatgagcagggcgagttcaccttctgtgaggacatggccgcccaggtgggcgtgtccatccaggccgtggtggccatcctgctgtgcatcctgaccatcaccgtcatcaccctgctgatcttcctgcggcggcggctgaggaagcaggcccgggcccacggcaagtctgtgcctgagatccacgagcagctggtgacctatgatgaggagggcggcggggagatggacaccaccagctatgatgtgtctgtgctgaacagcgtgcggcggggcggggccaagccacccaggcctgccctggatgcccggcccagcctgtatgcccaggtgcagaagccacccaggcatgcccctggggcccacggcggccctggagagatggccgccatgattgaggtgaagaaggatgaagctgaccatgatggagatggccccccctatgacaccctgcacatctacggctatgagggcagcgagagcattgctgagagcctgagcagcctgggcacagacagcagtgacagtgatgtggactatgacttcctgaatgactggggcccccgcttcaagatgctggccgagctgtatggcagtgacccccgggaggagctgctgtactag

SEQ ID NO: 18702 - DNA, 1578 bp, Artificial Sequence
  Description of Artificial Sequence: Synthetic coding sequence
atgcccagcacctgcagcaaggagaacatgtgggcccggagcagcggctccatgcagaggcaggagacctgcagccccctgcgggcccagaacaggatgaccaagtacagcatcctgcggggggactaccaggatgccttcaccatcgagaccaacccagcccacaatgaaggcatcatcaagcccatgaagcccctggactatgagtacatccagcagtacagcttcatcgtggaggccacagaccccaccatcgacctgcgctacatgagccccccagctggcaacagagcccaggtgatcatcaacatcacagatgtggatgagccccccatcttccagcagcccttctaccacttccagctgaaggagaaccagaagaagcccctgattggaacagtgctggccatggaccctgatgctgcccggcacagcatcggctacagcatccggaggaccagtgacaagggccagttcttccgggtgaccaagaagggggacatctacaatgagaaggagctggaccgggaggtgtacccctggtacaacctgactgtggaggccaaggagctggacagcacaggcacccccaccgggaaggagagcatcgtgcaggtgcacatcgaggtgctggatgaaaatgacaatgcccctgagtttgccaagccctaccagcccaaggtgtgtgaaaatgctgtgcacggccagctggtgctgcagatcagcgccatcgacaaggacatcaccccaagaaatgtgaagttcaagttcatcctgaacacagagaacaacttcaccctgacagacaaccacgacaacacagccaacatcaccgtgaagtatggccagtttgaccgggagcacaccaaggtgcacttcctgcctgtggtgatcagtgacaatggcatgcccagcaggacaggcaccagcaccctgactgtggccgtgtgcaagtgcaatgagcagggcgagttcaccttctgtgaggacatggccgcccaggtgggcgtgtccatccaggccgtggtggccatcctgctgtgcatcctgaccatcaccgtcatcaccctgctgatcttcctgcggcggcggctgaggaagcaggcccgggcccacggcaagtctgtgcctgagatccacgagcagctggtgacctatgatgaggagggcggcggggagatggacaccaccagctatgatgtgtctgtgctgaacagcgtgcggcggggcggggccaagccacccaggcctgccctggatgcccggcccagcctgtatgcccaggtgcagaagccacccaggcatgcccctggggcccacggcggccctggagagatggccgccatgattgaggtgaagaaggatgaagctgaccatgatggagatggccccccctatgacaccctgcacatctacggctatgagggcagcgagagcattgctgagagcctgagcagcctgggcacagacagcagtgacagtgatgtggactatgacttcctgaatgactggggcccccgcttcaagatgctggccgagctgtatggcagtgacccccgggaggagctgctgtactag

SEQ ID NO: 18703 - DNA, 2373 bp, Artificial Sequence
  Description of Artificial Sequence: Synthetic coding sequence
atgaggacctaccgctacttcctgctgctcttctgggtgggccagccctaccccaccctgagcacccccctgagcaagaggaccagcggcttccctgccaagaagagggccctggagctgagcggcaacagcaagaatgagctgaacagaagcaagaggtcctggatgtggaaccagttcttcctgctggaggagtacacaggcagtgactaccagtatgtgggcaagctgcacagcgaccaggacagaggagatggcagcctgaagtacatcctgtctggagatggagctggggacctcttcatcatcaatgaaaatactggagacatccaggccaccaagaggctggaccgggaggagaagcctgtgtacatcctgcgggcccaggccatcaacagaagaacaggccggcctgtggagcctgagagcgagttcatcatcaagatccatgacatcaatgacaatgagcccatcttcaccaaggaggtgtacacagccaccgtgcctgagatgtctgatgtgggcacctttgtggtgcaggtgacagccacagatgctgatgaccccacctacggcaacagcgccaaggtggtgtacagcatcctgcagggccagccctacttctctgtggagagcgagaccggcatcatcaagacagccctgctgaacatggacagagaaaatcgggagcagtaccaggtggtgatccaggccaaggacatgggcggccagatgggcggcctgagcggcaccaccaccgtgaacatcaccctgacagatgtgaatgacaaccccccacgcttcccccagagcacctaccagttcaagaccccagagagcagccccccaggcacccccatcggccgcatcaaggccagtgatgctgatgtgggagaaaatgctgagattgagtacagcatcacagatggagagggcctggacatgtttgatgtgatcacagaccaggagacccaggagggcatcatcaccgtgaagaagctgctggactttgagaagaagaaggtgtacaccctgaaggtggaggccagcaacccctacgtggagccccgcttcctgtacctgggccccttcaaggacagcgccaccgtgcgcatcgtggtggaggatgtggatgagccccctgtgttcagcaagctggcctacatcctgcagatccgggaggatgcccagatcaacaccaccatcggctctgtgacagcccaggaccctgatgctgccaggaaccctgtgaagtacagcgtggacagacacacagacatggaccgcatcttcaacattgattctggaaatggcagcatcttcaccagcaagctgctggaccgggagaccctgctgtggcacaacatcaccgtgattgccacagagatcaacaaccccaagcagagcagccgggtgcccctgtacatcaaggtgctggatgtgaatgacaatgcccctgagtttgctgagttctatgagacctttgtgtgtgagaaggccaaggctgaccagctgatccagaccctgcatgctgtggacaaggatgacccctacagcggccaccagttctccttcagcctggcccctgaggccgccagcggcagcaacttcaccatccaggacaacaaggacaacacagctggcatcctgaccaggaagaatggctacaacagacatgagatgagcacctacctgctgcctgtggtgatcagtgacaatgactaccctgtgcagagcagcactggaacagtgacagtgcgggtgtgtgcctgtgaccaccacggcaacatgcagagctgccacgccgaggccctgatccaccccaccggcctgagcactggagccctggtggccatcctgctgtgcatcgtcatcctgctggtgacagtggtgctgtttgctgccctgcggcggcagaggaagaaggagcccctcatcatcagcaaggaggacatccgggacaacatcgtgtcctacaatgatgaaggaggaggagaggaggacacccaggcctttgacatcggcaccctgaggaaccctgaggccatcgaggacaacaagctgcggcgggacatcgtgcctgaggccctcttcctgcccaggaggacccccacagcccgggacaacacagatgtgcgggacttcatcaaccagaggctgaaggaaaatgacacagaccccacagccccaccctatgacagcctggccacctacgcctatgagggcactggatctgtggccgacagcctgagcagcctggagagcgtgaccacagatgctgaccaggactatgactacctgagtgactggggcccccgcttcaagaagctggccgacatgtatggaggagtggacagcgacaaggacagctag

SEQ ID NO: 18704 - DNA, 576 bp, Artificial Sequence
  Description of Artificial Sequence: Synthetic coding sequence
atgggcggcagcggcagccggctgagcaaggagctgctggccgagtaccaggacctgaccttcctgaccaagcaggagatcctgctggcccaccggcgcttctgtgagctgctgccccaggagcagaggtctgtggagagcagcctgcgggcccaggtgccctttgagcagatcctgagcctgcctgagctgaaggccaaccccttcaaggagcgcatctgcagggtcttcagcaccagccctgccaaggacagcctgagctttgaggacttcctggacctgctgagcgtcttcagtgacacagccaccccagacatcaagagccactacgccttccgcatctttgattttgatgatgatggcaccctgaaccgggaggacctgagccggctggtgaactgcctgaccggggagggggaggacacccggctgagcgccagcgagatgaagcagctgattgacaacatcctggaggagagtgacatcgacagagatggcaccatcaacctgtctgagttccagcacgtgatcagccgcagcccagactttgccagcagcttcaagatcgtgctgtag

SEQ ID NO: 18705 - DNA, 237 bp, Artificial Sequence
  Description of Artificial Sequence: Synthetic coding sequence
atgtctgaggtgctgccctatggagatgagaagctgagcccctatggagatggaggagatgtgggccagatcttcagctgccgcctgcaggacaccaacaacttcttcggggccggccagaacaagaggcctcccaagctgggccagatcggccgcagcaagagggtggtgattgaagatgacagaattgatgatgtgctgaagaacatgacagacaaggcccctcctggggtgtag

SEQ ID NO: 18706 - DNA, 1563 bp, Artificial Sequence
  Description of Artificial Sequence: Synthetic coding sequence
atggagggcggccctgctgtgtgctgccaggaccccagggctgagctggtggagcgggtggccgccattgatgtgacccacctggaggaggctgatggcggccctgagcccaccagaaatggagtggaccccccaccccgggcccgggccgccagcgtcatccctggcagcaccagccggctgctgcctgcccggcccagcctgagcgccaggaagctgagcctgcaggagaggcctgctggcagctacctggaggcccaggccggcccctatgccactggacctgccagccacatcagcccccgggcctggaggcggcccaccatcgagagccaccacgtggccatcagtgatgctgaggactgtgtgcagctgaaccagtacaagctgcagagcgagatcggcaagggggcctatggagtggtgcggctggcctacaatgaaagtgaggacagacactacgccatgaaggtgctgagcaagaagaagctgctgaagcagtatggcttcccccggcggcccccaccccggggcagccaggccgcccagggcggccctgccaagcagctgctgcccctggagcgggtgtaccaggagatcgccatcctgaagaagctggaccacgtgaatgtggtgaagctgattgaggtgctggatgatcctgctgaggacaacctgtacctggccctgcagaaccaggcccagaacatccagctggacagcaccaacatcgccaagccccacagcctgctgcccagcgagcagcaggacagcggcagcacctgggccgcccggtctgtgtttgacctgctgaggaaaggacctgtgatggaggtgccctgtgacaagcccttcagcgaggagcaggcccggctgtacctgagagatgtgatcctgggcctggagtacctgcactgccagaagatcgtgcaccgggacatcaagcccagcaacctgctgctgggagatgatggccacgtgaagattgctgactttggagtgagcaaccagtttgagggcaatgatgcccagctgagcagcacagctggcaccccagccttcatggcccctgaggccatcagtgacagcggccagagcttcagcggcaaggccctggatgtgtgggccactggagtgaccctgtactgctttgtgtatggcaagtgccccttcattgatgacttcatcctggccctgcacaggaagatcaagaatgaacctgtggtgtttcctgaggagcctgagatcagcgaggagctgaaggacctgatcctgaagatgctggacaagaaccctgagacccgcatcggcgtgcctgacatcaagctgcacccctgggtgaccaagaatggagaggagcccctgcccagcgaggaggagcactgcagcgtggtggaggtgacagaggaggaggtgaagaacagcgtgcggctcatccccagctggaccaccgtcatcctggtgaagtccatgctgaggaagaggagctttggaaacccctttgagccccaggcccggcgggaggagaggtccatgtctgcccctggcaacctgctggtgtag

SEQ ID NO: 18707 - DNA, 1518 bp, Artificial Sequence
  Description of Artificial Sequence: Synthetic coding sequence
atggagggcggccctgctgtgtgctgccaggaccccagggctgagctggtggagcgggtggccgccattgatgtgacccacctggaggaggctgatggcggccctgagcccaccagaaatggagtggaccccccaccccgggcccgggccgccagcgtcatccctggcagcaccagccggctgctgcctgcccggcccagcctgagcgccaggaagctgagcctgcaggagaggcctgctggcagctacctggaggcccaggccggcccctatgccactggacctgccagccacatcagcccccgggcctggaggcggcccaccatcgagagccaccacgtggccatcagtgatgctgaggactgtgtgcagctgaaccagtacaagctgcagagcgagatcggcaagggggcctatggagtggtgcggctggcctacaatgaaagtgaggacagacactacgccatgaaggtgctgagcaagaagaagctgctgaagcagtatggcttcccccggcggcccccaccccggggcagccaggccgcccagggcggccctgccaagcagctgctgcccctggagcgggtgtaccaggagatcgccatcctgaagaagctggaccacgtgaatgtggtgaagctgattgaggtgctggatgatcctgctgaggacaacctgtacctggtgtttgacctgctgaggaaaggacctgtgatggaggtgccctgtgacaagcccttcagcgaggagcaggcccggctgtacctgagagatgtgatcctgggcctggagtacctgcactgccagaagatcgtgcaccgggacatcaagcccagcaacctgctgctgggagatgatggccacgtgaagattgctgactttggagtgagcaaccagtttgagggcaatgatgcccagctgagcagcacagctggcaccccagccttcatggcccctgaggccatcagtgacagcggccagagcttcagcggcaaggccctggatgtgtgggccactggagtgaccctgtactgctttgtgtatggcaagtgccccttcattgatgacttcatcctggccctgcacaggaagatcaagaatgaacctgtggtgtttcctgaggagcctgagatcagcgaggagctgaaggacctgatcctgaagatgctggacaagaaccctgagacccgcatcggcgtgcctgacatcaagctgcacccctgggtgaccaagaatggagaggagcccctgcccagcgaggaggagcactgcagcgtggtggaggtgacagaggaggaggtgaagaacagcgtgcggctcatccccagctggaccaccgtcatcctggtgaagtccatgctgaggaagaggagctttggaaacccctttgagccccaggcccggcgggaggagaggtccatgtctgcccctggcaacctgctggtgaaggagggctttggagagggcggcaagagccctgagctgcccggggtgcaggaggatgaagctgccagctag

SEQ ID NO: 18708 - DNA, 1599 bp, Artificial Sequence
  Description of Artificial Sequence: Synthetic coding sequence
atgcagtttgggaagctgtggtgtggctgcagcggggagttccccacccggctgcggcggaggacccccctgacagaggccatggagggcggccctgctgtgtgctgccaggaccccagggctgagctggtggagcgggtggccgccattgatgtgacccacctggaggaggctgatggcggccctgagcccaccagaaatggagtggaccccccaccccgggcccgggccgccagcgtcatccctggcagcaccagccggctgctgcctgcccggcccagcctgagcgccaggaagctgagcctgcaggagaggcctgctggcagctacctggaggcccaggccggcccctatgccaccggccctgccagccacatcagcccccgggcctggaggcggcccaccatcgagagccaccacgtggccatcagtgatgctgaggactgtgtgcagctgaaccagtacaagctgcagagcgagattggaaaaggagcctacggcgtggtgcggctggcctacaatgaaagtgaagatagacactacgccatgaaggtgctgagcaagaagaagctgctgaagcagtatggcttcccccggcggcccccaccccggggcagccaggccgcccagggcggccctgccaagcagctgctgcccctggagcgggtgtaccaggagatcgccatcctgaagaagctggaccacgtgaatgtggtgaagctgattgaggtgctggatgatcctgctgaggacaacctgtacctggtgtttgacctgctgaggaagggccctgtgatggaggtgccctgtgacaagcccttcagcgaggagcaggcccggctgtacctgagagatgtgatcctgggcctggagtacctgcactgccagaagatcgtgcaccgggacatcaagcccagcaacctgctgctgggagatgatggccacgtgaagattgctgactttggagtgagcaaccagtttgagggcaatgatgcccagctgagcagcacagctggcaccccagccttcatggcccctgaggccatcagtgacagcggccagagcttcagcggcaaggccctggatgtgtgggccaccggggtgaccctgtactgctttgtgtatggaaaatgtcccttcattgatgacttcatcctggccctgcacaggaagatcaagaatgaacctgtggtgtttcctgaggagcctgagatcagcgaggagctgaaggacctgatcctgaagatgctggacaagaaccctgagaccagaattggagtgcctgacatcaagctgcacccctgggtgaccaagaatggagaggagcccctgcccagcgaggaggagcactgcagcgtggtggaggtgacagaggaggaggtgaagaacagcgtgcggctcatccccagctggaccaccgtcatcctggtgaagtccatgctgaggaagaggagctttggaaacccctttgagccccaggcccggcgggaggagaggtccatgtctgcccctggcaacctgctggtgaaggagggctttggagagggcggcaagagccctgagctgcccggggtgcaggaggatgaggccgccagctag

SEQ ID NO: 18709 - DNA, 1632 bp, Artificial Sequence
  Description of Artificial Sequence: Synthetic coding sequence
atggagggcggccctgctgtgtgctgccaggaccccagggctgagctggtggagcgggtggccgccattgatgtgacccacctggaggaggctgatggcggccctgagcccaccagaaatggagtggaccccccaccccgggcccgggccgccagcgtcatccctggcagcaccagccggctgctgcctgcccggcccagcctgagcgccaggaagctgagcctgcaggagaggcctgctggcagctacctggaggcccaggccggcccctatgccactggacctgccagccacatcagcccccgggcctggaggcggcccaccatcgagagccaccacgtggccatcagtgatgctgaggactgtgtgcagctgaaccagtacaagctgcagagcgagatcggcaagggggcctatggagtggtgcggctggcctacaatgaaagtgaggacagacactacgccatgaaggtgctgagcaagaagaagctgctgaagcagtatggcttcccccggcggcccccaccccggggcagccaggccgcccagggcggccctgccaagcagctgctgcccctggagcgggtgtaccaggagatcgccatcctgaagaagctggaccacgtgaatgtggtgaagctgattgaggtgctggatgatcctgctgaggacaacctgtacctggccctgcagaaccaggcccagaacatccagctggacagcaccaacatcgccaagccccacagcctgctgcccagcgagcagcaggacagcggcagcacctgggccgcccggtctgtgtttgacctgctgaggaaaggacctgtgatggaggtgccctgtgacaagcccttcagcgaggagcaggcccggctgtacctgagagatgtgatcctgggcctggagtacctgcactgccagaagatcgtgcaccgggacatcaagcccagcaacctgctgctgggagatgatggccacgtgaagattgctgactttggagtgagcaaccagtttgagggcaatgatgcccagctgagcagcacagctggcaccccagccttcatggcccctgaggccatcagtgacagcggccagagcttcagcggcaaggccctggatgtgtgggccactggagtgaccctgtactgctttgtgtatggcaagtgccccttcattgatgacttcatcctggccctgcacaggaagatcaagaatgaacctgtggtgtttcctgaggagcctgagatcagcgaggagctgaaggacctgatcctgaagatgctggacaagaaccctgagacccgcatcggcgtgcctgacatcaagctgcacccctgggtgaccaagaatggagaggagcccctgcccagcgaggaggagcactgcagcgtggtggaggtgacagaggaggaggtgaagaacagcgtgcggctcatccccagctggaccaccgtcatcctggtgaagtccatgctgaggaagaggagctttggaaacccctttgagccccaggcccggcgggaggagaggtccatgtctgcccctggcaacctgctggtgaaggagggctttggagagggcggcaagagccctgagctgcccggggtgcaggaggatgaagctgccagctag

SEQ ID NO: 18710 - DNA, 1695 bp, Artificial Sequence
  Description of Artificial Sequence: Synthetic coding sequence
atggatgactttgagaggagaagagagctgcggcggcagaagcgggaggagatgaggctggaggccgagagaattgcctaccagagaaatgatgatgatgaggaggaggccgcccgggagaggagaagaagagcccggcaggagcggctgcggcagaagcaggaggaggagagcctgggccaggtgacagaccaggtggaggtgaatgcccagaacagcgtgcctgatgaggaggccaagaccaccaccaccaacacccaggtggagggagatgatgaggccgccttcctggagcggctggcccggcgggaggagcggcggcagaagaggctgcaggaggccctggagcggcagaaggagtttgaccccaccatcacagatgccagcctgagcctgcccagcaggaggatgcagaatgacacagcagaaaatgagaccacagagaaggaggagaagtctgagagccggcaggagagatatgaaattgaggagacagaaacagtgaccaagagctaccagaagaatgactggagagatgctgaggagaacaagaaggaggacaaggagaaggaggaggaggaggaggagaagcccaagaggggcagcattggagagaaccagggcgaggagaagggcaccaaggtgcaggccaagcgggagaagctgcaggaggacaagcccaccttcaagaaggaggagatcaaggatgagaagatcaagaaggacaaggagcccaaggaggaggtgaagagcttcatggacaggaagaagggcttcacagaggtgaagagccagaatggagagttcatgacccacaagctgaagcacacagagaacaccttcagcaggcctgggggccgggcctctgtggacaccaaggaggccgagggcgccccccaggtggaggccggcaagaggctggaggagctgcggaggagaagaggagaaacagaaagtgaggagtttgagaagctgaagcagaagcagcaggaggccgccctggagctggaggagctgaagaagaagcgggaggagaggaggaaggtgctggaggaggaggagcagaggaggaagcaggaggaggccgacaggaagctgcgggaggaggaggagaagaggcggctgaaggaggagattgaaagaagaagagctgaggccgctgagaagaggcagaagatgccagaagatggcctgagtgatgacaagaagcccttcaagtgcttcacccccaagggcagcagcctgaagattgaggagagagctgagttcctgaacaagtctgtgcagaagagcagcggcgtgaagagcacccaccaggccgccatcgtgtccaagattgacagccggctggagcagtacaccagcgccatcgagggcaccaagagcgccaagcccaccaagccagctgccagtgacctgcctgtgcctgctgagggcgtgaggaacatcaagtccatgtgggagaagggaaatgtgttcagcagccccacagctgctggcacccccaacaaggagacagctggcctgaaggtgggcgtgagcagccgcatcaatgagtggctgaccaagaccccagatggcaacaagagccctgcccccaagcccagcgacctgcggcctggagatgtgagcagcaagaggaacctgtgggagaagcagagcgtggacaaggtgaccagccccaccaaggtgtag

SEQ ID NO: 18711 - DNA, 2382 bp, Artificial Sequence
  Description of Artificial Sequence: Synthetic coding sequence
atggatgactttgagaggagaagagagctgcggcggcagaagcgggaggagatgaggctggaggccgagagaattgcctaccagagaaatgatgatgatgaggaggaggccgcccgggagaggagaagaagagcccggcaggagcggctgcggcagaagcaggaggaggagagcctgggccaggtgacagaccaggtggaggtgaatgcccagaacagcgtgcctgatgaggaggccaagaccaccaccaccaacacccaggtggagggagatgatgaggccgccttcctggagcggctggcccggcgggaggagcggcggcagaagaggctgcaggaggccctggagcggcagaaggagtttgaccccaccatcacagatgccagcctgagcctgcccagcaggaggatgcagaatgacacagcagaaaatgagaccacagagaaggaggagaagtctgagagccggcaggagagatatgaaattgaggagacagaaacagtgaccaagagctaccagaagaatgactggagagatgctgaggagaacaagaaggaggacaaggagaaggaggaggaggaggaggagaagcccaagaggggcagcattggagagaaccaggtggaggtgatggtggaggagaagaccacagagagccaggaggagaccgtggtgatgagcctgaagaatggccagatcagcagcgaggagcccaagcaggaggaggagcgggagcagggcagtgatgagatcagccaccacgagaagatggaggaggaggacaaggagagagctgaggccgagcgggcccggctggaggccgaggagcgggagcgcatcaaggccgagcaggacaagaagattgctgatgagcgggccagaattgaagctgaggagaaggccgccgcccaggagcgggagcggcgggaggccgaggagcgggagaggatgagggaggaggagaagagagctgctgaggagcggcagaggatcaaggaggaggagaagagagctgctgaggagcggcagaggatcaaggaggaggagaagagagctgctgaggagcggcagaggatcaaggaggaggagaagagagctgctgaggagcggcagagggcccgggcagaggaggaggagaaggccaaggtggaggagcagaagaggaacaagcagctggaggagaagaagcacgccatgcaggagaccaagatcaagggggagaaggtggagcagaagattgagggcaagtgggtgaatgagaagaaggcccaggaggacaagctgcagacagctgtgctgaagaagcagggcgaggagaagggcaccaaggtgcaggccaagcgggagaagctgcaggaggacaagcccaccttcaagaaggaggagatcaaggatgagaagatcaagaaggacaaggagcccaaggaggaggtgaagagcttcatggacaggaagaagggcttcacagaggtgaagagccagaatggagagttcatgacccacaagctgaagcacacagagaacaccttcagcaggcctgggggccgggcctctgtggacaccaaggaggccgagggcgccccccaggtggaggccggcaagaggctggaggagctgcggcggcggcggggggagacagagagcgaggagtttgagaagctgaagcagaagcagcaggaggccgccctggagctggaggagctgaagaagaagcgggaggagaggaggaaggtgctggaggaggaggagcagaggaggaagcaggaggaggccgacaggaagctgcgggaggaggaggagaagaggcggctgaaggaggagattgaaagaagaagagctgaggccgctgagaagaggcagaagatgccagaagatggcctgagtgatgacaagaagcccttcaagtgcttcacccccaagggcagcagcctgaagattgaggagcgggcagagttcctgaacaagtctgtgcagaagagcagtggagtgaagagcacccaccaggccgccatcgtgtccaagattgacagccggctggagcagtacaccagcgccatcgagggcaccaagagcgccaagcccaccaagccagctgccagtgacctgcctgtgcctgctgagggcgtgaggaacatcaagtccatgtgggagaagggaaatgtgttcagcagccccacagctgctggcacccccaacaaggagacagctggcctgaaggtgggcgtgagcagccgcatcaatgagtggctgaccaagaccccagatggcaacaagagccctgcccccaagcccagcgacctgcggcctggagatgtgagcagcaagaggaacctgtgggagaagcagagcgtggacaaggtgaccagccccaccaaggtgtag

SEQ ID NO: 18712 - DNA, 1617 bp, Artificial Sequence
  Description of Artificial Sequence: Synthetic coding sequence
atggatgactttgagaggagaagagagctgcggcggcagaagcgggaggagatgaggctggaggccgagagaattgcctaccagagaaatgatgatgatgaggaggaggccgcccgggagaggagaagaagagcccggcaggagcggctgcggcagaagcaggaggaggagagcctgggccaggtgacagaccaggtggaggtgaatgcccagaacagcgtgcctgatgaggaggccaagaccaccaccaccaacacccaggtggagggagatgatgaggccgccttcctggagcggctggcccggcgggaggagcggcggcagaagaggctgcaggaggccctggagcggcagaaggagtttgaccccaccatcacagatgccagcctgagcctgcccagcaggaggatgcagaatgacacagcagaaaatgagaccacagagaaggaggagaagtctgagagccggcaggagagatatgaaattgaggagacagaaacagtgaccaagagctaccagaagaatgactggagagatgctgaggagaacaagaaggaggacaaggagaaggaggaggaggaggaggagaagcccaagaggggcagcattggagagaaccagatcaaggatgagaagatcaagaaggacaaggagcccaaggaggaggtgaagagcttcatggacaggaagaagggcttcacagaggtgaagagccagaatggagagttcatgacccacaagctgaagcacacagagaacaccttcagcaggcctgggggccgggcctctgtggacaccaaggaggccgagggcgccccccaggtggaggccggcaagaggctggaggagctgcggaggagaagaggagaaacagaaagtgaggagtttgagaagctgaagcagaagcagcaggaggccgccctggagctggaggagctgaagaagaagcgggaggagaggaggaaggtgctggaggaggaggagcagaggaggaagcaggaggaggccgacaggaagctgcgggaggaggaggagaagaggcggctgaaggaggagattgaaagaagaagagctgaggccgctgagaagaggcagaagatgccagaagatggcctgagtgatgacaagaagcccttcaagtgcttcacccccaagggcagcagcctgaagattgaggagagagctgagttcctgaacaagtctgtgcagaagagcagcggcgtgaagagcacccaccaggccgccatcgtgtccaagattgacagccggctggagcagtacaccagcgccatcgagggcaccaagagcgccaagcccaccaagccagctgccagtgacctgcctgtgcctgctgagggcgtgaggaacatcaagtccatgtgggagaagggaaatgtgttcagcagccccacagctgctggcacccccaacaaggagacagctggcctgaaggtgggcgtgagcagccgcatcaatgagtggctgaccaagaccccagatggcaacaagagccctgcccccaagcccagcgacctgcggcctggagatgtgagcagcaagaggaacctgtgggagaagcagagcgtggacaaggtgaccagccccaccaaggtgtag

SEQ ID NO: 18713 - DNA, 1677 bp, Artificial Sequence
  Description of Artificial Sequence: Synthetic coding sequence
atgctgggcggcagcggcagccacggccgccgcagcctggccgccctgagccagatcgcctaccagagaaatgatgatgatgaggaggaggccgcccgggagaggagaagaagagcccggcaggagcggctgcggcagaagcaggaggaggagagcctgggccaggtgacagaccaggtggaggtgaatgcccagaacagcgtgcctgatgaggaggccaagaccaccaccaccaacacccaggtggagggagatgatgaggccgccttcctggagcggctggcccggcgggaggagcggcggcagaagaggctgcaggaggccctggagcggcagaaggagtttgaccccaccatcacagatgccagcctgagcctgcccagcaggaggatgcagaatgacacagcagaaaatgagaccacagagaaggaggagaagtctgagagccggcaggagagatatgaaattgaggagacagaaacagtgaccaagagctaccagaagaatgactggagagatgctgaggagaacaagaaggaggacaaggagaaggaggaggaggaggaggagaagcccaagaggggcagcattggagagaaccagggcgaggagaagggcaccaaggtgcaggccaagcgggagaagctgcaggaggacaagcccaccttcaagaaggaggagatcaaggatgagaagatcaagaaggacaaggagcccaaggaggaggtgaagagcttcatggacaggaagaagggcttcacagaggtgaagagccagaatggagagttcatgacccacaagctgaagcacacagagaacaccttcagcaggcctgggggccgggcctctgtggacaccaaggaggccgagggcgccccccaggtggaggccggcaagaggctggaggagctgcggaggagaagaggagaaacagaaagtgaggagtttgagaagctgaagcagaagcagcaggaggccgccctggagctggaggagctgaagaagaagcgggaggagaggaggaaggtgctggaggaggaggagcagaggaggaagcaggaggaggccgacaggaagctgcgggaggaggaggagaagaggcggctgaaggaggagattgaaagaagaagagctgaggccgctgagaagaggcagaagatgccagaagatggcctgagtgatgacaagaagcccttcaagtgcttcacccccaagggcagcagcctgaagattgaggagagagctgagttcctgaacaagtctgtgcagaagagcagcggcgtgaagagcacccaccaggccgccatcgtgtccaagattgacagccggctggagcagtacaccagcgccatcgagggcaccaagagcgccaagcccaccaagccagctgccagtgacctgcctgtgcctgctgagggcgtgaggaacatcaagtccatgtgggagaagggaaatgtgttcagcagccccacagctgctggcacccccaacaaggagacagctggcctgaaggtgggcgtgagcagccgcatcaatgagtggctgaccaagaccccagatggcaacaagagccctgcccccaagcccagcgacctgcggcctggagatgtgagcagcaagaggaacctgtgggagaagcagagcgtggacaaggtgaccagccccaccaaggtgtag

SEQ ID NO: 18714 - DNA, 1617 bp, Artificial Sequence; identical to SEQ ID NO: 18712
  Description of Artificial Sequence: Synthetic coding sequence

SEQ ID NO: 18715 - DNA, 1692 bp, Artificial Sequence
  Description of Artificial Sequence: Synthetic coding sequence
atggatgactttgagaggagaagagagctgcggcggcagaagcgggaggagatgaggctggaggccgagagaattgcctaccagagaaatgatgatgatgaggaggaggccgcccgggagaggagaagaagagcccggcaggagcggctgcggcagaagcaggaggaggagagcctgggccaggtgacagaccaggtggaggtgaatgcccagaacagcgtgcctgatgaggaggccaagaccaccaccaccaacacccaggtggagggagatgatgaggccgccttcctggagcggctggcccggcgggaggagcggcggcagaagaggctgcaggaggccctggagcggcagaaggagtttgaccccaccatcacagatgccagcctgagcctgcccagcaggaggatgcagaatgacacagcagaaaatgagaccacagagaaggaggagaagtctgagagccggcaggagagatatgaaattgaggagacagaaacagtgaccaagagctaccagaagaatgactggagagatgctgaggagaacaagaaggaggacaaggagaaggaggaggaggaggaggagaagcccaagaggggcagcattggagagaaccagggcgaggagaagggcaccaaggtgcaggccaagcgggagaagctgcaggaggacaagcccaccttcaagaaggaggagatcaaggatgagaagatcaagaaggacaaggagcccaaggaggaggtgaagagcttcatggacaggaagaagggcttcacagaggtgaagagccagaatggagagttcatgacccacaagctgaagcacacagagaacaccttcagcaggcctgggggccgggcctctgtggacaccaaggaggccgagggcgccccccaggtggaggccggcaagaggctggaggagctgcggaggagaagaggagaaacagaaagtgaggagtttgagaagctgaagcagaagcagcaggaggccgccctggagctggaggagctgaagaagaagcgggaggagaggaggaaggtgctggaggaggaggagcagaggaggaagcaggaggaggccgacaggaagctgcgggaggaggaggagaagaggcggctgaaggaggagattgaaagaagaagagctgaggccgctgagaagaggcagaagatgccagaagatggcctgagtgatgacaagaagcccttcaagtgcttcacccccaagggcagcagcctgaagattgaggagagagctgagttcctgaacaagtctgtgcagaagtctggagtgaagagcacccaccaggccgccatcgtgtccaagattgacagccggctggagcagtacaccagcgccatcgagggcaccaagagcgccaagcccaccaagccagctgccagtgacctgcctgtgcctgctgagggcgtgaggaacatcaagtccatgtgggagaagggaaatgtgttcagcagccccacagctgctggcacccccaacaaggagacagctggcctgaaggtgggcgtgagcagccgcatcaatgagtggctgaccaagaccccagatggcaacaagagccctgcccccaagcccagcgacctgcggcctggagatgtgagcagcaagaggaacctgtgggagaagcagagcgtggacaaggtgaccagccccaccaaggtgtag

SEQ ID NO: 18716 - DNA, 1599 bp, Artificial Sequence
  Description of Artificial Sequence: Synthetic coding sequence
atgctgggcggcagcggcagccacggccgccgcagcctggccgccctgagccagatcgcctaccagagaaatgatgatgatgaggaggaggccgcccgggagaggagaagaagagcccggcaggagcggctgcggcagaagcaggaggaggagagcctgggccaggtgacagaccaggtggaggtgaatgcccagaacagcgtgcctgatgaggaggccaagaccaccaccaccaacacccaggtggagggagatgatgaggccgccttcctggagcggctggcccggcgggaggagcggcggcagaagaggctgcaggaggccctggagcggcagaaggagtttgaccccaccatcacagatgccagcctgagcctgcccagcaggaggatgcagaatgacacagcagaaaatgagaccacagagaaggaggagaagtctgagagccggcaggagagatatgaaattgaggagacagaaacagtgaccaagagctaccagaagaatgactggagagatgctgaggagaacaagaaggaggacaaggagaaggaggaggaggaggaggagaagcccaagaggggcagcattggagagaaccagatcaaggatgagaagatcaagaaggacaaggagcccaaggaggaggtgaagagcttcatggacaggaagaagggcttcacagaggtgaagagccagaatggagagttcatgacccacaagctgaagcacacagagaacaccttcagcaggcctgggggccgggcctctgtggacaccaaggaggccgagggcgccccccaggtggaggccggcaagaggctggaggagctgcggaggagaagaggagaaacagaaagtgaggagtttgagaagctgaagcagaagcagcaggaggccgccctggagctggaggagctgaagaagaagcgggaggagaggaggaaggtgctggaggaggaggagcagaggaggaagcaggaggaggccgacaggaagctgcgggaggaggaggagaagaggcggctgaaggaggagattgaaagaagaagagctgaggccgctgagaagaggcagaagatgccagaagatggcctgagtgatgacaagaagcccttcaagtgcttcacccccaagggcagcagcctgaagattgaggagagagctgagttcctgaacaagtctgtgcagaagagcagcggcgtgaagagcacccaccaggccgccatcgtgtccaagattgacagccggctggagcagtacaccagcgccatcgagggcaccaagagcgccaagcccaccaagccagctgccagtgacctgcctgtgcctgctgagggcgtgaggaacatcaagtccatgtgggagaagggaaatgtgttcagcagccccacagctgctggcacccccaacaaggagacagctggcctgaaggtgggcgtgagcagccgcatcaatgagtggctgaccaagaccccagatggcaacaagagccctgcccccaagcccagcgacctgcggcctggagatgtgagcagcaagaggaacctgtgggagaagcagagcgtggacaaggtgaccagccccaccaaggtgtag

SEQ ID NO: 18717 - DNA, 528 bp, Artificial Sequence
  Description of Artificial Sequence: Synthetic coding sequence
atgccagaagatggcctgagtgatgacaagaagcccttcaagtgcttcacccccaagggcagcagcctgaagattgaggagagagctgagttcctgaacaagtctgtgcagaagtctggagtgaagagcacccaccaggccgccatcgtgtccaagattgacagccggctggagcagtacaccagcgccatcgagggcaccaagagcgccaagcccaccaagccagctgccagtgacctgcctgtgcctgctgagggcgtgaggaacatcaagtccatgtgggagaagggaaatgtgttcagcagccccacagctgctggcacccccaacaaggagacagctggcctgaaggtgggcgtgagcagccgcatcaatgagtggctgaccaagaccccagatggcaacaagagccctgcccccaagcccagcctgaccttctgcagcagcctgtttggcctgtggctgattggcaacctgctgctgctgcccagcttcctgcccctgctgcctgagtgggtgttcctgtag

SEQ ID NO: 18718 - DNA, 219 bp, Artificial Sequence
  Description of Artificial Sequence: Synthetic coding sequence
atggatgactttgagaggagaagagagctgcggcggcagaagcgggaggagatgaggctggaggccgagagaattgcctaccagagaaatgatgatgatgaggaggaggccgcccgggagaggagaagaagagcccggcaggagcggctgcggcagaagcaggaggaggagagcctgggccaggtgacagaccaggtggaggtgaatgcccagaactag

SEQ ID NO: 18719 - DNA, 1380 bp, Artificial Sequence
  Description of Artificial Sequence: Synthetic coding sequence
atggatgactttgagaggagaagagagctgcggcggcagaagcgggaggagatgaggctggaggccgagagaattgcctaccagagaaatgatgatgatgaggaggaggccgcccgggagaggagaagaagagcccggcaggagcggctgcggcagaagcaggaggaggagagcctgggccaggtgacagaccaggtggaggtgaatgcccagaacagcgtgcctgatgaggaggccaagaccaccaccaccaacacccaggtggagggagatgatgaggccgccttcctggagcggctggcccggcgggaggagcggcggcagaagaggctgcaggaggccctggagcggcagaaggagtttgaccccaccatcacagatgccagcctgagcctgcccagcaggaggatgcagaatgacacagcagaaaatgagaccacagagaaggaggagaagtctgagagccggcaggagagatatgaaattgaggagacagaaacagtgaccaagagctaccagaagaatgactggagagatgctgaggagaacaagaaggaggacaaggagaaggaggaggaggaggaggagaagcccaagaggggcagcattggagagaaccagatcaaggatgagaagatcaagaaggacaaggagcccaaggaggaggtgaagagcttcatggacaggaagaagggcttcacagaggtgaagagccagaatggagagttcatgacccacaagctgaagcacacagagaacaccttcagcaggcctgggggccgggcctctgtggacaccaaggaggccgagggcgccccccaggtggaggccggcaagaggctggaggagctgcggaggagaagaggagaaacagaaagtgaggagtttgagaagctgaagcagaagcagcaggaggccgccctggagctggaggagctgaagaagaagcgggaggagaggaggaaggtgctggaggaggaggagcagaggaggaagcaggaggaggccgacaggaagctgcgggaggaggaggagaagaggcggctgaaggaggagattgaaagaagaagagctgaggccgctgagaagaggcagaagatgccagaagatggcctgagtgatgacaagaagcccttcaagtgcttcacccccaagggcagcagcctgaagattgaggagagagctgagttcctgaacaagtctgtgcagaagagcagcggcgtgaagagcacccaccaggccgccatcgtgtccaagattgacagccggctggagcagtacaccagcgccatcgagggcaccaagagcgccaagcccaccaagccagctgccagtgacctgcctgtgcctgctgagggcgtgaggaacatcaagagctag

SEQ ID NO: 18720 - DNA, 219 bp, Artificial Sequence; identical to SEQ ID NO: 18718
  Description of Artificial Sequence: Synthetic coding sequence

SEQ ID NO: 18721 - DNA, 1632 bp, Artificial Sequence
  Description of Artificial Sequence: Synthetic coding sequence
atgaccagctacatgaaggtggaccggcagtggaatgctgagatcctggagctgatcctgggcaccggccagctgagcacaggccagatcgcctaccagagaaatgatgatgatgaggaggaggccgcccgggagaggagaagaagagcccggcaggagcggctgcggcagaagcaggaggaggagagcctgggccaggtgacagaccaggtggaggtgaatgcccagaacagcgtgcctgatgaggaggccaagaccaccaccaccaacacccaggtggagggagatgatgaagctgccttcctggagcggctggcccggcgggaggagcggcggcagaagaggctgcaggaggccctggagcggcagaaggagtttgaccccaccatcacagatgccagcctgagcctgcccagcaggaggatgcagaatgacacagcagaaaatgagaccacagagaaggaggagaagtctgagagccggcaggagagatatgaaattgaggagacagagaccgtgaccaagagctaccagaagaatgactggagagatgctgaggagaacaagaaggaggacaaggagaaggaggaggaggaggaggagaagcccaagaggggcagcatcggggagaaccagatcaaggatgagaagatcaagaaggacaaggagcccaaggaggaggtgaagagcttcatggacaggaagaagggcttcacagaggtgaagagccagaatggagagttcatgacccacaagctgaagcacacagagaacaccttcagcaggcctgggggccgggcctctgtggacaccaaggaggccgagggcgccccccaggtggaggccggcaagaggctggaggagctgcggcggcggcggggggagacagagagcgaggagtttgagaagctgaagcagaagcagcaggaggccgccctggagctggaggagctgaagaagaagcgggaggagaggaggaaggtgctggaggaggaggagcagaggaggaagcaggaggaggccgacaggaagctgcgggaggaggaggagaagaggcggctgaaggaggagattgaaagaagaagagctgaggccgctgagaagaggcagaagatgccagaagatggcctgagtgatgacaagaagcccttcaagtgcttcacccccaagggcagcagcctgaagattgaggagcgggcagagttcctgaacaagtctgtgcagaagagcagtggagtgaagagcacccaccaggccgccatcgtgtccaagattgacagccggctggagcagtacaccagcgccatcgagggcaccaagagcgccaagcccaccaagccagctgccagtgacctgcctgtgcctgctgagggcgtgaggaacatcaagtccatgtgggagaagggaaatgtgttcagcagccccacagctgctggcacccccaacaaggagacagctggcctgaaggtgggcgtgagcagccgcatcaatgagtggctgaccaagaccccagatggcaacaagagccctgcccccaagcccagcgacctgcggcctggagatgtgagcagcaagaggaacctgtgggagaagcagagcgtggacaaggtgaccagccccaccaaggtgtag

SEQ ID NO: 18722 - DNA, 3975 bp, Artificial Sequence
  Description of Artificial Sequence: Synthetic coding sequence
atggctgacagcctgtacaacatccggctgctgcgggagttcagcaatgagtacctgaacaagtgcttctacctgaccctggaggacatgctgtatgcccccctggtgctgaagcccaacgtgatggtgttcatcgccgagctgttctggtggtttgaaaatgtgaagccagactttgtgcagcccagagatgtgcaggagctgaaggatgccaagacagtgctgcaccagaagagcagccggccccctgtgcccatcagcaatgccaccaagaggagcttcctgggcagccctgctgctggcaccctggccgagctgcagccccctgtgcagctgcctgctgagggctgccaccgccactacctgcaccctgaggagcctgagtacctgggcaagggcacagctgccttcagccccagccaccccctgctgcccctgcggcagaagcagcagaagagcatccagggcgaggacatcccagaccagaggcacaggagcaacagcctgaccagggtggatggccagcccagaggagctgccatcgcctggccagagaagaagaccaggcctgccagccagcccaccccatttgccctgcaccacgccgccagctgtgaggtggaccccagcagcggggacagcatcagcctggcccggagcatcagcaaggacagcctggccagcaacatcgtgaacctgaccccccagaaccagccccaccccacagccaccaagagccacggcaagagcctgctgagcaatgtgtccattgaagatgaggaggaggagctggtggccatcgtgcgggcagatgtggtgccccagcaggccgaccctgagttcccccgggccagcccccgggccctgggcctgacagccaatgcccggagcccccagggccagctggacaccagcgagagcaagccagacagcttcttcctggagcccctgatgcctgctgtgctgaagccagccaaggagaagcaggtgatcaccaaggaggatgagcggggggagggccggcccaggagcatcgtgtcccggcggcccagcgagggcccccagcccctggtgcggaggaagatgacaggcagccgggacctgaacagaaccttcacccccatcccctgcagcgagttccccatgggcatcgaccccacagaaacaggccccctgtctgtggagacagctggggaggtgtgtggcggccccctggccctgggcggctttgaccccttcccccagggccccagcacagatggcttcttcctgcacgtgggccgggcagatgaggacacagagggccgcctgtatgtgtcctgcagcaagagccccaacagccatgacagcgagccctggaccctgctgcggcaggacagcgacagtgatgtggtggacatcgaggaggccgagcatgacttcatgggagaggcccaccctgtggtgttcagccgctacatcggggaggaggagagcgccaagctgcaggaggacatgaaggtgaaggagcacgaggacaaggatgatgccagcggccgcagcagcccctgcctgagcacagccagccagatgagctctgtgtccatggccagcggctctgtgaagatgaccagctttgctgagaggaagctgcagaggctgaacagctgtgagaccaagagcagcaccagcagcagccagaagaccaccccagatgccagcgagagctgcccagcccccctgaccacctggaggcagaagcgggagcagagccccagccagcacggcaaggaccctgccagcctgctggccagcgagctggtgcagctgcacatgcagctggaggagaagagaagagccatcgaggcccagaagaagaagatggaggccctgagcgcccggcagaggctgaagctgggcaaggccgccttcctgcacgtggtgaagaagggcaaggccgaggccgccccacccctgcggcctgagcactttgccaaggagtacagccagcacaatggagaggactgtggagatgctgtgtccaagacagaggacttcctggtgaaggaggagcagcgggaggagctgctgcacgagccccaggatgtggacaaggagagcctggcctttgcccagcagcacaaggccaaggaccctgtggccctgcacgagctggagaggaacaaggtgatctctgctgccctgctggaggacacagtgggggaggtggtggatgtgaatgaatgtgacctgagcattgagaagctgaatgagaccatcagcaccctgcagcaggccatcctgaagatcagccagcagcaggagcagctgctgatgaagagccccaccgtgcctgtgcccggcagcaagaacaacagccaggaccacaaggtgaaggcccctgtgcactttgtggagcccctgagccccaccggggtggccggccacaggaaggccccccggctgggccagggcaggaacagccgcagcggccggcctgctgagctgaaggtgcccaaggaccggccccagggcagcagccgcagcaagacccccacccccagcgtggagaccctgccccacctgcggcccttccctgccagcagccaccccaggacccccacagaccccggcctggacagcgccctggagcccagcggggacccccacggcaagtgcctgtttgacagctaccgcctgcatgatgagagcaaccagaggaccctgaccctgagcagcagcaaggatgccaacatcctgtctgagcagatgagcctgaaggaggtgctggatgcctctgtgaaggaggtgggcagcagcagcagtgatgtgtctgggaaggagagcgtgcctgtggaggagcccctgcggagccgggccagcctcatcgaggtggacctgagtgacctgaaggccccagatgaagatggagagctggtgtccctggatggcagcgctgacctggtgtctgagggggaccagaagccaggagtgggcttcttcttcaaggatgagcagaaggccgaggatgagctggccaagaagagagctgccttcctgctgaagcagcagaggaaggccgaggaggcccgggtgaggaagcagcagctggaggccgaggtggagctgaagagagatgaggcccggaggaaggccgaggaggacagagtgaggaaggaggaggagaaggcccggcgggagctgatcaagcaggagtacctgcggaggaagcagcagcagatcctggaggagcagggcctgggcaagcccaagagcaagcccaagaagccccggcccaagtctgtgcaccgggaggagagctgcagcgacagcggcaccaagtgcagcagcaccccagacaacctgagcaggacccagagcggcagcagcctgagcctggccagcgctgccaccacagagcctgagagcgtgcacagcggcggcacccccagccagagggtggagagcatggaggccctgcccatcctgagcaggaaccccagccgcagcacagaccgggactgggagacagccagcgctgccagcagcctggcctctgtggccgagtacacaggccccaagctgttcaaggagcccagcagcaagagcaacaagcccatcatccacaatgccatcagccactgctgcctggccggcaaggtgaatgagccccacaagaacagcatcctggaggagctggagaagtgtgatgccaaccactacatcatcctcttcagagatgctggctgccagttccgggccctgtactgctactacccagacacagaggagatctacaagctgaccggcaccggccccaagaacatcaccaagaagatgattgacaagctgtacaagtacagcagtgacaggaagcagttcaacctgatcccagccaagaccatgtctgtgtctgtggatgccctgaccatccacaaccacctgtggcagcccaagaggcctgctgtgcccaagaaggcccagaccaggaagtag

SEQ ID NO: 18723 - DNA, 4809 bp, Artificial Sequence
  Description of Artificial Sequence: Synthetic coding sequence
atggtggatgccagcggccgggctgctgctgagggctggaggaagatggaggcccccccagatggagctgctgacctggtgcccctggacagatatgatgctgcccgggccaagattgctgccaacctgcagtggatctgtgccaaggcctacggccgggacaacatccctgaggacctgcgggaccccttctacgtggaccagtatgagcaggagcacatcaagccccctgtgatcaagctgctgctgagcagcgagctgtactgccgggtgtgcagcctcatcctgaagggggaccaggtggccgccctgcagggccaccagagcgtcatccaggccctgagcaggaagggcatctacgtgatggagagtgatgacacccctgtgacagaaagtgacctgagccgggcccccatcaagatgtctgcccacatggccatggtggatgccctgatgatggcctacacagtggagatgatcagcattgagaaggtggtggcctctgtgaagcgcttcagcaccttcagcgccagcaaggagctgccctatgacctggaggatgccatggtgttctggatcaacaaggtgaacctgaagatgagggagatcacagagaaggaggtgaagctgaagcagcagctgctggagagccctgcccaccagaaggtgcgctaccgccgggagcacctgagcgcccggcagagcccctacttccccctgctggaggacctgatgagagatggcagtgatggagctgccctgctggccgtcatccactactactgcccagagcagatgaagctggatgacatctgcctgaaggaggtgacctccatggctgacagcctgtacaacatccggctgctgcgggagttcagcaatgagtacctgaacaagtgcttctacctgaccctggaggacatgctgtatgcccccctggtgctgaagcccaacgtgatggtgttcatcgccgagctgttctggtggtttgaaaatgtgaagccagactttgtgcagcccagagatgtgcaggagctgaaggatgccaagacagtgctgcaccagaagagcagccggccccctgtgcccatcagcaatgccaccaagaggagcttcctgggcagccctgctgctggcaccctggccgagctgcagccccctgtgcagctgcctgctgagggctgccaccgccactacctgcaccctgaggagcctgagtacctgggcaagggcacagctgccttcagccccagccaccccctgctgcccctgcggcagaagcagcagaagagcatccagggcgaggacatcccagaccagaggcacaggagcaacagcctgaccagggtggatggccagcccagaggagctgccatcgcctggccagagaagaagaccaggcctgccagccagcccaccccatttgccctgcaccacgccgccagctgtgaggtggaccccagcagcggggacagcatcagcctggcccggagcatcagcaaggacagcctggccagcaacatcgtgaacctgaccccccagaaccagccccaccccacagccaccaagagccacggcaagagcctgctgagcaatgtgtccattgaagatgaggaggaggagctggtggccatcgtgcgggcagatgtggtgccccagcaggccgaccctgagttcccccgggccagcccccgggccctgggcctgacagccaatgcccggagcccccagggccagctggacaccagcgagagcaagccagacagcttcttcctggagcccctgatgcctgctgtgctgaagccagccaaggagaagcaggtgatcaccaaggaggatgagcggggggagggccggcccaggagcatcgtgtcccggcggcccagcgagggcccccagcccctggtgcggaggaagatgacaggcagccgggacctgaacagaaccttcacccccatcccctgcagcgagttccccatgggcatcgaccccacagaaacaggccccctgtctgtggagacagctggggaggtgtgtggcggccccctggccctgggcggctttgaccccttcccccagggccccagcacagatggcttcttcctgcacgtgggccgggcagatgaggacacagagggccgcctgtatgtgtcctgcagcaagagccccaacagccatgacagcgagccctggaccctgctgcggcaggacagcgacagtgatgtggtggacatcgaggaggccgagcatgacttcatgggagaggcccaccctgtggtgttcagccgctacatcggggaggaggagagcgccaagctgcaggaggacatgaaggtgaaggagcacgaggacaaggatgatgccagcggccgcagcagcccctgcctgagcacagccagccagatgagctctgtgtccatggccagcggctctgtgaagatgaccagctttgctgagaggaagctgcagaggctgaacagctgtgagaccaagagcagcaccagcagcagccagaagaccaccccagatgccagcgagagctgcccagcccccctgaccacctggaggcagaagcgggagcagagccccagccagcacggcaaggaccctgccagcctgctggccagcgagctggtgcagctgcacatgcagctggaggagaagagaagagccatcgaggcccagaagaagaagatggaggccctgagcgcccggcagaggctgaagctgggcaaggccgccttcctgcacgtggtgaagaagggcaaggccgaggccgccccacccctgcggcctgagcactttgccaaggagtacagccagcacaatggagaggactgtggagatgctgtgtccaagacagaggacttcctggtgaaggaggagcagcgggaggagctgctgcacgagccccaggatgtggacaaggagagcctggcctttgcccagcagcacaaggccaaggaccctgtggccctgcacgagctggagaggaacaaggtgatctctgctgccctgctggaggacacagtgggggaggtggtggatgtgaatgaatgtgacctgagcattgagaagctgaatgagaccatcagcaccctgcagcaggccatcctgaagatcagccagcagcaggagcagctgctgatgaagagccccaccgtgcctgtgcccggcagcaagaacaacagccaggaccacaaggtgaaggcccctgtgcactttgtggagcccctgagccccaccggggtggccggccacaggaaggccccccggctgggccagggcaggaacagccgcagcggccggcctgctgagctgaaggtgcccaaggaccggccccagggcagcagccgcagcaagacccccacccccagcgtggagaccctgccccacctgcggcccttccctgccagcagccaccccaggacccccacagaccccggcctggacagcgccctggagcccagcggggacccccacggcaagtgcctgtttgacagctaccgcctgcatgatgagagcaaccagaggaccctgaccctgagcagcagcaaggatgccaacatcctgtctgagcagatgagcctgaaggaggtgctggatgcctctgtgaaggaggtgggcagcagcagcagtgatgtgtctgggaaggagagcgtgcctgtggaggagcccctgcggagccgggccagcctcatcgaggtggacctgagtgacctgaaggccccagatgaagatggagagctggtgtccctggatggcagcgctgacctggtgtctgagggggaccagaagccaggagtgggcttcttcttcaaggatgagcagaaggccgaggatgagctggccaagaagagagctgccttcctgctgaagcagcagaggaaggccgaggaggcccgggtgaggaagcagcagctggaggccgaggtggagctgaagagagatgaggcccggaggaaggccgaggaggacagagtgaggaaggaggaggagaaggcccggcgggagctgatcaagcaggagtacctgcggaggaagcagcagcagatcctggaggagcagggcctgggcaagcccaagagcaagcccaagaagccccggcccaagtctgtgcaccgggaggagagctgcagcgacagcggcaccaagtgcagcagcaccccagacaacctgagcaggacccagagcggcagcagcctgagcctggccagcgctgccaccacagagcctgagagcgtgcacagcggcggcacccccagccagagggtggagagcatggaggccctgcccatcctgagcaggaaccccagccgcagcacagaccgggactgggagacagccagcgctgccagcagcctggcctctgtggccgagtacacaggccccaagctgttcaaggagcccagcagcaagagcaacaagcccatcatccacaatgccatcagccactgctgcctggccggcaaggtgaatgagccccacaagaacagcatcctggaggagctggagaagtgtgatgccaaccactacatcatcctcttcagagatgctggctgccagttccgggccctgtactgctactacccagacacagaggagatctacaagctgaccggcaccggccccaagaacatcaccaagaagatgattgacaagctgtacaagtacagcagtgacaggaagcagttcaacctgatcccagccaagaccatgtctgtgtctgtggatgccctgaccatccacaaccacctgtggcagcccaagaggcctgctgtgcccaagaaggcccagaccaggaagtag

SEQ ID NO: 18724 - DNA, 4842 bp, Artificial Sequence
  Description of Artificial Sequence: Synthetic coding sequence
atggtggatgccagcggccgggctgctgctgagggctggaggaagatggaggcccccccagatggagctgctgacctggtgcccctggacagatatgatgctgcccgggccaagattgctgccaacctgcagtggatctgtgccaaggcctacggccgggacaacatccctgaggacctgcgggaccccttctacgtggaccagtatgagcaggagcacatcaagccccctgtgatcaagctgctgctgagcagcgagctgtactgccgggtgtgcagcctcatcctgaagggggaccaggtggccgccctgcagggccaccagagcgtcatccaggccctgagcaggaagggcatctacgtgatggagagtgatgacacccctgtgacagaaagtgacctgagccgggcccccatcaagatgtctgcccacatggccatggtggatgccctgatgatggcctacacagtggagatgatcagcattgagaaggtggtggcctctgtgaagcgcttcagcaccttcagcgccagcaaggagctgccctatgacctggaggatgccatggtgttctggatcaacaaggtgaacctgaagatgagggagatcacagagaaggaggtgaagctgaagcagcagctgctggagagccctgcccaccagaagagccccagcaagtggtactggaagctggtgcctgtgcgctacagaagagagcacctgagcgcccggcagagcccctacttccccctgctggaggacctgatgagagatggcagtgatggagctgccctgctggccgtcatccactactactgcccagagcagatgaagctggatgacatctgcctgaaggaggtgacctccatggctgacagcctgtacaacatccggctgctgcgggagttcagcaatgagtacctgaacaagtgcttctacctgaccctggaggacatgctgtatgcccccctggtgctgaagcccaacgtgatggtgttcatcgccgagctgttctggtggtttgaaaatgtgaagccagactttgtgcagcccagagatgtgcaggagctgaaggatgccaagacagtgctgcaccagaagagcagcaggcctcctgtgcccatcagcaatgccaccaagaggagcttcctgggcagccctgctgctggcaccctggccgagctgcagccccctgtgcagctgcctgctgagggctgccaccgccactacctgcaccctgaggagcctgagtacctgggcaaaggaacagctgccttcagccccagccaccccctgctgcccctgcggcagaagcagcagaagagcatccagggcgaggacatcccagaccagaggcacaggagcaacagcctgaccagggtggatggccagcccaggggggccgccatcgcctggccagagaagaagaccaggcctgccagccagcccaccccatttgccctgcaccacgccgccagctgtgaggtggaccccagcagcggggacagcatcagcctggcccggagcatcagcaaggacagcctggccagcaacatcgtgaacctgaccccccagaaccagccccaccccacagccaccaagagccacggcaagagcctgctgagcaatgtgtccattgaagatgaggaggaggagctggtggccatcgtgcgggcagatgtggtgccccagcaggccgaccctgagttcccccgggccagcccccgggccctgggcctgacagccaatgcccggagcccccagggccagctggacaccagcgagagcaagccagacagcttcttcctggagcccctgatgcctgctgtgctgaagccagccaaggagaagcaggtgatcaccaaggaggatgagcggggggagggccggcccaggagcatcgtgtccagaagacccagcgagggcccccagcccctggtgcggaggaagatgacaggcagccgggacctgaacagaaccttcacccccatcccctgcagcgagttccccatgggcatcgaccccacagagaccggccccctgtctgtggagacagctggggaggtgtgtggcggccccctggccctgggcggctttgaccccttcccccagggccccagcacagatggcttcttcctgcacgtgggccgggcagatgaggacacagagggccgcctgtatgtgtcctgcagcaagagccccaacagccatgattctgagccctggaccctgctgcggcaggacagcgacagtgatgtggtggacatcgaggaggccgagcatgacttcatgggagaggcccaccctgtggtgttcagccgctacatcggggaggaggagagcgccaagctgcaggaggacatgaaggtgaaggagcacgaggacaaggatgatgccagcggccgcagcagcccctgcctgagcacagccagccagatgagctctgtgtccatggccagcggctctgtgaagatgaccagctttgctgagaggaagctgcagaggctgaacagctgtgagaccaagagcagcaccagcagcagccagaagaccaccccagatgccagcgagagctgcccagcccccctgaccacctggaggcagaagcgggagcagagccccagccagcacggcaaggaccctgccagcctgctggccagcgagctggtgcagctgcacatgcagctggaggagaagaggcgggccatcgaggcccagaagaagaagatggaggccctgagcgcccggcagaggctgaagctgggcaaggccgccttcctgcacgtggtgaagaagggcaaggccgaggccgccccacccctgcggcctgagcactttgccaaggagtacagccagcacaacggggaggactgtggagatgctgtgtccaagacagaggacttcctggtgaaggaggagcagcgggaggagctgctgcacgagccccaggatgtggacaaggagagcctggcctttgcccagcagcacaaggccaaggaccctgtggccctgcacgagctggagaggaacaaggtgatctctgctgccctgctggaggacacagtgggggaggtggtggatgtgaatgaatgtgacctgagcattgagaagctgaatgagaccatcagcaccctgcagcaggccatcctgaagatcagccagcagcaggagcagctgctgatgaagagccccaccgtgcctgtgcccggcagcaagaacaacagccaggaccacaaggtgaaggcccctgtgcactttgtggagcccctgagccccactggagtggccggccacaggaaggccccccggctgggccagggcaggaacagccgcagcggccggcctgctgagctgaaggtgcccaaggaccggccccagggcagcagccgcagcaagacccccaccccatctgtggagaccctgccccacctgcggcccttccctgccagcagccaccccaggacccccacagatcctggcctggacagcgccctggagcccagcggggacccccacggcaagtgcctgtttgacagctaccgcctgcatgatgagagcaaccagaggaccctgaccctgagcagcagcaaggatgccaacatcctgtctgagcagatgagcctgaaggaggtgctggatgcctctgtgaaggaggtgggcagcagcagcagtgatgtgtctgggaaggagagcgtgcctgtggaggagcccctgcggagccgggccagcctgattgaggtggacctgagtgacctgaaggccccagatgaagatggagagctggtgtccctggatggcagcgctgacctggtgtctgagggggaccagaagccaggagtgggcttcttcttcaaggatgagcagaaggcagaagatgagctggccaagaagagagctgccttcctgctgaagcagcagaggaaggccgaggaggcccgggtgaggaagcagcagctggaggccgaggtggagctgaagagagatgaggcccggaggaaggccgaggaggacagagtgaggaaggaggaggagaaggcccggcgggagctgatcaagcaggagtacctgcggaggaagcagcagcagatcctggaggagcagggcctgggcaagcccaagagcaagcccaagaagccccggcccaagtctgtgcaccgggaggagagctgcagcgacagcggcaccaagtgcagcagcaccccagacaacctgagcaggacccagagcggcagcagcctgagcctggccagcgctgccaccacagagcctgagagcgtgcacagcggcggcacccccagccagagggtggagagcatggaggccctgcccatcctgagcaggaaccccagccgcagcacagaccgggactgggagacagccagcgctgccagcagcctggcctctgtggccgagtacacaggccccaagctgttcaaggagcccagcagcaagagcaacaagcccatcatccacaatgccatcagccactgctgcctggccggcaaggtgaatgagccccacaagaacagcatcctggaggagctggagaagtgtgatgccaaccactacatcatcctcttcagagatgctggctgccagttccgggccctgtactgctactacccagacacagaggagatctacaagctgactggaacaggccccaagaacatcaccaagaagatgattgacaagctgtacaagtacagcagtgacaggaagcagttcaacctgatcccagccaagaccatgtctgtgtctgtggatgccctgaccatccacaaccacctgtggcagcccaagaggcctgctgtgcccaagaaggcccagaccaggaagtag

SEQ ID NO: 18725 - DNA, 1983 bp, Artificial Sequence
  Description of Artificial Sequence: Synthetic coding sequence
atgaggatgcccagcagcacctgggcccgcatcatgagcagctgtggctgtgatgcctgccgggtgggccccagctctgtgatgaggcccagcccccgctacccccgggcctgggtgaccaggacctgggtgcccatccccccccggcccatggccagcagcggctctgtgccccgggactgctggctgctggccgccatcgccagcctgaccctgaatgacaccctgctgcaccgggtggtgccccacggccagagcttccagaatggctacgccggcatcttccacttccagctgtggcagtttggagagtgggtggatgtggtggtggatgacctgctgcccatcaaggatggcaagctggtgtttgtgcacagcgctgagggcaatgagttctggagcgccctgctggagaaggcctatgccaaggtgaatggcagctatgaggccctgagcggcggcagcaccagcgagggctttgaggacttcaccggcggcgtgacagagtggtatgagctgaggaaggcccccagcgacctgtaccagatcatcctgaaggccctggagcggggcagcctgctgggctgcagcattgacatcagctctgtgctggacatggaggccatcaccttcaagaagctggtgaagggccacgcctacagcgtgactggagccaagcaggtgaactaccggggccaggtggtgtccctcatccgcatgaggaacccctggggcgaggtggagtggacaggagcctggagcgacagcagcagcgagtggaacaacgtggacccctatgaaagagaccagctgcgggtgaagatggaggatggagagttctggatgtccttccgggacttcatgagggagttcacccggctggagatctgcaacctgaccccagatgccctgaagagcaggaccatcaggaagtggaacaccaccctgtatgagggcacctggaggcggggcagcacagctgggggctgcaggaactacccagccaccttctgggtgaacccccagttcaagatccggctggatgaaacagatgatcctgatgattatggagaccgggagagcggctgcagctttgtgctggccctgatgcagaagcacagaagaagagagcggcgcttcggccgggacatggagaccatcggctttgctgtgtatgaggtgcccccagagctggtgggccagcctgctgtgcacctgaagagggacttcttcctggccaatgccagccgggcccggtctgagcagttcatcaacctgcgggaggtgtccacccgcttccggctgcccccaggagaatatgtggtggtgcccagcacctttgagcccaacaaggagggggactttgtgctgcgcttcttcagcgagaagtctgctggcaccgtggagctggatgaccagatccaggccaacctgcctgatgagcaggtgctgtctgaggaggagattgatgagaacttcaaggccctcttccggcagctggccggggaggacatggagatctctgtgaaggagctgcggaccatcctgaaccgcatcatcagcaagcacaaggacctgcggaccaagggcttcagcctggagagctgccgctccatggtgaacctgatggacagagatggaaatggcaagctgggcctggtggagttcaacatcctgtggaaccgcatccggaactacctgagcatcttcaggaagtttgacctggacaagagcggctccatgtctgcctatgagatgaggatggccatcgagagcgctggcttcaagctgaacaagaagctgtatgagctgatcatcacccgctacagcgagccagacctggccgtggactttgacaactttgtgtgctgcctggtgcggctggagaccatgttccgcttcttcaagaccctggacacagacctggatggagtggtgacctttgacctcttcaagtggctgcagctgaccatgtttgcctag

SEQ ID NO: 18726 - DNA, 2145 bp, Artificial Sequence
  Description of Artificial Sequence: Synthetic coding sequence
atgtctgaggagatcatcacccctgtgtactgcaccggggtgtctgcccaggtgcagaagcagagggcccgggagctgggcctgggcagacatgaaaatgccatcaagtacctgggccaggactatgagcagctgcgggtgcgctgcctgcagagcggcaccctcttcagagatgaggccttcccccctgtgccccagagcctgggctacaaggacctgggccccaacagcagcaagacctacggcatcaagtggaagaggcccacagagctgctgagcaacccccagttcatcgtggatggagccaccaggacagacatctgccagggcgccctgggggactgctggctgctggccgccatcgccagcctgaccctgaatgacaccctgctgcaccgggtggtgccccacggccagagcttccagaatggctacgccggcatcttccacttccagctgtggcagtttggagagtgggtggatgtggtggtggatgacctgctgcccatcaaggatggcaagctggtgtttgtgcacagcgctgagggcaatgagttctggagcgccctgctggagaaggcctatgccaaggtgaatggcagctatgaggccctgagcggcggcagcaccagcgagggctttgaggacttcaccggcggcgtgacagagtggtatgagctgaggaaggcccccagcgacctgtaccagatcatcctgaaggccctggagcggggcagcctgctgggctgcagcattgacatcagctctgtgctggacatggaggccatcaccttcaagaagctggtgaagggccacgcctacagcgtgactggagccaagcaggtgaactaccggggccaggtggtgtccctcatccgcatgaggaacccctggggcgaggtggagtggacaggagcctggagcgacagcagcagcgagtggaacaacgtggacccctatgaaagagaccagctgcgggtgaagatggaggatggagagttctggatgtccttccgggacttcatgagggagttcacccggctggagatctgcaacctgaccccagatgccctgaagagcaggaccatcaggaagtggaacaccaccctgtatgagggcacctggaggcggggcagcacagctgggggctgcaggaactacccagccaccttctgggtgaacccccagttcaagatccggctggatgaaacagatgatcctgatgattatggagaccgggagagcggctgcagctttgtgctggccctgatgcagaagcacagaagaagagagcggcgcttcggccgggacatggagaccatcggctttgctgtgtatgaggtgcccccagagctggtgggccagcctgctgtgcacctgaagagggacttcttcctggccaatgccagccgggcccggtctgagcagttcatcaacctgcgggaggtgtccacccgcttccggctgcccccaggagaatatgtggtggtgcccagcacctttgagcccaacaaggagggggactttgtgctgcgcttcttcagcgagaagtctgctggcaccgtggagctggatgaccagatccaggccaacctgcctgatgagcaggtgctgtctgaggaggagattgatgagaacttcaaggccctcttccggcagctggccggggaggacatggagatctctgtgaaggagctgcggaccatcctgaaccgcatcatcagcaagcacaaggacctgcggaccaagggcttcagcctggagagctgccgctccatggtgaacctgatggacagagatggaaatggcaagctgggcctggtggagttcaacatcctgtggaaccgcatccggaactacctgagcatcttcaggaagtttgacctggacaagagcggctccatgtctgcctatgagatgaggatggccatcgagagcgctggcttcaagctgaacaagaagctgtatgagctgatcatcacccgctacagcgagccagacctggccgtggactttgacaactttgtgtgctgcctggtgcggctggagaccatgttccgcttcttcaagaccctggacacagacctggatggagtggtgacctttgacctcttcaagtggctgcagctgaccatgtttgcctag

SEQ ID NO: 18727 - DNA, 2145 bp, Artificial Sequence; identical to SEQ ID NO: 18726
  Description of Artificial Sequence: Synthetic coding sequence

SEQ ID NO: 18728 - DNA, 489 bp, Artificial Sequence
  Description of Artificial Sequence: Synthetic coding sequence
atgtctgaggagatcatcacccctgtgtactgcaccggggtgtctgcccaggtgcagaagcagagggcccgggagctgggcctgggcagacatgaaaatgccatcaagtacctgggccaggactatgagcagctgcgggtgcgctgcctgcagagcggcaccctcttcagagatgaggccttcccccctgtgccccagagcctgggctacaaggacctgggccccaacagcagcaagacctacggcatcaagtggaagaggcccacagagctgctgagcaacccccagttcatcgtggatggagccaccaggacagacatctgccagggcgccctgggggactgctggctgctggccgccatcgccagcctgaccctgaatgacaccctgctgcaccgggtggtgccccacggccagagcttccagaatggctacgccggcatcttccacttccagctgtggcagtttggagagtgggtggatgtgtag

SEQ ID NO: 18729 - DNA, 2145 bp, Artificial Sequence; identical to SEQ ID NO: 18726
  Description of Artificial Sequence: Synthetic coding sequence

SEQ ID NO: 18730 - DNA, 459 bp, Artificial Sequence
  Description of Artificial Sequence: Synthetic coding sequence
atgtctgaggagatcatcacccctgtgtactgcaccggggtgtctgcccaggtgcagaagcagagggcccgggagctgggcctgggcagacatgaaaatgccatcaagtacctgggccaggactatgagcagctgcgggtgcgctgcctgcagagcggcaccctcttcagagatgaggccttcccccctgtgccccagagcctgggctacaaggacctgggccccaacagcagcaagacctacggcatcaagtggaagaggcccacagagctgctgagcaacccccagttcatcgtggatggagccaccaggacagacatctgccagggcgccctgggggactgctggctgctggccgccatcgccagcctgaccctgaatgacaccctgctgcaccgggtggtgccccacggccagagcttccagaatggctacgccggcatcttccacttccagtag

SEQ ID NO: 18731 - DNA, 489 bp, Artificial Sequence; identical to SEQ ID NO: 18728
  Description of Artificial Sequence: Synthetic coding sequence

SEQ ID NO: 18732 - DNA, 492 bp, Artificial Sequence
  Description of Artificial Sequence: Synthetic coding sequence
atgtctgaggagatcatcacccctgtgtactgcaccggggtgtctgcccaggtgcagaagcagagggcccgggagctgggcctgggcagacatgaaaatgccatcaagtacctgggccaggactatgagcagctgcgggtgcgctgcctgcagagcggcaccctcttcagagatgaggccttcccccctgtgccccagagcctgggctacaaggacctgggccccaacagcagcaagacctacggcatcaagtggaagaggcccacagagctgctgagcaacccccagttcatcgtggatggagccaccaggacagacatctgccagggcgccctgggggactgctggctgctggccgccatcgccagcctgaccctgaatgacaccctgctgcaccgggtggtgccccacggccagagcttccagaatggctacgccggcatcttccacttccagctgtggcagtttggagagtgggtggatgtggtgtag

SEQ ID NO: 18733 - DNA, 576 bp, Artificial Sequence
  Description of Artificial Sequence: Synthetic coding sequence
atgtctgaggagatcatcacccctgtgtactgcaccggggtgtctgcccaggtgcagaagcagagggcccgggagctgggcctgggcagacatgaaaatgccatcaagtacctgggccaggactatgagcagctgcgggtgcgctgcctgcagagcggcaccctcttcagagatgaggccttcccccctgtgccccagagcctgggctacaaggacctgggccccaacagcagcaagacctacggcatcaagtggaagaggcccacagagctgctgagcaacccccagttcatcgtggatggagccaccaggacagacatctgccagggcgccctgggggactgctggctgctggccgccatcgccagcctgaccctgaatgacaccctgctgcaccgggtggtgccccacggccagagcttccagaatggctacgccggcatcttccacttccagctgtggcagtttggagagtgggtggatgtggtggtggatgacctgctgcccatcaaggatggcaagctggtgtttgtgcacagcgctgagggcaatgagttctggagcgccctgctgtag

SEQ ID NO: 18734 - DNA, 513 bp, Artificial Sequence
  Description of Artificial Sequence: Synthetic coding sequence
atgtctgaggagatcatcacccctgtgtactgcaccggggtgtctgcccaggtgcagaagcagagggcccgggagctgggcctgggcagacatgaaaatgccatcaagtacctgggccaggactatgagcagctgcgggtgcgctgcctgcagagcggcaccctcttcagagatgaggccttcccccctgtgccccagagcctgggctacaaggacctgggccccaacagcagcaagacctacggcatcaagtggaagaggcccacagagctgctgagcaacccccagttcatcgtggatggagccaccaggacagacatctgccagggcgccctgggggactgctggctgctggccgccatcgccagcctgaccctgaatgacaccctgctgcaccgggtggtgccccacggccagagcttccagaatggctacgccggcatcttccacttccagctgtggcagtttggagagtgggtggatgtggtggtggatgacctgctgcccatctag

SEQ ID NO: 18735 - DNA, 369 bp, Artificial Sequence
  Description of Artificial Sequence: Synthetic coding sequence
atgtctgaggagatcatcacccctgtgtactgcaccggggtgtctgcccaggtgcagaagcagagggcccgggagctgggcctgggcagacatgaaaatgccatcaagtacctgggccaggactatgagcagctgcgggtgcgctgcctgcagagcggcaccctcttcagagatgaggccttcccccctgtgccccagagcctgggctacaaggacctgggccccaacagcagcaagacctacggcatcaagtggaagaggcccacagagctgctgagcaacccccagttcatcgtggatggagccaccaggacagacatctgccagggcgccctgggggactgctggctgctggccgccatcgcctag

SEQ ID NO: 18736 - DNA, 192 bp, Artificial Sequence
  Description of Artificial Sequence: Synthetic coding sequence
atgtctgaggagatcatcacccctgtgtactgcaccggggtgtctgcccaggtgcagaagcagagggcccgggagctgggcctgggcagacatgaaaatgccatcaagtacctgggccaggactatgagcagctgcgggtgcgctgcctgcagagcggcaccctcttcagagatgaggccttccccccatag

SEQ ID NO: 18737 - DNA, 2145 bp, Artificial Sequence; identical to SEQ ID NO: 18726
  Description of Artificial Sequence: Synthetic coding sequence

SEQ ID NO: 18738 - DNA, 2145 bp, Artificial Sequence; identical to SEQ ID NO: 18726
  Description of Artificial Sequence: Synthetic coding sequence

SEQ ID NO: 18739 - DNA, 447 bp, Artificial Sequence
  Description of Artificial Sequence: Synthetic coding sequence
atgtctgaggagatcatcacccctgtgtactgcaccggggtgtctgcccaggtgcagaagcagagggcccgggagctgggcctgggcagacatgaaaatgccatcaagtacctgggccaggactatgagcagctgcgggtgcgctgcctgcagagcggcaccctcttcagagatgaggccttcccccctgtgccccagagcctgggctacaaggacctgggccccaacagcagcaagacctacggcatcaagtggaagaggcccacagagctgctgagcaacccccagttcatcgtggatggagccaccaggacagacatctgccagggcgccctgggggactgctggctgctggccgccatcgccagcctgaccctgaatgacaccctgctgcaccgggtggtgccccacggccagagcttccagaatggctacgccggcatctag

SEQ ID NO: 18740 - DNA, 411 bp, Artificial Sequence
  Description of Artificial Sequence: Synthetic coding sequence
atgtctgaggagatcatcacccctgtgtactgcaccggggtgtctgcccaggtgcagaagcagagggcccgggagctgggcctgggcagacatgaaaatgccatcaagtacctgggccaggactatgagcagctgcgggtgcgctgcctgcagagcggcaccctcttcagagatgaggccttcccccctgtgccccagagcctgggctacaaggacctgggccccaacagcagcaagacctacggcatcaagtggaagaggcccacagagctgctgagcaacccccagttcatcgtggatggagccaccaggacagacatctgccagggcgccctgggggactgctggctgctggccgccatcgccagcctgaccctgaatgacaccctgctgcaccgggtggtgccctag

SEQ ID NO: 18741 - DNA, 2103 bp, Artificial Sequence
  Description of Artificial Sequence: Synthetic coding sequence
atggccggcattgctgccaagctggccaaggaccgggaggccgctgagggcctgggcagccatgaccgggccatcaagtacctgaaccaggactatgaggccctgagaaatgaatgtctggaggccggcaccctcttccaggaccccagcttccctgccatccccagcgccctgggcttcaaggagctgggcccctacagcagcaagacccggggcatcgagtggaagaggcccacagagatctgtgccgacccccagttcatcattggaggagccaccaggacagacatctgccagggcgccctgggggactgctggctgctggccgccatcgccagcctgaccctgaatgaggagatcctggcccgggtggtgcccctgaaccagagcttccaggagaactatgccggcatcttccacttccagttctggcagtacggggagtgggtggaggtggtggtggatgaccggctgcccaccaaggatggagagctgctgtttgtgcacagcgctgagggcagcgagttctggagcgccctgctggagaaggcctatgccaagatcaatggctgctatgaggccctgagcggcggggccaccacagagggctttgaggacttcaccggcggcattgctgagtggtatgagctgaagaagcccccacccaacctcttcaagatcatccagaaggccctgcagaagggcagcctgctgggctgcagcattgacatcaccagcgctgctgacagcgaggccatcaccttccagaagctggtgaagggccacgcctacagcgtgactggagctgaggaggtggagagcaatggcagcctgcagaagctgatccgcatccggaacccctggggcgaggtggagtggacaggccgctggaatgacaactgccccagctggaacaccattgatcctgaggagcgggagcggctgaccaggagacatgaagatggagagttctggatgtccttcagtgacttcctgcggcactacagccggctggagatctgcaacctgaccccagacaccctgaccagtgacacctacaagaagtggaagctgaccaagatggatggcaactggaggcggggcagcacagctgggggctgcaggaactaccccaacaccttctggatgaacccccagtacctgatcaagctggaggaggaggatgaagatgaagaagatggagagagcggctgcaccttcctggtgggcctcatccagaagcacagaagacggcagaggaagatgggagaggacatgcacaccatcggcttcggcatctatgaggtgcctgaggagctgagcggccagaccaacatccacctgagcaagaacttcttcctgaccaacagagcccgggagaggagtgacaccttcatcaacctgcgggaggtgctgaaccgcttcaagctgcccccaggagagtacatcctggtgcccagcacctttgagcccaacaaggatggagacttctgcatccgggtcttcagcgagaagaaggctgactaccaggccgtggatgatgaaattgaggccaacctggaggagtttgacatcagtgaagatgacattgatgatggcttcagaagactctttgcccagctggccggggaggatgctgagatcagcgcctttgagctgcagaccatcctgcggcgggtgctggccaagaggcaggacatcaagagtgatggcttcagcattgagacctgcaagatcatggtggacatgctggacagtgatggcagcggcaagctgggcctgaaggagttctacatcctgtggaccaagatccagaagtaccagaagatctaccgggagattgatgtggacagaagtggcaccatgaacagctatgagatgaggaaggccctggaggaggccggcttcaagatgccctgccagctgcaccaggtgattgtggccaggtttgctgatgaccagctgatcatcgactttgacaactttgtgcgctgcctggtgcggctggagaccctcttcaagatcttcaagcagctggaccctgagaacacaggcaccatcgagctggacctgatctcctggctgtgcttctctgtgctgtag

SEQ ID NO: 18742 - DNA, 2190 bp, Artificial Sequence
  Description of Artificial Sequence: Synthetic coding sequence
gcccctggccctggccgggccccagctgagaggtctgctgagagcccccggcccttcagcgcccagtatggaagaagagaccgctccatggccggcattgctgccaagctggccaaggaccgggaggccgctgagggcctgggcagccatgaccgggccatcaagtacctgaaccaggactatgaggccctgagaaatgaatgtctggaggccggcaccctcttccaggaccccagcttccctgccatccccagcgccctgggcttcaaggagctgggcccctacagcagcaagacccggggcatcgagtggaagaggcccacagagatctgtgccgacccccagttcatcatcggcggggccaccaggacagacatctgccagggcgccctgggggactgctggctgctggccgccatcgccagcctgaccctgaatgaggagatcctggcccgggtggtgcccctgaaccagagcttccaggagaactatgccggcatcttccacttccagttctggcagtatggagagtgggtggaggtggtggtggatgaccggctgcccaccaaggatggagagctgctgtttgtgcacagcgctgagggcagcgagttctggagcgccctgctggagaaggcctatgccaagatcaatggctgctatgaggccctgtctggaggagccaccacagagggctttgaggacttcaccggcggcattgctgagtggtatgagctgaagaagcccccacccaacctcttcaagatcatccagaaggccctgcagaagggcagcctgctgggctgcagcattgacatcaccagcgctgctgacagcgaggccatcaccttccagaagctggtgaagggccacgcctacagcgtgactggagctgaggaggtggagagcaatggcagcctgcagaagctgatccgcatccggaacccctggggcgaggtggagtggacaggccgctggaatgacaactgccccagctggaacaccatcgaccctgaggagcgggagcggctgaccaggagacatgaagatggagagttctggatgtccttcagtgacttcctgcggcactacagccggctggagatctgcaacctgaccccagacaccctgaccagtgacacctacaagaagtggaagctgaccaagatggatggcaactggaggcggggcagcacagctgggggctgcaggaactaccccaacaccttctggatgaacccccagtacctgatcaagctggaggaggaggatgaagatgaggaggatggagagagcggctgcaccttcctggtgggcctcatccagaagcacagaagacggcagaggaagatgggagaggacatgcacaccatcggcttcggcatctatgaggtgcacccccagctgagcggccagaccaacatccacctgagcaagaacttcttcctgaccaacagagcccgggagaggagtgacaccttcatcaacctgcgggaggtgctgaaccgcttcaagctgcccccaggagagtacatcctggtgcccagcacctttgagcccaacaaggatggagacttctgcatccgggtcttcagcgagaagaaggctgactaccaggccgtggatgatgaaattgaggccaacctggaggagtttgacatcagtgaagatgacattgatgatggcttccggcggctgtttgcccagctggccggagaagatgctgagatcagcgcctttgagctgcagaccatcctgcggcgggtgctggccaagaggcaggacatcaagagtgatggcttcagcattgagacctgcaagatcatggtggacatgctggacagtgatggcagcggcaagctgggcctgaaggagttctacatcctgtggaccaagatccagaagtaccagaagatctaccgggagattgatgtggacaggagcggcaccatgaacagctatgagatgaggaaggccctggaggaggccggcttcaagatgccctgccagctgcaccaggtgattgtggccaggtttgctgatgaccagctgatcatcgactttgacaactttgtgcgctgcctggtgcggctggagaccctcttcaagatcttcaagcagctggaccctgaaaatacaggcaccatcgagctggacctgatctcctggctgtgcttctctgtgctgtag

SEQ ID NO: 18743 - DNA, 1869 bp, Artificial Sequence
  Description of Artificial Sequence: Synthetic coding sequence
atggagatctgtgccgacccccagttcatcattggaggagccaccaggacagacatctgccagggcgccctgggggactgctggctgctggccgccatcgccagcctgaccctgaatgaggagatcctggcccgggtggtgcccctgaaccagagcttccaggagaactatgccggcatcttccacttccagttctggcagtacggggagtgggtggaggtggtggtggatgaccggctgcccaccaaggatggagagctgctgtttgtgcacagcgctgagggcagcgagttctggagcgccctgctggagaaggcctatgccaagatcaatggctgctatgaggccctgagcggcggggccaccacagagggctttgaggacttcaccggcggcattgctgagtggtatgagctgaagaagcccccacccaacctcttcaagatcatccagaaggccctgcagaagggcagcctgctgggctgcagcattgacatcaccagcgctgctgacagcgaggccatcaccttccagaagctggtgaagggccacgcctacagcgtgactggagctgaggaggtggagagcaatggcagcctgcagaagctgatccgcatccggaacccctggggcgaggtggagtggacaggccgctggaatgacaactgccccagctggaacaccattgatcctgaggagcgggagcggctgaccaggagacatgaagatggagagttctggatgtccttcagtgacttcctgcggcactacagccggctggagatctgcaacctgaccccagacaccctgaccagtgacacctacaagaagtggaagctgaccaagatggatggcaactggaggcggggcagcacagctgggggctgcaggaactaccccaacaccttctggatgaacccccagtacctgatcaagctggaggaggaggatgaagatgaagaagatggagagagcggctgcaccttcctggtgggcctcatccagaagcacagaagacggcagaggaagatgggagaggacatgcacaccatcggcttcggcatctatgaggtgcctgaggagctgagcggccagaccaacatccacctgagcaagaacttcttcctgaccaacagagcccgggagaggagtgacaccttcatcaacctgcgggaggtgctgaaccgcttcaagctgcccccaggagagtacatcctggtgcccagcacctttgagcccaacaaggatggagacttctgcatccgggtcttcagcgagaagaaggctgactaccaggccgtggatgatgaaattgaggccaacctggaggagtttgacatcagtgaagatgacattgatgatggcttcagaagactctttgcccagctggccggggaggatgctgagatcagcgcctttgagctgcagaccatcctgcggcgggtgctggccaagaggcaggacatcaagagtgatggcttcagcattgagacctgcaagatcatggtggacatgctggacagtgatggcagcggcaagctgggcctgaaggagttctacatcctgtggaccaagatccagaagtaccagaagatctaccgggagattgatgtggacagaagtggcaccatgaacagctatgagatgaggaaggccctggaggaggccggcttcaagatgccctgccagctgcaccaggtgattgtggccaggtttgctgatgaccagctgatcatcgactttgacaactttgtgcgctgcctggtgcggctggagaccctcttcaagatcttcaagcagctggaccctgagaacacaggcaccatcgagctggacctgatctcctggctgtgcttctctgtgctgtag

SEQ ID NO: 18744 - DNA, 396 bp, Artificial Sequence
  Description of Artificial Sequence: Synthetic coding sequence
atggagatctgtgccgacccccagttcatcattggaggagccaccaggacagacatctgccagggcgccctgggggactgctggctgctggccgccatcgccagcctgaccctgaatgaggagatcctggcccgggtggtgcccctgaaccagagcttccaggagaactatgccggcatcttccacttccagttctggcagtacggggagtgggtggaggtggtggtggatgaccggctgcccaccaaggatggagagctgctgtttgtgcacagcgctgagggcagcgagttctggagcgccctgctggagaaggcctatgccaagatcaatggctgctatgaggccctgagcggcggggccaccacagagggctttgaggacttcaccggctag

SEQ ID NO: 18745 - DNA, 156 bp, Artificial Sequence
  Description of Artificial Sequence: Synthetic coding sequence
atgaagaaccgggaggccgccagagaatgtagaaggaagaagaaggagtatgtgaagtgcctggagaacagagtggccgtgctggagaaccagaacaagaccctcatcgaggagctgaaggccctgaaggacctgtactgccacaagagtgactag

SEQ ID NO: 18746 - DNA, 984 bp, Artificial Sequence
  Description of Artificial Sequence: Synthetic coding sequence
atgaccatggagagcggggctgagaaccagcagagcggagatgctgctgtgacagaagctgagaaccagcagatgacagtgcaggcccagccccagatcgccaccctggcccaggtgtccatgcctgctgcccacgccaccagcagcgcccccaccgtgaccctggtgcagctgcccaacggccagacagtgcaggtgcatggagtcatccaggccgcccagcccagcgtcatccagagcccccaggtgcagacagtgcagatcagcaccatcgccgagagcgaggacagccaggagagcgtggacagcgtgacagacagccagaagaggcgggagatcctgagccggcggcccagctacaggaagatcctgaatgacctgagcagtgatgcccctggggtgcccagaattgaggaggagaagtctgaggaggagaccagcgccccagccatcaccaccgtgacagtgcccacccccatctaccagaccagcagcggccagtacatcgccatcacccagggcggggccatccagctggccaacaacggcacagatggagtgcagggcctgcagaccctgaccatgaccaatgctgctgccacccagcccggcaccaccatcctgcagtatgcccagaccacagatggccagcagatcctggtgcccagcaaccaggtggtggtgcaggccgccagcggagatgtgcagacctaccagatcagaacagcccccaccagcaccatcgcccctggggtggtgatggccagcagccctgccctgcccacccagcctgctgaggaggccgccaggaagcgggaggtgcggctgatgaagaaccgggaggccgccagagaatgtagaaggaagaagaaggagtatgtgaagtgcctggagaacagagtggccgtgctggagaaccagaacaagaccctcatcgaggagctgaaggccctgaaggacctgtactgccacaagagtgactag

SEQ ID NO: 18747 - DNA, 693 bp, Artificial Sequence
  Description of Artificial Sequence: Synthetic coding sequence
atgaccatggagagcggggctgagaaccagcagagcggagatgctgctgtgacagaagctgagaaccagcagatgacagtgcaggcccagccccagatcgccaccctggcccaggtgtccatgcctgctgcccacgccaccagcagcgcccccaccgtgaccctggtgcagctgcccaacggccagacagtgcaggtgcatggagtcatccaggccgcccagcccagcgtcatccagagcccccaggtgcagacagtgcagagcagctgcaaggacctgaagaggctcttcagcggcacccagatcagcaccatcgccgagagcgaggacagccaggagagcgtggacagcgtgacagacagccagaagaggcgggagatcctgagccggcggcccagctacaggaagatcctgaatgacctgagcagtgatgcccctggggtgcccagaattgaggaggagaagtctgaggaggagaccagcgccctgcccacccagcctgctgaggaggccgccaggaagcgggaggtgcggctgatgaagaaccgggaggccgcccgggagtgcaggaggaagaagaaggagtatgtgaagtgcctggagaacagagtggccgtgctggagaaccagaacaagaccctgattgaggagctgaaggccctgaaggacctgtactgccacaagagtgactag

SEQ ID NO: 18748 - DNA, 240 bp, Artificial Sequence
  Description of Artificial Sequence: Synthetic coding sequence
atgaccatggagagcggggctgagaaccagcagagcggagatgctgctgtgacagaagctgagaaccagcagatgacagtgcaggcccagccccagatcgccaccctggcccaggtgtccatgcctgctgcccacgccaccagcagcgcccccaccgtgaccctggtgcagctgcccaacggccagacagtgcaggtgcatggagtcatccaggccgcccagcccagcgtcatccagtag

SEQ ID NO: 18749 - DNA, 984 bp, Artificial Sequence; identical to SEQ ID NO: 18746
  Description of Artificial Sequence: Synthetic coding sequence

SEQ ID NO: 18750 - DNA, 1026 bp, Artificial Sequence
  Description of Artificial Sequence: Synthetic coding sequence
atgaccatggagagcggggctgagaaccagcagagcggagatgctgctgtgacagaagctgagaaccagcagatgacagtgcaggcccagccccagatcgccaccctggcccaggtgtccatgcctgctgcccacgccaccagcagcgcccccaccgtgaccctggtgcagctgcccaacggccagacagtgcaggtgcatggagtcatccaggccgcccagcccagcgtcatccagagcccccaggtgcagacagtgcagagcagctgcaaggacctgaagaggctcttcagcggcacccagatcagcaccatcgccgagagcgaggacagccaggagagcgtggacagcgtgacagacagccagaagaggcgggagatcctgagccggcggcccagctacaggaagatcctgaatgacctgagcagtgatgcccctggggtgcccagaattgaggaggagaagtctgaggaggagaccagcgccccagccatcaccaccgtgacagtgcccacccccatctaccagaccagcagcggccagtacatcgccatcacccagggcggggccatccagctggccaacaacggcacagatggagtgcagggcctgcagaccctgaccatgaccaatgctgctgccacccagcccggcaccaccatcctgcagtatgcccagaccacagatggccagcagatcctggtgcccagcaaccaggtggtggtgcaggccgccagcggagatgtgcagacctaccagatcagaacagcccccaccagcaccatcgcccctggggtggtgatggccagcagccctgccctgcccacccagcctgctgaggaggccgccaggaagcgggaggtgcggctgatgaagaaccgggaggccgccagagaatgtagaaggaagaagaaggagtatgtgaagtgcctggagaacagagtggccgtgctggagaaccagaacaagaccctcatcgaggagctgaaggccctgaaggacctgtactgccacaagagtgactag

SEQ ID NO: 18751 - DNA, 549 bp, Artificial Sequence
  Description of Artificial Sequence: Synthetic coding sequence
atgaccatggagagcggggctgagaaccagcagagcggagatgctgctgtgacagaagctgagaaccagcagatgacagtgcaggcccagccccagatcgccaccctggcccaggtgtccatgcctgctgcccacgccaccagcagcgcccccaccgtgaccctggtgcagctgcccaacggccagacagtgcaggtgcatggagtcatccaggccgcccagcccagcgtcatccagagcccccaggtgcagacagtgcagagcagctgcaaggacctgaagaggctcttcagcggcacccagatcagcaccatcgccgagagcgaggacagccaggagagcgtggacagcgtgacagacagccagaagaggcgggagatcctgagccggcggcccagctacaggaagatcctgaatgacctgagcagtgatgcccctggggtgcccagaattgaggaggagaagtctgaggaggagaccagcgccccagccatcaccaccgtgacagtgcccacccccatctaccagaccagcagcggccagtactag

SEQ ID NO: 18752 - DNA, 399 bp, Artificial Sequence
  Description of Artificial Sequence: Synthetic coding sequence
atgaccatggagagcggggctgagaaccagcagagcggagatgctgctgtgacagaagctgagaaccagcagatgacagtgcaggcccagccccagatcgccaccctggcccaggtgtccatgcctgctgcccacgccaccagcagcgcccccaccgtgaccctggtgcagctgcccaacggccagacagtgcaggtgcatggagtcatccaggccgcccagcccagcgtcatccagagcccccaggtgcagacagtgcagagcagctgcaaggacctgaagaggctcttcagcggcacccagatcagcaccatcgccgagagcgaggacagccaggagagcgtggacagcgtgacagacagccagaagaggcgggagatcctgagccggcggccctag

SEQ ID NO: 18753 - DNA, 705 bp, Artificial Sequence
  Description of Artificial Sequence: Synthetic coding sequence
atgaccatggagagcggggctgagaaccagcagagcggagatgctgctgtgacagaagctgagaaccagcagatgacagtgcaggcccagccccagatcgccaccctggcccaggtgtccatgcctgctgcccacgccaccagcagcgcccccaccgtgaccctggtgcagctgcccaacggccagacagtgcaggtgcatggagtcatccaggccgcccagcccagcgtcatccagagcccccaggtgcagacagtgcagatcagcaccatcgccgagagcgaggacagccaggagagcgtggacagcgtgacagacagccagaagaggcgggagatcctgagccggcggcccagctacaggaagatcctgaatgacctgagcagtgatgcccctggggtgcccagaattgaggaggagaagtctgaggaggagaccagcgccccagccatcaccaccgtgacagtgcccacccccatctaccagaccagcagcggccagtacatcgccatcacccagggcggggccatccagctggccaacaacggcacagatggagtgcagggcctgcagaccctgaccatgaccaatgctgctgccacccagcccggcaccaccatcctgcagtatgcccagaccacagatggccagcagatcctggtgcccagcaaccaggtggtggtgcagggcacccagaagctgtag

SEQ ID NO: 18754 - DNA, 462 bp, Artificial Sequence
  Description of Artificial Sequence: Synthetic coding sequence
atgcctgctgcccacgccaccagcagcgcccccaccgtgaccctggtgcagctgcccaacggccagacagtgcaggtgcatggagtcatccaggccgcccagcccagcgtcatccagagcccccaggtgcagacagtgcagagcagctgcaaggacctgaagaggctcttcagcggcacccagatcagcaccatcgccgagagcgaggacagccaggagagcgtggacagcgtgacagacagccagaagaggcgggagatcctgagccggcggcccagctacaggaagatcctgaatgacctgagcagtgatgcccctggggtgcccagaattgaggaggagaagtctgaggaggagaccagcgccccagccatcaccaccgtgacagtgcccacccccatctaccagaccagcagcggccagtacacctacctgcgggacaccacctacagctgccagtag

SEQ ID NO: 18755 - DNA, 1998 bp, Artificial Sequence
  Description of Artificial Sequence: Synthetic coding sequence
atggcccacgagatgattggcacccagatcgtgacagagcggctggtggccctgctggagagcggcacagagaaggtgctgctgattgacagccggccctttgtggagtacaacaccagccacatcctggaggccatcaacatcaactgcagcaagctgatgaagaggcggctgcagcaggacaaggtgctgatcacagagctgatccagcacagcgccaagcacaaggtggacatcgactgcagccagaaggtggtggtgtatgaccagagcagccaggatgtggccagcctgagcagtgactgcttcctgactgtgctgctgggcaagctggagaagagcttcaacagcgtgcacctgctggccggcggctttgctgagttcagccgctgcttccctggcctgtgtgagggcaagagcaccctggtgcccacctgcatcagccagccctgcctgcctgtggccaacatcggccccacccgcatcctgcccaacctgtacctgggctgccagagagatgtgctgaacaaggagctgatgcagcagaatggaattggctacgtgctgaatgccagcaacacctgccccaagccagacttcatccctgagagccacttcctgcgggtgcctgtgaatgacagcttctgtgagaagatcctgccctggctggacaagtctgtggacttcatcgagaaggccaaggccagcaatggctgtgtgctggtgcactgcctggccggcatcagccgcagcgccaccatcgccatcgcctacatcatgaagaggatggacatgagcctggatgaggcctacagatttgtgaaggagaagaggcccaccatcagccccaacttcaacttcctgggccagctgctggactatgagaagaagatcaagaaccagacaggagccagcggccccaagagcaagctgaagctgctgcacctggagaagcccaatgaacctgtgcctgctgtgtctgagggcggccagaagtctgagacccccctgagccccccctgtgccgacagcgccaccagcgaggccgccggccagaggcctgtgcacccagcctctgtgcccagcgtgcccagcgtgcagcccagcctgctggaggacagccccctggtgcaggccctgagcggcctgcacctgtctgctgaccggctggaggacagcaacaagctgaagaggagcttcagcctggacatcaagtctgtgtcctacagcgcctccatggccgccagcctgcacggcttcagcagcagtgaagatgccctggagtactacaagcccagcaccaccctggatggcaccaacaagctgtgccagttcagccctgtgcaggagctgtctgagcagaccccagagaccagcccagacaaggaggaggccagcatccccaagaagctgcagacagcccggcccagcgacagccagagcaagaggctgcacagcgtgaggaccagcagcagcggcacagcccagaggagcctgctgagccccctgcacaggagcggctctgtggaggacaactaccacaccagcttcctgtttggcctgagcaccagccagcagcacctgaccaagtctgctggcctgggcctgaagggctggcacagcgacatcctggccccccagaccagcacccccagcctgaccagctcctggtactttgccacagagagcagccacttctacagcgccagcgccatctatggaggcagcgccagctacagcgcctacagctgcagccagctgcccacctgtggggaccaggtgtacagcgtgagaagacggcagaagcccagcgacagagctgacagccgccgctcctggcatgaggagagcccctttgagaagcagttcaagagaagaagctgccagatggagtttggagagagcatcatgtctgaaaatagaagccgggaggagctgggcaaggtgggcagccagagcagcttcagcggctccatggagatcatcgaggtgtcctag

SEQ ID NO: 18756 - DNA, 939 bp, Artificial Sequence
  Description of Artificial Sequence: Synthetic coding sequence
atgaggatgctgctggccctgctggccctgtctgctgcccggcccagcgccagcgctgagagccactggtgctatgaggtgcaggccgagagcagcaactacccctgcctggtgcctgtgaagtggggcggcaactgccagaaggaccggcagagccccatcaacatcgtgaccaccaaggccaaggtggacaagaagctgggccgcttcttcttcagcggctatgacaagaagcagacctggacagtgcagaacaacggccacagcgtgatgatgctgctggagaacaaggccagcatcagcggcggcggcctgcctgccccctaccaggccaagcagctgcacctgcactggagcgacctgccctacaagggcagcgagcacagcctggatggagagcactttgccatggagatgcacatcgtgcatgagaaggagaagggcaccagcagaaatgtgaaggaggcccaggaccctgaagatgaaattgctgtgctggccttcctggtggaggccggcacccaggtgaatgaaggcttccagcccctggtggaggccctgagcaacatccccaagccagagatgagcaccaccatggccgagagcagcctgctggacctgctgcccaaggaggagaagctgcggcactacttccgctacctgggcagcctgaccacccccacctgtgatgagaaggtggtgtggacagtgttccgggagcccatccagctgcaccgggagcagatcctggccttcagccagaagctgtactatgacaaggagcagacagtgtccatgaaggacaacgtgcggcccctgcagcagctgggccagaggacagtcatcaagagcggggcccctggccggcccctgccctgggccctgcctgccctgctgggccccatgctggcctgcctgctggccggcttcctgaggtag

SEQ ID NO: 18757 - DNA, 1380 bp, Artificial Sequence
  Description of Artificial Sequence: Synthetic coding sequence
atggcccccctgtgccccagcccctggctgcccctgctgatcccagccccagcccctggcctgactgtgcagctgctgctgagcctgctgctgctggtgcctgtgcacccccagaggctgcccaggatgcaggaggacagccccctgggcggcggcagcagcggggaggatgaccccctgggggaggaggacctgcccagcgaggaggacagcccccgggaggaggaccccccaggagaggaggacctgcccggggaggaggacctgcccggggaggaggacctgcctgaggtgaagcccaagtctgaggaggagggcagcctgaagctggaggacctgcccaccgtggaggcccctggggacccccaggagccccagaacaatgcccaccgggacaaggagggagatgaccagagccactggaggtatggaggagaccccccctggccccgggtgtccccagcctgtgccggccgcttccagagccctgtggacatccggccccagctggccgccttctgcccagccctgcggcccctggagctgctgggcttccagctgccccccctgcctgagctgcggctgaggaacaacggccacagcgtgcagctgaccctgcccccaggcctggagatggccctgggccctggccgggagtaccgggccctgcagctgcacctgcactggggcgccgccggccggcccggcagcgagcacacagtggagggccaccgcttccctgctgagatccacgtggtgcacctgagcacagcctttgcccgggtggatgaggccctgggccggcctgggggcctggccgtgctggccgccttcctggaggagggcccagaagaaaattctgcctatgagcagctgctgagccggctggaggagattgctgaggagggcagcgagacccaggtgcccggcctggacatcagcgccctgctgcccagcgacttcagccgctacttccagtatgagggcagcctgaccaccccaccctgtgcccagggcgtcatctggacagtgttcaaccagacagtgatgctgagcgccaagcagctgcacaccctgagtgacaccctgtggggccctggggacagccggctgcagctgaacttccgggccacccagcccctgaatggccgggtcatcgaggccagcttccctgctggggtggacagcagccccagggctgctgagcctgtgcagctgaacagctgcctggccgccggggacatcctggccctggtgtttggcctgctgtttgctgtgacctctgtggccttcctggtgcagatgaggcggcagcaccggcggggcaccaagggcggcgtgtcctacagacctgctgaggtggccgagactggagcctag

SEQ ID NO: 18758 - DNA, 1071 bp, Artificial Sequence
  Description of Artificial Sequence: Synthetic coding sequence
atggcccccctgtgccccagcccctggctgcccctgctgatcccagccccagcccctggcctgactgtgcagctgctgctgagcctgctgctgctggtgcctgtgcacccccagaggctgcccaggatgcaggaggacagccccctgggcggcggcagcagcggggaggatgaccccctgggggaggaggacctgcccagcgaggaggacagcccccgggaggaggaccccccaggagaggaggacctgcccggggaggaggacctgcccggggaggaggacctgcctgaggtgaagcccaagtctgaggaggagggcagcctgaagctggaggacctgcccaccgtggaggcccctggggacccccaggagccccagaacaatgcccaccgggacaaggagggagatgaccagagccactggaggtatggaggagaccccccctggccccgggtgtccccagcctgtgccggccgcttccagagccctgtggacatccggccccagctggccgccttctgcccagccctgcggcccctggagctgctgggcttccagctgccccccctgcctgagctgcggctgaggaacaacggccacagcgtgcagctgaccctgcccccaggcctggagatggccctgggccctggccgggagtaccgggccctgcagctgcacctgcactggggcgccgccggccggcccggcagcgagcacacagtggagggccaccgcttccctgctgagatccacgtggtgcacctgagcacagcctttgcccgggtggatgaggccctgggccggcctgggggcctggccgtgctggccgccttcctggaggagggcccagaagaaaattctgcctatgagcagctgctgagccggctggaggagattgctgaggagggcagcgagacccaggtgcccggcctggacatcagcgccctgctgcccagcgacttcagccgctacttccagtatgagggcagcctgaccaccccaccctgtgcccagggcgtcatctggacagtgttcaaccagacagtgatgctgagcgccaagcagagctag

SEQ ID NO: 18759 - DNA, 2775 bp, Artificial Sequence
  Description of Artificial Sequence: Synthetic coding sequence
atgcctggccccagccctggcctgcggcgggccctgctgggcctgtgggccgccctgggcctgggcctgtttggcctgtctgctgtgtcccaggagcccttctgggccgacctgcagccccgggtggcctttgtggagcggggcggcagcctgtggctgaactgcagcaccaactgccccaggcctgagcggggcggcctggagaccagcctgcggagaaatggcacccagaggggcctgcgctggctggcccggcagctggtggacatccgggagcctgagacccagcctgtgtgcttcttccgctgtgcccggaggaccctgcaggcccggggcctcatccgcaccttccagaggccagacagagtggagctgatgcccctgcccccctggcagcctgtgggggagaacttcaccctgagctgccgggtgcctggagctggcccccgggccagcctgaccctgaccctgctgcggggggcccaggagctgatccgccgcagctttgctggggagcccccccgggcccggggagctgtgctgacagccaccgtgctggcccggcgggaggaccacggggccaacttcagctgcagagctgagctggacctgcggccccacggcctgggcctgtttgagaacagcagcgccccccgggagctgcggaccttcagcctgagcccagatgccccccggctggccgccccccggctgctggaggtgggcagcgagaggcctgtgtcctgcaccctggatggcctcttccctgccagcgaggcccgggtgtacctggccctgggggaccagaacctgagcccagatgtgaccctggagggagatgcctttgtggccacagccacagccacagccagcgctgagcaggagggcgcccggcagctggtgtgcaatgtgaccctgggcggagaaaatcgggagaccagagaaaatgtgaccatctacagcttccctgcccccctgctgaccctgtctgagcccagcgtgtctgagggccagatggtgacagtgacctgtgccgccggggcccaggccctggtgaccctggagggcgtgcctgctgctgtgcccggccagcctgcccagctgcagctgaatgccacagaaaatgatgaccggcgctccttcttctgtgatgccaccctggatgtggatggagagaccctcatcaagaacagatctgctgagctgcgggtgctgtatgccccccggctggatgacagcgactgccccaggtcctggacctggccagagggccctgagcagaccctgcgctgtgaggcccggggcaaccctgagcccagcgtgcactgtgcccggagtgatggaggagctgtgctggccctgggcctgctgggccctgtgacccgggccctgagcggcacctaccgctgcaaggccgccaatgaccagggcgaggccgtgaaggatgtgaccctgactgtggagtatgccccagccctggacagcgtgggctgcccagagcgcatcacctggctggagggcacagaggccagcctgagctgtgtggcccatggagtgcccccaccagatgtgatctgtgtgcgctctggagagctgggcgccgtcatcgagggcctgctgcgggtggcccgggagcacgccggcacctaccgctgtgaggccaccaacccccggggcagcgctgccaagaatgtggccgtgacagtggagtatggccccaggtttgaggagcccagctgccccagcaactggacctgggtggagggcagcggccgcctcttcagctgtgaggtggatggcaagccccagcccagcgtgaagtgtgtgggcagcggcggggccacagaaggagtgctgctgcccctggcccccccagaccccagcccccgggccccccgcatcccccgggtgctggcccctggcatctacgtgtgcaatgccaccaacagacatggctctgtggccaagacagtggtggtgtctgctgagagccccccagagatggatgagagcacctgccccagccaccagacctggctggagggcgctgaggccagcgccctggcctgtgccgcccggggccggcccagccctggggtgcgctgcagccgggagggcatcccctggccagagcagcagagggtgtcccgggaggatgctggcacctaccactgtgtggccaccaatgcccatggaacagacagcaggacagtgacagtgggcgtggagtacagacctgtggtggccgagctggccgccagccccccaggcggcgtgcggcctgggggcaacttcaccctgacctgcagagctgaggcctggcccccagcccagatctcctggagggcccctcctggggccctgaacatcggcctgagcagcaacaacagcaccctgtctgtggccggggccatgggcagccacggcggggagtatgaatgtgccgccaccaatgcccacggcagacatgcccggcgcatcaccgtgcgggtggccggcccctggctgtgggtggccgtgggcggggccgccggcggggccgccctgctggccgccggggccggcctggccttctacgtgcagagcacagcctgcaagaagggggagtacaacgtgcaggaggccgagagcagcggggaggccgtgtgcctgaatggagctgggggcggggccggcggcgctgctggagctgagggcggccctgaggccgccggcggcgctgctgagagccctgctgagggggaggtgtttgccatccagctgaccagcgcctag

SEQ ID NO: 18760 - DNA, 1263 bp, Artificial Sequence
  Description of Artificial Sequence: Synthetic coding sequence
atggagagccccagcgccccaccccaccgctggtgcatcccctggcagaggctgctgctgacagccagcctgctgaccttctggaacccccccaccacagccaagctgaccatcgagagcacccccttcaacgtggccgagggcaaggaggtgctgctgctggtgcacaacctgccccagcacctgtttggctacagctggtacaagggggagcgggtggatggcaaccggcagatcatcggctacgtgattggcacccagcaggccaccccaggccctgcctacagcggccgggagatcatctacccaaatgccagcctgctgatccagaacatcatccagaacaagctgtctgtggaccacagcgaccccgtcatcctgaatgtgctgtatggcccagatgaccccaccatcagccccagctacacctactacagacctggggtgaacctgagcctgagctgccacgccgccagcaaccccccagcccagtacagctggctgattgatggcaacatccagcagcacacccaggagctgttcatcagcaacatcacagagaagaacagcggcctgtacacctgccaggccaacaacagcgccagcggccacagcaggaccaccgtgaagaccatcaccgtgtctgctgagctgcccaagcccagcatcagcagcaacaacagcaagcctgtggaggacaaggatgctgtggccttcacctgtgagcctgaggcccagaacaccacctacctgtggtgggtgaatggccagagcctgcctgtgagcccccggctgcagctgagcaatggaaacagaaccctgaccctcttcaacgtgaccagaaatgatgcccgggcctacgtgtgtggcatccagaacagcgtgtctgccaacagaagtgaccctgtgaccctggatgtgctgtatggccctgacacccccatcatcagccccccagacagcagctacctgagcggggccaacctgaacctgagctgccacagcgccagcaaccccagcccccagtacagctggaggatcaatggcatcccccagcagcacacccaggtgctcttcatcgccaagatcacccccaacaacaacggcacctacgcctgctttgtgagcaacctggccaccggcaggaacaacagcatcgtgaagagcatcaccgtgtctgccagcggcaccagccctggcctgtctgctggggccaccgtgggcatcatgattggagtgctggtgggcgtggccctgatctag

SEQ ID NO: 18761 - DNA, 2109 bp, Artificial Sequence
  Description of Artificial Sequence: Synthetic coding sequence
atggagagccccagcgccccaccccaccgctggtgcatcccctggcagaggctgctgctgacagccagcctgctgaccttctggaacccccccaccacagccaagctgaccatcgagagcacccccttcaacgtggccgagggcaaggaggtgctgctgctggtgcacaacctgccccagcacctgtttggctacagctggtacaagggggagcgggtggatggcaaccggcagatcatcggctacgtgattggcacccagcaggccaccccaggccctgcctacagcggccgggagatcatctacccaaatgccagcctgctgatccagaacatcatccagaatgacaccggcttctacaccctgcacgtgatcaagagtgacctggtgaatgaggaggccaccggccagttccgggtgtacccagagctgcccaagcccagcatcagcagcaacaacagcaagcctgtggaggacaaggatgctgtggccttcacctgtgagcctgagacccaggatgccacctacctgtggtgggtgaacaaccagagcctgcctgtgagcccccggctgcagctgagcaatggaaacagaaccctgaccctcttcaacgtgaccagaaatgacacagccagctacaagtgtgagacccagaaccctgtgtctgcccggcggagtgacagcgtcatcctgaatgtgctgtatggcccagatgcccccaccatcagccccctgaacaccagctacagaagtggagagaacctgaacctgagctgccacgccgccagcaaccccccagcccagtacagctggtttgtgaatggcaccttccagcagagcacccaggagctgttcatccccaacatcaccgtgaacaacagcggcagctacacctgccaggcccacaacagcgacaccggcctgaacagaaccaccgtgaccaccatcaccgtgtatgcagagccccccaagcccttcatcaccagcaacaacagcaaccctgtggaggatgaagatgctgtggccctgacctgtgagcctgagatccagaacaccacctacctgtggtgggtgaacaaccagagcctgcctgtgagcccccggctgcagctgagcaatgacaacagaaccctgaccctgctgtctgtgaccagaaatgatgtgggcccctatgaatgtggcatccagaacaagctgtctgtggaccacagcgaccccgtcatcctgaatgtgctgtatggcccagatgaccccaccatcagccccagctacacctactacagacctggggtgaacctgagcctgagctgccacgccgccagcaaccccccagcccagtacagctggctgattgatggcaacatccagcagcacacccaggagctgttcatcagcaacatcacagagaagaacagcggcctgtacacctgccaggccaacaacagcgccagcggccacagcaggaccaccgtgaagaccatcaccgtgtctgctgagctgcccaagcccagcatcagcagcaacaacagcaagcctgtggaggacaaggatgctgtggccttcacctgtgagcctgaggcccagaacaccacctacctgtggtgggtgaatggccagagcctgcctgtgagcccccggctgcagctgagcaatggaaacagaaccctgaccctcttcaacgtgaccagaaatgatgcccgggcctacgtgtgtggcatccagaacagcgtgtctgccaacagaagtgaccctgtgaccctggatgtgctgtatggccctgacacccccatcatcagccccccagacagcagctacctgagcggggccaacctgaacctgagctgccacagcgccagcaaccccagcccccagtacagctggaggatcaatggcatcccccagcagcacacccaggtgctcttcatcgccaagatcacccccaacaacaacggcacctacgcctgctttgtgagcaacctggccaccggcaggaacaacagcatcgtgaagagcatcaccgtgtctgccagcggcaccagccctggcctgtctgctggggccaccgtgggcatcatgattggagtgctggtgggcgtggccctgatctag

SEQ ID NO: 18762 - DNA, 1035 bp, Artificial Sequence
  Description of Artificial Sequence: Synthetic coding sequence
atgggccccccatctgccccaccctgccgcctgcacgtgccctggaaggaggtgctgctgacagccagcctgctgaccttctggaacccccccaccacagccaagctgaccatcgagagcacccccttcaacgtggccgagggcaaggaggtgctgctgctggcccacaacctgccccagaacagaattggctacagctggtacaagggggagcgggtggatggcaacagcctgattgtgggctacgtgattggcacccagcaggccaccccaggccctgcctacagcggccgggagaccatctacccaaatgccagcctgctgatccagaatgtgacccagaatgacaccggcttctacaccctgcaggtgatcaagagtgacctggtgaatgaggaggccaccggccagttccacgtgtacccagagctgcccaagcccagcatcagcagcaacaacagcaaccctgtggaggacaaggatgctgtggccttcacctgtgagcctgaggtgcagaacaccacctacctgtggtgggtgaatggccagagcctgcctgtgagcccccggctgcagctgagcaatggaaacatgaccctgaccctgctgtctgtgaagagaaatgatgctggcagctatgaatgtgagatccagaacccagccagcgccaacagaagtgaccctgtgaccctgaatgtgctgtatggcccagatggccccaccatcagccccagcaaggccaactacagacctggagagaacctgaacctgagctgccacgccgccagcaaccccccagcccagtacagctggttcatcaatggcaccttccagcagagcacccaggagctgttcatccccaacatcaccgtgaacaacagcggcagctacatgtgccaggcccacaacagcgccaccggcctgaacagaaccaccgtgaccatgatcaccgtgtctggcagcgcccctgtgctgtctgctgtggccaccgtgggcatcaccatcggcgtgctggcccgggtggccctgatctag

SEQ ID NO: 18763 - DNA, 1977 bp, Artificial Sequence
  Description of Artificial Sequence: Synthetic coding sequence
atggtgccccggctgctgctgcgggcctggccccggggccctgctgtgggccctggggcccccagccggcccctgtctgctggcagcggccctggccagtacctgcagaggagcatcgtgcccaccatgcactaccaggacagcctgccccggctgcccatccccaagctggaggacaccatccgccgctacctgagcgcccagaagcccctgctgaatgatggccagttcaggaagacagagcagttctgcaagagctttgaaaatggaattggcaaggagctgcacgagcagctggtggccctggacaagcagaacaagcacaccagctacatcagcggcccctggtttgacatgtacctgagcgcccgggacagcgtggtgctgaacttcaaccccttcatggccttcaacccagaccccaagtctgagtacaatgaccagctgacccgggccaccaacatgacagtgtctgccatccgcttcctgaagaccctgcgggccggcctgctggagcctgaggtgttccacctgaacccagccaagagtgacaccatcaccttcaagaggctcatccgctttgtgcccagcagcctgtcctggtacggggcctacctggtgaatgcctaccccctggacatgagccagtacttccgcctcttcaacagcacccggctgcccaagcccagcagagatgagctgttcacagatgacaaggcccggcacctgctggtgctgaggaagggcaacttctacatctttgatgtgctggaccaggacggcaacatcgtgagccccagcgagatccaggcccacctgaagtacatcctgagtgacagcagccctgcccctgagttccccctggcctacctgaccagcgagaacagagacatctgggccgagctgcggcagaagctgatgagcagtggaaatgaggagagcctgaggaaggtggacagcgctgtgttctgcctgtgcctggatgacttccccatcaaggacctggtgcacctgagccacaacatgctgcatggagatggcaccaaccgctggtttgacaagagcttcaacctgatcatcgccaaggatggcagcacagctgtgcactttgagcacagctggggagatggagtggccgtgctgcgcttcttcaatgaggtgttcaaggacagcacccagaccccagctgtgaccccccagagccagcctgccaccacagacagcacagtgacagtgcagaagctgaactttgagctgacagatgccctgaagacaggcatcacagctgccaaggagaagtttgatgccaccatgaagaccctgaccatcgactgtgtgcagttccagagaggaggcaaggagttcctgaagaagcagaagctgagcccagatgctgtggcccagctggccttccagatggccttcctgcggcagtatggccagacagtggccacctatgagagctgcagcacagctgccttcaagcacggccgcacagagaccatccggcctgcctctgtgtacaccaagcgctgcagcgaggcctttgtgcgggagcccagccgccacagcgctggggagctgcagcagatgatggtggagtgcagcaagtaccacggccagctgaccaaggaggccgccatgggccagggctttgacagacacctgtttgccctgcggcacctggccgccgccaagggcatcatcctgcctgagctgtacctggaccctgcctacggccagatcaaccacaacgtgctgagcaccagcaccctgagcagccctgctgtgaacctgggcggctttgcccctgtggtgtctgatggcttcggcgtgggctatgctgtgcatgacaactggattggctgcaatgtgtcctcctacccaggaagaaatgcccgggagttcctgcagtgtgtggagaaggccctggaggacatgtttgatgccctggagggcaagagcatcaagagctag

SEQ ID NO: 18764 - DNA, 1077 bp, Artificial Sequence
  Description of Artificial Sequence: Synthetic coding sequence
atgagggccacccccctggccgccccagctggcagcctgagcaggaagaagaggctggagctggatgacaacctggacacagagaggcctgtgcagaagagggcccggagcggcccccagccccggctgcccccctgcctgctgcccctgagccccccaacagccccagaccgggccacagctgtggccacagccagccggctgggcccctacgtgctgctggagcctgaggagggcggccgggcctaccaggccctgcactgccccaccggcacagagtacacctgcaaggtgtaccctgtgcaggaggccctggccgtgctggagccctatgcccggctgcccccccacaagcacgtggcccggcccacagaggtgctggccggcacccagctgctgtatgccttcttcaccaggacccatggagacatgcacagcctggtgcgcagccgccaccgcatccctgagcctgaggccgctgtgctcttccggcagatggccacagccctggcccactgccaccagcacggcctggtgctgcgggacctgaagctgtgccgctttgtgtttgctgaccgggagaggaagaagctggtgctggagaacctggaggacagctgtgtgctgaccggcccagatgacagcctgtgggacaagcacgcctgcccagcctacgtgggccctgagatcctgagcagccgggccagctacagcggcaaggccgcagatgtgtggagcctgggcgtggccctcttcaccatgctggccggccactaccccttccaggacagcgagcctgtgctgctgtttgggaagatccggcggggggcctatgccctgcctgctggcctgagcgccccagcccgctgcctggtgcgctgcctgctgcggcgggagcctgctgagcggctgacagccaccggcatcctgctgcacccctggctgcggcaggaccccatgcccctggcccccaccaggagccacctgtgggaggccgcccaggtggtgcctgatggcctgggcctggatgaggcccgggaggaggagggggaccgggaggtggtgctgtatggatag

SEQ ID NO: 18765 - DNA, 1176 bp, Artificial Sequence
  Description of Artificial Sequence: Synthetic coding sequence
atgagcggccctgtgcccagccgggcccgggtgtacacagatgtgaacacccaccggccccgggagtactgggactatgagagccacgtggtggagtggggcaaccaggatgactaccagctggtgaggaagctgggccggggcaagtacagcgaggtgtttgaggccatcaacatcaccaacaatgagaaggtggtggtgaagatcctgaagcctgtgaagaagaagaagatcaagcgggagatcaagatcctggagaacctgcggggcggccccaacatcatcaccctggccgacatcgtgaaggaccctgtgtccaggaccccagccctggtgtttgaacatgtgaacaacacagacttcaagcagctgtaccagaccctgacagattatgacatccgcttctacatgtatgagatcctgaaggccctggactactgccacagcatgggcatcatgcacagagatgtgaagccccacaacgtgatgattgaccacgagcacaggaagctgcggctgattgactggggcctggccgagttctaccaccctggccaggagtacaacgtgcgggtggccagccgctacttcaagggccctgagctgctggtggactaccagatgtatgactacagcctggacatgtggagcctgggctgcatgctggcctccatgatcttcaggaaggagcccttcttccacggccatgacaactatgaccagctggtgagaattgccaaggtgctgggcacagaggacctgtatgactacatcgacaagtacaacatcgagctggacccccgcttcaatgacatcctgggccgccacagcaggaagcgctgggagagatttgtgcacagcgagaaccagcacctggtgtccccagaggccctggacttcctggacaagctgctgcgctatgaccaccagagccggctgacagcccgggaggccatggagcacccctacttctacacagtggtgaaggaccaggccaggatgggcagcagctccatgcctgggggcagcacccctgtgagcagcgccaacatgatgagcggcatcagctctgtgcccacccccagccccctgggccccctggccggcagccctgtgattgctgctgccaaccccctgggcatgcctgtgcctgctgctgctggggcccagcagtag

SEQ ID NO: 18766 - DNA, 1194 bp, Artificial Sequence
  Description of Artificial Sequence: Synthetic coding sequence
atgagcggccctgtgcccagccgggcccgggtgtacacagatgtgaacacccaccggccccgggagtactgggactatgagagccacgtggtggagtggggcaaccaggatgactaccagctggtgaggaagctgggccggggcaagtacagcgaggtgtttgaggccatcaacatcaccaacaatgagaaggtggtggtgaagatcctgaagcctgtgaagaagaagaagatcaagcgggagatcaagatcctggagaacctgcggggcggccccaacatcatcaccctggccgacatcgtgaaggaccctgtgtccaggaccccagccctggtgtttgaacatgtgaacaacacagacttcaagcagctgtaccagaccctgacagattatgacatccgcttctacatgtatgagatcctgaaggccctggactactgccacagcatgggcatcatgcacagagatgtgaagccccacaacgtgatgattgaccacgagcacaggaagctgcggctgattgactggggcctggccgagttctaccaccctggccaggagtacaacgtgcgggtggccagccgctacttcaagggccctgagctgctggtggactaccagatgtatgactacagcctggacatgtggagcctgggctgcatgctggcctccatgatcttcaggaaggagcccttcttccacggccatgacaactatgaccagctggtgagaattgccaaggtgctgggcacagaggacctgtatgactacatcgacaagtacaacatcgagctggacccccgcttcaatgacatcctgggccgccacagcaggaagcgctgggagagatttgtgcacagcgagaaccagcacctggtgtccccagaggccctggacttcctggacaagctgctgcgctatgaccaccagagccggctgacagcccgggaggccatggagcacccctacttctacacagtggtgaaggaccaggccaggatgggcagcagctccatgcctgggggcagcacccctgtgagcagcgccaacatgatgagcggcatcagctctgtgcccacccccagccccctgggccccctggccggcagccctgtgattgctgctgccaaccccctgggctgcctcttccagctgcccctgcggtctgctgtgacagccctgtctgtgtcctag

SEQ ID NO: 18767 - DNA, 768 bp, Artificial Sequence
  Description of Artificial Sequence: Synthetic coding sequence
atgtatgagatcctgaaggccctggactactgccacagcatgggcatcatgcacagagatgtgaagccccacaacgtgatgattgaccacgagcacaggaagctgcggctgattgactggggcctggccgagttctaccaccctggccaggagtacaacgtgcgggtggccagccgctacttcaagggccctgagctgctggtggactaccagatgtatgactacagcctggacatgtggagcctgggctgcatgctggcctccatgatcttcaggaaggagcccttcttccacggccatgacaactatgaccagctggtgagaattgccaaggtgctgggcacagaggacctgtatgactacatcgacaagtacaacatcgagctggacccccgcttcaatgacatcctgggccgccacagcaggaagcgctgggagagatttgtgcacagcgagaaccagcacctggtgtccccagaggccctggacttcctggacaagctgctgcgctatgaccaccagagccggctgacagcccgggaggccatggagcacccctacttctacacagtggtgaaggaccaggccaggatgggcagcagctccatgcctgggggcagcacccctgtgagcagcgccaacatgatgagcggcatcagctctgtgcccacccccagccccctgggccccctggccggcagccctgtgattgctgctgccaaccccctgggcatgcctgtgcctgctgctgctggggcccagcagtag

SEQ ID NO: 18768 - DNA, 1158 bp, Artificial Sequence
  Description of Artificial Sequence: Synthetic coding sequence
atgagcggccctgtgcccagccgggcccgggtgtacacagatgtgaacacccaccggccccgggagtactgggactatgagagccacgtggtggagtggggcaaccaggatgactaccagctggtgaggaagctgggccggggcaagtacagcgaggtgtttgaggccatcaacatcaccaacaatgagaaggtggtggtgaagatcctgaagcctgtgaagaagaagaagatcaagcgggagatcaagatcctggagaacctgcggggcggccccaacatcatcaccctggccgacatcgtgaaggaccctgtgtccaggaccccagccctggtgtttgaacatgtgaacaacacagacttcaagcagctgtaccagaccctgacagattatgacatccgcttctacatgtatgagatcctgaaggccctggactactgccacagcatgggcatcatgcacagagatgtgaagccccacaacgtgatgattgaccacgagcacaggaagctgcggctgattgactggggcctggccgagttctaccaccctggccaggagtacaacgtgcgggtggccagccgctacttcaagggccctgagctgctggtggactaccagatgtatgactacagcctggacatgtggagcctgggctgcatgctggcctccatgatcttcaggaaggagcccttcttccacggccatgacaactatgaccagctggtgagaattgccaaggtgctgggcacagaggacctgtatgactacatcgacaagtacaacatcgagctggacccccgcttcaatgacatcctgggccgccacagcaggaagcgctgggagagatttgtgcacagcgagaaccagcacctggtgtccccagaggccctggacttcctggacaagctgctgcgctatgaccaccagagccggctgacagcccgggaggccatggagcacccctacttctacacagtggtgaaggaccaggccaggatgggcagcagctccatgcctgggggcagcacccctgtgagcagcgccaacatgatgtctgagatgaagttctgccgggtggcccaggccggcctggagctgctgagcagcacagtgtacccaccctggccacccaaggtgctgcggctggaggcctag

SEQ ID NO: 18769 - DNA, 1053 bp, Artificial Sequence
  Description of Artificial Sequence: Synthetic coding sequence
atgcctggccctgctgctggcagccgggcccgggtgtatgcagaggtgaacagcctgcggagccgggagtactgggactatgaggcccacgtgcccagctggggcaaccaggatgactaccagctggtgaggaagctgggccggggcaagtacagcgaggtgtttgaggccatcaacatcaccaacaatgaaagagtggtggtgaagatcctgaagcctgtgaagaagaagaagatcaagcgggaggtgaagatcctggagaacctgcggggcggcaccaacatcatcaagctgattgacacagtgaaggaccctgtgtccaagaccccagccctggtgtttgagtacatcaacaacacagacttcaagcagctgtaccagatcctgacagactttgacatccgcttctacatgtatgagctgctgaaggccctggactactgccacagcaagggcatcatgcacagagatgtgaagccccacaacgtgatgattgaccaccagcagaagaagctgcggctgattgactggggcctggccgagttctaccacccagcccaggagtacaacgtgcgggtggccagccgctacttcaagggccctgagctgctggtggactaccagatgtatgactacagcctggacatgtggagcctgggctgcatgctggcctccatgatcttcagaagagagcccttcttccacggccaggacaactatgaccagctggtgcgcatcgccaaggtgctgggcacagaggagctgtatggctacctgaagaagtaccacatcgacctggacccccacttcaatgacatcctgggccagcacagcaggaagcgctgggagaacttcatccacagtgaaaatagacacctggtgtccccagaggccctggacctgctggacaagctgctgcgctatgaccaccagcagaggctgacagccaaggaggccatggagcacccctacttctaccctgtggtgaaggagcagagccagccctgtgccgacaatgctgtgctgagcagcggcctgacagctgccaggtag

SEQ ID NO: 18770 - DNA, 600 bp, Artificial Sequence
  Description of Artificial Sequence: Synthetic coding sequence
atggaggcccgggacaagcaggtgctgcggagcctgcggctggagctgggcgctgaggtgctggtggagggcctggtgctgcagtacctgtaccaggagggcatcctgacagagaaccacatccaggagatcaatgcccagaccaccggcctgaggaagaccatgctgctgctggacatcctgcccagccggggccccaaggcctttgacaccttcctggacagcctgcaggagttcccctgggtgcgggagaagctgaagaaggcccgggaggaggccatgacagacctgcctgctggggaccggctgaccggcatccccagccacatcctgaacagcagccccagcgaccggcagatcaaccagctggcccagaggctgggccctgagtgggagcccatggtgctgagcctgggcctgagccagacagacatctaccgctgcaaggccaaccacccccacaacgtgcagagccaggtggtggaggccttcatccgctggaggcagagatttgggaagcaggccaccttccagagcctgcacaacggcctgcgggctgtggaggtggaccccagcctgctgctgcacatgctggagtag

SEQ ID NO: 18771 - DNA, 366 bp, Artificial Sequence
  Description of Artificial Sequence: Synthetic coding sequence
atggaggcccgggacaagcaggtgctgcggagcctgcggctggagctgggcgctgaggtgctggtggagggcctggtgctgcagtacctgtaccaggagggcatcctgacagagaaccacatccaggagatcaatgcccagaccaccggcctgaggaagaccatgctgctgctggacatcctgcccagccggggccccaaggcctttgacaccttcctggacagcctgcaggagttcccctgggtgcgggagaagctgaagaaggcccgggaggaggccatgacagacctgcctgctgagatgaggaagctgcggcccaaggacagcgtgacctgcctggccagccagctgacctggaggttctag

SEQ ID NO: 18772 - DNA, 600 bp, Artificial Sequence; identical to SEQ ID NO: 18770
  Description of Artificial Sequence: Synthetic coding sequence

SEQ ID NO: 18773 - DNA, 312 bp, Artificial Sequence
  Description of Artificial Sequence: Synthetic coding sequence
atggaggcccgggacaagcaggtgctgcggagcctgcggctggagctgggcgctgaggtgctggtggagggcctggtgctgcagtacctgtaccaggagggcatcctgacagagaaccacatccaggagatcaatgcccagaccaccggcctgaggaagaccatgctgctgctggacatcctgcccagccggggccccaaggcctttgacaccttcctggacagcctgcaggagttcccctgggtgcgggagaagctgaagaaggcccgggaggaggccatgacagacctgcctgctggctgctggccctag

SEQ ID NO: 18774 - DNA, 1443 bp, Artificial Sequence
  Description of Artificial Sequence: Synthetic coding sequence
atgtctgctgaggtgatccaccaggtggaggaggccctggacacagatgagaaggagatgctgctcttcctgtgcagagatgtggccattgatgtggtgccccccaacgtgcgggacctgctggacatcctgcgggagcggggcaagctgtctgtgggggacctggccgagctgctgtacagagtgagaagatttgacctgctgaagaggatcctgaagatggacaggaaggctgtggagacccacctgctgaggaacccccacctggtgtctgactacagagtgctgatggccgagatcggggaggacctggacaagagtgatgtgagcagcctcatcttcctgatgaaggactacatgggccggggcaagatcagcaaggagaagagcttcctggacctggtggtggagctggagaagctgaacctggtggccccagaccagctggacctgctggagaagtgcctgaagaacatccacagaattgacctgaagaccaagatccagaagtacaagcagagcgtgcagggcgccggcaccagctacagaaatgtgctgcaggccgccatccagaagagcctgaaggaccccagcaacaacttccggctgcacaacggccgcagcaaggagcagaggctgaaggagcagctgggcgcccagcaggagcctgtgaagaagagcatccaggagagcgaggccttcctgccccagagcatccctgaggagcgctacaagatgaagagcaagcccctgggcatctgcctgatcatcgactgcattggaaatgaaacagagctgctgcgggacaccttcaccagcctgggctatgaggtgcagaagttcctgcacctgtccatgcacggcatcagccagatcctgggccagtttgcctgcatgcctgagcaccgggactatgacagctttgtgtgtgtgctggtgtcccggggcggcagccagagcgtgtatggagtggaccagacccacagcggcctgcccctgcaccacatccggaggatgttcatgggagacagctgcccctacctggccggcaagcccaagatgttcttcatccagaactacgtggtgtctgagggccagctggaggacagcagcctgctggaggtggatggccctgccatgaagaatgtggagttcaaggcccagaagaggggcctgtgcaccgtgcaccgggaggccgacttcttctggagcctgtgcacagctgacatgagcctgctggagcagagccacagcagccccagcctgtacctgcagtgcctgagccagaagctgcggcaggagaggaagaggcccctgctggacctgcacatcgagctgaatggctacatgtatgactggaacagccgggtgtctgccaaggagaagtactacgtgtggctgcagcacaccctgaggaagaagctgatcctgagctacacctag

SEQ ID NO: 18775 - DNA, 1389 bp, Artificial Sequence
  Description of Artificial Sequence: Synthetic coding sequence
atgtctgctgaggtgatccaccaggtggaggaggccctggacacagatgagaaggagatgctgctcttcctgtgcagagatgtggccattgatgtggtgccccccaacgtgcgggacctgctggacatcctgcgggagcggggcaagctgtctgtgggggacctggccgagctgctgtacagagtgagaagatttgacctgctgaagaggatcctgaagatggacaggaaggctgtggagacccacctgctgaggaacccccacctggtgtctgactacagagtgctgatggccgagatcggggaggacctggacaagagtgatgtgagcagcctcatcttcctgatgaaggactacatgggccggggcaagatcagcaaggagaagagcttcctggacctggtggtggagctggagaagctgaacctggtggccccagaccagctggacctgctggagaagtgcctgaagaacatccacagaattgacctgaagaccaagatccagaagtacaagcagagcgtgcagggcgccggcaccagctacagaaatgtgctgcaggccgccatccagaagagcctgaaggaccccagcaacaacttccggctgcacaacggccgcagcaaggagcagaggctgaaggagcagctgggcgcccagcaggagcctgtgaagaagagcatccaggagagcgaggccttcctgccccagagcatccctgaggagcgctacaagatgaagagcaagcccctgggcatctgcctgatcatcgactgcattggaaatgaaacagagctgctgcgggacaccttcaccagcctgggctatgaggtgcagaagttcctgcacctgtccatgcacggcatcagccagatcctgggccagtttgcctgcatgcctgagcaccgggactatgacagctttgtgtgtgtgctggtgtcccggggcggcagccagagcgtgtatggagtggaccagacccacagcggcctgcccctgcaccacatccggaggatgttcatgggagacagctgcccctacctggccggcaagcccaagatgttcttcatccagaactacgtggtgtctgagggccagctggaggacagcagcctgctggaggtggatggccctgccatgaagaatgtggagttcaaggcccagaagaggggcctgtgcaccgtgcaccgggaggccgacttcttctggagcctgtgcacagctgacatgagcctgctggagcagagccacagcagccccagcctgtacctgcagtgcctgagccagaagctgcggcaggagcggggcaccatccctggcagcggcatcacagagagcaaggacatgcacttcagcagcctgggctgcatcctgctggatgtgctgtag

SEQ ID NO: 18776 - DNA, 1047 bp, Artificial Sequence
  Description of Artificial Sequence: Synthetic coding sequence
atggccgagatcggggaggacctggacaagagtgatgtgagcagcctcatcttcctgatgaaggactacatgggccggggcaagatcagcaaggagaagagcttcctggacctggtggtggagctggagaagctgaacctggtggccccagaccagctggacctgctggagaagtgcctgaagaacatccacagaattgacctgaagaccaagatccagaagtacaagcagagcgtgcagggcgccggcaccagctacagaaatgtgctgcaggccgccatccagaagagcctgaaggaccccagcaacaacttccgggaggagcctgtgaagaagagcatccaggagagcgaggccttcctgccccagagcatccctgaggagcgctacaagatgaagagcaagcccctgggcatctgcctgatcatcgactgcattggaaatgaaacagagctgctgcgggacaccttcaccagcctgggctatgaggtgcagaagttcctgcacctgtccatgcacggcatcagccagatcctgggccagtttgcctgcatgcctgagcaccgggactatgacagctttgtgtgtgtgctggtgtcccggggcggcagccagagcgtgtatggagtggaccagacccacagcggcctgcccctgcaccacatccggaggatgttcatgggagacagctgcccctacctggccggcaagcccaagatgttcttcatccagaactacgtggtgtctgagggccagctggaggacagcagcctgctggaggtggatggccctgccatgaagaatgtggagttcaaggcccagaagaggggcctgtgcaccgtgcaccgggaggccgacttcttctggagcctgtgcacagctgacatgagcctgctggagcagagccacagcagccccagcctgtacctgcagtgcctgagccagaagctgcggcaggagcggggcaccatccctggcagcggcatcacagagagcaaggacatgcacttcagcagcctgggctgcatcctgctggatgtgctgtag

SEQ ID NO: 18777 - DNA, 903 bp, Artificial Sequence
  Description of Artificial Sequence: Synthetic coding sequence
atgtctgctgaggtgatccaccaggtggaggaggccctggacacagatgagaaggagatgctgctcttcctgtgcagagatgtggccattgatgtggtgccccccaacgtgcgggacctgctggacatcctgcgggagcggggcaagctgtctgtgggggacctggccgagctgctgtacagagtgagaagatttgacctgctgaagaggatcctgaagatggacaggaaggctgtggagacccacctgctgaggaacccccacctggtgtctgactacagagtgctgatggccgagatcggggaggacctggacaagagtgatgtgagcagcctcatcttcctgatgaaggactacatgggccggggcaagatcagcaaggagaagagcttcctggacctggtggtggagctggagaagctgaacctggtggccccagaccagctggacctgctggagaagtgcctgaagaacatccacagaattgacctgaagaccaagatccagaagtacaagcagagcgtgcagggcgccggcaccagctacagaaatgtgctgcaggccgccatccagaagagcctgaaggaccccagcaacaacttccggctgcacaacggccgcagcaaggagcagaggctgaaggagcagctgggcgcccagcaggagcctgtgaagaagagcatccaggagagcgaggccttcctgccccagagcatccctgaggagcgctacaagatgaagagcaagcccctgggcatctgcctgatcatcgactgcattggaaatgaaacagaaaatgcccacagctggatcttcaccctgaacagcatggccacctgcatgattggaacagctgagttcctgcccaggaggaacatcatgagcggctgcagcaccctgtag

SEQ ID NO: 18778 - DNA, 753 bp, Artificial Sequence
  Description of Artificial Sequence: Synthetic coding sequence
atgtctgctgaggtgatccaccaggtggaggaggccctggacacagatgagaaggagatgctgctcttcctgtgcagagatgtggccattgatgtggtgccccccaacgtgcgggacctgctggacatcctgcgggagcggggcaagctgtctgtgggggacctggccgagctgctgtacagagtgagaagatttgacctgctgaagaggatcctgaagatggacaggaaggctgtggagacccacctgctgaggaacccccacctggtgtctgactacagagtgctgatggccgagatcggggaggacctggacaagagtgatgtgagcagcctcatcttcctgatgaaggactacatgggccggggcaagatcagcaaggagaagagcttcctggacctggtggtggagctggagaagctgaacctggtggccccagaccagctggacctgctggagaagtgcctgaagaacatccacagaattgacctgaagaccaagatccagaagtacaagcagagcggcggctggaatggcacctggatgaccaaggccagcttcagcctgtggctggagatcgccagcctgtacatcctgcacatcccagacctgcccacccccctgccctgcatcttcatgatcagcgccaagtgctgccaggccgtgctgaacatcagcgtcttcaagaaggagagcggcatctgcaccggctggcagagctatggccacagcggcgtgctgcacgtgtgctag

SEQ ID NO: 18779 - DNA, 357 bp, Artificial Sequence
  Description of Artificial Sequence: Synthetic coding sequence
atgtctgctgaggtgatccaccaggtggaggaggccctggacacagatgagaaggagatgctgctcttcctgtgcagagatgtggccattgatgtggtgccccccaacgtgcgggacctgctggacatcctgcgggagcggggcaagctgtctgtgggggacctggccgagctgctgtacagagtgagaagatttgacctgctgaagaggatcctgaagatggacaggaaggctgtggagacccacctgctgaggaacccccacctggtgtctgactacagagtgctgatggccgagatcggggaggacctggacaagagtgatgtgagcagcctcatcttcctgatgaaggactag

SEQ ID NO: 18780 - DNA, 1443 bp, Artificial Sequence; identical to SEQ ID NO: 18774
  Description of Artificial Sequence: Synthetic coding sequence

SEQ ID NO: 18781 - DNA, 189 bp, Artificial Sequence
  Description of Artificial Sequence: Synthetic coding sequence
atgtctgctgaggtgatccaccaggtggaggaggccctggacacagatgagaaggagatgctgctcttcctgtgcagagatgtggccattgatgtggtgccccccaacgtgcgggacctgctggacatcctgcgggagcggggcaagctgtctgtgggggacctggccgagctgctgtacagagtgtag

SEQ ID NO: 18782 - DNA, 195 bp, Artificial Sequence
  Description of Artificial Sequence: Synthetic coding sequence
atgtctgctgaggtgatccaccaggtggaggaggccctggacacagatgagaaggagatgctgctcttcctgtgcagagatgtggccattgatgtggtgccccccaacgtgcgggacctgctggacatcctgcgggagcggggcaagctgtctgtgggggacctggccgagctgctgtacagagtgagaagatag

SEQ ID NO: 18783 - DNA, 390 bp, Artificial Sequence
  Description of Artificial Sequence: Synthetic coding sequence
atgtctgctgaggtgatccaccaggtggaggaggccctggacacagatgagaaggagatgctgctcttcctgtgcagagatgtggccattgatgtggtgccccccaacgtgcgggacctgctggacatcctgcgggagcggggcaagctgtctgtgggggacctggccgagctgctgtacagagtgagaagatttgacctgctgaagaggatcctgaagatggacaggaaggctgtggagacccacctgctgaggaacccccacctggtgtctgactacagagtgctgatggccgagatcggggaggacctggacaagagtgatgtgagcagcctcatcttcctgatgaaggactacatgggccggggcaagatcagcaaggagaagtag

SEQ ID NO: 18784 - DNA, 1155 bp, Artificial Sequence
  Description of Artificial Sequence: Synthetic coding sequence
atggccgagatcggggaggacctggacaagagtgatgtgagcagcctcatcttcctgatgaaggactacatgggccggggcaagatcagcaaggagaagagcttcctggacctggtggtggagctggagaagctgaacctggtggccccagaccagctggacctgctggagaagtgcctgaagaacatccacagaattgacctgaagaccaagatccagaagtacaagcagagcgtgcagggcgccggcaccagctacagaaatgtgctgcaggccgccatccagaagagcctgaaggaccccagcaacaacttccggctgcacaacggccgcagcaaggagcagaggctgaaggagcagctgggcgcccagcaggagcctgtgaagaagagcatccaggagagcgaggccttcctgccccagagcatccctgaggagcgctacaagatgaagagcaagcccctgggcatctgcctgatcatcgactgcattggaaatgaaacagagctgctgcgggacaccttcaccagcctgggctatgaggtgcagaagttcctgcacctgtccatgcacggcatcagccagatcctgggccagtttgcctgcatgcctgagcaccgggactatgacagctttgtgtgtgtgctggtgtcccggggcggcagccagagcgtgtatggagtggaccagacccacagcggcctgcccctgcaccacatccggaggatgttcatgggagacagctgcccctacctggccggcaagcccaagatgttcttcatccagaactacgtggtgtctgagggccagctggaggacagcagcctgctggaggtggatggccctgccatgaagaatgtggagttcaaggcccagaagaggggcctgtgcaccgtgcaccgggaggccgacttcttctggagcctgtgcacagctgacatgagcctgctggagcagagccacagcagccccagcctgtacctgcagtgcctgagccagaagctgcggcaggagaggaagaggcccctgctggacctgcacatcgagctgaatggctacatgtatgactggaacagccgggtgtctgccaaggagaagtactacgtgtggctgcagcacaccctgaggaagaagctgatcctgagctacacctag

SEQ ID NO: 18785 - DNA, 666 bp, Artificial Sequence
  Description of Artificial Sequence: Synthetic coding sequence
atgtctgctgaggtgatccaccaggtggaggaggccctggacacagatgagaaggagatgctgctcttcctgtgcagagatgtggccattgatgtggtgccccccaacgtgcgggacctgctggacatcctgcgggagcggggcaagctgtctgtgggggacctggccgagctgctgtacagagtgagaagatttgacctgctgaagaggatcctgaagatggacaggaaggctgtggagacccacctgctgaggaacccccacctggtgtctgactacagagtgctgatggccgagatcggggaggacctggacaagagtgatgtgagcagcctcatcttcctgatgaaggactacatgggccggggcaagatcagcaaggagaagagcttcctggacctggtggtggagctggagaagctgaacctggtggccccagaccagctggacctgctggagaagtgcctgaagaacatccacagaattgacctgaagaccaagatccagaagtacaagcagagcgtgcagggcgccggcaccagctacagaaatgtgctgcaggccgccatccagaagagcctgaaggaccccagcaacaacttcaggatgatcaccccctatgcccactgcccagacctgaagatcctgggcaactgcagcatgtag

SEQ ID NO: 18786 - DNA, 1338 bp, Artificial Sequence
  Description of Artificial Sequence: Synthetic coding sequence
atgtctgctgaggtgatccaccaggtggaggaggccctggacacagatgagaaggagatgctgctcttcctgtgcagagatgtggccattgatgtggtgccccccaacgtgcgggacctgctggacatcctgcgggagcggggcaagctgtctgtgggggacctggccgagctgctgtacagagtgagaagatttgacctgctgaagaggatcctgaagatggacaggaaggctgtggagacccacctgctgaggaacccccacctggtgtctgactacagagtgctgatggccgagatcggggaggacctggacaagagtgatgtgagcagcctcatcttcctgatgaaggactacatgggccggggcaagatcagcaaggagaagagcttcctggacctggtggtggagctggagaagctgaacctggtggccccagaccagctggacctgctggagaagtgcctgaagaacatccacagaattgacctgaagaccaagatccagaagtacaagcagagcgtgcagggcgccggcaccagctacagaaatgtgctgcaggccgccatccagaagagcctgaaggaccccagcaacaacttccgcagcatccctgaggagcgctacaagatgaagagcaagcccctgggcatctgcctgatcatcgactgcattggaaatgaaacagagctgctgcgggacaccttcaccagcctgggctatgaggtgcagaagttcctgcacctgtccatgcacggcatcagccagatcctgggccagtttgcctgcatgcctgagcaccgggactatgacagctttgtgtgtgtgctggtgtccagaggaggcagccagagcgtgtatggagtggaccagacccacagcggcctgcccctgcaccacatccggaggatgttcatgggagacagctgcccctacctggccggcaagcccaagatgttcttcatccagaactacgtggtgtctgagggccagctggaggacagcagcctgctggaggtggatggccctgccatgaagaatgtggagttcaaggcccagaagaggggcctgtgcaccgtgcaccgggaggccgacttcttctggagcctgtgcacagctgacatgagcctgctggagcagagccacagcagccccagcctgtacctgcagtgcctgagccagaagctgcggcaggagaggaagaggcccctgctggacctgcacatcgagctgaatggctacatgtatgactggaacagccgggtgtctgccaaggagaagtactacgtgtggctgcagcacaccctgaggaagaagctgatcctgagctacacctag

SEQ ID NO: 18787 - DNA, 1152 bp, Artificial Sequence
  Description of Artificial Sequence: Synthetic coding sequence
atggctgacaaggtgctgaaggagaagaggaagctgttcatccgctccatgggagagggcaccatcaatggcctgctggatgagctgctgcagaccagggtgctgaacaaggaggagatggagaaggtgaagcgggagaatgccaccgtgatggacaagacccgggccctgattgacagcgtcatccccaagggggcccaggcctgccagatctgcatcacctacatctgtgaagaagattcctacctggccggcaccctgggcctgtctgctgccccccaggccgtgcaggacaacccagccatgcccaccagcagcggcagcgagggcaatgtgaagctgtgcagcctggaggaggcccagaggatctggaagcagaagtctgctgagatctaccccatcatggacaagagcagcaggacccggctggccctgatcatctgcaatgaggagtttgacagcatccccaggagaactggagctgaggtggacatcaccggcatgaccatgctgctgcagaacctgggctacagcgtggatgtgaagaagaacctgacagccagtgacatgaccacagagctggaggcctttgcccacaggcctgagcacaagaccagtgacagcaccttcctggtgttcatgagccacggcatccgggagggcatctgtgggaagaagcacagcgagcaggtgcctgacatcctgcagctgaatgccatcttcaacatgctgaacaccaagaactgccccagcctgaaggacaagcccaaggtgatcatcatccaggcctgccgcggggacagccctggggtggtgtggttcaaggacagcgtgggcgtgtctggcaacctgagcctgcccaccacagaggagtttgaagatgatgccatcaagaaggcccacatcgagaaggacttcatcgccttctgcagcagcaccccagacaacgtgtcctggaggcaccccaccatgggcagcgtcttcatcggccgcctgattgagcacatgcaggagtatgcctgcagctgtgatgtggaggagatcttcaggaaggtgcgcttctcctttgagcagccagatggccgggcccagatgcccaccacagagcgggtgaccctgacccgctgcttctacctgtttcctggccactag

SEQ ID NO: 18788 - DNA, 792 bp, Artificial Sequence
  Description of Artificial Sequence: Synthetic coding sequence
atggctgacaaggtgctgaaggagaagaggaagctgttcatccgctccatgggagaggccccccaggccgtgcaggacaacccagccatgcccaccagcagcggcagcgagggcaatgtgaagctgtgcagcctggaggaggcccagaggatctggaagcagaagtctgctgagatctaccccatcatggacaagagcagcaggacccggctggccctgatcatctgcaatgaggagtttgacagcatccccaggagaactggagctgaggtggacatcaccggcatgaccatgctgctgcagaacctgggctacagcgtggatgtgaagaagaacctgacagccagtgacatgaccacagagctggaggcctttgcccacaggcctgagcacaagaccagtgacagcaccttcctggtgttcatgagccacggcatccgggagggcatctgtgggaagaagcacagcgagcaggtgcctgacatcctgcagctgaatgccatcttcaacatgctgaacaccaagaactgccccagcctgaaggacaagcccaaggtgatcatcatccaggcctgccgcggggacaacgtgtcctggaggcaccccaccatgggcagcgtcttcatcggccgcctgattgagcacatgcaggagtatgcctgcagctgtgatgtggaggagatcttcaggaaggtgcgcttctcctttgagcagccagatggccgggcccagatgcccaccacagagcgggtgaccctgacccgctgcttctacctgtttcctggccactag

SEQ ID NO: 18789 - DNA, 267 bp, Artificial Sequence
  Description of Artificial Sequence: Synthetic coding sequence
atggctgacaaggtgctgaaggagaagaggaagctgttcatccgctccatgggagaagataatgtgtcctggaggcaccccaccatgggctctgtgttcatcggccgcctcatcgagcacatgcaggagtatgcctgcagctgtgatgtggaggagatcttcaggaaggtgcgcttctcctttgagcagccagatggccgggcccagatgcccaccacagagcgggtgaccctgacccgctgcttctacctgtttcctggccactag

SEQ ID NO: 18790 - DNA, 1152 bp, Artificial Sequence; identical to SEQ ID NO: 18787
  Description of Artificial Sequence: Synthetic coding sequence

SEQ ID NO: 18791 - DNA, 267 bp, Artificial Sequence; identical to SEQ ID NO: 18789
  Description of Artificial Sequence: Synthetic coding sequence

SEQ ID NO: 18792 - DNA, 1215 bp, Artificial Sequence
  Description of Artificial Sequence: Synthetic coding sequence
atggctgacaaggtgctgaaggagaagaggaagctgttcatccgctccatgggagagggcaccatcaatggcctgctggatgagctgctgcagaccagggtgctgaacaaggaggagatggagaaggtgaagcgggagaatgccaccgtgatggacaagacccgggccctgattgacagcgtcatccccaagggggcccaggcctgccagatctgcatcacctacatctgtgaagaagattcctacctggccggcaccctgggcctgtctgctgaccagaccagcggcaactacctgaacatgcaggacagccagggcgtgctgagcagcttccctgccccccaggccgtgcaggacaacccagccatgcccaccagcagcggcagcgagggcaatgtgaagctgtgcagcctggaggaggcccagaggatctggaagcagaagtctgctgagatctaccccatcatggacaagagcagcaggacccggctggccctgatcatctgcaatgaggagtttgacagcatccccaggagaactggagctgaggtggacatcaccggcatgaccatgctgctgcagaacctgggctacagcgtggatgtgaagaagaacctgacagccagtgacatgaccacagagctggaggcctttgcccacaggcctgagcacaagaccagtgacagcaccttcctggtgttcatgagccacggcatccgggagggcatctgtgggaagaagcacagcgagcaggtgcctgacatcctgcagctgaatgccatcttcaacatgctgaacaccaagaactgccccagcctgaaggacaagcccaaggtgatcatcatccaggcctgccgcggggacagccctggggtggtgtggttcaaggacagcgtgggcgtgtctggcaacctgagcctgcccaccacagaggagtttgaagatgatgccatcaagaaggcccacatcgagaaggacttcatcgccttctgcagcagcaccccagacaacgtgtcctggaggcaccccaccatgggctctgtgttcatcggccgcctcatcgagcacatgcaggagtatgcctgcagctgtgatgtggaggagatcttcaggaaggtgcgcttctcctttgagcagccagatggccgggcccagatgcccaccacagagcgggtgaccctgacccgctgcttctacctgtttcctggccactag

SEQ ID NO: 18793 - DNA, 792 bp, Artificial Sequence; identical to SEQ ID NO: 18788
  Description of Artificial Sequence: Synthetic coding sequence

SEQ ID NO: 18794 - DNA, 1152 bp, Artificial Sequence; identical to SEQ ID NO: 18787
  Description of Artificial Sequence: Synthetic coding sequence

SEQ ID NO: 18795 - DNA, 936 bp, Artificial Sequence
  Description of Artificial Sequence: Synthetic coding sequence
atggctgacaaggtgctgaaggagaagaggaagctgttcatccgctccatgggagaggccccccaggccgtgcaggacaacccagccatgcccaccagcagcggcagcgagggcaatgtgaagctgtgcagcctggaggaggcccagaggatctggaagcagaagtctgctgagatctaccccatcatggacaagagcagcaggacccggctggccctgatcatctgcaatgaggagtttgacagcatccccaggagaactggagctgaggtggacatcaccggcatgaccatgctgctgcagaacctgggctacagcgtggatgtgaagaagaacctgacagccagtgacatgaccacagagctggaggcctttgcccacaggcctgagcacaagaccagtgacagcaccttcctggtgttcatgagccacggcatccgggagggcatctgtgggaagaagcacagcgagcaggtgcctgacatcctgcagctgaatgccatcttcaacatgctgaacaccaagaactgccccagcctgaaggacaagcccaaggtgatcatcatccaggcctgccgcggggacagccctggggtggtgtggttcaaggacagcgtgggcgtgtctggcaacctgagcctgcccaccacagaggagtttgaagatgatgccatcaagaaggcccacatcgagaaggacttcatcgccttctgcagcagcaccccagacaacgtgtcctggaggcaccccaccatgggcagcgtcttcatcggccgcctgattgagcacatgcaggagtatgcctgcagctgtgatgtggaggagatcttcaggaaggtgcgcttctcctttgagcagccagatggccgggcccagatgcccaccacagagcgggtgaccctgacccgctgcttctacctgtttcctggccactag

SEQ ID NO: 18796 - DNA, 906 bp, Artificial Sequence
  Description of Artificial Sequence: Synthetic coding sequence
atggagaaggtgaagagagaaaatgccaccgtgatggacaagacccgggccctgattgattctgtcatccccaagggggcccaggcctgccagatctgcatcacctacatctgtgaggaggacagctacctggccggcaccctgggcctgtctgctgaccagaccagcggcaactacctgaacatgcaggacagccagggcgtgctgagcagcttccctgccccccaggccgtgcaggacaacccagccatgcccaccagcagcggcagcgagggcaatgtgaagctgtgcagcctggaggaggcccagaggatctggaagcagaagtctgctgagatctaccccatcatggacaagagcagcaggacccggctggccctgatcatctgcaatgaggagtttgacagcatccccaggagaactggagctgaggtggacatcaccggcatgaccatgctgctgcagaacctgggctacagcgtggatgtgaagaagaacctgacagccagtgacatgaccacagagctggaggcctttgcccacaggcctgagcacaagaccagtgacagcaccttcctggtgttcatgagccacggcatccgggagggcatctgtgggaagaagcacagcgagcaggtgcctgacatcctgcagctgaatgccatcttcaacatgctgaacaccaagaactgccccagcctgaaggacaagcccaaggtgatcatcatccaggcctgccgcggggacagccctggggtggtgtggttcaaggacagcgtgggcgtgtctggcaacctgagcctgcccaccacagaggagtttgaagatgatgccatcaagaaggcccacatcgagaaggacttcatcgccttctgcagcagcacccctgggaagagccagagctag

SEQ ID NO: 18797 - DNA, 333 bp, Artificial Sequence
  Description of Artificial Sequence: Synthetic coding sequence
atggctgacaaggtgctgaaggagaagaggaagctgttcatccgctccatgggagagggcaccatcaatggcctgctggatgagctgctgcagaccagggtgctgaacaaggaggagatggagaaggtgaagcgggagaatgccaccgtgatggacaagacccgggccctgattgacagcgtcatccccaagggggcccaggcctgccagatctgcatcacctacatctgtgaagaagattcctacctggccggcaccctgggcctgtctgctgacctgagcaacaacggccaggtgaagccccacaccagctgcagccactacctgcagtag

SEQ ID NO: 18798 - DNA, 267 bp, Artificial Sequence; identical to SEQ ID NO: 18789
  Description of Artificial Sequence: Synthetic coding sequence

SEQ ID NO: 18799 - DNA, 1215 bp, Artificial Sequence; identical to SEQ ID NO: 18792
  Description of Artificial Sequence: Synthetic coding sequence

SEQ ID NO: 18800 - DNA, 792 bp, Artificial Sequence; identical to SEQ ID NO: 18788
  Description of Artificial Sequence: Synthetic coding sequence

SEQ ID NO: 18801 - DNA, 1368 bp, Artificial Sequence
  Description of Artificial Sequence: Synthetic coding sequence
atgaagagccagggccagcactggtacagcagcagtgacaagaactgcaaggtgtccttccgggagaagctgctgatcatcgacagcaacctgggcgtgcaggatgtggagaacctgaagttcctgtgcatcggcctggtgcccaacaagaagctggagaagagcagcagcgccagtgatgtgtttgagcacctgctggccgaggacctgctgtctgaggaggaccccttcttcctggccgagctgctgtacatcatccggcagaagaagctgctgcagcacctgaactgcaccaaggaggaggtggagcggctgctgcccacccggcagagggtgtccctcttcaggaacctgctgtatgagctgtctgagggcatcgacagcgagaacctgaaggacatgatcttcctgctgaaggacagcctgcccaagacagagatgaccagcctgtccttcctggccttcctggagaagcagggcaagattgatgaggacaacctgacctgcctggaggacctgtgcaagacagtggtgcccaagctgctgagaaatattgagaagtacaagcgggagaaggccatccagatcgtgaccccacctgtggacaaggaggccgagagctaccagggcgaggaggagctggtgtcccagacagatgtgaagaccttcctggaggccctgccccaggagagctggcagaacaagcatgctggcagcaatgagatcctgagccacgtgttccagtggctgggcttcaccgtgcacatccacaacaacgtgaccaaggtggagatggagatggtgctgcagaagcagaagtgcaacccagcccatgctgatggagactgctttgtgttctgcatcctgacccacggccgctttggagctgtgtacagcagtgatgaggccctgatccccatccgggagatcatgagccacttcaccgccctgcagtgcccccggctggccgagaagcccaagctgttcttcatccaggcctgccagggcgaggagatccagcccagcgtgtccattgaagcagatgccctgaaccctgagcaggcccccaccagcctgcaggacagcatcccagctgaggccgacttcctgctgggcctggccaccgtgcccggctacgtgtccttccgccacgtggaggagggctcctggtacatccagagcctgtgcaaccacctgaagaagctggtgcccaggcatgaggacatcctgagcatcctgacagctgtgaatgatgatgtgtcccggcgggtggacaagcagggcaccaagaagcagatgccccagcctgccttcaccctgaggaagaagctggtgtttcctgtgcccctggatgccctgagcctgtag

SEQ ID NO: 18802 - DNA, 1437 bp, Artificial Sequence
  Description of Artificial Sequence: Synthetic coding sequence
atgaagagccagggccagcactggtacagcagcagtgacaagaactgcaaggtgtccttccgggagaagctgctgatcatcgacagcaacctgggcgtgcaggatgtggagaacctgaagttcctgtgcatcggcctggtgcccaacaagaagctggagaagagcagcagcgccagtgatgtgtttgagcacctgctggccgaggacctgctgtctgaggaggaccccttcttcctggccgagctgctgtacatcatccggcagaagaagctgctgcagcacctgaactgcaccaaggaggaggtggagcggctgctgcccacccggcagagggtgtccctcttcaggaacctgctgtatgagctgtctgagggcatcgacagcgagaacctgaaggacatgatcttcctgctgaaggacagcctgcccaagacagagatgaccagcctgtccttcctggccttcctggagaagcagggcaagattgatgaggacaacctgacctgcctggaggacctgtgcaagacagtggtgcccaagctgctgagaaatattgagaagtacaagcgggagaaggccatccagatcgtgaccccacctgtggacaaggaggccgagagctaccagggcgaggaggagctggtgtcccagacagatgtgaagaccttcctggaggccctgcccagggctgctgtgtacaggatgaacagaaaccaccggggcctgtgtgtgattgtgaacaaccacagcttcaccagcctgaaggaccggcagggcacccacaaggatgctgagatcctgagccacgtgttccagtggctgggcttcaccgtgcacatccacaacaacgtgaccaaggtggagatggagatggtgctgcagaagcagaagtgcaacccagcccatgctgatggagactgctttgtgttctgcatcctgacccacggccgctttggagctgtgtacagcagtgatgaggccctgatccccatccgggagatcatgagccacttcaccgccctgcagtgcccccggctggccgagaagcccaagctgttcttcatccaggcctgccagggcgaggagatccagcccagcgtgtccattgaagcagatgccctgaaccctgagcaggcccccaccagcctgcaggacagcatcccagctgaggccgacttcctgctgggcctggccaccgtgcccggctacgtgtccttccgccacgtggaggagggctcctggtacatccagagcctgtgcaaccacctgaagaagctggtgcccaggatgctgaagttcctggagaagaccatggagatccggggcaggaagaggacagtgtggggcgccaagcagatcagcgccaccagcctgcccacagccatcagcgcccagacccccaggcctcccatgaggcgctggagctctgtgtcctag

SEQ ID NO: 18803 - DNA, 1566 bp, Artificial Sequence
  Description of Artificial Sequence: Synthetic coding sequence
atgaagagccagggccagcactggtacagcagcagtgacaagaactgcaaggtgtccttccgggagaagctgctgatcatcgacagcaacctgggcgtgcaggatgtggagaacctgaagttcctgtgcatcggcctggtgcccaacaagaagctggagaagagcagcagcgccagtgatgtgtttgagcacctgctggccgaggacctgctgtctgaggaggaccccttcttcctggccgagctgctgtacatcatccggcagaagaagctgctgcagcacctgaactgcaccaaggaggaggtggagcggctgctgcccacccggcagagggtgtccctcttcaggaacctgctgtatgagctgtctgagggcatcgacagcgagaacctgaaggacatgatcttcctgctgaaggacagcctgcccaagacagagatgaccagcctgtccttcctggccttcctggagaagcagggcaagattgatgaggacaacctgacctgcctggaggacctgtgcaagacagtggtgcccaagctgctgagaaatattgagaagtacaagcgggagaaggccatccagatcgtgaccccacctgtggacaaggaggccgagagctaccagggcgaggaggagctggtgtcccagacagatgtgaagaccttcctggaggccctgccccaggagagctggcagaacaagcatgctggcagcaatggaaacagagccaccaacggggcccccagcctggtgtcccggggcatgcagggcgccagcgccaacaccctgaacagcgagaccagcaccaagagagctgctgtgtacaggatgaacagaaaccaccggggcctgtgtgtgattgtgaacaaccacagcttcaccagcctgaaggaccggcagggcacccacaaggatgctgagatcctgagccacgtgttccagtggctgggcttcaccgtgcacatccacaacaacgtgaccaaggtggagatggagatggtgctgcagaagcagaagtgcaacccagcccacgcagatggagactgctttgtgttctgcatcctgacccacggccgctttggagctgtgtacagcagtgatgaggccctgatccccatccgggagatcatgagccacttcaccgccctgcagtgcccccggctggccgagaagcccaagctgttcttcatccaggcctgccagggcgaggagatccagcccagcgtgtccattgaagcagatgccctgaaccctgagcaggcccccaccagcctgcaggacagcatcccagctgaggccgacttcctgctgggcctggccaccgtgcccggctacgtgtccttcagacatgtggaggagggctcctggtacatccagagcctgtgcaaccacctgaagaagctggtgcccaggatgctgaagttcctggagaagaccatggagatccggggcaggaagaggacagtgtggggcgccaagcagatcagcgccaccagcctgcccacagccatcagcgcccagaccccccggccccccatgaggcgctggagctctgtgtcctag

SEQ ID NO: 18804 - DNA, 1569 bp, Artificial Sequence
  Description of Artificial Sequence: Synthetic coding sequence
atgaagagccagggccagcactggtacagcagcagtgacaagaactgcaaggtgtccttccgggagaagctgctgatcatcgacagcaacctgggcgtgcaggatgtggagaacctgaagttcctgtgcatcggcctggtgcccaacaagaagctggagaagagcagcagcgccagtgatgtgtttgagcacctgctggccgaggacctgctgtctgaggaggaccccttcttcctggccgagctgctgtacatcatccggcagaagaagctgctgcagcacctgaactgcaccaaggaggaggtggagcggctgctgcccacccggcagagggtgtccctcttcaggaacctgctgtatgagctgtctgagggcatcgacagcgagaacctgaaggacatgatcttcctgctgaaggacagcctgcccaagacagagatgaccagcctgtccttcctggccttcctggagaagcagggcaagattgatgaggacaacctgacctgcctggaggacctgtgcaagacagtggtgcccaagctgctgagaaatattgagaagtacaagcgggagaaggccatccagatcgtgaccccacctgtggacaaggaggccgagagctaccagggcgaggaggagctggtgtcccagacagatgtgaagaccttcctggaggccctgccccaggagagctggcagaacaagcatgctggcagcaatggaaacagagccaccaacggggcccccagcctggtgtcccggggcatgcagggcgccagcgccaacaccctgaacagcgagaccagcaccaagagagctgctgtgtacaggatgaacagaaaccaccggggcctgtgtgtgattgtgaacaaccacagcttcaccagcctgaaggaccggcagggcacccacaaggatgctgagatcctgagccacgtgttccagtggctgggcttcaccgtgcacatccacaacaacgtgaccaaggtggagatggagatggtgctgcagaagcagaagtgcaacccagcccacgcagatggagactgctttgtgttctgcatcctgacccacggccgctttggagctgtgtacagcagtgatgaggccctgatccccatccgggagatcatgagccacttcaccgccctgcagtgcccccggctggccgagaagcccaagctgttcttcatccaggcctgccagggcgaggagatccagcccagcgtgtccattgaagcagatgccctgaaccctgagcaggcccccaccagcctgcaggacagcatcccagctgaggccgacttcctgctgggcctggccaccgtgcccggctacgtgtccttcagacatgtggaggagggctcctggtacatccagagcctgtgcaaccacctgaagaagctggtgcccaggcatgaggacatcctgagcatcctgacagctgtgaatgatgatgtgtccagaagagtggacaagcagggcaccaagaagcagatgccccagcctgccttcaccctgaggaagaagctggtgtttcctgtgcccctggatgccctgagcctgtag

SEQ ID NO: 18805 - DNA, 1440 bp, Artificial Sequence
  Description of Artificial Sequence: Synthetic coding sequence
atgaagagccagggccagcactggtacagcagcagtgacaagaactgcaaggtgtccttccgggagaagctgctgatcatcgacagcaacctgggcgtgcaggatgtggagaacctgaagttcctgtgcatcggcctggtgcccaacaagaagctggagaagagcagcagcgccagtgatgtgtttgagcacctgctggccgaggacctgctgtctgaggaggaccccttcttcctggccgagctgctgtacatcatccggcagaagaagctgctgcagcacctgaactgcaccaaggaggaggtggagcggctgctgcccacccggcagagggtgtccctcttcaggaacctgctgtatgagctgtctgagggcatcgacagcgagaacctgaaggacatgatcttcctgctgaaggacagcctgcccaagacagagatgaccagcctgtccttcctggccttcctggagaagcagggcaagattgatgaggacaacctgacctgcctggaggacctgtgcaagacagtggtgcccaagctgctgagaaatattgagaagtacaagcgggagaaggccatccagatcgtgaccccacctgtggacaaggaggccgagagctaccagggcgaggaggagctggtgtcccagacagatgtgaagaccttcctggaggccctgcccagggctgctgtgtacaggatgaacagaaaccaccggggcctgtgtgtgattgtgaacaaccacagcttcaccagcctgaaggaccggcagggcacccacaaggatgctgagatcctgagccacgtgttccagtggctgggcttcaccgtgcacatccacaacaacgtgaccaaggtggagatggagatggtgctgcagaagcagaagtgcaacccagcccatgctgatggagactgctttgtgttctgcatcctgacccacggccgctttggagctgtgtacagcagtgatgaggccctgatccccatccgggagatcatgagccacttcaccgccctgcagtgcccccggctggccgagaagcccaagctgttcttcatccaggcctgccagggcgaggagatccagcccagcgtgtccattgaagcagatgccctgaaccctgagcaggcccccaccagcctgcaggacagcatcccagctgaggccgacttcctgctgggcctggccaccgtgcccggctacgtgtccttccgccacgtggaggagggctcctggtacatccagagcctgtgcaaccacctgaagaagctggtgcccaggcatgaggacatcctgagcatcctgacagctgtgaatgatgatgtgtcccggcgggtggacaagcagggcaccaagaagcagatgccccagcctgccttcaccctgaggaagaagctggtgtttcctgtgcccctggatgccctgagcctgtag

SEQ ID NO: 18806 - DNA, 822 bp, Artificial Sequence
  Description of Artificial Sequence: Synthetic coding sequence
atgaagagccagggccagcactggtacagcagcagtgacaagaactgcaaggtgtccttccgggagaagctgctgatcatcgacagcaacctgggcgtgcaggatgtggagaacctgaagttcctgtgcatcggcctggtgcccaacaagaagctggagaagagcagcagcgccagtgatgtgtttgagcacctgctggccgaggacctgctgtctgaggaggaccccttcttcctggccgagctgctgtacatcatccggcagaagaagctgctgcagcacctgaactgcaccaaggaggaggtggagcggctgctgcccacccggcagagggtgtccctcttcaggaacctgctgtatgagctgtctgagggcatcgacagcgagaacctgaaggacatgatcttcctgctgaaggacagcctgcccaagacagagatgaccagcctgtccttcctggccttcctggagaagcagggcaagattgatgaggacaacctgacctgcctggaggacctgtgcaagacagtggtgcccaagctgctgagaaatattgagaagtacaagcgggagaaggccatccagatcgtgaccccacctgtggacaaggaggccgagagctaccagggcgaggaggagctggtgtcccagacagatgtgaagaccttcctggaggccctgccccaggagagctggcagaacaagcatgctggcagcaatgaaggcagctgtgtgcaggatgaaagtgagccccagaggcccctgtgccactgccagcagccccagctgtacctgcctgagggccagaccaggaacccctag

SEQ ID NO: 18807 - DNA, 1533 bp, Artificial Sequence
  Description of Artificial Sequence: Synthetic coding sequence
atggctgctgctgccctgcgggaccctgcccaggtgcctgtggccgctgacctgctgacagaccacgaggagggctacgtgacctttgaagatgtggccgtgtacttcagccaggaggagtggaggctgctggatgatgcccagaggctgctgtacagaaatgtgatgctggagaacttcaccctgctggccagcctgggcctggccagcagcaagacccatgagatcacccagctggagagctgggaggagcccttcatgcctgcctgggaggtggtgaccagcgccatcccccggggctgctggcatggagctgaggccgaggaggcccctgagcagatcgcctctgtgggcctgctgagcagcaacatccagcagcaccagaagcagcactgtggggagaagcccctgaagaggcaggagggccgggtgcctgtgctgcggagctgcaaggtgcacctgtctgagaagagcctgcagagccgggaggtgggcaaggccctgctgatcagcagcggcgtgctgaagcaccaggtgacccacactggagagaagagccacaggagcagcaagagccgggaggccttccacgccggcaagaggcactacaagtgcagtgaatgtgggaaggccttcggccagaagtacctgctggtgcagcaccagaggctgcacgccggcaagaagacctatgagtgcagtgaatgtgggaagctgttccgggacatgagcaacctcttcatccaccagatcgtgcacactggagagcggccctacggctgcagcaactgtgggaagagcttcagcagaaatgcccacctgattgagcaccagagggtgcacactggagagaagcccttcacctgcagtgaatgtgggaaggccttccgccacaacagcaccctggtgcagcaccacaagatccacactggagtgcggccctatgagtgcagtgaatgtgggaagctgttctccttcaacagcagcctgatgaagcaccagaggatccacactggagagcggccctacaagtgcagtgaatgtgggaagttctacagccacaagagcaacctgatcaagcactggagggtgcacactggagagcggccctacaagtgcagcgactgtgggaagttcttcacccagtgcagcagcctgatgcagcaccagaaggtgcacactggagagaagcccttcaagtgcaatgaatgtggccgcttcttccgggagaacagcaccctggtgcgccaccagagggtgcacactggagccaagccctatgagtgcagagaatgtgggaagttcttcagccagagcagcaccctgatgcagcacaggaaggtgcacatcggggagaagcccttcaagtgcaatgaatgtggccgcctcttccgggagaacagcagcctggtgaagcaccagagggtgcacactggagccaagccctatgagtgcagagaatgtgggaagttcttccgccacaacagcagcctcttcaagcaccggcgcatccacactggagagatgcagtag

SEQ ID NO: 18808 - DNA, 729 bp, Artificial Sequence
  Description of Artificial Sequence: Synthetic coding sequence
atgagcaaccccaggagcctggaggaggagaagtatgacatgtctggggcccggctggccctgatcctgtgtgtgaccaaggcccgggagggcagcgaggaggacctggatgccctggagcacatgttccggcagctgcgctttgagagcaccatgaagagggaccccacagctgagcagttccaggaggagctggagaagttccagcaggccatcgacagccgggaggaccctgtgtcctgtgcctttgtggtgctgatggcccacggccgggagggcttcctgaagggggaggatggagagatggtgaagctggagaacctgtttgaggccctgaacaacaagaactgccaggccctgcgggccaagcccaaggtgtacatcatccaggcctgccgcggggagcagagggaccctggagagaccgtgggcggagatgagatcgtgatggtgatcaaggacagcccccagaccatccccacctacacagatgccctgcacgtgtacagcacagtggagggctacatcgcctacagacatgaccagaagggcagctgcttcatccagaccctggtggatgtgttcaccaagaggaagggccacatcctggagctgctgacagaggtgaccaggaggatggccgaggccgagctggtgcaggagggcaaggccaggaagaccaaccctgagatccagagcaccctgaggaagaggctgtacctgcagtag

SEQ ID NO: 18809 - DNA, 1359 bp, Artificial Sequence
  Description of Artificial Sequence: Synthetic coding sequence
atggccgcccccagcgctggctcctggagcaccttccagcacaaggagctgatggctgctgaccggggccgccgcatcctgggcgtgtgtggcatgcacccccaccaccaggagaccctgaagaagaacagagtggtgctggccaagcagctgctgctgtctgagctgctggagcacctgctggagaaggacatcatcaccctggagatgagggagctgatccaggccaaggtgggcagcttcagccagaatgtggagctgctgaacctgctgcccaagaggggcccccaggcctttgatgccttctgtgaggccctgcgggagaccaagcagggccacctggaggacatgctgctgaccaccctgagcggcctgcagcacgtgctgccccccctgagctgtgactatgacctgagcctgcccttccctgtgtgtgagagctgccccctgtacaagaagctgcggctgagcacagacacagtggagcacagcctggacaacaaggatggccctgtgtgcctgcaggtgaagccctgcaccccagagttctaccagacccacttccagctggcctaccgcctgcagagccggccccggggcctggccctggtgctgagcaatgtgcacttcaccggggagaaggagctggagttccgctctggaggagatgtggaccacagcaccctggtgaccctcttcaagctgctgggctatgatgtgcacgtgctgtgtgaccagacagcccaggagatgcaggagaagctgcagaactttgcccagctgcctgcccaccgggtgacagacagctgcatcgtggccctgctgagccatggagtggagggcgccatctacggcgtggatggcaagctgctgcagctgcaggaggtgttccagctgtttgacaatgccaactgccccagcctgcagaacaagcccaagatgttcttcatccaggcctgcagaggagatgaaacagaccggggcgtggaccagcaggacggcaagaaccacgccggcagccctggctgtgaggagagtgatgctgggaaggagaagctgcccaagatgaggctgcccaccaggagtgacatgatctgtggctacgcctgcctgaagggcacagctgccatgaggaacaccaagaggggctcctggtacatcgaggccctggcccaggtgttttctgagcgggcctgtgacatgcacgtggccgacatgctggtgaaggtgaatgccctgatcaaggaccgggagggctacgcccctggaacagagttccaccgctgcaaggagatgtctgagtactgcagcaccctgtgccgccacctgtacctgtttcctggccacccccccacctag

SEQ ID NO: 18810 - DNA, 327 bp, Artificial Sequence
  Description of Artificial Sequence: Synthetic coding sequence
atggccgcccccagcgctggctcctggagcaccttccagcacaaggagctgatggctgctgaccggggccgccgcatcctgggcgtgtgtggcatgcacccccaccaccaggagaccctgaagaagaacagagtggtgctggccaagcagctgctgctgtctgagctgctggagcacctgctggagaaggacatcatcaccctggagatgagggagctgatccaggccaaggtgggcagcttcagccagaatgtggagctgctgaacctgctgcccaagaggggcccccaggcctttgatgccttctgtgaggccctgcacagctag

SEQ ID NO: 18811 - DNA, 942 bp, Artificial Sequence
  Description of Artificial Sequence: Synthetic coding sequence
atgcacccccaccaccaggagaccctgaagaagaacagagtggtgctggccaagcagctgctgctgtctgagctgctggagcacctgctggagaaggacatcatcaccctggagatgagggagctgatccaggccaaggtgggcagcttcagccagaatgtggagctgctgaacctgctgcccaagaggggcccccaggcctttgatgccttctgtgaggccctgcgggagaccaagcagggccacctggaggacatgctgctgaccaccctgagcggcctgcagcacgtgctgccccccctgagctgtgactatgacctgagcctgcccttccctgtgtgtgagagctgccccctgtacaagaagctgcggctgagcacagacacagtggagcacagcctggacaacaaggatggccctgtgtgcctgcaggtgaagccctgcaccccagagttctaccagacccacttccagctggcctaccgcctgcagagccggccccggggcctggccctggtgctgagcaatgtgcacttcaccggggagaaggagctggagttccgctctggaggagatgtggaccacagcaccctggtgaccctcttcaagctgctgggctatgatgtgcacgtgctgtgtgaccagacagcccaggagatgcaggagaagctgcagaactttgcccagctgcctgcccaccgggtgacagacagctgcatcgtggccctgctgagccacggcgtggagggcgccatctatggagtggatggcaagctgctgcagctgcaggaggtgttccagctgtttgacaatgccaactgccccagcctgcagaacaagcccaagatgttcttcatccaggcctgccgcggggccggggccatcggcagcctgggccacctgctgctcttcaccgctgccacagccagcctggccctgtag

SEQ ID NO: 18812 - DNA, 993 bp, Artificial Sequence
  Description of Artificial Sequence: Synthetic coding sequence
atgctgaagctgaagaccaagtttggctcctggcagaccctgtgcaagaggagcaatgtgtggcaggacaagtgcttcttcaagcccttcaacatcgaccagatcagccccaacaagaaggcccaccccaacatggaggccggccccccagagagcggggagagcacagatgccctgaagctgtgcccccatgaggagttcctgcggctgtgcaaggagagagctgaggagatctaccccatcaaggagaggaacaacagaacccggctggccctgatcatctgcaacacagaatttgaccacctgcccccaagaaatggagctgactttgacatcaccggcatgaaggagctgctggagggcctggactacagcgtggatgtggaggagaacctgacagcccgggacatggagagcgccctgcgggcctttgccaccaggcctgagcacaagagcagtgacagcaccttcctggtgctgatgagccacggcatcctggagggcatctgtggcaccgtgcatgatgagaagaagccagatgtgctgctgtatgacaccatcttccagatcttcaacaacagaaactgcctgagcctgaaggacaagcccaaggtgatcatcgtgcaggcctgccgcggggccaacagaggagagctgtgggtgcgggacagccctgccagcctggaggtggccagcagccagagcagcgagaacctggaggaggatgctgtgtacaagacccacgtggagaaggacttcatcgccttctgcagcagcaccccccacaacgtgtcctggagggacagcaccatgggcagcatcttcatcacccagctgatcacctgcttccagaagtacagctggtgctgccacctggaggaggtgttcaggaaggtgcagcagagctttgagaccccccgggccaaggcccagatgcccaccatcgagcggctgtccatgacccgctacttctacctgtttcctggcaactag

SEQ ID NO: 18813 - DNA, 444 bp, Artificial Sequence
  Description of Artificial Sequence: Synthetic coding sequence
atggccgagggcaaccacaggaagaagcccctgaaggtgctggagagcctgggcaaggacttcctgactggagtgctggacaacctggtggagcagaatgtgctgaactggaaggaggaggagaagaagaagtactatgatgccaagacagaggacaaggtgcgggtgatggctgacagcatgcaggagaagcagaggatggccggccagatgctgctgcagaccttcttcaacatcgaccagatcagccccaacaagaaggcccaccccaacatggaggccggccccccagagagcggggagagcacagatgccctgaagctgtgcccccatgaggagttcctgcggctgtgcaaggagcgggcagaggagatctaccccatcaaggagaggaacaacagaacccggctggccctgatcatctgcaacacagaatttgattag

SEQ ID NO: 18814 - DNA, 1134 bp, Artificial Sequence
  Description of Artificial Sequence: Synthetic coding sequence
atggccgagggcaaccacaggaagaagcccctgaaggtgctggagagcctgggcaaggacttcctgactggagtgctggacaacctggtggagcagaatgtgctgaactggaaggaggaggagaagaagaagtactatgatgccaagacagaggacaaggtgcgggtgatggctgacagcatgcaggagaagcagaggatggccggccagatgctgctgcagaccttcttcaacatcgaccagatcagccccaacaagaaggcccaccccaacatggaggccggccccccagagagcggggagagcacagatgccctgaagctgtgcccccatgaggagttcctgcggctgtgcaaggagcgggcagaggagatctaccccatcaaggagaggaacaacagaacccggctggccctgatcatctgcaacacagaatttgaccacctgcccccaagaaatggagctgactttgacatcaccggcatgaaggagctgctggagggcctggactacagcgtggatgtggaggagaacctgacagcccgggacatggagagcgccctgcgggcctttgccaccaggcctgagcacaagagcagtgacagcaccttcctggtgctgatgagccacggcatcctggagggcatctgtggcaccgtgcatgatgagaagaagccagatgtgctgctgtatgacaccatcttccagatcttcaacaacagaaactgcctgagcctgaaggacaagcccaaggtgatcatcgtgcaggcctgccgcggggccaacagaggagagctgtgggtgcgggacagccctgccagcctggaggtggccagcagccagagcagcgagaacctggaggaggatgctgtgtacaagacccacgtggagaaggacttcatcgccttctgcagcagcaccccccacaacgtgtcctggagggacagcaccatgggcagcatcttcatcacccagctgatcacctgcttccagaagtacagctggtgctgccacctggaggaggtgttcaggaaggtgcagcagagctttgagaccccccgggccaaggcccagatgcccaccatcgagcggctgtccatgacccgctacttctacctgtttcctggcaactag

SEQ ID NO: 18815 - DNA, 1305 bp, Artificial Sequence
  Description of Artificial Sequence: Synthetic coding sequence
atggctgaagattctgggaagaagaagaggaggaagaactttgaggccatgttcaagggcatcctgcagagcggcctggacaactttgtgatcaaccacatgctgaagaacaacgtggccggccagaccagcatccagaccctggtgcccaacacagaccagaagagcacctctgtgaagaaggacaaccacaagaagaagacagtgaagatgctggagtacctgggcaaggatgtgctgcatggagtcttcaactacctggccaagcatgatgtgctgaccctgaaggaggaggagaagaagaagtactatgacaccaagattgaggacaaggccctgatcctggtggacagcctgaggaagaacagagtggcccaccagatgttcacccagaccctgctgaacatggaccagaagatcacctctgtgaagcccctgctgcagattgaagctggccccccagagagcgctgagagcaccaacatcctgaagctgtgcccccgggaggagttcctgcggctgtgcaagaagaaccatgatgagatctaccccatcaagaagagagaagatagaagaaggctggccctgatcatctgcaacaccaagtttgaccacctgcctgccagaaatggagcccactatgacatcgtgggcatgaagaggctgctgcagggcctgggctacacagtggtggatgagaagaacctgacagcccgggacatggagagcgtgctgcgggcctttgctgcccggcctgagcacaagagcagtgacagcaccttcctggtgctgatgagccacggcatcctggagggcatctgtggcacagcccacaagaagaagaagccagatgtgctgctgtatgacaccatcttccagatcttcaacaacagaaactgcctgagcctgaaggacaagcccaaggtgatcatcgtgcaggcctgccgcggggagaagcacggggagctgtgggtgcgggacagccctgccagcctggccctgatcagcagccagagcagcgagaacctggaggccgacagcgtgtgcaagatccacgaggagaaggacttcatcgccttctgcagcagcaccccccacaacgtgtcctggagggacaggacccggggcagcatcttcatcacagagctgatcacctgcttccagaagtacagctgctgctgccacctgatggagatcttcaggaaggtgcagaagagctttgaggtgccccaggccaaggcccagatgcccaccatcgagcgggccaccctgacccgggacttctacctgtttcctggcaactag

SEQ ID NO: 18816 - DNA, 402 bp, Artificial Sequence
  Description of Artificial Sequence: Synthetic coding sequence
atgctgaagaacaacgtggccggccagaccagcatccagaccctggtgcccaacacagaccagaagagcacctctgtgaagaaggacaaccacaagaagaagacagtgaagatgctggagtacctgggcaaggatgtgctgcacggcgtcttcaactacctggccaagcatgatgtgctgaccctgaaggaggaggagaagaagaagtactatgacaccaagattgaggacaaggccctgatcctggtggacagcctgaggaagaacagagtggcccaccagatgttcacccagaccctgctgaacatggaccagaagatcacctctgtgaagcacctgagcaacaagaaggagcggggcccccagaccccaggcagccaccacatgcagtacaaggtgtag

SEQ ID NO: 18817 - DNA, 1344 bp, Artificial Sequence
  Description of Artificial Sequence: Synthetic coding sequence
atggctgctgtgccccgggtggagggcgtcttcatcttcctgattgaggacagcggcaagaagaagaggaggaagaactttgaggccatgttcaagggcatcctgcagagcggcctggacaacttcgtcatcaaccacatgctgaagaacaacgtggccggccagaccagcatccagaccctggtgcccaacacagaccagaagagcacctctgtgaagaaggacaaccacaagaagaagacagtgaagatgctggagtacctgggcaaggatgtgctgcacggcgtcttcaactacctggccaagcatgatgtgctgaccctgaaggaggaggagaagaagaagtactatgacaccaagattgaggacaaggccctgatcctggtggacagcctgaggaagaacagagtggcccaccagatgttcacccagaccctgctgaacatggaccagaagatcacctctgtgaagcccctgctgcagatcgaggccggccccccagagagcgctgagagcaccaacatcctgaagctgtgcccccgggaggagttcctgcggctgtgcaagaagaaccatgatgagatctaccccatcaagaagcgggaggacagaagaaggctggccctgatcatctgcaacaccaagtttgaccacctgcctgccagaaatggagcccactatgacatcgtgggcatgaagaggctgctgcagggcctgggctacacagtggtggatgagaagaacctgacagcccgggacatggagagcgtgctgcgggcctttgctgcccggcctgagcacaagagcagtgacagcaccttcctggtgctgatgagccacggcatcctggagggcatctgtggcacagcccacaagaagaagaagccagatgtgctgctgtatgacaccatcttccagatcttcaacaacagaaactgcctgagcctgaaggacaagcccaaggtgatcatcgtgcaggcctgccgcggggagaagcatggagagctgtgggtgcgggacagccctgccagcctggccctgatcagcagccagagcagcgagaacctggaggccgacagcgtgtgcaagatccacgaggagaaggacttcatcgccttctgcagcagcaccccccacaacgtgtcctggagggacaggacccggggcagcatcttcatcacagagctgatcacctgcttccagaagtacagctgctgctgccacctgatggagatcttcaggaaggtgcagaagagctttgaggtgccccaggccaaggcccagatgcccaccatcgagcgggccaccctgacccgggacttctacctgtttcctggcaactag

SEQ ID NO: 18818 - DNA, 879 bp, Artificial Sequence
  Description of Artificial Sequence: Synthetic coding sequence
atggccgccctgctgcagattgaagctggccccccagagagcgctgagagcaccaacatcctgaagctgtgcccccgggaggagttcctgcggctgtgcaagaagaaccatgatgagatctaccccatcaagaagagagaagatagaagaaggctggccctgatcatctgcaacaccaagtttgaccacctgcctgccagaaatggagcccactatgacatcgtgggcatgaagaggctgctgcagggcctgggctacacagtggtggatgagaagaacctgacagcccgggacatggagagcgtgctgcgggcctttgctgcccggcctgagcacaagagcagtgacagcaccttcctggtgctgatgagccacggcatcctggagggcatctgtggcacagcccacaagaagaagaagccagatgtgctgctgtatgacaccatcttccagatcttcaacaacagaaactgcctgagcctgaaggacaagcccaaggtgatcatcgtgcaggcctgccgcggggagaagcacggggagctgtgggtgcgggacagccctgccagcctggccctgatcagcagccagagcagcgagaacctggaggccgacagcgtgtgcaagatccacgaggagaaggacttcatcgccttctgcagcagcaccccccacaacgtgtcctggagggacaggacccggggcagcatcttcatcacagagctgatcacctgcttccagaagtacagctgctgctgccacctgatggagatcttcaggaaggtgcagaagagctttgaggtgccccaggccaaggcccagatgcccaccatcgagcgggccaccctgacccgggacttctacctgtttcctggcaactag

SEQ ID NO: 18819 - DNA, 1131 bp, Artificial Sequence
  Description of Artificial Sequence: Synthetic coding sequence
atggccgaggacaaccacaagaagaagacagtgaagatgctggagtacctgggcaaggatgtgctgcatggagtcttcaactacctggccaagcatgatgtgctgaccctgaaggaggaggagaagaagaagtactatgacaccaagattgaggacaaggccctgatcctggtggacagcctgaggaagaacagagtggcccaccagatgttcacccagaccctgctgaacatggaccagaagatcacctctgtgaagcccctgctgcagattgaagctggccccccagagagcgctgagagcaccaacatcctgaagctgtgcccccgggaggagttcctgcggctgtgcaagaagaaccatgatgagatctaccccatcaagaagagagaagatagaagaaggctggccctgatcatctgcaacaccaagtttgaccacctgcctgccagaaatggagcccactatgacatcgtgggcatgaagaggctgctgcagggcctgggctacacagtggtggatgagaagaacctgacagcccgggacatggagagcgtgctgcgggcctttgctgcccggcctgagcacaagagcagtgacagcaccttcctggtgctgatgagccacggcatcctggagggcatctgtggcacagcccacaagaagaagaagccagatgtgctgctgtatgacaccatcttccagatcttcaacaacagaaactgcctgagcctgaaggacaagcccaaggtgatcatcgtgcaggcctgccgcggggagaagcacggggagctgtgggtgcgggacagccctgccagcctggccctgatcagcagccagagcagcgagaacctggaggccgacagcgtgtgcaagatccacgaggagaaggacttcatcgccttctgcagcagcaccccccacaacgtgtcctggagggacaggacccggggcagcatcttcatcacagagctgatcacctgcttccagaagtacagctgctgctgccacctgatggagatcttcaggaaggtgcagaagagctttgaggtgccccaggccaaggcccagatgcccaccatcgagcgggccaccctgacccgggacttctacctgtttcctggcaactag

SEQ ID NO: 18820 - DNA, 1344 bp, Artificial Sequence; identical to SEQ ID NO: 18817
  Description of Artificial Sequence: Synthetic coding sequence

SEQ ID NO: 18821 - DNA, 879 bp, Artificial Sequence; identical to SEQ ID NO: 18818
  Description of Artificial Sequence: Synthetic coding sequence

SEQ ID NO: 18822 - DNA, 882 bp, Artificial Sequence
  Description of Artificial Sequence: Synthetic coding sequence
atgagcagcgccagcggcctgcggcggggccaccctgctggaggagaggagaacatgacagaaacagatgccttctacaagcgggagatgtttgatcctgctgagaagtacaagatggaccacagaagaagaggcatcgccctgatcttcaaccacgagcgcttcttctggcacctgaccctgcctgagcggcggggcacctgtgccgaccgggacaacctgacccggcgcttcagtgacctgggctttgaggtgaagtgcttcaatgacctgaaggccgaggagctgctgctgaagatccacgaggtgtccacagtgtcccatgctgatgctgactgctttgtgtgtgtgttcctgagccatggagagggcaaccacatctatgcctatgatgccaagattgagatccagaccctgaccggcctcttcaagggggacaagtgccacagcctggtgggcaagcccaagatcttcatcatccaggcctgccggggcaaccagcatgatgtgcctgtgatccccctggatgtggtggacaaccagacagagaagctggacaccaacatcacagaggtggatgctgcctctgtgtacaccctgcctgctggagctgacttcctgatgtgctacagcgtggccgagggctactacagccaccgggagaccgtgaatggctcctggtacatccaggacctgtgtgagatgctgggcaagtatggcagcagcctggagttcacagagctgctgaccctggtgaacaggaaggtgtcccagaggagagtggacttctgcaaggaccccagcgccatcggcaagaagcaggtgccctgctttgcctccatgctgaccaagaagctgcacttcttccccaagagcaactag

SEQ ID NO: 18823 - DNA, 615 bp, Artificial Sequence
  Description of Artificial Sequence: Synthetic coding sequence
atgagcagcgccagcggcctgcggcggggccaccctgctgtgtccacagtgtcccatgctgatgctgactgctttgtgtgtgtgttcctgagccacggggagggcaaccacatctatgcctatgatgccaagattgagatccagaccctgaccggcctcttcaagggggacaagtgccacagcctggtgggcaagcccaagatcttcatcatccaggcctgccggggcaaccagcatgatgtgcctgtgatccccctggatgtggtggacaaccagacagagaagctggacaccaacatcacagaggtggatgctgcctctgtgtacaccctgcctgctggagctgacttcctgatgtgctacagcgtggccgagggctactacagccaccgggagaccgtgaatggctcctggtacatccaggacctgtgtgagatgctgggcaagtatggcagcagcctggagttcacagagctgctgaccctggtgaacaggaaggtgtcccagaggagagtggacttctgcaaggaccccagcgccatcggcaagaagcaggtgccctgctttgcctccatgctgaccaagaagctgcacttcttccccaagagcaactag

SEQ ID NO: 18824 - DNA, 912 bp, Artificial Sequence
  Description of Artificial Sequence: Synthetic coding sequence
atggctgatgaccagggctgcatcgaggagcagggcgtggaggacagcgccaatgaagattctgtggatgccaagccagacaggagcagctttgtgcccagcctcttcagcaagaagaagaagaatgtgaccatgaggagcatcaagaccacccgggacagagtgcccacctaccagtacaacatgaactttgagaagctgggcaagtgcatcatcatcaacaacaagaactttgacaaggtgacaggcatgggcgtgagaaatggaacagacaaggatgctgaggccctcttcaagtgcttccgcagcctgggctttgatgtgattgtgtacaatgactgcagctgtgccaagatgcaggacctgctgaagaaggccagcgaggaggaccacaccaatgctgcctgctttgcctgcatcctgctgagccacggggaggagaatgtcatctacggcaaggatggagtgacccccatcaaggacctgacagcccacttccggggggaccgctgcaagaccctgctggagaagcccaagctgttcttcatccaggcctgccggggcacagagctggatgatggcatccaggccgacagcggccccatcaatgacacagatgccaacccccgctacaagatccctgtggaggccgacttcctgtttgcctacagcacagtgcccggctactacagctggaggagccctggccggggctcctggtttgtgcaggccctgtgcagcatcctggaggagcacggcaaggacctggagatcatgcagatcctgaccagggtgaatgacagagtggcccggcactttgagagccagagtgatgacccccacttccacgagaagaagcagatcccctgtgtggtgtccatgctgaccaaggagctgtacttcagccagtag

SEQ ID NO: 18825 - DNA, 912 bp, Artificial Sequence; identical to SEQ ID NO: 18824
  Description of Artificial Sequence: Synthetic coding sequence

SEQ ID NO: 18826 - DNA, 663 bp, Artificial Sequence
  Description of Artificial Sequence: Synthetic coding sequence
atggctgatgaccagggctgcatcgaggagcagggcgtggaggacagcgccaatgaagattctgtggatgccaagccagacaggagcagctttgtgcccagcctcttcagcaagaagaagaagaatgtgaccatgaggagcatcaagaccacccgggacagagtgcccacctaccagtacaacatgaactttgagaagctgggcaagtgcatcatcatcaacaacaagaactttgacaaggtgacaggcatgggcgtgagaaatggaacagacaaggatgctgaggccctcttcaagtgcttccgcagcctgggctttgatgtgattgtgtacaatgactgcagcgtgacccaggccggcgtgcagaggcgggacctgggccgcctgcagcccccaccaccccgcttcaagcagtacagctgcctgagcctgctgagctcctgggactacagacatgccccaccccggctggccaacttctgcatcttccggcgggagggcttccgccacgtgggccaggccggcctgaagctgctggccagcagtgacccccccaccagcggcagccagagcgctggcatcactggagtgtccctgcacacccagccccagatcatgaaggtgtccctgcggcactgcaacaccttcatctgctttgcctag

SEQ ID NO: 18827 - DNA, 912 bp, Artificial Sequence; identical to SEQ ID NO: 18824
  Description of Artificial Sequence: Synthetic coding sequence

SEQ ID NO: 18828 - DNA, 663 bp, Artificial Sequence
  Description of Artificial Sequence: Synthetic coding sequence
atggctgatgaccagggctgcatcgaggagcagggcgtggaggacagcgccaatgaagattctgtggatgccaagccagacaggagcagctttgtgcccagcctcttcagcaagaagaagaagaatgtgaccatgaggagcatcaagaccacccgggacagagtgcccacctaccagtacaacatgaactttgagaagctgggcaagtgcatcatcatcaacaacaagaactttgacaaggtgacaggcatgggcgtgagaaatggaacagacaaggatgctgaggccctcttcaagtgcttccgcagcctgggctttgatgtgattgtgtacaatgactgcagcttcacccaggccggcgtgcagaggcgggacctgggccgcctgcagcccccaccaccccgcttcaagcagtacagctgcctgagcctgctgagctcctgggactacagacatgccccaccccggctggccaacttctgcatcttccggcgggagggcttccgccacgtgggccaggccggcctgaagctgctggccagcagtgacccccccaccagcggcagccagagcgctggcatcactggagtgtccctgcacacccagccccagatcatgaaggtgtccctgcggcactgcaacaccttcatctgctttgcctag

SEQ ID NO: 18829 - DNA, 1011 bp, Artificial Sequence
  Description of Artificial Sequence: Synthetic coding sequence
atggactgtgtgggctggcccccaggcaggaagtggcacctggagaagaacaccagctgtggcggcagcagcggcatctgtgccagctatgtgacccagatggctgatgaccagggctgcatcgaggagcagggcgtggaggacagcgccaatgaagacagcgtggatgccaagccagacaggagcagctttgtgcccagcctcttcagcaagaagaagaagaatgtgaccatgaggagcatcaagaccacccgggacagagtgcccacctaccagtacaacatgaactttgagaagctgggcaagtgcatcatcatcaacaacaagaactttgacaaggtgacaggcatgggcgtgagaaatggaacagacaaggatgctgaggccctcttcaagtgcttccgcagcctgggctttgatgtgattgtgtacaatgactgcagctgtgccaagatgcaggacctgctgaagaaggccagcgaggaggaccacaccaatgctgcctgctttgcctgcatcctgctgagccatggagaggagaatgtcatctacggcaaggatggagtgacccccatcaaggacctgacagcccacttccggggggaccgctgcaagaccctgctggagaagcccaagctgttcttcatccaggcctgccggggcacagagctggatgatggcatccaggccgacagcggccccatcaatgacacagatgccaacccccgctacaagatccctgtggaggccgacttcctgtttgcctacagcacagtgcccggctactacagctggaggagccctggccggggctcctggtttgtgcaggccctgtgcagcatcctggaggagcacggcaaggacctggagatcatgcagatcctgaccagggtgaatgacagagtggcccggcactttgagagccagagtgatgacccccacttccacgagaagaagcagatcccctgtgtggtgtccatgctgaccaaggagctgtacttcagccagtag

SEQ ID NO: 18830 - DNA, 762 bp, Artificial Sequence
  Description of Artificial Sequence: Synthetic coding sequence
atggctgatgaccagggctgcatcgaggagcagggcgtggaggacagcgccaatgaagattctgtggatgccaagccagacaggagcagctttgtgcccagcctcttcagcaagaagaagaagaatgtgaccatgaggagcatcaagaccacccgggacagagtgcccacctaccagtacaacatgaactttgagaagctgggcaagtgcatcatcatcaacaacaagaactttgacaaggtgacaggcatgggcgtgagaaatggaacagacaaggatgctgaggccctcttcaagtgcttccgcagcctgggctttgatgtgattgtgtacaatgactgcagctgtgccaagatgcaggacctgctgaagaaggccagcgaggaggaccacaccaatgctgcctgctttgcctgcatcctgctgagccacggggaggagaacatggagagctgcagcgtgacccaggccggcgtgcagaggcgggacctgggccgcctgcagcccccaccaccccggctggccgagggccccagcctgatgatggccagccggcccacccggggccccagcatgacccagatgctgatcctggacaccaggagccagtggaagctgaccagcagcagccccatcccccgcttccaggccatcacccggggcggggcccaggaggaggcccctggcctgtgcaagcccagcgcccccagctggaggagcacagagaagacctggaagagctgccgcagcagccctggatag

SEQ ID NO: 18831 - DNA, 669 bp, Artificial Sequence
  Description of Artificial Sequence: Synthetic coding sequence
atggctgatgaccagggctgcatcgaggagcagggcgtggaggacagcgccaatgaagattctgtggatgccaagccagacaggagcagctttgtgcccagcctcttcagcaagaagaagaagaatgtgaccatgaggagcatcaagaccacccgggacagagtgcccacctaccagtacaacatgaactttgagaagctgggcaagtgcatcatcatcaacaacaagaactttgacaaggtgacaggcatgggcgtgagaaatggaacagacaaggatgctgaggccctcttcaagtgcttccgcagcctgggctttgatgtgattgtgtacaatgactgcagctgtgccaagatgcaggacctgctgaagaaggccagcgaggaggaccacaccaatgctgcctgctttgcctgcatcctgctgagccacggggaggagaatgtcatctacggcaaggatggagtgacccccatcaaggacctgacagcccacttccggggggaccgctgcaagaccctgctggagaagcccaagctgttcttcatccaggcctgccggggcacagagctggatgatggcatccaggccgacagcggccccatcaatgacacagatgccaacccccgctacaagatccctgtggaggccgacttcctgtttgcctag

SEQ ID NO: 18832 - DNA, 795 bp, Artificial Sequence
  Description of Artificial Sequence: Synthetic coding sequence
atggctgatgaccagggctgcatcgaggagcagggcgtggaggacagcgccaatgaagattctgtggatgccaagccagacaggagcagctttgtgcccagcctcttcagcaagaagaagaagaatgtgaccatgaggagcatcaagaccacccgggacagagtgcccacctaccagtacaacatgaactttgagaagctgggcaagtgcatcatcatcaacaacaagaactttgacaaggtgacaggcatgggcgtgagaaatggaacagacaaggatgctgaggccctcttcaagtgcttccgcagcctgggctttgatgtgattgtgtacaatgactgcagctgtgccaagatgcaggacctgctgaagaaggccagcgaggaggaccacaccaatgctgcctgctttgcctgcatcctcttcttcatccaggcctgccggggcacagagctggatgatggcatccaggccgacagcggccccatcaatgacacagatgccaacccccgctacaagatccctgtggaggccgacttcctgtttgcctacagcacagtgcccggctactacagctggaggagccctggccggggctcctggtttgtgcaggccctgtgcagcatcctggaggagcacggcaaggacctggagatcatgcagatcctgaccagggtgaatgacagagtggcccggcactttgagagccagagtgatgacccccacttccacgagaagaagcagatcccctgtgtggtgtccatgctgaccaaggagctgtacttcagccagtag

SEQ ID NO: 18833 - DNA, 837 bp, Artificial Sequence
  Description of Artificial Sequence: Synthetic coding sequence
atgcagaggggcctcttcagtgatggagacaccagcaagaagaagaagaatgtgaccatgaggagcatcaagaccacccgggacagagtgcccacctaccagtacaacatgaactttgagaagctgggcaagtgcatcatcatcaacaacaagaactttgacaaggtgacaggcatgggcgtgagaaatggaacagacaaggatgctgaggccctcttcaagtgcttccgcagcctgggctttgatgtgattgtgtacaatgactgcagctgtgccaagatgcaggacctgctgaagaaggccagcgaggaggaccacaccaatgctgcctgctttgcctgcatcctgctgagccatggagaggagaatgtcatctacggcaaggatggagtgacccccatcaaggacctgacagcccacttccggggggaccgctgcaagaccctgctggagaagcccaagctgttcttcatccaggcctgccggggcacagagctggatgatggcatccaggccgacagcggccccatcaatgacacagatgccaacccccgctacaagatccctgtggaggccgacttcctgtttgcctacagcacagtgcccggctactacagctggaggagccctggccggggctcctggtttgtgcaggccctgtgcagcatcctggaggagcacggcaaggacctggagatcatgcagatcctgaccagggtgaatgacagagtggcccggcactttgagagccagagtgatgacccccacttccacgagaagaagcagatcccctgtgtggtgtccatgctgaccaaggagctgtacttcagccagtag

SEQ ID NO: 18834 - DNA, 1188 bp, Artificial Sequence
  Description of Artificial Sequence: Synthetic coding sequence
atggacttcagcaggaacctgtatgacatcggggagcagctggacagcgaggacctggccagcctgaagttcctgagcctggactacatcccccagaggaagcaggagcccatcaaggatgccctgatgctgttccagaggctgcaggagaagaggatgctggaggagagcaacctgtccttcctgaaggagctgctcttccgcatcaaccggctggacctgctgatcacctacctgaacaccaggaaggaggagatggagcgggagctgcagaccccaggccgggcccagatcagcgcctacagagtgatgctgtaccagatcagcgaggaggtgagccgctctgagctgcgctccttcaagttcctgctgcaggaggagatcagcaagtgcaagctggatgatgacatgaacctgctggacatcttcatcgagatggagaagagggtcatcctgggggagggcaagctggacatcctgaagagggtgtgtgcccagatcaacaagagcctgctgaagatcatcaatgactatgaggagttcagcaaaggagccctgaccaccacctttgaggagctgcactttgagatcaagccccatgatgactgcaccgtggagcagatctatgagatcctgaagatctaccagctgatggaccacagcaacatggactgcttcatctgctgcatcctgagccatggagacaagggcatcatctacggcacagatggccaggaggcccccatctatgagctgaccagccagttcaccggcctgaagtgccccagcctggccggcaagcccaaggtgttcttcatccaggcctgccagggcgacaactaccagaagggcatccctgtggagacagattctgaggagcagccctacctggagatggacctgagcagcccccagacccgctacatcccagatgaagctgacttcctgctgggcatggccaccgtgaacaactgtgtgtcctacagaaatcctgctgagggcacctggtacatccagagcctgtgccagagcctgcgggagcgctgccccagaggagatgacatcctgaccatcctgacagaggtgaactatgaggtgagcaacaaggatgacaagaagaacatgggcaagcagatgccccagcccaccttcaccctgaggaagaagctggtgttccccagcgactag

SEQ ID NO: 18835 - DNA, 1491 bp, Artificial Sequence
  Description of Artificial Sequence: Synthetic coding sequence
atggacttcagcaggaacctgtatgacatcggggagcagctggacagcgaggacctggccagcctgaagttcctgagcctggactacatcccccagaggaagcaggagcccatcaaggatgccctgatgctgttccagaggctgcaggagaagaggatgctggaggagagcaacctgtccttcctgaaggagctgctcttccgcatcaaccggctggacctgctgatcacctacctgaacaccaggaaggaggagatggagcgggagctgcagaccccaggccgggcccagatcagcgcctaccgcttccacttctgcaggatgtcctgggccgaggccaacagccagtgccagacccagagcgtgcccttctggaggagagtggaccacctgctgatccgggtgatgctgtaccagatcagcgaggaggtgagccgctctgagctgcgctccttcaagttcctgctgcaggaggagatcagcaagtgcaagctggatgatgacatgaacctgctggacatcttcatcgagatggagaagagggtcatcctgggggagggcaagctggacatcctgaagagggtgtgtgcccagatcaacaagagcctgctgaagatcatcaatgactatgaggagttcagcaaaggagaggagctgtgtggggtgatgaccatcagtgacagcccccgggagcaggacagcgagagccagaccctggacaaggtgtaccagatgaagagcaagccccggggctactgcctgatcatcaacaaccacaactttgccaaggcccgggagaaggtgcccaagctgcacagcatccgggacagaaatggcacccacctggatgctggggccctgaccaccacctttgaggagctgcactttgagatcaagccccatgatgactgcaccgtggagcagatctatgagatcctgaagatctaccagctgatggaccacagcaacatggactgcttcatctgctgcatcctgagccacggggacaagggcatcatctatggaacagatggccaggaggcccccatctatgagctgaccagccagttcaccggcctgaagtgccccagcctggccggcaagcccaaggtgttcttcatccaggcctgccagggcgacaactaccagaagggcatccctgtggagacagacagcgaggagcagccctacctggagatggacctgagcagcccccagacccgctacatcccagatgaggccgacttcctgctgggcatggccaccgtgaacaactgtgtgtcctacagaaatcctgctgagggcacctggtacatccagagcctgtgccagagcctgcgggagcgctgccccagaggagatgacatcctgaccatcctgacagaggtgaactatgaggtgagcaacaaggatgacaagaagaacatgggcaagcagatgccccagcccaccttcaccctgaggaagaagctggtgttccccagcgactag

SEQ ID NO: 18836 - DNA, 1395 bp, Artificial Sequence
  Description of Artificial Sequence: Synthetic coding sequence
atggacttcagcaggaacctgtatgacatcggggagcagctggacagcgaggacctggccagcctgaagttcctgagcctggactacatcccccagaggaagcaggagcccatcaaggatgccctgatgctgttccagaggctgcaggagaagaggatgctggaggagagcaacctgtccttcctgaaggagctgctcttccgcatcaaccggctggacctgctgatcacctacctgaacaccaggaaggaggagatggagcgggagctgcagaccccaggccgggcccagatcagcgcctacagagtgatgctgtaccagatcagcgaggaggtgagccgctctgagctgcgctccttcaagttcctgctgcaggaggagatcagcaagtgcaagctggatgatgacatgaacctgctggacatcttcatcgagatggagaagagggtcatcctgggggagggcaagctggacatcctgaagagggtgtgtgcccagatcaacaagagcctgctgaagatcatcaatgactatgaggagttcagcaaaggagaggagctgtgtggggtgatgaccatcagtgacagcccccgggagcaggacagcgagagccagaccctggacaaggtgtaccagatgaagagcaagccccggggctactgcctgatcatcaacaaccacaactttgccaaggcccgggagaaggtgcccaagctgcacagcatccgggacagaaatggcacccacctggatgctggggccctgaccaccacctttgaggagctgcactttgagatcaagccccatgatgactgcaccgtggagcagatctatgagatcctgaagatctaccagctgatggaccacagcaacatggactgcttcatctgctgcatcctgagccacggggacaagggcatcatctatggaacagatggccaggaggcccccatctatgagctgaccagccagttcaccggcctgaagtgccccagcctggccggcaagcccaaggtgttcttcatccaggcctgccagggcgacaactaccagaagggcatccctgtggagacagacagcgaggagcagccctacctggagatggacctgagcagcccccagacccgctacatcccagatgaggccgacttcctgctgggcatggccaccgtgaacaactgtgtgtcctacagaaatcctgctgagggcacctggtacatccagagcctgtgccagagcctgcgggagcgctgccccagaggagatgacatcctgaccatcctgacagaggtgaactatgaggtgagcaacaaggatgacaagaagaacatgggcaagcagatgccccagcccaccttcaccctgaggaagaagctggtgttccccagcgactag

SEQ ID NO: 18837 - DNA, 1617 bp, Artificial Sequence
  Description of Artificial Sequence: Synthetic coding sequence
atggagggcggcagaagagcccgggtggtgattgagagcaagaggaacttcttcctgggcgccttccccacccccttccctgctgagcacgtggagctgggccgcctgggggacagcgagacagccatggtgcctggaaaaggaggagctgactacatcctgctgcccttcaagaagatggacttcagcaggaacctgtatgacattggagagcagctggacagcgaggacctggccagcctgaagttcctgagcctggactacatcccccagaggaagcaggagcccatcaaggatgccctgatgctgttccagaggctgcaggagaagaggatgctggaggagagcaacctgtccttcctgaaggagctgctcttccgcatcaaccggctggacctgctgatcacctacctgaacaccaggaaggaggagatggagcgggagctgcagaccccaggccgggcccagatcagcgcctacagagtgatgctgtaccagatcagcgaggaggtgagccgctctgagctgcggagcttcaagttcctgctgcaggaggagatcagcaagtgcaagctggatgatgacatgaacctgctggacatcttcatcgagatggagaagagggtcatcctgggggagggcaagctggacatcctgaagagggtgtgtgcccagatcaacaagagcctgctgaagatcatcaatgactatgaggagttcagcaaggagaggagcagcagcctggagggcagcccagatgagttcagcaatggagaggagctgtgtggggtgatgaccatcagtgacagcccccgggagcaggacagcgagagccagaccctggacaaggtgtaccagatgaagagcaagccccggggctactgcctgatcatcaacaaccacaactttgccaaggcccgggagaaggtgcccaagctgcacagcatccgggacagaaatggcacccacctggatgctggggccctgaccaccacctttgaggagctgcactttgagatcaagccccatgatgactgcaccgtggagcagatctatgagatcctgaagatctaccagctgatggaccacagcaacatggactgcttcatctgctgcatcctgagccacggggacaagggcatcatctatggaacagatggccaggaggcccccatctatgagctgaccagccagttcaccggcctgaagtgccccagcctggccggcaagcccaaggtgttcttcatccaggcctgccagggcgacaactaccagaagggcatccctgtggagacagacagcgaggagcagccctacctggagatggacctgagcagcccccagacccgctacatcccagatgaggccgacttcctgctgggcatggccaccgtgaacaactgtgtgtcctacagaaatcctgctgagggcacctggtacatccagagcctgtgccagagcctgcgggagcgctgccccagaggagatgacatcctgaccatcctgacagaggtgaactatgaggtgagcaacaaggatgacaagaagaacatgggcaagcagatgccccagcccaccttcaccctgaggaagaagctggtgttccccagcgactag

SEQ ID NO: 18838 - DNA, 708 bp, Artificial Sequence
  Description of Artificial Sequence: Synthetic coding sequence
atggacttcagcaggaacctgtatgacatcggggagcagctggacagcgaggacctggccagcctgaagttcctgagcctggactacatcccccagaggaagcaggagcccatcaaggatgccctgatgctgttccagaggctgcaggagaagaggatgctggaggagagcaacctgtccttcctgaaggagctgctcttccgcatcaaccggctggacctgctgatcacctacctgaacaccaggaaggaggagatggagcgggagctgcagaccccaggccgggcccagatcagcgcctacagagtgatgctgtaccagatcagcgaggaggtgagccgctctgagctgcgctccttcaagttcctgctgcaggaggagatcagcaagtgcaagctggatgatgacatgaacctgctggacatcttcatcgagatggagaagagggtcatcctgggggagggcaagctggacatcctgaagagggtgtgtgcccagatcaacaagagcctgctgaagatcatcaatgactatgaggagttcagcaaggagaggagcagcagcctggagggcagcccagatgagttcagcaatgactttggccagagcctgcccaatgagaagcagaccagcggcatcctgagtgaccaccagcagagccagttctgcaagagcactggagagagcgcccagaccagccagcactag

SEQ ID NO: 18839 - DNA, 708 bp, Artificial Sequence; identical to SEQ ID NO: 18838
  Description of Artificial Sequence: Synthetic coding sequence

SEQ ID NO: 18840 - DNA, 837 bp, Artificial Sequence
  Description of Artificial Sequence: Synthetic coding sequence
atggacttcagcaggaacctgtatgacatcggggagcagctggacagcgaggacctggccagcctgaagttcctgagcctggactacatcccccagaggaagcaggagcccatcaaggatgccctgatgctgttccagaggctgcaggagaagaggatgctggaggagagcaacctgtccttcctgaaggagctgctcttccgcatcaaccggctggacctgctgatcacctacctgaacaccaggaaggaggagatggagcgggagctgcagaccccaggccgggcccagatcagcgcctacagagtgatgctgtaccagatcagcgaggaggtgagccgctctgagctgcgctccttcaagttcctgctgcaggaggagatcagcaagtgcaagctggatgatgacatgaacctgctggacatcttcatcgagatggagaagagggtcatcctgggggagggcaagctggacatcctgaagagggtgtgtgcccagatcaacaagagcctgctgaagatcatcaatgactatgaggagttcagcaaaggagaggagctgtgtggggtgatgaccatcagtgacagcccccgggagcaggacagcgagagccagaccctggacaaggtgtaccagatgaagagcaagccccggggctactgcctgatcatcaacaaccacaactttgccaaggcccgggagaaggtgcccaagctgcacagcatccgggacagaaatggcacccacctggatgctggcagccacagcgtggcccaggccggcgtgcagtggtgtgacctgagcagcctgcagcccccaccaccctggttcaagtag

SEQ ID NO: 18841 - DNA, 1395 bp, Artificial Sequence; identical to SEQ ID NO: 18836
  Description of Artificial Sequence: Synthetic coding sequence

SEQ ID NO: 18842 - DNA, 663 bp, Artificial Sequence
  Description of Artificial Sequence: Synthetic coding sequence
atggacttcagcaggaacctgtatgacatcggggagcagctggacagcgaggacctggccagcctgaagttcctgagcctggactacatcccccagaggaagcaggagcccatcaaggatgccctgatgctgttccagaggctgcaggagaagaggatgctggaggagagcaacctgtccttcctgaaggagctgctcttccgcatcaaccggctggacctgctgatcacctacctgaacaccaggaaggaggagatggagcgggagctgcagaccccaggccgggcccagatcagcgcctacagagtgatgctgtaccagatcagcgaggaggtgagccgctctgagctgcgctccttcaagttcctgctgcaggaggagatcagcaagtgcaagctggatgatgacatgaacctgctggacatcttcatcgagatggagaagagggtcatcctgggggagggcaagctggacatcctgaagagggtgtgtgcccagatcaacaagagcctgctgaagatcatcaatgactatgaggagttcagcaaggactttggccagagcctgcccaatgagaagcagaccagcggcatcctgagtgaccaccagcagagccagttctgcaagagcactggagagagcgcccagaccagccagcactag

SEQ ID NO: 18843 - DNA, 597 bp, Artificial Sequence
  Description of Artificial Sequence: Synthetic coding sequence
atggacttcagcaggaacctgtatgacatcggggagcagctggacagcgaggacctggccagcctgaagttcctgagcctggactacatcccccagaggaagcaggagcccatcaaggatgccctgatgctgttccagaggctgcaggagaagaggatgctggaggagagcaacctgtccttcctgaaggagctgctcttccgcatcaaccggctggacctgctgatcacctacctgaacaccaggaaggaggagatggagcgggagctgcagaccccaggccgggcccagatcagcgcctacagagtgatgctgtaccagatcagcgaggaggtgagccgctctgagctgcgctccttcaagttcctgctgcaggaggagatcagcaagtgcaagctggatgatgacatgaacctgctggacatcttcatcgagatggagaagagggtcatcctgggggagggcaagctggacatcctgaagagggtgtgtgcccagatcaacaagagcctgctgaagatcatcaatgactatgaggagttcagcaaggagaggagcagcagcctggagggcagcccagatgagttcagcaactag

SEQ ID NO: 18844 - DNA, 351 bp, Artificial Sequence
  Description of Artificial Sequence: Synthetic coding sequence
atggacttcagcaggaacctgtatgacatcggggagcagctggacagcgaggacctggccagcctgaagttcctgagcctggactacatcccccagaggaagcaggagcccatcaaggatgccctgatgctgttccagaggctgcaggagaagaggatgctggaggagagcaacctgtccttcctgaaggagctgctcttccgcatcaaccggctggacctgctgatcacctacctgaacaccaggaaggaggagatggagcgggagctgcagaccccaggccgggcccagatcagcgcctacagagtgatgctgtaccagatcagcgaggaggtgagccgctctgagtag

SEQ ID NO: 18845 - DNA, 1440 bp, Artificial Sequence
  Description of Artificial Sequence: Synthetic coding sequence
atggacttcagcaggaacctgtatgacatcggggagcagctggacagcgaggacctggccagcctgaagttcctgagcctggactacatcccccagaggaagcaggagcccatcaaggatgccctgatgctgttccagaggctgcaggagaagaggatgctggaggagagcaacctgtccttcctgaaggagctgctcttccgcatcaaccggctggacctgctgatcacctacctgaacaccaggaaggaggagatggagcgggagctgcagaccccaggccgggcccagatcagcgcctacagagtgatgctgtaccagatcagcgaggaggtgagccgctctgagctgcgctccttcaagttcctgctgcaggaggagatcagcaagtgcaagctggatgatgacatgaacctgctggacatcttcatcgagatggagaagagggtcatcctgggggagggcaagctggacatcctgaagagggtgtgtgcccagatcaacaagagcctgctgaagatcatcaatgactatgaggagttcagcaaggagaggagcagcagcctggagggcagcccagatgagttcagcaatggagaggagctgtgtggggtgatgaccatcagtgacagcccccgggagcaggacagcgagagccagaccctggacaaggtgtaccagatgaagagcaagccccggggctactgcctgatcatcaacaaccacaactttgccaaggcccgggagaaggtgcccaagctgcacagcatccgggacagaaatggcacccacctggatgctggggccctgaccaccacctttgaggagctgcactttgagatcaagccccatgatgactgcaccgtggagcagatctatgagatcctgaagatctaccagctgatggaccacagcaacatggactgcttcatctgctgcatcctgagccatggagacaagggcatcatctacggcacagatggccaggaggcccccatctatgagctgaccagccagttcaccggcctgaagtgccccagcctggccggcaagcccaaggtgttcttcatccaggcctgccagggcgacaactaccagaagggcatccctgtggagacagattctgaggagcagccctacctggagatggacctgagcagcccccagacccgctacatcccagatgaagctgacttcctgctgggcatggccaccgtgaacaactgtgtgtcctacagaaatcctgctgagggcacctggtacatccagagcctgtgccagagcctgcgggagcgctgccccagaggagatgacatcctgaccatcctgacagaggtgaactatgaggtgagcaacaaggatgacaagaagaacatgggcaagcagatgccccagcccaccttcaccctgaggaagaagctggtgttccccagcgactag

SEQ ID NO: 18846 - DNA, 375 bp, Artificial Sequence
  Description of Artificial Sequence: Synthetic coding sequence
atggacttcagcaggaacctgtatgacatcggggagcagctggacagcgaggacctggccagcctgaagttcctgagcctggactacatcccccagaggaagcaggagcccatcaaggatgccctgatgctgttccagaggctgcaggagaagaggatgctggaggagagcaacctgtccttcctgaaggagctgctcttccgcatcaaccggctggacctgctgatcacctacctgaacaccaggaaggaggagatggagcgggagctgcagaccccaggccgggcccagatcagcgcctacagagtgatgctgtaccagatcagcgaggaggtgagccgctctgagctgcgctccttcaagttcctgctgtag

SEQ ID NO: 18847 - DNA, 630 bp, Artificial Sequence
  Description of Artificial Sequence: Synthetic coding sequence
atggacttcagcaggaacctgtatgacatcggggagcagctggacagcgaggacctggccagcctgaagttcctgagcctggactacatcccccagaggaagcaggagcccatcaaggatgccctgatgctgttccagaggctgcaggagaagaggatgctggaggagagcaacctgtccttcctgaaggagctgctcttccgcatcaaccggctggacctgctgatcacctacctgaacaccaggaaggaggagatggagcgggagctgcagaccccaggccgggcccagatcagcgcctacagagtgatgctgtaccagatcagcgaggaggtgagccgctctgagctgcgctccttcaagttcctgctgcaggaggagatcagcaagtgcaagctggatgatgacatgaacctgctggacatcttcatcgagatggagaagagggtcatcctgggggagggcaagctggacatcctgaagagggtgtgtgcccagatcaacaagagcctgctgaagatcatcaatgactatgaggagttcagcaaggactttggccagagcctgcccaatgagaagcagaccagcggcatcctgagtgaccaccagcagagccagttctgcaagtag

SEQ ID NO: 18848 - DNA, 1251 bp, Artificial Sequence
  Description of Artificial Sequence: Synthetic coding sequence
atggatgaggccgaccggcggctgctgcggcgctgccgcctgcggctggtggaggagctgcaggtggaccagctgtgggatgccctgctgagccgggagctgttccggccccacatgattgaggacatccagagagctggcagcggcagcagaagagaccaggcccggcagctgatcatcgacctggagacccggggcagccaggccctgcccctcttcatcagctgcctggaggacaccggccaggacatgctggccagcttcctgcggaccaaccggcaggccgccaagctgagcaagcccaccctggagaacctgacccctgtggtgctgcggcctgagatcaggaagccagaggtgctgcggcctgagacccccaggcctgtggacatcggcagcggcggctttggagatgtgggcgccctggagagcctgcggggaaatgctgacctggcctacatcctgtccatggagccctgtggccactgcctgatcatcaacaacgtgaacttctgccgggagagcggcctgcggaccaggacaggcagcaacatcgactgtgagaagctgcggcggcgcttcagcagcctgcacttcatggtggaggtgaagggggacctgacagccaagaagatggtgctggccctgctggagctggcccagcaggaccacggggccctggactgctgcgtggtggtgatcctgagccacggctgccaggccagccacctgcagtttcctggagctgtgtatggaacagatggctgccctgtgtctgtggagaagatcgtgaacatcttcaacggcaccagctgccccagcctgggcggcaagcccaagctgttcttcatccaggcctgtggcggggagcagaaggaccacggctttgaggtggccagcaccagcccagaagatgagagccctggcagcaaccctgagccagatgccacccccttccaggagggcctgcggacctttgaccagctggatgccatcagcagcctgcccacccccagcgacatctttgtgtcctacagcaccttccctggctttgtgtcctggagggaccccaagagcggctcctggtacgtggagaccctggatgacatctttgagcagtgggcccacagcgaggacctgcagagcctgctgctgcgggtggccaatgctgtgtctgtgaagggcatctacaagcagatgcctggctgcttcaacttcctgaggaagaagctgttcttcaagaccagctag

SEQ ID NO: 18849 - DNA, 801 bp, Artificial Sequence
  Description of Artificial Sequence: Synthetic coding sequence
atggatgaggccgaccggcggctgctgcggcgctgccgcctgcggctggtggaggagctgcaggtggaccagctgtgggatgccctgctgagccgggagctgttccggccccacatgattgaggacatccagagagctggcagcggcagcagaagagaccaggcccggcagctgatcatcgacctggagacccggggcagccaggccctgcccctcttcatcagctgcctggaggacaccggccaggacatgctggccagcttcctgcggaccaaccggcaggccgccaagctgagcaagcccaccctggagaacctgacccctgtggtgctgcggcctgagatcaggaagccagaggtgctgcggcctgagacccccaggcctgtggacatcggcagcggcggctttggagatgtggagcagaaggaccacggctttgaggtggccagcaccagcccagaagatgagagccctggcagcaaccctgagccagatgccacccccttccaggagggcctgcggacctttgaccagctggatgccatcagcagcctgcccacccccagcgacatctttgtgtcctacagcaccttccctggctttgtgtcctggagggaccccaagagcggctcctggtacgtggagaccctggatgacatctttgagcagtgggcccacagcgaggacctgcagagcctgctgctgcgggtggccaatgctgtgtctgtgaagggcatctacaagcagatgcctggctgcttcaacttcctgaggaagaagctgttcttcaagaccagctag

SEQ ID NO: 18850 - DNA, 603 bp, Artificial Sequence
  Description of Artificial Sequence: Synthetic coding sequence
atggagccctgtggccactgcctgatcatcaacaacgtgaacttctgccgggagagcggcctgcggaccaggacaggcagcaacatcgactgtgagaagctgcggcggcgcttcagcagcctgcacttcatggtggaggtgaagggggacctgacagccaagaagatggtgctggccctgctggagctggcccagcaggaccacggggccctggactgctgcgtggtggtgatcctgagccacggctgccaggccagccacctgcagtttcctggagctgtgtatggaacagatggctgccctgtgtctgtggagaagatcgtgaacatcttcaacggcaccagctgccccagcctgggcggcaagcccaagctgttcttcatccaggcctgtggcggcggctttgtgtcctggagggaccccaagagcggctcctggtacgtggagaccctggatgacatctttgagcagtgggcccacagcgaggacctgcagagcctgctgctgcgggtggccaatgctgtgtctgtgaagggcatctacaagcagatgcctggctgcttcaacttcctgaggaagaagctgttcttcaagaccagctag

SEQ ID NO: 18851 - DNA, 1002 bp, Artificial Sequence
  Description of Artificial Sequence: Synthetic coding sequence
atgctggccagcttcctgcggaccaaccggcaggccgccaagctgagcaagcccaccctggagaacctgacccctgtggtgctgcggcctgagatcaggaagccagaggtgctgcggcctgagacccccaggcctgtggacatcggcagcggcggctttggagatgtgggcgccctggagagcctgcggggaaatgctgacctggcctacatcctgtccatggagccctgtggccactgcctgatcatcaacaacgtgaacttctgccgggagagcggcctgcggaccaggacaggcagcaacatcgactgtgagaagctgcggcggcgcttcagcagcctgcacttcatggtggaggtgaagggggacctgacagccaagaagatggtgctggccctgctggagctggcccagcaggaccatggagccctggactgctgcgtggtggtgatcctgagccacggctgccaggccagccacctgcagtttcctggagctgtgtatggaacagatggctgccctgtgtctgtggagaagatcgtgaacatcttcaacggcaccagctgccccagcctgggcggcaagcccaagctgttcttcatccaggcctgtggcggggagcagaaggaccacggctttgaggtggccagcaccagcccagaagatgagagccctggcagcaaccctgagccagatgccacccccttccaggagggcctgcggacctttgaccagctggatgccatcagcagcctgcccacccccagcgacatctttgtgtcctacagcaccttccctggctttgtgtcctggagggaccccaagagcggctcctggtacgtggagaccctggatgacatctttgagcagtgggcccacagcgaggacctgcagagcctgctgctgcgggtggccaatgctgtgtctgtgaagggcatctacaagcagatgcctggctgcttcaacttcctgaggaagaagctgttcttcaagaccagctag

SEQ ID NO: 18852 - DNA, 765 bp, Artificial Sequence
  Description of Artificial Sequence: Synthetic coding sequence
atggatgaggccgaccggcggctgctgcggcgctgccgcctgcggctggtggaggagctgcaggtggaccagctgtgggatgccctgctgagccgggagctgttccggccccacatgattgaggacatccagagagctggcagcggcagcagaagagaccaggcccggcagctgatcatcgacctggagacccggggcagccaggccctgcccctcttcatcagctgcctggaggacaccggccaggacatgctggccagcttcctgcggaccaaccggcaggccgccaagctgagcaagcccaccctggagaacctgacccctgtggtgctgcggcctgagatcaggaagccagaggtgctgcggcctgagacccccaggcctgtggacatcggcagcggcggctttggagatgtgggcgccctggagagcctgcggggaaatgctgacctggcctacatcctgtccatggagccctgtggccactgcctgatcatcaacaacgtgaacttctgccgggagagcggcctgcggaccaggacaggcagcaacatcgactgtgagaagctgcggcggcgcttcagcagcctgcacttcatggtggaggtgaagggggacctgacagccaaggccagccacctgcagtttcctggagctgtgtatggaacagatggctgccctgtgtctgtggagaagatcgtgaacatcttcaacggcaccagctgccccagcctgggcggcaagcccaagctgttcttcatctag

SEQ ID NO: 18853 - DNA, 801 bp, Artificial Sequence
  Description of Artificial Sequence: Synthetic coding sequence
atgctggccagcttcctgcggaccaaccggcaggccgccaagctgagcaagcccaccctggagaacctgacccctgtggtgctgcggcctgagatcaggaagccagaggtgctgcggcctgagacccccaggcctgtggacatcggcagcggcggctttggagatgtgggcgccctggagagcctgcggggaaatgctgacctggcctacatcctgtccatggagccctgtggccactgcctgatcatcaacaacgtgaacttctgccgggagagcggcctgcggaccaggacaggcagcaacatcgactgtgagaagctgcggcggcgcttcagcagcctgcacttcatggtggaggtgaagggggacctgacagccaagaagatggtgctggccctgctggagctggcccagcaggaccatggagccctggactgctgcgtggtggtgatcctgagccacggctgccaggccagccacctgcagtttcctggagctgtgtatggaacagatggctgccctgtgtctgtggagaagatcgtgaacatcttcaacggcaccagctgccccagcctgggcggcaagcccaagctgttcttcatccaggcctgtggcggggagcagaaggaccacggctttgaggtggccagcaccagcccagaagatgagagccctggcagcaaccctgagccagatgccacccccttccaggagggcctgcggacctttgaccagctggatgccatcagcagcctgcccacccccagcgacatctttgtgtcctacagcaccttcccctag

SEQ ID NO: 18854 - DNA, 1266 bp, Artificial Sequence
  Description of Artificial Sequence: Synthetic coding sequence
atggatgaggccgaccggcggctgctgcggcgctgccgcctgcggctggtggaggagctgcaggtggaccagctgtgggatgccctgctgagccgggagctgttccggccccacatgattgaggacatccagagagctggcagcggcagcagaagagaccaggcccggcagctgatcatcgacctggagacccggggcagccaggccctgcccctcttcatcagctgcctggaggacaccggccaggacatgctggccagcttcctgcggaccaaccggcaggccgccaagctgagcaagcccaccctggagaacctgacccctgtggtgctgcggcctgagatcaggaagccagaggtgctgcggcctgagacccccaggcctgtggacatcggcagcggcggctttggagatgtgggcgccctggagagcctgcggggaaatgctgacctggcctacatcctgtccatggagccctgtggccactgcctgatcatcaacaacgtgaacttctgccgggagagcggcctgcggaccaggacaggcagcaacatcgactgtgagaagctgcggcggcgcttcagcagcctgcacttcatggtggaggtgaagggggacctgacagccaagaagatggtgctggccctgctggagctggcccagcaggaccacggggccctggactgctgcgtggtggtgatcctgagccacggctgccaggccagccacctgcagtttcctggagctgtgtatggaacagatggctgccctgtgtctgtggagaagatcgtgaacatcttcaacggcaccagctgccccagcctgggcggcaagcccaagctgttcttcatccaggcctgtggcggggagcagaaggaccacggctttgaggtggccagcaccagcccagaagatgagagccctggcagcaaccctgagccagatgccacccccttccaggagggcctgcggacctttgaccagctggatgccatcagcagcctgcccacccccagcgacatctttgtgtcctacagcaccttccctggctttgtgtcctggagggaccccaagagcggctcctggtacgtggagaccctggatgacatctttgagcagtgggcccacagcgaggacctgcagagcctgctgctgcgggtgtctgctgccttcctgtgcaagggggagggccgcctgctgcggggctctgtgtcctcctggggctggggctttggagtgtcccgggccggccccaaccagggctag

SEQ ID NO: 18855 - DNA, 2721 bp, Artificial Sequence
  Description of Artificial Sequence: Synthetic coding sequence
atgacagctgtgcacgccggcaacatcaacttcaagtgggaccccaagagcctggagatccgcaccctggccgtggagcggctgctggagcccctggtgacccaggtgaccaccctggtgaacaccaacagcaagggccccagcaacaagaagaggggccgcagcaagaaggcccacgtgctggccgcctctgtggagcaggccacagagaacttcctggagaagggggacaagatcgccaaggagagccagttcctgaaggaggagctggtggccgctgtggaggatgtgaggaagcagggcgacctgatgaaggctgctgctggggagtttgctgatgacccctgcagctctgtgaagaggggcaacatggtgcgggccgcccgggccctgctgtctgctgtgacccggctgctgatcctggccgacatggctgatgtgtacaagctgctggtgcagctgaaggtggtggaggatggcatcctgaagctgagaaatgctggaaatgagcaggacctgggcatccagtacaaggccctgaagccagaggtggacaagctgaacatcatggccgccaagaggcagcaggagctgaaggatgtgggccaccgggaccagatggctgctgcccggggcatcctgcagaagaatgtgcccatcctgtacacagccagccaggcctgcctgcagcacccagatgtggccgcctacaaggccaacagagacctgatctacaagcagctgcagcaggccgtgacaggcatcagcaatgctgcccaggccacagccagtgatgatgccagccagcaccagggcggcggcggcggggagctggcctatgccctgaacaactttgacaagcagatcatcgtggaccccctgtccttcagcgaggagcgcttccggcccagcctggaggagcggctggagagcatcatcagcggggccgccctgatggctgacagcagctgcaccagagatgacagaagagaaagaattgtggccgagtgcaatgctgtgcggcaggccctgcaggacctgctgtctgagtacatgggaaatgccggcaggaaggagaggagtgatgccctgaacagcgccatcgacaagatgaccaagaagacccgggacctgcggcggcagctgaggaaggctgtgatggaccacgtgtctgacagcttcctggagaccaacgtgcccctgctggtgctgattgaagctgccaagaatggaaatgagaaggaggtgaaggagtatgcccaggtgttccgggagcacgccaacaagctgattgaggtggccaacctggcctgcagcatcagcaacaatgaggagggcgtgaagctggtgaggatgtctgccagccagctggaggccctgtgcccccaggtgatcaatgctgccctggccctggccgccaagccccagagcaagctggcccaggagaacatggacctcttcaaggagcagtgggagaagcaggtgcgggtgctgacagatgctgtggatgacatcaccagcattgatgacttcctggccgtgtctgagaaccacatcctggaggatgtgaacaagtgtgtgattgccctgcaggagaaggatgtggatggcctggacagaacagctggggccatccggggccgggccgcccgggtcatccacgtggtgaccagcgagatggacaactatgagcccggggtgtacacagagaaggtgctggaggccaccaagctgctgagcaacacagtgatgccccgcttcacagagcaggtggaggccgctgtggaggccctgagcagtgaccctgcccagcccatggatgaaaatgagttcattgatgccagccggctggtgtatgatggcatccgggacatcaggaaggctgtgctgatgatccgcaccccagaggagctggatgacagcgactttgaaacagaggactttgatgtgcgcagcaggacctctgtgcagacagaagatgaccagctgattgctggccagagcgcccgggccatcatggcccagctgccccaggagcagaaggccaagattgctgagcaggtggccagcttccaggaggagaagagcaagctggatgctgaggtgtccaagtgggatgacagcggaaatgacatcatcgtgctggccaagcagatgtgcatgatcatgatggagatgacagacttcacccggggcaagggccccctgaagaacaccagtgatgtgatctctgctgccaagaagattgctgaggccggcagcaggatggacaagctgggccgcaccatcgctgaccactgcccagacagcgcctgcaagcaggacctgctggcctacctgcagagaattgccctgtactgccaccagctgaacatctgcagcaaggtgaaggccgaggtgcagaacctgggcggggagctggtggtgtctggagtggacagcgccatgagcctcatccaggccgccaagaacctgatgaatgctgtggtgcagacagtgaaggccagctatgtggccagcaccaagtaccagaagagccagggcatggccagcctgaacctgcctgctgtgtcctggaagatgaaggcccctgagaagaagcccctggtgaagcgggagaagcaggatgagacccagaccaagatcaagagggccagccagaagaagcacgtgaaccctgtgcaggccctgtctgagttcaaggccatggacagcatctag

SEQ ID NO: 18856 - DNA, 2412 bp, Artificial Sequence
  Description of Artificial Sequence: Synthetic coding sequence
atgaaggctgctgctggggagtttgctgatgacccctgcagctctgtgaagaggggcaacatggtgcgggccgcccgggccctgctgtctgctgtgacccggctgctgatcctggccgacatggctgatgtgtacaagctgctggtgcagctgaaggtggtggaggatggcatcctgaagctgagaaatgctggaaatgagcaggacctgggcatccagtacaaggccctgaagccagaggtggacaagctgaacatcatggccgccaagaggcagcaggagctgaaggatgtgggccaccgggaccagatggccgccgcccggggcatcctgcagaagaatgtgcccatcctgtacacagccagccaggcctgcctgcagcacccagatgtggccgcctacaaggccaacagagacctgatctacaagcagctgcagcaggccgtgacaggcatcagcaatgctgcccaggccacagccagtgatgatgccagccagcaccagggcggcggcggcggggagctggcctatgccctgaacaactttgacaagcagatcatcgtggaccccctgtccttcagcgaggagcgcttccggcccagcctggaggagcggctggagagcatcatctctggagctgccctgatggctgacagcagctgcaccagagatgaccggcgggagcgcatcgtggctgaatgtaatgctgtgcggcaggccctgcaggacctgctgtctgagtacatgggaaatgccggcaggaaggagaggagtgatgccctgaacagcgccatcgacaagatgaccaagaagacccgggacctgcggcggcagctgaggaaggctgtgatggaccacgtgtctgacagcttcctggagaccaacgtgcccctgctggtgctgattgaggccgccaagaatggaaatgagaaggaggtgaaggagtatgcccaggtgttccgggagcacgccaacaagctgattgaggtggccaacctggcctgcagcatcagcaacaatgaggagggcgtgaagctggtgaggatgtctgccagccagctggaggccctgtgcccccaggtgatcaatgctgccctggccctggccgccaagccccagagcaagctggcccaggagaacatggacctcttcaaggagcagtgggagaagcaggtgcgggtgctgacagatgctgtggatgacatcaccagcattgatgacttcctggccgtgtctgagaaccacatcctggaggatgtgaacaagtgtgtgattgccctgcaggagaaggatgtggatggcctggacagaacagctggggccatccggggccgggccgcccgggtcatccacgtggtgaccagcgagatggacaactatgagcccggggtgtacacagagaaggtgctggaggccaccaagctgctgagcaacacagtgatgccccgcttcacagagcaggtggaggccgctgtggaggccctgagcagtgaccctgcccagcccatggatgaaaatgagttcattgatgccagccggctggtgtatgatggcatccgggacatcaggaaggctgtgctgatgatccgcaccccagaggagctggatgacagcgactttgaaacagaagattttgatgtgcgcagcaggacctctgtgcagacagaagatgaccagctgattgctggccagagcgcccgggccatcatggcccagctgccccaggagcagaaggccaagattgctgagcaggtggccagcttccaggaggagaagagcaagctggatgctgaggtgtccaagtgggatgattctggaaatgacatcatcgtgctggccaagcagatgtgcatgatcatgatggagatgacagacttcacccggggcaagggccccctgaagaacaccagtgatgtgatctctgctgccaagaagattgctgaggccggcagcaggatggacaagctgggccgcaccatcgctgaccactgcccagattctgcctgcaagcaggacctgctggcctacctgcagagaattgccctgtactgccaccagctgaacatctgcagcaaggtgaaggccgaggtgcagaacctgggcggggagctggtggtgtctggagtggacagcgccatgagcctcatccaggccgccaagaacctgatgaatgctgtggtgcagacagtgaaggccagctatgtggccagcaccaagtaccagaagagccagggcatggccagcctgaacctgcctgctgtgtcctggaagatgaaggcccctgagaagaagcccctggtgaagcgggagaagcaggatgagacccagaccaagatcaagagggccagccagaagaagcacgtgaaccctgtgcaggccctgtctgagttcaaggccatggacagcatctag

SEQ ID NO: 18857 - DNA, 357 bp, Artificial Sequence
  Description of Artificial Sequence: Synthetic coding sequence
atgacagctgtgcacgccggcaacatcaacttcaagtgggaccccaagagcctggagatccgcaccctggccgtggagcggctgctggagcccctggtgacccaggtgaccaccctggtgaacaccaacagcaagggccccagcaacaagaagaggggccgcagcaagaaggcccacgtgctggccgcctctgtggagcaggccacagagaacttcctggagaagggggacaagatcgccaaggagagccagttcctgaaggaggagctggtggccgctgtggaggatgtgaggaagcagggcgacctgatgaaggctgctgctggggagtttgctgatgacccctgcagcagctag

SEQ ID NO: 18858 - DNA, 420 bp, Artificial Sequence
  Description of Artificial Sequence: Synthetic coding sequence
atgacagctgtgcacgccggcaacatcaacttcaagtgggaccccaagagcctggagatccgcaccctggccgtggagcggctgctggagcccctggtgacccaggtgaccaccctggtgaacaccaacagcaagggccccagcaacaagaagaggggccgcagcaagaaggcccacgtgctggccgcctctgtggagcaggccacagagaacttcctggagaagggggacaagatcgccaaggagagccagttcctgaaggaggagctggtggccgctgtggaggatgtgaggaagcagggcgacctgatgaaggctgctgctggggagtttgctgatgacccctgcagctctgtgaagaggggcaacatggtgcgggccgcccgggccctgctgtctgctgtgacccggctgctgtag

SEQ ID NO: 18859 - DNA, 648 bp, Artificial Sequence
  Description of Artificial Sequence: Synthetic coding sequence
atgacagctgtgcacgccggcaacatcaacttcaagtgggaccccaagagcctggagatccgcaccctggccgtggagcggctgctggagcccctggtgacccaggtgaccaccctggtgaacaccaacagcaagggccccagcaacaagaagaggggccgcagcaagaaggcccacgtgctggccgcctctgtggagcaggccacagagaacttcctggagaagggggacaagatcgccaaggagagccagttcctgaaggaggagctggtggccgctgtggaggatgtgaggaagcagggcgacctgatgaaggctgctgctggggagtttgctgatgacccctgcagctctgtgaagaggggcaacatggtgcgggccgcccgggccctgctgtctgctgtgacccggctgctgatcctggccgacatggctgatgtgtacaagctgctggtgcagctgaaggtggtggaggatggcatcctgaagctgagaaatgctggaaatgagcaggacctgggcatccagtacaaggccctgaagccagaggtggacaagctgaacatcatggccgccaagaggcagcaggagctgaaggatgtgggccaccgggaccagatggctgctgcccggggcatcctgcagtag

SEQ ID NO: 18860 - DNA, 306 bp, Artificial Sequence
  Description of Artificial Sequence: Synthetic coding sequence
atgacagctgtgcacgccggcaacatcaacttcaagtgggaccccaagagcctggagatccgcaccctggccgtggagcggctgctggagcccctggtgacccaggtgaccaccctggtgaacaccaacagcaagggccccagcaacaagaagaggggccgcagcaagaaggcccacgtgctggccgcctctgtggagcaggccacagagaacttcctggagaagggggacaagatcgccaaggagagccagttcctgaaggaggagctggtggccgctgtggaggatgtgaggaagcagggctag

SEQ ID NO: 18861 - DNA, 372 bp, Artificial Sequence
  Description of Artificial Sequence: Synthetic coding sequence
atgacagctgtgcacgccggcaacatcaacttcaagtgggaccccaagagcctggagatccgcaccctggccgtggagcggctgctggagcccctggtgacccaggtgaccaccctggtgaacaccaacagcaagggccccagcaacaagaagaggggccgcagcaagaaggcccacgtgctggccgcctctgtggagcaggccacagagaacttcctggagaagggggacaagatcgccaaggagagccagttcctgaaggaggagctggtggccgctgtggaggatgtgaggaagcagggcgacctgatgaaggctgctgctggggagtttgctgatgacccctgcagctctgtgaagaggggcaactag

SEQ ID NO: 18862 - DNA, 471 bp, Artificial Sequence
  Description of Artificial Sequence: Synthetic coding sequence
atgacagctgtgcacgccggcaacatcaacttcaagtgggaccccaagagcctggagatccgcaccctggccgtggagcggctgctggagcccctggtgacccaggtgaccaccctggtgaacaccaacagcaagggccccagcaacaagaagaggggccgcagcaagaaggcccacgtgctggccgcctctgtggagcaggccacagagaacttcctggagaagggggacaagatcgccaaggagagccagttcctgaaggaggagctggtggccgctgtggaggatgtgaggaagcagggcgacctgatgaaggctgctgctggggagtttgctgatgacccctgcagctctgtgaagaggggcaacatggtgcgggccgcccgggccctgctgtctgctgtgacccggctgctgatcctggccgacatggctgatgtgtacaagctgctggtgcagctgaaggtgtag

SEQ ID NO: 18863 - DNA, 285 bp, Artificial Sequence
  Description of Artificial Sequence: Synthetic coding sequence
atgacagctgtgcacgccggcaacatcaacttcaagtgggaccccaagagcctggagatccgcaccctggccgtggagcggctgctggagcccctggtgacccaggtgaccaccctggtgaacaccaacagcaagggccccagcaacaagaagaggggccgcagcaagaaggcccacgtgctggccgcctctgtggagcaggccacagagaacttcctggagaagggggacaagatcgccaaggagagccagttcctgaaggaggagctggtggccgctgtgtag

SEQ ID NO: 18864 - DNA, 2790 bp, Artificial Sequence
  Description of Artificial Sequence: Synthetic coding sequence
atgacagctgtgcacgccggcaacatcaacttcaagtgggaccccaagagcctggagatccgcaccctggccgtggagcggctgctggagcccctggtgacccaggtgaccaccctggtgaacaccaacagcaagggccccagcaacaagaagaggggccgcagcaagaaggcccacgtgctggccgcctctgtggagcaggccacagagaacttcctggagaagggggacaagatcgccaaggagagccagttcctgaaggaggagctggtggccgctgtggaggatgtgaggaagcagggcgacctgatgaaggctgctgctggggagtttgctgatgacccctgcagctctgtgaagaggggcaacatggtgcgggccgcccgggccctgctgtctgctgtgacccggctgctgatcctggccgacatggctgatgtgtacaagctgctggtgcagctgaaggtggtggaggatggcatcctgaagctgagaaatgctggaaatgagcaggacctgggcatccagtacaaggccctgaagccagaggtggacaagctgaacatcatggccgccaagaggcagcaggagctgaaggatgtgggccaccgggaccagatggctgctgcccggggcatcctgcagaagaatgtgcccatcctgtacacagccagccaggcctgcctgcagcacccagatgtggccgcctacaaggccaacagagacctgatctacaagcagctgcagcaggccgtgacaggcatcagcaatgctgcccaggccacagccagtgatgatgccagccagcaccagggcggcggcggcggggagctggcctatgccctgaacaactttgacaagcagatcatcgtggaccccctgtccttcagcgaggagcgcttccggcccagcctggaggagcggctggagagcatcatcagcggggccgccctgatggctgacagcagctgcaccagagatgacagaagagaaagaattgtggccgagtgcaatgctgtgcggcaggccctgcaggacctgctgtctgagtacatgggaaatgccggcaggaaggagaggagtgatgccctgaacagcgccatcgacaagatgaccaagaagacccgggacctgcggcggcagctgaggaaggctgtgatggaccacgtgtctgacagcttcctggagaccaacgtgcccctgctggtgctgattgaagctgccaagaatggaaatgagaaggaggtgaaggagtatgcccaggtgttccgggagcacgccaacaagctgattgaggtggccaacctggcctgcagcatcagcaacaatgaggagggcgtgaagctggtgaggatgtctgccagccagctggaggccctgtgcccccaggtgatcaatgctgccctggccctggccgccaagccccagagcaagctggcccaggagaacatggacctcttcaaggagcagtgggagaagcaggtgcgggtgctgacagatgctgtggatgacatcaccagcattgatgacttcctggccgtgtctgagaaccacatcctggaggatgtgaacaagtgtgtgattgccctgcaggagaaggatgtggatggcctggacagaacagctggggccatccggggccgggccgcccgggtcatccacgtggtgaccagcgagatggacaactatgagcccggggtgtacacagagaaggtgctggaggccaccaagctgctgagcaacacagtgatgccccgcttcacagagcaggtggaggccgctgtggaggccctgagcagtgaccctgcccagcccatggatgaaaatgagttcattgatgccagccggctggtgtatgatggcatccgggacatcaggaaggctgtgctgatgatccgcaccccagaggagctggatgacagcgactttgaaacagaggactttgatgtgcgcagcaggacctctgtgcagacagaagatgaccagctgattgctggccagagcgcccgggccatcatggcccagctgccccaggagcagaaggccaagattgctgagcaggtggccagcttccaggaggagaagagcaagctggatgctgaggtgtccaagtgggatgacagcggaaatgacatcatcgtgctggccaagcagatgtgcatgatcatgatggagatgacagacttcacccggggcaagggccccctgaagaacaccagtgatgtgatctctgctgccaagaagattgctgaggccggcagcaggatggacaagctgggccgcaccatcgctgaccactgcccagacagcgcctgcaagcaggacctgctggcctacctgcagagaattgccctgtactgccaccagctgaacatctgcagcaaggtgaaggccgaggtgcagaacctgggcggggagctggtggtgtctggcaactgtgacacctgtggggccctgcagggcctgaagggctggcccccacccctgtgtgccacccactgggtggacagcgccatgagcctcatccaggccgccaagaacctgatgaatgctgtggtgcagacagtgaaggccagctatgtggccagcaccaagtaccagaagagccagggcatggccagcctgaacctgcctgctgtgtcctggaagatgaaggcccctgagaagaagcccctggtgaagcgggagaagcaggatgagacccagaccaagatcaagagggccagccagaagaagcacgtgaaccctgtgcaggccctgtctgagttcaaggccatggacagcatctag

SEQ ID NO: 18865 - DNA, 1611 bp, Artificial Sequence
  Description of Artificial Sequence: Synthetic coding sequence
atgaccaagaagacccgggacctgcggcggcagctgaggaaggctgtgatggaccacgtgtctgacagcttcctggagaccaacgtgcccctgctggtgctgattgaagctgccaagaatggaaatgagaaggaggtgaaggagtatgcccaggtgttccgggagcacgccaacaagctgattgaggtggccaacctggcctgcagcatcagcaacaatgaggagggcgtgaagctggtgaggatgtctgccagccagctggaggccctgtgcccccaggtgatcaatgctgccctggccctggccgccaagccccagagcaagctggcccaggagaacatggacctcttcaaggagcagtgggagaagcaggtgcgggtgctgacagatgctgtggatgacatcaccagcattgatgacttcctggccgtgtctgagaaccacatcctggaggatgtgaacaagtgtgtgattgccctgcaggagaaggatgtggatggcctggacagaacagctggggccatccggggccgggccgcccgggtcatccacgtggtgaccagcgagatggacaactatgagcccggggtgtacacagagaaggtgctggaggccaccaagctgctgagcaacacagtgatgccccgcttcacagagcaggtggaggccgctgtggaggccctgagcagtgaccctgcccagcccatggatgaaaatgagttcattgatgccagccggctggtgtatgatggcatccgggacatcaggaaggctgtgctgatgatccgcaccccagaggagctggatgacagcgactttgaaacagaggactttgatgtgcgcagcaggacctctgtgcagacagaagatgaccagctgattgctggccagagcgcccgggccatcatggcccagctgccccaggagcagaaggccaagattgctgagcaggtggccagcttccaggaggagaagagcaagctggatgctgaggtgtccaagtgggatgacagcggaaatgacatcatcgtgctggccaagcagatgtgcatgatcatgatggagatgacagacttcacccggggcaagggccccctgaagaacaccagtgatgtgatctctgctgccaagaagattgctgaggccggcagcaggatggacaagctgggccgcaccatcgctgaccactgcccagacagcgcctgcaagcaggacctgctggcctacctgcagagaattgccctgtactgccaccagctgaacatctgcagcaaggtgaaggccgaggtgcagaacctgggcggggagctggtggtgtctggagtggacagcgccatgagcctcatccaggccgccaagaacctgatgaatgctgtggtgcagacagtgaaggccagctatgtggccagcaccaagtaccagaagagccagggcatggccagcctgaacctgcctgctgtgtcctggaagatgaaggcccctgagaagaagcccctggtgaagcgggagaagcaggatgagacccagaccaagatcaagagggccagccagaagaagcacgtgaaccctgtgcaggccctgtctgagttcaaggccatggacagcatctag

SEQ ID NO: 18866 - DNA, 2676 bp, Artificial Sequence
  Description of Artificial Sequence: Synthetic coding sequence
atgacagctgtgcacgccggcaacatcaacttcaagtgggaccccaagagcctggagatccgcaccctggccgtggagcggctgctggagcccctggtgacccaggtgaccaccctggtgaacaccaacagcaagggccccagcaacaagaagaggggccgcagcaagaaggcccacgtgctggccgcctctgtggagcaggccacagagaacttcctggagaagggggacaagatcgccaaggagagccagttcctgaaggaggagctggtggccgctgtggaggatgtgaggaagcagggcgacctgatgaaggctgctgctggggagtttgctgatgacccctgcagctctgtgaagaggggcaacatggtgcgggccgcccgggccctgctgtctgctgtgacccggctgctgaaggtggtggaggatggcatcctgaagctgagaaatgctggaaatgagcaggacctgggcatccagtacaaggccctgaagccagaggtggacaagctgaacatcatggccgccaagaggcagcaggagctgaaggatgtgggccaccgggaccagatggccgccgcccggggcatcctgcagaagaatgtgcccatcctgtacacagccagccaggcctgcctgcagcacccagatgtggccgcctacaaggccaacagagacctgatctacaagcagctgcagcaggccgtgacaggcatcagcaatgctgcccaggccacagccagtgatgatgccagccagcaccagggcggcggcggcggggagctggcctatgccctgaacaactttgacaagcagatcatcgtggaccccctgtccttcagcgaggagcgcttccggcccagcctggaggagcggctggagagcatcatctctggagctgccctgatggctgacagcagctgcaccagagatgaccggcgggagcgcatcgtggctgaatgtaatgctgtgcggcaggccctgcaggacctgctgtctgagtacatgggaaatgccggcaggaaggagaggagtgatgccctgaacagcgccatcgacaagatgaccaagaagacccgggacctgcggcggcagctgaggaaggctgtgatggaccacgtgtctgacagcttcctggagaccaacgtgcccctgctggtgctgattgaggccgccaagaatggaaatgagaaggaggtgaaggagtatgcccaggtgttccgggagcacgccaacaagctgattgaggtggccaacctggcctgcagcatcagcaacaatgaggagggcgtgaagctggtgaggatgtctgccagccagctggaggccctgtgcccccaggtgatcaatgctgccctggccctggccgccaagccccagagcaagctggcccaggagaacatggacctcttcaaggagcagtgggagaagcaggtgcgggtgctgacagatgctgtggatgacatcaccagcattgatgacttcctggccgtgtctgagaaccacatcctggaggatgtgaacaagtgtgtgattgccctgcaggagaaggatgtggatggcctggacagaacagctggggccatccggggccgggccgcccgggtcatccacgtggtgaccagcgagatggacaactatgagcccggggtgtacacagagaaggtgctggaggccaccaagctgctgagcaacacagtgatgccccgcttcacagagcaggtggaggccgctgtggaggccctgagcagtgaccctgcccagcccatggatgaaaatgagttcattgatgccagccggctggtgtatgatggcatccgggacatcaggaaggctgtgctgatgatccgcaccccagaggagctggatgacagcgactttgaaacagaagattttgatgtgcgcagcaggacctctgtgcagacagaagatgaccagctgattgctggccagagcgcccgggccatcatggcccagctgccccaggagcagaaggccaagattgctgagcaggtggccagcttccaggaggagaagagcaagctggatgctgaggtgtccaagtgggatgattctggaaatgacatcatcgtgctggccaagcagatgtgcatgatcatgatggagatgacagacttcacccggggcaagggccccctgaagaacaccagtgatgtgatctctgctgccaagaagattgctgaggccggcagcaggatggacaagctgggccgcaccatcgctgaccactgcccagattctgcctgcaagcaggacctgctggcctacctgcagagaattgccctgtactgccaccagctgaacatctgcagcaaggtgaaggccgaggtgcagaacctgggcggggagctggtggtgtctggagtggacagcgccatgagcctcatccaggccgccaagaacctgatgaatgctgtggtgcagacagtgaaggccagctatgtggccagcaccaagtaccagaagagccagggcatggccagcctgaacctgcctgctgtgtcctggaagatgaaggcccctgagaagaagcccctggtgaagcgggagaagcaggatgagacccagaccaagatcaagagggccagccagaagaagcacgtgaaccctgtgcaggccctgtctgagttcaaggccatggacagcatctag

SEQ ID NO: 18867 - DNA, 2346 bp, Artificial Sequence
  Description of Artificial Sequence: Synthetic coding sequence
atggccacccaggccgacctgatggagctggacatggccatggagccagacaggaaggctgctgtgagccactggcagcagcagagctacctggacagcggcatccacagcggggccaccaccacagcccccagcctgtctggaaaaggaaatcctgaggaggaggatgtggacaccagccaggtgctgtatgagtgggagcagggcttcagccagagcttcacccaggagcaggtggccgacattgatggccagtatgccatgacccgggcccagagggtgcgggccgccatgtttcctgagaccctggatgagggcatgcagatccccagcacccagtttgatgctgcccaccccaccaacgtgcagaggctggccgagcccagccagatgctgaagcatgctgtggtgaacctgatcaactaccaggatgatgctgagctggccacccgggccatccctgagctgaccaagctgctgaatgatgaggaccaggtggtggtgaacaaggctgctgtgatggtgcaccagctgagcaagaaggaggccagcagacatgccatcatgaggagcccccagatggtgtctgccatcgtgaggaccatgcagaacaccaatgatgtggagacagcccgctgcacagctggcaccctgcacaacctgagccaccaccgggagggcctgctggccatcttcaagagcggcggcatcccagccctggtgaagatgctgggcagccctgtggacagcgtgctcttctacgccatcaccaccctgcacaacctgctgctgcaccaggagggcgccaagatggctgtgcggctggccggcggcctgcagaagatggtggccctgctgaacaagaccaacgtgaagttcctggccatcaccacagactgcctgcagatcctggcctacggcaaccaggagagcaagctgatcatcctggccagcggcggcccccaggccctggtgaacatcatgaggacctacacctatgagaagctgctgtggaccaccagccgggtgctgaaggtgctgtctgtgtgcagcagcaacaagccagccatcgtggaggccggcggcatgcaggccctgggcctgcacctgacagaccccagccagaggctggtgcagaactgcctgtggaccctgaggaacctgagtgatgctgccaccaagcaggagggcatggagggcctgctgggcaccctggtgcagctgctgggcagtgatgacatcaacgtggtgacctgtgccgccggcatcctgagcaacctgacctgcaacaactacaagaacaagatgatggtgtgccaggtgggcggcatcgaggccctggtgaggacagtgctgcgggccggggaccgggaggacatcacagagcccgccatctgtgccctgcggcacctgaccagccgccaccaggaggccgagatggcccagaatgctgtgcggctgcactacggcctgcctgtggtggtgaagctgctgcacccccccagccactggcccctcatcaaggccaccgtgggcctcatccggaacctggccctgtgcccagccaaccacgcccccctgcgggagcagggcgccatcccccggctggtgcagctgctggtgcgggcccaccaggacacccagaggaggacctccatgggcggcacccagcagcagtttgtggagggcgtgaggatggaggagatcgtggagggctgcaccggggccctgcacatcctggccagagatgtgcacaaccgcatcgtcatccggggcctgaacaccatccccctgtttgtgcagctgctgtacagccccatcgagaacatccagagggtggccgccggcgtgctgtgtgagctggcccaggacaaggaggccgctgaggccattgaagctgagggcgccacagcccccctgacagagctgctgcacagcagaaatgaaggagtggccacctatgctgctgctgtgctcttcaggatgtctgaggacaagccccaggactacaagaagaggctgtctgtggagctgaccagcagcctcttcagaacagagcccatggcctggaatgaaacagctgacctgggcctggacatcggggcccagggcgagcccctgggctaccggcaggatgaccccagctaccgctccttccacagcggcggctacggccaggatgccctgggcatggaccccatgatggagcacgagatgggcggccaccaccctggagctgactaccctgtggatggcctgcctgacctgggccacgcccaggacctgatggatggcctgcccccaggggacagcaaccagctggcctggtttgacacagacctgtag

SEQ ID NO: 18868 - DNA, 2346 bp, Artificial Sequence; identical to SEQ ID NO: 18867
  Description of Artificial Sequence: Synthetic coding sequence

SEQ ID NO: 18869 - DNA, 2346 bp, Artificial Sequence; identical to SEQ ID NO: 18867
  Description of Artificial Sequence: Synthetic coding sequence

SEQ ID NO: 18870 - DNA, 2346 bp, Artificial Sequence; identical to SEQ ID NO: 18867
  Description of Artificial Sequence: Synthetic coding sequence

SEQ ID NO: 18871 - DNA, 453 bp, Artificial Sequence
  Description of Artificial Sequence: Synthetic coding sequence
atggccacccaggccgacctgatggagctggacatggccatggagccagacaggaaggctgctgtgagccactggcagcagcagagctacctggacagcggcatccacagcggggccaccaccacagcccccagcctgtctggaaaaggaaatcctgaggaggaggatgtggacaccagccaggtgctgtatgagtgggagcagggcttcagccagagcttcacccaggagcaggtggccgacattgatggccagtatgccatgacccgggcccagagggtgcgggccgccatgtttcctgagaccctggatgagggcatgcagatccccagcacccagtttgatgctgcccaccccaccaacgtgcagaggctggccgagcccagccagatgctgaagcatgctgtggtgaacctgatcaactaccaggatgatgctgagctggccacctag

SEQ ID NO: 18872 - DNA, 42 bp, Artificial Sequence; identical to SEQ ID NO: 9896
  Description of Artificial Sequence: Synthetic coding sequence

SEQ ID NO: 18873 - DNA, 303 bp, Artificial Sequence
  Description of Artificial Sequence: Synthetic coding sequence
atggccacccaggccgacctgatggagctggacatggccatggagccagacaggaaggctgctgtgagccactggcagcagcagagctacctggacagcggcatccacagcggggccaccaccacagcccccagcctgtctggaaaaggaaatcctgaggaggaggatgtggacaccagccaggtgctgtatgagtgggagcagggcttcagccagagcttcacccaggagcaggtggccgacattgatggccagtatgccatgacccgggcccagagggtgcgggccgccatgttcccctag

SEQ ID NO: 18874 - DNA, 327 bp, Artificial Sequence
  Description of Artificial Sequence: Synthetic coding sequence
atggccacccaggccgacctgatggagctggacatggccatggagccagacaggaaggctgctgtgagccactggcagcagcagagctacctggacagcggcatccacagcggggccaccaccacagcccccagcctgtctggaaaaggaaatcctgaggaggaggatgtggacaccagccaggtgctgtatgagtgggagcagggcttcagccagagcttcacccaggagcaggtggccgacattgatggccagtatgccatgacccgggcccagagggtgcgggccgccatgtttcctgagaccctggatgagggcatgcagtag

SEQ ID NO: 18875 - DNA, 2325 bp, Artificial Sequence
  Description of Artificial Sequence: Synthetic coding sequence
atggagctggacatggccatggagccagacaggaaggctgctgtgagccactggcagcagcagagctacctggacagcggcatccacagcggggccaccaccacagcccccagcctgagcggcaagggcaaccctgaggaggaggatgtggacaccagccaggtgctgtatgagtgggagcagggcttcagccagagcttcacccaggagcaggtggccgacattgatggccagtatgccatgacccgggcccagagggtgcgggccgccatgtttcctgagaccctggatgagggcatgcagatccccagcacccagtttgatgctgcccaccccaccaacgtgcagaggctggccgagcccagccagatgctgaagcatgctgtggtgaacctgatcaactaccaggatgatgctgagctggccacccgggccatccctgagctgaccaagctgctgaatgatgaggaccaggtggtggtgaacaaggctgctgtgatggtgcaccagctgagcaagaaggaggccagcagacatgccatcatgaggagcccccagatggtgtctgccatcgtgaggaccatgcagaacaccaatgatgtggagacagcccgctgcacagctggcaccctgcacaacctgagccaccaccgggagggcctgctggccatcttcaagagcggcggcatcccagccctggtgaagatgctgggcagccctgtggacagcgtgctcttctacgccatcaccaccctgcacaacctgctgctgcaccaggagggcgccaagatggctgtgcggctggccggcggcctgcagaagatggtggccctgctgaacaagaccaacgtgaagttcctggccatcaccacagactgcctgcagatcctggcctacggcaaccaggagagcaagctgatcatcctggccagcggcggcccccaggccctggtgaacatcatgaggacctacacctatgagaagctgctgtggaccaccagccgggtgctgaaggtgctgtctgtgtgcagcagcaacaagccagccatcgtggaggccggcggcatgcaggccctgggcctgcacctgacagaccccagccagaggctggtgcagaactgcctgtggaccctgaggaacctgagtgatgctgccaccaagcaggagggcatggagggcctgctgggcaccctggtgcagctgctgggcagtgatgacatcaacgtggtgacctgtgccgccggcatcctgagcaacctgacctgcaacaactacaagaacaagatgatggtgtgccaggtgggcggcatcgaggccctggtgaggacagtgctgcgggccggggaccgggaggacatcacagagcccgccatctgtgccctgcggcacctgaccagccgccaccaggaggccgagatggcccagaatgctgtgcggctgcactacggcctgcctgtggtggtgaagctgctgcacccccccagccactggcccctcatcaaggccaccgtgggcctcatccggaacctggccctgtgcccagccaaccacgcccccctgcgggagcagggcgccatcccccggctggtgcagctgctggtgcgggcccaccaggacacccagaggaggacctccatgggcggcacccagcagcagtttgtggagggcgtgaggatggaggagatcgtggagggctgcacaggagccctgcacatcctggccagagatgtgcacaacagaattgtcatccggggcctgaacaccatccccctgtttgtgcagctgctgtacagccccatcgagaacatccagagggtggccgccggcgtgctgtgtgagctggcccaggacaaggaggccgctgaggccatcgaggccgagggcgccacagcccccctgacagagctgctgcacagcagaaatgaaggagtggccacctacgccgctgctgtgctcttcaggatgtctgaggacaagccccaggactacaagaagaggctgtctgtggagctgaccagcagcctcttcagaacagagcccatggcctggaatgaaacagctgacctgggcctggacattggagcccagggcgagcccctgggctaccggcaggatgaccccagctaccgctccttccacagcggcggctacggccaggatgccctgggcatggaccccatgatggagcacgagatgggcggccaccaccctggagctgactaccctgtggatggcctgcctgacctgggccacgcccaggacctgatggatggcctgcccccaggggacagcaaccagctggcctggtttgacacagacctgtag

SEQ ID NO: 18876 - DNA, 1020 bp, Artificial Sequence
  Description of Artificial Sequence: Synthetic coding sequence
atgtggcagctgtgggccagcctgtgctgcctgctggtgctggccaatgcccggagccggcccagcttccaccccctgagtgatgagctggtgaactacgtgaacaagaggaacaccacctggcaggccggccacaacttctacaacgtggacatgagctacctgaagaggctgtgtggcaccttcctgggcggccccaagccaccccagagggtgatgttcacagaggacctgaagctgcctgccagctttgatgcccgggagcagtggccccagtgccccaccatcaaggagatccgggaccagggcagctgtggcagctgctgggcctttggagctgtggaggccatcagtgaccgcatctgcatccacaccaatgcccacgtgtctgtggaggtgtctgctgaggacctgctgacctgctgcggctccatgtgtggagatggctgcaatggaggctacccagctgaggcctggaacttctggaccaggaagggcctggtgtctgggggcctgtatgagagccacgtgggctgccggccctacagcatccccccctgtgagcaccacgtgaatggcagccggcccccctgcacaggagagggggacacccccaagtgcagcaagatctgtgagcccggctacagccccacctacaagcaggacaagcactacggctacaacagctacagcgtgagcaacagcgagaaggacatcatggccgagatctacaagaatggacctgtggagggcgccttctctgtgtacagcgacttcctgctgtacaagagcggcgtgtaccagcacgtgactggagagatgatgggcggccacgccatccgcatcctgggctggggcgtggagaatggcaccccctactggctggtggccaacagctggaacacagactggggagacaatggcttcttcaagatcctgcggggccaggaccactgcggcattgaaagtgaggtggtggccggcatccccaggacagaccagtactgggagaagatctag

SEQ ID NO: 18877 - DNA, 1020 bp, Artificial Sequence; identical to SEQ ID NO: 18876
  Description of Artificial Sequence: Synthetic coding sequence

SEQ ID NO: 18878 - DNA, 333 bp, Artificial Sequence
  Description of Artificial Sequence: Synthetic coding sequence
atgtggcagctgtgggccagcctgtgctgcctgctggtgctggccaatgcccggagccggcccagcttccaccccctgagtgatgagctggtgaactacgtgaacaagaggaacaccacctggcaggccggccacaacttctacaacgtggacatgagctacctgaagaggctgtgtggcaccttcctgggcggccccaagccaccccagagggtgatgttcacagaggacctgaagctgcctgccagctttgatgcccgggagcagtggccccagtgccccaccatcaaggagatccgggaccagggcagctgtggcagctgctggctgtag

SEQ ID NO: 18879 - DNA, 1020 bp, Artificial Sequence; identical to SEQ ID NO: 18876
  Description of Artificial Sequence: Synthetic coding sequence

SEQ ID NO: 18880 - DNA, 1020 bp, Artificial Sequence; identical to SEQ ID NO: 18876
  Description of Artificial Sequence: Synthetic coding sequence

SEQ ID NO: 18881 - DNA, 1020 bp, Artificial Sequence; identical to SEQ ID NO: 18876
  Description of Artificial Sequence: Synthetic coding sequence

SEQ ID NO: 18882 - DNA, 1020 bp, Artificial Sequence; identical to SEQ ID NO: 18876
  Description of Artificial Sequence: Synthetic coding sequence

SEQ ID NO: 18883 - DNA, 1020 bp, Artificial Sequence; identical to SEQ ID NO: 18876
  Description of Artificial Sequence: Synthetic coding sequence

SEQ ID NO: 18884 - DNA, 1020 bp, Artificial Sequence; identical to SEQ ID NO: 18876
  Description of Artificial Sequence: Synthetic coding sequence

SEQ ID NO: 18885 - DNA, 831 bp, Artificial Sequence
  Description of Artificial Sequence: Synthetic coding sequence
atggacatgaacagaagagccagctgcctgctgcctgacctgtgtggccagggctggggctggaggctcttccctgccagctgtgcctacctgggctctgtgccctggagggtgtggggcctgggcggcctgctggcccccctggccgctgctgggggcggcagcaccagcggcctgggccacctgggcagcacccagtggagcggggagctggtggtgctgctgtctgaggtgttcatccggggctgcctcttcagctgcaatggaggctacccagctgaggcctggaacttctggaccaggaagggcctggtgtctgggggcctgtatgagagccacgtgggctgccggccctacagcatccccccctgtgagcaccacgtgaatggcagcaggcctccctgcaccggggagggggacacccccaagtgcagcaagatctgtgagcccggctacagccccacctacaagcaggacaagcactacggctacaacagctacagcgtgagcaacagcgagaaggacatcatggccgagatctacaagaatggacctgtggagggcgccttctctgtgtacagcgacttcctgctgtacaagtctggagtgtaccagcacgtgactggagagatgatgggcggccacgccatccgcatcctgggctggggcgtggagaatggcaccccctactggctggtggccaacagctggaacacagactggggagacaatggcttcttcaagatcctgcggggccaggaccactgcggcatcgagagcgaggtggtggccggcatccccaggacagaccagtactgggagaagatctag

SEQ ID NO: 18886 - DNA, 738 bp, Artificial Sequence
  Description of Artificial Sequence: Synthetic coding sequence
atgcctggggccggccccctgagcatcccctgcaggatgtcctgggcctttggagctgtggaggccatcagtgaccgcatctgcatccacaccaatgcccacgtgtctgtggaggtgtctgctgaggacctgctgacctgctgcggctccatgtgtggagatggctgcaatggaggctacccagctgaggcctggaacttctggaccaggaagggcctggtgtctgggggcctgtatgagagccacgtgggctgccggccctacagcatccccccctgtgagcaccacgtgaatggcagccggcccccctgcacaggagagggggacacccccaagtgcagcaagatctgtgagcccggctacagccccacctacaagcaggacaagcactacggctacaacagctacagcgtgagcaacagcgagaaggacatcatggccgagatctacaagaatggacctgtggagggcgccttctctgtgtacagcgacttcctgctgtacaagagcggcgtgtaccagcacgtgactggagagatgatgggcggccacgccatccgcatcctgggctggggcgtggagaatggcaccccctactggctggtggccaacagctggaacacagactggggagacaatggcttcttcaagatcctgcggggccaggaccactgcggcattgaaagtgaggtggtggccggcatccccaggacagaccagtactgggagaagatctag

SEQ ID NO: 18887 - DNA, 1239 bp, Artificial Sequence
  Description of Artificial Sequence: Synthetic coding sequence
atgcagcccagcagcctgctgcccctggccctgtgcctgctggccgccccagccagcgccctggtgcgcatccccctgcacaagttcaccagcatccggaggaccatgtctgaggtgggcggctctgtggaggacctgattgccaagggccctgtgtccaagtacagccaggccgtgcctgctgtgacagagggccccatccctgaggtgctgaagaactacatggatgcccagtactacggggagattggaattggcaccccaccccagtgcttcaccgtggtgtttgacaccggcagcagcaacctgtgggtgcccagcatccactgcaagctgctggacatcgcctgctggatccaccacaagtacaacagcgacaagagcagcacctacgtgaagaatggcaccagctttgacatccactacggcagcggcagcctgagcggctacctgagccaggacacagtgtctgtgccctgccagagcgccagcagcgccagcgccctgggcggcgtgaaggtggagcggcaggtgtttggagaggccaccaagcagcccggcatcaccttcatcgccgccaagtttgatggcatcctgggcatggcctacccccgcatctctgtgaacaacgtgctgcctgtgtttgacaacctgatgcagcagaagctggtggaccagaacatcttctccttctacctgagccgggaccctgatgcccagcctggaggagagctgatgctgggcggcacagacagcaagtactacaagggcagcctgagctacctgaatgtgaccaggaaggcctactggcaggtgcacctggaccaggtggaggtggccagcggcctgaccctgtgcaaggagggctgtgaggccatcgtggacaccggcaccagcctgatggtgggccctgtggatgaggtgcgggagctgcagaaggccatcggggctgtgcccctcatccagggcgagtacatgatcccctgtgagaaggtgtccaccctgcctgccatcaccctgaagctgggcggcaagggctacaagctgagccctgaggactacaccctgaaggtgtcccaggccggcaagaccctgtgcctgagcggcttcatgggcatggacatccccccaccttctggccccctgtggatcctgggagatgtgttcatcggccgctactacacagtgtttgaccgggacaacaacagagtgggctttgctgaggccgcccggctgtag

SEQ ID NO: 18888 - DNA, 1002 bp, Artificial Sequence
  Description of Artificial Sequence: Synthetic coding sequence
atgaaccccaccctcatcctggccgccttctgcctgggcatcgccagcgccaccctgacctttgaccacagcctggaggcccagtggaccaagtggaaggccatgcacaaccggctgtatggcatgaatgaggagggctggaggagagctgtgtgggagaagaacatgaagatgattgagctgcacaaccaggagtaccgggagggcaagcacagcttcaccatggccatgaatgccttcggggacatgaccagcgaggagttccggcaggtgatgaatggcttccagaacaggaagcccaggaagggcaaggtgttccaggagcccctcttctatgaggcccccaggtctgtggactggagggagaagggctacgtgacccctgtgaagaaccagggccagtgtggcagctgctgggccttcagcgccaccggggccctggagggccagatgttcaggaagacaggccgcctcatcagcctgtctgagcagaacctggtggactgcagcggcccccagggcaatgaaggctgcaatggaggcctgatggactatgccttccagtatgtgcaggacaatggaggcctggacagcgaggagagctacccctatgaggccacagaggagagctgcaagtacaaccccaagtacagcgtggccaatgacaccggctttgtggacatccccaagcaggagaaggccctgatgaaggctgtggccaccgtgggccccatctctgtggccattgatgctggccacgagagcttcctgttctacaaggagggcatctactttgagccagactgcagcagcgaggacatggaccacggcgtgctggtggtgggctacggctttgagagcacagaaagtgacaacaacaagtactggctggtgaagaacagctggggcgaggagtggggcatgggcggctacgtgaagatggccaaggacagaagaaaccactgcggcatcgccagcgctgccagctaccccaccgtgtag

SEQ ID NO: 18889 - DNA, 678 bp, Artificial Sequence
  Description of Artificial Sequence: Synthetic coding sequence
atgaaccccaccctcatcctggccgccttctgcctgggcatcgccagcgccaccctgacctttgaccacagcctggaggcccagtggaccaagtggaaggccatgcacaaccggctgtatggcatgaatgaggagggctggaggagagctgtgtgggagaagaacatgaagatgattgagctgcacaaccaggagtaccgggagggcaagcacagcttcaccatggccatgaatgccttcggggacatgaccagcgaggagttccggcaggtgatgaatggcttccagaacaggaagcccaggaagggcaaggtgttccaggagcccctcttctatgaggcccccaggtctgtggactggagggagaagggctacgtgacccctgtgaagaaccagggccagtgtggcagctgctgggccttcagcgccaccggggccctggagggccagatgttcaggaagacaggccgcctcatcagcctgtctgagcagaacctggtggactgcagcggcccccagggcaatgaaggctgcaatggaggcctgatggactatgccttccagtatgtgcaggacaatggaggcctggacagcgaggagagctacccctatgaggccaccgtgtctggggccccctgccaccacagcagcagcgccttcggccgctggaccctgtag

SEQ ID NO: 18890 - DNA, 1002 bp, Artificial Sequence; identical to SEQ ID NO: 18888
  Description of Artificial Sequence: Synthetic coding sequence

SEQ ID NO: 18891 - DNA, 120 bp, Artificial Sequence
  Description of Artificial Sequence: Synthetic coding sequence
atgaaccccaccctcatcctggccgccttctgcctgggcatcgccagcgccaccctgacctttgaccacagcctggaggcccagtggaccaagtggaaggccatgcacaaccggctgtag

SEQ ID NO: 18892 - DNA, 444 bp, Artificial Sequence
  Description of Artificial Sequence: Synthetic coding sequence
atggctgatgagctgtctgagaagcaggtgtatgatgcccacaccaaggagattgacctggtgaacagagaccccaagcacctgaatgatgatgtggtgaagattgactttgaagatgtgattgctgagcctgagggcacccacagctttgatggcatctggaaggccagcttcaccaccttcaccgtgaccaagtactggttctaccgcctgctgagcgccctgtttggcatccccatggccctgatctggggcatctactttgccatcctgtccttcctgcacatctgggccgtggtgccctgcatcaagagcttcctgattgagatccagtgcatcagccgggtgtacagcatctacgtgcacacagtgtgtgaccccctgtttgaagctgtgggcaagatcttcagcaatgtgcgcatcaacctgcagaaggagatctag

SEQ ID NO: 18893 - DNA, 444 bp, Artificial Sequence; identical to SEQ ID NO: 18892
  Description of Artificial Sequence: Synthetic coding sequence

SEQ ID NO: 18894 - DNA, 537 bp, Artificial Sequence
  Description of Artificial Sequence: Synthetic coding sequence
atgtctgggggcaagtatgtggacagcgagggccacctgtacacagtgcccatccgggagcagggcaacatctacaagcccaacaacaaggccatggctgatgagctgtctgagaagcaggtgtatgatgcccacaccaaggagattgacctggtgaacagagaccccaagcacctgaatgatgatgtggtgaagattgactttgaagatgtgattgctgagcctgagggcacccacagctttgatggcatctggaaggccagcttcaccaccttcaccgtgaccaagtactggttctaccgcctgctgagcgccctgtttggcatccccatggccctgatctggggcatctactttgccatcctgtccttcctgcacatctgggccgtggtgccctgcatcaagagcttcctgattgagatccagtgcatcagccgggtgtacagcatctacgtgcacacagtgtgtgaccccctgtttgaggccgtgggcaagatcttcagcaatgtgcgcatcaacctgcagaaggagatctag

SEQ ID NO: 18895 - DNA, 345 bp, Artificial Sequence
  Description of Artificial Sequence: Synthetic coding sequence
atggccggcggcaaggccggcaaggacagcggcaaggccaaggccaaggctgtgagccgcagccagagagctggcctgcagtttcctgtgggccgcatccaccgccacctgaagaccaggaccaccagccacggccgggtgggcgccacagctgctgtgtacagcgctgccatcctggagtacctgacagctgaggtgctggagctggccggaaatgccagcaaggacctgaaggtgaagaggatcacccccaggcacctgcagctggccatcagaggagatgaggagctggacagcctcatcaaggccaccatcgccggcggggagaagaggcgctgcagctag

SEQ ID NO: 18896 - DNA, 339 bp, Artificial Sequence
  Description of Artificial Sequence: Synthetic coding sequence
atgggcctggagacagagaaggcagatgtgcagctgttcatggatgatgacagctacagccaccacagcggcctggagtatgctgaccctgagaagtttgctgacagcgaccaggaccgggacccccaccggctgaacagccacctgaaggacttcaatgccttctgcaaggacctgcccaatggaagtgccttctctgctgacaacatggaggagtgtgaccgctgctaccactgcagcatcgtgtatgaaagaaggaccatgctgctcttctgccagcctgccacagagcccggcctgaacacctggaccccaggcctggagatcggcatcctgtag

SEQ ID NO: 18897 - DNA, 342 bp, Artificial Sequence
  Description of Artificial Sequence: Synthetic coding sequence
atgggcctggagacagagaaggcagatgtgcagctgttcatggatgatgacagctacagccaccacagcggcctggagtatgctgaccctgagaagtttgctgacagcgaccaggaccgggacccccaccggctgaacagccacctgaagctgggctttgaagatgtgattgctgagcctgtgaccacccacagctttgacaaggtgtggatctgcagccacgccctgtttgagatcagcaaatatgtgatgtacaagttcctgactgtgttcctggccatccccctggccttcatcgccggcatcctgtttgccaccctgagctgcctgcacatctggtag

SEQ ID NO: 18898 - DNA, 1038 bp, Artificial Sequence
  Description of Artificial Sequence: Synthetic coding sequence
atgcagaggctggtggcctgggaccctgcctgcctgcccctgcccccacctcctccagccttcaagtccatggaggtggccaacttctactatgaagctgactgcctggccgccgcctacggcggcaaggccgccccagctgcccctcctgctgcccggcccggcccccggcccccagctggggagctgggcagcatcggggaccacgagcgggccatcgacttcagcccctacctggagcccctgggcgccccccaggccccagccccagccacagccacagacacctttgaagctgcccccccagccccagccccagccccagccagcagcggccagcaccacgacttcctgagtgacctcttcagtgatgattatggaggcaagaactgcaagaagccagcagaatatggctacgtgtccctgggccgcctgggcgccgccaagggggccctgcaccctggctgctttgcccccctgcaccccccacctcctcctcctcctcctcctgctgagctgaaggccgagcccggctttgagcctgctgactgcaagaggaaggaggaggccggggcccctgggggcggggccggcatggctgctggcttcccctatgccctgcgggcctacctgggctaccaggccgtgcccagcggcagcagcggcagcctgagcaccagcagcagcagcagccccccaggcacccccagccctgcagatgccaaggccccacccacagcctgctacgccggggccgccccagcccccagccaggtgaagagcaaggccaagaagacagtggacaagcacagtgatgagtacaagatcagaagagagaggaacaacattgctgtgaggaagagccgggacaaggccaagatgaggaacctggagacccagcacaaggtgctggagctgacagcagaaaatgaaaggctgcagaagaaggtggagcagctgagccgggagctgagcaccctgaggaacctcttcaagcagctgcctgagcccctgctggccagcagcggccactgctag

SEQ ID NO: 18899 - DNA, 2184 bp, Artificial Sequence
  Description of Artificial Sequence: Synthetic coding sequence
atggagggagatgctgtggaggccatcgtggaggagagcgagaccttcatcaagggcaaggagaggaagacctaccagaggcggcgggagggcggccaggaggaggatgcctgccacctgccccagaaccagacagatggaggagaggtggtgcaggatgtgaacagctctgtgcagatggtgatgatggagcagctggaccccaccctgctgcagatgaagacagaggtgatggagggcaccgtggcccctgaggccgaggccgctgtggatgacacccagatcatcaccctgcaggtggtgaacatggaggagcagcccatcaacatcggggagctgcagctggtgcaggtgcctgtgcctgtgacagtgcctgtggccaccacctctgtggaggagctgcagggcgcctatgaaaatgaggtgtccaaggagggcctggccgagagcgagcccatgatctgccacaccctgcccctgcctgagggcttccaggtggtgaaggtgggcgccaacggggaggtggagaccctggagcagggcgagctgcccccccaggaggaccccagctggcagaaggaccctgactaccagcccccagccaagaagaccaagaagaccaagaagagcaagctgcgctacacagaggagggcaaggatgtggatgtgtctgtgtatgactttgaggaggagcagcaggagggcctgctgtctgaggtgaatgctgagaaggtggtgggcaacatgaagccacccaagcccaccaagatcaagaagaagggcgtgaagaagaccttccagtgtgagctgtgcagctacacctgccccaggaggagcaacctggacagacacatgaagagccacacagatgagcggccccacaagtgccacctgtgtggccgggccttcagaacagtgaccctgctgaggaaccacctgaacacccacacaggcacccggccccacaagtgcccagactgtgacatggcctttgtgaccagcggggagctggtgcgccaccggcgctacaagcacacccatgagaagcccttcaagtgcagcatgtgtgactatgcctctgtggaggtgtccaagctgaagaggcacatccgcagccacactggagagcggcccttccagtgcagcctgtgcagctatgccagccgggacacctacaagctgaagaggcacatgaggacccacagcggggagaagccctatgagtgctacatctgccacgcccgcttcacccagagcggcaccatgaagatgcacatcctgcagaagcacacagaaaatgtggccaagttccactgcccccactgtgacaccgtcatcgccaggaagagtgacctgggcgtgcacctgaggaagcagcacagctacatcgagcagggcaagaagtgccgctactgtgatgctgtgttccacgagagatatgccctgatccagcaccagaagagccacaagaatgagaagcgcttcaagtgtgaccagtgtgactatgcctgccggcaggagcggcacatgatcatgcacaagaggacccacactggagagaagccctatgcctgcagccactgtgacaagaccttccggcagaagcagctgctggacatgcacttcaagcgctaccatgaccccaactttgtgcctgctgcctttgtgtgcagcaaatgtgggaagaccttcaccaggaggaacaccatggcccggcatgctgacaactgtgccggcccagatggagtggagggggagaatggaggagagaccaagaagagcaagaggggcaggaagaggaagatgaggagcaagaaggaggacagcagtgacagtgaaaatgctgagccagacctggatgacaatgaagatgaggaggagcctgctgtggagattgagcctgagcctgagccccagcctgtgaccccagcccctcctccagccaagaagagaagaggccggcccccaggccgcaccaaccagcccaagcagaaccagcccacagccatcatccaggtggaggaccagaacacaggagccatcgagaacatcatcgtggaggtgaagaaggagccagatgctgagcctgctgagggggaggaggaggaggcccagcctgctgccacagatgccccaaatggagacctgaccccagagatgatcctgtccatgatggacagatag

SEQ ID NO: 18900 - DNA, 1200 bp, Artificial Sequence
  Description of Artificial Sequence: Synthetic coding sequence
atggcctttgtgaccagcggggagctggtgcgccaccggcgctacaagcacacccatgagaagcccttcaagtgcagcatgtgtgactatgcctctgtggaggtgtccaagctgaagaggcacatccgcagccacactggagagcggcccttccagtgcagcctgtgcagctatgccagccgggacacctacaagctgaagaggcacatgaggacccacagcggggagaagccctatgagtgctacatctgccacgcccgcttcacccagagcggcaccatgaagatgcacatcctgcagaagcacacagaaaatgtggccaagttccactgcccccactgtgacaccgtcatcgccaggaagagtgacctgggcgtgcacctgaggaagcagcacagctacatcgagcagggcaagaagtgccgctactgtgatgctgtgttccacgagagatatgccctgatccagcaccagaagagccacaagaatgagaagcgcttcaagtgtgaccagtgtgactatgcctgccggcaggagcggcacatgatcatgcacaagaggacccacactggagagaagccctatgcctgcagccactgtgacaagaccttccggcagaagcagctgctggacatgcacttcaagcgctaccatgaccccaactttgtgcctgctgcctttgtgtgcagcaaatgtgggaagaccttcaccaggaggaacaccatggcccggcatgctgacaactgtgccggcccagatggagtggagggggagaatggaggagagaccaagaagagcaagaggggcaggaagaggaagatgaggagcaagaaggaggacagcagtgacagtgaaaatgctgagccagacctggatgacaatgaagatgaggaggagcctgctgtggagattgagcctgagcctgagccccagcctgtgaccccagcccctcctccagccaagaagagaagaggccggcccccaggccgcaccaaccagcccaagcagaaccagcccacagccatcatccaggtggaggaccagaacacaggagccatcgagaacatcatcgtggaggtgaagaaggagccagatgctgagcctgctgagggggaggaggaggaggcccagcctgctgccacagatgccccaaatggagacctgaccccagagatgatcctgtccatgatggacagatag

SEQ ID NO: 18901 - DNA, 1128 bp, Artificial Sequence
  Description of Artificial Sequence: Synthetic coding sequence
atggagcgggccagctgcctgctgctgctgctgctgcccctggtgcacgtgtctgccaccaccccagagccctgtgagctggatgatgaggacttccgctgtgtgtgcaacttcagcgagccccagcctgactggagcgaggccttccagtgtgtgtctgctgtggaggtggagatccatgctgggggcctgaacctggagcccttcctgaagagggtggatgctgatgctgacccccggcagtatgctgacacagtgaaggccctgcgggtgcggcggctgactgtgggcgccgcccaggtgcctgcccagctgctggtgggcgccctgcgggtgctggcctacagccggctgaaggagctgaccctggaggacctgaagatcaccggcaccatgccacccctgcccctggaggccaccggcctggccctgagcagcctgcggctgagaaatgtgtcctgggccaccggccgctcctggctggccgagctgcagcagtggctgaagccaggcctgaaggtgctgagcatcgcccaggcccacagccctgccttcagctgtgagcaggtgcgggccttccctgccctgaccagcctggacctgagtgacaaccctggcctgggggagcggggcctgatggccgccctgtgcccccacaagtttcctgccatccagaacctggccctgaggaacacaggcatggagacccccaccggggtgtgtgccgccctggccgctgctggggtgcagccccacagcctggacctgagccacaacagcctgcgggccaccgtgaaccccagcgccccccgctgcatgtggagcagcgccctgaacagcctgaacctgagctttgctggcctggagcaggtgcccaagggcctgcctgccaagctgcgggtgctggacctgagctgcaaccggctgaacagagccccccagccagatgagctgcctgaggtggacaacctgaccctggatggcaaccccttcctggtgcccggcacagccctgccccatgagggctccatgaacagcggcgtggtgcctgcctgtgcccggagcaccctgtctgtgggcgtgtctggcaccctggtgctgctgcagggcgcccggggctttgcctag

SEQ ID NO: 18902 - DNA, 1128 bp, Artificial Sequence; identical to SEQ ID NO: 18901
  Description of Artificial Sequence: Synthetic coding sequence

SEQ ID NO: 18903 - DNA, 402 bp, Artificial Sequence
  Description of Artificial Sequence: Synthetic coding sequence
atgtccttcccctgcaagtttgtggccagcttcctgctgatcttcaacgtgagcagcaaaggagctgtgtccaaggagatcaccaatgccctggagacctggggcgccctgggccaggacatcaacctggacatccccagcttccagatgtctgatgacattgatgacatcaagtgggagaagaccagtgacaagaagaagatcgcccagttcaggaaggagaaggagaccttcaaggagaaggacacctacaagctgttcaagaatggcaccctgaagatcaagcacctgaagacagatgaccaggacatctacaaggtgtccatctatgacaccaagggcaagaatgtgctggagaagatctttgacctgaagatccagggcaaatgttccttcccctag

SEQ ID NO: 18904 - DNA, 1056 bp, Artificial Sequence
  Description of Artificial Sequence: Synthetic coding sequence
atgtccttcccctgcaagtttgtggccagcttcctgctgatcttcaacgtgagcagcaaaggagctgtgtccaaggagatcaccaatgccctggagacctggggcgccctgggccaggacatcaacctggacatccccagcttccagatgtctgatgacattgatgacatcaagtgggagaagaccagtgacaagaagaagatcgcccagttcaggaaggagaaggagaccttcaaggagaaggacacctacaagctgttcaagaatggcaccctgaagatcaagcacctgaagacagatgaccaggacatctacaaggtgtccatctatgacaccaagggcaagaatgtgctggagaagatctttgacctgaagatccaggagcgggtgtccaagcccaagatctcctggacctgcatcaacaccaccctgacctgtgaggtgatgaatggaacagatcctgagctgaacctgtaccaggacggcaagcacctgaagctgagccagagggtcatcacccacaagtggaccaccagcctgagcgccaagttcaagtgcacagctggcaacaaggtgtccaaggagagctctgtggagcctgtgtcctgcccagagaagggcctggacatctacctgatcatcggcatctgtggcggcggcagcctgctgatggtgtttgtggccctgctggtgttctacatcaccaagaggaagaagcagaggagcagaagaaatgatgaggagctggagacccgggcccaccgggtggccacagaggagcggggcaggaagccccaccagatcccagccagcaccccccagaacccagccaccagccagcaccccccacctcctcctggccacaggagccaggcccccagccacaggcctcctcctcctggccaccgggtgcagcaccagccccagaagaggcccccagcccccagcggcacccaggtgcaccagcagaagggcccccccctgccccggccccgggtgcagcccaagccccctcatggagctgctgagaacagcctgagccccagcagcaactag

SEQ ID NO: 18905 - DNA, 2544 bp, Artificial Sequence
  Description of Artificial Sequence: Synthetic coding sequence
atgcacctgctgggcccctggctgctgctgctggtgctggagtacctggccttcagtgacagcagcaagtgggtgtttgagcaccctgagaccctgtatgcctgggagggcgcctgtgtgtggatcccctgcacctaccgggccctggatggagacctggagagcttcatcctcttccacaaccctgagtacaacaagaacaccagcaagtttgatggcacccggctgtatgagagcaccaaggatggcaaggtgcccagcgagcagaagagggtgcagttcctgggggacaagaacaagaactgcaccctgagcatccaccctgtgcacctgaatgacagcggccagctgggcctgaggatggagagcaagacagagaagtggatggagcgcatccacctgaatgtgtctgagcggcccttccccccccacatccagctgcccccagagatccaggagagccaggaggtgaccctgacctgcctgctgaacttcagctgctacggctaccccatccagctgcagtggctgctggagggcgtgcccatgaggcaggccgctgtgaccagcaccagcctgaccatcaagtctgtgttcaccaggtctgagctgaagttcagcccccagtggagccaccacggcaagatcgtgacctgccagctgcaggatgctgatggcaagttcctgagcaatgacacagtgcagctgaatgtgaagcacacccccaagctggagatcaaggtgacccccagtgatgccatcgtgcgggagggggacagcgtgaccatgacctgtgaggtgagcagcagcaaccctgagtacaccaccgtgtcctggctgaaggatggcaccagcctgaagaagcagaacaccttcaccctgaacctgcgggaggtgaccaaggaccagagcggcaagtactgctgccaggtgtccaatgatgtgggccctggccgctctgaggaggtgttcctgcaggtgcagtatgcccctgagcccagcacagtgcagatcctgcacagccctgctgtggagggcagccaggtggagttcctgtgcatgagcctggccaaccccctgcccaccaactacacctggtaccacaacgggaaggagatgcagggccgcacagaggagaaggtgcacatccccaagatcctgccctggcatgctggcacctacagctgtgtggccgagaacatcctgggcaccggccagaggggccctggagctgagctggatgtgcagtacccacccaagaaggtgaccaccgtcatccagaaccccatgcccatccgggagggggacacagtgaccctgagctgcaactacaacagcagcaaccccagcgtgaccaggtatgagtggaagccccatggagcctgggaggagcccagcctgggcgtgctgaagatccagaatgtgggctgggacaacaccaccatcgcctgtgccgcctgcaacagctggtgctcctgggccagccctgtggccctgaatgtgcagtatgcccccagagatgtgcgggtgaggaagatcaagcccctgtctgagatccacagcggcaacagcgtgtccctgcagtgtgacttcagcagcagccaccccaaggaggtgcagttcttctgggagaagaatggccgcctgctgggcaaggagagccagctgaactttgacagcatcagcccagaagatgctggcagctacagctgctgggtgaacaacagcatcggccagacagccagcaaggcctggaccctggaggtgctgtatgccccccggcggctgcgggtgtccatgagccctggggaccaggtgatggagggcaagagcgccaccctgacctgtgagagtgatgccaacccccctgtgagccactacacctggtttgactggaacaaccagagcctgccctaccacagccagaagctgcggctggagcctgtgaaggtgcagcacagcggggcctactggtgccagggcaccaacagcgtgggcaagggccgcagccccctgagcaccctgactgtgtactacagccctgagaccatcggccggcgggtggccgtgggcctgggcagctgcctggccatcctgatcctggccatctgtggcctgaagctgcagaggcgctggaagaggacccagagccagcagggcctgcaggagaacagcagcggccagagcttctttgtgaggaacaagaaggtgcggcgggcccccctgtctgagggcccccacagcctgggctgctacaaccccatgatggaggatggcatctcctacaccaccctgcgcttccctgagatgaacatccccaggactggagatgctgagagcagcgagatgcagaggcctcctccagactgtgatgacacagtgacctacagcgccctgcacaagaggcaggtgggggactatgaaaatgtcatcccagacttcccagaagatgagggcatccactacagcgagctgatccagtttggagtgggggagcggccccaggcccaggagaatgtggactatgtgatcctgaagcactag

SEQ ID NO: 18906 - DNA, 1989 bp, Artificial Sequence
  Description of Artificial Sequence: Synthetic coding sequence
atggagagcaagacagagaagtggatggagcgcatccacctgaatgtgtctgagcggcccttccccccccacatccagctgcccccagagatccaggagagccaggaggtgaccctgacctgcctgctgaacttcagctgctacggctaccccatccagctgcagtggctgctggagggcgtgcccatgaggcaggccgctgtgaccagcaccagcctgaccatcaagtctgtgttcaccaggtctgagctgaagttcagcccccagtggagccaccacggcaagatcgtgacctgccagctgcaggatgctgatggcaagttcctgagcaatgacacagtgcagctgaatgtgaagcacacccccaagctggagatcaaggtgacccccagtgatgccatcgtgcgggagggggacagcgtgaccatgacctgtgaggtgagcagcagcaaccctgagtacaccaccgtgtcctggctgaaggatggcaccagcctgaagaagcagaacaccttcaccctgaacctgcgggaggtgaccaaggaccagagcggcaagtactgctgccaggtgtccaatgatgtgggccctggccgctctgaggaggtgttcctgcaggtgcagtatgcccctgagcccagcacagtgcagatcctgcacagccctgctgtggagggcagccaggtggagttcctgtgcatgagcctggccaaccccctgcccaccaactacacctggtaccacaacgggaaggagatgcagggccgcacagaggagaaggtgcacatccccaagatcctgccctggcatgctggcacctacagctgtgtggccgagaacatcctgggcaccggccagaggggccctggagctgagctggatgtgcagtacccacccaagaaggtgaccaccgtcatccagaaccccatgcccatccgggagggggacacagtgaccctgagctgcaactacaacagcagcaaccccagcgtgaccaggtatgagtggaagccccatggagcctgggaggagcccagcctgggcgtgctgaagatccagaatgtgggctgggacaacaccaccatcgcctgtgccgcctgcaacagctggtgctcctgggccagccctgtggccctgaatgtgcagtatgcccccagagatgtgcgggtgaggaagatcaagcccctgtctgagatccacagcggcaacagcgtgtccctgcagtgtgacttcagcagcagccaccccaaggaggtgcagttcttctgggagaagaatggccgcctgctgggcaaggagagccagctgaactttgacagcatcagcccagaagatgctggcagctacagctgctgggtgaacaacagcatcggccagacagccagcaaggcctggaccctggaggtgctgtatgccccccggcggctgcgggtgtccatgagccctggggaccaggtgatggagggcaagagcgccaccctgacctgtgagagtgatgccaacccccctgtgagccactacacctggtttgactggaacaaccagagcctgccctaccacagccagaagctgcggctggagcctgtgaaggtgcagcacagcggggcctactggtgccagggcaccaacagcgtgggcaagggccgcagccccctgagcaccctgactgtgtactacagccctgagaccatcggccggcgggtggccgtgggcctgggcagctgcctggccatcctgatcctggccatctgtggcctgaagctgcagaggagagatgctgagagcagcgagatgcagaggcctcctccagactgtgatgacacagtgacctacagcgccctgcacaagaggcaggtgggggactatgaaaatgtcatcccagacttcccagaagatgagggcatccactacagcgagctgatccagtttggagtgggggagcggccccaggcccaggagaatgtggactatgtgatcctgaagcactag

SEQ ID NO: 18907 - DNA, 2013 bp, Artificial Sequence
  Description of Artificial Sequence: Synthetic coding sequence
atgcacctgctgggcccctggctgctgctgctggtgctggagtacctggccttcagtgacagcagcaagtgggtgtttgagcaccctgagaccctgtatgcctgggagggcgcctgtgtgtggatcccctgcacctaccgggccctggatggagacctggagagcttcatcctcttccacaaccctgagtacaacaagaacaccagcaagtttgatggcacccggctgtatgagagcaccaaggatggcaaggtgcccagcgagcagaagagggtgcagttcctgggggacaagaacaagaactgcaccctgagcatccaccctgtgcacctgaatgacagcggccagctgggcctgaggatggagagcaagacagagaagtggatggagcgcatccacctgaatgtgtctgagcggcccttccccccccacatccagctgcccccagagatccaggagagccaggaggtgaccctgacctgcctgctgaacttcagctgctacggctaccccatccagctgcagtggctgctggagggcgtgcccatgaggcaggccgctgtgaccagcaccagcctgaccatcaagtctgtgttcaccaggtctgagctgaagttcagcccccagtggagccaccacggcaagatcgtgacctgccagctgcaggatgctgatggcaagttcctgagcaatgacacagtgcagctgaatgtgaagcacccccccaagaaggtgaccaccgtcatccagaaccccatgcccatccgggagggggacacagtgaccctgagctgcaactacaacagcagcaaccccagcgtgaccaggtatgagtggaagccccacggggcctgggaggagcccagcctgggcgtgctgaagatccagaatgtgggctgggacaacaccaccatcgcctgtgccgcctgcaacagctggtgctcctgggccagccctgtggccctgaatgtgcagtatgcccccagagatgtgcgggtgaggaagatcaagcccctgtctgagatccacagcggcaacagcgtgtccctgcagtgtgacttcagcagcagccaccccaaggaggtgcagttcttctgggagaagaatggccgcctgctgggcaaggagagccagctgaactttgacagcatcagcccagaagatgctggcagctacagctgctgggtgaacaacagcatcggccagacagccagcaaggcctggaccctggaggtgctgtatgccccccggcggctgcgggtgtccatgagccctggggaccaggtgatggagggcaagagcgccaccctgacctgtgagagtgatgccaacccccctgtgagccactacacctggtttgactggaacaaccagagcctgccctaccacagccagaagctgcggctggagcctgtgaaggtgcagcacagcggggcctactggtgccagggcaccaacagcgtgggcaagggccgcagccccctgagcaccctgactgtgtactacagccctgagaccatcggcagaagagtggccgtgggcctgggcagctgcctggccatcctgatcctggccatctgtggcctgaagctgcagaggcgctggaagaggacccagagccagcagggcctgcaggagaacagcagcggccagagcttctttgtgaggaacaagaaggtgagaagagcccccctgtctgagggcccccacagcctgggctgctacaaccccatgatggaggatggcatctcctacaccaccctgcgcttccctgagatgaacatccccaggactggagatgctgagagcagcgagatgcagaggcctcctccagactgtgatgacacagtgacctacagcgccctgcacaagaggcaggtgggggactatgaaaatgtcatcccagacttcccagaagatgagggcatccactacagcgagctgatccagtttggagtgggggagcggccccaggcccaggagaatgtggactatgtgatcctgaagcactag

SEQ ID NO: 18908 - DNA, 2028 bp, Artificial Sequence
  Description of Artificial Sequence: Synthetic coding sequence
atgagcctgtggctgctggagggcgtgcccatgaggcaggccgctgtgaccagcaccagcctgaccatcaagtctgtgttcaccaggtctgagctgaagttcagcccccagtggagccaccacggcaagatcgtgacctgccagctgcaggatgctgatggcaagttcctgagcaatgacacagtgcagctgaatgtgaagcacacccccaagctggagatcaaggtgacccccagtgatgccatcgtgcgggagggggacagcgtgaccatgacctgtgaggtgagcagcagcaaccctgagtacaccaccgtgtcctggctgaaggatggcaccagcctgaagaagcagaacaccttcaccctgaacctgcgggaggtgaccaaggaccagagcggcaagtactgctgccaggtgtccaatgatgtgggccctggccgctctgaggaggtgttcctgcaggtgcagtatgcccctgagcccagcacagtgcagatcctgcacagccctgctgtggagggcagccaggtggagttcctgtgcatgagcctggccaaccccctgcccaccaactacacctggtaccacaacgggaaggagatgcagggccgcacagaggagaaggtgcacatccccaagatcctgccctggcatgctggcacctacagctgtgtggccgagaacatcctgggcaccggccagaggggccctggagctgagctggatgtgcagtacccacccaagaaggtgaccaccgtcatccagaaccccatgcccatccgggagggggacacagtgaccctgagctgcaactacaacagcagcaaccccagcgtgaccaggtatgagtggaagccccatggagcctgggaggagcccagcctgggcgtgctgaagatccagaatgtgggctgggacaacaccaccatcgcctgtgccgcctgcaacagctggtgctcctgggccagccctgtggccctgaatgtgcagtatgcccccagagatgtgcgggtgaggaagatcaagcccctgtctgagatccacagcggcaacagcgtgtccctgcagtgtgacttcagcagcagccaccccaaggaggtgcagttcttctgggagaagaatggccgcctgctgggcaaggagagccagctgaactttgacagcatcagcccagaagatgctggcagctacagctgctgggtgaacaacagcatcggccagacagccagcaaggcctggaccctggaggtgctgtatgccccccggcggctgcgggtgtccatgagccctggggaccaggtgatggagggcaagagcgccaccctgacctgtgagagtgatgccaacccccctgtgagccactacacctggtttgactggaacaaccagagcctgccctaccacagccagaagctgcggctggagcctgtgaaggtgcagcacagcggggcctactggtgccagggcaccaacagcgtgggcaagggccgcagccccctgagcaccctgactgtgtactacagccctgagaccatcggccggcgggtggccgtgggcctgggcagctgcctggccatcctgatcctggccatctgtggcctgaagctgcagaggcgctggaagaggacccagagccagcagggcctgcaggagaacagcagcggccagagcttctttgtgaggaacaagaaggtgcggcgggcccccctgtctgagggcccccacagcctgggctgctacaaccccatgatggaggatggcatctcctacaccaccctgcgcttccctgagatgaacatccccaggactggagatgctgagagcagcgagatgcagaggcctcctccagactgtgatgacacagtgacctacagcgccctgcacaagaggcaggtgggggactatgaaaatgtcatcccagacttcccagaagatgagggcatccactacagcgagctgatccagtttggagtgggggagcggccccaggcccaggagaatgtggactatgtgatcctgaagcactag

SEQ ID NO: 18909 - DNA, 2280 bp, Artificial Sequence
  Description of Artificial Sequence: Synthetic coding sequence
atgcacctgctgggcccctggctgctgctgctggtgctggagtacctggccttcagtgacagcagcaagtgggtgtttgagcaccctgagaccctgtatgcctgggagggcgcctgtgtgtggatcccctgcacctaccgggccctggatggagacctggagagcttcatcctcttccacaaccctgagtacaacaagaacaccagcaagtttgatggcacccggctgtatgagagcaccaaggatggcaaggtgcccagcgagcagaagagggtgcagttcctgggggacaagaacaagaactgcaccctgagcatccaccctgtgcacctgaatgacagcggccagctgggcctgaggatggagagcaagacagagaagtggatggagcgcatccacctgaatgtgtctgagcggcccttccccccccacatccagctgcccccagagatccaggagagccaggaggtgaccctgacctgcctgctgaacttcagctgctacggctaccccatccagctgcagtggctgctggagggcgtgcccatgaggcaggccgctgtgaccagcaccagcctgaccatcaagtctgtgttcaccaggtctgagctgaagttcagcccccagtggagccaccacggcaagatcgtgacctgccagctgcaggatgctgatggcaagttcctgagcaatgacacagtgcagctgaatgtgaagcacacccccaagctggagatcaaggtgacccccagtgatgccatcgtgcgggagggggacagcgtgaccatgacctgtgaggtgagcagcagcaaccctgagtacaccaccgtgtcctggctgaaggatggcaccagcctgaagaagcagaacaccttcaccctgaacctgcgggaggtgaccaaggaccagagcggcaagtactgctgccaggtgtccaatgatgtgggccctggccgctctgaggaggtgttcctgcaggtgcagtacccacccaagaaggtgaccaccgtcatccagaaccccatgcccatccgggagggggacacagtgaccctgagctgcaactacaacagcagcaaccccagcgtgaccaggtatgagtggaagccccatggagcctgggaggagcccagcctgggcgtgctgaagatccagaatgtgggctgggacaacaccaccatcgcctgtgccgcctgcaacagctggtgctcctgggccagccctgtggccctgaatgtgcagtatgcccccagagatgtgcgggtgaggaagatcaagcccctgtctgagatccacagcggcaacagcgtgtccctgcagtgtgacttcagcagcagccaccccaaggaggtgcagttcttctgggagaagaatggccgcctgctgggcaaggagagccagctgaactttgacagcatcagcccagaagatgctggcagctacagctgctgggtgaacaacagcatcggccagacagccagcaaggcctggaccctggaggtgctgtatgccccccggcggctgcgggtgtccatgagccctggggaccaggtgatggagggcaagagcgccaccctgacctgtgagagtgatgccaacccccctgtgagccactacacctggtttgactggaacaaccagagcctgccctaccacagccagaagctgcggctggagcctgtgaaggtgcagcacagcggggcctactggtgccagggcaccaacagcgtgggcaagggccgcagccccctgagcaccctgactgtgtactacagccctgagaccatcggccggcgggtggccgtgggcctgggcagctgcctggccatcctgatcctggccatctgtggcctgaagctgcagaggcgctggaagaggacccagagccagcagggcctgcaggagaacagcagcggccagagcttctttgtgaggaacaagaaggtgcggcgggcccccctgtctgagggcccccacagcctgggctgctacaaccccatgatggaggatggcatctcctacaccaccctgcgcttccctgagatgaacatccccaggactggagatgctgagagcagcgagatgcagaggcctcctccagactgtgatgacacagtgacctacagcgccctgcacaagaggcaggtgggggactatgaaaatgtcatcccagacttcccagaagatgagggcatccactacagcgagctgatccagtttggagtgggggagcggccccaggcccaggagaatgtggactatgtgatcctgaagcactag

SEQ ID NO: 18910 - DNA, 2256 bp, Artificial Sequence
  Description of Artificial Sequence: Synthetic coding sequence
atgcacctgctgggcccctggctgctgctgctggtgctggagtacctggccttcagtgacagcagcaagtgggtgtttgagcaccctgagaccctgtatgcctgggagggcgcctgtgtgtggatcccctgcacctaccgggccctggatggagacctggagagcttcatcctcttccacaaccctgagtacaacaagaacaccagcaagtttgatggcacccggctgtatgagagcaccaaggatggcaaggtgcccagcgagcagaagagggtgcagttcctgggggacaagaacaagaactgcaccctgagcatccaccctgtgcacctgaatgacagcggccagctgggcctgaggatggagagcaagacagagaagtggatggagcgcatccacctgaatgtgtctgagcggcccttccccccccacatccagctgcccccagagatccaggagagccaggaggtgaccctgacctgcctgctgaacttcagctgctacggctaccccatccagctgcagtggctgctggagggcgtgcccatgaggcaggccgctgtgaccagcaccagcctgaccatcaagtctgtgttcaccaggtctgagctgaagttcagcccccagtggagccaccacggcaagatcgtgacctgccagctgcaggatgctgatggcaagttcctgagcaatgacacagtgcagctgaatgtgaagcacacccccaagctggagatcaaggtgacccccagtgatgccatcgtgcgggagggggacagcgtgaccatgacctgtgaggtgagcagcagcaaccctgagtacaccaccgtgtcctggctgaaggatggcaccagcctgaagaagcagaacaccttcaccctgaacctgcgggaggtgaccaaggaccagagcggcaagtactgctgccaggtgtccaatgatgtgggccctggccgctctgaggaggtgttcctgcaggtgcagtatgcccctgagcccagcacagtgcagatcctgcacagccctgctgtggagggcagccaggtggagttcctgtgcatgagcctggccaaccccctgcccaccaactacacctggtaccacaacgggaaggagatgcagggccgcacagaggagaaggtgcacatccccaagatcctgccctggcatgctggcacctacagctgtgtggccgagaacatcctgggcaccggccagaggggccctggagctgagctggatgtgcagtacccacccaagaaggtgaccaccgtcatccagaaccccatgcccatccgggagggggacacagtgaccctgagctgcaactacaacagcagcaaccccagcgtgaccaggtatgagtggaagccccatggagcctgggaggagcccagcctgggcgtgctgaagatccagaatgtgggctgggacaacaccaccatcgcctgtgccgcctgcaacagctggtgctcctgggccagccctgtggccctgaatgtgcagtatgcccccagagatgtgcgggtgaggaagatcaagcccctgtctgagatccacagcggcaacagcgtgtccctgcagtgtgacttcagcagcagccaccccaaggaggtgcagttcttctgggagaagaatggccgcctgctgggcaaggagagccagctgaactttgacagcatcagcccagaagatgctggcagctacagctgctgggtgaacaacagcatcggccagacagccagcaaggcctggaccctggaggtgctgtatgccccccggcggctgcgggtgtccatgagccctggggaccaggtgatggagggcaagagcgccaccctgacctgtgagagtgatgccaacccccctgtgagccactacacctggtttgactggaacaaccagagcctgccctaccacagccagaagctgcggctggagcctgtgaaggtgcagcacagcggggcctactggtgccagggcaccaacagcgtgggcaagggccgcagccccctgagcaccctgactgtgtactacagccctgagaccatcggccggcgggtggccgtgggcctgggcagctgcctggccatcctgatcctggccatctgtggcctgaagctgcagaggcgctggaagaggacccagagccagcagggcctgcaggagaacagcagcggccagagcttctttgtgaggaacaagaagcgctgccgggtgctgagagatgctgagaccagccctggcctgaggtag

SEQ ID NO: 18911 - DNA, 783 bp, Artificial Sequence
  Description of Artificial Sequence: Synthetic coding sequence
atggcccggccccacccctggtggctgtgtgtgctgggcaccctggtgggcctgagcgccaccccagcccccaagagctgcccagagcggcactactgggcccagggcaagctgtgctgccagatgtgtgagcccggcaccttcctggtgaaggactgtgaccagcacaggaaggccgcccagtgtgacccctgcatccctggggtgtccttctccccagaccaccacacccggccccactgtgagagctgccgccactgcaacagcggcctgctggtgaggaactgcaccatcacagccaatgcagaatgtgcctgcagaaatggctggcagtgccgggacaaggagtgcacagaatgtgaccccctgcccaaccccagcctgacagcccggagcagccaggccctgagcccccacccccagcccacccacctgccctacgtgtctgagatgctggaggccaggacagctggccacatgcagaccctggccgacttccggcagctgcctgcccggaccctgagcacccactggccaccccagaggagcctgtgcagcagtgacttcatccgcatcctggtgatcttcagcggcatgttcctggtgttcaccctggccggggccctcttcctgcaccagaggaggaagtaccgcagcaacaagggggagagccctgtggagcctgctgagccctgccactacagctgcccccgggaggaggagggcagcaccatccccatccaggaggactacaggaagccagagcccgcctgcagcccctag

SEQ ID NO: 18912 - DNA, 1158 bp, Artificial Sequence
  Description of Artificial Sequence: Synthetic coding sequence
atgctggtgcggcggggggcccgggccggccccaggatgccccggggctggacagccctgtgcctgctgagcctgctgcccagcggcttcatgagcctggacaacaacggcacagccaccccagagctgcccacccagggcaccttcagcaatgtgtccaccaacgtgtcctaccaggagaccaccacccccagcaccctgggcagcaccagcctgcaccctgtgtcccagcacggcaatgaggccaccaccaacatcacagagaccaccgtgaagttcaccagcaccagcgtcatcacctctgtgtatggcaacaccaacagctctgtgcagagccagaccagcgtcatcagcacagtgttcaccaccccagccaacgtgtccaccccagagaccaccctgaagcccagcctgagccctggaaatgtgtctgacctgagcaccaccagcaccagcctggccaccagccccaccaagccctacaccagcagcagccccatcctgagtgacatcaaggccgagatcaagtgcagcggcatccgggaggtgaagctgacccagggcatctgcctggagcagaacaagaccagcagctgtgccgagttcaagaaggacagaggagagggcctggcccgggtgctgtgtggggaggagcaggctgatgctgatgctggggcccaggtgtgcagcctgctgctggcccagagcgaggtgcggccccagtgcctgctgctggtgctggccaacagaacagagatcagcagcaagctgcagctgatgaagaagcaccagagcgacctgaagaagctgggcatcctggacttcacagagcaggatgtggccagccaccagagctacagccagaagaccctcatcgccctggtgaccagcggggccctgctggccgtgctgggcatcaccggctacttcctgatgaacagaagatcctggagccccaccggggagcggctgggggaggacccctactacacagaaaatggaggcggccagggctacagcagcggccctggcaccagccctgaggcccagggcaaggcctctgtgaacagaggagcccaggagaatggcaccggccaggccaccagcagaaatggccacagcgcccggcagcacgtggtggccgacacagagctgtag

SEQ ID NO: 18913 - DNA, 987 bp, Artificial Sequence
  Description of Artificial Sequence: Synthetic coding sequence
atgctggtgcggcggggggcccgggccggccccaggatgccccggggctggacagccctgtgcctgctgagcctgctgcccagcggcttcatgagcctggacaacaacggcacagccaccccagagctgcccacccagggcaccttcagcaatgtgtccaccaacgtgtcctaccaggagaccaccacccccagcaccctgggcagcaccagcctgcaccctgtgtcccagcacggcaatgaggccaccaccaacatcacagagaccaccgtgaagttcaccagcaccagcgtcatcacctctgtgtatggcaacaccaacagctctgtgcagagccagaccagcgtcatcagcacagtgttcaccaccccagccaacgtgtccaccccagagaccaccctgaagcccagcctgagccctggaaatgtgtctgacctgagcaccaccagcaccagcctggccaccagccccaccaagccctacaccagcagcagccccatcctgagtgacatcaaggccgagatcaagtgcagcggcatccgggaggtgaagctgacccagggcatctgcctggagcagaacaagaccagcagctgtgccgagttcaagaaggacagaggagagggcctggcccgggtgctgtgtggggaggagcaggctgatgctgatgctggggcccaggtgtgcagcctgctgctggcccagagcgaggtgcggccccagtgcctgctgctggtgctggccaacagaacagagatcagcagcaagctgcagctgatgaagaagcaccagagcgacctgaagaagctgggcatcctggacttcacagagcaggatgtggccagccaccagagctacagccagaagaccctcatcgccctggtgaccagcggggccctgctggccgtgctgggcatcaccggctacttcctgatgaacagaagatcctggagccccaccggggagcggctggagctggagccctag

SEQ ID NO: 18914 - DNA, 684 bp, Artificial Sequence
  Description of Artificial Sequence: Synthetic coding sequence
atggactttggacctggccgcctcttccgcttcttctcctactgtgtggtggcccacatccagctggccgtgttcttcttctctgtgggcatcctggagacccgcatcctgctggctgatggagctgagttcaagaaggacagaggagagggcctggcccgggtgctgtgtggggaggagcaggctgatgctgatgctggggcccaggtgtgcagcctgctgctggcccagagcgaggtgcggccccagtgcctgctgctggtgctggccaacagaacagagatcagcagcaagctgcagctgatgaagaagcaccagagcgacctgaagaagctgggcatcctggacttcacagagcaggatgtggccagccaccagagctacagccagaagaccctcatcgccctggtgaccagcggggccctgctggccgtgctgggcatcaccggctacttcctgatgaacagaagatcctggagccccaccggggagcggctgggggaggacccctactacacagaaaatggaggcggccagggctacagcagcggccctggcaccagccctgaggcccagggcaaggcctctgtgaacagaggagcccaggagaatggcaccggccaggccaccagcagaaatggccacagcgcccggcagcacgtggtggccgacacagagctgtag

SEQ ID NO: 18915 - DNA, 1068 bp, Artificial Sequence
  Description of Artificial Sequence: Synthetic coding sequence
atgagcctggacaacaacggcacagccaccccagagctgcccacccagggcaccttcagcaatgtgtccaccaacgtgtcctaccaggagaccaccacccccagcaccctgggcagcaccagcctgcaccctgtgtcccagcacggcaatgaggccaccaccaacatcacagagaccaccgtgaagttcaccagcaccagcgtcatcacctctgtgtatggcaacaccaacagctctgtgcagagccagaccagcgtcatcagcacagtgttcaccaccccagccaacgtgtccaccccagagaccaccctgaagcccagcctgagccctggaaatgtgtctgacctgagcaccaccagcaccagcctggccaccagccccaccaagccctacaccagcagcagccccatcctgagtgacatcaaggccgagatcaagtgcagcggcatccgggaggtgaagctgacccagggcatctgcctggagcagaacaagaccagcagctgtgccgagttcaagaaggacagaggagagggcctggcccgggtgctgtgtggggaggagcaggctgatgctgatgctggggcccaggtgtgcagcctgctgctggcccagagcgaggtgcggccccagtgcctgctgctggtgctggccaacagaacagagatcagcagcaagctgcagctgatgaagaagcaccagagcgacctgaagaagctgggcatcctggacttcacagagcaggatgtggccagccaccagagctacagccagaagaccctcatcgccctggtgaccagcggggccctgctggccgtgctgggcatcaccggctacttcctgatgaacagaagatcctggagccccaccggggagcggctgggggaggacccctactacacagaaaatggaggcggccagggctacagcagcggccctggcaccagccctgaggcccagggcaaggcctctgtgaacagaggagcccaggagaatggcaccggccaggccaccagcagaaatggccacagcgcccggcagcacgtggtggccgacacagagctgtag

SEQ ID NO: 18916 - DNA, 753 bp, Artificial Sequence
  Description of Artificial Sequence: Synthetic coding sequence
atgttcctgcagatgtaccccaccaagaagctgcagcacctggtgcccctggaggtgcctgcctgcaccctgtgcctgaacatggccatgaggccccagcagaccagccaggccgagatcaagtgcagcggcatccgggaggtgaagctgacccagggcatctgcctggagcagaacaagaccagcagctgtgccgagttcaagaaggacagaggagagggcctggcccgggtgctgtgtggggaggagcaggctgatgctgatgctggggcccaggtgtgcagcctgctgctggcccagagcgaggtgcggccccagtgcctgctgctggtgctggccaacagaacagagatcagcagcaagctgcagctgatgaagaagcaccagagcgacctgaagaagctgggcatcctggacttcacagagcaggatgtggccagccaccagagctacagccagaagaccctgattgccctggtgaccagcggggccctgctggccgtgctgggcatcaccggctacttcctgatgaacagaagatcctggagccccactggagagcggctgggggaggacccctactacacagaaaatggaggcggccagggctacagcagcggccctggcaccagccctgaggcccagggcaaggcctctgtgaacagaggagcccaggagaatggaacaggccaggccaccagcagaaatggccacagcgcccggcagcacgtggtggccgacacagagctgtag

SEQ ID NO: 18917 - DNA, 516 bp, Artificial Sequence
  Description of Artificial Sequence: Synthetic coding sequence
atggagcacagcaccttcctgagcggcctggtgctggccaccctgctgagccaggtgagccccttcaagatccccatcgaggagctggaggacagagtgtttgtgaactgcaacaccagcatcacctgggtggagggcaccgtgggcaccctgctgagtgacatcacccggctggacctgggcaagaggatcctggacccccggggcatctaccgctgcaatggaacagacatctacaaggacaaggagagcacagtgcaggtgcactacaggatgtgccagagctgtgtggagctggaccctgccaccgtggccggcatcatcgtgacagatgtgattgccaccctgctgctggccctgggcgtcttctgctttgctggccacgagaccggccgcctgagcggggctgctgacacccaggccctgctgagaaatgaccaggtgtaccagcccctgcgggacagagatgatgcccagtacagccacctgggcggcaactgggccaggaacaagtag

SEQ ID NO: 18918 - DNA, 384 bp, Artificial Sequence
  Description of Artificial Sequence: Synthetic coding sequence
atggagcacagcaccttcctgagcggcctggtgctggccaccctgctgagccaggtgagccccttcaagatccccatcgaggagctggaggacagagtgtttgtgaactgcaacaccagcatcacctgggtggagggcaccgtgggcaccctgctgagtgacatcacccggctggacctgggcaagaggatcctggacccccggggcatctaccgctgcaatggaacagacatctacaaggacaaggagagcacagtgcaggtgcactacagaacagctgacacccaggccctgctgagaaatgaccaggtgtaccagcccctgcgggacagagatgatgcccagtacagccacctgggcggcaactgggccaggaacaagtag

SEQ ID NO: 18919 - DNA, 1377 bp, Artificial Sequence
  Description of Artificial Sequence: Synthetic coding sequence
atgaacagaggagtgcccttccgccacctgctgctggtgctgcagctggccctgctgcctgctgccacccagggcaagaaggtggtgctgggcaagaagggggacacagtggagctgacctgcacagccagccagaagaagagcatccagttccactggaagaacagcaaccagatcaagatcctgggcaaccagggcagcttcctgaccaagggccccagcaagctgaatgacagagctgacagcagaagaagcctgtgggaccagggcaacttccccctcatcatcaagaacctgaagattgaggacagcgacacctacatctgtgaggtggaggaccagaaggaggaggtgcagctgctggtgtttggcctgacagccaacagcgacacccacctgctgcagggccagagcctgaccctgaccctggagagccccccaggcagcagccccagcgtgcagtgccgcagcccccggggcaagaacatccagggcggcaagaccctgtctgtgtcccagctggagctgcaggacagcggcacctggacctgcaccgtgctgcagaaccagaagaaggtggagttcaagattgatattgtggtgctggccttccagaaggccagcagcatcgtgtacaagaaggagggggagcaggtggagttctccttccccctggccttcaccgtggagaagctgactggaagtggagagctgtggtggcaggccgagcgggccagcagcagcaagtcctggatcacctttgacctgaagaacaaggaggtgtctgtgaagagggtgacccaggaccccaagctgcagatgggcaagaagctgcccctgcacctgaccctgccccaggccctgccccagtatgccggcagcggcaacctgaccctggccctggaggccaagacaggcaagctgcaccaggaggtgaacctggtggtgatgagggccacccagctgcagaagaacctgacctgtgaggtgtggggccccaccagccccaagctgatgctgagcctgaagctggagaacaaggaggccaaggtgtccaagcgggagaaggctgtgtgggtgctgaaccctgaggccggcatgtggcagtgcctgctgagtgacagcggccaggtgctgctggagagcaacatcaaggtgctgcccacctggagcacccctgtgcagcccatggccctgattgtgctgggcggcgtggccggcctgctgctcttcatcggcctgggcatcttcttctgtgtgcgctgccgccacagaagacggcaggccgagaggatgagccagatcaagaggctgctgtctgagaagaagacctgccagtgcccccaccgcttccagaagacctgcagccccatctag

SEQ ID NO: 18920 - DNA, 723 bp, Artificial Sequence
  Description of Artificial Sequence: Synthetic coding sequence
atgattgagacctacaaccagaccagccccaggtctgctgccaccggcctgcccatctccatgaagatcttcatgtacctgctgactgtgttcctgatcacccagatgattggcagcgccctgtttgctgtgtacctgcaccggcggctggacaagattgaagatgaaagaaacctgcatgaagattttgtgttcatgaagaccatccagcgctgcaacacaggagagaggagcctgagcctgctgaactgtgaggagatcaagagccagtttgagggctttgtgaaggacatcatgctgaacaaggaggagaccaagaaggagaacagctttgagatgcagaaggtgctgcagtgggccgagaagggctactacaccatgagcaacaacctggtgaccctggagaatggcaagcagctgactgtgaagaggcagggcctgtactacatctatgcccaggtgaccttctgcagcaaccgggaggccagcagccaggcccccttcatcgccagcctgtgcctgaagagccctggccgctttgagcgcatcctgctgcgggccgccaacacccacagcagcgccaagccctgtggccagcagagcatccacctgggcggcgtgtttgagctgcagcccggggcctctgtgtttgtgaatgtgacagaccccagccaggtgagccacggcaccggcttcaccagctttggcctgctgaagctgtag

SEQ ID NO: 18921 - DNA, 786 bp, Artificial Sequence
  Description of Artificial Sequence: Synthetic coding sequence
atgattgagacctacaaccagaccagccccaggtctgctgccaccggcctgcccatctccatgaagatcttcatgtacctgctgactgtgttcctgatcacccagatgattggcagcgccctgtttgctgtgtacctgcaccggcggctggacaagattgaagatgaaagaaacctgcatgaagattttgtgttcatgaagaccatccagcgctgcaacacaggagagaggagcctgagcctgctgaactgtgaggagatcaagagccagtttgagggctttgtgaaggacatcatgctgaacaaggaggagaccaagaaggagaacagctttgagatgcagaagggggaccagaacccccagattgctgcccacgtgatcagcgaggccagcagcaagaccacctctgtgctgcagtgggccgagaagggctactacaccatgagcaacaacctggtgaccctggagaatggcaagcagctgactgtgaagaggcagggcctgtactacatctatgcccaggtgaccttctgcagcaaccgggaggccagcagccaggcccccttcatcgccagcctgtgcctgaagagccctggccgctttgagcgcatcctgctgcgggccgccaacacccacagcagcgccaagccctgtggccagcagagcatccacctgggcggcgtgtttgagctgcagcccggggcctctgtgtttgtgaatgtgacagaccccagccaggtgtcccatggaacaggcttcaccagctttggcctgctgaagctgtag

SEQ ID NO: 18922 - DNA, 612 bp, Artificial Sequence
  Description of Artificial Sequence: Synthetic coding sequence
atggtgcggctgcccctgcagtgtgtgctgtggggctgcctgctgacagctgtgcaccctgagcccccaacagcctgccgggagaagcagtacctgatcaacagccagtgctgcagcctgtgccagcccggccagaagctggtgtctgactgcacagagttcacagaaacagagtgcctgccctgtggggagagcgagttcctggacacctggaaccgggagacccactgccaccagcacaagtactgtgaccccaacctgggcctgcgggtgcagcagaagggcaccagcgagacagacaccatctgcacctgtgaggagggctggcactgcaccagcgaggcctgtgagagctgtgtgctgcacaggagctgcagccctggctttggagtgaagcagatcgccaccggggtgtctgacaccatctgtgagccctgccctgtgggcttcttcagcaatgtgagcagcgcctttgagaagtgccacccctggaccaggagccctggcagcgctgagagccctggaggagacccccaccacctgcgggaccctgtgtgccaccccctgggcgccggcctgtaccagaagggcggccaggaggccaaccagtag

SEQ ID NO: 18923 - DNA, 786 bp, Artificial Sequence
  Description of Artificial Sequence: Synthetic coding sequence
ggccgcagccccctgcggacccgggacagagtgctgaccaactgggaggatggcctgactgtggcctatggagctgtgaagctgatccagagcctgagcctgcagcctgtgggctggcagcagaactggggcctgagcagcccccccaccatgctgctgcccagccgggcccagagccccacagagctgcccctggcccccctggccgagcccaacacaggctgcagcagcctgctgtcctggcacagcaccagaggagagctgcacctgtgggccctgggcctgggccagatgggcggcagcaaatgtggcagccccctgagccccctggcccccaccctggaggccctgcggcggccctggtgtggccagcagggcgccggcggcacccggggcatcagcacagatcctccttctggaaaaggaggccgggcctggggccgggaccccctgccccgggagggcctgctgcggggcacagctgccccagctgctggaggagacctgaccccctgcctgagccggccccccacccccagcaggaacccccggcgcagcatcttccccaccatcttcctggcccccaccctgctgctgcagtgccggcggctgtacatggatgccaacagaagccccaggaggatggccaagagggtggccagccagtgccggcgggacagcgaggccgcccccacccaggagtgtggccacgtgggcaagcaggccgtgggccagagggcctggtgctgctgctgctgcggcgtgcgggtgcggggctggcactag

SEQ ID NO: 18924 - DNA, 834 bp, Artificial Sequence
  Description of Artificial Sequence: Synthetic coding sequence
atggtgcggctgcccctgcagtgtgtgctgtggggctgcctgctgacagctgtgcaccctgagcccccaacagcctgccgggagaagcagtacctgatcaacagccagtgctgcagcctgtgccagcccggccagaagctggtgtctgactgcacagagttcacagaaacagagtgcctgccctgtggggagagcgagttcctggacacctggaaccgggagacccactgccaccagcacaagtactgtgaccccaacctgggcctgcgggtgcagcagaagggcaccagcgagacagacaccatctgcacctgtgaggagggctggcactgcaccagcgaggcctgtgagagctgtgtgctgcacaggagctgcagccctggctttggagtgaagcagatcgccaccggggtgtctgacaccatctgtgagccctgccctgtgggcttcttcagcaatgtgagcagcgcctttgagaagtgccacccctggaccagctgtgagaccaaggacctggtggtgcagcaggccggcaccaacaagacagatgtggtgtgtggcccccaggaccggctgcgggccctggtggtgatccccatcatcttcggcatcctgtttgccatcctgctggtgctggtgttcatcaagaaggtggccaagaagcccaccaacaaggccccccaccccaagcaggagccccaggagatcaacttcccagatgacctgcccggcagcaacacagctgcccctgtgcaggagaccctgcacggctgccagcctgtgacccaggaggatggcaaggagagccgcatctctgtgcaggagcggcagtag

SEQ ID NO: 18925 - DNA, 1086 bp, Artificial Sequence
  Description of Artificial Sequence: Synthetic coding sequence
atggacaagttctggtggcacgccgcctggggcctgtgcctggtgcccctgagcctggcccagattgacctgaacatcacctgccgctttgctggggtcttccacgtggagaagaatggccgctacagcatcagcaggacagaagctgctgacctgtgcaaggccttcaacagcaccctgcccaccatggcccagatggagaaggccctgagcatcggctttgagacctgccgctatggcttcatcgagggccacgtggtgatcccccgcatccaccccaacagcatctgtgccgccaacaacacaggagtgtacatcctgaccagcaacaccagccagtatgacacctactgcttcaatgccagcgcccccccagaggaggactgcacctctgtgacagacctgcccaatgcctttgatggccccatcaccatcaccatcgtgaacagagatggcaccaggtatgtgcagaagggggagtaccgcaccaaccctgaggacatctaccccagcaaccccacagatgatgatgtgagcagcggcagcagcagcgagaggagcagcaccagcggcggctacatcttctacaccttcagcacagtgcaccccatcccagatgaggacagcccctggatcacagacagcacagaccgcatcccagccacccgggaccaggacaccttccaccccagcggcggcagccacaccacccacggcagcgagagtgatggccacagccacggcagccaggagggcggggccaacaccaccagcggccccatccgcaccccccagatccctgagtggctgatcatcctggccagcctgctggccctggccctgatcctggccgtgtgcatcgctgtgaacagcagaagaagatgtggccagaagaagaagctggtgatcaacagcggaaatggagctgtggaggacaggaagcccagcggcctgaatggagaggccagcaagagccaggagatggtgcacctggtgaacaaggagagcagcgagaccccagaccagttcatgacagcagatgagaccaggaacctgcagaatgtggacatgaagattggagtgtag

SEQ ID NO: 18926 - DNA, 420 bp, Artificial Sequence
  Description of Artificial Sequence: Synthetic coding sequence
atggacaagttctggtggcacgccgcctggggcctgtgcctggtgcccctgagcctggcccagattgacctgaacatcacctgccgctttgctggggtcttccacgtggagaagaatggccgctacagcatcagcaggacagaagctgctgacctgtgcaaggccttcaacagcaccctgcccaccatggcccagatggagaaggccctgagcatcggctttgagacctgcagcctgcactgcagccagcagagcaagaaggtgtgggccgaggagaaggccagtgaccagcagtggcagtggagctgtggcggccagaaggccaagtggacccagaggcggggccagcaggtgtctggaaatggagccttcggggagcagggcgtggtgaggaacagcaggcctgtgtatgacagctag

SEQ ID NO: 18927 - DNA, 1023 bp, Artificial Sequence
  Description of Artificial Sequence: Synthetic coding sequence
atggacaagttctggtggcacgccgcctggggcctgtgcctggtgcccctgagcctggcccagattgacctgaacatcacctgccgctttgctggggtcttccacgtggagaagaatggccgctacagcatcagcaggacagaagctgctgacctgtgcaaggccttcaacagcaccctgcccaccatggcccagatggagaaggccctgagcatcggctttgagacctgccgctatggcttcatcgagggccacgtggtgatcccccgcatccaccccaacagcatctgtgccgccaacaacacaggagtgtacatcctgaccagcaacaccagccagtatgacacctactgcttcaatgccagcgcccccccagaggaggactgcacctctgtgacagacctgcccaatgcctttgatggccccatcaccatcaccatcgtgaacagagatggcaccaggtatgtgcagaagggggagtaccgcaccaaccctgaggacatctaccccagcaaccccacagatgatgatgtgagcagcggcagcagcagcgagaggagcagcaccagcggcggctacatcttctacaccttcagcacagtgcaccccatcccagatgaggacagcccctggatcacagacagcacagaccgcatcccagccaccaggcacagccacggcagccaggagggcggggccaacaccaccagcggccccatccgcaccccccagatccctgagtggctgatcatcctggccagcctgctggccctggccctgatcctggccgtgtgcatcgctgtgaacagcagaagaagatgtggccagaagaagaagctggtgatcaacagcggaaatggagctgtggaggacaggaagcccagcggcctgaatggagaggccagcaagagccaggagatggtgcacctggtgaacaaggagagcagcgagaccccagaccagttcatgacagcagatgagaccaggaacctgcagaatgtggacatgaagattggagtgtag

SEQ ID NO: 18928 - DNA, 1191 bp, Artificial Sequence
  Description of Artificial Sequence: Synthetic coding sequence
atggacaagttctggtggcacgccgcctggggcctgtgcctggtgcccctgagcctggcccagattgacctgaacatcacctgccgctttgctggggtcttccacgtggagaagaatggccgctacagcatcagcaggacagaagctgctgacctgtgcaaggccttcaacagcaccctgcccaccatggcccagatggagaaggccctgagcatcggctttgagacctgccgctatggcttcatcgagggccacgtggtgatcccccgcatccaccccaacagcatctgtgccgccaacaacacaggagtgtacatcctgaccagcaacaccagccagtatgacacctactgcttcaatgccagcgcccccccagaggaggactgcacctctgtgacagacctgcccaatgcctttgatggccccatcaccatcaccatcgtgaacagagatggcaccaggtatgtgcagaagggggagtaccgcaccaaccctgaggacatctaccccagcaaccccacagatgatgatgtgagcagcggcagcagcagcgagaggagcagcaccagcggcggctacatcttctacaccttcagcacagtgcaccccatcccagatgaggacagcccctggatcacagacagcacagaccgcatcccagccaccaacatggacagcagccacagcatcaccctgcagcccacagccaaccccaacacaggcctggtggaggacctggacagaacaggccccctgtccatgaccacccggcgggaccaggacaccttccaccccagcggcggcagccacaccacccacggcagcgagagtgatggccacagccacggcagccaggagggcggggccaacaccaccagcggccccatccgcaccccccagatccctgagtggctgatcatcctggccagcctgctggccctggccctgatcctggccgtgtgcatcgctgtgaacagcagaagaagatgtggccagaagaagaagctggtgatcaacagcggaaatggagctgtggaggacaggaagcccagcggcctgaatggagaggccagcaagagccaggagatggtgcacctggtgaacaaggagagcagcgagaccccagaccagttcatgacagcagatgagaccaggaacctgcagaatgtggacatgaagattggagtgtag

SEQ ID NO: 18929 - DNA, 2100 bp, Artificial Sequence
  Description of Artificial Sequence: Synthetic coding sequence
atggacaagttctggtggcacgccgcctggggcctgtgcctggtgcccctgagcctggcccagattgacctgaacatcacctgccgctttgctggggtcttccacgtggagaagaatggccgctacagcatcagcaggacagaagctgctgacctgtgcaaggccttcaacagcaccctgcccaccatggcccagatggagaaggccctgagcatcggctttgagacctgccgctatggcttcatcgagggccacgtggtgatcccccgcatccaccccaacagcatctgtgccgccaacaacacaggagtgtacatcctgaccagcaacaccagccagtatgacacctactgcttcaatgccagcgcccccccagaggaggactgcacctctgtgacagacctgcccaatgcctttgatggccccatcaccatcaccatcgtgaacagagatggcaccaggtatgtgcagaagggggagtaccgcaccaaccctgaggacatctaccccagcaaccccacagatgatgatgtgagcagcggcagcagcagcgagaggagcagcaccagcggcggctacatcttctacaccttcagcacagtgcaccccatcccagatgaggacagcccctggatcacagacagcacagaccgcatcccagccaccagcaccagcagcaacaccatctctgctggctgggagcccaatgaggagaatgaagatgagcgggacagacacctgtccttcagcggcagcggcattgatgatgatgaggacttcatcagcagcaccatcagcaccaccccccgggcctttgaccacaccaagcagaaccaggactggacccagtggaaccccagccacagcaaccctgaggtgctgctgcagaccaccaccaggatgacagatgtggacagaaatggcaccacagcctatgagggcaactggaaccctgaggcccaccccccactcatccaccacgagcaccacgaggaggaggagaccccccacagcaccagcaccatccaggccacccccagcagcaccacagaggagacagccacccagaaggagcagtggtttggaaaccgctggcatgagggctaccggcagacccccaaggaggacagccacagcaccactggaacagctgctgccagcgcccacaccagccaccccatgcagggccgcaccacccccagccctgaggacagctcctggacagacttcttcaaccccatcagccaccccatgggccggggccaccaggccggccgcaggatggacatggacagcagccacagcatcaccctgcagcccacagccaaccccaacacaggcctggtggaggacctggacagaacaggccccctgtccatgaccacccagcagagcaacagccagagcttcagcaccagccatgagggcctggaggaggacaaggaccaccccaccaccagcaccctgaccagcagcaacagaaatgatgtgactggaggaagaagagaccccaaccacagcgagggcagcaccaccctgctggagggctacaccagccactacccccacaccaaggagagcaggaccttcatccctgtgaccagcgccaagacaggcagctttggagtgacagctgtgacagtgggggacagcaacagcaatgtgaacagaagcctgagcggggaccaggacaccttccaccccagcggcggcagccacaccacccacggcagcgagagtgatggccacagccacggcagccaggagggcggggccaacaccaccagcggccccatccgcaccccccagatccctgagtggctgatcatcctggccagcctgctggccctggccctgatcctggccgtgtgcatcgctgtgaacagcagaagaagatgtggccagaagaagaagctggtgatcaacagcggaaatggagctgtggaggacaggaagcccagcggcctgaatggagaggccagcaagagccaggagatggtgcacctggtgaacaaggagagcagcgagaccccagaccagttcatgacagcagatgagaccaggaacctgcagaatgtggacatgaagattggagtgtag

SEQ ID NO: 18930 - DNA, 243 bp, Artificial Sequence
  Description of Artificial Sequence: Synthetic coding sequence
atggacaagttctggtggcacgccgcctggggcctgtgcctggtgcccctgagcctggcccagattgacctgaacatcacctgccgctttgctggggtcttccacgtggagaagaatggccgctacagcatcagcaggacagaagctgctgacctgtgcaaggccttcaacagcaccctgcccaccatggcccagatggagaaggccctgagcatcggctttgagacctgcagcagcacctag

SEQ ID NO: 18931 - DNA, 2229 bp, Artificial Sequence
  Description of Artificial Sequence: Synthetic coding sequence
atggacaagttctggtggcacgccgcctggggcctgtgcctggtgcccctgagcctggcccagattgacctgaacatcacctgccgctttgctggggtcttccacgtggagaagaatggccgctacagcatcagcaggacagaagctgctgacctgtgcaaggccttcaacagcaccctgcccaccatggcccagatggagaaggccctgagcatcggctttgagacctgccgctatggcttcatcgagggccacgtggtgatcccccgcatccaccccaacagcatctgtgccgccaacaacacaggagtgtacatcctgaccagcaacaccagccagtatgacacctactgcttcaatgccagcgcccccccagaggaggactgcacctctgtgacagacctgcccaatgcctttgatggccccatcaccatcaccatcgtgaacagagatggcaccaggtatgtgcagaagggggagtaccgcaccaaccctgaggacatctaccccagcaaccccacagatgatgatgtgagcagcggcagcagcagcgagaggagcagcaccagcggcggctacatcttctacaccttcagcacagtgcaccccatcccagatgaggacagcccctggatcacagacagcacagaccgcatcccagccaccaccctgatgagcaccagcgccacagccacagaaacagccaccaagaggcaggagacctgggactggttctcctggctgttcctgcccagcgagagcaagaaccacctgcacaccaccacccagatggccggcaccagcagcaacaccatctctgctggctgggagcccaatgaagaaaatgaagatgagcgggacagacacctgtccttcagcggcagcggcattgatgatgatgaggacttcatcagcagcaccatcagcaccaccccccgggcctttgaccacaccaagcagaaccaggactggacccagtggaaccccagccacagcaaccctgaggtgctgctgcagaccaccaccaggatgacagatgtggacagaaatggcaccacagcctatgagggcaactggaaccctgaggcccaccccccactcatccaccacgagcaccacgaggaggaggagaccccccacagcaccagcaccatccaggccacccccagcagcaccacagaggagacagccacccagaaggagcagtggtttggaaaccgctggcatgagggctaccggcagacccccaaggaggacagccacagcaccaccggcacagctgctgccagcgcccacaccagccaccccatgcagggccgcaccacccccagccctgaggacagctcctggacagacttcttcaaccccatcagccaccccatgggccggggccaccaggccggccgcaggatggacatggacagcagccacagcatcaccctgcagcccacagccaaccccaacacaggcctggtggaggacctggacagaacaggccccctgtccatgaccacccagcagagcaacagccagagcttcagcaccagccatgagggcctggaggaggacaaggaccaccccaccaccagcaccctgaccagcagcaacagaaatgatgtgactggaggccggcgggaccccaaccacagcgagggcagcaccaccctgctggagggctacaccagccactacccccacaccaaggagagcaggaccttcatccctgtgaccagcgccaagacaggcagctttggagtgacagctgtgacagtgggggacagcaacagcaatgtgaacagaagcctgagcggggaccaggacaccttccaccccagcggcggcagccacaccacccacggcagcgagagtgatggccacagccacggcagccaggagggcggggccaacaccaccagcggccccatccgcaccccccagatccctgagtggctgatcatcctggccagcctgctggccctggccctgatcctggccgtgtgcatcgctgtgaacagcagaagaagatgtggccagaagaagaagctggtgatcaacagcggaaatggagctgtggaggacaggaagcccagcggcctgaatggagaggccagcaagagccaggagatggtgcacctggtgaacaaggagagcagcgagaccccagaccagttcatgacagcagatgagaccaggaacctgcagaatgtggacatgaagattggagtgtag

SEQ ID NO: 18932 - DNA, 2145 bp, Artificial Sequence
  Description of Artificial Sequence: Synthetic coding sequence
atggacaagttctggtggcacgccgcctggggcctgtgcctggtgcccctgagcctggcccagattgacctgaacatcacctgccgctttgctggggtcttccacgtggagaagaatggccgctacagcatcagcaggacagaagctgctgacctgtgcaaggccttcaacagcaccctgcccaccatggcccagatggagaaggccctgagcatcggctttgagacctgccgctatggcttcatcgagggccacgtggtgatcccccgcatccaccccaacagcatctgtgccgccaacaacacaggagtgtacatcctgaccagcaacaccagccagtatgacacctactgcttcaatgccagcgcccccccagaggaggactgcacctctgtgacagacctgcccaatgcctttgatggccccatcaccatcaccatcgtgaacagagatggcaccaggtatgtgcagaagggggagtaccgcaccaaccctgaggacatctaccccagcaaccccacagatgatgatgtgagcagcggcagcagcagcgagaggagcagcaccagcggcggctacatcttctacaccttcagcacagtgcaccccatcccagatgaggacagcccctggatcacagacagcacagaccgcatcccagccaccaccctgatgagcaccagcgccacagccacagaaacagccaccaagaggcaggagacctgggactggttctcctggctgttcctgcccagcgagagcaagaaccacctgcacaccaccacccagatggccggcaccagcagcaacaccatctctgctggctgggagcccaatgaagaaaatgaagatgagcgggacagacacctgtccttcagcggcagcggcattgatgatgatgaggacttcatcagcagcaccatcagcaccaccccccgggcctttgaccacaccaagcagaaccaggactggacccagtggaaccccagccacagcaaccctgaggtgctgctgcagaccaccaccaggatgacagcagatgtggacagaaatggcaccacagcctatgagggcaactggaaccctgaggcccaccccccactcatccaccacgagcaccacgaggaggaggagaccccccacagcaccagcaccatccaggccacccccagcagcaccacagaggagacagccacccagaaggagcagtggtttggaaaccgctggcatgagggctaccggcagacccccaaggaggacagccacagcaccactggaacagctgctgccagcgcccacaccagccaccccatgcagggccgcaccacccccagccctgaggacagctcctggacagacttcttcaaccccatcagccaccccatgggccggggccaccaggccggccgcaggatggacatggacagcagccacagcatcaccctgcagcccacagccaaccccaacacaggcctggtggaggacctggacagaacaggccccctgtccatgaccaccaggaacagaaatgatgtgactggaggccggcgggaccccaaccacagcgagggcagcaccaccctgctggagggctacaccagccactacccccacaccaaggagagcaggaccttcatccctgtgaccagcgccaagacaggcagctttggagtgacagctgtgacagtgggggacagcaacagcaatgtgaacagaagcctgagcggggaccaggacaccttccaccccagcggcggcagccacaccacccacggcagcgagagtgatggccacagccacggcagccaggagggcggggccaacaccaccagcggccccatccgcaccccccagatccctgagtggctgatcatcctggccagcctgctggccctggccctgatcctggccgtgtgcatcgctgtgaacagcagaagaagatgtggccagaagaagaagctggtgatcaacagcggaaatggagctgtggaggacaggaagcccagcggcctgaatggagaggccagcaagagccaggagatggtgcacctggtgaacaaggagagcagcgagaccccagaccagttcatgacagcagatgagaccaggaacctgcagaatgtggacatgaagattggagtgtag

SEQ ID NO: 18933 - DNA, 1482 bp, Artificial Sequence
  Description of Artificial Sequence: Synthetic coding sequence
atggacaagttctggtggcacgccgcctggggcctgtgcctggtgcccctgagcctggcccagattgacctgaacatcacctgccgctttgctggggtcttccacgtggagaagaatggccgctacagcatcagcaggacagaagctgctgacctgtgcaaggccttcaacagcaccctgcccaccatggcccagatggagaaggccctgagcatcggctttgagacctgccgctatggcttcatcgagggccacgtggtgatcccccgcatccaccccaacagcatctgtgccgccaacaacacaggagtgtacatcctgaccagcaacaccagccagtatgacacctactgcttcaatgccagcgcccccccagaggaggactgcacctctgtgacagacctgcccaatgcctttgatggccccatcaccatcaccatcgtgaacagagatggcaccaggtatgtgcagaagggggagtaccgcaccaaccctgaggacatctaccccagcaaccccacagatgatgatgtgagcagcggcagcagcagcgagaggagcagcaccagcggcggctacatcttctacaccttcagcacagtgcaccccatcccagatgaggacagcccctggatcacagacagcacagaccgcatcccagccaccaacatggacagcagccacagcatcaccctgcagcccacagccaaccccaacacaggcctggtggaggacctggacagaacaggccccctgtccatgaccacccagcagagcaacagccagagcttcagcaccagccatgagggcctggaggaggacaaggaccaccccaccaccagcaccctgaccagcagcaacagaaatgatgtgactggaggaagaagagaccccaaccacagcgagggcagcaccaccctgctggagggctacaccagccactacccccacaccaaggagagcaggaccttcatccctgtgaccagcgccaagacaggcagctttggagtgacagctgtgacagtgggggacagcaacagcaatgtgaacagaagcctgagcggggaccaggacaccttccaccccagcggcggcagccacaccacccacggcagcgagagtgatggccacagccacggcagccaggagggcggggccaacaccaccagcggccccatccgcaccccccagatccctgagtggctgatcatcctggccagcctgctggccctggccctgatcctggccgtgtgcatcgctgtgaacagcagaagaagatgtggccagaagaagaagctggtgatcaacagcggaaatggagctgtggaggacaggaagcccagcggcctgaatggagaggccagcaagagccaggagatggtgcacctggtgaacaaggagagcagcgagaccccagaccagttcatgacagcagatgagaccaggaacctgcagaatgtggacatgaagattggagtgtag

SEQ ID NO: 18934 - DNA, 1290 bp, Artificial Sequence
  Description of Artificial Sequence: Synthetic coding sequence
atggacaagttctggtggcacgccgcctggggcctgtgcctggtgcccctgagcctggcccagattgacctgaacatcacctgccgctttgctggggtcttccacgtggagaagaatggccgctacagcatcagcaggacagaagctgctgacctgtgcaaggccttcaacagcaccctgcccaccatggcccagatggagaaggccctgagcatcggctttgagacctgccgctatggcttcatcgagggccacgtggtgatcccccgcatccaccccaacagcatctgtgccgccaacaacacaggagtgtacatcctgaccagcaacaccagccagtatgacacctactgcttcaatgccagcgcccccccagaggaggactgcacctctgtgacagacctgcccaatgcctttgatggccccatcaccatcaccatcgtgaacagagatggcaccaggtatgtgcagaagggggagtaccgcaccaaccctgaggacatctaccccagcaaccccacagatgatgatgtgagcagcggcagcagcagcgagaggagcagcaccagcggcggctacatcttctacaccttcagcacagtgcaccccatcccagatgaggacagcccctggatcacagacagcacagaccgcatcccagccaccaacagaaatgatgtgactggaggaagaagagaccccaaccacagcgagggcagcaccaccctgctggagggctacaccagccactacccccacaccaaggagagcaggaccttcatccctgtgaccagcgccaagacaggcagctttggagtgacagctgtgacagtgggggacagcaacagcaatgtgaacagaagcctgagcggggaccaggacaccttccaccccagcggcggcagccacaccacccacggcagcgagagtgatggccacagccacggcagccaggagggcggggccaacaccaccagcggccccatccgcaccccccagatccctgagtggctgatcatcctggccagcctgctggccctggccctgatcctggccgtgtgcatcgctgtgaacagcagaagaagatgtggccagaagaagaagctggtgatcaacagcggaaatggagctgtggaggacaggaagcccagcggcctgaatggagaggccagcaagagccaggagatggtgcacctggtgaacaaggagagcagcgagaccccagaccagttcatgacagcagatgagaccaggaacctgcagaatgtggacatgaagattggagtgtag

SEQ ID NO: 18935 - DNA, 2025 bp, Artificial Sequence
  Description of Artificial Sequence: Synthetic coding sequence
atggacaagttctggtggcacgccgcctggggcctgtgcctggtgcccctgagcctggcccagattgacctgaacatcacctgccgctttgctggggtcttccacgtggagaagaatggccgctacagcatcagcaggacagaagctgctgacctgtgcaaggccttcaacagcaccctgcccaccatggcccagatggagaaggccctgagcatcggctttgagacctgccgctatggcttcatcgagggccacgtggtgatcccccgcatccaccccaacagcatctgtgccgccaacaacacaggagtgtacatcctgaccagcaacaccagccagtatgacacctactgcttcaatgccagcgcccccccagaggaggactgcacctctgtgacagacctgcccaatgcctttgatggccccatcaccatcaccatcgtgaacagagatggcaccaggtatgtgcagaagggggagtaccgcaccaaccctgaggacatctaccccagcaaccccacagatgatgatgtgagcagcggcagcagcagcgagaggagcagcaccagcggcggctacatcttctacaccttcagcacagtgcaccccatcccagatgaggacagcccctggatcacagacagcacagaccgcatcccagccaccaccctgatgagcaccagcgccacagccacagaaacagccaccaagaggcaggagacctgggactggttctcctggctgttcctgcccagcgagagcaagaaccacctgcacaccaccacccagatggccggcaccagcagcaacaccatctctgctggctgggagcccaatgaagaaaatgaagatgagcgggacagacacctgtccttcagcggcagcggcattgatgatgatgaggacttcatcagcagcaccatcagcaccaccccccgggcctttgaccacaccaagcagaaccaggactggacccagtggaaccccagccacagcaaccctgaggtgctgctgcagaccaccaccaggatgacagatgtggacagaaatggcaccacagcctatgagggcaactggaaccctgaggcccaccccccactcatccaccacgagcaccacgaggaggaggagaccccccacagcaccagcaccatccaggccacccccagcagcaccacagaggagacagccacccagaaggagcagtggtttggaaaccgctggcatgagggctaccggcagacccccaaggaggacagccacagcaccaccggcacagctgctgccagcgcccacaccagccaccccatgcagggccgcaccacccccagccctgaggacagctcctggacagacttcttcaaccccatcagccaccccatgggccggggccaccaggccggccgcaggatggacatggacagcagccacagcatcaccctgcagcccacagccaaccccaacacaggcctggtggaggacctggacagaacaggccccctgtccatgaccacccagcagagcaacagccagagcttcagcaccagccatgagggcctggaggaggacaaggaccaccccaccaccagcaccctgaccagcagccgggaccaggacaccttccaccccagcggcggcagccacaccacccacggcagcgagagtgatggccacagccacggcagccaggagggcggggccaacaccaccagcggccccatccgcaccccccagatccctgagtggctgatcatcctggccagcctgctggccctggccctgatcctggccgtgtgcatcgctgtgaacagcagaagaagatgtggccagaagaagaagctggtgatcaacagcggaaatggagctgtggaggacaggaagcccagcggcctgaatggagaggccagcaagagccaggagatggtgcacctggtgaacaaggagagcagcgagaccccagaccagttcatgacagcagatgagaccaggaacctgcagaatgtggacatgaagattggagtgtag

SEQ ID NO: 18936 - DNA, 2100 bp, Artificial Sequence
  Description of Artificial Sequence: Synthetic coding sequence
atggacaagttctggtggcacgccgcctggggcctgtgcctggtgcccctgagcctggcccagattgacctgaacatcacctgccgctttgctggggtcttccacgtggagaagaatggccgctacagcatcagcaggacagaagctgctgacctgtgcaaggccttcaacagcaccctgcccaccatggcccagatggagaaggccctgagcatcggctttgagacctgccgctatggcttcatcgagggccacgtggtgatcccccgcatccaccccaacagcatctgtgccgccaacaacacaggagtgtacatcctgaccagcaacaccagccagtatgacacctactgcttcaatgccagcgcccccccagaggaggactgcacctctgtgacagacctgcccaatgcctttgatggccccatcaccatcaccatcgtgaacagagatggcaccaggtatgtgcagaagggggagtaccgcaccaaccctgaggacatctaccccagcaaccccacagatgatgatgtgagcagcggcagcagcagcgagaggagcagcaccagcggcggctacatcttctacaccttcagcacagtgcaccccatcccagatgaggacagcccctggatcacagacagcacagaccgcatcccagccaccaccctgatgagcaccagcgccacagccacagaaacagccaccaagaggcaggagacctgggactggttctcctggctgttcctgcccagcgagagcaagaaccacctgcacaccaccacccagatggccggcaccagcagcaacaccatctctgctggctgggagcccaatgaagaaaatgaagatgagcgggacagacacctgtccttcagcggcagcggcattgatgatgatgaggacttcatcagcagcaccatcagcaccaccccccgggcctttgaccacaccaagcagaaccaggactggacccagtggaaccccagccacagcaaccctgaggtgctgctgcagaccaccaccaggatgacagatgtggacagaaatggcaccacagcctatgagggcaactggaaccctgaggcccaccccccactcatccaccacgagcaccacgaggaggaggagaccccccacagcaccagcaccacagccagcgcccacaccagccaccccatgcagggccgcaccacccccagccctgaggacagctcctggacagacttcttcaaccccatcagccaccccatgggccggggccaccaggccggccgcaggatggacatggacagcagccacagcatcaccctgcagcccacagccaaccccaacacaggcctggtggaggacctggacagaacaggccccctgtccatgaccacccagcagagcaacagccagagcttcagcaccagccatgagggcctggaggaggacaaggaccaccccaccaccagcaccctgaccagcagcaacagaaatgatgtgactggaggaagaagagaccccaaccacagcgagggcagcaccaccctgctggagggctacaccagccactacccccacaccaaggagagcaggaccttcatccctgtgaccagcgccaagacaggcagctttggagtgacagctgtgacagtgggggacagcaacagcaatgtgaacagaagcctgagcggggaccaggacaccttccaccccagcggcggcagccacaccacccacggcagcgagagtgatggccacagccacggcagccaggagggcggggccaacaccaccagcggccccatccgcaccccccagatccctgagtggctgatcatcctggccagcctgctggccctggccctgatcctggccgtgtgcatcgctgtgaacagcagaagaagatgtggccagaagaagaagctggtgatcaacagcggaaatggagctgtggaggacaggaagcccagcggcctgaatggagaggccagcaagagccaggagatggtgcacctggtgaacaaggagagcagcgagaccccagaccagttcatgacagcagatgagaccaggaacctgcagaatgtggacatgaagattggagtgtag

SEQ ID NO: 18937 - DNA, 237 bp, Artificial Sequence
  Description of Artificial Sequence: Synthetic coding sequence
atggacaagttctggtggcacgccgcctggggcctgtgcctggtgcccctgagcctggcccagattgacctgaacatcacctgccgctttgctggggtcttccacgtggagaagaatggccgctacagcatcagcaggacagaagctgctgacctgtgcaaggccttcaacagcaccctgcccaccatggcccagatggagaaggccctgagcatcggctttgagacctgcaggtag

SEQ ID NO: 18938 - DNA, 885 bp, Artificial Sequence
  Description of Artificial Sequence: Synthetic coding sequence
tgagacaagttctggtggcacgccgcctggggcctgtgcctggtgcccctgagcctggcccagattgacctgaacatcacctgccgctttgctggggtcttccacgtggagaagaatggccgctacagcatcagcaggacagaagctgctgacctgtgcaaggccttcaacagcaccctgcccaccatggcccagatggagaaggccctgagcatcggctttgagacctgccgctatggcttcatcgagggccacgtggtgatcccccgcatccaccccaacagcatctgtgccgccaacaacacaggagtgtacatcctgaccagcaacaccagccagtatgacacctactgcttcaatgccagcgcccccccagaggaggactgcacctctgtgacagacctgcccaatgcctttgatggccccatcaccatcaccatcgtgaacagagatggcaccaggtatgtgcagaagggggagtaccgcaccaaccctgaggacatctaccccagcaaccccacagatgatgatgtgagcagcggcagcagcagcgagaggagcagcaccagcggcggctacatcttctacaccttcagcacagtgcaccccatcccagatgaggacagcccctggatcacagacagcacagaccgcatcccagccacccgggaccaggacaccttccaccccagcggcggcagccacaccacccacggcagcgagagtgatggccacagccacggcagccaggagggcggggccaacaccaccagcggccccatccgcaccccccagatccctgagtggctgatcatcctggccagcctgctggccctggccctgatcctggccgtgtgcatcgctgtgaacagccgccgctcctag

SEQ ID NO: 18939 - DNA, 918 bp, Artificial Sequence
  Description of Artificial Sequence: Synthetic coding sequence
atgtggcccctggtggccgccctgctgctgggcagcgcctgctgcggcagcgcccagctgctcttcaacaagaccaagtctgtggagttcaccttctgcaatgacacagtggtgatcccctgctttgtgaccaacatggaggcccagaacaccacagaggtgtatgtgaagtggaagttcaagggccgggacatctacacctttgatggagccctgaacaagagcacagtgcccacagacttcagcagcgccaagattgaggtgtcccagctgctgaagggagatgccagcctgaagatggacaagagtgatgctgtgagccacactggaaactacacctgtgaggtgacagagctgacccgggagggggagaccatcatcgagctgaagtacagagtggtgtcctggttcagccccaatgaaaacatcctgattgtcatcttccccatctttgccatcctgctcttctggggccagtttggcatcaagaccctgaagtacagaagtggcggcatggatgagaagaccatcgccctgctggtggccggcctggtgatcaccgtgattgtgattgtgggcgccatcctgtttgtgcctggagagtacagcctgaagaatgccaccggcctgggcctgattgtgaccagcacaggcatcctgatcctgctgcactactacgtgttcagcacagccatcggcctgaccagctttgtgattgccatcctggtgatccaggtgattgcctacatcctggccgtggtgggcctgagcctgtgcatcgccgcctgcatccccatgcacggccccctgctgatcagcggcctgagcatcctggccctggcccagctgctgggcctggtgtacatgaagtttgtggccagcaaccagaagaccatccagcccccaagaaacaactag

SEQ ID NO: 18940 - DNA, 972 bp, Artificial Sequence
  Description of Artificial Sequence: Synthetic coding sequence
atgtggcccctggtggccgccctgctgctgggcagcgcctgctgcggcagcgcccagctgctcttcaacaagaccaagtctgtggagttcaccttctgcaatgacacagtggtgatcccctgctttgtgaccaacatggaggcccagaacaccacagaggtgtatgtgaagtggaagttcaagggccgggacatctacacctttgatggagccctgaacaagagcacagtgcccacagacttcagcagcgccaagattgaggtgtcccagctgctgaagggagatgccagcctgaagatggacaagagtgatgctgtgagccacactggaaactacacctgtgaggtgacagagctgacccgggagggggagaccatcatcgagctgaagtacagagtggtgtcctggttcagccccaatgaaaacatcctgattgtcatcttccccatctttgccatcctgctcttctggggccagtttggcatcaagaccctgaagtacagaagtggcggcatggatgagaagaccatcgccctgctggtggccggcctggtgatcaccgtgattgtgattgtgggcgccatcctgtttgtgcctggagagtacagcctgaagaatgccaccggcctgggcctgattgtgaccagcacaggcatcctgatcctgctgcactactacgtgttcagcacagccatcggcctgaccagctttgtgattgccatcctggtgatccaggtgattgcctacatcctggccgtggtgggcctgagcctgtgcatcgccgcctgcatccccatgcacggccccctgctgatcagcggcctgagcatcctggccctggcccagctgctgggcctggtgtacatgaagtttgtggccagcaaccagaagaccatccagccccccaggaaggctgtggaggagcccctgaatgccttcaaggagagcaagggcatgatgaatgatgaatag

SEQ ID NO: 18941 - DNA, 1488 bp, Artificial Sequence
  Description of Artificial Sequence: Synthetic coding sequence
atgcccatgggcagcctgcagcccctggccaccctgtacctgctgggcatgctggtggccagctgcctgggccgcctgtcctggtatgaccctgacttccaggcccggctgaccaggagcaacagcaagtgccagggccagctggaggtgtacctgaaggatggctggcacatggtgtgcagccagagctggggccgcagcagcaagcagtgggaggaccccagccaggccagcaaggtgtgccagaggctgaactgtggggtgcccctgagcctgggccccttcctggtgacctacaccccccagagcagcatcatctgctacggccagctgggcagcttcagcaactgcagccacagcagaaatgacatgtgccacagcctgggcctgacctgcctggagccccagaagaccaccccacccaccacccggcccccacccaccaccaccccagagcccacagccccaccccggctgcagctggtggcccagagcggcggccagcactgtgccggcgtggtggagttctacagcggcagcctgggcggcaccatctcctatgaggcccaggacaagacccaggacctggagaacttcctgtgcaacaacctgcagtgtggcagcttcctgaagcacctgcctgagacagaggccggccgggcccaggaccccggggagccccgggagcaccagcccctgcccatccagtggaagatccagaacagcagctgcaccagcctggagcactgcttcaggaagatcaagccccagaagagcggccgggtgctggccctgctgtgcagcggcttccagcccaaggtgcagagccggctggtgggcggcagcagcatctgtgagggcaccgtggaggtgcggcagggcgcccagtgggccgccctgtgtgacagcagcagcgcccggagcagcctgcgctgggaggaggtgtgccgggagcagcagtgtggctctgtgaacagctacagagtgctggatgctggggaccccaccagccggggcctcttctgcccccaccagaagctgagccagtgccacgagctgtgggagaggaacagctactgcaagaaggtgtttgtgacctgccaggaccccaacccagctggcctggccgccggcaccgtggccagcatcatcctggccctggtgctgctggtggtgctgctggtggtgtgtggccccctggcctacaagaagctggtgaagaagttccggcagaagaagcagaggcagtggattggccccaccggcatgaaccagaacatgtccttccacaggaaccacacagccaccgtgcgcagccatgctgagaaccccacagccagccacgtggacaatgagtacagccagccccccaggaacagccacctgagcgcctacccagccctggagggcgccctgcacaggagctccatgcagcctgacaacagcagtgacagcgactatgacctgcacggggcccagaggctgtag

SEQ ID NO: 18942 - DNA, 582 bp, Artificial Sequence
  Description of Artificial Sequence: Synthetic coding sequence
atgcctgaggagggcagcggctgcagcgtgagaagaagaccctacggctgtgtgctgcgggccgccctggtgcccctggtggccggcctggtgatctgcctggtggtgtgcatccagagatttgcccaggcccagcagcagctgcccctggagagcctgggctgggatgtggccgagctgcagctgaaccacacaggcccccagcaggacccccggctgtactggcagggcggccctgccctgggccgctccttcctgcacggccctgagctggacaagggccagctgcgcatccacagagatggcatctacatggtgcacatccaggtgaccctggccatctgcagcagcaccacagccagccgccaccaccccaccaccctggccgtgggcatctgcagccctgccagccgcagcatcagcctgctgcggctgtccttccaccagggctgcaccatcgccagccagaggctgacccccctggcccggggggacaccctgtgcaccaacctgaccggcaccctgctgcccagcaggaacacagatgagaccttcttcggcgtgcagtgggtgcggccctag

SEQ ID NO: 18943 - DNA, 627 bp, Artificial Sequence
  Description of Artificial Sequence: Synthetic coding sequence
atgcctgaggagggcagcggctgcagcgtgagaagaagaccctacggctgtgtgctgcgggccgccctggtgcccctggtggccggcctggtgatctgcctggtggtgtgcatccagagatttgcccaggcccagcagcagctgcccctggagagcctgggctgggatgtggccgagctgcagctgaaccacacaggcccccagcaggacccccggctgtactggcagggcggccctgccctgggccgctccttcctgcacggccctgagctggacaagggccagctgcgcatccacagagatggcatctacatggtgcacatccaggtgaccctggccatctgcagcagcaccacagccagccgccaccaccccaccaccctggccgtgggcatctgcagccctgccagccgcagcatcagcctgctgcggctgtccttccaccagggcctgtttggcttctggaactggggcctgaaggtgaagtgcttcctgcggcacctgatctggacagcccactgcttcatccccctgacccagctggtgttcatgcaggccctgcagagctggaggaaccaccactgcagccacttcacagatgaggagaacagaggagtgaacagatag

SEQ ID NO: 18944 - DNA, 1305 bp, Artificial Sequence
  Description of Artificial Sequence: Synthetic coding sequence
atgtctgcagatggagctgaggctgatggcagcacccaggtgacagtggaggagcctgtgcagcagcccagcgtggtggacagagtggcctccatgcccctcatcagcagcacctgtgacatggtgtctgctgcctatgccagcaccaaggagagctacccccacatcaagacagtgtgtgatgctgctgagaagggcgtgaggaccctgacagctgctgctgtgtctggggcccagcccatcctgagcaagctggagccccagatcgccagcgcctctgaatatgcccaccggggcctggacaagctggaggagaacctgcccatcctgcagcagcccacagagaaggtgctggccgacaccaaggagctggtgagcagcaaggtgtctggggcccaggagatggtgagcagcgccaaggacacagtggccacccagctgtctgaggccgtggatgccaccagaggagctgtgcagagcggcgtggacaagaccaagtctgtggtgactggaggagtgcagagcgtgatgggcagccggctgggccagatggtgctgtctggagtggacacagtgctgggcaagtctgaggagtgggccgacaaccacctgcccctgacagatgctgagctggcccgcatcgccaccagcctggatggctttgatgtggcctctgtgcagcagcagaggcaggagcagagctactttgtgcggctgggcagcctgtctgagcggctgcggcagcacgcctatgagcacagcctgggcaagctgcgggccaccaagcagagggcccaggaggccctgctgcagctgagccaggtgctgagcctgatggagaccgtgaagcagggcgtggaccagaagctggtggagggccaggagaagctgcaccagatgtggctgtcctggaaccagaagcagctgcagggccctgagaaggagccccccaagccagagcaggtggagagccgggccctgaccatgttccgggacatcgcccagcagctgcaggccacctgcaccagcctgggcagcagcatccagggcctgcccaccaacgtgaaggaccaggtgcagcaggcccggcggcaggtggaggacctgcaggccaccttcagcagcatccacagcttccaggacctgagcagcagcatcctggcccagagccgggagcgggtggccagcgcccgggaggccctggaccacatggtggagtatgtggcccagaacacccctgtgacctggctggtgggcccctttgcccctggcatcacagagaaggcccctgaggagaagaagtag

SEQ ID NO: 18945 - DNA, 567 bp, Artificial Sequence
  Description of Artificial Sequence: Synthetic coding sequence
atgcctgggggccctggggtgctgcaggccctgcctgccaccatcttcctgctcttcctgctgtctgctgtgtacctgggccctggctgccaggccctgtggatgcacaaggtgcctgccagcctgatggtgtccctgggggaggatgcccacttccagtgcccccacaacagcagcaacaatgccaacgtgacctggtggagggtgctgcacggcaactacacctggcccccagagttcctgggccctggagaggaccccaatgagcccccaccccggcccttcctggacatgggagagggcaccaagaaccgcatcatcacagctgagggcatcatcctgctcttctgtgctgtggtgcccggcaccctgctgctcttcaggaagcgctggcagaatgagaagctgggcctggatgctggagatgaatatgaagatgagaacctgtatgagggcctgaacctggatgactgcagcatgtatgaggacatcagccggggcctgcagggcacctaccaggatgtgggcagcctgaacattggagatgtgcagctggagaagccctag

SEQ ID NO: 18946 - DNA, 867 bp, Artificial Sequence
  Description of Artificial Sequence: Synthetic coding sequence
atgggccacacccggcggcagggcaccagccccagcaaatgtccctacctgaacttcttccagctgctggtgctggccggcctgagccacttctgcagcggggtcatccacgtgaccaaggaggtgaaggaggtggccaccctgagctgtggccacaacgtgtctgtggaggagctggcccagacccgcatctactggcagaaggagaagaagatggtgctgaccatgatgtctggggacatgaacatctggccagagtacaagaacagaaccatctttgacatcaccaacaacctgagcatcgtcatcctggccctgcggcccagtgatgagggcacctatgaatgtgtggtgctgaagtatgagaaggatgccttcaagcgggagcacctggccgaggtgaccctgtctgtgaaggctgacttccccacccccagcatcagtgactttgagatccccaccagcaacatccgccgcatcatctgcagcaccagcggcggcttccctgagccccacctgtcctggctggagaatggagaggagctgaatgccatcaacaccaccgtgtcccaggaccctgagacagagctgtatgctgtgagcagcaagctggacttcaacatgaccaccaaccacagcttcatgtgcctgatcaagtatggccacctgcgggtgaaccagaccttcaactggaacaccaccaagcaggagcacttcccagacaacctgctgcccagctgggccatcaccctcatctctgtgaatggcatcttcgtcatctgctgcctgacctactgctttgccccccgctgccgggagaggagaagaaatgaaaggctgcggcgggagagcgtgcggcctgtgtag

SEQ ID NO: 18947 - DNA, 489 bp, Artificial Sequence
  Description of Artificial Sequence: Synthetic coding sequence
atgggccacacccggcggcagggcaccagccccagcaaatgtccctacctgaacttcttccagctgctggtgctggccggcctgagccacttctgcagcggggtcatccacgtgaccaaggaggtgaaggaggtggccaccctgagctgtggccacaacgtgtctgtggaggagctggcccagacccgcatctactggcagaaggagaagaagatggtgctgaccatgatgtctggggacatgaacatctggccagagtacaagaacagaaccatctttgacatcaccaacaacctgagcatcgtcatcctggccctgcggcccagtgatgagggcacctatgaatgtgtggtgctgaagtatgagaaggatgccttcaagcgggagcacctggccgaggtgaccctgtctgtgaagggctttgccccccgctgccgggagaggagaagaaatgaaaggctgcggcgggagagcgtgcggcctgtgtag

SEQ ID NO: 18948 - DNA, 771 bp, Artificial Sequence
  Description of Artificial Sequence: Synthetic coding sequence
atgggccacacccggcggcagggcaccagccccagcaaatgtccctacctgaacttcttccagctgctggtgctggccggcctgagccacttctgcagcggggtcatccacgtgaccaaggaggtgaaggaggtggccaccctgagctgtggccacaacgtgtctgtggaggagctggcccagacccgcatctactggcagaaggagaagaagatggtgctgaccatgatgtctggggacatgaacatctggccagagtacaagaacagaaccatctttgacatcaccaacaacctgagcatcgtcatcctggccctgcggcccagtgatgagggcacctatgaatgtgtggtgctgaagtatgagaaggatgccttcaagcgggagcacctggccgaggtgaccctgtctgtgaaggctgacttccccacccccagcatcagtgactttgagatccccaccagcaacatccgccgcatcatctgcagcaccagcggcggcttccctgagccccacctgtcctggctggagaatggagaggagctgaatgccatcaacaccaccgtgtcccaggaccctgagacagagctgtatgctgtgagcagcaagctggacttcaacatgaccaccaaccacagcttcatgtgcctgatcaagtatggccacctgcgggtgaaccagaccttcaactggaacaccagctttgccccccgctgccgggagaggagaagaaatgaaaggctgcggcgggagagcgtgcggcctgtgtag

SEQ ID NO: 18949 - DNA, 867 bp, Artificial Sequence; identical to SEQ ID NO: 18946
  Description of Artificial Sequence: Synthetic coding sequence

SEQ ID NO: 18950 - DNA, 456 bp, Artificial Sequence
  Description of Artificial Sequence: Synthetic coding sequence
atgagcatccccttcagcaacacccactaccgcatcccccagggcttcggcaacctgctggagggcctgacccgggagatcctgcgggagcagcctgacaacatcccagcctttgctgctgcctactttgagagcctgctggagaagcgggagaagaccaactttgatcctgctgagtggggcagcaaggtggaggaccgcttctacaacaaccacgcctttgaggagcaggagcccccagagaagagtgaccccaagcaggaggagagccagatcagcggcaaggaggaggagacctctgtgaccatcctggacagcagcgaggaggacaaggagaaggaggaggtggccgctgtgaagatccaggccgccttccggggccacatcgcccgggaggaggccaagaagatgaagaccaacagcctgcagaatgaggagaaggaggagaacaagtag

SEQ ID NO: 18951 - DNA, 729 bp, Artificial Sequence
  Description of Artificial Sequence: Synthetic coding sequence
atgggcagcgcctgcatcaaggtgaccaagtacttcctgttcctgttcaacctgatcttcttcatcctgggcgctgtgatcctgggcttcggcgtgtggatcctggccgacaagagcagcttcatctctgtgctgcagaccagcagcagcagcctgaggatgggcgcctacgtgttcatcggcgtgggcgctgtgaccatgctgatgggcttcctgggctgcattggagctgtgaatgaggtgcgctgcctgctgggcctgctgaagcaggagatgggcggcatcgtgacagagctgatccgggactacaacagcagccgggaggacagcctgcaggatgcctgggactatgtgcaggcccaggtgaagtgctgcggctgggtgtccttctacaactggacagacaatgctgagctgatgaacagacctgaggtgacctacccctgcagctgtgaggtgaagggggaggaggacaacagcctgtctgtgaggaagggcttctgtgaggcccctggcaacagaacccagagcggcaaccaccctgaggactggcctgtgtaccaggagggctgcatggagaaggtgcaggcctggctgcaggagaacctgggcatcatcctgggcgtgggcgtgggcgtggccatcatcgagctgctgggcatggtgctgagcatctgcctgtgccgccacgtgcacagcgaggactacagcaaggtgcccaagtactag

SEQ ID NO: 18952 - DNA, 207 bp, Artificial Sequence
  Description of Artificial Sequence: Synthetic coding sequence
atgggcagcgcctgcatcaaggtgaccaagtacttcctgttcctgttcaacctgatcttcttcatcctgggcgctgtgatcctgggcttcggcgtgtggatcctggccgacaagagcagcttcatctctgtgctgcagaccagcagcagcagcctgaggatgggcgcctacgtgttcatcggcgtgggcgctgtgaccatgctgtag

SEQ ID NO: 18953 - DNA, 117 bp, Artificial Sequence
  Description of Artificial Sequence: Synthetic coding sequence
atgggcagcgcctgcatcaaggtgaccaagtacttcctgttcctgttcaacctgatcttcttcatcctgggcgctgtgatcctgggcttcggcgtgtggatcctggccgacaagtag

SEQ ID NO: 18954 - DNA, 318 bp, Artificial Sequence
  Description of Artificial Sequence: Synthetic coding sequence
atgggcagcgcctgcatcaaggtgaccaagtacttcctgttcctgttcaacctgatcttcttcatcctgggcgctgtgatcctgggcttcggcgtgtggatcctggccgacaagagcagcttcatctctgtgctgcagaccagcagcagcagcctgaggatgggcgcctacgtgttcatcggcgtgggcgctgtgaccatgctgatgggcttcctgggctgcattggagctgtgaatgaggtgcgctgcctgctgggcctgtactttgccttcctgctgctgatcctgattgcccaggtgacagctggggccctgtag

SEQ ID NO: 18955 - DNA, 327 bp, Artificial Sequence
  Description of Artificial Sequence: Synthetic coding sequence
atgggcagcgcctgcatcaaggtgaccaagtacttcctgttcctgttcaacctgatcttcttcatcctgggcgctgtgatcctgggcttcggcgtgtggatcctggccgacaagagcagcttcatctctgtgctgcagaccagcagcagcagcctgaggatgggcgcctacgtgttcatcggcgtgggcgctgtgaccatgctgatgggcttcctgggctgcattggagctgtgaatgaggtgcgctgcctgctgggcctgtactttgccttcctgctgctgatcctgattgcccaggtgacagctggggccctcttctacttctag

SEQ ID NO: 18956 - DNA, 708 bp, Artificial Sequence
  Description of Artificial Sequence: Synthetic coding sequence
atggccctgcctgtgacagccctgctgctgcccctggccctgctgctgcacgccgcccggcccagccagttccgggtgagccccctggacaggacctggaacctgggggagaccgtggagctgaagtgccaggtgctgctgagcaaccccaccagcggctgctcctggctgttccagcccagaggagctgctgccagccccaccttcctgctgtacctgagccagaacaagcccaaggctgctgagggcctggacacccagcgcttcagcggcaagaggctgggggacacctttgtgctgaccctgagtgacttccggcgggagaatgaaggctactacttctgcagcgccctgagcaacagcatcatgtacttcagccactttgtgcctgtgttcctgcctgccaagcccaccaccaccccagcccccaggcctcccaccccagcccccaccatcgccagccagcccctgagcctgcggcctgaggcctgcaggcctgctgctgggggcgctgtgcacacccggggcctggactttgcctgtgacatctacatctgggcccccctggccggcacctgtggggtgctgctgctgagcctggtgatcaccctgtactgcaaccacaggaacagaagaagagtgtgcaagtgccccaggcctgtggtgaagagcggggacaagcccagcctgagcgcccgctacgtgtag

SEQ ID NO: 18957 - DNA, 597 bp, Artificial Sequence
  Description of Artificial Sequence: Synthetic coding sequence
atggccctgcctgtgacagccctgctgctgcccctggccctgctgctgcacgccgcccggcccagccagttccgggtgagccccctggacaggacctggaacctgggggagaccgtggagctgaagtgccaggtgctgctgagcaaccccaccagcggctgctcctggctgttccagcccagaggagctgctgccagccccaccttcctgctgtacctgagccagaacaagcccaaggctgctgagggcctggacacccagcgcttcagcggcaagaggctgggggacacctttgtgctgaccctgagtgacttccggcgggagaatgaaggctactacttctgcagcgccctgagcaacagcatcatgtacttcagccactttgtgcctgtgttcctgcctgccaagcccaccaccaccccagcccccaggcctcccaccccagcccccaccatcgccagccagcccctgagcctgcggcctgaggcctgcaggcctgctgctgggggcgccggcaacagaagaagagtgtgcaagtgccccaggcctgtggtgaagagcggggacaagcccagcctgagcgcccgctacgtgtag

SEQ ID NO: 18958 - DNA, 708 bp, Artificial Sequence; identical to SEQ ID NO: 18956
  Description of Artificial Sequence: Synthetic coding sequence

SEQ ID NO: 18959 - DNA, 597 bp, Artificial Sequence
  Description of Artificial Sequence: Synthetic coding sequence
atggccctgcctgtgacagccctgctgctgcccctggccctgctgctgcacgccgcccggcccagccagttccgggtgagccccctggacaggacctggaacctgggggagaccgtggagctgaagtgccaggtgctgctgagcaaccccaccagcggctgctcctggctgttccagcccagaggagctgctgccagccccaccttcctgctgtacctgagccagaacaagcccaaggctgctgagggcctggacacccagcgcttcagcggcaagaggctgggggacacctttgtgctgaccctgagtgacttccggcgggagaatgaaggctactacttctgcagcgccctgagcaacagcatcatgtacttcagccactttgtgcctgtgttcctgcctgtgcacacccggggcctggactttgcctgtgacatctacatctgggcccccctggccggcacctgtggggtgctgctgctgagcctggtgatcaccctgtactgcaaccacaggaacagaagaagagtgtgcaagtgccccaggcctgtggtgaagagcggggacaagcccagcctgagcgcccgctacgtgtag

SEQ ID NO: 18960 - DNA, 663 bp, Artificial Sequence
  Description of Artificial Sequence: Synthetic coding sequence
atggccctgcctgtgacagccctgctgctgcccctggccctgctgctgcacgccgcccggcccagccagttccgggtgagccccctggacaggacctggaacctgggggagaccgtggagctgaagtgccaggtgctgctgagcaaccccaccagcggctgctcctggctgttccagcccagaggagctgctgccagccccaccttcctgctgtacctgagccagaacaagcccaaggctgctgagggcctggacaccctgagtgacttcagaagagaaaatgaaggctactacttctgcagcgccctgagcaacagcatcatgtacttcagccactttgtgcctgtgttcctgcctgccaagcccaccaccaccccagccccccggccccccaccccagcccccaccatcgccagccagcccctgagcctgcggcctgaggcctgcaggcctgctgctggaggagctgtgcacacccggggcctggactttgcctgtgacatctacatctgggcccccctggccggcacctgtggggtgctgctgctgagcctggtgatcaccctgtactgcaaccacaggaacagaagaagagtgtgcaagtgccccaggcctgtggtgaagagcggggacaagcccagcctgagcgcccgctacgtgtag

SEQ ID NO: 18961 - DNA, 597 bp, Artificial Sequence; identical to SEQ ID NO: 18957
  Description of Artificial Sequence: Synthetic coding sequence

SEQ ID NO: 18962 - DNA, 831 bp, Artificial Sequence
  Description of Artificial Sequence: Synthetic coding sequence
atgaggaaccaggcccctggccggcccaagggggccaccttccccccaagaagacccaccggcagccgggccccacccctggcccctgagctgcgggccaagcagaggcctggagagcgggtgatggccctgcctgtgacagccctgctgctgcccctggccctgctgctgcatgctgcccggcccagccagttccgggtgagccccctggacaggacctggaacctgggggagaccgtggagctgaagtgccaggtgctgctgagcaaccccaccagcggctgctcctggctgttccagcccagaggagctgctgccagccccaccttcctgctgtacctgagccagaacaagcccaaggctgctgagggcctggacacccagcgcttcagcggcaagaggctgggggacacctttgtgctgaccctgagtgacttcagaagagaaaatgaaggctactacttctgcagcgccctgagcaacagcatcatgtacttcagccactttgtgcctgtgttcctgcctgccaagcccaccaccaccccagccccccggccccccaccccagcccccaccatcgccagccagcccctgagcctgcggcctgaggcctgcaggcctgctgctggaggagctgtgcacacccggggcctggactttgcctgtgacatctacatctgggcccccctggccggcacctgtggggtgctgctgctgagcctggtgatcaccctgtactgcaaccacaggaacagaagaagagtgtgcaagtgccccaggcctgtggtgaagagcggggacaagcccagcctgagcgcccgctacgtgtag

SEQ ID NO: 18963 - DNA, 240 bp, Artificial Sequence
  Description of Artificial Sequence: Synthetic coding sequence
atgagccacaagcagatctactacagcgacaagtatgatgatgaggagtttgagtacagacatgtgatgctgcccaaggacatcgccaagctggtgcccaagacccacctgatgtctgagagcgagtggaggaacctgggcgtgcagcagagccagggctgggtgcactacatgatccacgagcctgagccccacatcctgctcttccggcggcccctgcccaagaagcccaagaagtag

SEQ ID NO: 18964 - DNA, 204 bp, Artificial Sequence
  Description of Artificial Sequence: Synthetic coding sequence
atgagccacaagcagatctactacagcgacaagtatgatgatgaggagtttgagtacagacatgtgatgctgcccaaggacatcgccaagctggtgcccaagacccacctgatgtctgagagcgagtggaggaacctgggcgtgcagcagagccagggctgggtgcactacatgatccacgagcccggccagtgcaccggctag

SEQ ID NO: 18965 - DNA, 192 bp, Artificial Sequence
  Description of Artificial Sequence: Synthetic coding sequence
atgaggaccaggcatgtgatgctgcccaaggacatcgccaagctggtgcccaagacccacctgatgtctgagagcgagtggaggaacctgggcgtgcagcagagccagggctgggtgcactacatgatccacgagcctgagccccacatcctgctcttccggcggcccctgcccaagaagcccaagaagtag

SEQ ID NO: 18966 - DNA, 240 bp, Artificial Sequence
  Description of Artificial Sequence: Synthetic coding sequence
atggcccacaagcagatctactacagcgacaagtactttgatgagcactatgagtacagacatgtgatgctgccccgggagctgagcaagcaggtgcccaagacccacctgatgtctgaggaggagtggaggcggctgggcgtgcagcagagcctgggctgggtgcactacatgatccacgagcctgagccccacatcctgctcttccggcggcccctgcccaaggaccagcagaagtag

SEQ ID NO: 18967 - DNA, 1533 bp, Artificial Sequence
  Description of Artificial Sequence: Synthetic coding sequence
atgcaccccctgcagtgtgtgctgcaggtgcagaggagcctgggctggggccccctggcctctgtgtcctggctgagcctgaggatgtgccgggcccacagcagcctgagcagcaccatgtgccccagccctgagcggcaggaggatggagccaggaaggacttcagcagccggctggccgccggccccaccttccagcacttcctgaagagcgccagcgccccccaggagaagctgagcagcgaggtggaggaccccccaccctacctgatgatggatgagctgctgggccggcagaggaaggtgtacctggagacctacggctgccagatgaatgtgaatgacacagagatcgcctggagcatcctgcagaagagcggctacctgcggaccagcaacctgcaggaggctgatgtgatcctgctggtgacctgcagcatccgggagaaggccgagcagaccatctggaaccggctgcaccagctgaaggccctgaagacccggcggcccaggagccgggtgcccctgcgcatcggcatcctgggctgcatggccgagcggctgaaggaggagatcctgaaccgggagaagatggtggacatcctggccggcccagatgcctacagagacctgccccggctgctggccgtggccgagagcggccagcaggccgccaacgtgctgctgagcctggatgagacctatgcagatgtgatgcctgtgcagaccagcgccagcgccaccagcgcctttgtgtccatcatgaggggctgtgacaacatgtgcagctactgcatcgtgcccttcacccggggccgggagaggagccggcccatcgccagcatcctggaggaggtgaagaagctgtctgagcaggtgctgcagctgatccacgagcgggacaacatctgcaagcagatccacctgcctgcccagagcggcagcagccgggtgctggaggccatgagaagaggctacagccgggaggcctacgtggagctggtgcaccacatccgggagagcatccctggggtgtccctgagcagtgacttcatcgccggcttctgtggggagacagaagaagatcatgtgcagacagtgtccctgctgcgggaggtgcagtacaacatgggcttcctgtttgcctacagcatgaggcagaagacccgggcctaccaccggctgaaggatgatgtgcctgaggaggtgaagctgcggcggctggaggagctgatcaccatcttccgggaggaggccaccaaggccaaccagacctctgtgggctgcacccagctggtgctggtggagggcctgagcaagaggtctgccacagacctgtgtggcagaaatgatggcaacctgaaggtgatcttcccagatgctgagatggaggatgtgaacaaccctggcctgcgggtgcgggcccagcccggggactatgtgctggtgaagatcaccagcgccagcagccagaccctgcggggccacgtgctgtgcaggaccaccctgcgggacagcagcgcctactgctag

SEQ ID NO: 18968 - DNA, 1764 bp, Artificial Sequence
  Description of Artificial Sequence: Synthetic coding sequence
atgcaccccctgcagtgtgtgctgcaggtgcagaggagcctgggctggggccccctggcctctgtgtcctggctgagcctgaggatgtgccgggcccacagcagcctgagcagcaccatgtgccccagccctgagcggcaggaggatggagccaggaaggacttcagcagccggctggccgccggccccaccttccagcacttcctgaagagcgccagcgccccccaggagaagctgagcagcgaggtggaggaccccccaccctacctgatgatggatgagctgctgggccggcagaggaaggtgtacctggagacctacggctgccagatgaatgtgaatgacacagagatcgcctggagcatcctgcagaagagcggctacctgcggaccagcaacctgcaggaggctgatgtgatcctgctggtgacctgcagcatccgggagaaggccgagcagaccatctggaaccggctgcaccagctgaaggccctgaagacccggcggcccaggagccgggtgcccctgcgcatcggcatcctgggctgcatggccgagcggctgaaggaggagatcctgaaccgggagaagatggtggacatcctggccggcccagatgcctacagagacctgccccggctgctggccgtggccgagagcggccagcaggccgccaacgtgctgctgagcctggatgagacctatgcagatgtgatgcctgtgcagaccagcgccagcgccaccagcgcctttgtgtccatcatgaggggctgtgacaacatgtgcagctactgcatcgtgcccttcacccggggccgggagaggagccggcccatcgccagcatcctggaggaggtgaagaagctgtctgagcagggcctgaaggaggtgaccctgctgggccagaatgtgaacagcttccgggacaacagcgaggtgcagttcaacagcgctgtgcccaccaacctgagccggggcttcaccaccaactacaagaccaagcagggcggcctgcgctttgcccacctgctggaccaggtgtcccgggtggaccctgagatgaggatccgcttcaccagcccccaccccaaggacttcccagatgaggtgctgcagctgattcatgagcgggacaacatctgcaagcagatccacctgcctgcccagagcggcagcagccgggtgctggaggccatgaggcggggctacagccgggaggcctacgtggagctggtgcaccacatccgggagagcatccctggggtgtccctgagcagtgacttcatcgccggcttctgtggggagacagaggaggaccacgtgcagacagtgtccctgctgcgggaggtgcagtacaacatgggcttcctgtttgcctacagcatgaggcagaagacccgggcctaccaccggctgaaggatgatgtgcctgaggaggtgaagctgcggcggctggaggagctgatcaccatcttccgggaggaggccaccaaggccaaccagacctctgtgggctgcacccagctggtgctggtggagggcctgagcaagaggtctgccacagacctgtgtggcagaaatgatggcaacctgaaggtgatcttcccagatgctgagatggaggatgtgaacaaccctggcctgcgggtgcgggcccagcccggggactatgtgctggtgaagatcaccagcgccagcagccagaccctgcggggccacgtgctgtgcaggaccaccctgcgggacagcagcgcctactgctag

SEQ ID NO: 18969 - DNA, 1806 bp, Artificial Sequence
  Description of Artificial Sequence: Synthetic coding sequence
atgcaccccctgcagtgtgtgctgcaggtgcagaggagcctgggctggggccccctggcctctgtgtcctggctgagcctgaggatgtgccgggcccacagcagcctgagcagcaccatgtgccccagccctgagcggcaggaggatggagccaggaaggacttcagcagccggctggccgccggccccaccttccagcacttcctgaagagcgccagcgccccccaggagaagctgagcagcgaggtggaggaccccccaccctacctgatgatggatgagctgctgggccggcagaggaaggtgtacctggagacctacggctgccagatgaatgtgaatgacacagagatcgcctggagcatcctgcagaagagcggctacctgcggaccagcaacctgcaggaggctgatgtgatcctgctggtgacctgcagcatccgggagaaggccgagcagaccatctggaaccggctgcaccagctgaaggccctgaagacccggcggcccaggagccgggtgcccctgcgcatcggcatcctgggctgcatggccgagcggctgaaggaggagatcctgaaccgggagaagatggtggacatcctggccggcccagatgcctacagagacctgccccggctgctggccgtggccgagagcggccagcaggccgccaacgtgctgctgagcctggatgagacctatgcagatgtgatgcctgtgcagaccagcgccagcgccaccagcgcctttgtgtccatcatgaggggctgtgacaacatgtgcagctactgcatcgtgcccttcacccggggccgggagaggagccggcccatcgccagcatcctggaggaggtgaagaagctgtctgagcaggtgttcctgccccccaggcctcccaaggtgctgggcctgcagggcctgaaggaggtgaccctgctgggccagaatgtgaacagcttccgggacaacagcgaggtgcagttcaacagcgctgtgcccaccaacctgagccggggcttcaccaccaactacaagaccaagcagggcggcctgcgctttgcccacctgctggaccaggtgtcccgggtggaccctgagatgaggatccgcttcaccagcccccaccccaaggacttcccagatgaggtgctgcagctgattcatgagcgggacaacatctgcaagcagatccacctgcctgcccagagcggcagcagccgggtgctggaggccatgaggcggggctacagccgggaggcctacgtggagctggtgcaccacatccgggagagcatccctggggtgtccctgagcagtgacttcatcgccggcttctgtggggagacagaggaggaccacgtgcagacagtgtccctgctgcgggaggtgcagtacaacatgggcttcctgtttgcctacagcatgaggcagaagacccgggcctaccaccggctgaaggatgatgtgcctgaggaggtgaagctgcggcggctggaggagctgatcaccatcttccgggaggaggccaccaaggccaaccagacctctgtgggctgcacccagctggtgctggtggagggcctgagcaagaggtctgccacagacctgtgtggcagaaatgatggcaacctgaaggtgatcttcccagatgctgagatggaggatgtgaacaaccctggcctgcgggtgcgggcccagcccggggactatgtgctggtgaagatcaccagcgccagcagccagaccctgcggggccacgtgctgtgcaggaccaccctgcgggacagcagcgcctactgctag

SEQ ID NO: 18970 - DNA, 984 bp, Artificial Sequence
  Description of Artificial Sequence: Synthetic coding sequence
atgaatgtgaatgacacagagatcgcctggagcatcctgcagaagagcggctacctgcggaccagcaacctgcaggaggctgatgtgatcctgctggtgacctgcagcatccgggagaaggccgagcagaccatctggaaccggctgcaccagctgaaggccctgaagacccggcggcccaggagccgggtgcccctgcgcatcggcatcctgggctgcatggccgagcggctgaaggaggagatcctgaaccgggagaagatggtggacatcctggccggcccagatgcctacagagacctgccccggctgctggccgtggccgagagcggccagcaggccgccaacgtgctgctgagcctggatgagacctatgcagatgtgatgcctgtgcagaccagcgccagcgccaccagcgcctttgtgtacagccgggaggcctacgtggagctggtgcaccacatccgggagagcatccctggggtgtccctgagcagtgacttcatcgccggcttctgtggggagacagaggaggaccacgtgcagacagtgtccctgctgcgggaggtgcagtacaacatgggcttcctgtttgcctacagcatgaggcagaagacccgggcctaccaccggctgaaggatgatgtgcctgaggaggtgaagctgcggcggctggaggagctgatcaccatcttccgggaggaggccaccaaggccaaccagacctctgtgggctgcacccagctggtgctggtggagggcctgagcaagaggtctgccacagacctgtgtggcagaaatgatggcaacctgaaggtgatcttcccagatgctgagatggaggatgtgaacaaccctggcctgcgggtgcgggcccagcccggggactatgtgctggtgaagatcaccagcgccagcagccagaccctgcggggccacgtgctgtgcaggaccaccctgcgggacagcagcgcctactgctag

SEQ ID NO: 18971 - DNA, 1494 bp, Artificial Sequence
  Description of Artificial Sequence: Synthetic coding sequence
atgatggatgagctgctgggccggcagaggaaggtgtacctggagacctacggctgccagatgaatgtgaatgacacagagatcgcctggagcatcctgcagaagagcggctacctgcggaccagcaacctgcaggaggctgatgtgatcctgctggtgacctgcagcatccgggagaaggccgagcagaccatctggaaccggctgcaccagctgaaggccctgaagacccggcggcccaggagccgggtgcccctgcgcatcggcatcctgggctgcatggccgagcggctgaaggaggagatcctgaaccgggagaagatggtggacatcctggccggcccagatgcctacagagacctgccccggctgctggccgtggccgagagcggccagcaggccgccaacgtgctgctgagcctggatgagacctatgcagatgtgatgcctgtgcagaccagcgccagcgccaccagcgcctttgtgtccatcatgaggggctgtgacaacatgtgcagctactgcatcgtgcccttcacccggggccgggagaggagccggcccatcgccagcatcctggaggaggtgaagaagctgtctgagcagggcctgaaggaggtgaccctgctgggccagaatgtgaacagcttccgggacaacagcgaggtgcagttcaacagcgctgtgcccaccaacctgagccggggcttcaccaccaactacaagaccaagcagggcggcctgcgctttgcccacctgctggaccaggtgtcccgggtggaccctgagatgaggatccgcttcaccagcccccaccccaaggacttcccagatgaggtgctgcagctgattcatgagcgggacaacatctgcaagcagatccacctgcctgcccagagcggcagcagccgggtgctggaggccatgaggcggggctacagccgggaggcctacgtggagctggtgcaccacatccgggagagcatccctggggtgtccctgagcagtgacttcatcgccggcttctgtggggagacagaggaggaccacgtgcagacagtgtccctgctgcgggaggtgcagtacaacatgggcttcctgtttgcctacagcatgaggcagaagacccgggcctaccaccggctgaaggatgatgtgcctgaggaggtgaagctgcggcggctggaggagctgatcaccatcttccgggaggaggccaccaaggccaaccagacctctgtgggctgcacccagctggtgctggtggagggcctgagcaagaggtctgccacagacctgtgtggcagaaatgatggcaacctgaaggtgatcttcccagatgctgagatggaggatgtgaacaaccctggcctgcgggtgcgggcccagcccggggactatgtgctggtgaagatcaccagcgccagcagccagaccctgcggggccacgtgctgtgcaggaccaccctgcgggacagcagcgcctactgctag

SEQ ID NO: 18972 - DNA, 1281 bp, Artificial Sequence
  Description of Artificial Sequence: Synthetic coding sequence
atgcaccccctgcagtgtgtgctgcaggtgcagaggagcctgggctggggccccctggcctctgtgtcctggctgagcctgaggatgtgccgggcccacagcagcctgagcagcaccatgtgccccagccctgagcggcaggaggatggagccaggaaggacttcagcagccggctggccgccggccccaccttccagcacttcctgaagagcgccagcgccccccaggagaagctgagcagcgaggtggaggaccccccaccctacctgatgatggatgagctgctgggccggcagaggaaggtgtacctggagacctacggctgccagatgaatgtgaatgacacagagatcgcctggagcatcctgcagaagagcggctacctgcggaccagcaacctgcaggaggctgatgtgatcctgctggtgacctgcagcatccgggagaaggccgagcagaccatctggaaccggctgcaccagctgaaggccctgaagacccggcggcccaggagccgggtgcccctgcgcatcggcatcctgggctgcatggccgagcggctgaaggaggagatcctgaaccgggagaagatggtggacatcctggccggcccagatgcctacagagacctgccccggctgctggccgtggccgagagcggccagcaggccgccaacgtgctgctgagcctggatgagacctatgcagatgtgatgcctgtgcagaccagcgccagcgccaccagcgcctttgtgtccatcatgaggggctgtgacaacatgtgcagctactgcatcgtgcccttcacccggggccgggagaggagccggcccatcgccagcatcctggaggaggtgaagaagctgtctgagcagggcctgaaggaggtgaccctgctgggccagaatgtgaacagcttccgggacaacagcgaggtgcagttcaacagcgctgtgcccaccaacctgagccggggcttcaccaccaactacaagaccaagcagggcggcctgcgctttgcccacctgctggaccaggtgtcccgggtggaccctgagatgaggatccgcttcaccagcccccaccccaaggacttcccagatgaggtgctgcagctgattcatgagcgggacaacatctgcaagcagatccacctgcctgcccagagcggcagcagccgggtgctggaggccatgaggcggggctacagccgggaggcctacgtggagctggtgcaccacatccgggagagcatccctgaggacaccggcatctcctag

SEQ ID NO: 18973 - DNA, 1122 bp, Artificial Sequence
  Description of Artificial Sequence: Synthetic coding sequence
ggggatggccagaacctcttcaccaaggatgtgaccgtcatcgagggggaggtggccaccatcagctgccaggtgaacaagagtgatgattctgtcatccagctgctgaaccccaaccggcagaccatctacttccgggacttccggcccctgaaggacagccgcttccagctgctgaacttcagcagcagcgagctgaaggtgtccctgaccaacgtgtccatcagtgatgagggccgctacttctgccagctgtacacagatcctccccaggagagctacaccaccatcaccgtgctggtgccccccaggaacctgatgattgacatccagaaggacacagctgtggagggggaggagattgaggtgaactgcacagccatggccagcaagccagccaccaccatccgctggttcaagggcaacacagagctgaagggcaagtctgaggtggaggagtggagcgacatgtacacagtgaccagccagctgatgctgaaggtgcacaaggaggatgatggagtgcctgtgatctgccaggtggagcaccctgctgtgactggaaacctgcagacccagcgctacctggaggtgcagtacaagccccaggtgcacatccagatgacctaccccctgcagggcctgacccgggagggagatgccctggagctgacctgtgaggccatcggcaagccccagcctgtgatggtgacctgggtgcgggtggatgatgagatgccccagcacgctgtgctgagcggccccaacctcttcatcaacaacctgaacaagacagacaatggcacctaccgctgtgaggccagcaacatcgtgggcaaggcccacagcgactacatgctgtatgtgtatgacagccgggccggggaggagggcagcatccgggctgtggaccacgccgtcatcggcggcgtggtggccgtggtggtgtttgccatgctgtgcctgctgatcatcctgggccgctactttgcccggcacaagggcacctacttcacccatgaggccaagggagcagatgatgctgctgatgctgacacagccatcatcaatgctgagggcggccagaacaacagcgaggagaagaaggagtacttcatctag

SEQ ID NO: 18974 - DNA, 1329 bp, Artificial Sequence
  Description of Artificial Sequence: Synthetic coding sequence
atggcctctgtggtgctgcccagcggcagccagtgtgccgctgctgctgctgctgctgcccctcctggcctgcggctgcggctgctgctgctgctcttctctgctgctgccctgatccccactggagatggccagaacctcttcaccaaggatgtgacagtgattgaaggagaggtggccaccatcagctgccaggtgaacaagagtgatgacagcgtcatccagctgctgaaccccaaccggcagaccatctacttccgggacttccggcccctgaaggacagccgcttccagctgctgaacttcagcagcagcgagctgaaggtgtccctgaccaacgtgtccatcagtgatgagggccgctacttctgccagctgtacacagaccccccccaggagagctacaccaccatcaccgtgctggtgcccccaagaaacctgatgattgacatccagaaggacacagctgtggagggggaggagattgaggtgaactgcacagccatggccagcaagccagccaccaccatccgctggttcaagggcaacacagagctgaagggcaagtctgaggtggaggagtggagcgacatgtacacagtgaccagccagctgatgctgaaggtgcacaaggaggatgatggagtgcctgtgatctgccaggtggagcaccctgctgtgacaggcaacctgcagacccagcgctacctggaggtgcagtacaagccccaggtgcacatccagatgacctaccccctgcagggcctgacccgggagggagatgccctggagctgacctgtgaggccatcggcaagccccagcctgtgatggtgacctgggtgcgggtggatgatgagatgccccagcacgctgtgctgagcggccccaacctcttcatcaacaacctgaacaagacagacaatggcacctaccgctgtgaggccagcaacatcgtgggcaaggcccacagcgactacatgctgtatgtgtatgacccccccaccaccatccccccacccaccaccaccaccaccaccaccaccaccaccaccaccaccatcctgaccatcatcacagacagcagagctggggaggagggcagcatccgggctgtggaccatgctgtgattggaggagtggtggccgtggtggtgtttgccatgctgtgcctgctgatcatcctgggccgctactttgcccggcacaagggcacctacttcacccatgaggccaagggagcagatgatgctgctgatgctgacacagccatcatcaatgctgagggcggccagaacaacagcgaggagaagaaggagtacttcatctag

SEQ ID NO: 18975 - DNA, 384 bp, Artificial Sequence
  Description of Artificial Sequence: Synthetic coding sequence
atgctgtatgtgtatgacccccccaccaccatccccccacccaccaccaccaccaccaccaccaccaccaccaccaccaccatcctgaccatcatcacagacaccacagccaccacagagcctgctgtgcatgacagccgggccggggaggagggcagcatccgggctgtggaccacgccgtcatcggcggcgtggtggccgtggtggtgtttgccatgctgtgcctgctgatcatcctgggccgctactttgcccggcacaagggcacctacttcacccatgaggccaagggagcagatgatgctgctgatgctgacacagccatcatcaatgctgagggcggccagaacaacagcgaggagaagaaggagtacttcatctag

SEQ ID NO: 18976 - DNA, 1245 bp, Artificial Sequence
  Description of Artificial Sequence: Synthetic coding sequence
atggcctctgtggtgctgcccagcggcagccagtgtgccgctgctgctgctgctgctgcccctcctggcctgcggctgcggctgctgctgctgctcttctctgctgctgccctgatccccactggagatggccagaacctcttcaccaaggatgtgacagtgattgaaggagaggtggccaccatcagctgccaggtgaacaagagtgatgacagcgtcatccagctgctgaaccccaaccggcagaccatctacttccgggacttccggcccctgaaggacagccgcttccagctgctgaacttcagcagcagcgagctgaaggtgtccctgaccaacgtgtccatcagtgatgagggccgctacttctgccagctgtacacagaccccccccaggagagctacaccaccatcaccgtgctggtgcccccaagaaacctgatgattgacatccagaaggacacagctgtggagggggaggagattgaggtgaactgcacagccatggccagcaagccagccaccaccatccgctggttcaagggcaacacagagctgaagggcaagtctgaggtggaggagtggagcgacatgtacacagtgaccagccagctgatgctgaaggtgcacaaggaggatgatggagtgcctgtgatctgccaggtggagcaccctgctgtgacaggcaacctgcagacccagcgctacctggaggtgcagtacaagccccaggtgcacatccagatgacctaccccctgcagggcctgacccgggagggagatgccctggagctgacctgtgaggccatcggcaagccccagcctgtgatggtgacctgggtgcgggtggatgatgagatgccccagcacgctgtgctgagcggccccaacctcttcatcaacaacctgaacaagacagacaatggcacctaccgctgtgaggccagcaacatcgtgggcaaggcccacagcgactacatgctgtatgtgtatgacagcagagctggggaggagggcagcatccgggctgtggaccatgctgtgattggaggagtggtggccgtggtggtgtttgccatgctgtgcctgctgatcatcctgggccgctactttgcccggcacaagggcacctacttcacccatgaggccaagggagcagatgatgctgctgatgctgacacagccatcatcaatgctgagggcggccagaacaacagcgaggagaagaaggagtacttcatctag

SEQ ID NO: 18977 - DNA, 5346 bp, Artificial Sequence
  Description of Artificial Sequence: Synthetic coding sequence
atgaccacctaccgggccatccccagtgatggagtggacctggccgccagctgtggggcccgggtgggagatgtgctgcccggcccccacactggagactatgcccccctgggcttctgggcccagaatggctccatgagccagcccctgggggagagccctgccacagccacagccacagccacagccaccacccggcccagccccaccaccccagccatgcccaagatgggcgtgcgggcccgggtggccgactggccacccaagcgggaggccctgcgggagcacagcaaccccagccccagccaggacacagatggcaccaaggccaccaagatggcccacagcatgaggagcatccagaatggccagccccccaccagcaccccagccagcagcggcagcaaggccttccaccggctgagcagaagaagaagcaaggatgtggagttccaggacggctggcccaggagccctggccgggccttcctgcccctgcggcacaggagcagcagcgagatcaccctgtctgaatgtgatgctgaagatgctggggagcccaggggggcccggcacactggagccctgcccctcttccgggagtatggcagcaccagcagcattgatgtgcagggcatgcctgagcagagcttctttgacatcctgaatgagttccgctctgagcagccagatgcccggggctgccaggccctgacagagctgctgcgggctgaccccggcccccacctgatgggcggcggcggcggggccaagggggacagccacaacggccagcctgccaaggacagcctgctgcccctgcagcccaccaaggagaaggagaaggccaggaagaagccagcccggggcctgggcggcggggacacagtggacagcagcatcttcaggaagctgcggagcagcaagccagagggggaggccggccgcagccctggagaggctgatgagggccgcagccccccagaggccagccggccctgggtgtgccagaagagctttgcccactttgatgtgcagagcatgctgtttgacctgaatgaagctgctgccaacagagtgtctgtgtcccagaggaggaacaccaccaccggggccagcgctgccagcgctgccagcgccatggccagcctgacagccagccgggcccacagcctgggcggcctggaccctgccttcaccagcacagaggacctgaactgcaaggagaacctggagcaggacctgggagatgacaacagcaatgacctgctgctgagctgcccccacttcagaaatgaaattggaggagaatgtgaaagaaatgtgtccttcagccgggcctctgtgggcagccccagcagcggggagggccacctggccgagcccgccctgagcgcctaccgcaccaatgccagcatctctgtgctggaggtgcccaaggagcagcagaggacccagagccggccccggcagtacagcattgagcacgtggacctgggcgcccgctactaccaggactactttgtgggcaaggagcacgccaactactttggagtggatgagaagctgggccctgtggccgtgtccatcaagcgggagaagctggaggaccacaaggagcacggcccccagtaccagtaccgcatcatcttccgcacccgggagctgatcaccctgcggggcagcatcctggaggatgccacccccacagccaccaagcacggcaccggccggggcctgcccctgaaggatgccctggagtatgtgattcctgagctgaacatccactgcctgcggctggccctgaacacccccaaggtgacagagcagctgctgaagctggatgagcagggcctgtgcaggaagcacaaggtgggcatcctgtactgcaaggccggccagagcagcgaggaggagatgtacaacaatgaggaggccggccctgcctttgaggagttcctgagcctgattggagagaaggtgtgcctgaagggcttcaccaagtatgctgcccagctggatgtgaagacagacagcacaggcacccacagcctgtacaccatgtaccaggactatgagatcatgtttcatgtgtccaccctgctgccctacacccccaacaaccggcagcagctgctgaggaagaggcacatcggaaatgacatcgtgaccatcatcttccaggagcccggggccctgcccttcacccccaagaacatccgcagccacttccagcacgtgttcatcatcgtgcgggtgcacaacccctgcacagacaacgtgtgctacagcatggctgtgaccaggagcaaggatgccccacccttcggcccccccatccccagcggcaccaccttcaggaagagtgatgtgttccgggacttcctgctggccaaggtgatcaatgcagaaaatgctgcccacaagagtgacaagttccacaccatggccaccaggacccggcaggagtacctgaaggacctggccgagaactgtgtgagcaacacccccatcgacagcacaggcaagttcaacctgatcagcctgaccagcaagaagaaggagaagaccaaggcccgggccggggctgagcagcacagcgctggggccatcgcctggagggtggtggcccaggactatgcccagggcgtggagattgactgcatcctgggcatcagcaatgaatttgtggtgctgctggacctgcggaccaaggaggtggtgttcaactgctactgtggagatgtgattggctggaccccagacagcagcaccctgaagatcttctacggccgcggggaccacatcttcctgcaggccacagagggctctgtggaggacatccgggagatcgtgcagaggctgaaggtgatgaccagcggctgggagaccgtggacatgaccctgcggagaaatggcctgggccagctgggcttccacgtgaagtatgatggcaccgtggccgaggtggaggactatggctttgcctggcaggccggcctgcggcagggcagccggctggtggagatctgcaaggtggccgtggtgaccctgacccatgaccagatgattgacctgctgcggacctctgtgacagtgaaggtggtgatcatccccccatttgaagatggcaccccaagaagaggctggccagagacctatgacatgaacaccagcgagcccaagacagagcaggagagcatcacccctgggggccggcccccctaccgcagcaatgccccctggcagtggagcggccctgccagccacaacagcctgcctgccagcaagtgggccacccccaccaccccaggccacgcccagagcctgagccggcccctgaagcagacccccatcgtgcccttccgggagagccagcccctgcacagcaagaggcctgtgtccttccctgagaccccctacacagtgtccccagctggagctgacagagtgcccccctaccggcagcccagcggcagcttcagcaccccaggcagcgccacctacgtgcgctacaagcccagccctgagcgctacacagctgccccccaccccctgctgagcctggacccccacttcagccatgatggcaccagcagcggggacagcagcagcggcggcctgaccagccaggagagcaccatggagcggcagaagccagagcccctgtggcacgtgcctgcccaggcccggctgagcgccatcgccggcagcagcggcaacaagcaccccagccggcaggatgctgctgggaaggacagccccaacagacacagcaagggggagccccagtacagcagccacagcagcagcaacaccctgagcagcaatgccagcagcagccacagtgatgaccgctggtttgaccccctggaccccctggagcctgagcaggaccccctgagcaaaggaggcagcagtgacagcggcatcgacaccaccctgtacaccagcagccccagctgcatgagcctggccaaggcccccaggcctgccaagccccacaagcccccaggctccatgggcctgtgtggcggcggccgggaggccgccggccgcagccaccacgccgacagaagaagagaggtgtccccagccccagctgtggccggccagagcaagggctaccggcccaagctgtacagcagcggcagcagcacccccaccggcctggccggcggcagccgggaccccccccggcagcccagcgacatgggcagccgggtgggctacccagcccaggtgtacaagacagccagcgctgagaccccccggcccagccagctggcccagcccagccccttccagctgagcgcctctgtgcccaagagcttcttcagcaagcagcctgtgaggaacaagcaccccaccggctggaagaggacagaggagcccccaccccggcccctgcccttcagtgaccccaagaagcaggtggacaccaacaccaagaatgtgtttggccagccccggctgcgggccagcctgcgggacctgcggagccccaggaagaactacaagagcaccattgaagatgacctgaagaagctgatcatcatggacaacctgggccctgagcaggagcgggacaccggccagagcccccagaagggcctgcagaggaccctgagtgatgagagcctgtgcagcggccggcgggagcccagctttgccagccctgctggcctggagcccggcctgcccagtgatgtgctcttcaccagcacctgtgccttccccagcagcaccctgcctgcccggcggcagcaccagcacccccacccccctgtgggccctggggccaccccagctgctggcagcggcttccctgagaagaagagcaccatcagcgccagcgagctgagcctggctgatggccgggaccggcccctgcggcggctggaccccggcctgatgcccctgcctgacacagctgctggcctggagtggagcagcctggtgaatgctgccaaggcctatgaggtgcagagagctgtgtccctcttcagcctgaatgaccctgccctgagcccagacatccccccagcccacagccctgtgcacagccacctgagcctggagcggggcccccccacccccaggaccacccccaccatgtctgaggagccccccctggacctgaccgggaaggtgtaccagctggaggtgatgctgaagcagctgcacacagacctgcagaaggagaagcaggacaaggtggtgctgcagagcgaggtggccagcctgcggcagaacaaccagaggctgcaggaggagagccaggccgccagcgagcagctgaggaagtttgctgagatcttctgccgggagaagaaggagctgtag

SEQ ID NO: 18978 - DNA, 660 bp, Artificial Sequence
  Description of Artificial Sequence: Synthetic coding sequence
atggaggccgcccgggactatgctggggccctgatccggcccctgaccttcatgggcagccagaccaagagggtgctcttcacccccctgatgcacccagcccggcccttccgggtgagcaaccacgacaggagcagcagaagaggagtgatggccagcagcctgcaggagctgatcagcaagaccctggatgccctggtgattgccaccggcctggtgaccctggtgctggaggaggatggcaccgtggtggacacagaggagttcttccagaccctgggggacaacacccacttcatgatcctggagaagggccagaagtggatgcctggcagccagcacgtgcccacctgcagcccccccaagaggagcggcatcgcccgggtgacctttgacctgtaccgcctgaaccccaaggacttcatcggctgcctgaatgtgaaggccaccatgtatgagatgtacagcgtgtcctatgacatccgctgcaccggcctgaagggcctgctgcggagcctgctgcgcttcctgagctacagcgcccaggtgacaggccagttcctgatctacctgggcacctacatgctgcgggtgctggatgacaaggaggagcggcccagcctgcggagccaggccaagggccgcttcacctgtggctag

SEQ ID NO: 18979 - DNA, 660 bp, Artificial Sequence
  Description of Artificial Sequence: Synthetic coding sequence
atggagtacctgagcgccctgaaccccagcgacctgctgcggtctgtgagcaacatcagcagcgagtttggaagaagagtgtggaccagcgcccccccaccccagaggcccttccgggtgtgtgaccacaagaggaccatcaggaagggcctgacagctgccacccggcaggagctgctggccaaggccctggagaccctgctgctgaatggagtgctgaccctggtgctggaggaggatggaacagctgtggacagcgaggacttcttccagctgctggaggatgacacctgcctgatggtgctgcagagcggccagagctggagccccaccaggtctggagtgctgtcctatggcctgggccgggagcggcccaagcacagcaaggacatcgcccgcttcacctttgatgtgtacaagcagaacccccgggacctgtttggcagcctgaatgtgaaggccaccttctacggcctgtacagcatgagctgtgacttccagggcctgggccccaagaaggtgctgcgggagctgctgcgctggaccagcaccctgctgcagggcctgggccacatgctgctgggcatcagcagcaccctgcggcatgctgtggagggcgctgagcagtggcagcagaagggccgcctgcacagctactag

SEQ ID NO: 18980 - DNA, 660 bp, Artificial Sequence; identical to SEQ ID NO: 18979
  Description of Artificial Sequence: Synthetic coding sequence

SEQ ID NO: 18981 - DNA, 660 bp, Artificial Sequence; identical to SEQ ID NO: 18979
  Description of Artificial Sequence: Synthetic coding sequence

SEQ ID NO: 18982 - DNA, 660 bp, Artificial Sequence; identical to SEQ ID NO: 18979
  Description of Artificial Sequence: Synthetic coding sequence

SEQ ID NO: 18983 - DNA, 1860 bp, Artificial Sequence
  Description of Artificial Sequence: Synthetic coding sequence
atgaacctggagcggctgaggaagagggtgcggcagtacctggaccagcagcagtaccagagcgccctcttctgggccgacaaggtggccagcctgagccgggagccccaggacatctactggctggcccagtgcctgtacctgacagcccagtaccacagagctgcccacgccctgcggagcaggaagctggacaagctgtatgaggcctgccgctacctggccgcccgctgccactatgctgccaaggagcaccagcaggccctggatgtgctggacatggaggagcccatcaacaagaggctgtttgagaagtacctgaaggatgaaagtggcttcaaggaccccagcagtgactgggagatgagccagagcagcatcaagagcagcatctgcctgctgcggggcaagatctatgatgccctggacaacagaaccctggccacctacagctacaaggaggccctgaagctggatgtgtactgctttgaggcctttgacctgctgaccagccaccacatgctgacagcccaggaggagaaggagctgctggagagcctgcccctgagcaagctgtgcaatgaggagcaggagctgctgcgcttcctgtttgagaacaagctgaagaagtacaacaagcccagcgagaccgtcatccctgagagcgtggatggcctgcaggagaacctggatgtggtggtgtccctggccgagcggcactactacaactgtgacttcaagatgtgctacaagctgacctctgtggtgatggagaaggaccccttccacgccagctgcctgcctgtgcacatcggcaccctggtggagctgaacaaggccaatgaactcttctacctgagccacaagctggtggacctgtaccccagcaaccctgtgtcctggtttgctgtgggctgctactacctgatggtgggccacaagaatgaacatgcccggcgctacctgagcaaggccaccaccctggagaagacctacggccctgcctggatcgcctacggccacagctttgctgtggagagcgagcatgaccaggccatggccgcctacttcaccgctgcccagctgatgaagggctgccacctgcccatgctgtacatcggcctggagtatggcctgaccaacaacagcaagctggccgagcgcttcttcagccaggccctgagcatcgcccctgaggacccctttgtgatgcatgaggtgggcgtggtggccttccagaatggagagtggaagacagctgagaagtggttcctggatgccctggagaagatcaaggccatcggaaatgaggtgacagtggacaagtgggagcccctgctgaacaacctgggccacgtgtgcaggaagctgaagaagtatgcagaggccctggactaccaccggcaggccctggtgctgatcccccagaatgccagcacctacagcgccatcggctacatccacagcctgatgggcaactttgaaaatgctgtggactacttccacacagccctgggcctgcggagagatgacaccttctctgtgaccatgctgggccactgcatcgagatgtacatcggggacagcgaggcctacatcggggctgacatcaaggacaagctgaagtgctatgactttgatgtgcacaccatgaagaccctgaagaacatcatcagccccccctgggacttccgggagtttgaggtggagaagcagacagctgaggagaccggcctgacccccctggagaccagcaggaagaccccagacagccggcccagcctggaggagacctttgaaattgagatgaatgaaagtgacatgatgctggagacctccatgtctgaccacagcacctag

SEQ ID NO: 18984 - DNA, 1428 bp, Artificial Sequence
  Description of Artificial Sequence: Synthetic coding sequence
atggaggagcccatcaacaagaggctgtttgagaagtacctgaaggatgagagcggcttcaaggaccccagcagtgactgggagatgagccagagcagcatcaagagcagcatctgcctgctgcggggcaagatctatgatgccctggacaacagaaccctggccacctacagctacaaggaggccctgaagctggatgtgtactgctttgaggcctttgacctgctgaccagccaccacatgctgacagcccaggaggagaaggagctgctggagagcctgcccctgagcaagctgtgcaatgaggagcaggagctgctgcgcttcctgtttgagaacaagctgaagaagtacaacaagcccagcgagaccgtcatccctgagagcgtggatggcctgcaggagaacctggatgtggtggtgtccctggccgagcggcactactacaactgtgacttcaagatgtgctacaagctgacctctgtggtgatggagaaggaccccttccacgccagctgcctgcctgtgcacatcggcaccctggtggagctgaacaaggccaatgagctgttctacctgagccacaagctggtggacctgtaccccagcaaccctgtgtcctggtttgctgtgggctgctactacctgatggtgggccacaagaatgagcacgcccggcgctacctgagcaaggccaccaccctggagaagacctacggccctgcctggatcgcctacggccacagctttgctgtggagagcgagcatgaccaggccatggccgcctacttcaccgctgcccagctgatgaagggctggaagacagctgagaagtggttcctggatgccctggagaagatcaaggccatcggaaatgaggtgacagtggacaagtgggagcccctgctgaacaacctgggccacgtgtgcaggaagctgaagaagtatgcagaggccctggactaccaccggcaggccctggtgctgatcccccagaatgccagcacctacagcgccatcggctacatccacagcctgatgggcaactttgaaaatgctgtggactacttccacacagccctgggcctgcggagagatgacaccttctctgtgaccatgctgggccactgcatcgagatgtacatcggggacagcgaggcctacatcggggctgacatcaaggacaagctgaagtgctatgactttgatgtgcacaccatgaagaccctgaagaacatcatcagccccccctgggacttccgggagtttgaggtggagaagcagacagctgaggagaccggcctgacccccctggagaccagcaggaagaccccagacagccggcccagcctggaggagacctttgaaattgagatgaatgaaagtgacatgatgctggagacctccatgtctgaccacagcacctag

SEQ ID NO: 18985 - DNA, 1863 bp, Artificial Sequence
  Description of Artificial Sequence: Synthetic coding sequence
atgaacctggagcggctgaggaagagggtgcggcagtacctggaccagcagcagtaccagagcgccctcttctgggccgacaaggtggccagcctgagccgggaggagccccaggacatctactggctggcccagtgcctgtacctgacagcccagtaccaccgggccgcccacgccctgcggagcaggaagctggacaagctgtatgaggcctgccgctacctggccgcccgctgccactacgccgccaaggagcaccagcaggccctggatgtgctggacatggaggagcccatcaacaagaggctgtttgagaagtacctgaaggatgagagcggcttcaaggaccccagcagtgactgggagatgagccagagcagcatcaagagcagcatctgcctgctgcggggcaagatctatgatgccctggacaacagaaccctggccacctacagctacaaggaggccctgaagctggatgtgtactgctttgaggcctttgacctgctgaccagccaccacatgctgacagcccaggaggagaaggagctgctggagagcctgcccctgagcaagctgtgcaatgaggagcaggagctgctgcgcttcctgtttgagaacaagctgaagaagtacaacaagcccagcgagaccgtcatccctgagagcgtggatggcctgcaggagaacctggatgtggtggtgtccctggccgagcggcactactacaactgtgacttcaagatgtgctacaagctgacctctgtggtgatggagaaggaccccttccacgccagctgcctgcctgtgcacatcggcaccctggtggagctgaacaaggccaatgagctgttctacctgagccacaagctggtggacctgtaccccagcaaccctgtgtcctggtttgctgtgggctgctactacctgatggtgggccacaagaatgagcacgcccggcgctacctgagcaaggccaccaccctggagaagacctacggccctgcctggatcgcctacggccacagctttgctgtggagagcgagcatgaccaggccatggccgcctacttcaccgctgcccagctgatgaagggctgccacctgcccatgctgtacatcggcctggagtatggcctgaccaacaacagcaagctggccgagcgcttcttcagccaggccctgagcatcgcccctgaggacccctttgtgatgcatgaggtgggcgtggtggccttccagaatggagagtggaagacagctgagaagtggttcctggatgccctggagaagatcaaggccatcggaaatgaggtgacagtggacaagtgggagcccctgctgaacaacctgggccacgtgtgcaggaagctgaagaagtatgcagaggccctggactaccaccggcaggccctggtgctgatcccccagaatgccagcacctacagcgccatcggctacatccacagcctgatgggcaactttgaaaatgctgtggactacttccacacagccctgggcctgcggagagatgacaccttctctgtgaccatgctgggccactgcatcgagatgtacatcggggacagcgaggcctacatcggggctgacatcaaggacaagctgaagtgctatgactttgatgtgcacaccatgaagaccctgaagaacatcatcagccccccctgggacttccgggagtttgaggtggagaagcagacagctgaggagaccggcctgacccccctggagaccagcaggaagaccccagacagccggcccagcctggaggagacctttgaaattgagatgaatgaaagtgacatgatgctggagacctccatgtctgaccacagcacctag

SEQ ID NO: 18986 - DNA, 1863 bp, Artificial Sequence; identical to SEQ ID NO: 18985
  Description of Artificial Sequence: Synthetic coding sequence

SEQ ID NO: 18987 - DNA, 1581 bp, Artificial Sequence
  Description of Artificial Sequence: Synthetic coding sequence
atggaggagcccatcaacaagaggctgtttgagaagtacctgaaggatgagagcggcttcaaggaccccagcagtgactgggagatgagccagagcagcatcaagagcagcatctgcctgctgcggggcaagatctatgatgccctggacaacagaaccctggccacctacagctacaaggaggccctgaagctggatgtgtactgctttgaggcctttgacctgctgaccagccaccacatgctgacagcccaggaggagaaggagctgctggagagcctgcccctgagcaagctgtgcaatgaggagcaggagctgctgcgcttcctgtttgagaacaagctgaagaagtacaacaagcccagcgagaccgtcatccctgagagcgtggatggcctgcaggagaacctggatgtggtggtgtccctggccgagcggcactactacaactgtgacttcaagatgtgctacaagctgacctctgtggtgatggagaaggaccccttccacgccagctgcctgcctgtgcacatcggcaccctggtggagctgaacaaggccaatgagctgttctacctgagccacaagctggtggacctgtaccccagcaaccctgtgtcctggtttgctgtgggctgctactacctgatggtgggccacaagaatgagcacgcccggcgctacctgagcaaggccaccaccctggagaagacctacggccctgcctggatcgcctacggccacagctttgctgtggagagcgagcatgaccaggccatggccgcctacttcaccgctgcccagctgatgaagggctgccacctgcccatgctgtacatcggcctggagtatggcctgaccaacaacagcaagctggccgagcgcttcttcagccaggccctgagcatcgcccctgaggacccctttgtgatgcatgaggtgggcgtggtggccttccagaatggagagtggaagacagctgagaagtggttcctggatgccctggagaagatcaaggccatcggaaatgaggtgacagtggacaagtgggagcccctgctgaacaacctgggccacgtgtgcaggaagctgaagaagtatgcagaggccctggactaccaccggcaggccctggtgctgatcccccagaatgccagcacctacagcgccatcggctacatccacagcctgatgggcaactttgaaaatgctgtggactacttccacacagccctgggcctgcggagagatgacaccttctctgtgaccatgctgggccactgcatcgagatgtacatcggggacagcgaggcctacatcggggctgacatcaaggacaagctgaagtgctatgactttgatgtgcacaccatgaagaccctgaagaacatcatcagccccccctgggacttccgggagtttgaggtggagaagcagacagctgaggagaccggcctgacccccctggagaccagcaggaagaccccagacagccggcccagcctggaggagacctttgaaattgagatgaatgaaagtgacatgatgctggagacctccatgtctgaccacagcacctag

SEQ ID NO: 18988 - DNA, 1581 bp, Artificial Sequence; identical to SEQ ID NO: 18987
  Description of Artificial Sequence: Synthetic coding sequence

SEQ ID NO: 18989 - DNA, 1428 bp, Artificial Sequence; identical to SEQ ID NO: 18984
  Description of Artificial Sequence: Synthetic coding sequence

SEQ ID NO: 18990 - DNA, 1500 bp, Artificial Sequence
  Description of Artificial Sequence: Synthetic coding sequence
atggcccagtttgcctttgaaagtgacctgcacagcctgctgcagctggatgcccccatccccaatgcccccccagcccgctggcagaggaaggccaaggaggccgccggccctgcccccagccccatgagagctgccaacagaagccacagcgctggccgcaccccaggccgcacccctgggaagagcagcagcaaggtgcagaccacccccagcaagccaggaggagaccgctacatcccccacaggtctgctgcccagatggaggtggccagcttcctgctgagcaaggagaaccagcctgagaacagccagacccccaccaagaaggagcaccagaaggcctgggccctgaacctgaatggatttgatgtggaggaggccaagatcctgcggctgagcggcaagccccagaatgcccctgagggctaccagaaccggctgaaggtgctgtacagccagaaggccaccccaggcagcagcaggaagacctgccgctacatccccagcctgcctgaccgcatcctggatgcccctgagatcagaaatgactactacctgaacctggtggactggagcagtggaaatgtgctggccgtggccctggacaacagcgtgtacctgtggagcgccagcagcggggacatcctgcagctgctgcagatggagcagcctggagagtacatcagctctgtggcctggatcaaggagggcaactacctggccgtgggcaccagcagcgctgaggtgcagctgtgggatgtgcagcagcagaagaggctgaggaacatgaccagccacagcgcccgggtgggcagcctgtcctggaacagctacatcctgagcagcggcagccgcagcggccacatccaccaccatgatgtgcgggtggccgagcaccacgtggccaccctgagcggccacagccaggaggtgtgtggcctgcgctgggccccagatggccgccacctggccagcggcggcaatgacaacctggtgaatgtgtggcccagcgcccctggagagggcggctgggtgcccctgcagaccttcacccagcaccagggcgctgtgaaggctgtggcctggtgcccctggcagagcaatgtgctggccactggaggcggcaccagtgacagacacatccgcatctggaatgtgtgcagcggggcctgcctgtctgctgtggatgcccacagccaggtgtgcagcatcctgtggagcccccactacaaggagctgatcagcggccacggctttgcccagaaccagctggtgatctggaagtaccccaccatggccaaggtggccgagctgaagggccacaccagccgggtgctgagcctgaccatgagcccagatggagccaccgtggccagcgctgctgctgatgagaccctgcggctgtggcgctgctttgagctggaccctgcccggcggcgggagcgggagaaggccagcgctgccaagagcagcctcatccaccagggcatcagatag

SEQ ID NO: 18991 - DNA, 1500 bp, Artificial Sequence; identical to SEQ ID NO: 18990
  Description of Artificial Sequence: Synthetic coding sequence

SEQ ID NO: 18992 - DNA, 1428 bp, Artificial Sequence
  Description of Artificial Sequence: Synthetic coding sequence
atggcccagtttgcctttgaaagtgacctgcacagcctgctgcagctggatgcccccatccccaatgcccccccagcccgctggcagaggaaggccaaggaggccgccggccctgcccccagccccatgagagctgccaacagaagccacagcgctggccgcaccccaggccgcacccctgggaagagcagcagcaaggtgcagaccacccccagcaaggagaaccagcctgagaacagccagacccccaccaagaaggagcaccagaaggcctgggccctgaacctgaatggatttgatgtggaggaggccaagatcctgcggctgagcggcaagccccagaatgcccctgagggctaccagaaccggctgaaggtgctgtacagccagaaggccaccccaggcagcagcaggaagacctgccgctacatccccagcctgcctgaccgcatcctggatgcccctgagatcagaaatgactactacctgaacctggtggactggagcagtggaaatgtgctggccgtggccctggacaacagcgtgtacctgtggagcgccagcagcggggacatcctgcagctgctgcagatggagcagcctggagagtacatcagctctgtggcctggatcaaggagggcaactacctggccgtgggcaccagcagcgctgaggtgcagctgtgggatgtgcagcagcagaagaggctgaggaacatgaccagccacagcgcccgggtgggcagcctgtcctggaacagctacatcctgagcagcggcagccgcagcggccacatccaccaccatgatgtgcgggtggccgagcaccacgtggccaccctgagcggccacagccaggaggtgtgtggcctgcgctgggccccagatggccgccacctggccagcggcggcaatgacaacctggtgaatgtgtggcccagcgcccctggagagggcggctgggtgcccctgcagaccttcacccagcaccagggcgctgtgaaggctgtggcctggtgcccctggcagagcaatgtgctggccactggaggcggcaccagtgacagacacatccgcatctggaatgtgtgcagcggggcctgcctgtctgctgtggatgcccacagccaggtgtgcagcatcctgtggagcccccactacaaggagctgatcagcggccacggctttgcccagaaccagctggtgatctggaagtaccccaccatggccaaggtggccgagctgaagggccacaccagccgggtgctgagcctgaccatgagcccagatggagccaccgtggccagcgctgctgctgatgagaccctgcggctgtggcgctgctttgagctggaccctgcccggcggcgggagcgggagaaggccagcgctgccaagagcagcctcatccaccagggcatcagatag

SEQ ID NO: 18993 - DNA, 1422 bp, Artificial Sequence
  Description of Artificial Sequence: Synthetic coding sequence
atgagcacagagctgttcagcagcacccgggaggagggcagcagcggcagcggccccagcttccgcagcaaccagaggaagatgctgaacctgctgctggagcgggacaccagcttcaccgtgtgcccagatgtgcccaggacccctgtgggcaagttcctgggggacagcgccaacctgagcatcctgagcggcggcacccccaagcgctgcctggacctgagcaacctgagcagtggagagatcacagccacccagctgaccaccagcgctgacctggatgagaccggccacctggacagcagcggcctgcaggaggtgcacctggccggcatgaaccacgaccagcacctgatgaagtgcagccctgcccagctgctgtgcagcacccccaacggcctggaccggggccacaggaagagagatgccatgtgcagcagcagcgccaacaaggaaaatgacaatggaaacctggtggacagcgagatgaagtacctgggcagccccatcaccaccgtgcccaagctggacaagaaccccaacctgggggaggaccaggccgaggagatcagtgatgagctgatggagttcagcctgaaggaccaggaggccaaggtgagccgcagcggcctgtaccgcagccccagcatgcctgagaacctgaaccggccccggctgaagcaggtggagaagttcaaggacaacaccatcccagacaaggtgaagaagaagtacttcagcggccagggcaagctgaggaagggcctgtgcctgaagaagacagtgtccctgtgtgacatcaccatcacccagatgctggaggaggacagcaaccagggccacctgattggagacttcagcaaggtgtgtgccctgcccaccgtgtctgggaagcaccaggacctgaagtatgtgaaccctgagaccgtggccgccctgctgagcggcaagttccagggcctcatcgagaagttctacgtgattgactgccgctacccctatgagtacctgggcggccacatccagggcgccctgaacctgtacagccaggaggagctgttcaacttcttcctgaagaagcccatcgtgcccctggacacccagaagaggatcatcatcgtgttccactgtgagttcagcagcgagcggggccccaggatgtgccgctgcctgcgggaggaggacaggagcctgaaccagtacccagccctgtactacccagagctgtacatcctgaagggcggctacagagacttcttccctgagtacatggagctgtgtgagccccagagctactgccccatgcaccaccaggaccacaagacagagctgctgcgctgccgcagccagagcaaggtgcaggagggggagcggcagctgcgggagcagatcgccctgctggtgaaggacatgagcccctag

SEQ ID NO: 18994 - DNA, 1203 bp, Artificial Sequence
  Description of Artificial Sequence: Synthetic coding sequence
atgagcacagagctgttcagcagcacccgggaggagggcagcagcggcagcggccccagcttccgcagcaaccagaggaagatgctgaacctgctgctggagcgggacaccagcttcaccgtgtgcccagatgtgcccaggacccctgtgggcaagttcctgggggacagcgccaacctgagcatcctgagcggcagccctggcttcttccgcaccagcggcagcgccttctcctgggatgacaatggaaacctggtggacagcgagatgaagtacctgggcagccccatcaccaccgtgcccaagctggacaagaaccccaacctgggggaggaccaggccgaggagatcagtgatgagctgatggagttcagcctgaaggaccaggaggccaaggtgagccgcagcggcctgtaccgcagccccagcatgcctgagaacctgaaccggccccggctgaagcaggtggagaagttcaaggacaacaccatcccagacaaggtgaagaagaagtacttcagcggccagggcaagctgaggaagggcctgtgcctgaagaagacagtgtccctgtgtgacatcaccatcacccagatgctggaggaggacagcaaccagggccacctgattggagacttcagcaaggtgtgtgccctgcccaccgtgtctgggaagcaccaggacctgaagtatgtgaaccctgagaccgtggccgccctgctgagcggcaagttccagggcctgattgagaagttctacgtgattgactgccgctacccctatgagtacctgggcggccacatccagggcgccctgaacctgtacagccaggaggagctgttcaacttcttcctgaagaagcccatcgtgcccctggacacccagaagaggatcatcatcgtgttccactgtgagttcagcagcgagcggggccccaggatgtgccgctgcctgcgggaggaggacaggagcctgaaccagtacccagccctgtactacccagagctgtacatcctgaagggcggctacagagacttcttccctgagtacatggagctgtgtgagccccagagctactgccccatgcaccaccaggaccacaagacagagctgctgcgctgccgcagccagagcaaggtgcaggagggggagcggcagctgcgggagcagatcgccctgctggtgaaggacatgagcccctag

SEQ ID NO: 18995 - DNA, 1332 bp, Artificial Sequence
  Description of Artificial Sequence: Synthetic coding sequence
atgagcacagagctgttcagcagcacccgggaggagggcagcagcggcagcggccccagcttccgcagcaaccagaggaagatgctgaacctgctgctggagcgggacaccagcttcaccgtgtgcccagatgtgcccaggacccctgtgggcaagttcctgggggacagcgccaacctgagcatcctgagcggcggcacccccaagcgctgcctggacctgagcaacctgagcagtggagagatcacagccacccagctgaccaccagcgctgacctggatgagaccggccacctggacagcagcggcctgcaggaggtgcacctggccggcatgaaccacgaccagcacctgatgaagtgcagcccagacaatggaaacctggtggacagcgagatgaagtacctgggcagccccatcaccaccgtgcccaagctggacaagaaccccaacctgggggaggaccaggccgaggagatcagtgatgagctgatggagttcagcctgaaggaccaggaggccaaggtgagccgcagcggcctgtaccgcagccccagcatgcctgagaacctgaaccggccccggctgaagcaggtggagaagttcaaggacaacaccatcccagacaaggtgaagaagaagtacttcagcggccagggcaagctgaggaagggcctgtgcctgaagaagacagtgtccctgtgtgacatcaccatcacccagatgctggaggaggacagcaaccagggccacctgattggagacttcagcaaggtgtgtgccctgcccaccgtgtctgggaagcaccaggacctgaagtatgtgaaccctgagaccgtggccgccctgctgagcggcaagttccagggcctcatcgagaagttctacgtgattgactgccgctacccctatgagtacctgggcggccacatccagggcgccctgaacctgtacagccaggaggagctgttcaacttcttcctgaagaagcccatcgtgcccctggacacccagaagaggatcatcatcgtgttccactgtgagttcagcagcgagcggggccccaggatgtgccgctgcctgcgggaggaggacaggagcctgaaccagtacccagccctgtactacccagagctgtacatcctgaagggcggctacagagacttcttccctgagtacatggagctgtgtgagccccagagctactgccccatgcaccaccaggaccacaagacagagctgctgcgctgccgcagccagagcaaggtgcaggagggggagcggcagctgcgggagcagatcgccctgctggtgaaggacatgagcccctag

SEQ ID NO: 18996 - DNA, 1293 bp, Artificial Sequence
  Description of Artificial Sequence: Synthetic coding sequence
atgagcacagagctgttcagcagcacccgggaggagggcagcagcggcagcggccccagcttccgcagcaaccagaggaagatgctgaacctgctgctggagcgggacaccagcttcaccgtgtgcccagatgtgcccaggacccctgtgggcaagttcctgggggacagcgccaacctgagcatcctgagcggcagccctggcttcttccgcaccagcggcagcgccttctcctgggatgcccagctgctgtgcagcaccccaaatggcctggaccggggccacaggaagagagatgccatgtgcagcagcagcgccaacaaggaaaatgacaatggaaacctggtggacagcgagatgaagtacctgggcagccccatcaccaccgtgcccaagctggacaagaaccccaacctgggggaggaccaggccgaggagatcagtgatgagctgatggagttcagcctgaaggaccaggaggccaaggtgagccgcagcggcctgtaccgcagccccagcatgcctgagaacctgaaccggccccggctgaagcaggtggagaagttcaaggacaacaccatcccagacaaggtgaagaagaagtacttcagcggccagggcaagctgaggaagggcctgtgcctgaagaagacagtgtccctgtgtgacatcaccatcacccagatgctggaggaggacagcaaccagggccacctgattggagacttcagcaaggtgtgtgccctgcccaccgtgtctgggaagcaccaggacctgaagtatgtgaaccctgagaccgtggccgccctgctgagcggcaagttccagggcctgattgagaagttctacgtgattgactgccgctacccctatgagtacctgggcggccacatccagggcgccctgaacctgtacagccaggaggagctgttcaacttcttcctgaagaagcccatcgtgcccctggacacccagaagaggatcatcatcgtgttccactgtgagttcagcagcgagcggggccccaggatgtgccgctgcctgcgggaggaggacaggagcctgaaccagtacccagccctgtactacccagagctgtacatcctgaagggcggctacagagacttcttccctgagtacatggagctgtgtgagccccagagctactgccccatgcaccaccaggaccacaagacagagctgctgcgctgccgcagccagagcaaggtgcaggagggggagcggcagctgcgggagcagatcgccctgctggtgaaggacatgagcccctag

SEQ ID NO: 18997 - DNA, 1203 bp, Artificial Sequence; identical to SEQ ID NO: 18994
  Description of Artificial Sequence: Synthetic coding sequence

SEQ ID NO: 18998 - DNA, 750 bp, Artificial Sequence
  Description of Artificial Sequence: Synthetic coding sequence
atgagcacagagctgttcagcagcacccgggaggagggcagcagcggcagcggccccagcttccgcagcaaccagaggaagatgctgaacctgctgctggagcgggacaccagcttcaccgtgtgcccagatgtgcccaggacccctgtgggcaagttcctgggggacagcgccaacctgagcatcctgagcggcggcacccccaagcgctgcctggacctgagcaacctgagcagtggagagatcacagccacccagctgaccaccagcgctgacctggatgagaccggccacctggacagcagcggcctgcaggaggtgcacctggccggcatgaaccacgaccagcacctgatgaagtgcagccctgcccagctgctgtgcagcacccccaacggcctggaccggggccacaggaagagagatgccatgtgcagcagcagcgccaacaaggaaaatgacaatggaaacctggtggacagcgagatgaagtacctgggcagccccatcaccaccgtgcccaagctggacaagaaccccaacctgggggaggaccaggccgaggagatcagtgatgagctgatggagttcagcctgaaggaccaggaggccaaggtgagccgcagcggcctgtaccgcagccccagcatgcctgagaacctgaaccggccccggctgaagcaggtggagaagttcaaggacaacaccatcccagacaaggtgaagaagaagtacttcagcggccagtag

SEQ ID NO: 18999 - DNA, 1422 bp, Artificial Sequence; identical to SEQ ID NO: 18993
  Description of Artificial Sequence: Synthetic coding sequence

SEQ ID NO: 19000 - DNA, 1473 bp, Artificial Sequence
  Description of Artificial Sequence: Synthetic coding sequence
atgtctgaggaggcccgcttctgcttcagccctggagagaacagcaagaccatgagcacagagctgttcagcagcacccgggaggagggcagcagcggcagcggccccagcttccgcagcaaccagaggaagatgctgaacctgctgctggagcgggacaccagcttcaccgtgtgcccagatgtgcccaggacccctgtgggcaagttcctgggggacagcgccaacctgagcatcctgagcggcggcacccccaagcgctgcctggacctgagcaacctgagcagcggggagatcacagccacccagctgaccaccagcgctgacctggatgaaacaggccacctggacagcagcggcctgcaggaggtgcacctggccggcatgaaccacgaccagcacctgatgaagtgcagccctgcccagctgctgtgcagcaccccaaatggcctggaccggggccacaggaagagagatgccatgtgcagcagcagcgccaacaaggaaaatgacaatggaaacctggtggacagcgagatgaagtacctgggcagccccatcaccaccgtgcccaagctggacaagaaccccaacctgggggaggaccaggccgaggagatcagtgatgagctgatggagttcagcctgaaggaccaggaggccaaggtgagccgcagcggcctgtaccgcagccccagcatgcctgagaacctgaaccggccccggctgaagcaggtggagaagttcaaggacaacaccatcccagacaaggtgaagaagaagtacttcagcggccagggcaagctgaggaagggcctgtgcctgaagaagacagtgtccctgtgtgacatcaccatcacccagatgctggaggaggacagcaaccagggccacctgattggagacttcagcaaggtgtgtgccctgcccaccgtgtctgggaagcaccaggacctgaagtatgtgaaccctgagaccgtggccgccctgctgagcggcaagttccagggcctgattgagaagttctacgtgattgactgccgctacccctatgagtacctgggcggccacatccagggcgccctgaacctgtacagccaggaggagctgttcaacttcttcctgaagaagcccatcgtgcccctggacacccagaagaggatcatcatcgtgttccactgtgagttcagcagcgagcggggccccaggatgtgccgctgcctgcgggaggaggacaggagcctgaaccagtacccagccctgtactacccagagctgtacatcctgaagggcggctacagagacttcttccctgagtacatggagctgtgtgagccccagagctactgccccatgcaccaccaggaccacaagacagagctgctgcgctgccgcagccagagcaaggtgcaggagggggagcggcagctgcgggagcagatcgccctgctggtgaaggacatgagcccctag

SEQ ID NO: 19001 - DNA, 288 bp, Artificial Sequence
  Description of Artificial Sequence: Synthetic coding sequence
atggagggcggctttggaagtgactttggaggcagcggcagcggcaagctggaccccggcctcatcatggagcaggtgaaggtgcagattgctgtggccaatgcccaggagctgctgcagaggatgacagacaagtgcttcagaaaatgtattggcaagccaggcggcagcctggacaacagcgagcagaagtgcatcgccatgtgcatggaccgctacatggatgcctggaacacagtgtcccgggcctacaacagccggctgcagcgggagcgggccaacatgtag

SEQ ID NO: 19002 - DNA, 576 bp, Artificial Sequence
  Description of Artificial Sequence: Synthetic coding sequence
atgcagaccatcaagtgtgtggtggtgggagatggagctgtgggcaagacctgcctgctgatctcctacaccaccaacaagttccccagtgaatatgtgcccaccgtgtttgacaactatgctgtgacagtgatgattggaggagagccctacaccctgggcctgtttgacacagctggccaggaggactatgaccggctgcggcccctgagctacccccagacagatgtgttcctggtgtgcttctctgtggtgagccccagcagctttgaaaatgtgaaggagaagtgggtgcctgagatcacccaccactgccccaagacccccttcctgctggtgggcacccagattgacctgagagatgaccccagcaccatcgagaagctggccaagaacaagcagaagcccatcaccccagagacagctgagaagctggcccgggacctgaaggctgtgaagtatgtggagtgcagcgccctgacccagaggggcctgaagaatgtgtttgatgaggccatcctggccgccctggagcccccagagacccagcccaagaggaagtgctgcatcttctag

SEQ ID NO: 19003 - DNA, 576 bp, Artificial Sequence
  Description of Artificial Sequence: Synthetic coding sequence
atgcagaccatcaagtgtgtggtggtgggagatggagctgtgggcaagacctgcctgctgatctcctacaccaccaacaagttccccagtgaatatgtgcccaccgtgtttgacaactatgctgtgacagtgatgattggaggagagccctacaccctgggcctgtttgacacagctggccaggaggactatgaccggctgcggcccctgagctacccccagacagatgtgttcctggtgtgcttctctgtggtgagccccagcagctttgaaaatgtgaaggagaagtgggtgcctgagatcacccaccactgccccaagacccccttcctgctggtgggcacccagattgacctgagagatgaccccagcaccatcgagaagctggccaagaacaagcagaagcccatcaccccagagacagctgagaagctggcccgggacctgaaggctgtgaagtatgtggagtgcagcgccctgacccagaagggcctgaagaatgtgtttgatgaggccatcctggccgccctggagcccccagagcccaagaagagccgccgctgtgtgctgctgtag

SEQ ID NO: 19004 - DNA, 576 bp, Artificial Sequence; identical to SEQ ID NO: 19003
  Description of Artificial Sequence: Synthetic coding sequence

SEQ ID NO: 19005 - DNA, 411 bp, Artificial Sequence
  Description of Artificial Sequence: Synthetic coding sequence
atgcagaccatcaagtgtgtggtggtgggagatggagctgtgggcaagacctgcctgctgatctcctacaccaccaacaagttccccagtgaatatgtgcccaccgtgtttgacaactatgctgtgacagtgatgattggaggagagccctacaccctgggcctgtttgacacagctggccaggaggactatgaccggctgcggcccctgagctacccccagacagatgtgttcctggtgtgcttctctgtggtgagccccagcagctttgaaaatgtgaaggagaagtgggtgcctgagatcacccaccactgccccaagacccccttcctgctggtgggcacccagattgacctgagagatgaccccagcaccatcgagaagctggccaagaacaagcagaagccctag

SEQ ID NO: 19006 - DNA, 702 bp, Artificial Sequence
  Description of Artificial Sequence: Synthetic coding sequence
atgagcccagacatcctgcacaacaagcagatcagcatcggcatctgcacagactacctggacttctcctgggtgaactacatccacttcaagcagctgaagaaccagtggaaggtgcggcggggggacaccggctttgcccggtctgctggccggcagaacagcagccggcaggacagcaatgagtggtggagccagtttggagaggtgtgccccacctcctggaatgaggtgtttgacaactatgctgtgacagtgatgattggaggagagccctacaccctgggcctgtttgacacagctggccaggaggactatgaccggctgcggcccctgagctacccccagacagatgtgttcctggtgtgcttctctgtggtgagccccagcagctttgaaaatgtgaaggagaagtgggtgcctgagatcacccaccactgccccaagacccccttcctgctggtgggcacccagattgacctgagagatgaccccagcaccatcgagaagctggccaagaacaagcagaagcccatcaccccagagacagctgagaagctggcccgggacctgaaggctgtgaagtatgtggagtgcagcgccctgacccagaagggcctgaagaatgtgtttgatgaggccatcctggccgccctggagcccccagagcccaagaagagccgccgctgtgtgctgctgtag

SEQ ID NO: 19007 - DNA, 1269 bp, Artificial Sequence
  Description of Artificial Sequence: Synthetic coding sequence
atgaacagcggccacagcttcagccagacccccagcgccagcttccacggggccggcggcggctggggccggcccaggagcttcccccgggcccccaccgtgcatggaggagctgggggcgcccgcatcagcctgtccttcaccaccaggagctgccccccacctgggggctcctggggcagcggccgcagcagccccctgctgggcggcaatggcaaggccaccatgcagaacctgaatgaccggctggccagctacctggagaaggtgcgggccctggaggaggccaacatgaagctggagagccgcatcctgaagtggcaccagcagagggaccccggcagcaagaaggactacagccagtatgaggagaacatcacccacctgcaggagcagatcgtggatggcaagatgaccaatgcccagatcatcctgctgattgacaatgccaggatggctgtggatgacttcaacctgaagtatgaaaatgagcacagcttcaagaaggacctggagattgaggtggagggcctgcggaggaccctggacaacctgaccatcgtgaccacagacctggagcaggaggtggagggcatgaggaaggagctgatcctgatgaagaagcaccacgagcaggagatggagaagcaccacgtgcccagcgacttcaacgtgaatgtgaaggtggacaccggccccagagaagatctcatcaaggtgctggaggacatgaggcaggagtatgagctgatcatcaagaagaagcaccgggacctggacacctggtacaaggagcagagcgctgccatgagccaggaggccgccagccctgccaccgtgcagagccggcagggcgacatccacgagctgaagaggaccttccaggccctggagattgacctgcagacccagtacagcaccaagagcgccctggagaacatgctgtctgagacccagagccgctacagctgcaagctgcaggacatgcaggagatcatcagccactatgaggaggagctgacccagctgcggcatgagctggagcggcagaacaatgagtaccaggtgctgctgggcatcaagacccacctggagaaggagatcaccacctaccgccgcctgctggagggggagagcgagggcacccgggaggagagcaagagctccatgaaggtgtctgccacccccaagatcaaggccatcacccaggagaccatcaatggccgcctggtgctgtgccaggtgaatgagatccagaagcacgcctag

SEQ ID NO: 19008 - DNA, 1596 bp, Artificial Sequence
  Description of Artificial Sequence: Synthetic coding sequence
atggctgatgtgctgtctgtgctgcggcagtacaacatccagaagaaggagatcgtggtgaagggagatgaagtcatctttggagagttctcctggcccaagaatgtgaagaccaactacgtggtgtggggcaccgggaaggagggccagccccgggagtactacaccctggacagcatcctcttcctgctgaacaacgtgcacctgagccaccctgtgtatgtgcggcgggccgccacagagaacatccctgtggtgagaagaccagacaggaaggacctgctgggctacctgaatggagaggccagcaccagcgccagcattgacagaagtgcccccctggagatcggcctgcagaggagcacccaggtgaagagagctgctgatgaggtgctggccgaggccaagaagcccagaattgaagatgaggagtgtgtgcggctggacaaggagcggctggccgcccggctggagggccacaaggagggcatcgtgcagacagagcagatccgcagcctgtctgaggccatgtctgtggagaagattgctgccatcaaggccaagatcatggccaagaagaggagcaccatcaagacagacctggatgatgacatcacagccctgaagcagaggagctttgtggatgctgaggtggatgtgacccgggacatcgtgtcccgggagcgggtgtggaggaccaggaccaccatcctgcagagcacaggcaagaacttcagcaagaacatctttgccatcctgcagagcgtgaaggcccgggaggagggccgggcccctgagcagaggcctgccccaaatgctgcccctgtggaccccaccctgcggaccaagcagcccatcccagctgcctacaacagatatgaccaggagcgcttcaagggcaaggaggagacagagggcttcaagattgacaccatgggcacctaccacggcatgaccctgaagtctgtgacagagggcgccagcgccaggaagacccagaccccagctgcccagcctgtgcccaggcctgtgtcccaggcccggcccccacccaaccagaagaagggcagcaggacccccatcatcatcatcccagctgccaccaccagcctcatcaccatgctgaatgccaaggacctgctgcaggacctgaagtttgtgcccagtgatgagaagaagaagcagggctgccagcgggagaatgagaccctcatccagaggaggaaggaccagatgcagcccggcggcacagccatctctgtgacagtgccctacagagtggtggaccagcccctgaagctgatgccccaggactgggacagagtggtggccgtgtttgtgcagggccctgcctggcagttcaagggctggccctggctgctgcctgatggcagccctgtggacatctttgccaagatcaaggccttccacctgaagtatgatgaggtgcggctggaccccaacgtgcagaagtgggatgtgacagtgctggagctgagctaccacaagaggcacctggacaggcctgtgttcctgcgcttctgggagaccctggaccgctacatggtgaagcacaagagccacctgcgcttctag

SEQ ID NO: 19009 - DNA, 951 bp, Artificial Sequence
  Description of Artificial Sequence: Synthetic coding sequence
atggctgatgtgctgtctgtgctgcggcagtacaacatccagaagaaggagatcgtggtgaagggagatgaagtcatctttggagagttctcctggcccaagaatgtgaagaccaactacgtggtgtggggcaccgggaaggagggccagccccgggagtactacaccctggacagcatcctcttcctgctgaacaacgtgcacctgagccaccctgtgtatgtgcggcgggccgccacagagaacatccctgtggtgagaagaccagacaggaaggacctgctgggctacctgaatggagaggccagcaccagcgccagcattgacagaagtgcccccctggagatcggcctgcagaggagcacccaggtgaagagagctgctgatgaggtgctggccgaggccaagaagcccagaattgaagatgaggagtgtgtgcggctggacaaggagcggctggccgcccggctggagggccacaaggagggcatcgtgcagacagagcagatccgcagcctgtctgaggccatgtctgtggagaagattgctgccatcaaggccaagatcatggccaagaagaggagcaccatcaagacagacctggatgatgacatcacagccctgaagcagaggagctttgtggatgctgaggtggatgtgacccgggacatcgtgtcccgggagcgggtgtggaggaccaggaccaccatcctgcagagcacaggcaagaacttcagcaagaacatctttgccatcctgcagagcgtgaaggcccgggaggagggccgggcccctgagcagaggcctgccccaaatgctgcccctgtggaccccaccctgcggaccaagcagcccatcccagctgcctacaacagatatgaccaggagcgcatcagcaacacccactaccacaacagctgcagctaccacctgttcaacaaccacgcctag

SEQ ID NO: 19010 - DNA, 1317 bp, Artificial Sequence
  Description of Artificial Sequence: Synthetic coding sequence
atgggcggctgtgccggcagcagaagacgcttcagtgacagcgagggggaggagaccgtgcctgagccccggctgcccctgctggaccaccagggcgcccactggaagaatgctgtgggcttctggctgctgggcctgtgcaacaacttctcctatgtggtgatgctgtctgctgcccatgacatcctgagccacaagaggaccagcggcaaccagagccacgtggaccccggccccacccccatcccccacaacagcagcagcagatttgactgcaacagcgtgtccacagctgctgtgctgctggccgacatcctgcccaccctggtgatcaagctgctggcccccctgggcctgcacctgctgccctacagcccccgggtgctggtgtctggcatctgtgccgccggcagctttgtgctggtggccttcagccacagcgtgggcaccagcctgtgtggggtggtgtttgccagcatcagcagcggcctgggggaggtgaccttcctgagcctgacagccttctaccccagggctgtgatctcctggtggagcagcggcaccggcggggccggcctgctgggcgccctgagctacctgggcctgacccaggccggcctgagcccccagcagaccctgctgtccatgctgggcatcccagccctgctgctggccagctacttcctgctgctgaccagccctgaggcccaggaccctggaggagaggaggaggccgagagcgctgcccggcagcccctcatcagaacagaggcccctgagagcaagccaggcagcagcagcagcctgagcctgcgggagcgctggacagtgttcaagggcctgctgtggtacatcgtgcccctggtggtggtgtactttgctgagtacttcatcaaccagggcctgtttgagctgctcttcttctggaacaccagcctgagccacgcccagcagtaccgctggtaccagatgctgtaccaggccggcgtgtttgccagccgcagcagcctgcgctgctgccgcatccgcttcacctgggccctggccctgctgcagtgcctgaacctggtgttcctgctggctgatgtgtggtttggcttcctgcccagcatctacctggtgttcctgatcatcctgtatgagggcctgctgggcggggccgcctacgtgaacaccttccacaacatcgccctggagaccagtgatgagcaccgggagtttgccatggccgccacctgcatcagtgacaccctgggcatcagcctgagcggcctgctggccctgcccctgcatgacttcctgtgccagctgtcctag

SEQ ID NO: 19011 - DNA, 504 bp, Artificial Sequence
  Description of Artificial Sequence: Synthetic coding sequence
atgggcggctgtgccggcagcagaagacgcttcagtgacagcgagggggaggagaccgtgcctgagccccggctgcccctgctggaccaccagggcgcccactggaagaatgctgtgggcttctggctgctgggcctgtgcaacaacttctcctatgtggtgatgctgtctgctgcccatgacatcctgagccacaagaggaccagcggcaaccagagccaccccccaggcagccggcagtgggacctgtgctgctggaagctgcggcccggctgcctcttctccttctgtggggaccagcctgtgtgctacttcctgctgctgaccagccctgaggcccaggaccccggcggggaggaggaggccgagagcgctgcccggcagcccctcatcagaacagaggcccctgagagcaagccaggcagcagcagcagcctgagcctgcgggagcgctggacagtgttcaagggcctgctgtggtacatcgtgcccctggtggtgtag

SEQ ID NO: 19012 - DNA, 1266 bp, Artificial Sequence
  Description of Artificial Sequence: Synthetic coding sequence
atgggcggctgtgccggcagcagaagacgcttcagtgacagcgagggggaggagaccgtgcctgagccccggctgcccctgctggaccaccagggcgcccactggaagaatgctgtgggcttctggctgctgggcctgtgcaacaacttctcctatgtggtgatgctgtctgctgcccatgacatcctgagccacaagaggaccagcggcaaccagagccacgtggaccccggccccacccccatcccccacaacagcagcagcagatttgactgcaacagcgtgtccacagctgctgtgctgctggccgacatcctgcccaccctggtgatcaagctgctggcccccctgggcctgcacctgctgccctacagcccccgggtgctggtgtctggcatctgtgccgccggcagctttgtgctggtggccttcagccacagcgtgggcaccagcctgtgtggggtggtgtttgccagcatcagcagcggcctgggggaggtgaccttcctgagcctgacagccttctaccccagggctgtgatctcctggtggagcagcggcaccggcggggccggcctgctgggcgccctgagctacctgggcctgacccaggccggcctgagcccccagcagaccctgctgtccatgctgggcatcccagccctgctgctggccagctacttcctgctgctgaccagccctgaggcccaggaccctggaggagaggaggaggccgagagcgctgcccggcagcccctcatcagaacagaggcccctgagagcaagccaggcagcagcagcagcctgagcctgcgggagcgctggacagtgttcaaggtgaggatgatggccggctttgagctgctcttcttctggaacaccagcctgagccacgcccagcagtaccgctggtaccagatgctgtaccaggccggcgtgtttgccagccgcagcagcctgcgctgctgccgcatccgcttcacctgggccctggccctgctgcagtgcctgaacctggtgttcctgctggctgatgtgtggtttggcttcctgcccagcatctacctggtgttcctgatcatcctgtatgagggcctgctgggcggggccgcctacgtgaacaccttccacaacatcgccctggagaccagtgatgagcaccgggagtttgccatggccgccacctgcatcagtgacaccctgggcatcagcctgagcggcctgctggccctgcccctgcatgacttcctgtgccagctgtcctag

SEQ ID NO: 19013 - DNA, 1173 bp, Artificial Sequence
  Description of Artificial Sequence: Synthetic coding sequence
atgggcggctgtgccggcagcagaagacgcttcagtgacagcgagggggaggagaccgtgcctgagccccggctgcccctgctggaccaccagggcgcccactggaagaatgctgtgggcttctggctgctgggcctgtgcaacaacttctcctatgtggtgatgctgtctgctgcccatgacatcctgagccacaagaggaccagcggcaaccagagccacgtggaccccggccccacccccatcccccacaacagcagcagcagatttgactgcaacagcgtgtccacagctgctgtgctgctggccgacatcctgcccaccctggtgatcaagctgctggcccccctgggcctgcacctgctgccctacagcccccgggtgctggtgtctggcatctgtgccgccggcagctttgtgctggtggccttcagccacagcgtgggcaccagcctgtgtggggtggtgtttgccagcatcagcagcggcctgggggaggtgaccttcctgagcctgacagccttctaccccagctacttcctgctgctgaccagccctgaggcccaggaccctggaggagaggaggaggccgagagcgctgcccggcagcccctcatcagaacagaggcccctgagagcaagccaggcagcagcagcagcctgagcctgcgggagcgctggacagtgttcaagggcctgctgtggtacatcgtgcccctggtggtggtgtactttgctgagtacttcatcaaccagggcctgtttgagctgctcttcttctggaacaccagcctgagccacgcccagcagtaccgctggtaccagatgctgtaccaggccggcgtgtttgccagccgcagcagcctgcgctgctgccgcatccgcttcacctgggccctggccctgctgcagtgcctgaacctggtgttcctgctggctgatgtgtggtttggcttcctgcccagcatctacctggtgttcctgatcatcctgtatgagggcctgctgggcggggccgcctacgtgaacaccttccacaacatcgccctggagaccagtgatgagcaccgggagtttgccatggccgccacctgcatcagtgacaccctgggcatcagcctgagcggcctgctggccctgcccctgcatgacttcctgtgccagctgtcctag

SEQ ID NO: 19014 - DNA, 762 bp, Artificial Sequence
  Description of Artificial Sequence: Synthetic coding sequence
atgggcggctgtgccggcagcagaagacgcttcagtgacagcgagggggaggagaccgtgcctgagccccggctgcccctgctggaccaccagggcgcccactggaagaatgctgtgggcttctggctgctgggcctgtgcaacaacttctcctatgtggtgatgctgtctgctgcccatgacatcctgagccacaagaggaccagcggcaaccagagccacgtggaccccggccccacccccatcccccacaacagcagcagcagatttgactgcaacagcgtgtccacagctgctgtgctgctggccgacatcctgcccaccctggtgatcaagctgctggcccccctgggcctgcacctgctgccctacagcccccgggtgctggtgtctggcatctgtgccgccggcagctttgtgctggtggccttcagccacagcgtgggcaccagcctgtgtggcagcagcagcagcctgagcctgcgggagcgctggacagtgttcaagggcctgctgtggtacatcgtgcccctggtggtggtgtactttgctgagtacttcatcaaccagggcctgtttgagctgctcttcttctggaacaccagcctgagccacgcccagcagtaccgctggtaccagatgctgtaccaggccggcgtgtttgccagccgcagcagcctgcgctgctgccgcatccgcttcacctgggccctggccctgctgcagatggagagccgctctgtggcccaggccggcatgtag

SEQ ID NO: 19015 - DNA, 1020 bp, Artificial Sequence
  Description of Artificial Sequence: Synthetic coding sequence
atgggcggctgtgccggcagcagaagacgcttcagtgacagcgagggggaggagaccgtgcctgagccccggctgcccctgctggaccaccagggcgcccactggaagaatgctgtgggcttctggctgctgggcctgtgcaacaacttctcctatgtggtgatgctgtctgctgcccatgacatcctgagccacaagaggaccagcggcaaccagagccacgtggaccccggccccacccccatcccccacaacagcagcagcagatttgactgcaacagcgtgtccacagcccctcctggcagccggcagtgggacctgtgctgctggaagctgcggcccggctgcctcttctccttctgtggggaccagcctgtgtgctacttcctgctgctgaccagccctgaggcccaggaccccggcggggaggaggaggccgagagcgctgcccggcagcccctcatcagaacagaggcccctgagagcaagccaggcagcagcagcagcctgagcctgcgggagcgctggacagtgttcaagggcctgctgtggtacatcgtgcccctggtggtggtgtactttgctgagtacttcatcaaccagggcctgtttgagctgctcttcttctggaacaccagcctgagccacgcccagcagtaccgctggtaccagatgctgtaccaggccggcgtgtttgccagccgcagcagcctgcgctgctgccgcatccgcttcacctgggccctggccctgctgcagtgcctgaacctggtgttcctgctggctgatgtgtggtttggcttcctgcccagcatctacctggtgttcctgatcatcctgtatgagggcctgctgggcggggccgcctacgtgaacaccttccacaacatcgccctggagaccagtgatgagcaccgggagtttgccatggccgccacctgcatcagtgacaccctgggcatcagcctgagcggcctgctggccctgcccctgcatgacttcctgtgccagctgtcctag

SEQ ID NO: 19016 - DNA, 1155 bp, Artificial Sequence
  Description of Artificial Sequence: Synthetic coding sequence
atgctgtctgctgcccatgacatcctgagccacaagaggaccagcggcaaccagagccacgtggaccccggccccacccccatcccccacaacagcagcagcagatttgactgcaacagcgtgtccacagctgctgtgctgctggccgacatcctgcccaccctggtgatcaagctgctggcccccctgggcctgcacctgctgccctacagcccccgggtgctggtgtctggcatctgtgccgccggcagctttgtgctggtggccttcagccacagcgtgggcaccagcctgtgtggggtggtgtttgccagcatcagcagcggcctgggggaggtgaccttcctgagcctgacagccttctaccccagggctgtgatctcctggtggagcagcggcaccggcggggccggcctgctgggcgccctgagctacctgggcctgacccaggccggcctgagcccccagcagaccctgctgtccatgctgggcatcccagccctgctgctggccagctacttcctgctgctgaccagccctgaggcccaggaccctggaggagaggaggaggccgagagcgctgcccggcagcccctcatcagaacagaggcccctgagagcaagccaggcagcagcagcagcctgagcctgcgggagcgctggacagtgttcaagggcctgctgtggtacatcgtgcccctggtggtggtgtactttgctgagtacttcatcaaccagggcctgtttgagctgctcttcttctggaacaccagcctgagccacgcccagcagtaccgctggtaccagatgctgtaccaggccggcgtgtttgccagccgcagcagcctgcgctgctgccgcatccgcttcacctgggccctggccctgctgcagtgcctgaacctggtgttcctgctggctgatgtgtggtttggcttcctgcccagcatctacctggtgttcctgatcatcctgtatgagggcctgctgggcggggccgcctacgtgaacaccttccacaacatcgccctggagaccagtgatgagcaccgggagtttgccatggccgccacctgcatcagtgacaccctgggcatcagcctgagcggcctgctggccctgcccctgcatgacttcctgtgccagctgtcctag

SEQ ID NO: 19017 - DNA, 1317 bp, Artificial Sequence; identical to SEQ ID NO: 19010
  Description of Artificial Sequence: Synthetic coding sequence

SEQ ID NO: 19018 - DNA, 1317 bp, Artificial Sequence; identical to SEQ ID NO: 19010
  Description of Artificial Sequence: Synthetic coding sequence

SEQ ID NO: 19019 - DNA, 1017 bp, Artificial Sequence
  Description of Artificial Sequence: Synthetic coding sequence
atgtggacccaggcccagaggaggagccccaccacagcccaccacgacctgacagccaccctgagcctgcggctgccccgggtgctggtgtctggcatctgtgccgccggcagctttgtgctggtggccttcagccacagcgtgggcaccagcctgtgtggggtggtgtttgccagcatcagcagcggcctgggggaggtgaccttcctgagcctgacagccttctaccccagggctgtgatctcctggtggagcagcggcaccggcggggccggcctgctgggcgccctgagctacctgggcctgacccaggccggcctgagcccccagcagaccctgctgtccatgctgggcatcccagccctgctgctggccagctacttcctgctgctgaccagccctgaggcccaggaccctggaggagaggaggaggccgagagcgctgcccggcagcccctcatcagaacagaggcccctgagagcaagccaggcagcagcagcagcctgagcctgcgggagcgctggacagtgttcaagggcctgctgtggtacatcgtgcccctggtggtggtgtactttgctgagtacttcatcaaccagggcctgtttgagctgctcttcttctggaacaccagcctgagccacgcccagcagtaccgctggtaccagatgctgtaccaggccggcgtgtttgccagccgcagcagcctgcgctgctgccgcatccgcttcacctgggccctggccctgctgcagtgcctgaacctggtgttcctgctggctgatgtgtggtttggcttcctgcccagcatctacctggtgttcctgatcatcctgtatgagggcctgctgggcggggccgcctacgtgaacaccttccacaacatcgccctggagaccagtgatgagcaccgggagtttgccatggccgccacctgcatcagtgacaccctgggcatcagcctgagcggcctgctggccctgcccctgcatgacttcctgtgccagctgtcctag

SEQ ID NO: 19020 - DNA, 1083 bp, Artificial Sequence
  Description of Artificial Sequence: Synthetic coding sequence
atgctgtctgctgcccatgacatcctgagccacaagaggaccagcggcaaccagagccatgctgtgctgctggccgacatcctgcccaccctggtgatcaagctgctggcccccctgggcctgcacctgctgccctacagcccccgggtgctggtgtctggcatctgtgccgccggcagctttgtgctggtggccttcagccacagcgtgggcaccagcctgtgtggggtggtgtttgccagcatcagcagcggcctgggggaggtgaccttcctgagcctgacagccttctaccccagggctgtgatctcctggtggagcagcggcaccggcggggccggcctgctgggcgccctgagctacctgggcctgacccaggccggcctgagcccccagcagaccctgctgtccatgctgggcatcccagccctgctgctggccagctacttcctgctgctgaccagccctgaggcccaggaccctggaggagaggaggaggccgagagcgctgcccggcagcccctcatcagaacagaggcccctgagagcaagccaggcagcagcagcagcctgagcctgcgggagcgctggacagtgttcaagggcctgctgtggtacatcgtgcccctggtggtggtgtactttgctgagtacttcatcaaccagggcctgtttgagctgctcttcttctggaacaccagcctgagccacgcccagcagtaccgctggtaccagatgctgtaccaggccggcgtgtttgccagccgcagcagcctgcgctgctgccgcatccgcttcacctgggccctggccctgctgcagtgcctgaacctggtgttcctgctggctgatgtgtggtttggcttcctgcccagcatctacctggtgttcctgatcatcctgtatgagggcctgctgggcggggccgcctacgtgaacaccttccacaacatcgccctggagaccagtgatgagcaccgggagtttgccatggccgccacctgcatcagtgacaccctgggcatcagcctgagcggcctgctggccctgcccctgcatgacttcctgtgccagctgtcctag

SEQ ID NO: 19021 - DNA, 1299 bp, Artificial Sequence
  Description of Artificial Sequence: Synthetic coding sequence
atggctgtgccctttgtggaggactgggacctggtgcagaccctgggggagggcgcctacggggaggtgcagctggccgtgaacagagtgacagaggaggccgtggccgtgaagatcgtggacatgaagagagctgtggactgcccagagaacatcaagaaggagatctgcatcaacaagatgctgaaccatgaaaatgtggtgaagttctacggccaccggcgggagggcaacatccagtacctgttcctggagtactgcagcggcggggagctgtttgaccgcatcgagccagacatcggcatgcctgagccagatgcccagcgcttcttccaccagctgatggccggcgtggtgtacctgcacggcatcggcatcacccaccgggacatcaagccagagaacctgctgctggatgagcgggacaacctgaagatcagtgactttggcctggccaccgtcttccgctacaacaaccgggagcggctgctgaacaagatgtgtggcaccctgccctacgtggcccctgagctgctgaagagaagagagttccacgccgagcctgtggatgtgtggagctgtggcatcgtgctgacagccatgctggccggggagctgccctgggaccagcccagcgacagctgccaggagtacagcgactggaaggagaagaagacctacctgaacccctggaagaagattgacagcgcccccctggccctgctgcacaagatcctggtggagaaccccagcgcccgcatcaccatcccagacatcaagaaggaccgctggtacaacaagcccctgaagaagggggccaagaggccccgggtgaccagcggcggcgtgtctgagagccccagcggcttcagcaagcacatccagagcaacctggacttcagccctgtgaacagcgccagcagcgaggagaatgtgaagtacagcagcagccagcctgagcccaggacaggcctgagcctgtgggacaccagccccagctacatcgacaagctggtgcagggcatctccttcagccagcccacctgcccagaccacatgctgctgaacagccagctgctgggcaccccaggcagcagccaggtgaccatcagcaccacagacagaagaaacaacaagctgatcttcaaggtgaacctgctggagatggatgacaagatcctggtggacttccggctgagcaaaggagatggcctggagttcaagaggcacttcctgaagatcaagggcaagctgattgatattgtgagcagccagaagatctggctgcctgccacctag

SEQ ID NO: 19022 - DNA, 1431 bp, Artificial Sequence
  Description of Artificial Sequence: Synthetic coding sequence
atggctgtgccctttgtggaggactgggacctggtgcagaccctgggggagggcgcctacggggaggtgcagctggccgtgaacagagtgacagaggaggccgtggccgtgaagatcgtggacatgaagagagctgtggactgcccagagaacatcaagaaggagatctgcatcaacaagatgctgaaccatgaaaatgtggtgaagttctacggccaccggcgggagggcaacatccagtacctgttcctggagtactgcagcggcggggagctgtttgaccgcatcgagccagacatcggcatgcctgagccagatgcccagcgcttcttccaccagctgatggccggcgtggtgtacctgcacggcatcggcatcacccaccgggacatcaagccagagaacctgctgctggatgagcgggacaacctgaagatcagtgactttggcctggccaccgtcttccgctacaacaaccgggagcggctgctgaacaagatgtgtggcaccctgccctacgtggcccctgagctgctgaagagaagagagttccacgccgagcctgtggatgtgtggagctgtggcatcgtgctgacagccatgctggccggggagctgccctgggaccagcccagcgacagctgccaggagtacagcgactggaaggagaagaagacctacctgaacccctggaagaagattgacagcgcccccctggccctgctgcacaagatcctggtggagaaccccagcgcccgcatcaccatcccagacatcaagaaggaccgctggtacaacaagcccctgaagaagggggccaagaggccccgggtgaccagcggcggcgtgtctgagagccccagcggcttcagcaagcacatccagagcaacctggacttcagccctgtgaacagcgccagcagcgaggagaatgtgaagtacagcagcagccagcctgagcccaggacaggcctgagcctgtgggacaccagccccagctacatcgacaagctggtgcagggcatctccttcagccagcccacctgcccagaccacatgctgctgaacagccagctgctgggcaccccaggcagcagccagaacccctggcagaggctggtgaagaggatgacccgcttcttcaccaagctggatgctgacaagagctaccagtgcctgaaggagacctgtgagaagctgggctaccagtggaagaagagctgcatgaaccaggtgaccatcagcaccacagacagaagaaacaacaagctgatcttcaaggtgaacctgctggagatggatgacaagatcctggtggacttccggctgagcaaaggagatggcctggagttcaagaggcacttcctgaagatcaagggcaagctgattgatattgtgagcagccagaagatctggctgcctgccacctag

SEQ ID NO: 19023 - DNA, 1431 bp, Artificial Sequence; identical to SEQ ID NO: 19022
  Description of Artificial Sequence: Synthetic coding sequence

SEQ ID NO: 19024 - DNA, 1431 bp, Artificial Sequence; identical to SEQ ID NO: 19022
  Description of Artificial Sequence: Synthetic coding sequence

SEQ ID NO: 19025 - DNA, 402 bp, Artificial Sequence
  Description of Artificial Sequence: Synthetic coding sequence
atggctgtgccctttgtggaggactgggacctggtgcagaccctgggggagggcgcctacggggaggtgcagctggccgtgaacagagtgacagaggaggccgtggccgtgaagatcgtggacatgaagagagctgtggactgcccagagaacatcaagaaggagatctgcatcaacaagatgctgaaccatgaaaatgtggtgaagttctacggccaccggcgggagggcaacatccagtacctgttcctggagtactgcagcggcggggagctgtttgaccgcatcgagccagacatcggcatgcctgagccagatgcccagcgcttcttccaccagctgatggccggcgtggtgtacctgcacggcatcggcatcacccaccgggacatcaagccctag

SEQ ID NO: 19026 - DNA, 513 bp, Artificial Sequence
  Description of Artificial Sequence: Synthetic coding sequence
atggctgtgccctttgtggaggactgggacctggtgcagaccctgggggagggcgcctacggggaggtgcagctggccgtgaacagagtgacagaggaggccgtggccgtgaagatcgtggacatgaagagagctgtggactgcccagagaacatcaagaaggagatctgcatcaacaagatgctgaaccatgaaaatgtggtgaagttctacggccaccggcgggagggcaacatccagtacctgttcctggagtactgcagcggcggggagctgtttgaccgcatcgagccagacatcggcatgcctgagccagatgcccagcgcttcttccaccagctgatggccggcgtggtgtacctgcacggcatcggcatcacccaccgggacatcaagccagagaacctgctgctggatgagcgggacaacctgaagatcagtgactttggcctggccaccgtcttccgctacaacaaccgggagcggctgctgaacaagatgtgtggcacctag

SEQ ID NO: 19027 - DNA, 615 bp, Artificial Sequence
  Description of Artificial Sequence: Synthetic coding sequence
atggctgtgccctttgtggaggactgggacctggtgcagaccctgggggagggcgcctacggggaggtgcagctggccgtgaacagagtgacagaggaggccgtggccgtgaagatcgtggacatgaagagagctgtggactgcccagagaacatcaagaaggagatctgcatcaacaagatgctgaaccatgaaaatgtggtgaagttctacggccaccggcgggagggcaacatccagtacctgttcctggagtactgcagcggcggggagctgtttgaccgcatcgagccagacatcggcatgcctgagccagatgcccagcgcttcttccaccagctgatggccggcgtggtgtacctgcacggcatcggcatcacccaccgggacatcaagccagagaacctgctgctggatgagcgggacaacctgaagatcagtgactttggcctggccaccgtcttccgctacaacaaccgggagcggctgctgaacaagatgtgtggcaccctgccctacgtggcccctgagctgctgaagagaagagagttccacgccgagcctgtggatgtgtggagctgtggcatcgtgctgacagccatgctggccggctag

SEQ ID NO: 19028 - DNA, 129 bp, Artificial Sequence
  Description of Artificial Sequence: Synthetic coding sequence
atggctgtgccctttgtggaggactgggacctggtgcagaccctgggggagggcgcctacggggaggtgcagctggccgtgaacagagtgacagaggaggccgtggccgtgaagatcgtggacatgtag

SEQ ID NO: 19029 - DNA, 1431 bp, Artificial Sequence; identical to SEQ ID NO: 19022
  Description of Artificial Sequence: Synthetic coding sequence

SEQ ID NO: 19030 - DNA, 384 bp, Artificial Sequence
  Description of Artificial Sequence: Synthetic coding sequence
atggctgtgccctttgtggaggactgggacctggtgcagaccctgggggagggcgcctacggggaggtgcagctggccgtgaacagagtgacagaggaggccgtggccgtgaagatcgtggacatgaagagagctgtggactgcccagagaacatcaagaaggagatctgcatcaacaagatgctgaaccatgaaaatgtggtgaagttctacggccaccggcgggagggcaacatccagtacctgttcctggagtactgcagcggcggggagctgtttgaccgcatcgagccagacatcggcatgcctgagccagatgcccagcgcttcttccaccagctgatggccggcgtggtgtacctgcacggcatcggcatcacctag

SEQ ID NO: 19031 - DNA, 1329 bp, Artificial Sequence
  Description of Artificial Sequence: Synthetic coding sequence
atggctgtgccctttgtggaggactgggacctggtgcagaccctgggggagggcgcctacggggaggtgcagctggccgtgaacagagtgacagaggaggccgtggccgtgaagatcgtggacatgaagagagctgtggactgcccagagaacatcaagaaggagatctgcatcaacaagatgctgaaccatgaaaatgtggtgaagttctacggccaccggcgggagggcaacatccagtacctgttcctggagtactgcagcggcggggagctgtttgaccgcatcgagccagacatcggcatgcctgagccagatgcccagcgcttcttccaccagctgatggccggcgtggtgtacctgcacggcatcggcatcacccaccgggacatcaagccagagaacctgctgctggatgagcgggacaacctgaagatcagtgactttggcctggccaccgtcttccgctacaacaaccgggagcggctgctgaacaagatgtgtggcaccctgccctacgtggcccctgagctgctgaagagaagagagttccacgccgagcctgtggatgtgtggagctgtggcatcgtgctgacagccatgctggccggggagctgccctgggaccagcccagcgacagctgccaggagtacagcgactggaaggagaagaagacctacctgaacccctggaagaagattgacagcgcccccctggccctgctgcacaagatcctggtggagaaccccagcgcccgcatcaccatcccagacatcaagaaggaccgctggtacaacaagcccctgaagaagggggccaagaggccccgggtgaccagcggcggcgtgtctgagagccccagcggcttcagcaagcacatccagagcaacctggacttcagccctgtgaacagcgccagcagcgaggagaatgtgaagtacagcagcagccagcctgagcccaggacaggcctgagcctgtgggacaccagccccagctacatcgacaagctggtgcagggcatctccttcagccagcccacctgcccagaccacatgctgctgaacagccagctgctgggcaccccaggcagcagccagaacccctggcagaggctggtgaagaggatgacccgcttcttcaccaagctggatgctgacaagagctaccagtgcctgaaggagacctgtgagaagctgggctaccagtggaagaagagctgcatgaaccagggagatggcctggagttcaagaggcacttcctgaagatcaagggcaagctgattgatattgtgagcagccagaagatctggctgcctgccacctag

SEQ ID NO: 19032 - DNA, 1632 bp, Artificial Sequence
  Description of Artificial Sequence: Synthetic coding sequence
atgagccgggagagtgatgtggaggcccagcagagccacggcagcagcgcctgcagccagccccacggctctgtgacccagagccagggcagcagcagccagagccagggcatcagcagcagcagcaccagcaccatgcccaacagcagccagagcagccacagcagcagcggcaccctgagcagcctggagaccgtgtccacccaggagctgtacagcatccctgaggaccaggagcctgaggaccaggagcctgaggagcccaccccagccccctgggcccggctgtgggccctgcaggacggctttgccaacctggagtgtgtgaatgacaactactggtttggccgggacaagagctgtgagtactgctttgatgagcccctgctgaagaggacagacaagtaccgcacctacagcaagaagcacttccgcatcttccgggaggtgggccccaagaacagctacatcgcctacatcgaggaccacagcggaaatggcacctttgtgaacacagagctggtgggcaagggcaagaggcggcccctgaacaacaacagcgagatcgccctgagcctgagcaggaacaaggtgtttgtgttctttgacctgactgtggatgaccagagcgtgtaccccaaggccctgagagatgagtacatcatgagcaagaccctgggcagcggggcctgtggggaggtgaagctggcctttgagaggaagacctgcaagaaggtggccatcaagatcatcagcaagaggaagtttgccatcggcagcgcccgggaggccgaccctgccctgaatgtggagacagaaattgagatcctgaagaagctgaaccacccctgcatcatcaagatcaagaacttctttgatgctgaggactactacatcgtgctggagctgatggagggcggggagctgtttgacaaggtggtgggcaacaagaggctgaaggaggccacctgcaagctgtacttctaccagatgctgctggccgtgcagtacctgcatgaaaatggcatcatccaccgggacctgaagccagaaaatgtgctgctgagcagccaggaggaggactgcctgatcaagatcacagactttggccacagcaagatcctgggggagaccagcctgatgaggaccctgtgtggcacccccacctacctggcccctgaggtgctggtgtctgtgggcacagctggctacaacagagctgtggactgctggagcctgggcgtcatcctcttcatctgcctgagcggctacccacccttcagcgagcacaggacccaggtgtccctgaaggaccagatcaccagcggcaagtacaacttcatccctgaggtgtgggccgaggtgtctgagaaggccctggacctggtgaagaagctgctggtggtggaccccaaggcccgcttcaccacagaggaggccctgcggcacccctggctgcaggatgaggacatgaagaggaagttccaggacctgctgtctgaggagaatgaaagcacagccctgccccaggtgctggcccagcccagcaccagcaggaagaggccccgggagggggaggccgagggcgctgagaccaccaagaggcctgctgtgtgtgccgctgtgctgtag

SEQ ID NO: 19033 - DNA, 1545 bp, Artificial Sequence
  Description of Artificial Sequence: Synthetic coding sequence
atgagccgggagagtgatgtggaggcccagcagagccacggcagcagcgcctgcagccagccccacggctctgtgacccagagccagggcagcagcagccagagccagggcatcagcagcagcagcaccagcaccatgcccaacagcagccagagcagccacagcagcagcggcaccctgagcagcctggagaccgtgtccacccaggagctgtacagcatccctgaggaccaggagcctgaggaccaggagcctgaggagcccaccccagccccctgggcccggctgtgggccctgcaggacggctttgccaacctggagtgtgtgaatgacaactactggtttggccgggacaagagctgtgagtactgctttgatgagcccctgctgaagaggacagacaagtaccgcacctacagcaagaagcacttccgcatcttccgggaggtgggccccaagaacagctacatcgcctacatcgaggaccacagcggaaatggcacctttgtgaacacagagctggtgggcaagggcaagaggcggcccctgaacaacaacagcgagatcgccctgagcctgagcaggaacaaggtgtttgtgttctttgacctgactgtggatgaccagagcgtgtaccccaaggccctgagagatgagtacatcatgagcaagaccctgggcagcggggcctgtggggaggtgaagctggcctttgagaggaagacctgcaagaaggtggccatcaagatcatcagcaagaggaagtttgccatcggcagcgcccgggaggccgaccctgccctgaatgtggagacagaaattgagatcctgaagaagctgaaccacccctgcatcatcaagatcaagaacttctttgatgctgaggactactacatcgtgctggagctgatggagggcggggagctgtttgacaaggtggtgggcaacaagaggctgaaggaggccacctgcaagctgtacttctaccagatgctgctggccgtgcagatcacagactttggccacagcaagatcctgggggagaccagcctgatgaggaccctgtgtggcacccccacctacctggcccctgaggtgctggtgtctgtgggcacagctggctacaacagagctgtggactgctggagcctgggcgtcatcctcttcatctgcctgagcggctacccacccttcagcgagcacaggacccaggtgtccctgaaggaccagatcaccagcggcaagtacaacttcatccctgaggtgtgggccgaggtgtctgagaaggccctggacctggtgaagaagctgctggtggtggaccccaaggcccgcttcaccacagaggaggccctgcggcacccctggctgcaggatgaggacatgaagaggaagttccaggacctgctgtctgaagaaaatgaaagcacagccctgccccaggtgctggcccagcccagcaccagcaggaagaggccccgggagggggaggccgagggcgctgagaccaccaagaggcctgctgtgtgtgccgctgtgctgtag

SEQ ID NO: 19034 - DNA, 681 bp, Artificial Sequence
  Description of Artificial Sequence: Synthetic coding sequence
atgagccgggagagtgatgtggaggcccagcagagccacggcagcagcgcctgcagccagccccacggctctgtgacccagagccagggcagcagcagccagagccagggcatcagcagcagcagcaccagcaccatgcccaacagcagccagagcagccacagcagcagcggcaccctgagcagcctggagaccgtgtccacccaggagctgtacagcatccccccagaggtgctggtgtctgtgggcacagctggctacaacagagctgtggactgctggagcctgggcgtcatcctcttcatctgcctgagcggctacccacccttcagcgagcacaggacccaggtgtccctgaaggaccagatcaccagcggcaagtacaacttcatccctgaggtgtgggccgaggtgtctgagaaggccctggacctggtgaagaagctgctggtggtggaccccaaggcccgcttcaccacagaggaggccctgcggcacccctggctgcaggatgaggacatgaagaggaagttccaggacctgctgtctgaagaaaatgaaagcacagccctgccccaggtgctggcccagcccagcaccagcaggaagaggccccgggagggggaggccgagggcgctgagaccaccaagaggcctgctgtgtgtgccgctgtgctgtag

SEQ ID NO: 19035 - DNA, 492 bp, Artificial Sequence
  Description of Artificial Sequence: Synthetic coding sequence
atgagccgggagagtgatgtggaggcccagcagagccacggcagcagcgcctgcagccagccccacggctctgtgacccagagccagggcagcagcagccagagccagggcatcagcagcagcagcaccagcaccatgcccaacagcagccagagcagccacagcagcagcggcaccctgagcagcctggagaccgtgtccacccaggagctgtacagcatccctgaggaccaggagcctgaggaccaggagcctgaggagcccaccccagccccctgggcccggctgtgggccctgcaggacggctttgccaacctgggagatgaggacatgaagaggaagttccaggacctgctgtctgaggagaatgaaagcacagccctgccccaggtgctggcccagcccagcaccagcaggaagaggccccgggagggggaggccgagggcgctgagaccaccaagaggcctgctgtgtgtgccgctgtgctgtag

SEQ ID NO: 19036 - DNA, 870 bp, Artificial Sequence
  Description of Artificial Sequence: Synthetic coding sequence
atgagccgggagagtgatgtggaggcccagcagagccacggcagcagcgcctgcagccagccccacggctctgtgacccagagccagggcagcagcagccagagccagggcatcagcagcagcagcaccagcaccatgcccaacagcagccagagcagccacagcagcagcggcaccctgagcagcctggagaccgtgtccacccaggagctgtacagcatccctgaggaccaggagcctgaggaccaggagcctgaggagcccaccccagccccctgggcccggctgtgggccctgcaggacggctttgccaacctggagtgtgtgaatgacaactactggtttggccgggacaagagctgtgagtactgctttgatgagcccctgctgaagaggacagacaagtaccgcacctacagcaagaagcacttccgcatcttccgggaggtgggccccaagaacagctacatcgcctacatcgaggaccacagcggaaatggcacctttgtgaacacagagctggtgggcaagggcaagaggcggcccctgaacaacaacagcgagatcgccctgagcctgagcaggaacaaggtgtttgtgttctttgacctgactgtggatgaccagagcgtgtaccccaaggccctgagagatgagtacatcatgagcaagaccctgggcagcggggcctgtggggaggtgaagctggcctttgagaggaagacctgcaagaaggtggccatcaagatcatcagcaagaggaagtttgccatcggcagcgcccgggaggccgaccctgccctgaatgtggagacagaaattgagatcctgaagaagctgaaccatgatggccggggccgggctgtgtag

SEQ ID NO: 19037 - DNA, 1359 bp, Artificial Sequence
  Description of Artificial Sequence: Synthetic coding sequence
atgagccgggagagtgatgtggaggcccagcagagccacggcagcagcgcctgcagccagccccacggctctgtgacccagagccagggcagcagcagccagagccagggcatcagcagcagcagcaccagcaccatgcccaacagcagccagagcagccacagcagcagcggcaccctgagcagcctggagaccgtgtccacccaggagctgtacagcatccctgaggaccaggagcctgaggaccaggagcctgaggagcccaccccagccccctgggcccggctgtgggccctgcaggacggctttgccaacctggtgtttgtgttctttgacctgactgtggatgaccagagcgtgtaccccaaggccctgagagatgagtacatcatgagcaagaccctgggcagcggggcctgtggggaggtgaagctggcctttgagaggaagacctgcaagaaggtggccatcaagatcatcagcaagaggaagtttgccatcggcagcgcccgggaggccgaccctgccctgaatgtggagacagaaattgagatcctgaagaagctgaaccacccctgcatcatcaagatcaagaacttctttgatgctgaggactactacatcgtgctggagctgatggagggcggggagctgtttgacaaggtggtgggcaacaagaggctgaaggaggccacctgcaagctgtacttctaccagatgctgctggccgtgcagtacctgcatgaaaatggcatcatccaccgggacctgaagccagaaaatgtgctgctgagcagccaggaggaggactgcctgatcaagatcacagactttggccacagcaagatcctgggggagaccagcctgatgaggaccctgtgtggcacccccacctacctggcccctgaggtgctggtgtctgtgggcacagctggctacaacagagctgtggactgctggagcctgggcgtcatcctcttcatctgcctgagcggctacccacccttcagcgagcacaggacccaggtgtccctgaaggaccagatcaccagcggcaagtacaacttcatccctgaggtgtgggccgaggtgtctgagaaggccctggacctggtgaagaagctgctggtggtggaccccaaggcccgcttcaccacagaggaggccctgcggcacccctggctgcaggatgaggacatgaagaggaagttccaggacctgctgtctgaagaaaatgaaagcacagccctgccccaggtgctggcccagcccagcaccagcaggaagaggccccgggagggggaggccgagggcgctgagaccaccaagaggcctgctgtgtgtgccgctgtgctgtag

SEQ ID NO: 19038 - DNA, 1761 bp, Artificial Sequence
  Description of Artificial Sequence: Synthetic coding sequence
atgagccgggagagtgatgtggaggcccagcagagccacggcagcagcgcctgcagccagccccacggctctgtgacccagagccagggcagcagcagccagagccagggcatcagcagcagcagcaccagcaccatgcccaacagcagccagagcagccacagcagcagcggcaccctgagcagcctggagaccgtgtccacccaggagctgtacagcatccctgaggaccaggagcctgaggaccaggagcctgaggagcccaccccagccccctgggcccggctgtgggccctgcaggacggctttgccaacctggagacagagagcggccacgtgacccagagcgacctggagctgctgctgagcagtgaccccccagccagcgccagccagagcgctggcatccggggcgtgcgccaccaccccaggcctgtgtgcagcctgaagtgtgtgaatgacaactactggtttggccgggacaagagctgtgagtactgctttgatgagcccctgctgaagaggacagacaagtaccgcacctacagcaagaagcacttccgcatcttccgggaggtgggccccaagaacagctacatcgcctacatcgaggaccacagcggaaatggcacctttgtgaacacagagctggtgggcaagggcaagagaagacccctgaacaacaacagcgagatcgccctgagcctgagcaggaacaaggtgtttgtgttctttgacctgactgtggatgaccagagcgtgtaccccaaggccctgagagatgagtacatcatgagcaagaccctgggcagcggggcctgtggggaggtgaagctggcctttgagaggaagacctgcaagaaggtggccatcaagatcatcagcaagaggaagtttgccatcggcagcgcccgggaggccgaccctgccctgaatgtggagacagaaattgagatcctgaagaagctgaaccacccctgcatcatcaagatcaagaacttctttgatgctgaggactactacatcgtgctggagctgatggagggcggggagctgtttgacaaggtggtgggcaacaagaggctgaaggaggccacctgcaagctgtacttctaccagatgctgctggccgtgcagtacctgcatgaaaatggcatcatccaccgggacctgaagccagaaaatgtgctgctgagcagccaggaggaggactgcctgatcaagatcacagactttggccacagcaagatcctgggggagaccagcctgatgaggaccctgtgtggcacccccacctacctggcccctgaggtgctggtgtctgtgggcacagctggctacaacagagctgtggactgctggagcctgggcgtcatcctcttcatctgcctgagcggctacccacccttcagcgagcacaggacccaggtgtccctgaaggaccagatcaccagcggcaagtacaacttcatccctgaggtgtgggccgaggtgtctgagaaggccctggacctggtgaagaagctgctggtggtggaccccaaggcccgcttcaccacagaggaggccctgcggcacccctggctgcaggatgaggacatgaagaggaagttccaggacctgctgtctgaagaaaatgaaagcacagccctgccccaggtgctggcccagcccagcaccagcaggaagaggccccgggagggggaggccgagggcgctgagaccaccaagaggcctgctgtgtgtgccgctgtgctgtag

SEQ ID NO: 19039 - DNA, 1545 bp, Artificial Sequence; identical to SEQ ID NO: 19033
  Description of Artificial Sequence: Synthetic coding sequence

SEQ ID NO: 19040 - DNA, 1359 bp, Artificial Sequence; identical to SEQ ID NO: 19037
  Description of Artificial Sequence: Synthetic coding sequence

SEQ ID NO: 19041 - DNA, 1632 bp, Artificial Sequence; identical to SEQ ID NO: 19032
  Description of Artificial Sequence: Synthetic coding sequence

SEQ ID NO: 19042 - DNA, 1632 bp, Artificial Sequence; identical to SEQ ID NO: 19032
  Description of Artificial Sequence: Synthetic coding sequence

SEQ ID NO: 19043 - DNA, 969 bp, Artificial Sequence
  Description of Artificial Sequence: Synthetic coding sequence
atgagcaagaccctgggcagcggggcctgtggggaggtgaagctggcctttgagaggaagacctgcaagaaggtggccatcaagatcatcagcaagaggaagtttgccatcggcagcgcccgggaggccgaccctgccctgaatgtggagacagaaattgagatcctgaagaagctgaaccacccctgcatcatcaagatcaagaacttctttgatgctgaggactactacatcgtgctggagctgatggagggcggggagctgtttgacaaggtggtgggcaacaagaggctgaaggaggccacctgcaagctgtacttctaccagatgctgctggccgtgcagtacctgcatgaaaatggcatcatccaccgggacctgaagccagaaaatgtgctgctgagcagccaggaggaggactgcctgatcaagatcacagactttggccacagcaagatcctgggggagaccagcctgatgaggaccctgtgtggcacccccacctacctggcccctgaggtgctggtgtctgtgggcacagctggctacaacagagctgtggactgctggagcctgggcgtcatcctcttcatctgcctgagcggctacccacccttcagcgagcacaggacccaggtgtccctgaaggaccagatcaccagcggcaagtacaacttcatccctgaggtgtgggccgaggtgtctgagaaggccctggacctggtgaagaagctgctggtggtggaccccaaggcccgcttcaccacagaggaggccctgcggcacccctggctgcaggatgaggacatgaagaggaagttccaggacctgctgtctgaagaaaatgaaagcacagccctgccccaggtgctggcccagcccagcaccagcaggaagaggccccgggagggggaggccgagggcgctgagaccaccaagaggcctgctgtgtgtgccgctgtgctgtag

SEQ ID NO: 19044 - DNA, 624 bp, Artificial Sequence
  Description of Artificial Sequence: Synthetic coding sequence
atgagccgggagagtgatgtggaggcccagcagagccacggcagcagcgcctgcagccagccccacggctctgtgacccagagccagggcagcagcagccagagccagggcatcagcagcagcagcaccagcaccatgcccaacagcagccagagcagccacagcagcagcggcaccctgagcagcctggagaccgtgtccacccaggagctgtacagcatccctgaggaccaggagcctgaggaccaggagcctgaggagcccaccccagccccctgggcccggctgtgggccctgcaggacggctttgccaacctggagtgtgtgaatgacaactactggtttggccgggacaagagctgtgagtactgctttgatgagcccctgctgaagaggacagacaagtaccgcacctacagcaagaagcacttccgcatcttccgggaggtgggccccaagaacagctacatcgcctacatcgaggaccacagcggaaatggcacctttgtgaacacagagctggtgggcaagggcaagaggcggcccctgaacaacaacagcgagatcgccctgagcctgagcaggaacaaggagaagatcctgaagatctacagcctgtcctag

SEQ ID NO: 19045 - DNA, 294 bp, Artificial Sequence
  Description of Artificial Sequence: Synthetic coding sequence
atgaaggtgtctgctgccctgctgtggctgctgctgattgctgctgccttcagcccccagggcctggccggccctgcctctgtgcccaccacctgctgcttcaacctggccaacaggaagatccccctgcagaggctggagagctaccgccgcatcaccagcggcaagtgcccccagaaggctgtgatcttcaagaccaagctggccaaggacatctgtgccgaccccaagaagaagtgggtgcaggacagcatgaagtacctggaccagaagagccccacccccaagccctag

SEQ ID NO: 19046 - DNA, 1692 bp, Artificial Sequence
  Description of Artificial Sequence: Synthetic coding sequence
atgagccgcatcggcggggccggcctgcctgctgctgccctgactggacctggccgcttcaggatggcccgggaggagcccgccccagctgccctggccgctgctggccagcccggcggcggccggggcggggagcgggccctgcagggccctggggtggcccggcggggccggcccagcctgagccgggccaagctgcacggcctgcggcacatgtgtgccggccgcacagctgctgggggcagcttccagaggcgggccctgtgggtgctggccttctgcaccagctttggcctgctgctgtcctggagcagcaaccggctgctgtactggctgtccttccccagccacaccagggtgcaccgggagtggagccggcagctgcccttccctgctgtgacagtgtgcaacaacaaccccctgcgcttcccccggctgagcaagggggacctgtactatgccggccactggctgggcctgctgctgcccaacagaacagcccggcccctggtgtctgagctgctgcggggagatgagccccggcggcagtggttcaggaagctggccgacttccgcctcttcctgccccccaggcactttgagggcatctctgctgccttcatggaccggctgggccaccagctggaggacatgctgctgagctgcaagtacagaggagagctgtgtggcccccacaacttcagcagcgtcttcaccaagtatggcaagtgctacatgttcaacagcggagaagatggcaagcccctgctgaccaccgtgaagggcggcactggaaatggcctggagatcatgctggacatccagcaggatgagtacctgcccatctggggcgagacagaggagaccacctttgaagctggggtgaaggtgcagatccacagccagagcgagccccccttcatccaggagctgggctttggagtggcccctggcttccagacctttgtggccacccaggagcagaggctgacctacctgcccccaccctggggagaatgtcgcagcagcgagatgggcctggacttcttccctgtgtacagcatcacagcctgcagaattgactgtgagacccgctacatcgtggagaactgcaactgcaggatggtgcacatgcctggagatgcccccttctgcaccccagagcagcacaaggaatgtgccgagcccgccctgggcctgctggccgagaaggacagcaactactgcctgtgcaggaccccctgcaacctgacccgctacaacaaggagctgtccatggtgaagatccccagcaagaccagcgccaagtacctggagaagaagttcaacaagtctgagaagtacatcagcgagaacatcctggtgctggacatcttctttgaggccctgaactatgagaccatcgagcagaagaaggcctatgaggtggccgccctgctgggggacattggaggccagatgggcctcttcatcggggccagcatcctgaccatcctggagctgtttgactacatctatgagctgatcaaggagaagctgctggacctgctgggcaaggaggaggatgagggcagccatgatgaaaatgtgtccacctgtgacaccatgcccaaccacagcgagaccatcagccacacagtgaatgtgcccctgcagaccaccctgggcaccctggaggagatcgcctgctag

SEQ ID NO: 19047 - DNA, 2328 bp, Artificial Sequence
  Description of Artificial Sequence: Synthetic coding sequence
atggtgggcccagaagatgctggggcctgcagcggcaggaaccccaagctgctgcctgtgcctgccccagaccctgtgggccaggacaggaaggtgatccgggccaccggcggctttggaggcggcgtgggcgctgtggagcccccagaggaggctgatgaggaggaggaggctgatgaggaggaggagaccccaccccggcagctgctgcagcgctacctggccgctgctggggagcagctggagcccggcctgtgctactgccccctgcctgctggccaggccggggcccctcctccttctgctgcccccaggagtgatgcctgcctgctgggcagcggcagcaagcacagaggagctgaggtggctgatggccgggcccccaggcatgagggcatgaccaatggagacagcggcttcctgcccggccgggactgccgggacctggaggaggcccggggcctggcccgggccggcggccgggagagcagaagaagaagaccctacggccgcctgcggctggagggccctggagatgaagatgctgatggagctggcagccccagcgactgggccagccccctggaggaccccctgcggagctgctgcctggtggccgcagatgcccaggagcctgagggcgccggcagtgacagcggggacagccctgccagcagctgcagcagcagtgaagattctgagcagaggggcgtgggcgctgggggccctgaggagggcgcccccccagccaccagcgctgagaggaccaatggaggagctgagccccggctgggcttcagtgacatccacttcaacagcaggaacaccttccaggtgtcccggggccagagcgcccgggaccacctgcccccagctggcccccctgtgcccctgcctgctgctgagcagggccctgctggggccagcgcccgggccaggagaagtggcggctttgctgacttcttcaccaggaacctcttccccaagaggaccaaggagctgaagtctgtggtgcacagcgcccctggctggaagctgtttgggaaggtgcccccccgggagaacctgcagaagaccagcaagatcatccagcaggagtatgaggccaggactggaagaacctgcaagcccccaccccagagcagcaggaggaagaactttgaatttgagcccctgagcaccacagccctgatcctggaggaccggcccagcaacctgcctgccaagtctgtggaggaggccctgcggcaccggcaggagtatgatgagatggtggccgaggccaagaagcgggagatcaaggaggcccacaagaggaagaggatcatgaaggagcgcttcaagcaggaggagaacatcgccagcgccatggtgatctggatcaatgagatcctgcccaactgggaggtgatgaggagcaccaggagagtgcgggagctgtggtggcagggcctgccccccagcgtgcggggcaaggtgtggagcctggccgtgggcaatgagctgaacatcaccccagagctgtatgagatcttcctgagccgggccaaggagcgctggaagagcttcagcgagaccagcagtgaaaatgacacagagggcgtgtctgtggccgaccgggaggccagcctggagctgatcaagctggacatcagcaggaccttccccagcctgtacatcttccagaagggcggcccctaccatgatgtgctgcacagcatcctgggcgcctacacctgctacagaccagatgtgggctacgtgcagggcatgtccttcatcgctgctgtgctgatcctgaacctggaggaggctgatgccttcatcgcctttgccaacctgctgaacaagccctgccagctggccttcttccgggtggaccacagcatgatgctgaagtactttgccacctttgaggtgttctttgaggagaacctgagcaagctgttcctgcacttcaagagctacagcctgaccccagacatctacctgattgactggatcttcaccctgtacagcaagagcctgcccctggacctggcctgccgggtgtgggatgtgttctgcagagatggagaggagttcctgttcagaacaggcctgggcatcctgcggctgtatgaggacatcctgctgcagatggacttcatccacatcgcccagttcctgaccaagctgcctgaggacatcaccagcgagaagctgttcagctgcatcgccgccatccagatgcagaacagcaccaagaagtggacccaggtgtttgcctctgtgatgaaggacatcaaggagggggacaagaacagcagccctgccctgaagagctag

SEQ ID NO: 19048 - DNA, 276 bp, Artificial Sequence
  Description of Artificial Sequence: Synthetic coding sequence
atgaaggtgtctgctgctgccctggccgtcatcctgattgccacagccctgtgtgccccagccagcgccagcccctacagcagtgacaccaccccctgctgctttgcctacatcgcccggcccctgccccgggcccacatcaaggagtacttctacaccagcggcaagtgcagcaacccagctgtggtgtttgtgaccaggaagaaccggcaggtgtgtgccaaccctgagaagaagtgggtgcgggagtacatcaacagcctggagatgtcctag

SEQ ID NO: 19049 - DNA, 276 bp, Artificial Sequence; identical to SEQ ID NO: 19048
  Description of Artificial Sequence: Synthetic coding sequence

SEQ ID NO: 19050 - DNA, 300 bp, Artificial Sequence
  Description of Artificial Sequence: Synthetic coding sequence
atgaaggccagcgctgccctgctgtgcctgctgctgacagctgctgccttcagcccccagggcctggcccagcctgtgggcatcaacaccagcaccacctgctgctaccgcttcatcaacaagaagatccccaagcagaggctggagagctacagaaggaccaccagcagccactgcccccgggaggccgtcatcttcaagaccaagctggacaaggagatctgtgccgaccccacccagaagtgggtgcaggacttcatgaagcacctggacaagaagacccagacccccaagctgtag

SEQ ID NO: 19051 - DNA, 330 bp, Artificial Sequence
  Description of Artificial Sequence: Synthetic coding sequence
atgtggaagcccatgcccagccccagcaacatgaaggccagcgctgccctgctgtgcctgctgctgacagctgctgccttcagcccccagggcctggcccagcctgtgggcatcaacaccagcaccacctgctgctaccgcttcatcaacaagaagatccccaagcagaggctggagagctacagaaggaccaccagcagccactgcccccgggaggccgtcatcttcaagaccaagctggacaaggagatctgtgccgaccccacccagaagtgggtgcaggacttcatgaagcacctggacaagaagacccagacccccaagctgtag

SEQ ID NO: 19052 - DNA, 276 bp, Artificial Sequence
  Description of Artificial Sequence: Synthetic coding sequence
atgtggaagcccatgcccagccccagcaacatgaaggccagcgctgccctgctgtgcctgctgctgacagctgctgccttcagcccccagggcctggcccagcctgagcggcccaggacccacccccagtggaccttcctgctggtggtgtccctgcagctgggcctcatcctgcagctgcctgctgccacagacctgagcatcaggaagagcctgagccggggctggagggccacagagggcccccctgtggccaccgtgcctgggaagctgtag

SEQ ID NO: 19053 - DNA, 174 bp, Artificial Sequence
  Description of Artificial Sequence: Synthetic coding sequence
atgtggaagcccatgcccagccccagcaacatgaaggccagcgctgccctgctgtgcctgctgctgacagctgctgccttcagcccccagggcctggcccagcctgccagccggcccaactggaccaggagatctgtgctgaccccccacaggagcggcagcaggaccctgtag

SEQ ID NO: 19054 - DNA, 297 bp, Artificial Sequence
  Description of Artificial Sequence: Synthetic coding sequence
atgaaccagacagccatcctgatctgctgcctgatcttcctgaccctgagcggcatccagggcgtgcccctgagcaggacagtgcgctgcacctgcatcagcatcagcaaccagcctgtgaaccccaggagcctggagaagctggagatcatcccagccagccagttctgcccccgggtggagatcatcgccaccatgaagaagaagggggagaagcgctgcctgaaccctgagagcaaggccatcaagaacctgctgaaggctgtgtccaaggagaggagcaagaggagcccctag

SEQ ID NO: 19055 - DNA, 270 bp, Artificial Sequence
  Description of Artificial Sequence: Synthetic coding sequence
atgaatgccaaggtggtggtggtgctggtgctggtgctgacagccctgtgcctgagtgatggcaagcctgtgtccctgagctaccgctgcccctgccgcttctttgagagccacgtggcccgggccaacgtgaagcacctgaagatcctgaacacccccaactgtgccctgcagatcgtggcccggctgaagaacaacaaccggcaggtgtgcatcgaccccaagctgaagtggatccaggagtacctggagaaggccctgaacaagtag

SEQ ID NO: 19056 - DNA, 360 bp, Artificial Sequence
  Description of Artificial Sequence: Synthetic coding sequence
atgaatgccaaggtggtggtggtgctggtgctggtgctgacagccctgtgcctgagtgatggcaagcctgtgtccctgagctaccgctgcccctgccgcttctttgagagccacgtggcccgggccaacgtgaagcacctgaagatcctgaacacccccaactgtgccctgcagatcgtggcccggctgaagaacaacaaccggcaggtgtgcatcgaccccaagctgaagtggatccaggagtacctggagaaggccctgaacaagggcagaagagaggagaaggtgggcaagaaggagaagattggcaagaagaagaggcagaagaagaggaaggccgcccagaagaggaagaactag

SEQ ID NO: 19057 - DNA, 282 bp, Artificial Sequence
  Description of Artificial Sequence: Synthetic coding sequence
atgaatgccaaggtggtggtggtgctggtgctggtgctgacagccctgtgcctgagtgatggcaagcctgtgtccctgagctaccgctgcccctgccgcttctttgagagccacgtggcccgggccaacgtgaagcacctgaagatcctgaacacccccaactgtgccctgcagatcgtggcccggctgaagaacaacaaccggcaggtgtgcatcgaccccaagctgaagtggatccaggagtacctggagaaggccctgaacaagcgcttcaagatgtag

SEQ ID NO: 19058 - DNA, 423 bp, Artificial Sequence
  Description of Artificial Sequence: Synthetic coding sequence
atgaatgccaaggtggtggtggtgctggtgctggtgctgacagccctgtgcctgagtgatggcaagcctgtgtccctgagctaccgctgcccctgccgcttctttgagagccacgtggcccgggccaacgtgaagcacctgaagatcctgaacacccccaactgtgccctgcagatcgtggcccggctgaagaacaacaaccggcaggtgtgcatcgaccccaagctgaagtggatccaggagtacctggagaaggccctgaacaacctgatctctgctgccccagctgggaagagggtgattgctggggcccgggccctgcaccccagccccccccgggcctgccccacagcccgggccctgtgtgagatccggctgtggcccccacctgagtggagctggcccagccctggagatgtgtag

SEQ ID NO: 19059 - DNA, 273 bp, Artificial Sequence
  Description of Artificial Sequence: Synthetic coding sequence
atgaatgccaaggtggtggtggtgctggtgctggtgctgacagccctgtgcctgagtgatggcaagcctgtgtccctgagctaccgctgcccctgccgcttctttgagagccacgtggcccgggccaacgtgaagcacctgaagatcctgaacacccccaactgtgccctgcagatcgtggcccggctgaagaacaacaaccggcaggtgtgcatcgaccccaagctgaagtggatccaggagtacctggagaaggccctgaacaactgctag

SEQ ID NO: 19060 - DNA, 330 bp, Artificial Sequence
  Description of Artificial Sequence: Synthetic coding sequence
atgaagttcatcagcaccagcctgctgctgatgctgctggtgagcagcctgagccctgtgcagggcgtgctggaggtgtactacaccagcctgcgctgccgctgtgtgcaggagagcagcgtcttcatcccccggcgcttcatcgaccgcatccagatcctgcccagaggaaatggctgccccaggaaggagatcatcgtgtggaagaagaacaagagcatcgtgtgtgtggacccccaggccgagtggatccagaggatgatggaggtgctgaggaagaggagcagcagcaccctgcctgtgcctgtgttcaagaggaagatcccctag

SEQ ID NO: 19061 - DNA, 1560 bp, Artificial Sequence
  Description of Artificial Sequence: Synthetic coding sequence
atgttcctgctgcccctgcctgctgctggccgggtggtggtgcggcggctggccgtgcggcgcttcggcagccgcagcctgagcacagctgacatgaccaagggcctggtgctgggcatctacagcaaggagaaggaggatgatgtgccccagttcaccagcgctggagaaaattttgacaagctgctggccggcaagctgcgggagaccctgaacatcagcggcccccccctgaaggccggcaagaccaggaccttctacggcctgcaccaggacttccccagcgtggtgctggtgggcctgggcaagaaggccgccggcattgatgagcaggagaactggcatgagggcaaggagaacatccgggctgctgtggccgccggctgccggcagatccaggacctggagctgagctctgtggaggtggacccctgtggagatgcccaggccgctgctgagggcgctgtgctgggcctgtatgaatatgatgacctgaagcagaagaagaagatggctgtgtctgccaagctgtatggcagcggggaccaggaggcctggcagaagggcgtgctgtttgccagcggccagaacctggcccggcagctgatggagaccccagccaatgagatgacccccaccaggtttgctgagatcatcgagaagaacctgaagagcgccagcagcaagacagaggtgcacatccggcccaagtcctggattgaggagcaggccatgggcagcttcctgtctgtggccaagggcagtgatgagccccctgtgttcctggagatccactacaagggcagccccaatgccaatgaaccacccctggtgtttgtgggcaagggcatcacctttgacagcggcggcatcagcatcaaggccagcgccaacatggacctgatgagagctgacatgggcggggccgccaccatctgcagcgccatcgtgtctgctgccaagctgaacctgcccatcaacatcatcggcctggcccccctgtgtgagaacatgcccagcggcaaggccaacaagccaggagatgtggtgcgggccaagaatggcaagaccatccaggtggacaacacagatgctgagggccgcctcatcctggctgatgccctgtgctacgcccacaccttcaaccccaaggtgatcctgaatgctgccaccctgactggagccatggatgtggccctgggcagcggggccactggagtcttcaccaacagctcctggctgtggaacaagctgtttgaggccagcattgaaacaggagacagagtgtggaggatgcccctgtttgagcactacacccggcaggtggtggactgccagctggctgatgtgaacaacatcggcaagtacagatctgctggggcctgcacagctgctgccttcctgaaggagtttgtgacccaccccaagtgggcccacctggacattgctggggtgatgaccaacaaggatgaggtgccctacctgaggaagggcatgacaggccggcccaccaggaccctcatcgagttcctgctgcgcttcagccaggacaatgcctag

SEQ ID NO: 19062 - DNA, 378 bp, Artificial Sequence
  Description of Artificial Sequence: Synthetic coding sequence
atgaagaagagcggcgtgctcttcctgctgggcatcatcctgctggtgctgattggagtgcagggcacccctgtggtgaggaagggccgctgcagctgcatcagcaccaaccagggcaccatccacctgcagagcctgaaggacctgaagcagtttgcccccagccccagctgtgagaagattgagatcatcgccaccctgaagaatggagtgcagacctgcctgaacccagattctgcagatgtgaaggagctgatcaagaagtgggagaagcaggtgtcccagaagaagaagcagaagaatggcaagaagcaccagaagaagaaggtgctgaaggtgaggaagagccagaggagccggcagaagaagaccacctag

SEQ ID NO: 19063 - DNA, 1083 bp, Artificial Sequence
  Description of Artificial Sequence: Synthetic coding sequence
atggaggacttcaacatggagagtgacagctttgaggacttctggaagggggaggacctgagcaactacagctacagcagcaccctgccccccttcctgctggatgctgccccctgtgagcctgagagcctggagatcaacaagtactttgtggtgatcatctatgccctggtgttcctgctgagcctgctgggcaacagcctggtgatgctggtgatcctgtacagccgggtgggccgctctgtgacagatgtgtacctgctgaacctggccctggccgacctgctgtttgccctgaccctgcccatctgggccgccagcaaggtgaatggctggatcttcggcaccttcctgtgcaaggtggtgtccctgctgaaggaggtgaacttctacagcggcatcctgctgctggcctgcatctctgtggaccgctacctggccatcgtgcacgccaccaggaccctgacccagaagcgctacctggtgaagttcatctgcctgagcatctggggcctgagcctgctgctggccctgcctgtgctgctcttccggaggacagtgtacagcagcaatgtgtccccagcctgctatgaggacatgggcaacaacacagccaactggaggatgctgctgcgcatcctgccccagagctttggcttcatcgtgcccctgctgatcatgctgttctgctacggcttcaccctgcggaccctcttcaaggcccacatgggccagaagcaccgggccatgagggtcatctttgctgtggtgctgatcttcctgctgtgctggctgccctacaacctggtgctgctggccgacaccctgatgaggacccaggtgatccaggagacctgtgagaggaggaaccacatcgaccgggccctggatgccacagagatcctgggcatcctgcacagctgcctgaaccccctcatctatgccttcatcggccagaagttcagacatggcctgctgaagatcctggccatccacggcctcatcagcaaggacagcctgcccaaggacagccggcccagctttgtgggcagcagcagcggccacaccagcaccaccctgtag

SEQ ID NO: 19064 - DNA, 417 bp, Artificial Sequence
  Description of Artificial Sequence: Synthetic coding sequence
atggaggacttcaacatggagagtgacagctttgaggacttctggaagggggaggacctgagcaactacagctacagcagcaccctgccccccttcctgctggatgctgccccctgtgagcctgagagcctggagatcaacaagtactttgtggtgatcatctatgccctggtgttcctgctgagcctgctgggcaacagcctggtgatgctggtgatcctgtacagccgggtgggccgctctgtgacagatgtgtacctgctgaacctggccctggccgacctgctgtttgccctgaccctgcccatctgggccgccagcaaggtgaatggctggatcttcggcaccttcctgtgcaaggtggtgtccctgctgaaggaggtgaacttctacagcggcatcctgctgctggcctag

SEQ ID NO: 19065 - DNA, 48 bp, Artificial Sequence
  Description of Artificial Sequence: Synthetic coding sequence
atggaggacttcaacatggagagtgacagctttgaggacttctggtag

SEQ ID NO: 19066 - DNA, 519 bp, Artificial Sequence
  Description of Artificial Sequence: Synthetic coding sequence
atggaggacttcaacatggagagtgacagctttgaggacttctggaagggggaggacctgagcaactacagctacagcagcaccctgccccccttcctgctggatgctgccccctgtgagcctgagagcctggagatcaacaagtactttgtggtgatcatctatgccctggtgttcctgctgagcctgctgggcaacagcctggtgatgctggtgatcctgtacagccgggtgggccgctctgtgacagatgtgtacctgctgaacctggccctggccgacctgctgtttgccctgaccctgcccatctgggccgccagcaaggtgaatggctggatcttcggcaccttcctgtgcaaggtggtgtccctgctgaaggaggtgaacttctacagcggcatcctgctgctggcctgcatctctgtggaccgctacctggccatcgtgcacgccaccaggaccctgacccagaagcgctacctggtgaagttcatctgcctgagcatctggggcctgtag

SEQ ID NO: 19067 - DNA, 48 bp, Artificial Sequence; identical to SEQ ID NO: 19065
  Description of Artificial Sequence: Synthetic coding sequence

SEQ ID NO: 19068 - DNA, 606 bp, Artificial Sequence
  Description of Artificial Sequence: Synthetic coding sequence
atggaggacttcaacatggagagtgacagctttgaggacttctggaagggggaggacctgagcaactacagctacagcagcaccctgccccccttcctgctggatgctgccccctgtgagcctgagagcctggagatcaacaagtactttgtggtgatcatctatgccctggtgttcctgctgagcctgctgggcaacagcctggtgatgctggtgatcctgtacagccgggtgggccgctctgtgacagatgtgtacctgctgaacctggccctggccgacctgctgtttgccctgaccctgcccatctgggccgccagcaaggtgaatggctggatcttcggcaccttcctgtgcaaggtggtgtccctgctgaaggaggtgaacttctacagcggcatcctgctgctggcctgcatctctgtggaccgctacctggccatcgtgcacgccaccaggaccctgacccagaagcgctacctggtgaagttcatctgcctgagcatctggggcctgagcctgctgctggccctgcctgtgctgctcttccggaggacagtgtacagcagcaatgtgtccccagcctgctatgaggacatgggctag

SEQ ID NO: 19069 - DNA, 411 bp, Artificial Sequence
  Description of Artificial Sequence: Synthetic coding sequence
atggaggacttcaacatggagagtgacagctttgaggacttctggaagggggaggacctgagcaactacagctacagcagcaccctgccccccttcctgctggatgctgccccctgtgagcctgagagcctggagatcaacaagtactttgtggtgatcatctatgccctggtgttcctgctgagcctgctgggcaacagcctggtgatgctggtgatcctgtacagccgggtgggccgctctgtgacagatgtgtacctgctgaacctggccctggccgacctgctgtttgccctgaccctgcccatctgggccgccagcaaggtgaatggctggatcttcggcaccttcctgtgcaaggtggtgtccctgctgaaggaggtgaacttctacagcggcatcctgctgtag

SEQ ID NO: 19070 - DNA, 1059 bp, Artificial Sequence
  Description of Artificial Sequence: Synthetic coding sequence
atggagggcatcagcatctacaccagtgacaactacacagaggagatgggcagcggggactatgacagcatgaaggagccctgcttccgggaggagaatgccaacttcaacaagatcttcctgcccaccatctacagcatcatcttcctgactggaattgtgggcaatggcctggtgatcctggtgatgggctaccagaagaagctgcgctccatgacagacaagtaccgcctgcacctgtctgtggccgacctgctgtttgtgatcaccctgcccttctgggccgtggatgctgtggccaactggtacttcggcaacttcctgtgcaaggctgtgcacgtgatctacacagtgaacctgtacagctctgtgctgatcctggccttcatcagcctggaccgctacctggccatcgtgcacgccaccaacagccagaggcccaggaagctgctggccgagaaggtggtgtatgtgggcgtgtggatcccagccctgctgctgaccatcccagacttcatctttgccaacgtgtctgaggctgatgaccgctacatctgtgaccgcttctacccaaatgacctgtgggtggtggtgttccagttccagcacatcatggtgggcctcatcctgcccggcatcgtcatcctgagctgctactgcatcatcatcagcaagctgagccacagcaagggccaccagaagaggaaggccctgaagaccaccgtcatcctgatcctggccttctttgcctgctggctgccctactacatcggcatcagcattgacagcttcatcctgctggagatcatcaagcagggctgtgaatttgaaaatacagtgcacaagtggatcagcatcacagaggccctggccttcttccactgctgcctgaaccccatcctgtatgccttcctgggcgccaagttcaagaccagcgcccagcacgccctgacctctgtgtcccggggcagcagcctgaagatcctgagcaagggcaagagaggaggccacagctctgtgtccacagagagcgagagcagcagcttccacagcagctag

SEQ ID NO: 19071 - DNA, 1071 bp, Artificial Sequence
  Description of Artificial Sequence: Synthetic coding sequence
atgagcatccccctgcccctgctgcagatctacaccagtgacaactacacagaggagatgggcagcggggactatgacagcatgaaggagccctgcttccgggaggagaatgccaacttcaacaagatcttcctgcccaccatctacagcatcatcttcctgactggaattgtgggcaatggcctggtgatcctggtgatgggctaccagaagaagctgcgctccatgacagacaagtaccgcctgcacctgtctgtggccgacctgctgtttgtgatcaccctgcccttctgggccgtggatgctgtggccaactggtacttcggcaacttcctgtgcaaggctgtgcacgtgatctacacagtgaacctgtacagctctgtgctgatcctggccttcatcagcctggaccgctacctggccatcgtgcacgccaccaacagccagaggcccaggaagctgctggccgagaaggtggtgtatgtgggcgtgtggatcccagccctgctgctgaccatcccagacttcatctttgccaacgtgtctgaggctgatgaccgctacatctgtgaccgcttctacccaaatgacctgtgggtggtggtgttccagttccagcacatcatggtgggcctcatcctgcccggcatcgtcatcctgagctgctactgcatcatcatcagcaagctgagccacagcaagggccaccagaagaggaaggccctgaagaccaccgtcatcctgatcctggccttctttgcctgctggctgccctactacatcggcatcagcattgacagcttcatcctgctggagatcatcaagcagggctgtgaatttgaaaatacagtgcacaagtggatcagcatcacagaggccctggccttcttccactgctgcctgaaccccatcctgtatgccttcctgggcgccaagttcaagaccagcgcccagcacgccctgacctctgtgtcccggggcagcagcctgaagatcctgagcaagggcaagagaggaggccacagctctgtgtccacagagagcgagagcagcagcttccacagcagctag

SEQ ID NO: 19072 - DNA, 669 bp, Artificial Sequence
  Description of Artificial Sequence: Synthetic coding sequence
atgccctggcagacaggcaccctgggcaccagctatgcccggcagagcatgagcagcacccagagcaccagcacagctgtgagcagctcctggatcccagccctgctgctgaccatcccagacttcatctttgccaacgtgtctgaggctgatgaccgctacatctgtgaccgcttctacccaaatgacctgtgggtggtggtgttccagttccagcacatcatggtgggcctcatcctgcccggcatcgtcatcctgagctgctactgcatcatcatcagcaagctgagccacagcaagggccaccagaagaggaaggccctgaagaccaccgtcatcctgatcctggccttctttgcctgctggctgccctactacatcggcatcagcattgacagcttcatcctgctggagatcatcaagcagggctgtgaatttgaaaatacagtgcacaagtggatcagcatcacagaggccctggccttcttccactgctgcctgaaccccatcctgtatgccttcctgggcgccaagttcaagaccagcgcccagcacgccctgacctctgtgtcccggggcagcagcctgaagatcctgagcaagggcaagagaggaggccacagctctgtgtccacagagagcgagagcagcagcttccacagcagctag

SEQ ID NO: 19073 - DNA, 2832 bp, Artificial Sequence
  Description of Artificial Sequence: Synthetic coding sequence
atgacccagaggagcattgctggccccatctgcaacctgaagtttgtgaccctgctggtggccctgagcagcgagctgcccttcctgggcgccggcgtgcagctgcaggacaatggctacaacggcctgctgattgccatcaacccccaggtgcctgagaaccagaacctgatcagcaacatcaaggagatgatcacagaggccagcttctacctgttcaatgccaccaagagaagagtcttcttcaggaacatcaagatcctgatcccagccacctggaaggccaacaacaacagcaagatcaagcaggagagctatgagaaggccaacgtcatcgtgacagactggtatggagcccatggagatgacccctacaccctgcagtaccggggctgtgggaaggagggcaagtacatccacttcacccccaacttcctgctgaatgacaacctgacagctggctacggcagccggggccgggtgtttgtgcatgagtgggcccacctgcgctggggcgtgtttgatgagtacaacaatgacaagcccttctacatcaatggccagaaccagatcaaggtgacccgctgcagcagtgacatcaccggcatctttgtgtgtgagaagggcccctgcccccaggagaactgcatcatcagcaagctgttcaaggagggctgcaccttcatctacaacagcacccagaatgccacagccagcatcatgttcatgcagagcctgagctctgtggtggagttctgcaatgccagcacccacaaccaggaggcccccaacctgcagaaccagatgtgcagcctgcggagcgcctgggatgtgatcacagacagcgctgacttccaccacagcttccccatgaatggaacagagctgcccccaccacccaccttcagcctggtgcaggccggggacaaggtggtgtgcctggtgctggatgtgagcagcaagatggccgaggccgaccggctgctgcagctgcagcaggccgctgagttctacctgatgcagatcgtggagatccacacctttgtgggcatcgccagctttgacagcaaaggagagatccgggcccagctgcaccagatcaacagcaatgatgacaggaagctgctggtgtcctacctgcccaccaccgtgtctgccaagacagacatcagcatctgcagcggcctgaagaagggctttgaggtggtggagaagctgaatggcaaggcctacggctctgtgatgatcctggtgaccagcggagatgacaagctgctgggcaactgcctgcccaccgtgctgagcagcggcagcaccatccacagcatcgccctgggcagcagcgctgcccccaacctggaggagctgagccggctgaccggcggcctgaagttctttgtgcctgacatcagcaacagcaacagcatgattgatgccttcagccgcatcagcagcggcactggagacatcttccagcagcacatccagctggagagcactggagaaaatgtgaagccccaccaccagctgaagaacacagtgacagtggacaacacagtgggcaatgacaccatgttcctggtgacctggcaggccagcggccccccagagatcatcctgtttgatcctgatggcaggaagtactacaccaacaacttcatcaccaacctgaccttcagaacagccagcctgtggatccctggaacagccaagccaggccactggacctacaccctgaacaacacccaccacagcctgcaggccctgaaggtgacagtgaccagccgggccagcaacagcgctgtgcccccagccaccgtggaggcctttgtggagcgggacagcctgcacttcccccaccctgtgatgatctatgccaacgtgaagcagggcttctaccccatcctgaatgccaccgtgacagccaccgtggagcctgagaccggggaccctgtgaccctgcggctgctggatgatggagctggagcagatgtgatcaagaatgatggcatctacagccgctacttcttctcctttgctgccaacggccgctacagcctgaaggtgcacgtgaaccacagccccagcatcagcaccccagcccacagcatccctggcagccacgccatgtatgtgcccggctacacagccaacggcaacatccagatgaatgcccccaggaagtctgtgggcagaaatgaggaggagaggaagtggggcttcagccgggtgagcagcggcggcagcttctctgtgctgggcgtgcctgctggcccccacccagatgtgtttcctccctgcaagatcatcgacctggaggccgtgaaggtggaggaggagctgaccctgtcctggacagcccctggagaggactttgaccagggccaggccaccagctatgagatccgcatgagcaagagcctgcagaacatccaggatgacttcaacaatgccatcctggtgaacaccagcaagaggaacccccagcaggccggcatccgggagatcttcaccttcagcccccagatcagcaccaacggccctgagcaccagcccaatggagagacccatgagagccaccgcatctacgtggccatccgggccatggacaggaacagcctgcagagcgctgtgagcaacatcgcccaggcccccctcttcatcccccccaacagcgaccctgtgcctgcccgggactacctgatcctgaagggcgtgctgacagccatgggcctgattggcatcatctgcctgatcatcgtggtgacccaccacaccctgagcaggaagaagagagctgacaagaaggaaaatggcaccaagctgctgtag

SEQ ID NO: 19074 - DNA, 423 bp, Artificial Sequence
  Description of Artificial Sequence: Synthetic coding sequence
atgacccagaggagcattgctggccccatctgcaacctgaagtttgtgaccctgctggtggccctgagcagcgagctgcccttcctgggcgccggcgtgcagctgcaggacaatggctacaacggcctgctgattgccatcaacccccaggtgcctgagaaccagaacctgatcagcaacatcaaggagatgatcacagaggccagcttctacctgttcaatgccaccaagagaagagtcttcttcaggaacatcaagatcctgatcccagccacctggaaggccaacaacaacagcaagatcaagcaggagagctatgagaaggccaacgtcatcgtgacagactggtatggagcccatggagatgaccagggcgtggagaagcgggagaacaccttcatcagccacctgatctcctactag

SEQ ID NO: 19075 - DNA, 1233 bp, Artificial Sequence
  Description of Artificial Sequence: Synthetic coding sequence
atgaatgatgaggactacagcaccatctatgacaccatccagaatgaaagaacctatgaggtgcctgaccagccagaagaaaatgaaagcccccactatgatgatgtgcatgagtacctgcggccagaaaatgacctgtatgccacccagctgaacacccatgaatatgactttgtgtctgtgtacaccatcaagggggaggagaccagcctggcctctgtgcagagtgaagatcggggctacctgctgcctgatgagatctacagcgagctgcaggaggcccaccctggagagccccaggaggaccggggcatctccatggagggcctgtacagcagcacccaggaccagcagctgtgtgccgctgagctgcaggagaatggatctgtgatgaaggaggacctgcccagccccagcagcttcaccatccagcacagcaaggccttcagcaccaccaagtacagctgctacagtgatgctgagggcctggaggagaaggagggcgcccacatgaaccctgagatctacctgtttgtgaaggccggcattgatggagagagcatcggcaactgccccttcagccagaggctcttcatgatcctgtggctgaagggcgtggtgttcaacgtgaccaccgtggacctgaagaggaagccagctgacctgcacaacctggcccctggcacccacccccccttcctgaccttcaatggagatgtgaagacagatgtgaacaagattgaggagttcctggaggagaccctgaccccagagaagtaccccaagctggccgccaagcaccgggagagcaacacagctggcatcgacatcttcagcaagttcagcgcctacatcaagaacaccaagcagcagaacaatgctgccctggagcggggcctgaccaaggccctgaagaagctggatgactacctgaacacccccctgcctgaggagattgatgccaacacctgtggggaggacaagggcagcaggaggaagttcctggatggagatgagctgaccctggccgactgcaacctgctgcccaagctgcacgtggtgaagatcgtggccaagaagtacagaaattatgacatcccagctgagatgacaggcctgtggagatacctgaagaatgcctatgccagagatgagttcaccaacacctgtgccgctgacagcgagattgagctggcctatgcagatgtggccaagaggctgagccgctcctag

SEQ ID NO: 19076 - DNA, 756 bp, Artificial Sequence
  Description of Artificial Sequence: Synthetic coding sequence
atgacagacagcgccacagccaatggagatgaccgggaccctgagattgagctgtttgtgaaggccggcattgatggagagagcatcggcaactgccccttcagccagaggctcttcatgatcctgtggctgaagggcgtggtgttcaacgtgaccaccgtggacctgaagaggaagccagctgacctgcacaacctggcccctggcacccacccccccttcctgaccttcaatggagatgtgaagacagatgtgaacaagattgaggagttcctggaggagaccctgaccccagagaagtaccccaagctggccgccaagcaccgggagagcaacacagctggcatcgacatcttcagcaagttcagcgcctacatcaagaacaccaagcagcagaacaatgctgccctggagcggggcctgaccaaggccctgaagaagctggatgactacctgaacacccccctgcctgaggagattgatgccaacacctgtggagaagataaaggcagcaggaggaagttcctggatggagatgagctgaccctggccgactgcaacctgctgcccaagctgcacgtggtgaagatcgtggccaagaagtacagaaattatgacatcccagctgagatgacaggcctgtggagatacctgaagaatgcctatgccagagatgagttcaccaacacctgtgccgctgacagcgagattgagctggcctatgcagatgtggccaagaggctgagccgctcctag

SEQ ID NO: 19077 - DNA, 618 bp, Artificial Sequence
  Description of Artificial Sequence: Synthetic coding sequence
atgacagacagcgccacagccaatggagatgaccgggaccctgagattgagctgtttgtgaaggccggcattgatggagagagcatcggcaactgccccttcagccagaggctcttcatgatcctgtggctgaagggcgtggtgttcaacgtgaccaccgtggacctgaagaggaagccagctgacctgcacaacctggcccctggcacccacccccccttcctgaccttcaatggagatgtgaagacagatgtgaacaagattgaggagttcctggaggagaccctgaccccagagaagtaccccaagctggccgccaagcaccgggagagcaacacagctggcatcgacatcttcagcaagttcagcgcctacatcaagaacaccaagcagcagaacaatgctgccctggagcggggcctgaccaaggccctgaagaagctggatgactacctgaacacccccctgcctgaggagattgatgccaacacctgtggagaagataaaggcagcaggaggaagttcctggatggagatgagctgaccctggccgactgcaacctgctgcccaagctgcacgtggtgaaggagcaggtgcccctgaagggcatgatctag

SEQ ID NO: 19078 - DNA, 5823 bp, Artificial Sequence
  Description of Artificial Sequence: Synthetic coding sequence
atggccagcggcctgggcagccccagcccctgcagcgctggcagcgaggaggaggacatggatgccctgctgaacaacagcctgcccccaccccacccagaaaatgaagaagatcctgaggaggacctgtctgaaacagagacccccaagctgaagaagaagaagaagcccaagaagccccgggaccccaagatccccaagagcaagaggcagaagaaggagaggatgctgctgtgccggcagctgggggacagcagcggggagggccctgagtttgtggaggaggaggaggaggtggccctgcggagtgacagcgagggcagtgactacacccctgggaagaagaagaagaagaagctgggccccaagaaggagaagaagagcaagagcaagaggaaggaggaggaggaggaggaggatgatgatgatgacagcaaggagcccaagagcagcgcccagctgctggaggactggggcatggaggacatcgaccacgtgttcagcgaggaggactaccgcaccctgaccaactacaaggccttcagccagtttgtgcggcccctgattgctgccaagaaccccaagattgctgtgtccaagatgatgatggtgctgggcgccaagtggagggagttcagcaccaacaaccccttcaagggcagcagcggggcctctgtggccgctgctgctgctgctgctgtggccgtggtggagagcatggtgacagccacagaggtggcccctcctcctcctcctgtggaggtgcccatcaggaaggccaagaccaaggagggcaagggccccaatgcccggaggaagcccaagggcagcccccgggtgcctgatgccaagaagcccaagcccaagaaggtggcccccctgaagatcaagctgggcggcttcggcagcaagaggaagaggagcagcagtgaagatgatgacctggatgtggagagtgactttgatgatgccagcatcaacagctacagcgtgtctgatggcagcaccagccgcagcagccgcagcaggaagaagctgcggaccaccaagaagaagaagaagggggaggaggaggtgacagctgtggatggctatgaaacagaccaccaggactactgtgaggtgtgccagcagggcggggagatcatcctgtgtgacacctgcccccgggcctaccacatggtgtgcctggaccctgacatggagaaggcccctgagggcaagtggagctgcccccactgtgagaaggagggcatccagtgggaggccaaggaggacaacagcgagggggaggagatcctggaggaggtgggcggggacctggaggaggaggatgaccaccacatggagttctgccgggtgtgcaaggatggaggagagctgctgtgctgtgacacctgccccagcagctaccacatccactgcctgaacccccccctgcctgagatccccaatggagagtggctgtgcccccgctgcacctgcccagccctgaagggcaaggtgcagaagatcctgatctggaagtggggccagccccccagccccacccctgtgccccggcccccagatgctgaccccaacacccccagccccaagcccctggagggccggcctgagcggcagttctttgtgaagtggcagggcatgagctactggcactgctcctgggtgtctgagctgcagctggagctgcactgccaggtgatgttcaggaactaccagaggaagaatgacatggatgagcccccatctggggactttggaggagatgaggagaagagcaggaagaggaagaacaaggaccccaagtttgctgagatggaggagcgcttctaccgctatggcatcaagccagagtggatgatgatccaccgcatcctgaaccacagcgtggacaagaagggccacgtgcactacctgatcaagtggagggacctgccctatgaccaggcctcctgggagagtgaagatgtggagatccaggactatgacctcttcaagcagagctactggaaccaccgggagctgatgagaggagaggagggccggcctgggaagaagctgaagaaggtgaagctgaggaagctggagcggcccccagagacccccaccgtggaccccaccgtgaagtatgaaaggcagcctgagtacctggatgccaccggcggcaccctgcacccctaccagatggagggcctgaactggctgcgcttctcctgggcccagggcacagacaccatcctggctgatgagatgggcctgggcaagacagtgcagacagctgtgttcctgtacagcctgtacaaggagggccacagcaagggccccttcctggtgtctgcccccctgagcaccatcatcaactgggagcgggagtttgagatgtgggccccagacatgtatgtggtgacctacgtgggggacaaggacagccgggccatcatccgggagaatgagttctcctttgaggacaatgccatccggggcggcaagaaggccagcaggatgaagaaggaggcctctgtgaagttccacgtgctgctgaccagctatgagctgatcaccatcgacatggccatcctgggcagcattgactgggcctgcctgattgtggatgaggcccaccggctgaagaacaaccagagcaagttcttccgggtgctgaatggctacagcctgcagcacaagctgctgctgaccggcacccccctgcagaacaacctggaggagctgttccacctgctgaacttcctgaccccagagcgcttccacaacctggagggcttcctggaggagtttgctgacatcgccaaggaggaccagatcaagaagctgcatgacatgctgggcccccacatgctgcggcggctgaaggcagatgtgttcaagaacatgcccagcaagacagagctgattgtgcgggtggagctgagccccatgcagaagaagtactacaagtacatcctgaccaggaactttgaggccctgaatgcccggggcggcggcaaccaggtgtccctgctgaatgtggtgatggacctgaagaagtgctgcaaccacccctacctgtttcctgtggccgccatggaggcccccaagatgcccaacggcatgtatgatggcagcgccctgatccgggccagcggcaagctgctgctgctgcagaagatgctgaagaacctgaaggagggcggccaccgggtgctgatcttcagccagatgaccaagatgctggacctgctggaggacttcctggagcacgagggctacaagtatgaaagaattgatggcggcatcactggaaacatgaggcaggaggccatcgaccgcttcaatgcccctggggcccagcagttctgcttcctgctgagcacccgggccggcggcctgggcatcaacctggccacagctgacaccgtcatcatctatgacagcgactggaacccccacaatgacatccaggccttcagccgggcccacagaattggccagaacaagaaggtgatgatctacagatttgtgacccgggcctctgtggaggagcgcatcacccaggtggccaagaagaagatgatgctgacccacctggtggtgcggcccggcctgggcagcaagacaggctccatgagcaagcaggagctggatgacatcctgaagtttggaacagaggagctgttcaaggatgaggccacagatggcggcggggacaacaaggagggggaggacagcagcgtcatccactatgatgacaaggccatcgagcggctgctggacaggaaccaggatgaaacagaggacacagagctgcagggcatgaatgagtacctgagcagcttcaaggtggcccagtatgtggtgcgggaggaggagatgggagaggaggaggaggtggagcgggagatcatcaagcaggaggagagcgtggaccctgactactgggagaagctgctgcggcaccactatgagcagcagcaggaggacctggccaggaacctgggcaagggcaagaggatcaggaagcaggtgaactacaatgatggcagccaggaggaccggggcgtgtgtggccggccccggcccccacccatgggccgcagcaccagggctgtgggccctgcccacctgcccagcctgcccccagactggcaggatgaccagagcgacaaccagagcgactacagcgtggccagcgaggagggagatgaagattttgatgagaggtctgaggccccccggcggcccagcaggaagggcctgagaaatgacaaggacaagcccctgccccccctgctggcccgggtgggcggcaacatcgaggtgctgggcttcaatgcccggcagaggaaggccttcctgaatgccatcatgagatatggcatgccaccccaggatgccttcaccacccagtggctggtgcgggacctgcggggcaagtctgagaaggagttcaaggcctacgtgtccctcttcatgaggcacctgtgtgagcccggggctgatggagctgagacctttgctgatggagtgccccgggagggcctgagccggcagcacgtgctgacccgcatcggcgtgatgagcctcatcaggaagaaggtgcaggagtttgaacatgtgaatggccgctggagcatgcctgagctggccgaggtggaggagaacaagaagatgagccagcccggcagccccagccccaagacccccacccccagcacccctggggacacccagcccaacaccccagcccctgtgcccccagcagaagatggcatcaagattgaggagaacagcctgaaggaggaggagagcattgaaggagagaaggaggtgaagagcacagcccctgagacagccattgaatgtacccaggccccagccccagcctctgaagatgagaaggtggtggtggagcccccagagggggaggagaaggtggagaaggccgaggtgaaggagaggacagaggagcccatggagacagagcccaagggagctgctgatgtggagaaggtggaggagaagagcgccatcgacctgacccccatcgtggtggaggacaaggaggagaagaaggaggaggaggagaagaaggaggtgatgctgcagaatggagagacccccaaggacctgaatgatgagaagcagaagaagaacatcaagcagcgcttcatgttcaacattgctgatggcggcttcacagagctgcacagcctgtggcagaatgaggagcgggccgccaccgtgaccaagaagacctatgagatctggcacagaagacatgactactggctgctggccggcatcatcaaccacggctacgcccgctggcaggacatccagaatgaccccaggtatgccatcctgaatgagcccttcaagggggagatgaacagaggcaacttcctggagatcaagaacaagttcctggcccggcgcttcaagctgctggagcaggccctggtgattgaggagcagctgcggcgggccgcctacctgaacatgtctgaggaccccagccaccccagcatggccctgaacaccaggtttgctgaggtggagtgcctggccgagagccaccagcacctgagcaaggagagcatggccggcaacaagccagccaatgctgtgctgcacaaggtgctgaagcagctggaggagctgctgagtgacatgaaggcagatgtgacccggctgcctgccaccatcgcccgcatcccccctgtggccgtgcggctgcagatgtctgagaggaacatcctgagccggctggccaacagagcccctgagcccaccccccagcaggtggcccagcagcagtag

SEQ ID NO: 19079 - DNA, 5739 bp, Artificial Sequence
  Description of Artificial Sequence: Synthetic coding sequence
atggccagcggcctgggcagccccagcccctgcagcgctggcagcgaggaggaggacatggatgccctgctgaacaacagcctgcccccaccccacccagaaaatgaagaagatcctgaggaggacctgtctgaaacagagacccccaagctgaagaagaagaagaagcccaagaagccccgggaccccaagatccccaagagcaagaggcagaagaaggagaggatgctgctgtgccggcagctgggggacagcagcggggagggccctgagtttgtggaggaggaggaggaggtggccctgcggagtgacagcgagggcagtgactacacccctgggaagaagaagaagaagaagctgggccccaagaaggagaagaagagcaagagcaagaggaaggaggaggaggaggaggaggatgatgatgatgacagcaaggagcccaagagcagcgcccagctgctggaggactggggcatggaggacatcgaccacgtgttcagcgaggaggactaccgcaccctgaccaactacaaggccttcagccagtttgtgcggcccctgattgctgccaagaaccccaagattgctgtgtccaagatgatgatggtgctgggcgccaagtggagggagttcagcaccaacaaccccttcaagggcagcagcggggcctctgtggccgctgctgctgctgctgctgtggccgtggtggagagcatggtgacagccacagaggtggcccctcctcctcctcctgtggaggtgcccatcaggaaggccaagaccaaggagggcaagggccccaatgcccggaggaagcccaagggcagcccccgggtgcctgatgccaagaagcccaagcccaagaaggtggcccccctgaagatcaagctgggcggcttcggcagcaagaggaagaggagcagcagtgaagatgatgacctggatgtggagagtgactttgatgatgccagcatcaacagctacagcgtgtctgatggcagcaccagccgcagcagccgcagcaggaagaagctgcggaccaccaagaagaagaagaagggggaggaggaggtgacagctgtggatggctatgaaacagaccaccaggactactgtgaggtgtgccagcagggcggggagatcatcctgtgtgacacctgcccccgggcctaccacatggtgtgcctggaccctgacatggagaaggcccctgagggcaagtggagctgcccccactgtgagaaggagggcatccagtgggaggccaaggaggacaacagcgagggggaggagatcctggaggaggtgggcggggacctggaggaggaggatgaccaccacatggagttctgccgggtgtgcaaggatggaggagagctgctgtgctgtgacacctgccccagcagctaccacatccactgcctgaacccccccctgcctgagatccccaatggagagtggctgtgcccccgctgcacctgcccagccctgaagggcaaggtgcagaagatcctgatctggaagtggggccagccccccagccccacccctgtgccccggcccccagatgctgaccccaacacccccagccccaagcccctggagggccggcctgagcggcagttctttgtgaagtggcagggcatgagctactggcactgctcctgggtgtctgagctgcagctggagctgcactgccaggtgatgttcaggaactaccagaggaagaatgacatggatgagcccccatctggggactttggaggagatgaggagaagagcaggaagaggaagaacaaggaccccaagtttgctgagatggaggagcgcttctaccgctatggcatcaagccagagtggatgatgatccaccgcatcctgaaccacagcgtggacaagaagggccacgtgcactacctgatcaagtggagggacctgccctatgaccaggcctcctgggagagtgaagatgtggagatccaggactatgacctcttcaagcagagctactggaaccaccgggagctgatgagaggagaggagggccggcctgggaagaagctgaagaaggtgaagctgaggaagctggagcggcccccagagacccccaccgtggaccccaccgtgaagtatgaaaggcagcctgagtacctggatgccaccggcggcaccctgcacccctaccagatggagggcctgaactggctgcgcttctcctgggcccagggcacagacaccatcctggctgatgagatgggcctgggcaagacagtgcagacagctgtgttcctgtacagcctgtacaaggagggccacagcaagggccccttcctggtgtctgcccccctgagcaccatcatcaactgggagcgggagtttgagatgtgggccccagacatgtatgtggtgacctacgtgggggacaaggacagccgggccatcatccgggagaatgagttctcctttgaggacaatgccatccggggcggcaagaaggccagcaggatgaagaaggaggcctctgtgaagttccacgtgctgctgaccagctatgagctgatcaccatcgacatggccatcctgggcagcattgactgggcctgcctgattgtggatgaggcccaccggctgaagaacaaccagagcaagttcttccgggtgctgaatggctacagcctgcagcacaagctgctgctgaccggcacccccctgcagaacaacctggaggagctgttccacctgctgaacttcctgaccccagagcgcttccacaacctggagggcttcctggaggagtttgctgacatcgccaaggaggaccagatcaagaagctgcatgacatgctgggcccccacatgctgcggcggctgaaggcagatgtgttcaagaacatgcccagcaagacagagctgattgtgcgggtggagctgagccccatgcagaagaagtactacaagtacatcctgaccaggaactttgaggccctgaatgcccggggcggcggcaaccaggtgtccctgctgaatgtggtgatggacctgaagaagtgctgcaaccacccctacctgtttcctgtggccgccatggaggcccccaagatgcccaacggcatgtatgatggcagcgccctgatccgggccagcggcaagctgctgctgctgcagaagatgctgaagaacctgaaggagggcggccaccgggtgctgatcttcagccagatgaccaagatgctggacctgctggaggacttcctggagcacgagggctacaagtatgaaagaattgatggcggcatcactggaaacatgaggcaggaggccatcgaccgcttcaatgcccctggggcccagcagttctgcttcctgctgagcacccgggccggcggcctgggcatcaacctggccacagctgacaccgtcatcatctatgacagcgactggaacccccacaatgacatccaggccttcagccgggcccacagaattggccagaacaagaaggtgatgatctacagatttgtgacccgggcctctgtggaggagcgcatcacccaggtggccaagaagaagatgatgctgacccacctggtggtgcggcccggcctgggcagcaagacaggctccatgagcaagcaggagctggatgacatcctgaagtttggaacagaggagctgttcaaggatgaggccacagatggcggcggggacaacaaggagggggaggacagcagcgtcatccactatgatgacaaggccatcgagcggctgctggacaggaaccaggatgaaacagaggacacagagctgcagggcatgaatgagtacctgagcagcttcaaggtggcccagtatgtggtgcgggaggaggagatgggagaggaggaggaggtggagcgggagatcatcaagcaggaggagagcgtggaccctgactactgggagaagctgctgcggcaccactatgagcagcagcaggaggacctggccaggaacctgggcaagggcaagaggatcaggaagcaggtgaactacaatgatggcagccaggaggaccgggactggcaggatgaccagagcgacaaccagagcgactacagcgtggccagcgaggagggagatgaagattttgatgagaggtctgaggccccccggcggcccagcaggaagggcctgagaaatgacaaggacaagcccctgccccccctgctggcccgggtgggcggcaacatcgaggtgctgggcttcaatgcccggcagaggaaggccttcctgaatgccatcatgagatatggcatgccaccccaggatgccttcaccacccagtggctggtgcgggacctgcggggcaagtctgagaaggagttcaaggcctacgtgtccctcttcatgaggcacctgtgtgagcccggggctgatggagctgagacctttgctgatggagtgccccgggagggcctgagccggcagcacgtgctgacccgcatcggcgtgatgagcctcatcaggaagaaggtgcaggagtttgaacatgtgaatggccgctggagcatgcctgagctggccgaggtggaggagaacaagaagatgagccagcccggcagccccagccccaagacccccacccccagcacccctggggacacccagcccaacaccccagcccctgtgcccccagcagaagatggcatcaagattgaggagaacagcctgaaggaggaggagagcattgaaggagagaaggaggtgaagagcacagcccctgagacagccattgaatgtacccaggccccagccccagcctctgaagatgagaaggtggtggtggagcccccagagggggaggagaaggtggagaaggccgaggtgaaggagaggacagaggagcccatggagacagagcccaagggagctgctgatgtggagaaggtggaggagaagagcgccatcgacctgacccccatcgtggtggaggacaaggaggagaagaaggaggaggaggagaagaaggaggtgatgctgcagaatggagagacccccaaggacctgaatgatgagaagcagaagaagaacatcaagcagcgcttcatgttcaacattgctgatggcggcttcacagagctgcacagcctgtggcagaatgaggagcgggccgccaccgtgaccaagaagacctatgagatctggcacagaagacatgactactggctgctggccggcatcatcaaccacggctacgcccgctggcaggacatccagaatgaccccaggtatgccatcctgaatgagcccttcaagggggagatgaacagaggcaacttcctggagatcaagaacaagttcctggcccggcgcttcaagctgctggagcaggccctggtgattgaggagcagctgcggcgggccgcctacctgaacatgtctgaggaccccagccaccccagcatggccctgaacaccaggtttgctgaggtggagtgcctggccgagagccaccagcacctgagcaaggagagcatggccggcaacaagccagccaatgctgtgctgcacaaggtgctgaagcagctggaggagctgctgagtgacatgaaggcagatgtgacccggctgcctgccaccatcgcccgcatcccccctgtggccgtgcggctgcagatgtctgagaggaacatcctgagccggctggccaacagagcccctgagcccaccccccagcaggtggcccagcagcagtag

SEQ ID NO: 19080 - DNA, 5661 bp, Artificial Sequence
  Description of Artificial Sequence: Synthetic coding sequence
atggatgccctgctgaacaacagcctgcccccaccccacccagaaaatgaggaggaccctgaggaggacctgtctgaaacagagacccccaagctgaagaagaagaagaagcccaagaagccccgggaccccaagatccccaagagcaagaggcagaagaaggagctgggggacagcagcggggagggccctgagtttgtggaggaggaggaggaggtggccctgcggagtgacagcgagggcagtgactacacccctgggaagaagaagaagaagaagctgggccccaagaaggagaagaagagcaagagcaagaggaaggaggaggaggaggaggaggatgatgatgatgacagcaaggagcccaagagcagcgcccagctgctggaggactggggcatggaggacatcgaccacgtgttcagcgaggaggactaccgcaccctgaccaactacaaggccttcagccagtttgtgcggcccctgattgctgccaagaaccccaagattgctgtgtccaagatgatgatggtgctgggcgccaagtggagggagttcagcaccaacaaccccttcaagggcagcagcggggcctctgtggccgctgctgctgctgctgctgtggccgtggtggagagcatggtgacagccacagaggtggcccctcctcctcctcctgtggaggtgcccatcaggaaggccaagaccaaggagggcaagggccccaatgcccggaggaagcccaagggcagcccccgggtgcctgatgccaagaagcccaagcccaagaaggtggcccccctgaagatcaagctgggcggcttcggcagcaagaggaagaggagcagcagtgaagatgatgacctggatgtggagagtgactttgatgatgccagcatcaacagctacagcgtgtctgatggcagcaccagccgcagcagccgcagcaggaagaagctgcggaccaccaagaagaagaagaagggggaggaggaggtgacagctgtggatggctatgaaacagaccaccaggactactgtgaggtgtgccagcagggcggggagatcatcctgtgtgacacctgcccccgggcctaccacatggtgtgcctggaccctgacatggagaaggcccctgagggcaagtggagctgcccccactgtgagaaggagggcatccagtgggaggccaaggaggacaacagcgagggggaggagatcctggaggaggtgggcggggacctggaggaggaggatgaccaccacatggagttctgccgggtgtgcaaggatggaggagagctgctgtgctgtgacacctgccccagcagctaccacatccactgcctgaacccccccctgcctgagatccccaatggagagtggctgtgcccccgctgcacctgcccagccctgaagggcaaggtgcagaagatcctgatctggaagtggggccagccccccagccccacccctgtgccccggcccccagatgctgaccccaacacccccagccccaagcccctggagggccggcctgagcggcagttctttgtgaagtggcagggcatgagctactggcactgctcctgggtgtctgagctgcagctggagctgcactgccaggtgatgttcaggaactaccagaggaagaatgacatggatgagcccccatctggggactttggaggagatgaggagaagagcaggaagaggaagaacaaggaccccaagtttgctgagatggaggagcgcttctaccgctatggcatcaagccagagtggatgatgatccaccgcatcctgaaccacagcgtggacaagaagggccacgtgcactacctgatcaagtggagggacctgccctatgaccaggcctcctgggagagtgaagatgtggagatccaggactatgacctcttcaagcagagctactggaaccaccgggagctgatgagaggagaggagggccggcctgggaagaagctgaagaaggtgaagctgaggaagctggagcggcccccagagacccccaccgtggaccccaccgtgaagtatgaaaggcagcctgagtacctggatgccaccggcggcaccctgcacccctaccagatggagggcctgaactggctgcgcttctcctgggcccagggcacagacaccatcctggctgatgagatgggcctgggcaagacagtgcagacagctgtgttcctgtacagcctgtacaaggagggccacagcaagggccccttcctggtgtctgcccccctgagcaccatcatcaactgggagcgggagtttgagatgtgggccccagacatgtatgtggtgacctacgtgggggacaaggacagccgggccatcatccgggagaatgagttctcctttgaggacaatgccatccggggcggcaagaaggccagcaggatgaagaaggaggcctctgtgaagttccacgtgctgctgaccagctatgagctgatcaccatcgacatggccatcctgggcagcattgactgggcctgcctgattgtggatgaggcccaccggctgaagaacaaccagagcaagttcttccgggtgctgaatggctacagcctgcagcacaagctgctgctgaccggcacccccctgcagaacaacctggaggagctgttccacctgctgaacttcctgaccccagagcgcttccacaacctggagggcttcctggaggagtttgctgacatcgccaaggaggaccagatcaagaagctgcatgacatgctgggcccccacatgctgcggcggctgaaggcagatgtgttcaagaacatgcccagcaagacagagctgattgtgcgggtggagctgagccccatgcagaagaagtactacaagtacatcctgaccaggaactttgaggccctgaatgcccggggcggcggcaaccaggtgtccctgctgaatgtggtgatggacctgaagaagtgctgcaaccacccctacctgtttcctgtggccgccatggaggcccccaagatgcccaacggcatgtatgatggcagcgccctgatccgggccagcggcaagctgctgctgctgcagaagatgctgaagaacctgaaggagggcggccaccgggtgctgatcttcagccagatgaccaagatgctggacctgctggaggacttcctggagcacgagggctacaagtatgaaagaattgatggcggcatcactggaaacatgaggcaggaggccatcgaccgcttcaatgcccctggggcccagcagttctgcttcctgctgagcacccgggccggcggcctgggcatcaacctggccacagctgacaccgtcatcatctatgacagcgactggaacccccacaatgacatccaggccttcagccgggcccacagaattggccagaacaagaaggtgatgatctacagatttgtgacccgggcctctgtggaggagcgcatcacccaggtggccaagaagaagatgatgctgacccacctggtggtgcggcccggcctgggcagcaagacaggctccatgagcaagcaggagctggatgacatcctgaagtttggaacagaggagctgttcaaggatgaggccacagatggcggcggggacaacaaggagggggaggacagcagcgtcatccactatgatgacaaggccatcgagcggctgctggacaggaaccaggatgaaacagaggacacagagctgcagggcatgaatgagtacctgagcagcttcaaggtggcccagtatgtggtgcgggaggaggagatgggagaggaggaggaggtggagcgggagatcatcaagcaggaggagagcgtggaccctgactactgggagaagctgctgcggcaccactatgagcagcagcaggaggacctggccaggaacctgggcaagggcaagaggatcaggaagcaggtgaactacaatgatggcagccaggaggaccgggactggcaggatgaccagagcgacaaccagagcgactacagcgtggccagcgaggagggagatgaagattttgatgagaggtctgaggccccccggcggcccagcaggaagggcctgagaaatgacaaggacaagcccctgccccccctgctggcccgggtgggcggcaacatcgaggtgctgggcttcaatgcccggcagaggaaggccttcctgaatgccatcatgagatatggcatgccaccccaggatgccttcaccacccagtggctggtgcgggacctgcggggcaagtctgagaaggagttcaaggcctacgtgtccctcttcatgaggcacctgtgtgagcccggggctgatggagctgagacctttgctgatggagtgccccgggagggcctgagccggcagcacgtgctgacccgcatcggcgtgatgagcctcatcaggaagaaggtgcaggagtttgaacatgtgaatggccgctggagcatgcctgagctggccgaggtggaggagaacaagaagatgagccagcccggcagccccagccccaagacccccacccccagcacccctggggacacccagcccaacaccccagcccctgtgcccccagcagaagatggcatcaagattgaggagaacagcctgaaggaggaggagagcattgaaggagagaaggaggtgaagagcacagcccctgagacagccattgaatgtacccaggccccagccccagcctctgaagatgagaaggtggtggtggagcccccagagggggaggagaaggtggagaaggccgaggtgaaggagaggacagaggagcccatggagacagagcccaagggagctgctgatgtggagaaggtggaggagaagagcgccatcgacctgacccccatcgtggtggaggacaaggaggagaagaaggaggaggaggagaagaaggaggtgatgctgcagaatggagagacccccaaggacctgaatgatgagaagcagaagaagaacatcaagcagcgcttcatgttcaacattgctgatggcggcttcacagagctgcacagcctgtggcagaatgaggagcgggccgccaccgtgaccaagaagacctatgagatctggcacagaagacatgactactggctgctggccggcatcatcaaccacggctacgcccgctggcaggacatccagaatgaccccaggtatgccatcctgaatgagcccttcaagggggagatgaacagaggcaacttcctggagatcaagaacaagttcctggcccggcgcttcaagctgctggagcaggccctggtgattgaggagcagctgcggcgggccgcctacctgaacatgtctgaggaccccagccaccccagcatggccctgaacaccaggtttgctgaggtggagtgcctggccgagagccaccagcacctgagcaaggagagcatggccggcaacaagccagccaatgctgtgctgcacaaggtgctgaagcagctggaggagctgctgagtgacatgaaggcagatgtgacccggctgcctgccaccatcgcccgcatcccccctgtggccgtgcggctgcagatgtctgagaggaacatcctgagccggctggccaacagagcccctgagcccaccccccagcaggtggcccagcagcagtag

SEQ ID NO: 19081 - DNA, 5718 bp, Artificial Sequence
  Description of Artificial Sequence: Synthetic coding sequence
atggccagcggcctgggcagccccagcccctgcagcgctggcagcgaggaggaggacatggatgccctgctgaacaacagcctgcccccaccccacccagaaaatgaagaagatcctgaggaggacctgtctgaaacagagacccccaagctgaagaagaagaagaagcccaagaagccccgggaccccaagatccccaagagcaagaggcagaagaaggagctgggggacagcagtggagagggccctgagtttgtggaggaggaggaggaggtggccctgcggagtgacagcgagggcagtgactacaccccaggcaagaagaagaagaagaagctgggccccaagaaggagaagaagagcaagagcaagaggaaggaggaggaggaggaggaggatgatgatgatgacagcaaggagcccaagagcagcgcccagctgctggaggactggggcatggaggacatcgaccacgtgttttctgaggaggactaccgcaccctgaccaactacaaggccttcagccagtttgtgcggcccctgattgctgccaagaaccccaagattgctgtgtccaagatgatgatggtgctgggcgccaagtggagggagttcagcaccaacaaccccttcaagggcagcagcggggcctctgtggccgctgctgctgctgctgctgtggccgtggtggagagcatggtgacagccacagaggtggcccctcctcctcctcctgtggaggtgcccatcaggaaggccaagaccaaggagggcaagggccccaatgcccggaggaagcccaagggcagcccccgggtgcctgatgccaagaagcccaagcccaagaaggtggcccccctgaagatcaagctgggcggcttcggcagcaagaggaagaggagcagcagtgaagatgatgacctggatgtggagagtgactttgatgatgccagcatcaacagctacagcgtgtctgatggcagcaccagccgcagcagccgcagcaggaagaagctgcggaccaccaagaagaagaagaagggggaggaggaggtgacagctgtggatggctatgaaacagaccaccaggactactgtgaggtgtgccagcagggcggggagatcatcctgtgtgacacctgcccccgggcctaccacatggtgtgcctggaccctgacatggagaaggcccctgagggcaagtggagctgcccccactgtgagaaggagggcatccagtgggaggccaaggaggacaacagcgagggggaggagatcctggaggaggtgggcggggacctggaggaggaggatgaccaccacatggagttctgccgggtgtgcaaggatggaggagagctgctgtgctgtgacacctgccccagcagctaccacatccactgcctgaacccccccctgcctgagatccccaacggggagtggctgtgcccccgctgcacctgcccagccctgaagggcaaggtgcagaagatcctgatctggaagtggggccagccccccagccccacccctgtgccccggcccccagatgctgaccccaacacccccagccccaagcccctggagggccggcctgagcggcagttctttgtgaagtggcagggcatgagctactggcactgctcctgggtgtctgagctgcagctggagctgcactgccaggtgatgttcaggaactaccagaggaagaatgacatggatgagccccccagcggggactttggaggagatgaggagaagagcaggaagaggaagaacaaggaccccaagtttgctgagatggaggagcgcttctaccgctatggcatcaagccagagtggatgatgatccaccgcatcctgaaccacagcgtggacaagaagggccacgtgcactacctgatcaagtggagggacctgccctatgaccaggcctcctgggagagtgaagatgtggagatccaggactatgacctcttcaagcagagctactggaaccaccgggagctgatgagaggagaggagggccggcctgggaagaagctgaagaaggtgaagctgaggaagctggagaggcctcctgagacccccaccgtggaccccaccgtgaagtatgagcggcagcctgagtacctggatgccactggaggcaccctgcacccctaccagatggagggcctgaactggctgcgcttctcctgggcccagggcacagacaccatcctggctgatgagatgggcctgggcaagacagtgcagacagctgtgttcctgtacagcctgtacaaggagggccacagcaagggccccttcctggtgtctgcccccctgagcaccatcatcaactgggagcgggagtttgagatgtgggccccagacatgtatgtggtgacctacgtgggggacaaggacagccgggccatcatcagagaaaatgagttctcctttgaagataatgccatccggggcggcaagaaggccagcaggatgaagaaggaggcctctgtgaagttccacgtgctgctgaccagctatgagctgatcaccatcgacatggccatcctgggcagcattgactgggcctgcctgattgtggatgaggcccaccggctgaagaacaaccagagcaagttcttccgggtgctgaatggctacagcctgcagcacaagctgctgctgaccggcacccccctgcagaacaacctggaggagctgttccacctgctgaacttcctgaccccagagcgcttccacaacctggagggcttcctggaggagtttgctgacatcgccaaggaggaccagatcaagaagctgcatgacatgctgggcccccacatgctgcggcggctgaaggcagatgtgttcaagaacatgcccagcaagacagagctgattgtgcgggtggagctgagccccatgcagaagaagtactacaagtacatcctgaccaggaactttgaggccctgaatgcccggggcggcggcaaccaggtgtccctgctgaatgtggtgatggacctgaagaagtgctgcaaccacccctacctgtttcctgtggccgccatggaggcccccaagatgcccaacggcatgtatgatggcagcgccctgatccgggccagcggcaagctgctgctgctgcagaagatgctgaagaacctgaaggagggcggccaccgggtgctgatcttcagccagatgaccaagatgctggacctgctggaggacttcctggagcacgagggctacaagtatgaaagaattgatggcggcatcaccggcaacatgaggcaggaggccatcgaccgcttcaatgcccctggggcccagcagttctgcttcctgctgagcaccagggctgggggcctgggcatcaacctggccacagctgacaccgtcatcatctatgacagcgactggaacccccacaatgacatccaggccttcagccgggcccaccgcatcggccagaacaagaaggtgatgatctacagatttgtgacccgggcctctgtggaggagcgcatcacccaggtggccaagaagaagatgatgctgacccacctggtggtgcggcccggcctgggcagcaagacaggctccatgagcaagcaggagctggatgacatcctgaagtttggaacagaggagctgttcaaggatgaggccacagatggcggcggggacaacaaggagggggaggacagcagcgtcatccactatgatgacaaggccatcgagcggctgctggacaggaaccaggatgaaacagaggacacagagctgcagggcatgaatgagtacctgagcagcttcaaggtggcccagtatgtggtgcgggaggaggagatgggagaggaggaggaggtggagcgggagatcatcaagcaggaggagagcgtggaccctgactactgggagaagctgctgcggcaccactatgagcagcagcaggaggacctggccaggaacctgggcaagggcaagaggatcaggaagcaggtgaactacaatgatggcagccaggaggaccgggactggcaggatgaccagagcgacaaccagagcgactacagcgtggccagcgaggagggagatgaggactttgatgagaggtctgaggccccccggcggcccagcaggaagggcctgagaaatgacaaggacaagcccctgccccccctgctggcccgggtgggcggcaacatcgaggtgctgggcttcaatgcccggcagaggaaggccttcctgaatgccatcatgagatatggcatgccaccccaggatgccttcaccacccagtggctggtgcgggacctgcggggcaagtctgagaaggagttcaaggcctacgtgtccctcttcatgaggcacctgtgtgagcctggagcagatggagctgagacctttgctgatggagtgccccgggagggcctgagccggcagcacgtgctgaccagaattggagtgatgagcctcatcaggaagaaggtgcaggagtttgagcacgtgaatggccgctggagcatgcctgagctggccgaggtggaggagaacaagaagatgagccagcccggcagccccagccccaagacccccacccccagcacccctggggacacccagcccaacaccccagcccctgtgcccccagcagaagatggcatcaagattgaggagaacagcctgaaggaggaggagagcattgaaggagagaaggaggtgaagagcacagcccctgagacagccatcgagtgcacccaggccccagccccagcctctgaagatgagaaggtggtggtggagcccccagagggggaggagaaggtggagaaggccgaggtgaaggagaggacagaggagcccatggagacagagcccaagggagctgctgatgtggagaaggtggaggagaagagcgccatcgacctgacccccatcgtggtggaggacaaggaggagaagaaggaggaggaggagaagaaggaggtgatgctgcagaatggagagacccccaaggacctgaatgatgagaagcagaagaagaacatcaagcagcgcttcatgttcaacattgctgatggcggcttcacagagctgcacagcctgtggcagaatgaggagagagctgccaccgtgaccaagaagacctatgagatctggcacagaagacatgactactggctgctggccggcatcatcaaccacggctacgcccgctggcaggacatccagaatgaccccaggtatgccatcctgaatgagcccttcaagggggagatgaacagaggcaacttcctggagatcaagaacaagttcctggcccggcgcttcaagctgctggagcaggccctggtgattgaggagcagctgcggcgggccgcctacctgaacatgtctgaggaccccagccaccccagcatggccctgaacaccaggtttgctgaggtggagtgcctggccgagagccaccagcacctgagcaaggagagcatggccggcaacaagccagccaatgctgtgctgcacaaggtgctgaagcagctggaggagctgctgagtgacatgaaggcagatgtgacccggctgcctgccaccatcgcccgcatcccccctgtggccgtgcggctgcagatgtctgaaagaaacatcctgagccggctggccaacagagcccctgagcccaccccccagcaggtggcccagcagcagtag

SEQ ID NO: 19082 - DNA, 5814 bp, Artificial Sequence
  Description of Artificial Sequence: Synthetic coding sequence
atggccagcggcctgggcagccccagcccctgcagcgctggcagcgaggaggaggacatggatgccctgctgaacaacagcctgcccccaccccaccctgaggaccctgaggaggacctgtctgaaacagagacccccaagctgaagaagaagaagaagcccaagaagccccgggaccccaagatccccaagagcaagaggcagaagaaggagaggatgctgctgtgccggcagctgggggacagcagtggagagggccctgagtttgtggaggaggaggaggaggtggccctgcggagtgacagcgagggcagtgactacaccccaggcaagaagaagaagaagaagctgggccccaagaaggagaagaagagcaagagcaagaggaaggaggaggaggaggaggaggatgatgatgatgacagcaaggagcccaagagcagcgcccagctgctggaggactggggcatggaggacatcgaccacgtgttttctgaggaggactaccgcaccctgaccaactacaaggccttcagccagtttgtgcggcccctgattgctgccaagaaccccaagattgctgtgtccaagatgatgatggtgctgggcgccaagtggagggagttcagcaccaacaaccccttcaagggcagcagcggggcctctgtggccgctgctgctgctgctgctgtggccgtggtggagagcatggtgacagccacagaggtggcccctcctcctcctcctgtggaggtgcccatcaggaaggccaagaccaaggagggcaagggccccaatgcccggaggaagcccaagggcagcccccgggtgcctgatgccaagaagcccaagcccaagaaggtggcccccctgaagatcaagctgggcggcttcggcagcaagaggaagaggagcagcagtgaagatgatgacctggatgtggagagtgactttgatgatgccagcatcaacagctacagcgtgtctgatggcagcaccagccgcagcagccgcagcaggaagaagctgcggaccaccaagaagaagaagaagggggaggaggaggtgacagctgtggatggctatgaaacagaccaccaggactactgtgaggtgtgccagcagggcggggagatcatcctgtgtgacacctgcccccgggcctaccacatggtgtgcctggaccctgacatggagaaggcccctgagggcaagtggagctgcccccactgtgagaaggagggcatccagtgggaggccaaggaggacaacagcgagggggaggagatcctggaggaggtgggcggggacctggaggaggaggatgaccaccacatggagttctgccgggtgtgcaaggatggaggagagctgctgtgctgtgacacctgccccagcagctaccacatccactgcctgaacccccccctgcctgagatccccaacggggagtggctgtgcccccgctgcacctgcccagccctgaagggcaaggtgcagaagatcctgatctggaagtggggccagccccccagccccacccctgtgccccggcccccagatgctgaccccaacacccccagccccaagcccctggagggccggcctgagcggcagttctttgtgaagtggcagggcatgagctactggcactgctcctgggtgtctgagctgcagctggagctgcactgccaggtgatgttcaggaactaccagaggaagaatgacatggatgagccccccagcggggactttggaggagatgaggagaagagcaggaagaggaagaacaaggaccccaagtttgctgagatggaggagcgcttctaccgctatggcatcaagccagagtggatgatgatccaccgcatcctgaaccacagcgtggacaagaagggccacgtgcactacctgatcaagtggagggacctgccctatgaccaggcctcctgggagagtgaagatgtggagatccaggactatgacctcttcaagcagagctactggaaccaccgggagctgatgagaggagaggagggccggcctgggaagaagctgaagaaggtgaagctgaggaagctggagaggcctcctgagacccccaccgtggaccccaccgtgaagtatgagcggcagcctgagtacctggatgccactggaggcaccctgcacccctaccagatggagggcctgaactggctgcgcttctcctgggcccagggcacagacaccatcctggctgatgagatgggcctgggcaagacagtgcagacagctgtgttcctgtacagcctgtacaaggagggccacagcaagggccccttcctggtgtctgcccccctgagcaccatcatcaactgggagcgggagtttgagatgtgggccccagacatgtatgtggtgacctacgtgggggacaaggacagccgggccatcatcagagaaaatgagttctcctttgaagataatgccatccggggcggcaagaaggccagcaggatgaagaaggaggcctctgtgaagttccacgtgctgctgaccagctatgagctgatcaccatcgacatggccatcctgggcagcattgactgggcctgcctgattgtggatgaggcccaccggctgaagaacaaccagagcaagttcttccgggtgctgaatggctacagcctgcagcacaagctgctgctgaccggcacccccctgcagaacaacctggaggagctgttccacctgctgaacttcctgaccccagagcgcttccacaacctggagggcttcctggaggagtttgctgacatcgccaaggaggaccagatcaagaagctgcatgacatgctgggcccccacatgctgcggcggctgaaggcagatgtgttcaagaacatgcccagcaagacagagctgattgtgcgggtggagctgagccccatgcagaagaagtactacaagtacatcctgaccaggaactttgaggccctgaatgcccggggcggcggcaaccaggtgtccctgctgaatgtggtgatggacctgaagaagtgctgcaaccacccctacctgtttcctgtggccgccatggaggcccccaagatgcccaacggcatgtatgatggcagcgccctgatccgggccagcggcaagctgctgctgctgcagaagatgctgaagaacctgaaggagggcggccaccgggtgctgatcttcagccagatgaccaagatgctggacctgctggaggacttcctggagcacgagggctacaagtatgaaagaattgatggcggcatcaccggcaacatgaggcaggaggccatcgaccgcttcaatgcccctggggcccagcagttctgcttcctgctgagcaccagggctgggggcctgggcatcaacctggccacagctgacaccgtcatcatctatgacagcgactggaacccccacaatgacatccaggccttcagccgggcccaccgcatcggccagaacaagaaggtgatgatctacagatttgtgacccgggcctctgtggaggagcgcatcacccaggtggccaagaagaagatgatgctgacccacctggtggtgcggcccggcctgggcagcaagacaggctccatgagcaagcaggagctggatgacatcctgaagtttggaacagaggagctgttcaaggatgaggccacagatggcggcggggacaacaaggagggggaggacagcagcgtcatccactatgatgacaaggccatcgagcggctgctggacaggaaccaggatgaaacagaggacacagagctgcagggcatgaatgagtacctgagcagcttcaaggtggcccagtatgtggtgcgggaggaggagatgggagaggaggaggaggtggagcgggagatcatcaagcaggaggagagcgtggaccctgactactgggagaagctgctgcggcaccactatgagcagcagcaggaggacctggccaggaacctgggcaagggcaagaggatcaggaagcaggtgaactacaatgatggcagccaggaggacagaggagtgtgtggccggccccggcccccacccatgggccgcagcaccagggctgtgggccctgcccacctgcccagcctgcccccagactggcaggatgaccagagcgacaaccagagcgactacagcgtggccagcgaggagggagatgaggactttgatgagaggtctgaggccccccggcggcccagcaggaagggcctgagaaatgacaaggacaagcccctgccccccctgctggcccgggtgggcggcaacatcgaggtgctgggcttcaatgcccggcagaggaaggccttcctgaatgccatcatgagatatggcatgccaccccaggatgccttcaccacccagtggctggtgcgggacctgcggggcaagtctgagaaggagttcaaggcctacgtgtccctcttcatgaggcacctgtgtgagcctggagcagatggagctgagacctttgctgatggagtgccccgggagggcctgagccggcagcacgtgctgaccagaattggagtgatgagcctcatcaggaagaaggtgcaggagtttgagcacgtgaatggccgctggagcatgcctgagctggccgaggtggaggagaacaagaagatgagccagcccggcagccccagccccaagacccccacccccagcacccctggggacacccagcccaacaccccagcccctgtgcccccagcagaagatggcatcaagattgaggagaacagcctgaaggaggaggagagcattgaaggagagaaggaggtgaagagcacagcccctgagacagccatcgagtgcacccaggccccagccccagcctctgaagatgagaaggtggtggtggagcccccagagggggaggagaaggtggagaaggccgaggtgaaggagaggacagaggagcccatggagacagagcccaagggagctgctgatgtggagaaggtggaggagaagagcgccatcgacctgacccccatcgtggtggaggacaaggaggagaagaaggaggaggaggagaagaaggaggtgatgctgcagaatggagagacccccaaggacctgaatgatgagaagcagaagaagaacatcaagcagcgcttcatgttcaacattgctgatggcggcttcacagagctgcacagcctgtggcagaatgaggagagagctgccaccgtgaccaagaagacctatgagatctggcacagaagacatgactactggctgctggccggcatcatcaaccacggctacgcccgctggcaggacatccagaatgaccccaggtatgccatcctgaatgagcccttcaagggggagatgaacagaggcaacttcctggagatcaagaacaagttcctggcccggcgcttcaagctgctggagcaggccctggtgattgaggagcagctgcggcgggccgcctacctgaacatgtctgaggaccccagccaccccagcatggccctgaacaccaggtttgctgaggtggagtgcctggccgagagccaccagcacctgagcaaggagagcatggccggcaacaagccagccaatgctgtgctgcacaaggtgctgaagcagctggaggagctgctgagtgacatgaaggcagatgtgacccggctgcctgccaccatcgcccgcatcccccctgtggccgtgcggctgcagatgtctgaaagaaacatcctgagccggctggccaacagagcccctgagcccaccccccagcaggtggcccagcagcagtag

SEQ ID NO: 19083 - DNA, 1065 bp, Artificial Sequence
  Description of Artificial Sequence: Synthetic coding sequence
atggccagcggcctgggcagccccagcccctgcagcgctggcagcgaggaggaggacatggatgccctgctgaacaacagcctgcccccaccccacccagaaaatgaagaagatcctgaggaggacctgtctgaaacagagacccccaagctgaagaagaagaagaagcccaagaagccccgggaccccaagatccccaagagcaagaggcagaagaaggagaggatgctgctgtgccggcagctgggggacagcagcggggagggccctgagtttgtggaggaggaggaggaggtggccctgcggagtgacagcgagggcagtgactacacccctgggaagaagaagaagaagaagctgggccccaagaaggagaagaagagcaagagcaagaggaaggaggaggaggaggaggaggatgatgatgatgacagcaaggagcccaagagcagcgcccagctgctggaggactggggcatggaggacatcgaccacgtgttcagcgaggaggactaccgcaccctgaccaactacaaggccttcagccagtttgtgcggcccctgattgctgccaagaaccccaagattgctgtgtccaagatgatgatggtgctgggcgccaagtggagggagttcagcaccaacaaccccttcaagggcagcagcggggcctctgtggccgctgctgctgctgctgctgtggccgtggtggagagcatggtgacagccacagaggtggcccctcctcctcctcctgtggaggtgcccatcaggaaggccaagaccaaggagggcaagggccccaatgcccggaggaagcccaagggcagcccccgggtgcctgatgccaagaagcccaagcccaagaaggtggcccccctgaagatcaagctgggcggcttcggcagcaagaggaagaggagcagcagtgaagatgatgacctggatgtggagagtgactttgatgatgccagcatcaacagctacagcgtgtctgatggcagcaccagccgcagcagccgcagcaggaagaagctgcggaccaccaagaagaagaagaagtag

SEQ ID NO: 19084 - DNA, 1065 bp, Artificial Sequence; identical to SEQ ID NO: 19083
  Description of Artificial Sequence: Synthetic coding sequence

SEQ ID NO: 19085 - DNA, 2562 bp, Artificial Sequence
  Description of Artificial Sequence: Synthetic coding sequence
atgttcctgccccacatgaaccacctgaccctggagcagaccttcttcagccaggtgctgcccaagacagtgaagctgtttgatgacatgatgtatgagctgaccagccaggcccggggcctgagcagccagaacctggagatccagaccaccctgaggaacatcctgcagaccatggtgcagctgctgggcgccctgaccggctgtgtgcagcacatctgtgccacccaggagagcatcatcctggagaacatccagagcctgcccagctctgtgctgcacatcatcaagagcacctttgtgcactgcaagaacagcgagagcgtgtacagcggctgcctgcacctggtgtctgacctgctgcaggccctcttcaaggaggcctacagcctgcagaagcagctgatggagctgctggacatggtgtgcatggaccccctggtggatgacaatgatgacatcctgaacatggtgattgtcatccacagcctgctggacatctgcagcgtcatcagctccatggaccacgccttccacgccaacacctggaagttcatcatcaagcagagcctgaagcaccagagcatcatcaagagccagctgaagcacaaggacatcatcaccagcctgtgtgaggacatcctcttctccttccacagctgcctgcagctggccgagcagatgacccagagtgatgcccaggacaatgctgactaccgcctcttccagaagaccctgaagctgtgccgcttctttgccaacagcctgctgcactacgccaaggagttcctgcccttcctgagtgacagctgctgcaccctgcaccagctgtacctgcagatccacagcaagttcccccccagcctgtatgccacccgcatcagcaaggcccaccaggaggagattgctggggccttcctggtgaccctggaccccctcatcagccagctgctgaccttccagcccttcatgcaggtggtgctggacagcaagctggacctgccctgtgagctgcagttcccccagtgcctgctgctggtggtggtgatggacaagctgcccagccagcccaaggaggtgcagaccctgtggtgcacagacagccaggtgtctgagaccaccacccgcatcagcctgctgaaggctgtgttctacagctttgagcagtgcagcggggagctgagcctgcctgtgcacctgcagggcctgaagagcaagggcaaggccgaggtggccgtgaccctgtaccagcacgtgtgtgtgcacctgtgcaccttcatcaccagcttccaccccagcctgtttgctgagctggatgctgccctgctgaatgctgtgctgagcgccaacatgatcaccagcctgctggccatggatgcctggtgcttcctggcccgctatggaacagctgagctgtgtgcccaccacgtgaccatcgtggcccacctgatcaagagctgccctggagagtgctaccagctgatcaacctgagcatcctgctgaagaggctcttcttcttcatggccccaccccaccagctggagttcatccagaagttcagccccaaggaggccgagaacctgcccctgtggcagcacatctccttccaggccctgcccccagagctgcgggagcagacagtgcatgaggtgaccaccgtgggcacagctgagtgcaggaagtggctgagccgcagcaggaccctgggggagctggagagcctgaacacagtgctgagcgccctgctggccgtgtgcaacagcgctggggaggccctggacaccgggaagcagacagccatcatcgaggtggtgtcccagctgtgggccttcctgaacatcaagcaggtggccgaccagccctacgtgcagcagaccttcagcctgctgctgcccctgctgggcttcttcatccagaccctggaccccaagctgatcctgcaggccgtgaccctgcagaccagcctgctgaagctggagctgcctgactatgtgcggctggccatgctggactttgtgagcagcctgggcaagctgttcatccctgaggccatccaggaccgcatcctgcccaacctgagctgcatgtttgccctgctgctggccgaccgctcctggctgctggagcagcacaccctggaggccttcacccagtttgctgagggcaccaaccacgaggagatcgtgccccagtgcctgagcagcgaggagaccaagaacaaggtggtgtccttcctggagaagacaggctttgtggatgaaacagaagctgccaaggtggagcgggtgaagcaggagaagggcatcttctgggagccctttgccaacgtgacagtggaggaggccaagaggagcagcctgcagccctatgccaagagggcccggcaggagttcccctgggaggaggagtaccgcagcgccctgcacaccatcgccggggccctggaggccacagagagcctgctgcagaagggccctgccccagcctggctgtccatggagatggaggccctgcaggagaggatggacaagctgaagcgctacatccacaccctgggctag

SEQ ID NO: 19086 - DNA, 2562 bp, Artificial Sequence; identical to SEQ ID NO: 19085
  Description of Artificial Sequence: Synthetic coding sequence

SEQ ID NO: 19087 - DNA, 993 bp, Artificial Sequence
  Description of Artificial Sequence: Synthetic coding sequence
atgatgtatgagctgaccagccaggcccggggcctgagcagccagaacctggagatccagaccaccctgaggaacatcctgcagaccatggtgcagctgctgggcgccctgaccggctgtgtgcagcacatctgtgccacccaggagagcatcatcctggagaacatccagagcctgcccagctctgtgctgcacatcatcaagagcacctttgtgcactgcaagaacagcgagagcgtgtacagcggctgcctgcacctggtgtctgacctgctgcaggccctcttcaaggaggcctacagcctgcagaagcagctgatggagctgctggacatggtgtgcatggaccccctggtggatgacaatgatgacatcctgaacatggtgattgtcatccacagcctgctggacatctgcagcgtcatcagctccatggaccacgccttccacgccaacacctggaagttcatcatcaagcagagcctgaagcaccagagcatcatcaagagccagctgaagcacaaggacatcatcaccagcctgtgtgaggacatcctcttctccttccacagctgcctgcagctggccgagcagatgacccagagtgatgcccaggacaatgctgactaccgcctcttccagaagaccctgaagctgtgccgcttctttgccaacagcctgctgcactacgccaaggagttcctgcccttcctgagtgacagctgctgcaccctgcaccagctgtacctgcagatccacagcaagtttcctcccagcctgtatgccacccgcatcagcaaggcccaccaggaggagattgctggggccttcctggtgaccctggaccccctcatcagccagctgctgaccttccagcccttcatgcaggtggtgctggacagcaagctgggctacctgtacagcaagcccttcagcacagtgctgagctctgtgctggtgaacagcctgtacctgttcatctacagagactag

SEQ ID NO: 19088 - DNA, 1047 bp, Artificial Sequence
  Description of Artificial Sequence: Synthetic coding sequence
atgagccaggagggcgctgtgcctgccagcgctgtgcccctggaggagctgagctcctggccagaggagctgtgccggcgggagctgcccagcgtgctgccccggctgctgagcctgagccagcacagcgacagctggattgagcacatccagatcctgaagatcatcgtggagatgttcctgccccacatgaaccacctgaccctggagcagaccttcttcagccaggtgctgcccaagacagtgaagctgtttgatgacatgatgtatgagctgaccagccaggcccggggcctgagcagccagaacctggagatccagaccaccctgaggaacatcctgcagaccatggtgcagctgctgggcgccctgaccggctgtgtgcagcacatctgtgccacccaggagagcatcatcctggagaacatccagagcctgcccagctctgtgctgcacatcatcaagagcacctttgtgcactgcaagaacagcgagagcgtgtacagcggctgcctgcacctggtgtctgacctgctgcaggccctcttcaaggaggcctacagcctgcagaagcagctgatggagctgctggacatggtgtgcatggaccccctggtggatgacaatgatgacatcctgaacatggtgattgtcatccacagcctgctggacatctgcagcgtcatcagctccatggaccacgccttccacgccaacacctggaagttcatcatcaagcagagcctgaagcaccagagcatcatcaagagccagctgaagcacaaggacatcatcaccagcctgtgtgaggacatcctcttctccttccacagctgcctgcagctggccgagcagatgacccagagtgatgcccaggacaatgctgactaccgcctcttccagaagaccctgaagctgtgccgcttctttgccaacagcctgctgcactacgccaaggagttcctgcccttcctgagtgacagctgctgcaccctgcaccagctgtacctgcagatccaccgctggagctttgccctggccgtgtag

SEQ ID NO: 19089 - DNA, 2100 bp, Artificial Sequence
  Description of Artificial Sequence: Synthetic coding sequence
atgctgaagctgtctggagagggcctgcgggacagctaccacagccggcgggaccagatcgccctgaagaacctgcagagtgatgtgacagaggccaagagtgacttcaccaaggagaccctggccagccagaacaccaagatgatcagcagcatcgtcatcagccagatgattgatgagaacaagagcagagaaaatagagccagcctgcccctgccctgtgccatcgcccagagccgggcccaccacgccaagcagagcctggccaacagaagtggagtgaacatccaccgggcctttgccctgctgcccggccgcctgggcatcccagcccccagtgatgagcggggccctgaggccgagctgccccccaaggaggagcggccctgtggcggcccccggcggggctttgccagcatcaccatcacagccaggagagtgggccccccagcccgggccctggtgtggggcacagctggggacagcctgtgccccaagtgcagagctgaggacaccctcttccaggcccccccagccctggccaacggggcccaccctggccgccaccagaggagctttgcctgcacagagttcagcaggaacagctctgtggtgcggctgaaggtgcctgaggcccacacaggcctgtgtgaaagaaggaagtactgggtgacccatgctgatgacaaggagaccagcttctccccagacacccccctgagcggcaagagccccctggtgttcagcagctgtgtgcacctgcgggtgtcccagcagtgcccagacagcatctactacgtggacaagagcctgtctgtgcccatcgagcccccccagatcgccagccccaagatgcacaggtctgtgctgagcctgaacctgaactgcagcagccaccggctgacagcagatggagtggatggcctggtgaaccgggagcccatcagcgaggccctgaagcaggagctgctggagggggaccaggacctggtgggccagcgctggaaccctggcctgcaggagagccacctgaaggagacccccagcctgcggcgggtgcacctgggcactggagcctgcccctggagcggcagcttccccctggagaacacagagctggccaacgtgggcgccaaccaggtgacagtgaggaaaggagagaaggaccacaccacccactgccacgccagtgaccacgccaaccagctgagcatccacatccctggctggagctacagagctgtgcacaccaaggtgttttctggcagcagcaagaggcagcagggcgaggtgtgcatgacagtgtctgcccctcctgtggagcagaagcccaccaggcacttcctgcccatcggggacagcagccccagtgatgactgcctgagccgggacctgtctgagcccacagaaagaagacaccagagcttcctgaagccccgcatcctcttccctggcttcctgtgccccctgcaggatgtgtgtgccagcctgcaggaggacaatggagtgcagatcgagagcaagttccccaagggggactacacctgctgtgacctggtggtgaagatcaaggagtgcaagaagtctgaggaccccaccaccccagagcccagccctgctgcccccagccctgcccccagagatggagctggcagccctggcctgtctgaggactgcagcgagagccagcagaccccagcccggagcctgaccctgcaggaggccctggaggtgaggaagccccagttcatcagccgcagccaggagcggctgaagaagctggagcacatggtgcagcagaggaaggcccagaggaaagaagacctgcggcagaagcagagcctgctgcccatccgcaccagcaagaagcagttcaccatcccccaccccctgagtgacaacctcttcaagcccaaggagcgctgcatcagcgagaaggagatgcacatgaggagcaagaggatctatgacaacctgcctgaggtgaagaagaagaaggaggagcagaggaagagggtcatcctgcagagcaaccggctgcgggcagaggtgttcaagaagcagctgctggaccagctgctgcagagaaatgctgtgtag

SEQ ID NO: 19090 - DNA, 1959 bp, Artificial Sequence
  Description of Artificial Sequence: Synthetic coding sequence
atgatcagcagcatcgtcatcagccagatgattgatgagaacaagagccgggagaacagagccagcctgcccctgccctgtgccatcgcccagagccgggcccaccacgccaagcagagcctggccaacagaagtggagtgaacatccaccgggcctttgccctgctgcccggccgcctgggcatcccagcccccagtgatgagcggggccctgaggccgagctgccccccaaggaggagcggccctgtggcggcccccggcggggctttgccagcatcaccatcacagcccggcgggtgggccccccagcccgggccctggtgtggggcacagctggggacagcctgtgccccaagtgcagagctgaggacaccctcttccaggcccccccagccctggccaatggagcccaccctggccgccaccagaggagctttgcctgcacagagttcagcaggaacagctctgtggtgcggctgaaggtgcctgaggcccacacaggcctgtgtgagaggaggaagtactgggtgacccatgctgatgacaaggagaccagcttctccccagacacccccctgagcggcaagagccccctggtgttcagcagctgtgtgcacctgcgggtgtcccagcagtgcccagacagcatctactacgtggacaagagcctgtctgtgcccatcgagcccccccagatcgccagccccaagatgcacaggtctgtgctgagcctgaacctgaactgcagcagccaccggctgacagcagatggagtggatggcctggtgaaccgggagcccatcagcgaggccctgaagcaggagctgctggagggggaccaggacctggtgggccagcgctggaaccctggcctgcaggagagccacctgaaggagacccccagcctgcggcgggtgcacctgggcaccggggcctgcccctggagcggcagcttccccctggagaacacagagctggccaacgtgggcgccaaccaggtgacagtgaggaagggggagaaggaccacaccacccactgccacgccagtgaccacgccaaccagctgagcatccacatccctggctggagctacagagctgtgcacaccaaggtgttcagcggcagcagcaagaggcagcagggcgaggtgtgcatgacagtgtctgcccctcctgtggagcagaagcccaccaggcacttcctgcccatcggggacagcagccccagtgatgactgcctgagccgggacctgtctgagcccacagagcggcggcaccagagcttcctgaagccccgcatcctcttccctggcttcctgtgccccctgcaggatgtgtgtgccagcctgcaggaggacaacggggtgcagatcgagagcaagttccccaagggggactacacctgctgtgacctggtggtgaagatcaaggagtgcaagaagtctgaggaccccaccaccccagagcccagccctgctgcccccagccctgcccccagagatggagctggcagccctggcctgtctgaggactgcagcgagagccagcagaccccagcccggagcctgaccctgcaggaggccctggaggtgaggaagccccagttcatcagccgcagccaggagcggctgaagaagctggagcacatggtgcagcagaggaaggcccagaggaaggaggacctgcggcagaagcagagcctgctgcccatccgcaccagcaagaagcagttcaccatcccccaccccctgagtgacaacctcttcaagcccaaggagcgctgcatcagcgagaaggagatgcacatgaggagcaagaggatctatgacaacctgcctgaggtgaagaagaagaaggaggagcagaggaagagggtcatcctgcagagcaaccggctgcgggcagaggtgttcaagaagcagctgctggaccagctgctgcagagaaatgctgtgtag

SEQ ID NO: 19091 - DNA, 1152 bp, Artificial Sequence
  Description of Artificial Sequence: Synthetic coding sequence
atgatcagcagcatcgtcatcagccagatgattgatgagaacaagagccgggagaacagagccagcctgcccctgccctgtgccatcgcccagagccgggcccaccacgccaagcagagcctggccaacagaagtggagtgaacatccaccgggcctttgccctgctgcccggccgcctgggcatcccagcccccagtgatgagcggggccctgaggccgagctgccccccaaggaggagcggccctgtggcggcccccggcggggctttgccagcatcaccatcacagcccggcgggtgggccccccagcccgggccctggtgtggggcacagctggggacagcctgtgccccaagtgcagagctgaggacaccctcttccaggcccccccagccctggccaatggagcccaccctggccgccaccagaggagctttgcctgcacagagttcagcaggaacagctctgtggtgcggctgaaggtgcctgaggcccacacaggcctgtgtgagaggaggaagtactgggtgacccatgctgatgacaaggagaccagcttctccccagacacccccctgagcggcaagagccccctggtgttcagcagctgtgtgcacctgcgggtgtcccagcagtgcccagacagcatctactacgtggacaagagcctgtctgtgcccatcgagcccccccagatcgccagccccaagatgcacaggtctgtgctgagcctgaacctgaactgcagcagccaccggctgacagcagatggagtggatggcctggtgaaccgggagcccatcagcgaggccctgaagcaggagctgctggagggggaccaggacctggtgggccagcgctggaaccctggcctgcaggagagccacctgaaggagacccccagcctgcggcgggtgcacctgggcaccggggcctgcccctggagcggcagcttccccctggagaacacagagctggccaacgtgggcgccaaccaggtgacagtgaggaagggggagaaggaccacaccacccactgccacgccagtgaccacgccaaccagctgagcatccacatccctggctggagctacagagctgacctgctgcaggagggccagcacaagcagctgtccatgttccagaggtag

SEQ ID NO: 19092 - DNA, 1152 bp, Artificial Sequence; identical to SEQ ID NO: 19091
  Description of Artificial Sequence: Synthetic coding sequence

SEQ ID NO: 19093 - DNA, 729 bp, Artificial Sequence
  Description of Artificial Sequence: Synthetic coding sequence
tgatggagcggcagcttccccctggagaacacagagctggccaacgtgggcgccaaccaggtgacagtgaggaaaggagagaaggaccacaccacccactgccacgccagtgaccacgccaaccagctgagcatccacatccctggctggagctaccgggccggggactacacctgctgtgacctggtggtgaagatcaaggagtgcaagaagtctgaggaccccaccaccccagagcccagccctgctgcccccagccctgcccccagagatggagctggcagccctggcctgtctgaggactgcagcgagagccagcagaccccagcccggagcctgaccctgcaggaggccctggaggtgaggaagccccagttcatcagccgcagccaggagcggctgaagaagctggagcacatggtgcagcagaggaaggcccagaggaaggaggacctgcggcagaagcagagcctgctgcccatccgcaccagcaagaagcagttcaccatcccccaccccctgagtgacaacctcttcaagcccaaggagcgctgcatcagcgagaaggagatgcacatgaggagcaagaggatctatgacaacctgcctgaggtgaagaagaagaaggaggagcagaggaagagggtcatcctgcagagcaaccggctgcgggcagaggtgttcaagaagcagctgctggaccagctgctgcagagaaatgctgtgtag

SEQ ID NO: 19094 - DNA, 1989 bp, Artificial Sequence
  Description of Artificial Sequence: Synthetic coding sequence
atgctgaagctgtctggagagggcctgcgggacagctaccacagccggcgggaccagatcgccctgaagaacctgcagagtgatgtgacagaggccaagagtgacttcaccaaggagaccctggccagccagaacaccaagatgatcagcagcatcgtcatcagccagatgattgatgagaacaagagcagagaaaatagagccagcctgcccctgccctgtgccatcgcccagagccgggcccaccacgccaagcagagcctggccaacagaagtggagtgaacatccaccgggcctttgccctgctgcccggccgcctgggcatcccagcccccagtgatgagcggggccctgaggccgagctgccccccaaggaggagcggccctgtggcggcccccggcggggctttgccagcatcaccatcacagccaggagagtgggccccccagcccgggccctggtgtggggcacagctggggacagcctgtgccccaagtgcagagctgaggacaccctcttccaggcccccccagccctggccaacggggcccaccctggccgccaccagaggagctttgcctgcacagagttcagcaggaacagctctgtggtgcggctgaaggtgcctgaggcccacacaggcctgtgtgaaagaaggaagtactgggtgacccatgctgatgacaaggagaccagcttctccccagacacccccctgagcggcaagagccccctggtgttcagcagctgtgtgcacctgcgggtgtcccagcagtgcccagacagcatctactacgtggacaagagcctgtctgtgcccatcgagcccccccagatcgccagccccaagatgcacaggtctgtgctgagcctgaacctgaactgcagcagccaccggctgacagcagatggagtggatggcctggtgaaccgggagcccatcagcgaggccctgaagcaggagctgctggagggggaccaggacctggtgggccagcgctggaaccctggcctgcaggagagccacctgaaggagacccccagcctgcggcgggtgcacctgggcactggagcctgcccctggagcggcagcttccccctggagaacacagagctggccaacgtgggcgccaaccaggtgacagtgaggaaaggagagaaggaccacaccacccactgccacgccagtgaccacgccaaccagctgagcatccacatccctggctggagctacagagctgtgcacaccaaggtgttttctggcagcagcaagaggcagcagggcgaggtgtgcatgacagtgtctgcccctcctgtggagcagaagcccaccaggcacttcctgcccatcggggacagcagccccagtgatgactgcctgagccgggacctgtctgagcccacagaaagaagacaccagagcttcctgaagccccgcatcctcttccctggcttcctgtgccccctgcaggatgtgtgtgccagcctgcaggaggacaatggagtgcagatcgagagcaagttccccaagggggactacacctgctgtgacctggtggtgaagatcaaggagtgcaagaagtctgaggaccccaccaccccagagcccagccctgctgcccccagccctgcccccagagatggagctggcagccctggcctgtctgaggactgcagcgagagccagcagaccccagcccggagcctgaccctgcaggaggccctggaggtgaggaagccccagttcatcagccgcagccaggagcggctgaagaagctggagcacatggtgcagcagaggaaggcccagaggaaagaagacctgcggcagaagcagagcctgctgcccatccgcaccagcaagaagcagttcaccatcccccaccccctgagtgacaacctcttcaagcccaaggagcgctgcatcagcgagaaggagatgcacatgaggagcaagaggatctatgacaacctgcctgaggtgtag

SEQ ID NO: 19095 - DNA, 1809 bp, Artificial Sequence
  Description of Artificial Sequence: Synthetic coding sequence
atgctgaagctgtctggagagggcctgcgggacagctaccacagccggcgggaccagatcgccctgaagaacctgcagagtgatgtgacagaggccaagagtgacttcaccaaggagaccctggccagccagaacaccaagatgatcagcagcatcgtcatcagccagatgattgatgagaacaagagcagagaaaatagagccagcctgcccctgccctgtgccatcgcccagagccgggcccaccacgccaagcagagcctggccaacagaagtggagtgaacatccaccgggcctttgccctgctgcccggccgcctgggcatcccagcccccagtgatgagcggggccctgaggccgagctgccccccaaggaggagcggccctgtggcggcccccggcggggctttgccagcatcaccatcacagccaggagagtgggccccccagcccgggccctggtgtggggcacagctggggacagcctgtgccccaagtgcagagctgaggacaccctcttccaggcccccccagccctggccaacggggcccaccctggccgccaccagaggagctttgcctgcacagagttcagcaggaacagctctgtggtgcggctgaaggtgcctgaggcccacacaggcctgtgtgaaagaaggaagtactgggtgacccatgctgatgacaaggagaccagcttctccccagacacccccctgagcggcaagagccccctggtgttcagcagctgtgtgcacctgcgggtgtcccagcagtgcccagacagcatctactacgtggacaagagcctgtctgtgcccatcgagcccccccagatcgccagccccaagatgcacaggtctgtgctgagcctgaacctgaactgcagcagccaccggctgacagcagatggagtggatggcctggtgaaccgggagcccatcagcgaggccctgaagcaggagctgctggagggggaccaggacctggtgggccagcgctggaaccctggcctgcaggagagccacctgaaggagacccccagcctgcggcgggtgcacctgggcactggagcctgcccctggagcggcagcttccccctggagaacacagagctggccaacgtgggcgccaaccaggtgacagtgaggaaaggagagaaggaccacaccacccactgccacgccagtgaccacgccaaccagctgagcatccacatccctggctggagctaccgggccggggactacacctgctgtgacctggtggtgaagatcaaggagtgcaagaagtctgaggaccccaccaccccagagcccagccctgctgcccccagccctgcccccagagatggagctggcagccctggcctgtctgaggactgcagcgagagccagcagaccccagcccggagcctgaccctgcaggaggccctggaggtgaggaagccccagttcatcagccgcagccaggagcggctgaagaagctggagcacatggtgcagcagaggaaggcccagaggaaggaggacctgcggcagaagcagagcctgctgcccatccgcaccagcaagaagcagttcaccatcccccaccccctgagtgacaacctcttcaagcccaaggagcgctgcatcagcgagaaggagatgcacatgaggagcaagaggatctatgacaacctgcctgaggtgaagaagaagaaggaggagcagaggaagagggtcatcctgcagagcaaccggctgcgggcagaggtgttcaagaagcagctgctggaccagctgctgcagagaaatgctgtgtag

SEQ ID NO: 19096 - DNA, 2391 bp, Artificial Sequence
  Description of Artificial Sequence: Synthetic coding sequence
atgcagcacagcggcatccccaccaagacccacccccagggctacgccgcccgctacacagaaacagctgtgcacaggaccttccagatcaagaccttcagcacagagctgaagaaccacgtgatggtgatggactttgtgaagagcaactggttccccagccagaggcgggccaaggtgtgcatcatccacatgtgccagggcctgaagacagctgagcagacagccagccgctatgagatccacagccgcctcttcagcagccccaaggaccacagcgcctgggagagaaatgaaagcctgagcaatgccggcctgcgggacagctaccacagcagaagagaccagatcgccctgaagaacctgcagagtgatgtgacagaggccaagagtgacttcaccaaggagaccctggccagccagaacaccaagatgatcagcagcatcgtcatcagccagatgattgatgagaacaagagccgggagaacagagccagcctgcccctgccctgtgccatcgcccagagccgggcccaccacgccaagcagagcctggccaacagaagtggagtgaacatccaccgggcctttgccctgctgcccggccgcctgggcatcccagcccccagtgatgagcggggccctgaggccgagctgccccccaaggaggagcggccctgtggcggcccccggcggggctttgccagcatcaccatcacagcccggcgggtgggccccccagcccgggccctggtgtggggcacagctggggacagcctgtgccccaagtgcagagctgaggacaccctcttccaggcccccccagccctggccaatggagcccaccctggccgccaccagaggagctttgcctgcacagagttcagcaggaacagctctgtggtgcggctgaaggtgcctgaggcccacacaggcctgtgtgagaggaggaagtactgggtgacccatgctgatgacaaggagaccagcttctccccagacacccccctgagcggcaagagccccctggtgttcagcagctgtgtgcacctgcgggtgtcccagcagtgcccagacagcatctactacgtggacaagagcctgtctgtgcccatcgagcccccccagatcgccagccccaagatgcacaggtctgtgctgagcctgaacctgaactgcagcagccaccggctgacagcagatggagtggatggcctggtgaaccgggagcccatcagcgaggccctgaagcaggagctgctggagggggaccaggacctggtgggccagcgctggaaccctggcctgcaggagagccacctgaaggagacccccagcctgcggcgggtgcacctgggcaccggggcctgcccctggagcggcagcttccccctggagaacacagagctggccaacgtgggcgccaaccaggtgacagtgaggaagggggagaaggaccacaccacccactgccacgccagtgaccacgccaaccagctgagcatccacatccctggctggagctacagagctgtgcacaccaaggtgttcagcggcagcagcaagaggcagcagggcgaggtgtgcatgacagtgtctgcccctcctgtggagcagaagcccaccaggcacttcctgcccatcggggacagcagccccagtgatgactgcctgagccgggacctgtctgagcccacagagcggcggcaccagagcttcctgaagccccgcatcctcttccctggcttcctgtgccccctgcaggatgtgtgtgccagcctgcaggaggacaacggggtgcagatcgagagcaagttccccaagggggactacacctgctgtgacctggtggtgaagatcaaggagtgcaagaagtctgaggaccccaccaccccagagcccagccctgctgcccccagccctgcccccagagatggagctggcagccctggcctgtctgaggactgcagcgagagccagcagaccccagcccggagcctgaccctgcaggaggccctggaggtgaggaagccccagttcatcagccgcagccaggagcggctgaagaagctggagcacatggtgcagcagaggaaggcccagaggaaggaggacctgcggcagaagcagagcctgctgcccatccgcaccagcaagaagcagttcaccatcccccaccccctgagtgacaacctcttcaagcccaaggagcgctgcatcagcgagaaggagatgcacatgaggagcaagaggatctatgacaacctgcctgaggtgaagaagaagaaggaggagcagaggaagagggtcatcctgcagagcaaccggctgcgggcagaggtgttcaagaagcagctgctggaccagctgctgcagagaaatgctgtgtag

SEQ ID NO: 19097 - DNA, 786 bp, Artificial Sequence
  Description of Artificial Sequence: Synthetic coding sequence
atgagcaccaccacctgccaggtggtggccttcctgctgagcatcctgggcctggccggctgcatcgccgccaccggcatggacatgtggagcacccaggacctgtatgacaaccctgtgaccagcgtcttccagtatgagggcctgtggaggagctgtgtgcggcagagcagcggcttcacagagtgccggccctacttcaccatcctgggcctgcctgccatgctgcaggccgtgcgggccctgatgattgtgggcatcgtgctgggcgccatcggcctgctggtgtccatctttgccctgaagtgcatccgcatcggctccatggaggacagcgccaaggccaacatgaccctgaccagcggcatcatgttcatcgtgtctggcctgtgtgccatcgccggcgtgtctgtgtttgccaacatgctggtgaccaacttctggatgagcacagccaacatgtacacaggcatgggcggcatggtgcagacagtgcagacccgctacacctttggagctgccctgtttgtgggctgggtggccggcggcctgaccctgattggaggagtgatgatgtgcatcgcctgccggggcctggcccctgaggagaccaactacaaggctgtgtcctaccacgccagcggccacagcgtggcctacaagccaggcggcttcaaggccagcactggatttggcagcaacaccaagaacaagaagatctatgatggaggagccaggacagaagatgaggtgcagagctaccccagcaagcatgactatgtgtag

SEQ ID NO: 19098 - DNA, 786 bp, Artificial Sequence
  Description of Artificial Sequence: Synthetic coding sequence
atggctgtgacagcctgccagggcctgggctttgtggtgtccctcatcggcattgctggcatcatcgccgccacctgcatggaccagtggagcacccaggacctgtacaacaaccctgtgacagctgtgttcaactaccagggcctgtggaggagctgtgtgcgggagagcagcggcttcacagagtgccggggctacttcaccctgctgggcctgcctgccatgctgcaggccgtgcgggccctgatgattgtgggcatcgtgctgggcgccatcggcctgctggtgtccatctttgccctgaagtgcatccgcatcggctccatggaggacagcgccaaggccaacatgaccctgaccagcggcatcatgttcatcgtgtctggcctgtgtgccatcgccggcgtgtctgtgtttgccaacatgctggtgaccaacttctggatgagcacagccaacatgtacacaggcatgggcggcatggtgcagacagtgcagacccgctacacctttggagctgccctgtttgtgggctgggtggccggcggcctgaccctgattggaggagtgatgatgtgcatcgcctgccggggcctggcccctgaggagaccaactacaaggctgtgtcctaccacgccagcggccacagcgtggcctacaagccaggcggcttcaaggccagcactggatttggcagcaacaccaagaacaagaagatctatgatggaggagccaggacagaagatgaggtgcagagctaccccagcaagcatgactatgtgtag

SEQ ID NO: 19099 - DNA, 753 bp, Artificial Sequence
  Description of Artificial Sequence: Synthetic coding sequence
atgagcaccaccacctgccaggtggtggccttcctgctgagcatcctgggcctggccggctgcatcgccgccaccggcatggacatgtggagcacccaggacctgtatgacaaccctgtgaccagcgtcttccagtatgagggcctgtggaggagctgtgtgcggcagagcagcggcttcacagagtgccggccctacttcaccatcctgggcctgcctgccatgctgcaggccgtgcgggccctgatgattgtggccatctttgccctgaagtgcatcagaattggctccatggaggacagcgccaaggccaacatgaccctgaccagcggcatcatgtttattgtgtctggcctgtgtgccatcgccggcgtgtctgtgtttgccaacatgctggtgaccaacttctggatgagcacagccaacatgtacacaggcatgggcggcatggtgcagacagtgcagacccgctacaccttcggggccgccctgtttgtgggctgggtggccggcggcctgaccctcatcggcggcgtgatgatgtgcatcgcctgccggggcctggcccctgaggagaccaactacaaggctgtgtcctaccacgccagcggccacagcgtggcctacaagccaggcggcttcaaggccagcacaggcttcggcagcaacaccaagaacaagaagatctatgatggaggagccaggacagaagatgaggtgcagagctaccccagcaagcatgactatgtgtag

SEQ ID NO: 19100 - DNA, 3000 bp, Artificial Sequence
  Description of Artificial Sequence: Synthetic coding sequence
atgggccctgcccccctgcccctgctgctgggcctcttcctgcctgccctgtggaggcgggccatcacagaggcccgggaggaggccaagccctaccccctcttccctggccccttccctggcagcctgcagacagaccacacccccctgctgagcctgccccacgccagcggctaccagcctgccctgatgttcagccccacccagcccggccggccccacactggaaatgtggccatcccccaggtgacctctgtggagagcaagcccctgccccccctggccttcaagcacacagtgggccacatcatcctgtctgagcacaagggcgtgaagttcaactgcagcatctctgtgcccaacatctaccaggacaccaccatctcctggtggaaggatggcaaggagctgctgggcgcccaccacgccatcacccagttctacccagatgatgaggtgacagccatcatcgccagcttcagcatcacctctgtgcagaggagtgacaatggcagctacatctgcaagatgaagatcaacaatgaggagatcgtgtctgaccccatctacatcgaggtgcagggcctgccccacttcaccaagcagcctgagagcatgaatgtgaccaggaacacagccttcaacctgacctgccaggccgtgggccccccagagcctgtgaacatcttctgggtgcagaacagcagccgggtgaatgagcagcctgagaagagccccagcgtgctgactgtgcccggcctgacagagatggctgtgttcagctgtgaggcccacaatgacaagggcctgactgtgtccaagggcgtgcagatcaacatcaaggccatccccagccccccaacagaggtgtccatccggaacagcacagcccacagcatcctgatctcctgggtgcccggctttgatggctacagccccttcaggaactgcagcatccaggtgaaggaggccgaccccctgagcaatggatctgtgatgatcttcaacaccagcgccctgccccacctgtaccagatcaagcagctgcaggccctggccaactacagcattggagtgtcctgcatgaatgaaattggctggagcgctgtgagcccctggatcctggccagcaccacagaaggagcccccagcgtggcccccctgaatgtgacagtgttcctgaatgaaagcagtgacaacgtggacatccgctggatgaagccacccaccaagcagcaggatggagagctggtgggctaccgcatcagccacgtgtggcagagcgctggcatcagcaaggagctgctggaggaggtgggccagaatggcagccgggcccgcatctctgtgcaggtgcacaatgccacctgcaccgtgagaattgctgctgtgacccggggcggcgtgggccccttcagtgaccctgtgaagatcttcatcccagcccacggctgggtggactatgcccccagcagcaccccagcccctggaaatgctgaccctgtgctgatcatcttcggctgcttctgtggcttcatcctgattggcctcatcctgtacatcagcctggccatcaggaagagggtgcaggagaccaagtttggaaatgccttcacagaagaagattctgagctggtggtgaactacatcgccaagaagagcttctgcagaagagccatcgagctgaccctgcacagcctgggcgtgtctgaggagctgcagaacaagctggaggatgtggtgattgacaggaacctgctgatcctgggcaagatcctgggggagggggagtttggatctgtgatggagggcaacctgaagcaggaggatggcaccagcctgaaggtggccgtgaagaccatgaagctggacaacagcagccagcgggagattgaggagttcctgtctgaggccgcctgcatgaaggacttcagccaccccaacgtcatccggctgctgggcgtgtgcatcgagatgagcagccagggcatccccaagcccatggtgatcctgcccttcatgaagtacggggacctgcacacctacctgctgtacagccggctggagaccggccccaagcacatccccctgcagaccctgctgaagttcatggtggacatcgccctgggcatggagtacctgagcaacagaaacttcctgcaccgggacctggccgccaggaactgcatgctgagagatgacatgacagtgtgtgtggccgactttggcctgagcaagaagatctacagcggggactactaccggcagggcagaattgccaagatgcctgtgaagtggatcgccatcgagagcctggccgacagagtgtacaccagcaagagtgatgtgtgggccttcggcgtgaccatgtgggagatcgccacccggggcatgaccccctacccaggagtgcagaaccacgagatgtatgactacctgctgcacggccaccggctgaagcagcctgaggactgcctggatgagctgtatgagatcatgtacagctgctggaggacagaccccctggaccggcccaccttctctgtgctgcggctgcagctggagaagctgctggagagcctgcctgatgtgaggaaccaggctgatgtgatctacgtgaacacccagctgctggagagcagcgagggcctggcccagggcagcaccctggcccccctggacctgaacattgatcctgacagcatcatcgccagctgcaccccccgggccgccatctctgtggtgacagctgaggtgcatgacagcaagccccatgagggccgctacatcctgaatggaggcagcgaggagtgggaggacctgaccagcgcccccagcgctgctgtgacagctgagaagaacagcgtgctgcccggggagcggctggtgagaaatggagtgtcctggagccacagctccatgctgcccctgggcagcagcctgcctgatgagctgctgtttgctgatgacagcagcgagggcagcgaggtgctgatgtag

SEQ ID NO: 19101 - DNA, 1671 bp, Artificial Sequence
  Description of Artificial Sequence: Synthetic coding sequence
atgaagccacccaccaagcagcaggatggagagctggtgggctaccgcatcagccacgtgtggcagagcgctggcatcagcaaggagctgctggaggaggtgggccagaatggcagccgggcccgcatctctgtgcaggtgcacaatgccacctgcaccgtgagaattgctgctgtgacccggggcggcgtgggccccttcagtgaccctgtgaagatcttcatcccagcccacggggagagctacacccacgcccagatcgccaggaacctgcacaaggtgcggcctgcctacatcagcctgaccatctgcagcagcctgctgcaggcctctgtgagccacatcttccagaccatgacaggcctgctggtgtccacccggctgggccgcctgtgccccctcttcaacagcggggcctggcagaggaggagctgtgcccaccacctgtggctgctgctgtggatcctgattggcctcatcctgtacatcagcctggccatcaggaagagggtgcaggagaccaagtttggaaatgccttcacagaagaagattctgagctggtggtgaactacatcgccaagaagagcttctgcagaagagccatcgagctgaccctgcacagcctgggcgtgtctgaggagctgcagaacaagctggaggatgtggtgattgacaggaacctgctgatcctgggcaagatcctgggggagggggagtttggatctgtgatggagggcaacctgaagcaggaggatggcaccagcctgaaggtggccgtgaagaccatgaagctggacaacagcagccagcgggagattgaggagttcctgtctgaggccgcctgcatgaaggacttcagccaccccaacgtcatccggctgctgggcaccagcgagaagtgccgctgggtggccaagagggccctgctgatctgcagcgtgcccaaggagaagatcagcggcgtggacaagaactgcctgcagatccacatccccctgcagaccctgctgaagttcatggtggacatcgccctgggcatggagtacctgagcaacagaaacttcctgcaccgggacctggccgccaggaactgcatgctgagagatgacatgacagtgtgtgtggccgactttggcctgagcaagaagatctacagcggggactactaccggcagggcagaattgccaagatgcctgtgaagtggatcgccatcgagagcctggccgacagagtgtacaccagcaagagtgatgtgtgggccttcggcgtgaccatgtgggagatcgccacccggggcatgaccccctacccaggagtgcagaaccacgagatgtatgactacctgctgcacggccaccggctgaagcagcccacagcctggatgaactgtgaccaggtgggcatgtgccggggcgtggagcccacagacaccccagcccaggagcccttcctgatgtgggagatcgtgtatgagtgcaccctggccggggagcccatcccagaccggcccaccttctctgtgctgcggctgcagctggagaagctgctggagagcctgcctgatgtgaggaaccaggctgatgtgatctacgtgaacacccagctgctggagagcagcgagggcctggccctgcacccctgcagcacaggcctggagcaccggccctag

SEQ ID NO: 19102 - DNA, 2472 bp, Artificial Sequence
  Description of Artificial Sequence: Synthetic coding sequence
atgaagatcaacaatgaggagatcgtgtctgaccccatctacatcgaggtgcagggcctgccccacttcaccaagcagcctgagagcatgaatgtgaccaggaacacagccttcaacctgacctgccaggccgtgggccccccagagcctgtgaacatcttctgggtgcagaacagcagccgggtgaatgagcagcctgagaagagccccagcgtgctgactgtgcccggcctgacagagatggctgtgttcagctgtgaggcccacaatgacaagggcctgactgtgtccaagggcgtgcagatcaacatcaaggccatccccagccccccaacagaggtgtccatccggaacagcacagcccacagcatcctgatctcctgggtgcccggctttgatggctacagccccttcaggaactgcagcatccaggtgaaggaggccgaccccctgagcaatggatctgtgatgatcttcaacaccagcgccctgccccacctgtaccagatcaagcagctgcaggccctggccaactacagcattggagtgtcctgcatgaatgaaattggctggagcgctgtgagcccctggatcctggccagcaccacagaaggagcccccagcgtggcccccctgaatgtgacagtgttcctgaatgaaagcagtgacaacgtggacatccgctggatgaagccacccaccaagcagcaggatggagagctggtgggctaccgcatcagccacgtgtggcagagcgctggcatcagcaaggagctgctggaggaggtgggccagaatggcagccgggcccgcatctctgtgcaggtgcacaatgccacctgcaccgtgagaattgctgctgtgacccggggcggcgtgggccccttcagtgaccctgtgaagatcttcatcccagcccacggctgggtggactatgcccccagcagcaccccagcccctggaaatgctgaccctgtgctgatcatcttcggctgcttctgtggcttcatcctgattggcctcatcctgtacatcagcctggccatcaggaagagggtgcaggagaccaagtttggaaatgccttcacagaagaagattctgagctggtggtgaactacatcgccaagaagagcttctgcagaagagccatcgagctgaccctgcacagcctgggcgtgtctgaggagctgcagaacaagctggaggatgtggtgattgacaggaacctgctgatcctgggcaagatcctgggggagggggagtttggatctgtgatggagggcaacctgaagcaggaggatggcaccagcctgaaggtggccgtgaagaccatgaagctggacaacagcagccagcgggagattgaggagttcctgtctgaggccgcctgcatgaaggacttcagccaccccaacgtcatccggctgctgggcgtgtgcatcgagatgagcagccagggcatccccaagcccatggtgatcctgcccttcatgaagtacggggacctgcacacctacctgctgtacagccggctggagaccggccccaagcacatccccctgcagaccctgctgaagttcatggtggacatcgccctgggcatggagtacctgagcaacagaaacttcctgcaccgggacctggccgccaggaactgcatgctgagagatgacatgacagtgtgtgtggccgactttggcctgagcaagaagatctacagcggggactactaccggcagggcagaattgccaagatgcctgtgaagtggatcgccatcgagagcctggccgacagagtgtacaccagcaagagtgatgtgtgggccttcggcgtgaccatgtgggagatcgccacccggggcatgaccccctacccaggagtgcagaaccacgagatgtatgactacctgctgcacggccaccggctgaagcagcctgaggactgcctggatgagctgtatgagatcatgtacagctgctggaggacagaccccctggaccggcccaccttctctgtgctgcggctgcagctggagaagctgctggagagcctgcctgatgtgaggaaccaggctgatgtgatctacgtgaacacccagctgctggagagcagcgagggcctggcccagggcagcaccctggcccccctggacctgaacattgatcctgacagcatcatcgccagctgcaccccccgggccgccatctctgtggtgacagctgaggtgcatgacagcaagccccatgagggccgctacatcctgaatggaggcagcgaggagtgggaggacctgaccagcgcccccagcgctgctgtgacagctgagaagaacagcgtgctgcccggggagcggctggtgagaaatggagtgtcctggagccacagctccatgctgcccctgggcagcagcctgcctgatgagctgctgtttgctgatgacagcagcgagggcagcgaggtgctgatgtag

SEQ ID NO: 19103 - DNA, 3000 bp, Artificial Sequence; identical to SEQ ID NO: 19100
  Description of Artificial Sequence: Synthetic coding sequence

SEQ ID NO: 19104 - DNA, 501 bp, Artificial Sequence
  Description of Artificial Sequence: Synthetic coding sequence
atggccagcggcgtggccgtgtctgatggagtcatcaaggtgttcaatgacatgaaggtgaggaagagcagcaccccagaggaggtgaagaagaggaagaaggctgtgctcttctgcctgtctgaggacaagaagaacatcatcctggaggagggcaaggagatcctggtgggagatgtgggccagacagtggatgacccctatgccacctttgtgaagatgctgcctgacaaggactgccgctatgccctgtatgatgccacctatgagaccaaggagagcaagaaggaggacctggtgttcatcttctgggcccctgagagcgcccccctgaagagcaagatgatctatgccagcagcaaggatgccatcaagaagaagctgaccggcatcaagcatgagctgcaggccaactgctatgaggaggtgaaggaccgctgcaccctggccgagaagctgggcggcagcgctgtgatcagcctggagggcaagcccctgtag

SEQ ID NO: 19105 - DNA, 501 bp, Artificial Sequence; identical to SEQ ID NO: 19104
  Description of Artificial Sequence: Synthetic coding sequence

SEQ ID NO: 19106 - DNA, 276 bp, Artificial Sequence
  Description of Artificial Sequence: Synthetic coding sequence
atggccagcggcgtggccgtgtctgatggagtcatcaaggtgttcaatgacatgaaggtgaggaagagcagcaccccagaggaggtgaagaagaggaagaaggctgtgctcttctgcctgtctgaggacaagaagaacatcatcctggaggagggcaaggagatcctggtgggagatgtgggccagacagtggatgacccctatgccacctttgtgaagatgctgcctgacaaggactgccgctatgccctgtatgatgccacctatgagacctag

SEQ ID NO: 19107 - DNA, 4101 bp, Artificial Sequence
  Description of Artificial Sequence: Synthetic coding sequence
atgctgagctttgtggacaccaggaccctgctgctgctggccgtgaccctgtgcctggccacctgccagagcctgcaggaggagaccgtgaggaagggccctgctggggaccggggccccagaggagagcggggccccccaggccccccaggaagagatggagaagatggccccactggacctcctggccccccaggccccccaggccccccaggcctgggcggcaactttgctgcccagtatgatggcaagggcgtgggcctgggccctggccccatgggcctgatgggcccccggggccccccaggagctgctggggcccctggcccccagggcttccagggccctgctggggagcccggggagcccggccagacaggccctgctggggcccggggccctgctggccccccaggcaaggctggagaagatggccaccctgggaagccaggccggcctggagagcggggcgtggtgggcccccagggcgcccggggcttccctggcaccccaggcctgcccggcttcaagggcatccggggccacaacggcctggatggcctgaagggccagcccggggcccctggggtgaagggggagcccggggcccctggagaaaatggcaccccaggccagacaggagcccggggcctgcctggagagcggggccgggtgggcgcccctggccctgctggggcccggggcagtgatggctctgtgggccctgtgggccctgctggccccatcggcagcgctggccccccaggcttccctggggcccctggccccaagggggagattggagctgtgggcaatgccggccctgctggccctgctggccccagaggagaggtgggcctgcccggcctgagcggccctgtgggccccccaggcaaccctggggccaacggcctgaccggggccaagggagctgctggcctgcccggggtggccggggcccctggcctgcccggcccccggggcatccctggccctgtgggcgccgccggggccactggagcccggggcctggtgggggagcccggccctgctggcagcaagggggagagcggcaacaagggggagcccggcagcgctggcccccagggccccccaggccccagcggggaggagggcaagaggggccccaacggggaggccggcagcgctggccccccaggccccccaggcctgcggggcagccctggcagccggggcctgcccggggctgatggccgggccggcgtgatgggccccccaggcagcagaggagccagcggccctgctggggtgcggggccccaatggagatgctggccggcctggagagcccggcctgatgggcccccggggcctgcccggcagccctggcaacatcggccctgctgggaaggagggccctgtgggcctgcccggcattgatggccggcccggccccatcggccctgctggggcccggggggagcccggcaacatcggcttccctggccccaagggccccactggagaccccgggaagaatggagacaagggccatgctggcctggccggggcccggggggcccctggcccagatggcaacaacggggcccagggccccccaggcccccagggcgtgcagggcggcaaaggagagcagggccccccaggccccccaggcttccagggcctgcccggccccagcggccctgctggggaggtgggcaagccaggagagcggggcctgcacggggagtttggcctgcccggccctgctggccccagaggagagcggggccccccaggagagagcggggccgccggccccaccggccccatcggcagccggggccccagcggccccccaggcccagatggcaacaagggggagcccggggtggtgggcgctgtgggcacagctggccccagcggccccagcggcctgcccggggagagaggagctgctggcatccctgggggcaagggggagaagggggagcccggcctgcggggggagatcggcaaccctggaagagatggagcccggggggcccctggagctgtgggcgcccctggccctgctggggccaccggggacagaggagaggccggggctgctggccctgctggccctgctggcccccggggcagccctggagagcggggggaggtgggccctgctggccccaatggatttgctggccctgctggagctgctggccagcccggggccaagggggagcggggggccaagggccccaagggagaaaatggagtggtgggccccaccggccctgtgggcgccgccggccctgctggccccaacggccccccaggccctgctggcagcagaggagatggcggccccccaggcatgacaggcttccctggagctgctggccgcactggacctcctggccccagcggcatcagcggccccccaggccccccaggccctgctgggaaggagggcctgcggggccccaggggggaccagggccctgtgggccgcactggagaggtgggcgctgtgggccccccaggctttgctggggagaagggccccagcggggaggccggcacagctggccccccaggcaccccaggcccccagggcctgctgggcgcccctggcatcctgggcctgcccggcagcagaggagagcggggcctgcccggggtggccggggctgtgggggagcccggccccctgggcattgctggccccccaggggcccggggccccccaggagctgtgggcagccctggggtgaatggagcccctggagaggccggcagagatggcaaccctggaaatgatggccccccaggaagagatggccagcccggccacaagggggagcggggctacccaggcaacatcggccctgtgggcgccgccggggcccctggcccccacggccctgtgggccctgctgggaagcacggcaacagaggagaaacaggccccagcggccctgtgggccctgctggagctgtgggcccccggggccccagcggcccccagggcatccggggggacaagggggagcctggagagaagggcccccggggcctgcccggcctgaagggccacaacggcctgcagggcctgcccggcattgctggccaccacggggaccagggcgcccctggctctgtgggccctgctggcccccggggccctgctggccccagcggccctgctgggaaggatggccgcacaggccaccctggcaccgtgggccctgctggcatccggggcccccagggccaccagggccctgctggccccccaggccccccaggccccccaggccccccaggagtgtctgggggcggctatgactttggctatgatggagacttctacagagctgaccagcccaggtctgcccccagcctgcggcccaaggactatgaggtggatgccaccctgaagagcctgaacaaccagatcgagaccctgctgaccccagagggcagcaggaagaacccagcccggacctgccgggacctgcggctgagccaccctgagtggagcagcggctactactggattgaccccaaccagggctgcaccatggatgccatcaaggtgtactgtgacttcagcactggagagacctgcatccgggcccagcctgagaacatcccagccaagaactggtaccgcagcagcaaggacaagaagcacgtgtggctgggggagaccatcaatgccggcagccagtttgagtacaacgtggagggcgtgaccagcaaggagatggccacccagctggccttcatgaggctgctggccaactatgccagccagaacatcacctaccactgcaagaacagcatcgcctacatggatgaggagactggaaacctgaagaaggctgtgatcctgcagggcagcaatgatgtggagctggtggccgagggcaacagccgcttcacctacacagtgctggtggatggctgcagcaagaagaccaatgagtggggcaagaccatcatcgagtacaagaccaacaagcccagccggctgcccttcctggacatcgcccccctggacattggaggagctgaccaggagttctttgtggacatcggccctgtgtgcttcaagtag

SEQ ID NO: 19108 - DNA, 4104 bp, Artificial Sequence
  Description of Artificial Sequence: Synthetic coding sequence
atgctgagctttgtggacaccaggaccctgctgctgctggccgtgaccctgtgcctggccacctgccagtgcaccctgggcggccagaccctgagcaagtttcctccctacctgcacatcgagaggtctgagcagggccccccaggccccccaggaagagatggagaagatggccccaccggccccccaggccccccaggccccccaggccccccaggcctgggcggcaactttgctgcccagtatgatggaaaaggagtgggcctgggccctggccccatgggcctgatgggcccccggggccccccaggagctgctggggcccctggcccccagggcttccagggccctgctggggagcctggagagcccggccagacaggccctgctggggcccggggccctgctggccccccaggcaaggccggggaggatggccaccctgggaagccaggccggcctggagagcggggcgtggtgggcccccagggcgcccggggcttccctggcaccccaggcctgcccggcttcaagggcatccggggccacaacggcctggatggcctgaagggccagcccggggcccctggggtgaagggggagcccggggcccctggagaaaatggcaccccaggccagacaggagcccggggcctgcccggggagcggggccgggtgggcgcccctggccctgctggggcccggggcagtgatggctctgtgggccctgtgggccctgctggccccatcggcagcgctggccccccaggcttccctggggcccctggccccaagggggagatcggggctgtgggcaatgccggccctgctggccctgctggccccagaggagaggtgggcctgcccggcctgagcggccctgtgggccccccaggcaaccctggggccaacggcctgactggagccaagggagctgctggcctgcccggggtggccggggcccctggcctgcccggcccccggggcatccctggccctgtgggcgctgctggggccaccggggcccggggcctggtgggggagcccggccctgctggcagcaaaggagagagcggcaacaagggggagcccggcagcgctggcccccagggccccccaggccccagcggggaggagggcaagaggggccccaatggagaggccggcagcgctggccccccaggccccccaggcctgcggggcagccctggcagccggggcctgcctggagcagatggccgggccggcgtgatgggccccccaggcagcagaggagccagcggccctgctggggtgcggggccccaatggagatgctggccggcctggagagcccggcctgatgggcccccggggcctgcccggcagccctggcaacatcggccctgctgggaaggagggccctgtgggcctgcccggcattgatggccggcccggccccatcggccctgctggggcccggggggagcccggcaacatcggcttccctggccccaagggccccaccggggaccccgggaagaatggagacaagggccacgccggcctggccggggcccggggggcccctggcccagatggcaacaatggagcccagggccccccaggcccccagggcgtgcagggcggcaagggggagcagggccccccaggccccccaggcttccagggcctgcccggccccagcggccctgctggggaggtgggcaagccaggagagcggggcctgcatggagaatttggcctgcccggccctgctggccccagaggagagcggggccccccaggagagagcggggctgctggccccaccggccccatcggcagccggggccccagcggccccccaggcccagatggcaacaagggggagcccggggtggtgggcgctgtgggcacagctggccccagcggccccagcggcctgcctggagagagaggagctgctggcatccctgggggcaaaggagagaagggggagcccggcctgcggggggagatcggcaaccctggaagagatggagcccggggggcccctggagctgtgggcgcccctggccctgctggggccactggagacagaggagaggccggggccgccggccctgctggccctgctggcccccggggcagccctggagagcggggggaggtgggccctgctggccccaacggctttgctggccctgctggagctgctggccagcccggggccaagggggagcggggggccaagggccccaagggggagaatggagtggtgggccccactggacctgtgggcgctgctggccctgctggccccaatggacctcctggccctgctggcagcagaggagatggcggccccccaggcatgacaggcttccctggagctgctggccgcacaggccccccaggccccagcggcatcagcggccccccaggccccccaggccctgctgggaaggagggcctgcggggccccaggggggaccagggccctgtgggccgcactggagaggtgggcgctgtgggccccccaggctttgctggggagaagggccccagcggggaggccggcacagctggccccccaggcaccccaggcccccagggcctgctgggcgcccctggcatcctgggcctgcccggcagcagaggagagcggggcctgcccggggtggccggggctgtgggggagcccggccccctgggcattgctggccccccaggggcccggggccccccaggagctgtgggcagccctggggtgaatggagcccctggagaggccggcagagatggcaaccctggaaatgatggccccccaggaagagatggccagcccggccacaagggggagcggggctacccaggcaacatcggccctgtgggcgctgctggggcccctggcccccacggccctgtgggccctgctgggaagcacggcaacagaggagagaccggccccagcggccctgtgggccctgctggagctgtgggcccccggggccccagcggcccccagggcatccggggggacaagggggagcccggggagaagggcccccggggcctgcccggcctgaagggccacaacggcctgcagggcctgcccggcattgctggccaccacggggaccagggcgcccctggctctgtgggccctgctggcccccggggccctgctggccccagcggccctgctgggaaggatggccgcacaggccaccctggcaccgtgggccctgctggcatccggggcccccagggccaccagggccctgctggccccccaggccccccaggccccccaggccccccaggagtgtctgggggcggctatgactttggctatgatggagacttctacagagctgaccagcccaggtctgcccccagcctgcggcccaaggactatgaggtggatgccaccctgaagagcctgaacaaccagatcgagaccctgctgaccccagagggcagcaggaagaacccagcccggacctgccgggacctgcggctgagccaccctgagtggagcagcggctactactggattgaccccaaccagggctgcaccatggatgccatcaaggtgtactgtgacttcagcactggagagacctgcatccgggcccagcctgagaacatcccagccaagaactggtaccgcagcagcaaggacaagaagcacgtgtggctgggggagaccatcaatgccggcagccagtttgagtacaacgtggagggcgtgaccagcaaggagatggccacccagctggccttcatgaggctgctggccaactatgccagccagaacatcacctaccactgcaagaacagcatcgcctacatggatgaggagaccggcaacctgaagaaggccgtcatcctgcagggcagcaatgatgtggagctggtggccgagggcaacagccgcttcacctacacagtgctggtggatggctgcagcaagaagaccaatgagtggggcaagaccatcatcgagtacaagaccaacaagcccagccggctgcccttcctggacatcgcccccctggacatcggcggcgctgaccaggagttctttgtggacatcggccctgtgtgcttcaagtag

SEQ ID NO: 19109 - DNA, 4401 bp, Artificial Sequence
  Description of Artificial Sequence: Synthetic coding sequence
atgatgagctttgtgcagaagggctcctggctgctgctggccctgctgcaccccaccatcatcctggcccagcaggaggccgtggagggcggctgcagccacctgggccagagctatgctgacagagatgtgtggaagccagagccctgccagatctgtgtgtgtgacagcggctctgtgctgtgtgatgacatcatctgtgatgaccaggagctggactgccccaaccctgagatcccctttggagagtgctgtgctgtgtgcccccagcccccaacagcccccacccggccccccaacggccagggcccccagggccccaagggggaccccggccccccaggcatccctggaagaaatggagaccccggcatccctggccagcccggcagccctggcagccctggccccccaggcatctgtgagagctgccccaccggcccccagaactacagcccccagtatgacagctatgatgtgaagagcggcgtggccgtgggcggcctggccggctacccaggccctgctggccccccaggccccccaggccccccaggcaccagcggccaccctggcagccctggcagccctggctaccagggccccccaggagagcccggccaggccggccccagcggccccccaggccccccaggggccatcggccccagcggccctgctgggaaggatggagagagcggccggcccggccggcctggagagcggggcctgcccggccccccaggcatcaagggccctgctggcatccctggcttccctggcatgaagggccaccggggctttgatggaagaaatggagagaagggggagaccggggcccctggcctgaagggggagaatggcctgcccggggagaatggagcccctggccccatgggccccaggggggcccctggagagcggggccggcccggcctgcccggggctgctggggcccggggaaatgatggagcccggggcagtgatggccagcccggccccccaggccccccaggcacagctggcttccctggcagccctggggccaagggggaggtgggccctgctggcagccctggcagcaatggagcccctggccagagaggagagcccggcccccagggccatgctggggcccagggccccccaggccccccaggcatcaatggcagccctgggggcaaaggagagatgggccctgctggcatccctggggcccctggcctgatgggcgcccggggccccccaggccctgctggggccaacggggcccctggcctgcggggcggggccggggagcccgggaagaatggagccaagggggagcccggccccagaggagagcggggggaggccggcatccctggggtgcctggggccaagggagaagatggcaaggatggcagccctggagagcccggggccaacggcctgcctggagctgctggggagcggggggcccctggcttccggggccctgctggccccaacggcatccctggagagaagggccctgctggggagcggggggcccctggccctgctggccccagaggagctgctggggagcccggcagagatggagtgcctgggggccctggcatgaggggcatgcctggcagccctgggggccctggcagtgatggcaagccaggccccccaggcagccagggcgagagcggccggcccggccccccaggccccagcggcccccggggccagcccggggtgatgggcttccctggccccaagggaaatgatggagcccctgggaagaatggagagcggggcggccctgggggccctggcccccagggccccccaggcaagaatggagagaccggcccccagggccccccaggccccactggacctggaggagacaagggggacaccggccccccaggcccccagggcctgcagggcctgcccggcaccggcggccccccaggagaaaatggcaagccaggagagcccggccccaagggagatgctggggcccctggggcccctgggggcaaaggagatgctggggcccctggagagcggggccccccaggcctggccggggcccctggcctgcggggcggggccggccccccaggccctgagggcggcaaaggagctgctggccccccaggccccccaggagctgctggcaccccaggcctgcagggcatgcctggagagcggggcggcctgggcagccctggccccaagggggacaagggggagcccggcggccctggagcagatggagtgcctgggaaggatggcccccggggccccaccggccccatcggccccccaggccctgctggccagcccggggacaagggggagggcggggcccctggcctgcccggcattgctggcccccggggcagccctggagagcggggggagactggacctcctggccctgctggcttccctggggcccctggccagaatggagagcccggcggcaagggggagcggggggcccctggagagaagggggagggcggccccccaggagtggccggccccccaggcggcagcggccctgctggccccccaggcccccagggcgtgaagggggagcggggcagccctgggggccctggagctgctggcttccctggggcccggggcctgcccggccccccaggcagcaatggaaatcctggccccccaggccccagcggcagccctgggaaggatggccccccaggccctgctggcaacacaggagcccctggcagccctggggtgtctggccccaagggagatgctggccagcctggagagaagggcagccctggggcccagggccccccaggggcccctggccccctgggcattgctggcatcactggagcccggggcctggccggccccccaggcatgcctggcccccggggcagccctggcccccagggcgtgaagggggagagcggcaagccaggggccaacggcctgtctggagagcggggccccccaggcccccagggcctgcccggcctggccggcacagctggggagcccggcagagatggcaaccctggcagtgatggcctgcccggcagagatggcagccctgggggcaaaggagacagaggagaaaatggcagccctggggcccctggggcccctggccaccctggccccccaggccctgtgggccctgctgggaagagcggggacagaggagagagcggccctgctggccctgctggggcccctggccctgctggcagcagaggagcccctggcccccagggccccaggggggacaagggggagactggagagagaggagctgctggcatcaagggccaccggggcttccctggcaaccctggggcccctggcagccctggccctgctggccagcagggcgccatcggcagccctggccctgctggcccccggggccctgtgggccccagcggccccccaggcaaggatggcaccagcggccaccctggccccatcggccccccaggcccccggggcaacagaggagagcggggcagcgagggcagccctggccaccctggccagcccggccccccaggccccccaggggcccctggcccctgctgcggcggcgtgggcgctgctgccatcgccggcatcggcggggagaaggccggcggctttgccccctactatggagatgagcccatggacttcaagatcaacacagatgagatcatgaccagcctgaagtctgtgaatggccagatcgagagcctcatcagcccagatggcagcaggaagaacccagccaggaactgccgggacctgaagttctgccaccctgagctgaagagcggggagtactgggtggaccccaaccagggctgcaagctggatgccatcaaggtgttctgcaacatggagaccggggagacctgcatcagcgccaaccccctgaatgtgcccaggaagcactggtggacagacagcagcgctgagaagaagcacgtgtggtttggagagagcatggatggcggcttccagttctcctatggcaaccctgagctgcctgaagatgtgctggatgtgcacctggccttcctgcggctgctgagcagccgggccagccagaacatcacctaccactgcaagaacagcatcgcctacatggaccaggccagcggaaatgtgaagaaggccctgaagctgatgggcagcaatgaaggagagttcaaggccgagggcaacagcaagttcacctacacagtgctggaggatggctgcaccaagcacactggagagtggagcaagacagtgtttgagtaccgcaccaggaaggctgtgcggctgcccatcgtggacatcgccccctatgacattggaggccctgaccaggagtttggagtggatgtgggccctgtgtgcttcctgtag

SEQ ID NO: 19110 - DNA, 3492 bp, Artificial Sequence
  Description of Artificial Sequence: Synthetic coding sequence
atgatgagctttgtgcagaagggctcctggctgctgctggccctgctgcaccccaccatcatcctggcccagcaggaggccgtggagggcggctgcagccacctgggccagagctatgctgacagagatgtgtggaagccagagccctgccagatctgtgtgtgtgacagcggctctgtgctgtgtgatgacatcatctgtgatgaccaggagctggactgccccaaccctgagatcccctttggagagtgctgtgctgtgtgcccccagcccccaacagcccccacccggccccccaacggccagggcccccagggccccaagggggaccccggccccccaggcatccctggaagaaatggagaccccggcatccctggccagcccggcagccctggcagccctggccccccaggcatctgtgagagctgccccaccggcccccagaactacagcccccagtatgacagctatgatgtgaagagcggcgtggccgtgggcggcctggccggctacccaggccctgctggccccccaggccccccaggccccccaggcaccagcggccaccctggcagccctggcagccctggctaccagggccccccaggagagcccggccaggccggccccagcggccccccaggccccccaggggccatcggccccagcggccctgctgggaaggatggagagagcggccggcccggccggcctggagagcggggcctgcccggccccccaggcatcaagggccctgctggcatccctggcttccctggcatgaagggccaccggggctttgatggaagaaatggagagaagggggagaccggggcccctggcctgaagggggagaatggcctgcccggggagaatggagcccctggccccatgggccccaggggggcccctggagagcggggccggcccggcctgcccggggctgctggggcccggggaaatgatggagcccggggcagtgatggccagcccggccccccaggccccccaggcacagctggcttccctggcagccctggggccaagggggaggtgggccctgctggcagccctggcagcaatggagcccctggccagagaggagagcccggcccccagggccatgctggggcccagggccccccaggccccccaggcatcaatggcagccctgggggcaaaggagagatgggccctgctggcatccctggggcccctggcctgatgggcgcccggggccccccaggccctgctggggccaacggggcccctggcctgcggggcggggccggggagcccgggaagaatggagccaagggggagcccggccccagaggagagcggggggaggccggcatccctggggtgcctggggccaagggagaagatggcaaggatggcagccctggagagcccggggccaacggcctgcctggagctgctggggagcggggggcccctggcttccggggccctgctggccccaacggcatccctggagagaagggccctgctggggagcggggggcccctggccctgctggccccagaggagctgctggggagcccggcagagatggagtgcctgggggccctggcatgaggggcatgcctggcagccctgggggccctggcagtgatggcaagccaggccccccaggcagccagggcgagagcggccggcccggccccccaggccccagcggcccccggggccagcccggggtgatgggcttccctggccccaagggaaatgatggagcccctgggaagaatggagagcggggcggccctgggggccctggcccccagggccccccaggcaagaatggagagaccggcccccagggccccccaggccccactggacctggaggagacaagggggacaccggccccccaggcccccagggcctgcagggcctgcccggcaccggcggccccccaggagaaaatggcaagccaggagagcccggccccaagggagatgctggggcccctggggcccctgggggcaaaggagatgctggggcccctggagagcggggccccccaggcctggccggggcccctggcctgcggggcggggccggccccccaggccctgagggcggcaaaggagctgctggccccccaggccccccaggagctgctggcaccccaggcctgcagggcatgcctggagagcggggcggcctgggcagccctggccccaagggggacaagggggagcccggcggccctggagcagatggagtgcctgggaaggatggcccccggggccccaccggccccatcggccccccaggccctgctggccagcccggggacaagggggagggcggggcccctggcctgcccggcattgctggcccccggggcagccctggagagcggggggagactggacctcctggccctgctggcttccctggggcccctggccagaatggagagcccggcggcaagggggagcggggggcccctggagagaagggggagggcggccccccaggcctgtttggccccccaggcaaggatggcaccagcggccaccctggccccatcggccccccaggcccccggggcaacagaggagagcggggcagcgagggcagccctggccaccctggccagcccggccccccaggccccccaggggcccctggcccctgctgcggcggcgtgggcgccgccgccatcgccggcattggaggagagaaggccggcggctttgccccctactatggagatgagcccatggacttcaagatcaacacagatgagatcatgaccagcctgaagtctgtgaatggccagatcgagagcctcatcagcccagatggcagcaggaagaacccagccaggaactgccgggacctgaagttctgccaccctgagctgaagtctggagagtactgggtggaccccaaccagggctgcaagctggatgccatcaaggtgttctgcaacatggagactggagagacctgcatcagcgccaaccccctgaatgtgcccaggaagcactggtggacagacagcagcgctgagaagaagcacgtgtggtttggagagagcatggatggcggcttccagttctcctatggcaaccctgagctgcctgaagatgtgctggatgtgcacctggccttcctgcggctgctgagcagccgggccagccagaacatcacctaccactgcaagaacagcatcgcctacatggaccaggccagcggaaatgtgaagaaggccctgaagctgatgggcagcaatgaaggagagttcaaggccgagggcaacagcaagttcacctacacagtgctggaggatggctgcaccaagcacactggagagtggagcaagacagtgtttgagtaccgcaccaggaaggctgtgcggctgcccatcgtggacatcgccccctatgacatcggcggccctgaccaggagtttggagtggatgtgggccctgtgtgcttcctgtag

SEQ ID NO: 19111 - DNA, 5139 bp, Artificial Sequence
  Description of Artificial Sequence: Synthetic coding sequence
atgggccgggaccagagagctgtggccggccctgccctgcggcgctggctgctgctgggcaccgtgacagtgggcttcctggcccagagcgtgctggccggcgtgaagaagtttgatgtgccctgtggcggccgggactgcagcggcggctgccagtgctacccagagaagggcggccggggccagcccggccctgtgggcccccagggctacaacggccccccaggcctgcagggcttccctggcctgcagggcaggaaaggagacaagggggagcggggggcccctggggtgacaggccccaagggagatgtgggcgcccggggcgtgtctggcttccctggagcagatggcatccctggccaccctggccagggcggcccccggggccggcccggctatgatggctgcaatggcacccagggcgacagcggcccccagggccccccaggcagcgagggcttcaccggccccccaggcccccagggccccaagggccagaagggggagccctatgccctgcccaaggaggagcgggaccgctacagaggagagcccggggagcccggcctggtgggcttccagggccccccaggccggcccggccacgtgggccagatgggccctgtgggcgcccctggccggcccggccccagcagtgatgagagcttcaagaacaagctgaagaacaagggcctgaactactacacagtgaacagcatgcagggagatgtgggccagcccggccccaacggcatccccagcgacaccctgcaccccatcatcgcccccactggagtgaccttccacccagaccagtacaagggccctgtgggctggaggggccggccctgggtggccggcatcagcctgaagggggaggagggcatcatgggcttccctggcctgcggggctacccaggcctgagcggggagaagggcagccctggccagaagggcagccggggcctggatggctaccagggcccagatggcccccggggccccaagggggaggccggggaccccggccccccaggcctgcctgcctacagcccccaccccagcctggccaagggggcccggggggaccccggcttccctggggcccagggcgagcccggcagccagggcgagcccggggaccccggcctgcccggccccccaggcctgagcattggagatggagaccagaggcggggcctgcctggagagatgggccccaagggcttcatcggggaccccggcatcccagccctgtatggaggccccccaggcccagatggcaagaggggccccccaggccccccaggcctgcccggccccccaggcccagatggcttcctgtttggcctgaagggggccaagggccgggccggcttccctggcctgcccggcagccctggggcccggggccccaagggctggaagggagatgctggggagtgccgctgcacagaaggagatgaggccatcaagggcctgcccggcctgcccggccccaagggctttgctggcatcaacggggagcccggcaggaagggggacagaggagaccccggccagcacggcctgcccggcttccctggcctgaagggcgtgcccggcaacatcggggcccctggccccaagggggccaagggggacagcaggaccatcaccaccaagggggagcggggccagcccggggtgcctggggtgcccggcatgaagggagatgatggcagccctggaagagatggcctggatggcttccctggcctgcccggccccccaggagatggcatcaagggccccccaggggaccccggctacccaggcatccctggcaccaagggcaccccaggagagatgggccccccaggcctgggcctgcccggcctgaagggccagaggggcttccctggagatgctggcctgcccggccccccaggcttcctgggccccccaggccctgctggcaccccaggccagattgactgtgacacagatgtgaagagagctgtgggcggggaccggcaggaggccatccagcccggctgcatcggcggccccaagggcctgcccggcctgcccggccccccaggccccaccggggccaagggcctgcggggcatccctggctttgctggagcagatggcggccctggcccccggggcctgcctggagatgctggccgggagggcttccctggccccccaggcttcatcggcccccggggcagcaaaggagctgtgggcctgcccggcccagatggcagccctggccccatcggcctgcccggcccagatggccccccaggagagcggggcctgcctggagaggtgctgggcgcccagcccggccccagaggagatgctggggtgcccggccagcccggcctgaagggcctgcccggggaccggggccccccaggcttccggggcagccagggcatgcctggcatgcctggcctgaagggccagcccggcctgcccggccccagcggccagcccggcctgtatggccccccaggcctgcacggcttccctggggcccctggccaggagggccccctgggcctgcccggcatccctggccgggagggcctgcccggggacagaggagaccccggggacaccggggcccctggccctgtgggcatgaagggcctgagcggggacagaggagatgctggcttcaccggggagcagggccaccctggcagccctggcttcaagggcattgatggcatgcctggcaccccaggcctgaagggggaccggggcagccctggcatggatggcttccagggcatgcctggcctgaagggccggcccggcttccctggcagcaagggggaggccggcttcttcggcatccctggcctgaagggcctggccggggagcccggcttcaagggcagcagaggagaccccggccccccaggccccccacctgtgatcctgcccggcatgaaggacatcaagggggagaagggagatgagggccccatgggcctgaagggctacctgggcgccaagggcatccagggcatgcctggcatccctggcctgagcggcatccctggcctgcccggccggcccggccacatcaagggcgtgaagggggacattggagtgcccggcatccctggcctgcccggcttccctggggtggccggccccccaggcatcaccggcttccctggcttcatcggcagcagaggagacaagggggcccctggccgggccggcctgtatggagagatcggggccactggagactttggagacattggagacaccatcaacctgcccggccggcccggcctgaagggggagcggggcaccaccggcatccctggcctgaagggcttctttggagagaagggcacagaaggagacatcggcttccctggcatcaccggggtgactggagtgcagggccccccaggcctgaagggccagacaggcttccctggcctgactggacctcctggcagccagggcgagctgggcagaattggcctgcccggcggcaaaggagatgatggctggccaggggcccctggcctgcccggcttccctggcctgcggggcatccggggcctgcacggcctgcccggcaccaagggcttccctggcagccctggcagtgacatccacggggaccccggcttccctggccccccaggagagcggggggaccctggagaggccaacaccctgcccggccctgtgggcgtgcccggccagaagggggaccagggcgcccctggagagcggggccccccaggcagccctggcctgcagggcttccctggcatcaccccacccagcaacatcagcggggcccctggggacaagggggcccctggcatcttcggcctgaagggctaccggggccccccaggccccccaggcagcgctgccctgcccggcagcaagggggacaccggcaaccctggggcccctggcaccccaggcaccaagggctgggccggggacagcggcccccagggccggcctggggtgtttggcctgcctggagagaagggccccagaggagagcagggcttcatgggcaacacaggccccactggagctgtgggggaccggggccccaagggccccaagggggaccccggcttccctggggcccctggcaccgtgggcgcccctggcattgctggcatcccccagaagattgctgtgcagcccggcaccgtgggcccccagggcagaagaggccccccaggggcccctggagagatgggcccccagggccccccaggagagcccggcttccggggggcccctgggaaggccggcccccagggccggggcggcgtgtctgctgtgcccggcttcagaggagatgagggccccatcggccaccagggccccatcggccaggagggcgcccctggccggcccggcagccctggcctgcccggcatgcctggccgctctgtgtccatcggctacctgctggtgaagcacagccagacagaccaggagcccatgtgccctgtgggcatgaacaagctgtggagcggctacagcctgctgtactttgagggccaggagaaggcccacaaccaggacctgggcctggccggcagctgcctggcccgcttcagcaccatgcccttcctgtactgcaaccctggagatgtgtgctactatgccagcagaaatgacaagagctactggctgagcaccacagcccccctgcccatgatgcctgtggccgaggatgagatcaagccctacatcagccgctgcagcgtgtgtgaggccccagccatcgccatcgctgtgcacagccaggatgtgtccatcccccactgcccagctggctggaggagcctgtggattggctacagcttcctgatgcacacagctgctggagatgaaggaggcggccagagcctggtgtccccaggcagctgcctggaggacttccgggccacccccttcattgaatgtaatggaggccggggcacctgccactactatgccaacaagtacagcttctggctgaccaccatccctgagcagagcttccagggcagccccagcgctgacaccctgaaggccggcctcatccgcacccacatcagccgctgccaggtgtgcatgaagaacctgtag

SEQ ID NO: 19112 - DNA, 5139 bp, Artificial Sequence
  Description of Artificial Sequence: Synthetic coding sequence
atgggccgggaccagagagctgtggccggccctgccctgcggcgctggctgctgctgggcaccgtgacagtgggcttcctggcccagagcgtgctggccggcgtgaagaagtttgatgtgccctgtggcggccgggactgcagcggcggctgccagtgctacccagagaagggcggccggggccagcccggccctgtgggcccccagggctacaacggccccccaggcctgcagggcttccctggcctgcagggcaggaaaggagacaagggggagcggggggcccctggggtgacaggccccaagggagatgtgggcgcccggggcgtgtctggcttccctggagcagatggcatccctggccaccctggccagggcggcccccggggccggcccggctatgatggctgcaatggcacccagggcgacagcggcccccagggccccccaggcagcgagggcttcaccggccccccaggcccccagggccccaagggccagaagggggagccctatgccctgcccaaggaggagcgggaccgctacagaggagagcccggggagcccggcctggtgggcttccagggccccccaggccggcccggccacgtgggccagatgggccctgtgggcgcccctggccggcccggccccccaggccccccaggccccaagggccagcagggcaacagaggcctgggcttctacggcgtgaagggggagaagggagatgtgggccagcccggccccaacggcatccccagcgacaccctgcaccccatcatcgcccccactggagtgaccttccacccagaccagtacaagggggagaagggcagcgagggggagcccggcatccggggcatcagcctgaagggggaggagggcatcatgggcttccctggcctgcggggctacccaggcctgagcggggagaagggcagccctggccagaagggcagccggggcctggatggctaccagggcccagatggcccccggggccccaagggggaggccggggaccccggccccccaggcctgcctgcctacagcccccaccccagcctggccaagggggcccggggggaccccggcttccctggggcccagggcgagcccggcagccagggcgagcccggggaccccggcctgcccggccccccaggcctgagcattggagatggagaccagaggcggggcctgcctggagagatgggccccaagggcttcatcggggaccccggcatcccagccctgtatggaggccccccaggcccagatggcaagaggggccccccaggccccccaggcctgcccggccccccaggcccagatggcttcctgtttggcctgaagggggccaagggccgggccggcttccctggcctgcccggcagccctggggcccggggccccaagggctggaagggagatgctggggagtgccgctgcacagaaggagatgaggccatcaagggcctgcccggcctgcccggccccaagggctttgctggcatcaacggggagcccggcaggaagggggacagaggagaccccggccagcacggcctgcccggcttccctggcctgaagggcgtgcccggcaacatcggggcccctggccccaagggggccaagggggacagcaggaccatcaccaccaagggggagcggggccagcccggggtgcctggggtgcccggcatgaagggagatgatggcagccctggaagagatggcctggatggcttccctggcctgcccggccccccaggagatggcatcaagggccccccaggggaccccggctacccaggcatccctggcaccaagggcaccccaggagagatgggccccccaggcctgggcctgcccggcctgaagggccagaggggcttccctggagatgctggcctgcccggccccccaggcttcctgggccccccaggccctgctggcaccccaggccagattgactgtgacacagatgtgaagagagctgtgggcggggaccggcaggaggccatccagcccggctgcatcggcggccccaagggcctgcccggcctgcccggccccccaggccccaccggggccaagggcctgcggggcatccctggctttgctggagcagatggcggccctggcccccggggcctgcctggagatgctggccgggagggcttccctggccccccaggcttcatcggcccccggggcagcaaaggagctgtgggcctgcccggcccagatggcagccctggccccatcggcctgcccggcccagatggccccccaggagagcggggcctgcctggagaggtgctgggcgcccagcccggccccagaggagatgctggggtgcccggccagcccggcctgaagggcctgcccggggaccggggccccccaggcttccggggcagccagggcatgcctggcatgcctggcctgaagggccagcccggcctgcccggccccagcggccagcccggcctgtatggccccccaggcctgcacggcttccctggggcccctggccaggagggccccctgggcctgcccggcatccctggccgggagggcctgcccggggacagaggagaccccggggacaccggggcccctggccctgtgggcatgaagggcctgagcggggacagaggagatgctggcttcaccggggagcagggccaccctggcagccctggcttcaagggcattgatggcatgcctggcaccccaggcctgaagggggaccggggcagccctggcatggatggcttccagggcatgcctggcctgaagggccggcccggcttccctggcagcaagggggaggccggcttcttcggcatccctggcctgaagggcctggccggggagcccggcttcaagggcagcagaggagaccccggccccccaggccccccacctgtgatcctgcccggcatgaaggacatcaagggggagaagggagatgagggccccatgggcctgaagggctacctgggcgccaagggcatccagggcatgcctggcatccctggcctgagcggcatccctggcctgcccggccggcccggccacatcaagggcgtgaagggggacattggagtgcccggcatccctggcctgcccggcttccctggggtggccggccccccaggcatcaccggcttccctggcttcatcggcagcagaggagacaagggggcccctggccgggccggcctgtatggagagatcggggccactggagactttggagacattggagacaccatcaacctgcccggccggcccggcctgaagggggagcggggcaccaccggcatccctggcctgaagggcttctttggagagaagggcacagaaggagacatcggcttccctggcatcaccggggtgactggagtgcagggccccccaggcctgaagggccagacaggcttccctggcctgactggacctcctggcagccagggcgagctgggcagaattggcctgcccggcggcaaaggagatgatggctggccaggggcccctggcctgcccggcttccctggcctgcggggcatccggggcctgcacggcctgcccggcaccaagggcttccctggcagccctggcagtgacatccacggggaccccggcttccctggccccccaggagagcggggggaccctggagaggccaacaccctgcccggccctgtgggcgtgcccggccagaagggggaccagggcgcccctggagagcggggccccccaggcagccctggcctgcagggcttccctggcatcaccccacccagcaacatcagcggggcccctggggacaagggggcccctggcatcttcggcctgaagggctaccggggccccccaggccccccaggcagcgctgccctgcccggcagcaagggggacaccggcaaccctggggcccctggcaccccaggcaccaagggctgggccggggacagcggcccccagggccggcctggggtgtttggcctgcctggagagaagggccccagaggagagcagggcttcatgggcaacacaggccccactggagctgtgggggaccggggccccaagggccccaagggggaccccggcttccctggggcccctggcaccgtgggcgcccctggcattgctggcatcccccagaagattgctgtgcagcccggcaccgtgggcccccagggcagaagaggccccccaggggcccctggagagatgggcccccagggccccccaggagagcccggcttccggggggcccctgggaaggccggcccccagggccggggcggcgtgtctgctgtgcccggcttcagaggagatgagggccccatcggccaccagggccccatcggccaggagggcgcccctggccggcccggcagccctggcctgcccggcatgcctggccgctctgtgtccatcggctacctgctggtgaagcacagccagacagaccaggagcccatgtgccctgtgggcatgaacaagctgtggagcggctacagcctgctgtactttgagggccaggagaaggcccacaaccaggacctgggcctggccggcagctgcctggcccgcttcagcaccatgcccttcctgtactgcaaccctggagatgtgtgctactatgccagcagaaatgacaagagctactggctgagcaccacagcccccctgcccatgatgcctgtggccgaggatgagatcaagccctacatcagccgctgcagcgtgtgtgaggccccagccatcgccatcgctgtgcacagccaggatgtgtccatcccccactgcccagctggctggaggagcctgtggattggctacagcttcctgatgcacacagctgctggagatgaaggaggcggccagagcctggtgtccccaggcagctgcctggaggacttccgggccacccccttcattgaatgtaatggaggccggggcacctgccactactatgccaacaagtacagcttctggctgaccaccatccctgagcagagcttccagggcagccccagcgctgacaccctgaaggccggcctcatccgcacccacatcagccgctgccaggtgtgcatgaagaacctgtag

SEQ ID NO: 19113 - DNA, 318 bp, Artificial Sequence
  Description of Artificial Sequence: Synthetic coding sequence
atgggccgggaccagagagctgtggccggccctgccctgcggcgctggctgctgctgggcaccgtgacagtgggcttcctggcccagagcgtgctggccggcgtgaagaagtttgatgtgccctgtggcggccgggactgcagcggcggctgccagtgctacccagagaagggcggccggggccagcccggccctgtgggcccccagggctacaacggccccccaggcctgcagggcttccctggcctgcagggcaggaaaggagacaagggggagcggggggcccctggggtgacaggccccaagggagatgtgtag

SEQ ID NO: 19114 - DNA, 4497 bp, Artificial Sequence
  Description of Artificial Sequence: Synthetic coding sequence
atgtctgccaggacagccccccggccccaggtgctgctgctgcccctgctgctggtgctgctggccgccgccccagctgccagcaagggctgtgtgtgcaaggacaagggccagtgcttctgtgatggagccaagggggagaagggggagaagggcttccctggccccccaggcagccctggccagaagggcttcaccggccctgagggcctgcccggcccccagggccccaagagcttccgggccatccccagctacagcggcggcaagagcctgcagggcatcagcggcctgcccggcttcagcggcagccctggcctgcccggcaccccaggcaacacaggcccctacggcctggtgggcgtgcccggctgcagcggcagcaaaggagagcagggcttccctggcctgcccggcaccctgggctacccaggcatccctggcatccacaacctgaagatcttcaagggggccccagccaaggaggaggacatcgagctggatgccaagggggaccccggcctgcccggggcccctggcccccagggcctgcccggccccccaggcttccctggccctgtgggccccccaggccccccaggcttcttcggcttccctggggccatgggcccccggggccccaagagctttgtgctgagcagccgcatcagcaccaagggggagaagggcgtgaagggcctgactggacctcctggccccccaggcaccgtgattgtgaccctgactggaccagacaacagaacagacctgaagggggagaagggggacaagggggccatgggagagcccggccccccaggccccagcggcctgcctggagagagctatggcagcgagaagggggcccctggggaccccggcctgcagggcaagccaggcaaggatggagtgcccggcttccctggcagcgagggcgtgaagggcaacagaggcttccctggcctgatgggagaagatggcatcaaggaggagaagagagatgtggccatcgtgtccttcagcagcaagacagagtactatgacacctaccaggagaagggagatgagggcaccccaggccccccaggccccaggggggcccggggcccccagggcaagaacaagttccgctgcatccctggcagccagggcagcagccggcccggcctgcggggggcccctggctggccaggcctgaagggcagcaaaggagagcggggccggcctgggaaggatgccatgggcaccccaggcagccctggctgtgccggcagccctggcctgcccggcagccctggccccccaggccccccaggggacatcgtgttcagaaaaggacctcctggggaccacggcctgcccggctacctgggcagccctggcatccctggggtggatggccccaagggggagcccggcctgctgtgcacccagtgcccctacatccctggccccccaggcctgcccggcctgcccggcctgcatggagtgaagggcatccctggccggcagggcgctgctggcctgaagggcagccctggcagccctggcaacacaggcctgcccggcttccctggcttccctggggcccagggcgaccccggcctgaagggggagaagggggagaccctgcagcctgagggccaggtgggcgtgcctggggaccccggcctgcggggccagcccggcaggaagggcctggatggcatccctggcaccccaggagtgaagggcctgcccggccccaagggggagctggccctgtctggagagaagggggaccagggccccccaggggaccccggcagccctggcagccctggccctgctggccctgctggccccccaggctacggcccccagggcgagcccggcctgcagggcacccagggcgtgcctggggcccctggccccccaggagaggccggccccagaggagagctgtctgtgtccacccctgtgcccggccccccaggccccccaggccccccaggccaccctggcccccagggccccccaggcatccctggcagcctgggcaaatgtggggaccccggcctgcccggcccagatggagagcccggcatccctggcatcggcttccctggccccccaggccccaagggggaccagggcttccctggcaccaagggcagcctgggctgccctgggaagatgggagagcccggcctgcccgggaagccaggcctgcccggggccaagggggagcctgctgtggccatgcctgggggccctggcaccccaggcttccctggagagcggggcaacagcggggagcacggggagatcggcctgcccggcctgcccggcctgcccggcaccccaggaaatgaaggcctggatggccccaggggggaccccggccagcccggccccccaggagagcagggccccccaggccgctgcatcgagggccccaggggggcccagggcctgcccggcctgaatggcctgaagggccagcagggcagaagaggcaagacaggccccaagggggaccccggcatccctggcctggacagaagtggcttccctggagaaacaggcagccctggcatccctggccaccagggcgagatgggccccctgggccagaggggctacccaggcaaccctggcatcctgggccccccaggagaagatggagtgattggcatgatgggcttccctggggccatcggccccccaggccccccaggcaaccctggcaccccaggccagaggggcagccctggcatccctggggtgaagggccagaggggcacccctggggccaagggggagcagggcgacaagggcaaccctggccccagcgagatcagccacgtgattggagacaagggggagcccggcctgaagggctttgctggcaaccctggagagaagggcaacagaggagtgcccggcatgcctggcctgaagggcctgaagggcctgcccggccctgctggccccccaggccccaggggggacctgggcagcacaggcaaccctggagagcccggcctgcggggcatccctggctccatgggcaacatgggcatgcctggcagcaagggcaagaggggcaccctgggcttccctggccgggccggccggcccggcctgcccggcatccacggcctgcagggcgacaagggggagcccggctacagcgagggcacccggcccggccccccaggccccaccggggaccccggcctgcccggggacatgggcaagaagggggagatgggccagcccggccccccaggccacctgggccctgctggccctgagggcgcccctggcagccctggcagccctggcctgcccgggaagccaggcccccacggggacctgggcttcaagggcatcaagggcctgctgggccccccaggcatccggggccccccaggcctgcccggcttccctggcagccctggccccatgggcatccggggggaccagggcagagatggcatccctggccctgctggggagaagggggagaccggcctgctgcgggcccctcctggcccccggggcaaccctggggcccagggcgccaagggggacagaggagcccctggcttccctggcctgcccggcaggaagggggccatgggagatgctggcccccggggccccaccggcatcgagggcttccctggccccccaggcctgcccggggccatcatccctggccagacaggcaacagaggccccccaggcagccggggcagccctggggcccctggccccccaggccccccaggcagccacgtgattggcatcaagggggacaagggctccatgggccaccctggccccaagggccccccaggcacagctggggacatgggccccccaggccgcctgggcgcccctggcaccccaggcctgcccggccccaggggggaccccggcttccagggcttccctggggtgaagggggagaagggcaaccctggcttcctgggcagcatcggccccccaggccccatcggccccaagggccccccaggagtgcggggggaccccggcaccctgaagatcatcagcctgcccggcagccctggccccccaggcaccccaggagagcccggcatgcagggcgagcccggccccccaggccccccaggcaacctgggcccctgtggcccccggggcaagccaggcaaggatggcaagccaggcaccccaggccctgctggggagaagggcaacaagggcagcaagggggagcccggccctgctggcagtgatggcctgcccggcctgaagggcaagagaggagacagcggcagccctgccacctggaccacccggggctttgtgttcaccaggcacagccagaccacagccatccccagctgcccagagggcaccgtgcccctgtacagcggcttctccttcctgtttgtgcagggcaaccagagggcccacggccaggacctggatgccctgtttgtgaaggtgctgcggagcccctag

SEQ ID NO: 19115 - DNA, 4914 bp, Artificial Sequence
  Description of Artificial Sequence: Synthetic coding sequence
atgtctgccaggacagccccccggccccaggtgctgctgctgcccctgctgctggtgctgctggccgccgccccagctgccagcaagggctgtgtgtgcaaggacaagggccagtgcttctgtgatggagccaagggggagaagggggagaagggcttccctggccccccaggcagccctggccagaagggcttcaccggccctgagggcctgcccggcccccagggccccaagagcttccgggccatccccagctacagcggcggcaagagcctgcagggcatcagcggcctgcccggcttcagcggcagccctggcctgcccggcaccccaggcaacacaggcccctacggcctggtgggcgtgcccggctgcagcggcagcaaaggagagcagggcttccctggcctgcccggcaccctgggctacccaggcatccctggcatccacaacctgaagatcttcaagggggccccagccaaggaggaggacatcgagctggatgccaagggggaccccggcctgcccggggcccctggcccccagggcctgcccggccccccaggcttccctggccctgtgggccccccaggccccccaggcttcttcggcttccctggggccatgggcccccggggccccaagagctttgtgctgagcagccgcatcagcaccaagggggagaagggcgtgaagggcctgactggacctcctggccccccaggcaccgtgattgtgaccctgactggaccagacaacagaacagacctgaagggggagaagggggacaagggggccatgggagagcccggccccccaggccccagcggcctgcctggagagagctatggcagcgagaagggggcccctggggaccccggcctgcagggcaagccaggcaaggatggagtgcccggcttccctggcagcgagggcgtgaagggcaacagaggcttccctggcctgatgggagaagatggcatcaaggaggagaagagagatgtggccatcgtgtccttcagcagcaagacagagtactatgacacctaccaggagaagggagatgagggcaccccaggccccccaggccccaggggggcccggggcccccagggcaagaacaagttccgctgcatccctggcagccagggcagcagccggcccggcctgcggggggcccctggctggccaggcctgaagggcagcaaaggagagcggggccggcctgggaaggatgccatgggcaccccaggcagccctggctgtgccggcagccctggcctgcccggcagccctggccccccaggccccccaggggacatcgtgttcagaaaaggacctcctggggaccacggcctgcccggctacctgggcagccctggcatccctggggtggatggccccaagggggagcccggcctgctgtgcacccagtgcccctacatccctggccccccaggcctgcccggcctgcccggcctgcatggagtgaagggcatccctggccggcagggcgctgctggcctgaagggcagccctggcagccctggcaacacaggcctgcccggcttccctggcttccctggggcccagggcgaccccggcctgaagggggagaagggggagaccctgcagcctgagggccaggtgggcgtgcctggggaccccggcctgcggggccagcccggcaggaagggcctggatggcatccctggcaccccaggagtgaagggcctgcccggccccaagggggagctggccctgtctggagagaagggggaccagggccccccaggggaccccggcagccctggcagccctggccctgctggccctgctggccccccaggctacggcccccagggcgagcccggcctgcagggcacccagggcgtgcctggggcccctggccccccaggagaggccggccccagaggagagctgtctgtgtccacccctgtgcccggccccccaggccccccaggccccccaggccaccctggcccccagggccccccaggcatccctggcagcctgggcaaatgtggggaccccggcctgcccggcccagatggagagcccggcatccctggcatcggcttccctggccccccaggccccaagggggaccagggcttccctggcaccaagggcagcctgggctgccctgggaagatgggagagcccggcctgcccgggaagccaggcctgcccggggccaagggggagcctgctgtggccatgcctgggggccctggcaccccaggcttccctggagagcggggcaacagcggggagcacggggagatcggcctgcccggcctgcccggcctgcccggcaccccaggaaatgaaggcctggatggccccaggggggaccccggccagcccggccccccaggagagcagggccccccaggccgctgcatcgagggccccaggggggcccagggcctgcccggcctgaatggcctgaagggccagcagggcagaagaggcaagacaggccccaagggggaccccggcatccctggcctggacagaagtggcttccctggagaaacaggcagccctggcatccctggccaccagggcgagatgggccccctgggccagaggggctacccaggcaaccctggcatcctgggccccccaggagaagatggagtgattggcatgatgggcttccctggggccatcggccccccaggccccccaggcaaccctggcaccccaggccagaggggcagccctggcatccctggggtgaagggccagaggggcacccctggggccaagggggagcagggcgacaagggcaaccctggccccagcgagatcagccacgtgattggagacaagggggagcccggcctgaagggctttgctggcaaccctggagagaagggcaacagaggagtgcccggcatgcctggcctgaagggcctgaagggcctgcccggccctgctggccccccaggccccaggggggacctgggcagcacaggcaaccctggagagcccggcctgcggggcatccctggctccatgggcaacatgggcatgcctggcagcaagggcaagaggggcaccctgggcttccctggccgggccggccggcccggcctgcccggcatccacggcctgcagggcgacaagggggagcccggctacagcgagggcacccggcccggccccccaggccccaccggggaccccggcctgcccggggacatgggcaagaagggggagatgggccagcccggccccccaggccacctgggccctgctggccctgagggcgcccctggcagccctggcagccctggcctgcccgggaagccaggcccccacggggacctgggcttcaagggcatcaagggcctgctgggccccccaggcatccggggccccccaggcctgcccggcttccctggcagccctggccccatgggcatccggggggaccagggcagagatggcatccctggccctgctggggagaagggggagaccggcctgctgcgggcccctcctggcccccggggcaaccctggggcccagggcgccaagggggacagaggagcccctggcttccctggcctgcccggcaggaagggggccatgggagatgctggcccccggggccccaccggcatcgagggcttccctggccccccaggcctgcccggggccatcatccctggccagacaggcaacagaggccccccaggcagccggggcagccctggggcccctggccccccaggccccccaggcagccacgtgattggcatcaagggggacaagggctccatgggccaccctggccccaagggccccccaggcacagctggggacatgggccccccaggccgcctgggcgcccctggcaccccaggcctgcccggccccaggggggaccccggcttccagggcttccctggggtgaagggggagaagggcaaccctggcttcctgggcagcatcggccccccaggccccatcggccccaagggccccccaggagtgcggggggaccccggcaccctgaagatcatcagcctgcccggcagccctggccccccaggcaccccaggagagcccggcatgcagggcgagcccggccccccaggccccccaggcaacctgggcccctgtggcccccggggcaagccaggcaaggatggcaagccaggcaccccaggccctgctggggagaagggcaacaagggcagcaagggggagcccggccctgctggcagtgatggcctgcccggcctgaagggcaagagaggagacagcggcagccctgccacctggaccacccggggctttgtgttcaccaggcacagccagaccacagccatccccagctgcccagagggcaccgtgcccctgtacagcggcttctccttcctgtttgtgcagggcaaccagagggcccacggccaggacctgggcaccctgggcagctgcctgcagcgcttcaccaccatgcccttcctgttctgcaatgtgaatgatgtgtgcaactttgccagcagaaatgactacagctactggctgagcaccccagccctgatgcccatgaacatggcccccatcaccggccgggccctggagccctacatcagccgctgcaccgtgtgtgagggccctgccatcgccatcgctgtgcacagccagaccacagacatccccccctgcccccacggctggatcagcctgtggaagggcttctccttcatcatgaaggcctacagcatcaactgtgagagctggggcatcaggaagaacaacaagagcctgtctggagtgcatgaggagaagaccctgaagctgaagaagacagctgagctgctcttcttcatcctgaagaacaaggtgatgacagagcacgctgtgatctag

SEQ ID NO: 19116 - DNA, 4485 bp, Artificial Sequence
  Description of Artificial Sequence: Synthetic coding sequence
atgtctgccaggacagccccccggccccaggtgctgctgctgcccctgctgctggtgctgctggccgccgccccagctgccagcaagggctgtgtgtgcaaggacaagggccagtgcttctgtgatggagccaagggggagaagggggagaagggcttccctggccccccaggcagccctggccagaagggcttcaccggccctgagggcctgcccggcccccagggccccaagagcttccgggccatccccagctacagcggcggcaagagcctgcagggcatcagcggcctgcccggcttcagcggcagccctggcctgcccggcaccccaggcaacacaggcccctacggcctggtgggcgtgcccggctgcagcggcagcaaaggagagcagggcttccctggcctgcccggcaccctgggctacccaggcatccctggcatccacaacctgaagatcttcaagggggccccagccaaggaggaggacatcgagctggatgccaagggggaccccggcctgcccggggcccctggcccccagggcctgcccggccccccaggcttccctggccctgtgggccccccaggccccccaggcttcttcggcttccctggggccatgggcccccggggccccaagagctttgtgctgagcagccgcatcagcaccaagggggagaagggcgtgaagggcctgactggacctcctggccccccaggcaccgtgattgtgaccctgactggaccagacaacagaacagacctgaagggggagaagggggacaagggggccatgggagagcccggccccccaggccccagcggcctgcctggagagagctatggcagcgagaagggggcccctggggaccccggcctgcagggcaagccaggcaaggatggagtgcccggcttccctggcagcgagggcgtgaagggcaacagaggcttccctggcctgatgggagaagatggcatcaaggaggagaagagagatgtggccatcgtgtccttcagcagcaagacagagtactatgacacctaccaggagaagggagatgagggcaccccaggccccccaggccccaggggggcccggggcccccagggcaagaacaagttccgctgcatccctggcagccagggcagcagccggcccggcctgcggggggcccctggctggccaggcctgaagggcagcaaaggagagcggggccggcctgggaaggatgccatgggcaccccaggcagccctggctgtgccggcagccctggcctgcccggcagccctggccccccaggccccccaggggacatcgtgttcagaaaaggacctcctggggaccacggcctgcccggctacctgggcagccctggcatccctggggtggatggccccaagggggagcccggcctgctgtgcacccagtgcccctacatccctggccccccaggcctgcccggcctgcccggcctgcatggagtgaagggcatccctggccggcagggcgctgctggcctgaagggcagccctggcagccctggcaacacaggcctgcccggcttccctggcttccctggggcccagggcgaccccggcctgaagggggagaagggggagaccctgcagcctgagggccaggtgggcgtgcctggggaccccggcctgcggggccagcccggcaggaagggcctggatggcatccctggcaccccaggagtgaagggcctgcccggccccaagggggagctggccctgtctggagagaagggggaccagggccccccaggggaccccggcagccctggcagccctggccctgctggccctgctggccccccaggctacggcccccagggcgagcccggcctgcagggcacccagggcgtgcctggggcccctggccccccaggagaggccggccccagaggagagctgtctgtgtccacccctgtgcccggccccccaggccccccaggccccccaggccaccctggcccccagggccccccaggcatccctggcagcctgggcaaatgtggggaccccggcctgcccggcccagatggagagcccggcatccctggcatcggcttccctggccccccaggccccaagggggaccagggcttccctggcaccaagggcagcctgggctgccctgggaagatgggagagcccggcctgcccgggaagccaggcctgcccggggccaagggggagcctgctgtggccatgcctgggggccctggcaccccaggcttccctggagagcggggcaacagcggggagcacggggagatcggcctgcccggcctgcccggcctgcccggcaccccaggaaatgaaggcctggatggccccaggggggaccccggccagcccggccccccaggagagcagggccccccaggccgctgcatcgagggccccaggggggcccagggcctgcccggcctgaatggcctgaagggccagcagggcagaagaggcaagacaggccccaagggggaccccggcatccctggcctggacagaagtggcttccctggagaaacaggcagccctggcatccctggccaccagggcgagatgggccccctgggccagaggggctacccaggcaaccctggcatcctgggccccccaggagaagatggagtgattggcatgatgggcttccctggggccatcggccccccaggccccccaggcaaccctggcaccccaggccagaggggcagccctggcatccctggggtgaagggccagaggggcacccctggggccaagggggagcagggcgacaagggcaaccctggccccagcgagatcagccacgtgattggagacaagggggagcccggcctgaagggctttgctggcaaccctggagagaagggcaacagaggagtgcccggcatgcctggcctgaagggcctgaagggcctgcccggccctgctggccccccaggccccaggggggacctgggcagcacaggcaaccctggagagcccggcctgcggggcatccctggctccatgggcaacatgggcatgcctggcagcaagggcaagaggggcaccctgggcttccctggccgggccggccggcccggcctgcccggcatccacggcctgcagggcgacaagggggagcccggctacagcgagggcacccggcccggccccccaggccccaccggggaccccggcctgcccggggacatgggcaagaagggggagatgggccagcccggccccccaggccacctgggccctgctggccctgagggcgcccctggcagccctggcagccctggcctgcccgggaagccaggcccccacggggacctgggcttcaagggcatcaagggcctgctgggccccccaggcatccggggccccccaggcctgcccggcttccctggcagccctggccccatgggcatccggggggaccagggcagagatggcatccctggccctgctggggagaagggggagaccggcctgctgcgggcccctcctggcccccggggcaaccctggggcccagggcgccaagggggacagaggagcccctggcttccctggcctgcccggcaggaagggggccatgggagatgctggcccccggggccccaccggcatcgagggcttccctggccccccaggcctgcccggggccatcatccctggccagacaggcaacagaggccccccaggcagccggggcagccctggggcccctggccccccaggccccccaggcagccacgtgattggcatcaagggggacaagggctccatgggccaccctggccccaagggccccccaggcacagctggggacatgggccccccaggccgcctgggcgcccctggcaccccaggcctgcccggccccaggggggaccccggcttccagggcttccctggggtgaagggggagaagggcaaccctggcttcctgggcagcatcggccccccaggccccatcggccccaagggccccccaggagtgcggggggaccccggcaccctgaagatcatcagcctgcccggcagccctggccccccaggcaccccaggagagcccggcatgcagggcgagcccggccccccaggccccccaggcaacctgggcccctgtggcccccggggcaagccaggcaaggatggcaagccaggcaccccaggccctgctggggagaagggcaacaagggcagcaagggggagcccggccctgctggcagtgatggcctgcccggcctgaagggcaagagaggagacagcggcagccctgccacctggaccacccggggctttgtgttcaccaggcacagccagaccacagccatccccagctgcccagagggcaccgtgcccctgtacagcggcttctccttcctgtttgtgcagggcaaccagagggcccacggccaggacctggagagcctcttccaccagctgtag

SEQ ID NO: 19117 - DNA, 4275 bp, Artificial Sequence
  Description of Artificial Sequence: Synthetic coding sequence
atgtctgccaggacagccccccggccccaggtgctgctgctgcccctgctgctggtgctgctggccgccgccccagctgccagcaagggctgtgtgtgcaaggacaagggccagtgcttctgtgatggagccaagggggagaagggggagaagggcttccctggccccccaggcagccctggccagaagggcttcaccggccctgagggcctgcccggcccccagggccccaagagcttccgggccatccccagctacagcggcggcaagagcctgcagggcatcagcggcctgcccggcttcagcggcagccctggcctgcccggcaccccaggcaacacaggcccctacggcctggtgggcgtgcccggctgcagcggcagcaaaggagagcagggcttccctggcctgcccggcaccctgggctacccaggcatccctggcatccacaacctgaagatcttcaagggggccccagccaaggaggaggacatcgagctggatgccaagggggaccccggcctgcccggggcccctggcccccagggcctgcccggccccccaggcttccctggccctgtgggccccccaggccccccaggcttcttcggcttccctggggccatgggcccccggggccccaagagctttgtgctgagcagccgcatcagcaccaagggggagaagggcgtgaagggcctgactggacctcctggccccccaggcaccgtgattgtgaccctgactggaccagacaacagaacagacctgaagggggagaagggggacaagggggccatgggagagcccggccccccaggccccagcggcctgcctggagagagctatggcagcgagaagggggcccctggggaccccggcctgcagggcaagccaggcaaggatggagtgcccggcttccctggcagcgagggcgtgaagggcaacagaggcttccctggcctgatgggagaagatggcatcaaggaggagaagagagatgtggccatcgtgtccttcagcagcaagacagagtactatgacacctaccaggagaagggagatgagggcaccccaggccccccaggccccaggggggcccggggcccccagggcaagaacaagttccgctgcatccctggcagccagggcagcagccggcccggcctgcggggggcccctggctggccaggcctgaagggcagcaaaggagagcggggccggcctgggaaggatgccatgggcaccccaggcagccctggctgtgccggcagccctggcctgcccggcagccctggccccccaggccccccaggggacatcgtgttcagaaaaggacctcctggggaccacggcctgcccggctacctgggcagccctggcatccctggggtggatggccccaagggggagcccggcctgctgtgcacccagtgcccctacatccctggccccccaggcctgcccggcctgcccggcctgcatggagtgaagggcatccctggccggcagggcgctgctggcctgaagggcagccctggcagccctggcaacacaggcctgcccggcttccctggcttccctggggcccagggcgaccccggcctgaagggggagaagggggagaccctgcagcctgagggccaggtgggcgtgcctggggaccccggcctgcggggccagcccggcaggaagggcctggatggcatccctggcaccccaggagtgaagggcctgcccggccccaagggggagctggccctgtctggagagaagggggaccagggccccccaggggaccccggcagccctggcagccctggccctgctggccctgctggccccccaggctacggcccccagggcgagcccggcctgcagggcacccagggcgtgcctggggcccctggccccccaggagaggccggccccagaggagagctgtctgtgtccacccctgtgcccggccccccaggccccccaggccccccaggccaccctggcccccagggccccccaggcatccctggcagcctgggcaaatgtggggaccccggcctgcccggcccagatggagagcccggcatccctggcatcggcttccctggccccccaggccccaagggggaccagggcttccctggcaccaagggcagcctgggctgccctgggaagatgggagagcccggcctgcccgggaagccaggcctgcccggggccaagggggagcctgctgtggccatgcctgggggccctggcaccccaggcttccctggagagcggggcaacagcggggagcacggggagatcggcctgcccggcctgcccggcctgcccggcaccccaggaaatgaaggcctggatggccccaggggggaccccggccagcccggccccccaggagagcagggccccccaggccgctgcatcgagggccccaggggggcccagggcctgcccggcctgaatggcctgaagggccagcagggcagaagaggcaagacaggccccaagggggaccccggcatccctggcctggacagaagtggcttccctggagaaacaggcagccctggcatccctggccaccagggcgagatgggccccctgggccagaggggctacccaggcaaccctggcatcctgggccccccaggagaagatggagtgattggcatgatgggcttccctggggccatcggccccccaggccccccaggcaaccctggcaccccaggccagaggggcagccctggcatccctggggtgaagggccagaggggcacccctggggccaagggggagcagggcgacaagggcaaccctggccccagcgagatcagccacgtgattggagacaagggggagcccggcctgaagggctttgctggcaaccctggagagaagggcaacagaggagtgcccggcatgcctggcctgaagggcctgaagggcctgcccggccctgctggccccccaggccccaggggggacctgggcagcacaggcaaccctggagagcccggcctgcggggcatccctggctccatgggcaacatgggcatgcctggcagcaagggcaagaggggcaccctgggcttccctggccgggccggccggcccggcctgcccggcatccacggcctgcagggcgacaagggggagcccggctacagcgagggcacccggcccggccccccaggccccaccggggaccccggcctgcccggggacatgggcaagaagggggagatgggccagcccggccccccaggccacctgggccctgctggccctgagggcgcccctggcagccctggcagccctggcctgcccgggaagccaggcccccacggggacctgggcttcaagggcatcaagggcctgctgggccccccaggcatccggggccccccaggcctgcccggcttccctggcagccctggccccatgggcatccggggggaccagggcagagatggcatccctggccctgctggggagaagggggagaccggcctgctgcgggcccctcctggcccccggggcaaccctggggcccagggcgccaagggggacagaggagcccctggcttccctggcctgcccggcaggaagggggccatgggagatgctggcccccggggccccaccggcatcgagggcttccctggccccccaggcctgcccggggccatcatccctggccagacaggcaacagaggccccccaggcagccggggcagccctggggcccctggccccccaggccccccaggcagccacgtgattggcatcaagggggacaagggctccatgggccaccctggccccaagggccccccaggcacagctggggacatgggccccccaggccgcctgggcgcccctggcaccccaggcctgcccggccccaggggggaccccggcttccagggcttccctggggtgaagggggagaagggcaaccctggcttcctgggcagcatcggccccccaggccccatcggccccaagggccccccaggagtgcggggggaccccggcaccctgaagatcatcagcctgcccggcagccctggccccccaggcaccccaggagagcccggcatgcagggcgagcccggccccccaggccccccaggcaacctgggcccctgtggcccccggggcaagccaggcaaggatggcaagccaggcaccccaggccctgctggggagaagggcaacaagggcagcaagggggagcctgagagcctcttccaccagctgtag

SEQ ID NO: 19118 - DNA, 5013 bp, Artificial Sequence
  Description of Artificial Sequence: Synthetic coding sequence
atgtctgccaggacagccccccggccccaggtgctgctgctgcccctgctgctggtgctgctggccgccgccccagctgccagcaagggctgtgtgtgcaaggacaagggccagtgcttctgtgatggagccaagggggagaagggggagaagggcttccctggccccccaggcagccctggccagaagggcttcaccggccctgagggcctgcccggcccccagggccccaagggcttccctggcctgcccggcctgaccggcagcaagggcgtgcggggcatcagcggcctgcccggcttcagcggcagccctggcctgcccggcaccccaggcaacacaggcccctacggcctggtgggcgtgcccggctgcagcggcagcaaaggagagcagggcttccctggcctgcccggcaccctgggctacccaggcatccctggagctgctggcctgaagggccagaagggggccccagccaaggaggaggacatcgagctggatgccaagggggaccccggcctgcccggggcccctggcccccagggcctgcccggccccccaggcttccctggccctgtgggccccccaggccccccaggcttcttcggcttccctggggccatgggcccccggggccccaagggccacatgggagagcgggtgattggccacaagggggagcggggcgtgaagggcctgactggacctcctggccccccaggcaccgtgattgtgaccctgactggaccagacaacagaacagacctgaagggggagaagggggacaagggggccatgggagagcccggccccccaggccccagcggcctgcctggagagagctatggcagcgagaagggggcccctggggaccccggcctgcagggcaagccaggcaaggatggagtgcccggcttccctggcagcgagggcgtgaagggcaacagaggcttccctggcctgatgggagaagatggcatcaagggccagaagggggacatcggccccccaggcttccggggccccacagagtactatgacacctaccaggagaagggagatgagggcaccccaggccccccaggccccaggggggcccggggcccccagggccccagcggccccccaggagtgcccggcagccctggcagcagccggcccggcctgcggggggcccctggctggccaggcctgaagggcagcaaaggagagcggggccggcctgggaaggatgccatgggcaccccaggcagccctggctgtgccggcagccctggcctgcccggcagccctggccccccaggccccccaggggacatcgtgttcagaaaaggacctcctggggaccacggcctgcccggctacctgggcagccctggcatccctggggtggatggccccaagggggagcccggcctgctgtgcacccagtgcccctacatccctggccccccaggcctgcccggcctgcccggcctgcatggagtgaagggcatccctggccggcagggcgctgctggcctgaagggcagccctggcagccctggcaacacaggcctgcccggcttccctggcttccctggggcccagggcgaccccggcctgaagggggagaagggggagaccctgcagcctgagggccaggtgggcgtgcctggggaccccggcctgcggggccagcccggcaggaagggcctggatggcatccctggcaccccaggagtgaagggcctgcccggccccaagggggagctggccctgtctggagagaagggggaccagggccccccaggggaccccggcagccctggcagccctggccctgctggccctgctggccccccaggctacggcccccagggcgagcccggcctgcagggcacccagggcgtgcctggggcccctggccccccaggagaggccggccccagaggagagctgtctgtgtccacccctgtgcccggccccccaggccccccaggccccccaggccaccctggcccccagggccccccaggcatccctggcagcctgggcaaatgtggggaccccggcctgcccggcccagatggagagcccggcatccctggcatcggcttccctggccccccaggccccaagggggaccagggcttccctggcaccaagggcagcctgggctgccctgggaagatgggagagcccggcctgcccgggaagccaggcctgcccggggccaagggggagcctgctgtggccatgcctgggggccctggcaccccaggcttccctggagagcggggcaacagcggggagcacggggagatcggcctgcccggcctgcccggcctgcccggcaccccaggaaatgaaggcctggatggccccaggggggaccccggccagcccggccccccaggagagcagggccccccaggccgctgcatcgagggccccaggggggcccagggcctgcccggcctgaatggcctgaagggccagcagggcagaagaggcaagacaggccccaagggggaccccggcatccctggcctggacagaagtggcttccctggagaaacaggcagccctggcatccctggccaccagggcgagatgggccccctgggccagaggggctacccaggcaaccctggcatcctgggccccccaggagaagatggagtgattggcatgatgggcttccctggggccatcggccccccaggccccccaggcaaccctggcaccccaggccagaggggcagccctggcatccctggggtgaagggccagaggggcacccctggggccaagggggagcagggcgacaagggcaaccctggccccagcgagatcagccacgtgattggagacaagggggagcccggcctgaagggctttgctggcaaccctggagagaagggcaacagaggagtgcccggcatgcctggcctgaagggcctgaagggcctgcccggccctgctggccccccaggccccaggggggacctgggcagcacaggcaaccctggagagcccggcctgcggggcatccctggctccatgggcaacatgggcatgcctggcagcaagggcaagaggggcaccctgggcttccctggccgggccggccggcccggcctgcccggcatccacggcctgcagggcgacaagggggagcccggctacagcgagggcacccggcccggccccccaggccccaccggggaccccggcctgcccggggacatgggcaagaagggggagatgggccagcccggccccccaggccacctgggccctgctggccctgagggcgcccctggcagccctggcagccctggcctgcccgggaagccaggcccccacggggacctgggcttcaagggcatcaagggcctgctgggccccccaggcatccggggccccccaggcctgcccggcttccctggcagccctggccccatgggcatccggggggaccagggcagagatggcatccctggccctgctggggagaagggggagaccggcctgctgcgggcccctcctggcccccggggcaaccctggggcccagggcgccaagggggacagaggagcccctggcttccctggcctgcccggcaggaagggggccatgggagatgctggcccccggggccccaccggcatcgagggcttccctggccccccaggcctgcccggggccatcatccctggccagacaggcaacagaggccccccaggcagccggggcagccctggggcccctggccccccaggccccccaggcagccacgtgattggcatcaagggggacaagggctccatgggccaccctggccccaagggccccccaggcacagctggggacatgggccccccaggccgcctgggcgcccctggcaccccaggcctgcccggccccaggggggaccccggcttccagggcttccctggggtgaagggggagaagggcaaccctggcttcctgggcagcatcggccccccaggccccatcggccccaagggccccccaggagtgcggggggaccccggcaccctgaagatcatcagcctgcccggcagccctggccccccaggcaccccaggagagcccggcatgcagggcgagcccggccccccaggccccccaggcaacctgggcccctgtggcccccggggcaagccaggcaaggatggcaagccaggcaccccaggccctgctggggagaagggcaacaagggcagcaagggggagcccggccctgctggcagtgatggcctgcccggcctgaagggcaagagaggagacagcggcagccctgccacctggaccacccggggctttgtgttcaccaggcacagccagaccacagccatccccagctgcccagagggcaccgtgcccctgtacagcggcttctccttcctgtttgtgcagggcaaccagagggcccacggccaggacctgggcaccctgggcagctgcctgcagcgcttcaccaccatgcccttcctgttctgcaatgtgaatgatgtgtgcaactttgccagcagaaatgactacagctactggctgagcaccccagccctgatgcccatgaacatggcccccatcaccggccgggccctggagccctacatcagccgctgcaccgtgtgtgagggccctgccatcgccatcgctgtgcacagccagaccacagacatccccccctgcccccacggctggatcagcctgtggaagggcttctccttcatcatgttcaccagcgctggcagcgagggcaccggccaggccctggccagccctggcagctgcctggaggagttccgggccagccccttcctggagtgccacggccggggcacctgcaactactacagcaacagctacagcttctggctggccagcctgaaccctgagaggatgttcaggaagcccatccccagcacagtgaaggccggggagctggagaagatcatcagccgctgccaggtgtgcatgaagaagaggcactag

SEQ ID NO: 19119 - DNA, 4500 bp, Artificial Sequence
  Description of Artificial Sequence: Synthetic coding sequence
atgatggccaactgggccgaggcccggcccctgctgatcctgattgtgctgctgggccagtttgtgtccatcaaggcccaggaggaggatgaagatgagggctatggagaggagatcgcctgcacccagaatggccagatgtacctgaacagagacatctggaagccagccccctgccagatctgtgtgtgtgacaacggggccatcctgtgtgacaagattgagtgccaggatgtgctggactgtgccgaccctgtgaccccacctggagagtgctgccctgtgtgcagccagacccctgggggcggcaacaccaactttggccggggcaggaagggccagaagggggagcccggcctggtgcctgtggtgacaggcatccggggccggcccggccctgctggccccccaggcagccagggccccagaggagagcggggccccaagggccggcccggcccccggggcccccagggcattgatggagagcccggggtgcccggccagcccggggcccctggccccccaggccaccccagccaccctggcccagatggcctgagccggcccttcagcgcccagatggccggcctggatgagaagagcggcctgggcagccaggtgggcctgatgcctggctctgtgggccctgtgggcccccggggcccccagggcctgcagggccagcagggcggggccggccccaccggccccccaggagagcccggggaccccggccccatgggccccatcggcagccggggccctgagggccccccaggcaagccaggagaagatggagagcctggaagaaatggaaatcctggagaggtgggctttgctggcagccctggggcccggggcttccctggggcccctggcctgcccggcctgaagggccaccggggccacaagggcctggagggccccaagggggaggtgggcgcccctggcagcaagggggaggccggccccaccggccccatgggcgccatgggccccctgggcccccggggcatgcctggagagcggggccgcctgggcccccagggcgcccctggccagagaggagcccacggcatgcctgggaagccaggccccatgggccccctgggcatccctggcagcagcggcttccctggcaaccctggcatgaagggggaggccggccccaccggggcccggggccctgagggcccccagggccagagaggagaaacaggccccccaggccctgtgggcagccctggcctgcccggggccatcggcacagatggcacccctggggccaagggccccaccggcagccctggcaccagcggccccccaggcagcgctggccccccaggcagccctggcccccagggcagcacaggcccccagggcatccggggccagcccggggaccccggggtgcccggcttcaagggggaggccggccccaagggggagcccggcccccacggcatccagggccccatcggccccccaggagaggagggcaagaggggccccaggggggaccccggcaccgtgggccccccaggccctgtgggggagcggggggcccctggcaacagaggcttccctggcagtgatggcctgcccggccccaagggggcccagggcgagcggggccctgtgggcagcagcggccccaagggcagccagggcgaccccggccggcctggagagcccggcctgcccggggcccggggcctgactggaaatcctggggtgcagggccctgagggcaagctgggccccctgggcgcccctggagaagatggccggcccggccccccaggcagcatcggcatccggggccagcccggctccatgggcctgcccggccccaagggcagcagcggggaccccgggaagccaggagaggccggaaatgccggcgtgcccggccagagaggagcccctgggaaggatggagaggtgggccccagcggccctgtgggccccccaggcctggccggggagcggggggagcagggccccccaggccccaccggcttccagggcctgcccggccccccaggccccccaggagagggcggcaagccaggggaccagggcgtgcctggggaccctggagctgtgggccccctgggccccagaggagagcggggcaaccctggagagcggggggagcccggcatcaccggcctgcccggggagaagggcatggccggcggccacggcccagatggccccaagggcagccctggccccagcggcacccctggggacaccggccccccaggcctgcagggcatgcctggagagcggggcattgctggcaccccaggccccaagggggaccggggcggcatcggggagaagggagctgagggcacagctggaaatgatggagcccggggcctgcccggccccctgggccccccaggccctgctggccccaccggggagaagggggagcccggcccccggggcctggtgggccccccaggcagccggggcaaccctggcagcagaggagaaaatggccccaccggggctgtgggctttgctggcccccagggcccagatggccagcccggggtgaagggggagcctggagagcccggccagaagggagatgctggcagccctggcccccagggcctggccggcagccctggcccccacggccccaacggggtgcccggcctgaagggcggccggggcacccagggccccccaggggccaccggcttccctggcagcgctggccgggtgggccccccaggccctgctggggcccctggccctgctggccccctgggggagcccgggaaggagggccccccaggcctgcggggggaccccggcagccacggccgggtgggggaccggggccctgctggccccccaggcggccctggggacaagggggaccctggagaagatggccagcccggcccagatggccccccaggccctgctggcaccaccggccagaggggcatcgtgggcatgcctggccagagaggagagcggggcatgcctggcctgcccggccctgctggcacccctgggaaggtgggccccaccggggccactggagacaagggccccccaggccctgtgggccccccaggcagcaatggacctgtgggggagcccggccctgagggccctgctggaaatgatggcaccccaggaagagatggagctgtgggggagcggggggacagaggagaccccggccctgctggcctgcccggcagccagggcgcccctggcaccccaggccctgtgggcgcccctggagatgctggccagagaggagaccccggcagccggggccccatcggccccccaggccgggccggcaagaggggcctgcccggcccccagggccccaggggggacaagggggaccatggagacagaggagaccggggccagaagggccaccggggcttcaccggcctgcagggcctgcccggccccccaggccccaacggggagcagggcagcgctggcatccctggccccttcggcccccggggccccccaggccctgtgggccccagcggcaaggagggcaaccctggccccctgggccccatcggccccccaggagtgcggggctctgtgggggaggccggccctgagggccccccaggagagcccggccccccaggccccccaggccccccaggccacctgacagctgccctgggggacatcatgggccactatgatgagagcatgccagaccccctgcctgagttcacagaggaccaggccgccccagatgacaagaacaagacagaccccggggtgcacgccaccctgaagagcctgagcagccagatcgagaccatgaggagcccagatggcagcaagaagcacccagcccggacctgtgatgacctgaagctgtgccacagcgccaagcagagcggggagtactggattgaccccaaccagggctctgtggaggatgccatcaaggtgtactgcaacatggagaccggggagacctgcatcagcgccaaccccagctctgtgcccaggaagacctggtgggccagcaagagcccagacaacaagcctgtgtggtacggcctggacatgaacagaggcagccagtttgcctacggggaccaccagagccccaacacagccatcacccagatgaccttcctgcggctgctgagcaaggaggccagccagaacatcacctacatctgcaagaacagcgtgggctacatggatgaccaggccaagaacctgaagaaggctgtggtgctgaagggggccaatgacctggacatcaaggccgagggcaacatccgcttccgctacatcgtgctgcaggacacctgcagcaagagaaatggaaatgtgggcaagacagtgtttgagtaccgcacccagaatgtggcccggctgcccatcatcgacctggcccctgtggatgtgggcggcacagaccaggagtttggagtggagatcggccctgtgtgctttgtgtag

SEQ ID NO: 19120 - DNA, 3420 bp, Artificial Sequence
  Description of Artificial Sequence: Synthetic coding sequence
ctgcccggccgccgccaccggctgggccccccaggcagccagggccccagaggagagcggggccccaagggccggcccggcccccggggcccccagggcattgatggagagcccggggtgcccggccagcccggggcccctggaggagctggccccactggacctcctggagagcccggggaccccggccccatgggccccatcggcagccggggccctgagggccccccaggcaagccaggagaagatggagagcccggcagaaatggaaatcctggagaggtgggctttgctggcagccctggggcccggggcttccctggggcccctggcctgcccggcctgaagggccaccggggccacaagggcctggagggccccaagggggaggtgggcgcccctggcagcaaaggagaggccggccccaccggccccaggggggaccccggcaccgtgggccccccaggccctgtgggggagcggggggcccctggcaacagaggcttccctggcagtgatggcctgcccggccccaagggggcccagggcgagcggggccctgtgggcagcagcggccccaagggcagccagggcgaccccggccggcctggagagcccggcctgcccggggcccggggcctgactggaaatcctggggtgcagggccctgagggcaagctgggccccctgggcgcccctggagaagatggccggcccggccccccaggcagcatcggcatccggggccagcccggctccatgggcctgcccggccccaagggcagcagcggggaccccgggaagccaggagaggccggaaatgccggcgtgcccggccagagaggagcccctgggaaggatggagaggtgggccccagcggccctgtgggccccccaggcctggccggggagcggggggagcagggccccccaggccccaccggcttccagggcctgcccggccccccaggccccccaggagagggcggcaagccaggggaccagggcgtgcctggggaccctggagctgtgggccccctgggccccagaggagagcggggcaaccctggagagcggggggagcccggcatcaccggcctgcccggggagaagggcatggccggcggccacggcccagatggccccaagggcagccctggccccagcggcacccctggggacaccggccccccaggcctgcagggcatgcctggagagcggggcattgctggcaccccaggccccaagggggaccggggcggcatcggggagaagggagctgagggcacagctggaaatgatggagcccggggcctgcccggccccctgggccccccaggccctgctggccccaccggggagaagggggagcccggcccccggggcctggtgggccccccaggcagccggggcaaccctggcagcagaggagaaaatggccccaccggggctgtgggctttgctggcccccagggcccagatggccagcccggggtgaagggggagcctggagagcccggccagaagggagatgctggcagccctggcccccagggcctggccggcagccctggcccccacggccccaacggggtgcccggcctgaagggcggccggggcacccagggccccccaggggccaccggcttccctggcagcgctggccgggtgggccccccaggccctgctggggcccctggccctgctggccccctgggggagcccgggaaggagggccccccaggcctgcggggggaccccggcagccacggccgggtgggggaccggggccctgctggccccccaggcggccctggggacaagggggaccctggagaagatggccagcccggcccagatggccccccaggccctgctggcaccaccggccagaggggcatcgtgggcatgcctggccagagaggagagcggggcatgcctggcctgcccggccctgctggcacccctgggaaggtgggccccaccggggccactggagacaagggccccccaggccctgtgggccccccaggcagcaatggacctgtgggggagcccggccctgagggccctgctggaaatgatggcaccccaggaagagatggagctgtgggggagcggggggacagaggagaccccggccctgctggcctgcccggcagccagggcgcccctggcaccccaggccctgtgggcgcccctggagatgctggccagagaggagaccccggcagccggggccccatcggccccccaggccgggccggcaagaggggcctgcccggcccccagggccccaggggggacaagggggaccatggagacagaggagaccggggccagaagggccaccggggcttcaccggcctgcagggcctgcccggccccccaggccccaacggggagcagggcagcgctggcatccctggccccttcggcccccggggccccccaggccctgtgggccccagcggcaaggagggcaaccctggccccctgggccccatcggccccccaggagtgcggggctctgtgggggaggccggccctgagggccccccaggagagcccggccccccaggccccccaggccccccaggccacctgacagctgccctgggggacatcatgggccactatgatgagagcatgccagaccccctgcctgagttcacagaggaccaggccgccccagatgacaagaacaagacagaccccggggtgcacgccaccctgaagagcctgagcagccagatcgagaccatgaggagcccagatggcagcaagaagcacccagcccggacctgtgatgacctgaagctgtgccacagcgccaagcagagcggggagtactggattgaccccaaccagggctctgtggaggatgccatcaaggtgtactgcaacatggagaccggggagacctgcatcagcgccaaccccagctctgtgcccaggaagacctggtgggccagcaagagcccagacaacaagcctgtgtggtacggcctggacatgaacagaggcagccagtttgcctacggggaccaccagagccccaacacagccatcacccagatgaccttcctgcggctgctgagcaaggaggccagccagaacatcacctacatctgcaagaacagcgtgggctacatggatgaccaggccaagaacctgaagaaggctgtggtgctgaagggggccaatgacctggacatcaaggccgagggcaacatccgcttccgctacatcgtgctgcaggacacctgcagcaagagaaatggaaatgtgggcaagacagtgtttgagtaccgcacccagaatgtggcccggctgcccatcatcgacctggcccctgtggatgtgggcggcacagaccaggagtttggagtggagatcggccctgtgtgctttgtgtag

SEQ ID NO: 19121 - DNA, 5304 bp, Artificial Sequence
  Description of Artificial Sequence: Synthetic coding sequence
atggagccctggagcagccgctggaagaccaagcgctggctgtgggacttcaccgtgaccaccctggccctgaccttcctgttccaggcccgggaggtgcggggggccgcccctgtggatgtgctgaaggccctggacttccacaacagccctgagggcatcagcaagaccaccggcttctgcaccaacaggaagaacagcaagggcagtgacacagcctacagagtgtccaagcaggcccagctgagcgcccccaccaagcagctgtttcctgggggcaccttccctgaggacttcagcatcctcttcaccgtgaagcccaagaagggcatccagagcttcctgctgagcatctacaatgagcacggcatccagcagattggagtggaggtgggccgcagccctgtgttcctgtttgaggaccacacaggcaagccagcccctgaggactaccccctcttcagaacagtgaacattgctgatggcaagtggcaccgggtggccatctctgtggagaagaagacagtgaccatgattgtggactgcaagaagaagaccaccaagcccctggacagaagtgagcgggccatcgtggacaccaacggcatcaccgtgtttggcacccgcatcctggatgaggaggtgtttgaaggagacatccagcagttcctgatcaccggggaccccaaggccgcctatgactactgtgagcactacagcccagactgtgacagcagcgcccccaaggccgcccaggcccaggagccccagattgatgaggccaacatcgtggatgacttccaggagtacaactacggcaccatggagagctaccagacagaggcccccaggcatgtgtctggcaccaatgagcccaaccctgtggaggagatcttcacagaggagtacctgactggagaagattatgacagccagaggaagaacagcgaggacaccctgtatgagaacaaggagattgatggccgggacagcgacctgctggtggatggagacctgggggagtatgacttctatgagtacaaggagtatgaggacaagcccaccagccccccaaatgaggagtttggacctggggtgcctgctgagacagacatcacagagaccagcatcaatggccacggggcctatggagagaagggccagaagggggagcctgctgtggtggagcccggcatgctggtggagggccccccaggccctgctggccctgctggcatcatgggccccccaggcctgcagggccccactggacctcctggggaccccggggaccggggccccccaggccggcccggcctgcctggagcagatggcctgcccggccccccaggcaccatgctgatgctgcccttccgctatggaggagatggcagcaagggccccaccatcagcgcccaggaggcccaggcccaggccatcctgcagcaggcccgcatcgccctgcggggccccccaggccccatgggcctgaccggccggcccggccctgtgggcggccctggcagcagcggggccaagggggagagcggggaccccggcccccagggcccccggggcgtgcagggccccccaggccccaccgggaagccaggcaagaggggccggcctggagcagatggcggccggggcatgcctggagagcccggggccaagggggaccggggctttgatggcctgcccggcctgcccggggacaagggccacagaggagagcggggcccccagggccccccaggccccccaggagatgatggcatgagaggagaagatggagagatcggcccccggggcctgcccggggaggccggcccccggggcctgctgggcccccggggcacccctggggcccctggccagcccggcatggccggcgtggatggccccccaggccccaagggcaacatgggcccccagggcgagcccggccccccaggccagcagggcaaccctggcccccagggcctgcccggcccccagggccccatcggccccccaggagagaagggcccccagggcaagccaggcctggccggcctgcctggagcagatggccccccaggccaccctgggaaggagggccagagcggggagaagggggccctgggccccccaggcccccagggccccatcggctacccaggcccccggggcgtgaagggagcagatggagtgcggggcctgaagggcagcaagggggagaagggagaagatggcttccctggcttcaagggggacatgggcctgaagggggacagaggagaggtgggccagatcggccccagaggagaagatggccctgagggccccaagggccgggccggccccactggagaccccggccccagcggccaggccggggagaagggcaagctgggcgtgcccggcctgcccggctacccaggccggcagggccccaagggcagcacaggcttccctggcttccctggggccaatggagagaagggggcccggggcgtggccggcaagccaggcccccggggccagaggggccccaccggcccccggggcagcagaggagcccggggccccaccgggaagccaggccccaagggcaccagcggaggagatggccccccaggccccccaggagagcggggcccccagggcccccagggccctgtgggcttccctggccccaagggccccccaggccccccaggcaaggatggcctgcccggccaccctggccagagaggagaaacaggcttccagggcaagacaggccccccaggccctgggggcgtggtgggcccccagggccccaccggggagaccggccccatcggggagcggggccaccctggccccccaggccccccaggagagcagggcctgcccggggctgctgggaaggagggcgccaagggggaccccggcccccagggcatcagcggcaaggatggccctgctggcctgcggggcttccctggagagcggggcctgcccggggcccagggcgcccctggcctgaagggcggggagggcccccagggccccccaggccctgtgggcagccctggagagcggggcagcgctggaacagctggccccatcggcctgcccggccggcccggcccccagggccccccaggccctgctggggagaagggggcccctggagagaagggcccccagggccctgctggaagagatggagtgcagggccctgtgggcctgcccggccctgctggccctgctggcagccctggagaagatggagacaagggggagatcggggagcccggccagaagggcagcaaaggagacaagggggagaatggacctcctggccccccaggcctgcagggccctgtgggcgcccctggcattgctggaggagatggagagcccggcccccggggccagcagggcatgtttggccagaagggagatgaaggagcccggggcttccctggccccccaggccccatcggcctgcagggcctgcccggccccccaggagagaagggggagaatggagatgtgggccccatgggccccccaggccccccaggcccccggggcccccagggccccaacggggctgatggcccccagggccccccaggctctgtgggctctgtgggcggcgtgggggagaagggggagcccggggaggccggcaaccctggccccccaggagaggccggcgtgggcggccccaagggggagcggggggagaagggggaggccggccccccaggagctgctggccccccaggggccaagggccccccaggagatgatggccccaagggcaaccctggccctgtgggcttccctggggaccccggccccccaggagagcccggccctgctggccaggatggagtgggcggggacaagggggaggatggagaccccggccagcccggccccccaggccccagcggggaggccggccccccaggccccccaggcaagaggggccccccaggagctgctggagctgagggccggcagggcgagaagggggccaagggggaggccggggctgagggccccccaggcaagacaggccctgtgggcccccagggccctgctgggaagccaggccctgagggcctgcggggcatccctggccctgtgggggagcagggcctgcctggagctgctggccaggacggccccccaggccccatgggccccccaggcctgcccggcctgaagggggaccccggcagcaagggggagaagggccaccctggcctgattggcctcatcggccccccaggagagcagggcgagaagggggaccggggcctgcccggcacccagggcagccctggggccaagggagatggcggcatccctggccctgctggccccctgggccccccaggccccccaggcctgcccggcccccagggccccaagggcaacaagggcagcactggacctgctggccagaagggggacagcggcctgcccggccccccaggcagccctggccccccaggagaggtgatccagcccctgcccatcctgagcagcaagaagacccggcggcacacagagggcatgcaggctgatgctgatgacaacatcctggactacagtgatggcatggaggagatcttcggcagcctgaacagcctgaagcaggacatcgagcacatgaagttccccatgggcacccagaccaacccagcccggacctgcaaggacctgcagctgagccacccagacttcccagatggagagtactggattgaccccaaccagggctgcagcggggacagcttcaaggtgtactgcaacttcaccagcggcggggagacctgcatctacccagacaagaagtctgagggcgtgcgcatcagctcctggcccaaggagaagccaggctcctggttcagcgagttcaagaggggcaagctgctgagctacctggatgtggagggcaacagcatcaacatggtgcagatgaccttcctgaagctgctgacagccagcgcccggcagaacttcacctaccactgccaccagagcgctgcctggtatgatgtgagcagcggcagctatgacaaggccctgcgcttcctgggcagcaatgatgaggagatgtcctatgacaacaaccccttcatcaagaccctgtatgatggctgtgccagcaggaagggctatgagaagacagtgattgagatcaacacccccaagattgaccaggtgcccatcgtggatgtgatgatcaatgactttggagaccagaaccagaagtttggatttgaggtgggccctgtgtgcttcctgggctag

SEQ ID NO: 19122 - DNA, 5457 bp, Artificial Sequence
  Description of Artificial Sequence: Synthetic coding sequence
atggagccctggagcagccgctggaagaccaagcgctggctgtgggacttcaccgtgaccaccctggccctgaccttcctgttccaggcccgggaggtgcggggggccgcccctgtggatgtgctgaaggccctggacttccacaacagccctgagggcatcagcaagaccaccggcttctgcaccaacaggaagaacagcaagggcagtgacacagcctacagagtgtccaagcaggcccagctgagcgcccccaccaagcagctgtttcctgggggcaccttccctgaggacttcagcatcctcttcaccgtgaagcccaagaagggcatccagagcttcctgctgagcatctacaatgagcacggcatccagcagattggagtggaggtgggccgcagccctgtgttcctgtttgaggaccacacaggcaagccagcccctgaggactaccccctcttcagaacagtgaacattgctgatggcaagtggcaccgggtggccatctctgtggagaagaagacagtgaccatgattgtggactgcaagaagaagaccaccaagcccctggacagaagtgagcgggccatcgtggacaccaacggcatcaccgtgtttggcacccgcatcctggatgaggaggtgtttgaaggagacatccagcagttcctgatcaccggggaccccaaggccgcctatgactactgtgagcactacagcccagactgtgacagcagcgcccccaaggccgcccaggcccaggagccccagattgatgagaagaagaagagcaacttcaagaagaagatgaggacagtggccaccaagagcaaggagaagagcaagaagttcaccccacccaagtctgagaagttcagcagcaagaagaagaagagctaccaggccagcgccaaggccaagctgggcgtgaaggccaacatcgtggatgacttccaggagtacaactacggcaccatggagagctaccagacagaggcccccaggcatgtgtctggcaccaatgagcccaaccctgtggaggagatcttcacagaggagtacctgaccggggaggactatgacagccagaggaagaacagcgaggacaccctgtatgagaacaaggagattgatggccgggacagcgacctgctggtggatggagacctgggggagtatgacttctatgagtacaaggagtatgaggacaagcccaccagccccccaaatgaggagtttggacctggggtgcctgctgagacagacatcacagagaccagcatcaatggacatggagcctacggggagaagggccagaagggggagcctgctgtggtggagcccggcatgctggtggagggccccccaggccctgctggccctgctggcatcatgggccccccaggcctgcagggccccaccggccccccaggggaccccggggaccggggccccccaggccggcccggcctgcccggggctgatggcctgcccggccccccaggcaccatgctgatgctgcccttccgctatggaggagatggcagcaagggccccaccatcagcgcccaggaggcccaggcccaggccatcctgcagcaggccagaattgccctgcggggccccccaggccccatgggcctgaccggccggcccggccctgtgggcggccctggcagcagcggggccaagggggagagcggggaccccggcccccagggcccccggggcgtgcagggccccccaggccccaccgggaagccaggcaagaggggccggcctggagcagatggcggccggggcatgcctggagagcccggggccaagggggaccggggctttgatggcctgcccggcctgcccggggacaagggccacagaggagagcggggcccccagggccccccaggccccccaggagatgatggcatgagaggagaagatggagaaattggcccccggggcctgcctggagaggccggcccccggggcctgctgggcccccggggcacccctggggcccctggccagcccggcatggccggcgtggatggccccccaggccccaagggcaacatgggcccccagggcgagcccggccccccaggccagcagggcaaccctggcccccagggcctgcccggcccccagggccccatcggccccccaggagagaagggcccccagggcaagccaggcctggccggcctgcccggggctgatggccccccaggccaccctgggaaggagggccagagcggggagaagggggccctgggccccccaggcccccagggccccatcggctacccaggcccccggggcgtgaagggagcagatggagtgcggggcctgaagggcagcaaaggagagaagggggaggatggcttccctggcttcaagggggacatgggcctgaagggggacagaggagaggtgggccagatcggccccagaggagaagatggccctgagggccccaagggccgggccggccccaccggggaccccggccccagcggccaggccggggagaagggcaagctgggcgtgcccggcctgcccggctacccaggccggcagggccccaagggcagcacaggcttccctggcttccctggggccaacggggagaagggggcccggggcgtggccggcaagccaggcccccggggccagaggggccccaccggcccccggggcagcagaggagcccggggccccaccgggaagccaggccccaagggcaccagcggaggagatggccccccaggccccccaggagagcggggcccccagggcccccagggccctgtgggcttccctggccccaagggccccccaggccccccaggcaaggatggcctgcccggccaccctggccagagaggagagaccggcttccagggcaagacaggccccccaggccctggaggagtggtgggcccccagggccccactggagagaccggccccatcggggagcggggccaccctggccccccaggccccccaggagagcagggcctgcctggagctgctgggaaggagggcgccaagggggaccccggcccccagggcatcagcggcaaggatggccctgctggcctgcggggcttccctggagagcggggcctgcccggggcccagggcgcccctggcctgaagggcggggagggcccccagggccccccaggccctgtgggcagccctggagagcggggcagcgctggaacagctggccccatcggcctgcccggccggcccggcccccagggccccccaggccctgctggggagaagggggcccctggagagaagggcccccagggccctgctggaagagatggagtgcagggccctgtgggcctgcccggccctgctggccctgctggcagccctggagaagatggagacaagggggagattggagagcccggccagaagggcagcaagggggacaagggagaaaatggccccccaggccccccaggcctgcagggccctgtgggcgcccctggcattgctggaggagatggagagcccggcccccggggccagcagggcatgtttggccagaagggagatgagggcgcccggggcttccctggccccccaggccccatcggcctgcagggcctgcccggccccccaggagagaagggagaaaatggagatgtgggccccatgggccccccaggccccccaggcccccggggcccccagggccccaatggagcagatggcccccagggccccccaggctctgtgggctctgtgggcggcgtgggggagaagggggagcctggagaggccggcaaccctggccccccaggagaggccggcgtgggcggccccaagggggagcggggggagaagggggaggccggccccccaggagctgctggccccccaggggccaagggccccccaggagatgatggccccaagggcaaccctggccctgtgggcttccctggggaccccggccccccaggagagcccggccctgctggccaggatggagtgggcggggacaagggagaagatggagaccccggccagcccggccccccaggccccagcggggaggccggccccccaggccccccaggcaagaggggccccccaggagctgctggagctgagggccggcagggcgagaagggggccaagggggaggccggggctgagggccccccaggcaagacaggccctgtgggcccccagggccctgctgggaagccaggccctgagggcctgcggggcatccctggccctgtgggggagcagggcctgcccggggctgctggccaggacggccccccaggccccatgggccccccaggcctgcccggcctgaagggggaccccggcagcaaaggagagaagggccaccctggcctcatcggcctgattggccccccaggagagcagggcgagaagggggaccggggcctgcccggcacccagggcagccctggggccaagggagatggcggcatccctggccctgctggccccctgggccccccaggccccccaggcctgcccggcccccagggccccaagggcaacaagggcagcacaggccctgctggccagaagggggacagcggcctgcccggccccccaggcagccctggccccccaggagaggtgatccagcccctgcccatcctgagcagcaagaagaccaggaggcacacagagggcatgcaggctgatgctgatgacaacatcctggactacagtgatggcatggaggagatcttcggcagcctgaacagcctgaagcaggacatcgagcacatgaagttccccatgggcacccagaccaacccagcccggacctgcaaggacctgcagctgagccacccagacttcccagatggagagtactggattgaccccaaccagggctgcagcggggacagcttcaaggtgtactgcaacttcaccagcggcggggagacctgcatctacccagacaagaagtcagaaggagtgcgcatcagctcctggcccaaggagaagccaggctcctggttcagcgagttcaagaggggcaagctgctgagctacctggatgtggagggcaacagcatcaacatggtgcagatgaccttcctgaagctgctgacagccagcgcccggcagaacttcacctaccactgccaccagagcgctgcctggtatgatgtgagcagcggcagctatgacaaggccctgcgcttcctgggcagcaatgatgaggagatgtcctatgacaacaaccccttcatcaagaccctgtatgatggctgtgccagcaggaagggctatgagaagacagtcatcgagatcaacacccccaagattgaccaggtgcccatcgtggatgtgatgatcaatgactttggagaccagaaccagaagtttggatttgaggtgggccctgtgtgcttcctgggctag

SEQ ID NO: 19123 - DNA, 3081 bp, Artificial Sequence
  Description of Artificial Sequence: Synthetic coding sequence
atggtgtctgaggtgtcccgggacctgaaggtgaagcgggagaagctggtgaagctggcccaggagggcaagatggccctgaaggaccccaaggtggagcaggcccagctggagacccaggtgctgcaggtgaagcaggagaagcgggagaacctggagttccaggactaccaggacatccaggaggacaaggtgcagaggatcagtgatgtgattggcagcacaggcttccctggcttccctggggccaacggggagaagggggcccggggcgtggccggcaagccaggcccccggggccagaggggccccaccggcccccggggcagcagaggagcccggggccccaccgggaagccaggccccaagggcaccagcggaggagatggccccccaggccccccaggagagcggggcccccagggcccccagggccctgtgggcttccctggccccaagggccccccaggccccccaggcaaggatggcctgcccggccaccctggccagagaggagagaccggcttccagggcaagacaggccccccaggccctggaggagtggtgggcccccagggccccactggagagaccggccccatcggggagcggggccaccctggccccccaggccccccaggagagcagggcctgcctggagctgctgggaaggagggcgccaagggggaccccggcccccagggcatcagcggcaaggatggccctgctggcctgcggggcttccctggagagcggggcctgcccggggcccagggcgcccctggcctgaagggcggggagggcccccagggccccccaggccctgtgggcagccctggagagcggggcagcgctggaacagctggccccatcggcctgcccggccggcccggcccccagggccccccaggccctgctggggagaagggggcccctggagagaagggcccccagggccctgctggaagagatggagtgcagggccctgtgggcctgcccggccctgctggccctgctggcagccctggagaagatggagacaagggggagattggagagcccggccagaagggcagcaagggggacaagggagaaaatggccccccaggccccccaggcctgcagggccctgtgggcgcccctggcattgctggaggagatggagagcccggcccccggggccagcagggcatgtttggccagaagggagatgagggcgcccggggcttccctggccccccaggccccatcggcctgcagggcctgcccggccccccaggagagaagggagaaaatggagatgtgggccccatgggccccccaggccccccaggcccccggggcccccagggccccaatggagcagatggcccccagggccccccaggctctgtgggctctgtgggcggcgtgggggagaagggggagcctggagaggccggcaaccctggccccccaggagaggccggcgtgggcggccccaagggggagcggggggagaagggggaggccggccccccaggagctgctggccccccaggggccaagggccccccaggagatgatggccccaagggcaaccctggccctgtgggcttccctggggaccccggccccccaggagagcccggccctgctggccaggatggagtgggcggggacaagggagaagatggagaccccggccagcccggccccccaggccccagcggggaggccggccccccaggccccccaggcaagaggggccccccaggagctgctggagctgagggccggcagggcgagaagggggccaagggggaggccggggctgagggccccccaggcaagacaggccctgtgggcccccagggccctgctgggaagccaggccctgagggcctgcggggcatccctggccctgtgggggagcagggcctgcccggggctgctggccaggacggccccccaggccccatgggccccccaggcctgcccggcctgaagggggaccccggcagcaaaggagagaagggccaccctggcctcatcggcctgattggccccccaggagagcagggcgagaagggggaccggggcctgcccggcacccagggcagccctggggccaagggagatggcggcatccctggccctgctggccccctgggccccccaggccccccaggcctgcccggcccccagggccccaagggcaacaagggcagcacaggccctgctggccagaagggggacagcggcctgcccggccccccaggcagccctggccccccaggagaggtgatccagcccctgcccatcctgagcagcaagaagaccaggaggcacacagagggcatgcaggctgatgctgatgacaacatcctggactacagtgatggcatggaggagatcttcggcagcctgaacagcctgaagcaggacatcgagcacatgaagttccccatgggcacccagaccaacccagcccggacctgcaaggacctgcagctgagccacccagacttcccagatggagagtactggattgaccccaaccagggctgcagcggggacagcttcaaggtgtactgcaacttcaccagcggcggggagacctgcatctacccagacaagaagtcagaaggagtgcgcatcagctcctggcccaaggagaagccaggctcctggttcagcgagttcaagaggggcaagctgctgagctacctggatgtggagggcaacagcatcaacatggtgcagatgaccttcctgaagctgctgacagccagcgcccggcagaacttcacctaccactgccaccagagcgctgcctggtatgatgtgagcagcggcagctatgacaaggccctgcgcttcctgggcagcaatgatgaggagatgtcctatgacaacaaccccttcatcaagaccctgtatgatggctgtgccagcaggaagggctatgagaagacagtcatcgagatcaacacccccaagattgaccaggtgcccatcgtggatgtgatgatcaatgactttggagaccagaaccagaagtttggatttgaggtgggccctgtgtgcttcctgggctag

SEQ ID NO: 19124 - DNA, 5421 bp, Artificial Sequence
  Description of Artificial Sequence: Synthetic coding sequence
atggagccctggagcagccgctggaagaccaagcgctggctgtgggacttcaccgtgaccaccctggccctgaccttcctgttccaggcccgggaggtgcggggggccgcccctgtggatgtgctgaaggccctggacttccacaacagccctgagggcatcagcaagaccaccggcttctgcaccaacaggaagaacagcaagggcagtgacacagcctacagagtgtccaagcaggcccagctgagcgcccccaccaagcagctgtttcctgggggcaccttccctgaggacttcagcatcctcttcaccgtgaagcccaagaagggcatccagagcttcctgctgagcatctacaatgagcacggcatccagcagattggagtggaggtgggccgcagccctgtgttcctgtttgaggaccacacaggcaagccagcccctgaggactaccccctcttcagaacagtgaacattgctgatggcaagtggcaccgggtggccatctctgtggagaagaagacagtgaccatgattgtggactgcaagaagaagaccaccaagcccctggacagaagtgagcgggccatcgtggacaccaacggcatcaccgtgtttggcacccgcatcctggatgaggaggtgtttgaaggagacatccagcagttcctgatcaccggggaccccaaggccgcctatgactactgtgagcactacagcccagactgtgacagcagcgcccccaaggccgcccaggcccaggagccccagattgatgaatatgcccctgaggacatcattgaatatgactatgaatatggagaggccgagtacaaggaggccgagagcgtgacagagggccccaccgtgacagaggagaccatcgcccagacagaggccaacatcgtggatgacttccaggagtacaactacggcaccatggagagctaccagacagaggcccccaggcatgtgtctggcaccaatgagcccaaccctgtggaggagatcttcacagaggagtacctgaccggggaggactatgacagccagaggaagaacagcgaggacaccctgtatgagaacaaggagattgatggccgggacagcgacctgctggtggatggagacctgggggagtatgacttctatgagtacaaggagtatgaggacaagcccaccagccccccaaatgaggagtttggacctggggtgcctgctgagacagacatcacagagaccagcatcaatggacatggagcctacggggagaagggccagaagggggagcctgctgtggtggagcccggcatgctggtggagggccccccaggccctgctggccctgctggcatcatgggccccccaggcctgcagggccccaccggccccccaggggaccccggggaccggggccccccaggccggcccggcctgcccggggctgatggcctgcccggccccccaggcaccatgctgatgctgcccttccgctatggaggagatggcagcaagggccccaccatcagcgcccaggaggcccaggcccaggccatcctgcagcaggccagaattgccctgcggggccccccaggccccatgggcctgaccggccggcccggccctgtgggcggccctggcagcagcggggccaagggggagagcggggaccccggcccccagggcccccggggcgtgcagggccccccaggccccaccgggaagccaggcaagaggggccggcctggagcagatggcggccggggcatgcctggagagcccggggccaagggggaccggggctttgatggcctgcccggcctgcccggggacaagggccacagaggagagcggggcccccagggccccccaggccccccaggagatgatggcatgagaggagaagatggagaaattggcccccggggcctgcctggagaggccggcccccggggcctgctgggcccccggggcacccctggggcccctggccagcccggcatggccggcgtggatggccccccaggccccaagggcaacatgggcccccagggcgagcccggccccccaggccagcagggcaaccctggcccccagggcctgcccggcccccagggccccatcggccccccaggagagaagggcccccagggcaagccaggcctggccggcctgcccggggctgatggccccccaggccaccctgggaaggagggccagagcggggagaagggggccctgggccccccaggcccccagggccccatcggctacccaggcccccggggcgtgaagggagcagatggagtgcggggcctgaagggcagcaaaggagagaagggggaggatggcttccctggcttcaagggggacatgggcctgaagggggacagaggagaggtgggccagatcggccccagaggagaagatggccctgagggccccaagggccgggccggccccaccggggaccccggccccagcggccaggccggggagaagggcaagctgggcgtgcccggcctgcccggctacccaggccggcagggccccaagggcagcacaggcttccctggcttccctggggccaacggggagaagggggcccggggcgtggccggcaagccaggcccccggggccagaggggccccaccggcccccggggcagcagaggagcccggggccccaccgggaagccaggccccaagggcaccagcggaggagatggccccccaggccccccaggagagcggggcccccagggcccccagggccctgtgggcttccctggccccaagggccccccaggccccccaggcaaggatggcctgcccggccaccctggccagagaggagagaccggcttccagggcaagacaggccccccaggccctggaggagtggtgggcccccagggccccactggagagaccggccccatcggggagcggggccaccctggccccccaggccccccaggagagcagggcctgcctggagctgctgggaaggagggcgccaagggggaccccggcccccagggcatcagcggcaaggatggccctgctggcctgcggggcttccctggagagcggggcctgcccggggcccagggcgcccctggcctgaagggcggggagggcccccagggccccccaggccctgtgggcagccctggagagcggggcagcgctggaacagctggccccatcggcctgcccggccggcccggcccccagggccccccaggccctgctggggagaagggggcccctggagagaagggcccccagggccctgctggaagagatggagtgcagggccctgtgggcctgcccggccctgctggccctgctggcagccctggagaagatggagacaagggggagattggagagcccggccagaagggcagcaagggggacaagggagaaaatggccccccaggccccccaggcctgcagggccctgtgggcgcccctggcattgctggaggagatggagagcccggcccccggggccagcagggcatgtttggccagaagggagatgagggcgcccggggcttccctggccccccaggccccatcggcctgcagggcctgcccggccccccaggagagaagggagaaaatggagatgtgggccccatgggccccccaggccccccaggcccccggggcccccagggccccaatggagcagatggcccccagggccccccaggctctgtgggctctgtgggcggcgtgggggagaagggggagcctggagaggccggcaaccctggccccccaggagaggccggcgtgggcggccccaagggggagcggggggagaagggggaggccggccccccaggagctgctggccccccaggggccaagggccccccaggagatgatggccccaagggcaaccctggccctgtgggcttccctggggaccccggccccccaggagagcccggccctgctggccaggatggagtgggcggggacaagggagaagatggagaccccggccagcccggccccccaggccccagcggggaggccggccccccaggccccccaggcaagaggggccccccaggagctgctggagctgagggccggcagggcgagaagggggccaagggggaggccggggctgagggccccccaggcaagacaggccctgtgggcccccagggccctgctgggaagccaggccctgagggcctgcggggcatccctggccctgtgggggagcagggcctgcccggggctgctggccaggacggccccccaggccccatgggccccccaggcctgcccggcctgaagggggaccccggcagcaaaggagagaagggccaccctggcctcatcggcctgattggccccccaggagagcagggcgagaagggggaccggggcctgcccggcacccagggcagccctggggccaagggagatggcggcatccctggccctgctggccccctgggccccccaggccccccaggcctgcccggcccccagggccccaagggcaacaagggcagcacaggccctgctggccagaagggggacagcggcctgcccggccccccaggcagccctggccccccaggagaggtgatccagcccctgcccatcctgagcagcaagaagaccaggaggcacacagagggcatgcaggctgatgctgatgacaacatcctggactacagtgatggcatggaggagatcttcggcagcctgaacagcctgaagcaggacatcgagcacatgaagttccccatgggcacccagaccaacccagcccggacctgcaaggacctgcagctgagccacccagacttcccagatggagagtactggattgaccccaaccagggctgcagcggggacagcttcaaggtgtactgcaacttcaccagcggcggggagacctgcatctacccagacaagaagtcagaaggagtgcgcatcagctcctggcccaaggagaagccaggctcctggttcagcgagttcaagaggggcaagctgctgagctacctggatgtggagggcaacagcatcaacatggtgcagatgaccttcctgaagctgctgacagccagcgcccggcagaacttcacctaccactgccaccagagcgctgcctggtatgatgtgagcagcggcagctatgacaaggccctgcgcttcctgggcagcaatgatgaggagatgtcctatgacaacaaccccttcatcaagaccctgtatgatggctgtgccagcaggaagggctatgagaagacagtcatcgagatcaacacccccaagattgaccaggtgcccatcgtggatgtgatgatcaatgactttggagaccagaaccagaagtttggatttgaggtgggccctgtgtgcttcctgggctag

SEQ ID NO: 19125 - DNA, 5073 bp, Artificial Sequence
  Description of Artificial Sequence: Synthetic coding sequence
atggagccctggagcagccgctggaagaccaagcgctggctgtgggacttcaccgtgaccaccctggccctgaccttcctgttccaggcccgggaggtgcggggggccgcccctgtggatgtgctgaaggccctggacttccacaacagccctgagggcatcagcaagaccaccggcttctgcaccaacaggaagaacagcaagggcagtgacacagcctacagagtgtccaagcaggcccagctgagcgcccccaccaagcagctgtttcctgggggcaccttccctgaggacttcagcatcctcttcaccgtgaagcccaagaagggcatccagagcttcctgctgagcatctacaatgagcacggcatccagcagattggagtggaggtgggccgcagccctgtgttcctgtttgaggaccacacaggcaagccagcccctgaggactaccccctcttcagaacagtgaacattgctgatggcaagtggcaccgggtggccatctctgtggagaagaagacagtgaccatgattgtggactgcaagaagaagaccaccaagcccctggacagaagtgagcgggccatcgtggacaccaacggcatcaccgtgtttggcacccgcatcctggatgaggaggtgtttgaaggagacatccagcagttcctgatcaccggggaccccaaggccgcctatgactactgtgagcactacagcccagactgtgacagcagcgcccccaaggccgcccaggcccaggagccccagattgatgaatatgcccctgaggacatcattgaatatgactatgaatatggagaggccgagtacaaggaggccgagagcgtgacagagggccccaccgtgacagaggagaccatcgcccagacagagatcaatggacatggagcctacggggagaagggccagaagggggagcctgctgtggtggagcccggcatgctggtggagggccccccaggccctgctggccctgctggcatcatgggccccccaggcctgcagggccccaccggccccccaggggaccccggggaccggggccccccaggccggcccggcctgcccggggctgatggcctgcccggccccccaggcaccatgctgatgctgcccttccgctatggaggagatggcagcaagggccccaccatcagcgcccaggaggcccaggcccaggccatcctgcagcaggccagaattgccctgcggggccccccaggccccatgggcctgaccggccggcccggccctgtgggcggccctggcagcagcggggccaagggggagagcggggaccccggcccccagggcccccggggcgtgcagggccccccaggccccaccgggaagccaggcaagaggggccggcctggagcagatggcggccggggcatgcctggagagcccggggccaagggggaccggggctttgatggcctgcccggcctgcccggggacaagggccacagaggagagcggggcccccagggccccccaggccccccaggagatgatggcatgagaggagaagatggagaaattggcccccggggcctgcctggagaggccggcccccggggcctgctgggcccccggggcacccctggggcccctggccagcccggcatggccggcgtggatggccccccaggccccaagggcaacatgggcccccagggcgagcccggccccccaggccagcagggcaaccctggcccccagggcctgcccggcccccagggccccatcggccccccaggagagaagggcccccagggcaagccaggcctggccggcctgcccggggctgatggccccccaggccaccctgggaaggagggccagagcggggagaagggggccctgggccccccaggcccccagggccccatcggctacccaggcccccggggcgtgaagggagcagatggagtgcggggcctgaagggcagcaaaggagagaagggggaggatggcttccctggcttcaagggggacatgggcctgaagggggacagaggagaggtgggccagatcggccccagaggagaagatggccctgagggccccaagggccgggccggccccaccggggaccccggccccagcggccaggccggggagaagggcaagctgggcgtgcccggcctgcccggctacccaggccggcagggccccaagggcagcacaggcttccctggcttccctggggccaacggggagaagggggcccggggcgtggccggcaagccaggcccccggggccagaggggccccaccggcccccggggcagcagaggagcccggggccccaccgggaagccaggccccaagggcaccagcggaggagatggccccccaggccccccaggagagcggggcccccagggcccccagggccctgtgggcttccctggccccaagggccccccaggccccccaggcaaggatggcctgcccggccaccctggccagagaggagagaccggcttccagggcaagacaggccccccaggccctggaggagtggtgggcccccagggccccactggagagaccggccccatcggggagcggggccaccctggccccccaggccccccaggagagcagggcctgcctggagctgctgggaaggagggcgccaagggggaccccggcccccagggcatcagcggcaaggatggccctgctggcctgcggggcttccctggagagcggggcctgcccggggcccagggcgcccctggcctgaagggcggggagggcccccagggccccccaggccctgtgggcagccctggagagcggggcagcgctggaacagctggccccatcggcctgcccggccggcccggcccccagggccccccaggccctgctggggagaagggggcccctggagagaagggcccccagggccctgctggaagagatggagtgcagggccctgtgggcctgcccggccctgctggccctgctggcagccctggagaagatggagacaagggggagattggagagcccggccagaagggcagcaagggggacaagggagaaaatggccccccaggccccccaggcctgcagggccctgtgggcgcccctggcattgctggaggagatggagagcccggcccccggggccagcagggcatgtttggccagaagggagatgagggcgcccggggcttccctggccccccaggccccatcggcctgcagggcctgcccggccccccaggagagaagggagaaaatggagatgtgggccccatgggccccccaggccccccaggcccccggggcccccagggccccaatggagcagatggcccccagggccccccaggctctgtgggctctgtgggcggcgtgggggagaagggggagcctggagaggccggcaaccctggccccccaggagaggccggcgtgggcggccccaagggggagcggggggagaagggggaggccggccccccaggagctgctggccccccaggggccaagggccccccaggagatgatggccccaagggcaaccctggccctgtgggcttccctggggaccccggccccccaggagagcccggccctgctggccaggatggagtgggcggggacaagggagaagatggagaccccggccagcccggccccccaggccccagcggggaggccggccccccaggccccccaggcaagaggggccccccaggagctgctggagctgagggccggcagggcgagaagggggccaagggggaggccggggctgagggccccccaggcaagacaggccctgtgggcccccagggccctgctgggaagccaggccctgagggcctgcggggcatccctggccctgtgggggagcagggcctgcccggggctgctggccaggacggccccccaggccccatgggccccccaggcctgcccggcctgaagggggaccccggcagcaaaggagagaagggccaccctggcctcatcggcctgattggccccccaggagagcagggcgagaagggggaccggggcctgcccggcacccagggcagccctggggccaagggagatggcggcatccctggccctgctggccccctgggccccccaggccccccaggcctgcccggcccccagggccccaagggcaacaagggcagcacaggccctgctggccagaagggggacagcggcctgcccggccccccaggcagccctggccccccaggagaggtgatccagcccctgcccatcctgagcagcaagaagaccaggaggcacacagagggcatgcaggctgatgctgatgacaacatcctggactacagtgatggcatggaggagatcttcggcagcctgaacagcctgaagcaggacatcgagcacatgaagttccccatgggcacccagaccaacccagcccggacctgcaaggacctgcagctgagccacccagacttcccagatggagagtactggattgaccccaaccagggctgcagcggggacagcttcaaggtgtactgcaacttcaccagcggcggggagacctgcatctacccagacaagaagtcagaaggagtgcgcatcagctcctggcccaaggagaagccaggctcctggttcagcgagttcaagaggggcaagctgctgagctacctggatgtggagggcaacagcatcaacatggtgcagatgaccttcctgaagctgctgacagccagcgcccggcagaacttcacctaccactgccaccagagcgctgcctggtatgatgtgagcagcggcagctatgacaaggccctgcgcttcctgggcagcaatgatgaggagatgtcctatgacaacaaccccttcatcaagaccctgtatgatggctgtgccagcaggaagggctatgagaagacagtcatcgagatcaacacccccaagattgaccaggtgcccatcgtggatgtgatgatcaatgactttggagaccagaaccagaagtttggatttgaggtgggccctgtgtgcttcctgggctag

SEQ ID NO: 19126 - DNA, 4560 bp, Artificial Sequence
  Description of Artificial Sequence: Synthetic coding sequence
atggccccctacccctgtggctgccacatcctgctgctgctcttctgctgcctggccgccgcccgggccaacctgctgaacctgaactggctgtggttcaacaatgaagacaccagccatgctgccaccaccatccctgagccccagggccccctgcctgtgcagcccacagctgacaccaccacccacgtgaccccaagaaatggcagcacagagcccgccacagcccctggcagccctgagccccccagcgagctgctggaggatggccaggacacccccaccagcgctgagagcccagatgccccagaagaaaatattgctggggtgggcgctgagatcctgaatgtggccaagggcatccgcagctttgtgcagctgtggaatgacacagtgcccacagagagcctggcccgggcagagaccctggtgctggagacccctgtgggccccctggccctggccggccccagcagcaccccccaggagaatggcaccaccctgtggcccagccggggcatccccagcagccctggggcccacaccacagaagctggcaccctgcctgcccccacccccagcccccccagcctgggccggccctgggcccccctgaccggccccagcgtgcccccacccagcagcgagcgcatcagcgaggaggtgggcctgctgcagctgctgggggaccccccaccccagcaggtgacccagacagatgatcctgatgtgggcctggcctacgtgtttggaccagatgccaacagcggccaggtggcccgctaccacttccccagcctcttcttccgggacttcagcctgctcttccacatccggcctgccacagagggccctggggtgctgtttgccatcacagacagcgcccaggccatggtgctgctgggcgtgaagctgagcggcgtgcaggacggccaccaggacatcagcctgctgtacacagagcccggggccggccagacccacacagctgccagcttccggctgcctgcctttgtgggccagtggacccacctggccctgtctgtggccggcggctttgtggccctgtatgtggactgtgaggagttccagaggatgcccctggcccggagcagccggggcctggagctggagcctggagctggcctgtttgtggcccaggccggcggcgctgaccctgacaagttccagggcgtgattgctgagctgaaggtgcggcgggacccccaggtgagccccatgcactgcctggatgaggagggagatgacagtgatggagccagcggggacagcggcagcggcctgggagatgcccgggagctgctgcgggaggagaccggggccgccctgaagccccggctgcctgcccctcctcctgtgaccaccccacccctggccggcggcagcagcacagaggacagccgctctgaggaggtggaggagcagaccaccgtggccagcctgggcgcccagaccctgcccggcagtgacagcgtgtccacctgggatggctctgtgaggaccccaggcggccgggtgaaggagggcggcctgaagggccagaagggggagcccggggtgcccggccccccaggccgggccggccccccaggcagcccctgcctgcccggccccccaggcctgccctgccctgtgagccccctgggccctgctggccctgccctgcagacagtgcccggcccccagggccccccaggccccccaggaagagatggcaccccaggaagagatggagagcccggggaccccggggaggatggcaagccaggggacaccggcccccagggcttccctggcaccccaggagatgtgggccccaagggggacaagggggaccccggggtgggggagcggggccccccaggcccccagggccccccaggccccccaggccccagcttcagacatgacaagctgaccttcatcgacatggagggcagcggctttggaggagacctggaggccctgcggggcccccggggcttccctggccccccaggccccccaggagtgcccggcctgcccggggagcccggccgcttcggcgtgaacagcagtgatgtgcccggccctgctggcctgcccggggtgcccggccgggagggccccccaggcttccctggcctgcccggccccccaggccccccaggccgggagggccccccaggccgcacaggccagaagggcagcctgggggaggccggggcccctggccacaagggcagcaagggggcccctggccctgctggggcccggggggagagcggcctggccggggcccctggccctgctggccccccaggccccccaggccccccaggccccccaggccctggcctgcctgctggctttgatgacatggagggcagcggcggccccttctggagcacagcccggtctgcagatggcccccagggccccccaggcctgcccggcctgaagggggaccccggggtgcccggcctgcccggggccaagggggaggtgggcgcagatggagtgcccggcttccctggcctgcccggccgggagggcattgctggcccccagggccccaagggggaccggggcagcagaggagagaagggggaccccgggaaggatggagtgggccagcccggcctgcccggccccccaggccccccaggccctgtggtgtatgtgtctgagcaggacggctctgtgctgtctgtgcccggccctgagggccggcccggctttgctggcttccctggccctgctggccccaagggcaacctgggcagcaagggggagcggggcagccctggccccaagggggagaagggggagcccggcagcatcttctccccagatggaggagccctgggccctgcccagaagggggccaagggggagcccggcttccggggccccccaggcccctacggccggcccggctacaagggggagatcggcttccctggccggcccggccggcccggcatgaatggcctgaagggggagaagggggagcctggagatgccagcctgggcttcggcatgaggggcatgcctggccccccaggccccccaggccccccaggccccccaggcacccctgtgtatgacagcaatgtgtttgctgagagcagcaggcctggccccccaggcctgcccggcaaccagggccccccaggccccaagggggccaagggggaggtgggccccccaggccccccaggccagttcccctttgacttcctgcagctggaggccgagatgaagggggagaagggggacagaggagatgctggccagaagggggagcggggggagcccggcggcggcggcttcttcggcagcagcctgcccggccccccaggccccccaggccccccaggcccccggggctacccaggcatccctggccccaagggggagagcatccggggccagcccggccccccaggcccccagggccccccaggcatcggctatgagggccggcagggccccccaggccccccaggccccccaggccccccatccttccctggcccccaccggcagaccatctctgtgcccggccccccaggccccccaggccccccaggccccccaggcaccatgggcgccagcagcggcgtgcggctgtgggccacccggcaggccatgctgggccaggtgcatgaggtgcctgagggctggctgatctttgtggccgagcaggaggagctgtatgtgcgggtgcagaatggcttcaggaaggtgcagctggaggcccggacccccctgccccggggcacagacaatgaggtggccgccctgcagccccctgtggtgcagctgcatgacagcaacccctacccccggcgggagcacccccaccccacagcccggccctggagggcagatgacatcctggccagccccccccggctgcctgagccccagccctacccaggggccccccaccacagcagctatgtgcacctgcggcctgcccggcccaccagccccccagcccacagccaccgggacttccagcctgtgctgcacctggtggccctgaacagccccctgagcggcggcatgaggggcatcagaggagctgacttccagtgcttccagcaggcccgggctgtgggcctggccggcaccttccgggccttcctgagcagccggctgcaggacctgtacagcatcgtgcggcgggctgacagagctgctgtgcccatcgtgaacctgaaggatgagctgctcttccccagctgggaggccctcttcagcggcagcgagggccccctgaagccaggggcccgcatcttctcctttgatggcaaggatgtgctgcggcaccccacctggccccagaagtctgtgtggcacggcagtgaccccaacggccggcggctgacagagagctactgtgagacctggaggacagaggcccccagcgccaccggccaggccagcagcctgctgggcggccgcctgctgggccagagcgctgccagctgccaccacgcctacatcgtgctgtgcattgaaaattccttcatgacagccagcaagtag

SEQ ID NO: 19127 - DNA, 5265 bp, Artificial Sequence
  Description of Artificial Sequence: Synthetic coding sequence
atggccccctacccctgtggctgccacatcctgctgctgctcttctgctgcctggccgccgcccgggccaacctgctgaacctgaactggctgtggttcaacaatgaagacaccagccatgctgccaccaccatccctgagccccagggccccctgcctgtgcagcccacagctgacaccaccacccacgtgaccccaagaaatggcagcacagagcccgccacagcccctggcagccctgagccccccagcgagctgctggaggatggccaggacacccccaccagcgctgagagcccagatgccccagaagaaaatattgctggggtgggcgctgagatcctgaatgtggccaagggcatccgcagctttgtgcagctgtggaatgacacagtgcccacagagagcctggcccgggcagagaccctggtgctggagacccctgtgggccccctggccctggccggccccagcagcaccccccaggagaatggcaccaccctgtggcccagccggggcatccccagcagccctggggcccacaccacagaagctggcaccctgcctgcccccacccccagcccccccagcctgggccggccctgggcccccctgaccggccccagcgtgcccccacccagcagcggccgggccagcctgagcagcctgctgggcggggccccaccctggggcagcctgcaggaccctgacagccagggcctgagccctgctgctgctgcccccagccagcagctgcagaggccagatgtgcggctgcggacccccctgctgcaccccctggtgatgggcagcctgggcaagcacgccgcccccagcgccttcagcagcggcctgcccggggccctgagccaggtggccgtgaccaccctgacccgggacagcggggcctgggtgagccacgtggccaacagcgtgggccctggcctggccaacaacagcgccctgctgggcgctgaccctgaggccccagctggccgctgcctgcccctgccccccagcctgcctgtgtgtggccacctgggcatcagccgcttctggctgcccaaccacctgcaccacgagagcggggagcaggtgcgggccggggcccgggcctggggcggcctgctgcagacccactgccaccccttcctggcctggttcttctgcctgctgctggtgcccccctgtggctctgtgcccccaccagcccccccaccctgctgccagttctgtgaggccctgcaggatgcctgctggagccggctgggcggcggccgcctgcctgtggcctgtgccagcctgcccacccaggaggatggctactgtgtgctgattggccctgctgctgagcgcatcagcgaggaggtgggcctgctgcagctgctgggggaccccccaccccagcaggtgacccagacagatgatcctgatgtgggcctggcctacgtgtttggaccagatgccaacagcggccaggtggcccgctaccacttccccagcctcttcttccgggacttcagcctgctcttccacatccggcctgccacagagggccctggggtgctgtttgccatcacagattctgcccaggccatggtgctgctgggcgtgaagctgtctggagtgcaggacggccaccaggacatcagcctgctgtacacagagcctggagctggccagacccacacagctgccagcttccggctgcctgcctttgtgggccagtggacccacctggccctgtctgtggccggcggctttgtggccctgtatgtggactgtgaggagttccagaggatgcccctggcccggagcagccggggcctggagctggagcccggggccggcctgtttgtggcccaggccggcggcgctgaccctgacaagttccagggcgtgattgctgagctgaaggtgagaagagacccccaggtgagccccatgcactgcctggatgaggagggagatgacagtgatggagccagcggggacagcggcagcggcctgggagatgcccgggagctgctgcgggaggagactggagctgccctgaagccccggctgcctgcccctcctcctgtgaccaccccacccctggccggcggcagcagcacagaggacagccgctctgaggaggtggaggagcagaccaccgtggccagcctgggcgcccagaccctgcccggcagtgacagcgtgtccacctgggatggctctgtgaggacccctgggggccgggtgaaggagggcggcctgaagggccagaagggggagcccggggtgcccggccccccaggccgggccggccccccaggcagcccctgcctgcccggccccccaggcctgccctgccctgtgagccccctgggccctgctggccctgccctgcagacagtgcccggcccccagggccccccaggccccccaggaagagatggcaccccaggaagagatggagagcccggggaccctggagaagatggcaagccaggggacaccggcccccagggcttccctggcaccccaggagatgtgggccccaagggggacaagggggaccccggggtgggggagcggggccccccaggcccccagggccccccaggccccccaggccccagcttcagacatgacaagctgaccttcatcgacatggagggcagcggctttggaggagacctggaggccctgcggggcccccggggcttccctggccccccaggccccccaggagtgcccggcctgcctggagagcccggccgctttggagtgaacagcagtgatgtgcccggccctgctggcctgcccggggtgcccggccgggagggccccccaggcttccctggcctgcccggccccccaggccccccaggccgggagggccccccaggccgcacaggccagaagggcagcctgggggaggccggggcccctggccacaagggcagcaaaggagcccctggccctgctggggcccggggggagagcggcctggccggggcccctggccctgctggccccccaggccccccaggccccccaggccccccaggccctggcctgcctgctggctttgatgacatggagggcagcggcggccccttctggagcacagcccggtctgcagatggcccccagggccccccaggcctgcccggcctgaagggggaccccggggtgcccggcctgcccggggccaagggggaggtgggcgcagatggagtgcccggcttccctggcctgcccggccgggagggcattgctggcccccagggccccaagggggaccggggcagcagaggagagaagggggaccccgggaaggatggagtgggccagcccggcctgcccggccccccaggccccccaggccctgtggtgtatgtgtctgagcaggacggctctgtgctgtctgtgcccggccctgagggccggcccggctttgctggcttccctggccctgctggccccaagggcaacctgggcagcaaaggagagcggggcagccctggccccaagggggagaagggggagcccggcagcatcttctccccagatggaggagccctgggccctgcccagaagggggccaagggggagcccggcttccggggccccccaggcccctacggccggcccggctacaagggggagatcggcttccctggccggcccggccggcccggcatgaatggcctgaagggggagaagggggagcctggagatgccagcctgggcttcggcatgaggggcatgcctggccccccaggccccccaggccccccaggccccccaggcacccctgtgtatgacagcaatgtgtttgctgagagcagccggcccggccccccaggcctgcccggcaaccagggccccccaggccccaagggggccaagggggaggtgggccccccaggccccccaggccagttcccctttgacttcctgcagctggaggccgagatgaagggggagaagggggacagaggagatgctggccagaagggggagcggggggagcccggcggcggcggcttcttcggcagcagcctgcccggccccccaggccccccaggccccccaggcccccggggctacccaggcatccctggccccaagggggagagcatccggggccagcccggccccccaggcccccagggccccccaggcatcggctatgagggccggcagggccccccaggccccccaggccccccaggcccccccagcttccctggcccccaccggcagaccatctctgtgcccggccccccaggccccccaggccccccaggccccccaggcaccatgggcgccagcagtggagtgcggctgtgggccacccggcaggccatgctgggccaggtgcatgaggtgcctgagggctggctgatctttgtggccgagcaggaggagctgtatgtgcgggtgcagaatggcttcaggaaggtgcagctggaggcccggacccccctgccccggggcacagacaatgaggtggccgccctgcagccccctgtggtgcagctgcatgacagcaacccctacccccggcgggagcacccccaccccacagcccggccctggagggcagatgacatcctggccagccccccccggctgcctgagccccagccctacccaggggccccccaccacagcagctatgtgcacctgcggcctgcccggcccaccagccccccagcccacagccaccgggacttccagcctgtgctgcacctggtggccctgaacagccccctgagcggcggcatgaggggcatcagaggagctgacttccagtgcttccagcaggcccgggctgtgggcctggccggcaccttccgggccttcctgagcagccggctgcaggacctgtacagcatcgtgagaagagctgacagagctgctgtgcccatcgtgaacctgaaggatgagctgctcttccccagctgggaggccctcttcagcggcagcgagggccccctgaagccaggggcccgcatcttctcctttgatggcaaggatgtgctgcggcaccccacctggccccagaagtctgtgtggcacggcagtgaccccaatggaagaaggctgacagagagctactgtgagacctggaggacagaggcccccagcgccaccggccaggccagcagcctgctgggcggccgcctgctgggccagagcgctgccagctgccaccacgcctacatcgtgctgtgcatcgagaacagcttcatgacagccagcaagtag

SEQ ID NO: 19128 - DNA, 4020 bp, Artificial Sequence
  Description of Artificial Sequence: Synthetic coding sequence
atggccccccgctgcccctggccctggcccaggagaagaaggctgctggatgtgctggcccccctggtgctgctgctgggcgtgcgggccgccagcgctgagcctgagcgcatcagcgaggaggtgggcctgctgcagctgctgggggaccccccaccccagcaggtgacccagacagatgatcctgatgtgggcctggcctacgtgtttggaccagatgccaacagcggccaggtggcccgctaccacttccccagcctcttcttccgggacttcagcctgctcttccacatccggcctgccacagagggccctggggtgctgtttgccatcacagacagcgcccaggccatggtgctgctgggcgtgaagctgagcggcgtgcaggacggccaccaggacatcagcctgctgtacacagagcccggggccggccagacccacacagctgccagcttccggctgcctgcctttgtgggccagtggacccacctggccctgtctgtggccggcggctttgtggccctgtatgtggactgtgaggagttccagaggatgcccctggcccggagcagccggggcctggagctggagcctggagctggcctgtttgtggcccaggccggcggcgctgaccctgacaagttccagggcgtgattgctgagctgaaggtgcggcgggacccccaggtgagccccatgcactgcctggatgaggagggagatgacagtgatggagccagcggggacagcggcagcggcctgggagatgcccgggagctgctgcgggaggagaccggggccgccctgaagccccggctgcctgcccctcctcctgtgaccaccccacccctggccggcggcagcagcacagaggacagccgctctgaggaggtggaggagcagaccaccgtggccagcctgggcgcccagaccctgcccggcagtgacagcgtgtccacctgggatggctctgtgaggaccccaggcggccgggtgaaggagggcggcctgaagggccagaagggggagcccggggtgcccggccccccaggccgggccggccccccaggcagcccctgcctgcccggccccccaggcctgccctgccctgtgagccccctgggccctgctggccctgccctgcagacagtgcccggcccccagggccccccaggccccccaggaagagatggcaccccaggaagagatggagagcccggggaccccggggaggatggcaagccaggggacaccggcccccagggcttccctggcaccccaggagatgtgggccccaagggggacaagggggaccccggggtgggggagcggggccccccaggcccccagggccccccaggccccccaggccccagcttcagacatgacaagctgaccttcatcgacatggagggcagcggctttggaggagacctggaggccctgcggggcccccggggcttccctggccccccaggccccccaggagtgcccggcctgcccggggagcccggccgcttcggcgtgaacagcagtgatgtgcccggccctgctggcctgcccggggtgcccggccgggagggccccccaggcttccctggcctgcccggccccccaggccccccaggccgggagggccccccaggccgcacaggccagaagggcagcctgggggaggccggggcccctggccacaagggcagcaagggggcccctggccctgctggggcccggggggagagcggcctggccggggcccctggccctgctggccccccaggccccccaggccccccaggccccccaggccctggcctgcctgctggctttgatgacatggagggcagcggcggccccttctggagcacagcccggtctgcagatggcccccagggccccccaggcctgcccggcctgaagggggaccccggggtgcccggcctgcccggggccaagggggaggtgggcgcagatggagtgcccggcttccctggcctgcccggccgggagggcattgctggcccccagggccccaagggggaccggggcagcagaggagagaagggggaccccgggaaggatggagtgggccagcccggcctgcccggccccccaggccccccaggccctgtggtgtatgtgtctgagcaggacggctctgtgctgtctgtgcccggccctgagggccggcccggctttgctggcttccctggccctgctggccccaagggcaacctgggcagcaagggggagcggggcagccctggccccaagggggagaagggggagcccggcagcatcttctccccagatggaggagccctgggccctgcccagaagggggccaagggggagcccggcttccggggccccccaggcccctacggccggcccggctacaagggggagatcggcttccctggccggcccggccggcccggcatgaatggcctgaagggggagaagggggagcctggagatgccagcctgggcttcggcatgaggggcatgcctggccccccaggccccccaggccccccaggccccccaggcacccctgtgtatgacagcaatgtgtttgctgagagcagcaggcctggccccccaggcctgcccggcaaccagggccccccaggccccaagggggccaagggggaggtgggccccccaggccccccaggccagttcccctttgacttcctgcagctggaggccgagatgaagggggagaagggggacagaggagatgctggccagaagggggagcggggggagcccggcggcggcggcttcttcggcagcagcctgcccggccccccaggccccccaggccccccaggcccccggggctacccaggcatccctggccccaagggggagagcatccggggccagcccggccccccaggcccccagggccccccaggcatcggctatgagggccggcagggccccccaggccccccaggccccccaggccccccatccttccctggcccccaccggcagaccatctctgtgcccggccccccaggccccccaggccccccaggccccccaggcaccatgggcgccagcagcggcgtgcggctgtgggccacccggcaggccatgctgggccaggtgcatgaggtgcctgagggctggctgatctttgtggccgagcaggaggagctgtatgtgcgggtgcagaatggcttcaggaaggtgcagctggaggcccggacccccctgccccggggcacagacaatgaggtggccgccctgcagccccctgtggtgcagctgcatgacagcaacccctacccccggcgggagcacccccaccccacagcccggccctggagggcagatgacatcctggccagccccccccggctgcctgagccccagccctacccaggggccccccaccacagcagctatgtgcacctgcggcctgcccggcccaccagccccccagcccacagccaccgggacttccagcctgtgctgcacctggtggccctgaacagccccctgagcggcggcatgaggggcatcagaggagctgacttccagtgcttccagcaggcccgggctgtgggcctggccggcaccttccgggccttcctgagcagccggctgcaggacctgtacagcatcgtgcggcgggctgacagagctgctgtgcccatcgtgaacctgaaggatgagctgctcttccccagctgggaggccctcttcagcggcagcgagggccccctgaagccaggggcccgcatcttctcctttgatggcaaggatgtgctgcggcaccccacctggccccagaagtctgtgtggcacggcagtgaccccaacggccggcggctgacagagagctactgtgagacctggaggacagaggcccccagcgccaccggccaggccagcagcctgctgggcggccgcctgctgggccagagcgctgccagctgccaccacgcctacatcgtgctgtgcattgaaaattccttcatgacagccagcaagtag

SEQ ID NO: 19129 - DNA, 4020 bp, Artificial Sequence
  Description of Artificial Sequence: Synthetic coding sequence
atggccccccgctgcccctggccctggcccaggagaagaaggctgctggatgtgctggcccccctggtgctgctgctgggcgtgcgggccgccagcgctgagcctgagcgcatcagcgaggaggtgggcctgctgcagctgctgggggaccccccaccccagcaggtgacccagacagatgatcctgatgtgggcctggcctacgtgtttggaccagatgccaacagcggccaggtggcccgctaccacttccccagcctcttcttccgggacttcagcctgctcttccacatccggcctgccacagagggccctggggtgctgtttgccatcacagacagcgcccaggccatggtgctgctgggcgtgaagctgagcggcgtgcaggacggccaccaggacatcagcctgctgtacacagagcccggggccggccagacccacacagctgccagcttccggctgcctgcctttgtgggccagtggacccacctggccctgtctgtggccggcggctttgtggccctgtatgtggactgtgaggagttccagaggatgcccctggcccggagcagccggggcctggagctggagcctggagctggcctgtttgtggcccaggccggcggcgctgaccctgacaagttccagggcgtgattgctgagctgaaggtgcggcgggacccccaggtgagccccatgcactgcctggatgaggagggagatgacagtgatggagccagcggggacagcggcagcggcctgggagatgcccgggagctgctgcgggaggagaccggggccgccctgaagccccggctgcctgcccctcctcctgtgaccaccccacccctggccggcggcagcagcacagaggacagccgctctgaggaggtggaggagcagaccaccgtggccagcctgggcgcccagaccctgcccggcagtgacagcgtgtccacctgggatggctctgtgaggaccccaggcggccgggtgaaggagggcggcctgaagggccagaagggggagcccggggtgcccggccccccaggccgggccggccccccaggcagcccctgcctgcccggccccccaggcctgccctgccctgtgagccccctgggccctgctggccctgccctgcagacagtgcccggcccccagggccccccaggccccccaggaagagatggcaccccaggaagagatggagagcctgtgagcccccacgtgccccccagccctggggacaccggcccccagggcttccctggcaccccaggagatgtgggccccaagggggacaagggggaccccggggtgggggagcggggccccccaggcccccagggccccccaggccccccaggccccagcttcagacatgacaagctgaccttcatcgacatggagggcagcggctttggaggagacctggaggccctgcggggcccccggggcttccctggccccccaggccccccaggagtgcccggcctgcccggggagcccggccgcttcggcgtgaacagcagtgatgtgcccggccctgctggcctgcccggggtgcccggccgggagggccccccaggcttccctggcctgcccggccccccaggccccccaggccgggagggccccccaggccgcacaggccagaagggcagcctgcagggcgctggggcccctggggtgcagggcagcaagggggcccctggccctgctggggcccggggggagagcggcctggccggggcccctggccctgctggccccccaggccccccaggccccccaggccccccaggccctggcctgcctgctggctttgatgacatggagggcagcggcggccccttctggagcacagcccggtctgcagatggcccccaggagcccccagccctgcacggcatcggcggggaccccggggtgcccggcctgcccggggccaagggggaggtgggcgcagatggagtgcccggcttccctggcctgcccggccgggagggcattgctggcccccagggccccaagggggaccggggcagcagaggagagaagggggaccccgggaaggatggagtgggccagcccggcctgcccggccccccaggccccccaggccctgtggtgtatgtgtctgagcaggacggctctgtgctgtctgtgcccggccctgagggccggcccggctttgctggcttccctggccctgctggccccaagggcaacctgggcagcaagggggagcggggcagccctggccccaagggggagaagggggagcccggcagcatcttctccccagatggaggagccctgggccctgcccagaagggggccaagggggagcccggcttccggggccccccaggcccctacggccggcccggctacaagggggagatcggcttccctggccggcccggccggcccggcatgaatggcctgaagggggagaagggggagcctggagatgccagcctgggcttcggcatgaggggcatgcctggccccccaggccccccaggccccccaggccccccaggcacccctgtgtatgacagcaatgtgtttgctgagagcagcaggcctggccccccaggcctgcccggcaaccagggccccccaggccccaagggggccaagggggaggtgggccccccaggccccccaggccagttcccctttgacttcctgcagctggaggccgagatgaagggggagaagggggacagaggagatgctggccagaagggggagcggggggagcccggcggcggcggcttcttcggcagcagcctgcccggccccccaggccccccaggccccccaggcccccggggctacccaggcatccctggccccaagggggagagcatccggggccagcccggccccccaggcccccagggccccccaggcatcggctatgagggccggcagggccccccaggccccccaggccccccaggccccccatccttccctggcccccaccggcagaccatctctgtgcccggccccccaggccccccaggccccccaggccccccaggcaccatgggcgccagcagcggcgtgcggctgtgggccacccggcaggccatgctgggccaggtgcatgaggtgcctgagggctggctgatctttgtggccgagcaggaggagctgtatgtgcgggtgcagaatggcttcaggaaggtgcagctggaggcccggacccccctgccccggggcacagacaatgaggtggccgccctgcagccccctgtggtgcagctgcatgacagcaacccctacccccggcgggagcacccccaccccacagcccggccctggagggcagatgacatcctggccagccccccccggctgcctgagccccagccctacccaggggccccccaccacagcagctatgtgcacctgcggcctgcccggcccaccagccccccagcccacagccaccgggacttccagcctgtgctgcacctggtggccctgaacagccccctgagcggcggcatgaggggcatcagaggagctgacttccagtgcttccagcaggcccgggctgtgggcctggccggcaccttccgggccttcctgagcagccggctgcaggacctgtacagcatcgtgcggcgggctgacagagctgctgtgcccatcgtgaacctgaaggatgagctgctcttccccagctgggaggccctcttcagcggcagcgagggccccctgaagccaggggcccgcatcttctcctttgatggcaaggatgtgctgcggcaccccacctggccccagaagtctgtgtggcacggcagtgaccccaacggccggcggctgacagagagctactgtgagacctggaggacagaggcccccagcgccaccggccaggccagcagcctgctgggcggccgcctgctgggccagagcgctgccagctgccaccacgcctacatcgtgctgtgcattgaaaattccttcatgacagccagcaagtag

SEQ ID NO: 19130 - DNA, 5265 bp, Artificial Sequence
  Description of Artificial Sequence: Synthetic coding sequence
atggccccctacccctgtggctgccacatcctgctgctgctcttctgctgcctggccgccgcccgggccaacctgctgaacctgaactggctgtggttcaacaatgaagacaccagccatgctgccaccaccatccctgagccccagggccccctgcctgtgcagcccacagctgacaccaccacccacgtgaccccaagaaatggcagcacagagcccgccacagcccctggcagccctgagccccccagcgagctgctggaggatggccaggacacccccaccagcgctgagagcccagatgccccagaagaaaatattgctggggtgggcgctgagatcctgaatgtggccaagggcatccgcagctttgtgcagctgtggaatgacacagtgcccacagagagcctggcccgggcagagaccctggtgctggagacccctgtgggccccctggccctggccggccccagcagcaccccccaggagaatggcaccaccctgtggcccagccggggcatccccagcagccctggggcccacaccacagaagctggcaccctgcctgcccccacccccagcccccccagcctgggccggccctgggcccccctgaccggccccagcgtgcccccacccagcagcggccgggccagcctgagcagcctgctgggcggggccccaccctggggcagcctgcaggaccctgacagccagggcctgagccctgctgctgctgcccccagccagcagctgcagaggccagatgtgcggctgcggacccccctgctgcaccccctggtgatgggcagcctgggcaagcacgccgcccccagcgccttcagcagcggcctgcccggggccctgagccaggtggccgtgaccaccctgacccgggacagcggggcctgggtgagccacgtggccaacagcgtgggccctggcctggccaacaacagcgccctgctgggcgctgaccctgaggccccagctggccgctgcctgcccctgccccccagcctgcctgtgtgtggccacctgggcatcagccgcttctggctgcccaaccacctgcaccacgagagcggggagcaggtgcgggccggggcccgggcctggggcggcctgctgcagacccactgccaccccttcctggcctggttcttctgcctgctgctggtgcccccctgtggctctgtgcccccaccagcccccccaccctgctgccagttctgtgaggccctgcaggatgcctgctggagccggctgggcggcggccgcctgcctgtggcctgtgccagcctgcccacccaggaggatggctactgtgtgctgattggccctgctgctgagcgcatcagcgaggaggtgggcctgctgcagctgctgggggaccccccaccccagcaggtgacccagacagatgatcctgatgtgggcctggcctacgtgtttggaccagatgccaacagcggccaggtggcccgctaccacttccccagcctcttcttccgggacttcagcctgctcttccacatccggcctgccacagagggccctggggtgctgtttgccatcacagattctgcccaggccatggtgctgctgggcgtgaagctgtctggagtgcaggacggccaccaggacatcagcctgctgtacacagagcctggagctggccagacccacacagctgccagcttccggctgcctgcctttgtgggccagtggacccacctggccctgtctgtggccggcggctttgtggccctgtatgtggactgtgaggagttccagaggatgcccctggcccggagcagccggggcctggagctggagcccggggccggcctgtttgtggcccaggccggcggcgctgaccctgacaagttccagggcgtgattgctgagctgaaggtgagaagagacccccaggtgagccccatgcactgcctggatgaggagggagatgacagtgatggagccagcggggacagcggcagcggcctgggagatgcccgggagctgctgcgggaggagactggagctgccctgaagccccggctgcctgcccctcctcctgtgaccaccccacccctggccggcggcagcagcacagaggacagccgctctgaggaggtggaggagcagaccaccgtggccagcctgggcgcccagaccctgcccggcagtgacagcgtgtccacctgggatggctctgtgaggacccctgggggccgggtgaaggagggcggcctgaagggccagaagggggagcccggggtgcccggccccccaggccgggccggccccccaggcagcccctgcctgcccggccccccaggcctgccctgccctgtgagccccctgggccctgctggccctgccctgcagacagtgcccggcccccagggccccccaggccccccaggaagagatggcaccccaggaagagatggagagcctgtgagcccccacgtgccccccagccctggggacaccggcccccagggcttccctggcaccccaggagatgtgggccccaagggggacaagggggaccccggggtgggggagcggggccccccaggcccccagggccccccaggccccccaggccccagcttcagacatgacaagctgaccttcatcgacatggagggcagcggctttggaggagacctggaggccctgcggggcccccggggcttccctggccccccaggccccccaggagtgcccggcctgcctggagagcccggccgctttggagtgaacagcagtgatgtgcccggccctgctggcctgcccggggtgcccggccgggagggccccccaggcttccctggcctgcccggccccccaggccccccaggccgggagggccccccaggccgcacaggccagaagggcagcctgcagggcgctggggcccctggggtgcagggcagcaaaggagcccctggccctgctggggcccggggggagagcggcctggccggggcccctggccctgctggccccccaggccccccaggccccccaggccccccaggccctggcctgcctgctggctttgatgacatggagggcagcggcggccccttctggagcacagcccggtctgcagatggcccccagggccccccaggcctgcccggcctgaagggggaccccggggtgcccggcctgcccggggccaagggggaggtgggcgcagatggagtgcccggcttccctggcctgcccggccgggagggcattgctggcccccagggccccaagggggaccggggcagcagaggagagaagggggaccccgggaaggatggagtgggccagcccggcctgcccggccccccaggccccccaggccctgtggtgtatgtgtctgagcaggacggctctgtgctgtctgtgcccggccctgagggccggcccggctttgctggcttccctggccctgctggccccaagggcaacctgggcagcaaaggagagcggggcagccctggccccaagggggagaagggggagcccggcagcatcttctccccagatggaggagccctgggccctgcccagaagggggccaagggggagcccggcttccggggccccccaggcccctacggccggcccggctacaagggggagatcggcttccctggccggcccggccggcccggcatgaatggcctgaagggggagaagggggagcctggagatgccagcctgggcttcggcatgaggggcatgcctggccccccaggccccccaggccccccaggccccccaggcacccctgtgtatgacagcaatgtgtttgctgagagcagccggcccggccccccaggcctgcccggcaaccagggccccccaggccccaagggggccaagggggaggtgggccccccaggccccccaggccagttcccctttgacttcctgcagctggaggccgagatgaagggggagaagggggacagaggagatgctggccagaagggggagcggggggagcccggcggcggcggcttcttcggcagcagcctgcccggccccccaggccccccaggccccccaggcccccggggctacccaggcatccctggccccaagggggagagcatccggggccagcccggccccccaggcccccagggccccccaggcatcggctatgagggccggcagggccccccaggccccccaggccccccaggcccccccagcttccctggcccccaccggcagaccatctctgtgcccggccccccaggccccccaggccccccaggccccccaggcaccatgggcgccagcagtggagtgcggctgtgggccacccggcaggccatgctgggccaggtgcatgaggtgcctgagggctggctgatctttgtggccgagcaggaggagctgtatgtgcgggtgcagaatggcttcaggaaggtgcagctggaggcccggacccccctgccccggggcacagacaatgaggtggccgccctgcagccccctgtggtgcagctgcatgacagcaacccctacccccggcgggagcacccccaccccacagcccggccctggagggcagatgacatcctggccagccccccccggctgcctgagccccagccctacccaggggccccccaccacagcagctatgtgcacctgcggcctgcccggcccaccagccccccagcccacagccaccgggacttccagcctgtgctgcacctggtggccctgaacagccccctgagcggcggcatgaggggcatcagaggagctgacttccagtgcttccagcaggcccgggctgtgggcctggccggcaccttccgggccttcctgagcagccggctgcaggacctgtacagcatcgtgagaagagctgacagagctgctgtgcccatcgtgaacctgaaggatgagctgctcttccccagctgggaggccctcttcagcggcagcgagggccccctgaagccaggggcccgcatcttctcctttgatggcaaggatgtgctgcggcaccccacctggccccagaagtctgtgtggcacggcagtgaccccaatggaagaaggctgacagagagctactgtgagacctggaggacagaggcccccagcgccaccggccaggccagcagcctgctgggcggccgcctgctgggccagagcgctgccagctgccaccacgcctacatcgtgctgtgcatcgagaacagcttcatgacagccagcaagtag

SEQ ID NO: 19131 - DNA, 1623 bp, Artificial Sequence
  Description of Artificial Sequence: Synthetic coding sequence
atgggccctggagagagagctgggggcggcggagatgctggaaaaggaaatgctgctgggggcggcggcggcggccgcagcgccaccacagctggcagcagagctgtgtctgccctgtgcctgctgctgtctgtgggcagcgctgctgcctgcctgctgctgggcgtgcaggccgccgccctgcagggccgggtggccgccctggaggaggagcgggagctgctgcggcgggccggccccccaggggccctggatgcctgggccgagccccacctggagcggctgctgcgggagaagctggatggcctggccaagatcagaacagcccgggaggcccccagtgaatgtgtgtgccccccaggccccccaggaagaagaggcaagccaggaagaagaggagaccccggccccccaggccagagcggcagagatggctacccaggccccctgggcctggatggcaagccaggcctgcccggccccaagggggagaagggggcccctggggactttggccccaggggggaccagggccaggatggagctgctggccccccaggccccccaggccccccaggggcccggggccccccaggggacaccgggaaggatggccccaggggggcccagggccctgctggccccaagggggagcccggccaggatggagagatgggccccaagggccccccaggccccaagggggagcccggggtgcctgggaagaagggagatgatggcacccccagccagcccggccccccaggccccaagggggagcccggctccatgggccccagaggagaaaatggagtggatggagcccctggccccaagggggagcccggccaccggggcacagatggagctgctggccccaggggggcccctggcctgaagggggagcagggcgacacagtggtgattgattatgatggccgcatcctggatgccctgaagggccccccaggcccccagggccccccaggccccccaggcatccctggggccaagggggagctgggcctgcccggggcccctggcattgatggagagaagggccccaagggccagaagggggaccccggggagcccggccctgctggcctgaagggggaggccggggagatgggcctgagcggcctgcctggagcagatggcctgaagggggagaagggggagagcgccagtgacagcctgcaggagagcctggcccagctgattgtggagcccggccccccaggccccccaggccccccaggccccatgggcctgcagggcatccagggccccaagggcctggatggagccaagggggagaagggggccagcggggagcggggccccagcggcctgcccggccctgtgggccccccaggcctcatcggcctgcccggcaccaagggggagaagggccggcctggagagcccggcctggatggcttccctggccccagaggagagaagggggacagaagtgagcggggggagaagggggagcggggcgtgcccggcaggaaaggagtgaagggccagaagggggagcccggccccccaggcctggaccagccctgccctgtgggcccagatggcctgcctgtgcccggctgctggcacaagtag

SEQ ID NO: 19132 - DNA, 930 bp, Artificial Sequence
  Description of Artificial Sequence: Synthetic coding sequence
atggagagccgcagcggcatccaggccggcgtgcgctgccgggacctgggcagcctgcagcccccacccctggccctgaagcagttcagcagcctgagcctgcccagctcctgggactacagaaggctgcccccaagatgtggcttcctgtttgaggtgtctgagaccaccaaccccccagctggcaccaacagccgccacaccctgactgtgaagctggatggcctggccaagatcagaacagcccgggaggcccccagtgaatgtgtgtgccccccaggccccccaggccggcggggcaagccaggccggcggggggaccccggccccccaggccccctgggcctggatggcaagccaggcctgcccggccccaagggggagaagggggcccctggggactttggccccaggggggaccagggccaggatggagctgctggccccccaggccccccaggccccccaggggcccggggccccccaggggacaccgggaaggatggccccaggggggcccagggccctgctggccccaagggggagcccggccaggatggagagatgggccccaagggccccccaggccccaagggggagcccggggtgcctgggaagaagggagatgatggcacccccagccagcccggccccccaggccccaagggggagcccggctccatgggccccagaggagaaaatggagtggatggagcccctggccccaagggggagcccggccaccggggcacagatggagctgctggccccagaggagatgtgcgggaccccggcctgggctctgtgagcagctgcagccagaggctggccagcagcagcaagaagaatggaagtgagcccccacctggctgtgccggctgcccccggccccagggccgggccggccgccacagcggggaccggctgtag

SEQ ID NO: 19133 - DNA, 1665 bp, Artificial Sequence
  Description of Artificial Sequence: Synthetic coding sequence
atgacagcccctggagctgctggccgctgcccccccaccacctggctgggcagcctgctgctgctggtgtgcctgctggccagccgcagcatcacagaggaggtgtctgagtactgcagccacatgattggcagcggccacctgcagagcctgcagaggctgattgacagccagatggagaccagctgccagatcacctttgaatttgtggaccaggagcagctgaaggaccctgtgtgctacctgaagaaggccttcctgctggtgcaggacatcatggaggacaccatgaggttccgggacaacaccccaaatgccatcgccatcgtgcagctgcaggagctgagcctgcggctgaagagctgcttcaccaaggactatgaggagcatgacaaggcctgtgtgaggaccttctatgagacccccctgcagctgctggagaaggtgaagaatgtgttcaatgagaccaagaacctgctggacaaggactggaacatcttcagcaagaactgcaacaacagctttgctgaatgtagcagccaggatgtggtgaccaagccagactgcaactgcctgtaccccaaggccatccccagcagtgaccctgcctctgtgagcccccaccagcccctggcccccagcatggcccctgtggccggcctgacctgggaggacagcgagggcacagagggcagcagcctgctgcccggggagcagcccctgcacacagtggaccccggcagcgccaagcagaggcctcccaggagcacctgccagagctttgagcccccagagacccctgtggtgaaggacagcaccatcggcggcagcccccagccccggcccagcgtgggcgccttcaaccctggcatggaggacatcctggacagcgccatgggcaccaactgggtgcctgaggaggccagcggggaggccagcgagatccctgtgccccagggcacagagctgagccccagcaggcctgggggcggctccatgcagacagagcccgcccggcccagcaacttcctgagcgccagcagccccctgcctgccagcgccaagggccagcagcctgcagatgtgactggaacagccctgccccgggtgggccctgtgcggcccaccggccaggactggaaccacaccccccagaagacagaccaccccagcgccctgctgcgggaccccccagagcccggcagcccccgcatcagcagcctgcggccccagggcctgagcaaccccagcaccctgagcgcccagccccagctgagccgcagccacagcagcggctctgtgctgcccctgggggagctggagggcagaagaagcacccgggacagaagaagccctgctgagcctgagggcggccctgccagcgagggcgccgcccggcccctgccccgcttcaacagcgtgcccctgacagacaccggccacgagcggcagagcgagggcagcttcagcccccagctgcaggagagcgtcttccacctgctggtgcccagcgtcatcctggtgctgctggccgtgggcggcctgctcttctaccgctggaggcggcgcagccaccaggagccccagagagctgacagccccctggagcagcctgagggcagccccctgacccaggatgaccggcaggtggagctgcctgtgtag

SEQ ID NO: 19134 - DNA, 1317 bp, Artificial Sequence
  Description of Artificial Sequence: Synthetic coding sequence
atgacagcccctggagctgctggccgctgcccccccaccacctggctgggcagcctgctgctgctggtgtgcctgctggccagccgcagcatcacagaggaggtgtctgagtactgcagccacatgattggcagcggccacctgcagagcctgcagaggctgattgacagccagatggagaccagctgccagatcacctttgaatttgtggaccaggagcagctgaaggaccctgtgtgctacctgaagaaggccttcctgctggtgcaggacatcatggaggacaccatgaggttccgggacaacaccccaaatgccatcgccatcgtgcagctgcaggagctgagcctgcggctgaagagctgcttcaccaaggactatgaggagcatgacaaggcctgtgtgaggaccttctatgagacccccctgcagctgctggagaaggtgaagaatgtgttcaatgagaccaagaacctgctggacaaggactggaacatcttcagcaagaactgcaacaacagctttgctgaatgtagcagccaggatgtggtgaccaagccagactgcaactgcctgtaccccaaggccatccccagcagtgaccctgcctctgtgagcccccaccagcccctggcccccagcatggcccctgtggccggcctgacctgggaggacagcgagggcacagagggcagcagcctgctgcccggggagcagcccctgcacacagtggaccccggcagcgccaagcagaggcctcccaggagcacctgccagagctttgagcccccagagacccctgtggtgaaggacagcaccatcggcggcagcccccagccccggcccagcgtgggcgccttcaaccctggcatggaggacatcctggacagcgccatgggcaccaactgggtgcctgaggaggccagcggggaggccagcgagatccctgtgccccagggcacagagctgagccccagcaggcctgggggcggctccatgcagacagagcccgcccggcccagcaacttcctgagcgccagcagccccctgcctgccagcgccaagggccagcagcctgcagatgtgactggacatgagcggcagagcgagggcagcttcagcccccagctgcaggagagcgtcttccacctgctggtgcccagcgtcatcctggtgctgctggccgtgggcggcctgctcttctaccgctggaggcggcgcagccaccaggagccccagagagctgacagccccctggagcagcctgagggcagccccctgacccaggatgaccggcaggtggagctgcctgtgtag

SEQ ID NO: 19135 - DNA, 360 bp, Artificial Sequence
  Description of Artificial Sequence: Synthetic coding sequence
atgacagcccctggagctgctggccgctgcccccccaccacctggctgggcagcctgctgctgctggtgtgcctgctggccagccgcagcatcacagaggaggtgtctgagtactgcagccacatgattggcagcggccacctgcagagcctgcagaggctgattgacagccagatggagaccagctgccagatcacctttgaatttgtggaccaggagcagctgaaggaccctgtgtgctacctgaagaaggccttcctgctggtgcaggacatcatggaggacaccatgaggttccgggacaacaccccaaatgccatcgccatcgtgcagctgcaggagctgagcctgcggctgtag

SEQ ID NO: 19136 - DNA, 1317 bp, Artificial Sequence; identical to SEQ ID NO: 19134
  Description of Artificial Sequence: Synthetic coding sequence

SEQ ID NO: 19137 - DNA, 1665 bp, Artificial Sequence; identical to SEQ ID NO: 19133
  Description of Artificial Sequence: Synthetic coding sequence

SEQ ID NO: 19138 - DNA, 771 bp, Artificial Sequence
  Description of Artificial Sequence: Synthetic coding sequence
atgacagcccctggagctgctggccgctgcccccccaccacctggctgggcagcctgctgctgctggtgtgcctgctggccagccgcagcatcacagaggaggtgtctgagtactgcagccacatgattggcagcggccacctgcagagcctgcagaggctgattgacagccagatggagaccagctgccagatcacctttgaatttgtggaccaggagcagctgaaggaccctgtgtgctacctgaagaaggccttcctgctggtgcaggacatcatggaggacaccatgaggttccgggacaacaccccaaatgccatcgccatcgtgcagctgcaggagctgagcctgcggctgaagagctgcttcaccaaggactatgaggagcatgacaaggcctgtgtgaggaccttctatgagacccccctgcagctgctggagaaggtgaagaatgtgttcaatgagaccaagaacctgctggacaaggactggaacatcttcagcaagaactgcaacaacagctttgctgaatgtagcagccagggccacgagcggcagagcgagggcagcttcagcccccagctgcaggagagcgtcttccacctgctggtgcccagcgtcatcctggtgctgctggccgtgggcggcctgctcttctaccgctggaggcggcgcagccaccaggagccccagagagctgacagccccctggagcagcctgagggcagccccctgacccaggatgaccggcaggtggagctgcctgtgtag

SEQ ID NO: 19139 - DNA, 828 bp, Artificial Sequence
  Description of Artificial Sequence: Synthetic coding sequence
ggcagccctggcatggccggggccctgtgtgccggccacatcgccggcctgtatggagaccggggcctggtgcccagcacccggcgggaggagcggggcggcaggaagacctggcagacaggagctgcccggccccagggcggggcccggggggccggcggcccctggcacccagacagacacccccggcccaaggagacccggggcaacctgggccccctggagaccccagcccgctgggccacccagggccctgctgcccccagcgagcccatccctggcatcaagggcaccaagggcagccctggcaacatcaaggaccagcccaggcctgccttcagcgccatcagaagaaaccccaatggaggccagaggggccacagcaccaggagcagccccaccaggaagaacagaaccaggaccaccccagctgacagcagcgccctgtacccagccaccaccaccagccccagccgctgctgccccagcggcaagagcgcctgccccagcagccccccccagggcgcccggagtgatgccccctgggcctctgtgaccccacccacccggggcagcagccgctggtgccagggcgcctggtgcttcagctgcagccgggtgaccaggagcggcctgaagaagacccccaagagggtgaccttcacccgggccctgcggcccacagccagcagcgctgccagcagcagcagccacctgcctgagcccgggaaggaccccctgccccacccccccctgtggctgccctgcagcgcctgcaagatgggcgccctgctgctgcagctgctgaagggcggcggctggctgtag

SEQ ID NO: 19140 - DNA, 738 bp, Artificial Sequence
  Description of Artificial Sequence: Synthetic coding sequence
atggagggcccccggggctggctggtgctgtgtgtgctggccatcagcctggcctccatggtgacagaggacctgtgccgggccccagatggcaagaagggggaggccggccggcctggaagaagaggccggcccggcctgaagggggagcagggcgagcccggggcccctggcatcagaacaggcatccagggcctgaagggggaccagggcgagcccggccccagcggcaaccctgggaaggtgggctacccaggccccagcggccccctgggcgcccggggcatccctggcatcaagggcaccaagggcagccctggcaacatcaaggaccagcccaggcctgccttcagcgccatcagaagaaacccccccatgggcggcaatgtggtgatctttgacaccgtcatcaccaaccaggaggagccctaccagaaccacagcggccgctttgtgtgcaccgtgcccggctactactacttcaccttccaggtgctgagccagtgggagatctgcctgagcatcgtgagcagcagccggggccaggtgcggcgcagcctgggcttctgtgacaccaccaacaagggcctcttccaggtggtgtctgggggcatggtgctgcagctgcagcagggcgaccaggtgtgggtggagaaggaccccaagaagggccacatctaccagggcagcgaggccgacagcgtcttcagcggcttcctgatcttccccagcgcctag

SEQ ID NO: 19141 - DNA, 738 bp, Artificial Sequence; identical to SEQ ID NO: 19140
  Description of Artificial Sequence: Synthetic coding sequence

SEQ ID NO: 19142 - DNA, 666 bp, Artificial Sequence
  Description of Artificial Sequence: Synthetic coding sequence
atggagggcccccggggctggctggtgctgtgtgtgctggccatcagcctggcctccatggtgacagaggacctgtgccgggccccagatggcaagaagggggaggccggccggcctggaagaagaggccggcccggcctgaagggggagcagggcgagcccggggcccctggcatcagaacaggcatccagggcctgaagggggaccagggcgagcccggccccagcggcaaccctgggaaggtgggctacccaggccccagcggccccctgggcgcccggggcatccctggcatcaagggcaccaagggcagccctggcaacatcaaggaccagcccaggcctgccttcagcgccatcagaagaaacccccccatgggcggcaatgtggtgatctttgacaccgtcatcaccaaccaggaggagccctaccagaaccacagcggccgctttgtgtgcaccgtgcccggctactactacttcaccttccaggtgctgagccagtgggagatctgcctgagcatcgtgagcagcagccggggccaggtgcggcgcagcctgggcttctgtgacaccaccaacaagggcctcttccaggtggtgtctgggggcatggtgctgcagctgcagcagggcgaccaggtgtgggtggagaaggacccctag

SEQ ID NO: 19143 - DNA, 1050 bp, Artificial Sequence
  Description of Artificial Sequence: Synthetic coding sequence
atgacagctgcctccatgggccctgtgcgggtggcctttgtggtgctgctggccctgtgcagcaggcctgctgtgggccagaactgcagcggcccctgccgctgcccagatgagcccgccccccgctgcccagctggggtgtccctggtgctggatggctgcggctgctgccgggtgtgtgccaagcagctgggggagctgtgcacagagcgggacccctgtgacccccacaagggcctcttctgccacttcggcagccctgccaacaggaagattggagtgtgcacagccaaggatggagccccctgcatctttggaggcaccgtgtaccgcagcggggagagcttccagagcagctgcaagtaccagtgcacctgcctggatggagctgtgggctgcatgcccctgtgcagcatggatgtgcggctgcccagcccagactgccccttcccccggcgggtgaagctgcccgggaagtgctgtgaggagtgggtgtgtgatgagcccaaggaccagacagtggtgggccctgccctggccgcctaccgcctggaggacaccttcggccctgaccccaccatgatccgggccaactgcctggtgcagaccacagagtggagcgcctgcagcaagacctgtggcatgggcatcagcaccagggtgaccaatgacaatgccagctgccgcctggagaagcagagccggctgtgcatggtgcggccctgtgaggccgacctggaggagaacatcaagaagggcaagaagtgcatccgcacccccaagatcagcaagcccatcaagtttgagctgagcggctgcacctccatgaagacctaccgggccaagttctgtggggtgtgcacagatggccgctgctgcaccccccacaggaccaccaccctgcctgtggagttcaagtgcccagatggagaggtgatgaagaagaacatgatgttcatcaagacctgtgcctgccactacaactgccctggggacaatgacatctttgagagcctgtactacaggaagatgtatggagacatggcctag

SEQ ID NO: 19144 - DNA, 2238 bp, Artificial Sequence
  Description of Artificial Sequence: Synthetic coding sequence
atggagcggcccccaggcctgcggcctggagctgggggcccctgggagatgagggagcggctgggcactggaggctttggaaatgtgtgcctgtaccagcaccgggagctggacctgaagatcgccatcaagagctgccgcctggagctgagcaccaagaaccgggagcgctggtgccacgagatccagatcatgaagaagctgaaccacgccaacgtggtgaaggcctgtgatgtgcctgaggagctgaacatcctgattcatgatgtgcccctgctggccatggagtactgcagcggcggggacctgaggaagctgctgaacaagccagagaactgctgcggcctgaaggagagccagatcctgagcctgctgagtgacatcggcagcggcatccgctacctgcacgagaacaagatcatccaccgggacctgaagccagagaacatcgtgctgcaggatgtgggcggcaagatcatccacaagatcatcgacctgggctacgccaaggatgtggaccagggcagcctgtgcaccagctttgtgggcaccctgcagtacctggcccctgagctgtttgagaacaagccctacacagccaccgtggactactggagctttggcaccatggtgtttgaatgtattgctggctaccggcccttcctgcaccacctgcagcccttcacctggcatgagaagatcaagaagaaggaccccaagtgcatctttgcctgtgaggagatgtctggagaggtgcgcttcagcagccacctgccccagcccaacagcctgtgcagcctggtggtggagcccatggagaactggctgcagctgatgctgaactgggacccccagcagaggggcggccctgtggacctgaccctgaagcagccccgctgctttgtgctgatggaccacatcctgaacctgaagatcgtgcacatcctgaacatgaccagcgccaagatcatctccttcctgctgcccccagatgagagcctgcacagcctgcagagcagaattgagcgggagaccggcatcaacacaggcagccaggagctgctgtctgagaccggcatcagcctggaccccaggaagccagccagccagtgtgtgctggatggagtgcggggctgtgacagctacatggtgtacctgtttgacaagagcaagacagtgtatgagggcccctttgccagccgcagcctgagtgactgtgtgaactacatcgtgcaggacagcaagatccagctgcccatcatccagctgaggaaggtgtgggccgaggccgtgcactacgtgtctggcctgaaggaggactacagccgcctcttccagggccagagagctgccatgctgagcctgctgcgctacaatgccaacctgaccaagatgaagaacaccctcatcagcgccagccagcagctgaaggccaagctggagttcttccacaagagcatccagctggacctggagcgctacagcgagcagatgacctacggcatcagcagcgagaagatgctgaaggcctggaaggagatggaggagaaggccatccactacgccgaggtgggcgtgattggctacctggaggaccagatcatgagcctgcatgctgagatcatggagctgcagaagagcccctatggaagacggcagggcgacctgatggagagcctggagcagagggccatcgacctgtacaagcagctgaagcaccggcccagcgaccacagctacagcgacagcacagagatggtgaagatcatcgtgcacacagtgcagagccaggacagagtgctgaaggagctgtttggccacctgagcaagctgctgggctgcaagcagaagatcatcgacctgctgcccaaggtggaggtggccctgagcaacatcaaggaggccgacaacacagtgatgttcatgcagggcaagaggcagaaggagatctggcacctgctgaagatcgcctgcacccagagcagcgcccggagcctggtgggcagcagcctggagggcgctgtgaccccccagaccagcgcctggctgccccccaccagcgctgagcatgaccacagcctgagctgtgtggtgaccccccaggatggagagaccagcgcccagatgattgaggagaacctgaactgcctgggccacctgagcaccatcatccacgaggccaatgaggagcagggcaacagcatgatgaacctggactggagctggctgacagaatag

SEQ ID NO: 19145 - DNA, 1653 bp, Artificial Sequence
  Description of Artificial Sequence: Synthetic coding sequence
atgtggaaggccagcgctggccatgctgtgtccatcgcccaggatgatgctggagcagatgactgggagacagatcctgactttgtgaatgatgtgtctgagaaggagcagcgctggggcgccaagacagtgcagggcagcggccaccaggagcacatcaacatccacaagctgcgggagaatgtgttccaggagcaccagaccctgaaggagaaggagctggagaccggccccaaggccagccacggctacggcggcaagtttggagtggagcaggacaggatggacaagtctgctgtgggccacgagtaccagagcaagctgagcaagcactgcagccaggtggacagcgtgcggggctttggaggcaagtttggagtgcagatggacagagtggaccagagcgctgtgggctttgagtaccagggcaagacagagaagcacgccagccagaaggactacagcagcggctttggaggcaagtatggagtgcaggccgacagagtggacaagtctgctgtgggctttgactaccagggcaagacagagaagcatgagagccagagggactacagcaaaggatttggaggcaagtatggaattgacaaggacaaggtggacaagtctgctgtgggctttgagtaccagggcaagacagagaagcatgagagccagaaggactatgtgaagggctttggaggcaagtttggagtgcagacagaccggcaggacaagtgtgccctgggctgggaccaccaggagaagctgcagctgcacgagagccagaaggactacaagacaggctttggaggcaagtttggagtgcagagcgagcggcaggacagcgctgctgtgggctttgactacaaggagaagctggccaagcatgagagccagcaggactacagcaagggctttggaggcaagtatggagtgcagaaggacaggatggacaagaatgccagcacctttgaagatgtgacccaggtgagcagcgcctaccagaagacagtgcctgtggaggccgtgaccagcaagaccagcaacatccgggccaactttgagaacctggccaaggagaaggagcaggaggacaggaggaaggccgaggccgagcgggcccagaggatggccaaggagcggcaggagcaggaggaggcccggaggaagctggaggagcaggcccgggccaagacccagaccccacctgtgtccccagccccccagcccacagaggagcggctgcccagcagccctgtgtatgaagatgctgccagcttcaaggccgagctgagctaccggggccctgtgtctggaacagagcctgagcctgtgtacagcatggaggccgctgactaccgggaggccagcagccagcagggcctggcctatgccacagaggccgtgtatgagagcgctgaggcccctggccactacccagctgaggacagcacctatgatgaatatgaaaatgacctgggcatcacagctgtggccctgtatgactaccaggccgctggagatgatgagatcagctttgatcctgatgacatcatcaccaacatcgagatgattgatgatggctggtggaggggcgtgtgcaagggccgctatggcctcttccctgccaactacgtggagctgcggcagtag

SEQ ID NO: 19146 - DNA, 1542 bp, Artificial Sequence
  Description of Artificial Sequence: Synthetic coding sequence
atgtggaaggccagcgctggccatgctgtgtccatcgcccaggatgatgctggagcagatgactgggagacagatcctgactttgtgaatgatgtgtctgagaaggagcagcgctggggcgccaagacagtgcagggcagcggccaccaggagcacatcaacatccacaagctgcgggagaatgtgttccaggagcaccagaccctgaaggagaaggagctggagaccggccccaaggccagccacggctacggcggcaagtttggagtggagcaggacaggatggacaagtctgctgtgggccacgagtaccagagcaagctgagcaagcactgcagccaggtggacagcgtgcggggctttggaggcaagtttggagtgcagatggacagagtggaccagagcgctgtgggctttgagtaccagggcaagacagagaagcacgccagccagaaggactacagcagcggctttggaggcaagtatggagtgcaggccgacagagtggacaagtctgctgtgggctttgactaccagggcaagacagagaagcatgagagccagagggactacagcaaaggatttggaggcaagtatggaattgacaaggacaaggtggacaagtctgctgtgggctttgagtaccagggcaagacagagaagcatgagagccagaaggactatgtgaagggctttggaggcaagtttggagtgcagacagaccggcaggacaagtgtgccctgggctgggaccaccaggagaagctgcagctgcacgagagccagaaggactacagcaaaggatttggaggcaagtatggagtgcagaaggacaggatggacaagaatgccagcacctttgaagatgtgacccaggtgtcctctgcctaccagaagacagtgcctgtggaggccgtgaccagcaagaccagcaacatccgggccaactttgagaacctggccaaggagaaggagcaggaggacaggaggaaggccgaggccgagcgggcccagaggatggccaaggagcggcaggagcaggaggaggcccggaggaagctggaggagcaggcccgggccaagacccagaccccacctgtgtccccagccccccagcccacagaggagcggctgcccagcagccctgtgtatgaagatgctgccagcttcaaggccgagctgagctaccggggccctgtgtctggaacagagcctgagcctgtgtacagcatggaggccgctgactaccgggaggccagcagccagcagggcctggcctatgccacagaagctgtgtatgaatctgctgaggcccctggccactacccagctgaggacagcacctatgatgaatatgaaaatgacctgggcatcacagctgtggccctgtatgactaccaggccgctggagatgatgagatcagctttgatcctgatgacatcatcaccaacatcgagatgattgatgatggctggtggaggggcgtgtgcaagggccgctatggcctcttccctgccaactacgtggagctgcggcagtag

SEQ ID NO: 19147 - DNA, 1905 bp, Artificial Sequence
  Description of Artificial Sequence: Synthetic coding sequence
atgtggaaggccagcgctggccatgctgtgtccatcgcccaggatgatgctggagcagatgactgggagacagatcctgactttgtgaatgatgtgtctgagaaggagcagcgctggggcgccaagacagtgcagggcagcggccaccaggagcacatcaacatccacaagctgcgggagaatgtgttccaggagcaccagaccctgaaggagaaggagctggagaccggccccaaggccagccacggctacggcggcaagtttggagtggagcaggacaggatggacaagtctgctgtgggccacgagtaccagagcaagctgagcaagcactgcagccaggtggacagcgtgcggggctttggaggcaagtttggagtgcagatggacagagtggaccagagcgctgtgggctttgagtaccagggcaagacagagaagcacgccagccagaaggactacagcagcggctttggaggcaagtatggagtgcaggccgacagagtggacaagtctgctgtgggctttgactaccagggcaagacagagaagcatgagagccagagggactacagcaaaggatttggaggcaagtatggaattgacaaggacaaggtggacaagtctgctgtgggctttgagtaccagggcaagacagagaagcatgagagccagaaggactatgtgaagggctttggaggcaagtttggagtgcagacagaccggcaggacaagtgtgccctgggctgggaccaccaggagaagctgcagctgcacgagagccagaaggactacagcaaaggatttggaggcaagtatggagtgcagaaggacaggatggacaagaatgccagcacctttgaagatgtgacccaggtgtcctctgcctaccagaagacagtgcctgtggaggccgtgaccagcaagaccagcaacatccgggccaactttgagaacctggccaaggagaaggagcaggaggacaggaggaaggccgaggccgagcgggcccagaggatggccaaggagcggcaggagcaggaggaggcccggaggaagctggaggagcaggcccgggccaagacccagaccccacctgtgtccccagccccccagcccacagaggagcggctgcccagcagccctgtgtatgaagatgctgccagcttcaaggccgagctgagctaccggggccctgtgtctggaacagagcctgagcctgtgtacagcatggaggccgctgactaccgggaggccagcagccagcagggcctggcctatgccacagaagctgtgtatgaatctgctgaggcccctggccactacccagctgaggacagcacctatgatgaatatgaaaatgacctgggcatcacagctgtggccctgtatgactaccaggccgctggagatgatgagatcagctttgatcctgatgacatcatcaccaacatcgagatgattgatgatggctggtggaggggcgtgtgcaagggccgcttccgggagctggccttcagctgtgtgcgggtggccctggtgcccatcaagtgcagccgggacctgcccggccaggcccggggcctgcggagcgccctgtggagggtgggcaggaaggactgccccaggagaggagccagcagccgggtgtccctgctgggcagaagaggcctgggcctgatggaggtgaaccctgagctgagccaccctgagcacaggagctgccacgtgcgctgggagatctgcctgtgccacacagtgacagcccggcgcatcaggaagctgatctccttcctgcggagccgggaggccggccctgtgcccagctgcagccaggtgggcggcgtgtccttccagaaggtgacctggaagtgcctgggcacctgggtgcctgagtgcccctag

SEQ ID NO: 19148 - DNA, 945 bp, Artificial Sequence
  Description of Artificial Sequence: Synthetic coding sequence
atggacaagaatgccagcacctttgaagatgtgacccaggtgagcagcgcctaccagaagacagtgcctgtggaggccgtgaccagcaagaccagcaacatccgggccaactttgagaacctggccaaggagaaggagcaggaggacaggaggaaggccgaggccgagcgggcccagaggatggccaaggagcggcaggagcaggaggaggcccggaggaagctggaggagcaggcccgggccaagacccagaccccacctgtgtccccagccccccagcccacagaggagcggctgcccagcagccctgtgtatgaagatgctgccagcttcaaggccgagctgagctaccggggccctgtgtctggaacagagcctgagcctgtgtacagcatggaggccgctgactaccgggaggccagcagccagcagggcctggcctatgccacagaggccgtgtatgagagcgctgaggcccctggccactacccagctgaggacagcacctatgatgaatatgaaaatgacctgggcatcacagctgtggccctgtatgactaccaggccgctggagatgatgagatcagctttgatcctgatgacatcatcaccaacatcgagatgattgatgatggctggtggaggggcgtgtgcaagggccgcttccgggagctggccttcagctgtgtgcgggtggccctggtgcccatcaagtgcagccgggacctgcccggccaggcccggggcctgcggagcgccctgtggagggtgggcaggaaggactgcccccggcggggggccagcagccgggtgtccctgctgggccggcggggcctgggcctgatggaggtgaaccctgagctgagccaccctgagcacaggagctgccacgtgcgctgggagatctgcctgtgccacacagtgacagcccggcgcatcagatag

SEQ ID NO: 19149 - DNA, 1761 bp, Artificial Sequence
  Description of Artificial Sequence: Synthetic coding sequence
atgggcgtgaatgctgtgcactggttcaggaagggcctgcggctgcatgacaacccagccctgaaggagtgcatccagggcgctgacaccatccgctgtgtgtacatcctggacccctggtttgctggcagcagcaatgtgggcatcaaccgctggaggttcctgctgcagtgcctggaggacctggatgccaacctgaggaagctgaacagccgcctcttcgtcatccggggccagcctgcagatgtgttccccaggctcttcaaggagtggaacatcaccaagctgagcattgaatatgacagcgagccctttgggaaggagagagatgctgccatcaagaagctggccacagaggccggcgtggaggtgattgtgcgcatcagccacaccctgtatgacctggacaagatcatcgagctgaatggaggccagccccccctgacctacaagcgcttccagaccctcatcagcaagatggagcccctggagatccctgtggagaccatcaccagcgaggtgattgagaagtgcaccacccccctgagtgatgaccatgatgagaagtatggagtgcccagcctggaggagctgggctttgacacagatggcctgagcagcgctgtgtggccaggaggagaaacagaggccctgacccggctggagcggcacctggagaggaaggcctgggtggccaactttgagcggcccaggatgaatgccaacagcctgctggccagccccaccggcctgagcccctacctgcgcttcggctgcctgagctgccgcctcttctacttcaagctgacagacctgtacaagaaggtgaagaagaacagcagcccccccctgagcctgtatggccagctgctgtggagggagttcttctacacagctgccaccaacaaccccaggtttgacaagatggagggcaaccccatctgtgtgcagatcccctgggacaagaaccctgaggccctggccaagtgggccgagggccgcacaggcttcccctggattgatgccatcatgacccagctgcggcaggagggctggatccaccacctggcccggcatgctgtggcctgcttcctgaccaggggggacctgtggatctcctgggaggagggcatgaaggtgtttgaggagctgctgctggatgctgactggagcatcaatgccggctcctggatgtggctgagctgcagcagcttcttccagcagttcttccactgctactgccctgtgggcttcggccgcaggacagaccccaatggagactacatccgccgctacctgcctgtgctgcggggcttccctgccaagtacatctatgacccctggaatgcccctgagggcatccagaaggtggccaagtgcctgattggagtgaactaccccaagcccatggtgaaccacgccgaggccagccggctgaacattgaaagaatgaagcagatctaccagcagctgagccgctaccggggcctgggcctgctggcctctgtgcccagcaaccccaatggaaatggaggcttcatgggctacagcgctgagaacatccctggctgcagcagcagcggcagctgcagccagggcagcggcatcctgcactacgcccatggagacagccagcagacccacctgctgaagcagggccgcagctccatgggcaccggcctgagcggcggcaagaggcccagccaggaggaggacacccagagcatcggccccaaggtgcagaggcagagcaccaactag

SEQ ID NO: 19150 - DNA, 582 bp, Artificial Sequence
  Description of Artificial Sequence: Synthetic coding sequence
atgctggaggtgggctgcggctgcctggtggtgcccttcttcaacttcttccactgctactgccctgtgggctttggaagaagaacagaccccaacggggactacatccgccgctacctgcctgtgctgcggggcttccctgccaagtacatctatgacccctggaatgcccctgagggcatccagaaggtggccaagtgcctgattggagtgaactaccccaagcccatggtgaaccacgccgaggccagccggctgaacatcgagaggatgaagcagatctaccagcagctgagccgctaccggggcctgggcctgctggcctctgtgcccagcaaccccaatggaaatggaggcttcatgggctacagcgctgagaacatccctggctgcagcagcagcggcagctgcagccagggcagcggcatcctgcactacgcccacggggacagccagcagacccacctgctgaagcagggccgcagctccatgggcaccggcctgagcggcggcaagaggcccagccaggaggaggacacccagagcatcggccccaaggtgcagaggcagagcaccaactag

SEQ ID NO: 19151 - DNA, 1323 bp, Artificial Sequence
  Description of Artificial Sequence: Synthetic coding sequence
atgggcagcagccacctgctgaacaagggcctgcccctgggcgtgcggccccccatcatgaatggccccctgcacccccggcccctggtggccctgctggatggccgggactgcaccgtggagatgcccatcctgaaggatgtggccaccgtggccttctgtgatgcccagagcacccaggagatccacgagaaggtgctgaatgaggccgtgggcgccctgatgtaccacaccatcaccctgacccgggaggacctggagaagttcaaggccctgcgcatcatcgtgcgcatcggcagcggctttgacaacatcgacatcaagtctgctggggacctgggcattgctgtgtgcaatgtgcctgctgcctctgtggaggagacagctgacagcaccctgtgccacatcctgaacctgtacagaagagccacctggctgcaccaggccctgcgggagggcaccagggtgcagagcgtggagcagatccgggaggtggccagcggggccgcccgcatccggggggagaccctgggcatcatcggcctgggccgggtgggccaggccgtggccctgcgggccaaggccttcggcttcaacgtgctcttctatgacccctacctgagtgatggagtggagcgggccctgggcctgcagagggtgtccaccctgcaggacctgctcttccacagcgactgtgtgaccctgcactgcggcctgaatgagcacaaccaccacctgatcaatgacttcaccgtgaagcagatgaggcagggcgccttcctggtgaacacagcccggggcggcctggtggatgagaaggccctggcccaggccctgaaggagggccgcatcagaggagctgccctggatgtgcatgagagcgagcccttctccttcagccagggccccctgaaggatgcccccaacctgatctgcacccctcatgctgcctggtacagcgagcaggccagcattgagatgagggaggaggccgcccgggagatccggcgggccatcaccggccgcatcccagacagcctgaagaactgtgtgaacaaggaccacctgacagctgccacccactgggcctccatggaccctgctgtggtgcaccctgagctgaatggagctgcctaccgctacccacctggggtggtgggcgtggcccccaccggcatcccagctgctgtggagggcatcgtgcccagcgccatgagcctgagccacggcctgccccctgtggcccacccccctcatgcccccagccctggccagacagtgaagccagaggccgaccgggaccacgccagtgaccagctgtag

SEQ ID NO: 19152 - DNA, 1290 bp, Artificial Sequence
  Description of Artificial Sequence: Synthetic coding sequence
atgtctggagtgcggccccccatcatgaatggccccctgcacccccggcccctggtggccctgctggatggccgggactgcaccgtggagatgcccatcctgaaggatgtggccaccgtggccttctgtgatgcccagagcacccaggagatccacgagaaggtgctgaatgaagctgtgggcgccctgatgtaccacaccatcaccctgacccgggaggacctggagaagttcaaggccctgcgcatcatcgtgagaattggcagcggctttgacaacatcgacatcaagtctgctggggacctgggcattgctgtgtgcaatgtgcctgctgcctctgtggaggagacagctgacagcaccctgtgccacatcctgaacctgtaccgccgggccacctggctgcaccaggccctgcgggagggcaccagggtgcagagcgtggagcagatccgggaggtggccagcggggccgcccgcatccggggggagaccctgggcatcatcggcctgggccgggtgggccaggccgtggccctgcgggccaaggccttcggcttcaacgtgctcttctatgacccctacctgagtgatggagtggagcgggccctgggcctgcagagggtgtccaccctgcaggacctgctcttccacagcgactgtgtgaccctgcactgcggcctgaatgagcacaaccaccacctgatcaatgacttcaccgtgaagcagatgaggcagggcgccttcctggtgaacacagcccggggcggcctggtggatgagaaggccctggcccaggccctgaaggagggccgcatccggggggccgccctggatgtgcatgaaagtgagcccttctccttcagccagggccccctgaaggatgcccccaacctgatctgcacccctcatgctgcctggtacagcgagcaggccagcattgagatgagggaggaggccgcccgggagatcagaagagccatcaccggccgcatcccagacagcctgaagaactgtgtgaacaaggaccacctgacagctgccacccactgggcctccatggaccctgctgtggtgcaccctgagctgaatggagctgcctaccgctacccacctggggtggtgggcgtggcccccaccggcatcccagctgctgtggagggcatcgtgcccagcgccatgagcctgagccacggcctgccccctgtggcccaccccccccacgcccccagccctggccagacagtgaagccagaggccgaccgggaccacgccagtgaccagctgtag

SEQ ID NO: 19153 - DNA, 438 bp, Artificial Sequence
  Description of Artificial Sequence: Synthetic coding sequence
atgtctggagtgcggccccccatcatgaatggccccctgcacccccggcccctggtggccctgctggatggccgggactgcaccgtggagatgcccatcctgaaggatgtggccaccgtggccttctgtgatgcccagagcacccaggagatccacgagaaggtgctgaatgaagctgtgggcgccctgatgtaccacaccatcaccctgacccgggaggacctggagaagttcaaggccctgcgcatcatcgtgagaattggcagcggctttgacaacatcgacatcaagtctgctggggacctgggcattgctgtgtgcaatgtgcctgctgcctctgtggaggagacagctgacagcaccctgtgccacatcctgaacctgtaccgccgggccacctggctgcaccaggccctgcgggagggcaccagggtgtag

SEQ ID NO: 19154 - DNA, 516 bp, Artificial Sequence
  Description of Artificial Sequence: Synthetic coding sequence
atgtctggagtgcggccccccatcatgaatggccccctgcacccccggcccctggtggccctgctggatggccgggactgcaccgtggagatgcccatcctgaaggatgtggccaccgtggccttctgtgatgcccagagcacccaggagatccacgagaaggtgctgaatgaagctgtgggcgccctgatgtaccacaccatcaccctgacccgggaggacctggagaagttcaaggccctgcgcatcatcgtgagaattggcagcggctttgacaacatcgacatcaagtctgctggggacctgggcattgctgtgtgcaatgtgcctgctgcctctgtggaggagacagctgacagcaccctgtgccacatcctgaacctgtaccgccgggccacctggctgcaccaggccctgcgggagggcaccagggtgcagagcgtggagcagatccgggaggtggccagcggggccgcccgcatccggggggagaccctgggcatcatcggcctgtag

SEQ ID NO: 19155 - DNA, 2958 bp, Artificial Sequence
  Description of Artificial Sequence: Synthetic coding sequence
atgcctgtgcccagccgccacatcaacatcggccgcagccagagctgggatgctgctggctggtatgagggcccctgggagaatgctgagagcctgcggcccctgggcagaagaagcagcctgacctatggaacagctgagggcacctggtttgagcccaaccaccggccccaggatgctgccctgcctgtggccgctgagccctacctgtaccgggaggccgtgtacaacagcgtggccgccaggaagggcagcaccccagacttcaccttctatgacagccggcaggccgtgatgagcggccgcagccccctgctgccccgggagtactacagcgaccccagcggggccgcccgggtgcccaaggagccccccctgtacagagaccccggggtgtccaggcctgtgcccagctatggagtgctgggcagcaggacctcctgggaccccatgcagggccgcagccctgccctgcaggatgctggccacctgtacagagaccccggcggcaagatgatcccccagggccggcagacccagagcagagctgccagccctggccgctatggccgggagcagcctgacacccgctacggggctgaggtgcctgcctaccccctgagccaggtgttcagtgacatcagcgagcggcccattgatcctgccccagcccggcaggtggcccccacctgcctggtggtggaccccagcagcgctgctgcccctgagggcagcactggagtggcccctggggccctgaacagaggctacggccctgcccgggagagcatccccagcaagatggcctatgagacctatgaagctgacctgagcaccttccagggccctgggggcaagaggacagtgctgcctgagttcctggccttcctgcgggcagagggcctggccgaggccaccctgggcgccctgctgcagcagggctttgacagccctgctgtgctggccaccctggaggatgctgacatcaagtctgtggcccccaacctgggccaggcccgggtgctgagccggctggccaacagctgcaggacagagatgcagctgcggcggcaggacagaggaggccccctgccccgggcccggagcagcagcttcagccacaggtctgagctgctgcacggggacctggccagcctgggcgctgctgcccccctgcagacagccagccccagggctggggaccctgcccggcggcccagcagcgcccccagccagcacctgctggagacagctgccacctacagcgcccctggggtgggcacccacgccccccacttccccagcaacagcggctacagcagccccaccccctgtgccctgacagcccggctgagccccacctaccccctgcaggccggcgtggccctgaccaaccctggccccagcaaccccctgcaccctggccccaggacagcctacagcacagcctacacagtgcccatggagctgctgaagcgggagagaaatgtggccgccagccccctgcccagcccccacggcagcccccaggtgctgaggaagccaggggcccccctgggccccagcaccctgcccccagccagccagagcctgcacaccccccacagcccctaccagaaggtggccaggagaactggagcccccatcatcgtgtccaccatgctggcccctgagcccagcatccggccccagatcatgaatggccccctgcacccccggcccctggtggccctgctggatggccgggactgcaccgtggagatgcccatcctgaaggacctggccaccgtggccttctgtgatgcccagagcacccaggagatccacgagaaggtgctgaatgaggccgtgggcgccatgatgtaccacaccatcaccctgacccgggaggacctggagaagttcaaggccctgcgggtgattgtgcgcatcggcagcggctatgacaacgtggacatcaaggccgccggggagctgggcattgctgtgtgcaacatccccagcgctgctgtggaggagacagctgacagcaccatctgccacatcctgaacctgtacagaagaaacacctggctgtaccaggccctgcgggagggcaccagggtgcagagcgtggagcagatccgggaggtggccagcggggccgcccgcatccggggggagaccctgggcctcatcggcttcggccgcacaggccaggccgtggccgtgcgggccaaggccttcggcttcagcgtcatcttctatgacccctacctgcaggacggcatcgagaggagcctgggcgtgcagagggtgtacaccctgcaggacctgctgtaccagagcgactgtgtgtccctgcactgcaacctgaatgagcacaaccaccacctgatcaatgacttcaccatcaagcagatgaggcagggcgccttcctggtgaatgctgcccggggcggcctggtggatgagaaggccctggcccaggccctgaaggagggccgcatcagaggagctgccctggatgtgcatgagagcgagcccttctcctttgcccagggccccctgaaggatgcccccaacctgatctgcaccccccacacagcctggtacagcgagcaggccagcctggagatgagggaggccgccgccacagagatccggcgggccatcaccggccgcatccctgagagcctgaggaactgtgtgaacaaggagttctttgtgaccagcgccccctggagcgtgattgaccagcaggccatccaccctgagctgaatggagccacctaccgctacccacctggcatcgtgggcgtggcccctgggggcctgcctgctgccatggagggcatcatccctgggggcatccctgtgacccacaacctgcccaccgtggcccaccccagccaggcccccagccccaaccagcccaccaagcatggagacaaccgggagcaccccaatgagcagtag

SEQ ID NO: 19156 - DNA, 1338 bp, Artificial Sequence
  Description of Artificial Sequence: Synthetic coding sequence
atggccctggtggacaagcacaaggtgaagaggcagaggctggaccgcatctgtgagggcatccggccccagatcatgaatggccccctgcacccccggcccctggtggccctgctggatggccgggactgcaccgtggagatgcccatcctgaaggacctggccaccgtggccttctgtgatgcccagagcacccaggagatccacgagaaggtgctgaatgaggccgtgggcgccatgatgtaccacaccatcaccctgacccgggaggacctggagaagttcaaggccctgcgggtgattgtgcgcatcggcagcggctatgacaacgtggacatcaaggccgccggggagctgggcattgctgtgtgcaacatccccagcgctgctgtggaggagacagctgacagcaccatctgccacatcctgaacctgtacagaagaaacacctggctgtaccaggccctgcgggagggcaccagggtgcagagcgtggagcagatccgggaggtggccagcggggccgcccgcatccggggggagaccctgggcctcatcggcttcggccgcacaggccaggccgtggccgtgcgggccaaggccttcggcttcagcgtcatcttctatgacccctacctgcaggacggcatcgagaggagcctgggcgtgcagagggtgtacaccctgcaggacctgctgtaccagagcgactgtgtgtccctgcactgcaacctgaatgagcacaaccaccacctgatcaatgacttcaccatcaagcagatgaggcagggcgccttcctggtgaatgctgcccggggcggcctggtggatgagaaggccctggcccaggccctgaaggagggccgcatcagaggagctgccctggatgtgcatgagagcgagcccttctcctttgcccagggccccctgaaggatgcccccaacctgatctgcaccccccacacagcctggtacagcgagcaggccagcctggagatgagggaggccgccgccacagagatccggcgggccatcaccggccgcatccctgagagcctgaggaactgtgtgaacaaggagttctttgtgaccagcgccccctggagcgtgattgaccagcaggccatccaccctgagctgaatggagccacctaccgctacccacctggcatcgtgggcgtggcccctgggggcctgcctgctgccatggagggcatcatccctgggggcatccctgtgacccacaacctgcccaccgtggcccaccccagccaggcccccagccccaaccagcccaccaagcatggagacaaccgggagcaccccaatgagcagtag

SEQ ID NO: 19157 - DNA, 1338 bp, Artificial Sequence; identical to SEQ ID NO: 19156
  Description of Artificial Sequence: Synthetic coding sequence

SEQ ID NO: 19158 - DNA, 1338 bp, Artificial Sequence; identical to SEQ ID NO: 19156
  Description of Artificial Sequence: Synthetic coding sequence

SEQ ID NO: 19159 - DNA, 12 bp, Artificial Sequence
  Description of Artificial Sequence: Synthetic coding sequence
atggccctgtag

SEQ ID NO: 19160 - DNA, 1338 bp, Artificial Sequence; identical to SEQ ID NO: 19156
  Description of Artificial Sequence: Synthetic coding sequence

SEQ ID NO: 19161 - DNA, 2331 bp, Artificial Sequence
  Description of Artificial Sequence: Synthetic coding sequence
atgagcagcaccaggagccagaacccccacggcctgaagcagatcggcctggaccagatctgggatgacctgcgggccggcatccagcaggtgtacacccggcagagcatggccaagagccgctacatggagctgtacacccacgtgtacaactactgcacctctgtgcaccagagcaaccaggcccggggagctggggtgccccccagcaagagcaagaagggccagacccctgggggcgcccagtttgtgggcctggagctgtacaagaggctgaaggagttcctgaagaactacctgaccaacctgctgaaggatggagaggacctgatggatgagagcgtgctgaagttctacacccagcagtgggaggactaccgcttcagcagcaaggtgctgaatggcatctgtgcctacctgaacagacactgggtgcggcgggagtgtgatgagggcaggaagggcatctatgagatctacagcctggccctggtgacctggagggactgcctcttccggcccctgaacaagcaggtgaccaatgctgtgctgaagctgattgagaaggagagaaatggagagaccatcaacaccaggctcatcagcggcgtggtgcagagctatgtggagctgggcctgaatgaagatgatgcctttgccaagggccccaccctgactgtgtacaaggagagctttgagagccagttcctggccgacacagagcgcttctacacccgggagagcacagagttcctgcagcagaaccctgtgacagagtacatgaagaaggccgaggcccggctgctggaggagcagaggagagtgcaggtgtacctgcacgagagcacccaggatgagctggccaggaaatgtgagcaggtgctgattgagaagcacctggagatcttccacacagagttccagaacctgctggatgctgacaagaatgaagacctgggccgcatgtacaacctggtgagccgcatccaggacggcctgggggagctgaagaagctgctggagacccacatccacaaccagggcctggccgccatcgagaagtgtggggaggccgccctgaatgaccccaagatgtatgtgcagacagtgctggatgtgcacaagaagtacaatgccctggtgatgtctgccttcaacaatgatgctggctttgtggccgccctggacaaggcctgtggccgcttcatcaacaacaatgctgtgaccaagatggcccagagcagcagcaagagccctgagctgctggcccgctactgtgacagcctgctgaagaagagcagcaagaaccctgaggaggccgagctggaggacaccctgaaccaggtgatggtggtgttcaagtacatcgaggacaaggatgtgttccagaagttctacgccaagatgctggccaagaggctggtgcaccagaacagcgccagtgatgatgctgaggcctccatgatcagcaagctgaagcaggcctgtggctttgagtacaccagcaagctgcagaggatgttccaggacattggagtgtccaaggacctgaatgagcagttcaagaagcacctgaccaacagcgagcccctggacctggacttcagcatccaggtgctgagcagcggctcctggcccttccagcagagctgcacctttgccctgcccagcgagctggagaggagctaccagcgcttcaccgccttctacgccagccgccacagcggcaggaagctgacctggctgtaccagctgagcaaaggagagctggtgaccaactgcttcaagaaccgctacaccctgcaggccagcaccttccagatggccatcctgctgcagtacaacacagaagatgcctacacagtgcagcagctgacagacagcacccagatcaagatggacatcctggcccaggtgctgcagatcctgctgaagagcaagctgctggtgctggaggatgaaaatgccaacgtggatgaggtggagctgaagccagacaccctcatcaagctgtacctgggctacaagaacaagaagctgcgggtgaacatcaacgtgcccatgaagacagagcagaagcaggagcaggagaccacccacaagaacatcgaggaggacaggaagctgctgatccaggccgccatcgtgcgcatcatgaagatgaggaaggtgctgaagcaccagcagctgctgggggaggtgctgacccagctgagcagccgcttcaagccccgggtgcctgtgatcaagaagtgcatcgacatcctgattgagaaggagtacctggagcgggtggatggagagaaggacacctacagctacctggcctag

SEQ ID NO: 19162 - DNA, 2331 bp, Artificial Sequence; identical to SEQ ID NO: 19161
  Description of Artificial Sequence: Synthetic coding sequence

SEQ ID NO: 19163 - DNA, 2112 bp, Artificial Sequence
  Description of Artificial Sequence: Synthetic coding sequence
atgagcagcaccaggagccagaacccccacggcctgaagcagatcggcctggaccagatctgggatgacctgcgggccggcatccagcaggtgtacacccggcagagcatggccaagagccgctacatggagctgtacacccagcagtgggaggactaccgcttcagcagcaaggtgctgaatggcatctgtgcctacctgaacagacactgggtgagaagagaatgtgatgagggcaggaagggcatctatgagatctacagcctggccctggtgacctggagggactgcctcttccggcccctgaacaagcaggtgaccaatgctgtgctgaagctgattgagaaggagagaaatggagagaccatcaacaccaggctcatctctggagtggtgcagagctatgtggagctgggcctgaatgaagatgatgcctttgccaagggccccaccctgactgtgtacaaggagagctttgagagccagttcctggccgacacagagcgcttctacacccgggagagcacagagttcctgcagcagaaccctgtgacagagtacatgaagaaggccgaggcccggctgctggaggagcagaggagagtgcaggtgtacctgcacgagagcacccaggatgagctggccaggaaatgtgagcaggtgctgattgagaagcacctggagatcttccacacagagttccagaacctgctggatgctgacaagaatgaagacctgggccgcatgtacaacctggtgagccgcatccaggacggcctgggggagctgaagaagctgctggagacccacatccacaaccagggcctggccgccattgaaaaatgtggggaggccgccctgaatgaccccaagatgtatgtgcagacagtgctggatgtgcacaagaagtacaatgccctggtgatgtctgccttcaacaatgatgctggctttgtggccgccctggacaaggcctgtggccgcttcatcaacaacaatgctgtgaccaagatggcccagagcagcagcaagagccctgagctgctggcccgctactgtgacagcctgctgaagaagagcagcaagaaccctgaggaggccgagctggaggacaccctgaaccaggtgatggtggtgttcaagtacatcgaggacaaggatgtgttccagaagttctacgccaagatgctggccaagaggctggtgcaccagaacagcgccagtgatgatgctgaggcctccatgatcagcaagctgaagcaggcctgtggctttgagtacaccagcaagctgcagaggatgttccaggacatcggcgtgtccaaggacctgaatgagcagttcaagaagcacctgaccaacagcgagcccctggacctggacttcagcatccaggtgctgagcagcggctcctggcccttccagcagagctgcacctttgccctgcccagcgagctggagaggagctaccagcgcttcaccgccttctacgccagccgccacagcggcaggaagctgacctggctgtaccagctgagcaagggggagctggtgaccaactgcttcaagaaccgctacaccctgcaggccagcaccttccagatggccatcctgctgcagtacaacacagaagatgcctacacagtgcagcagctgacagacagcacccagatcaagatggacatcctggcccaggtgctgcagatcctgctgaagagcaagctgctggtgctggaggatgaaaatgccaacgtggatgaggtggagctgaagccagacaccctcatcaagctgtacctgggctacaagaacaagaagctgcgggtgaacatcaacgtgcccatgaagacagagcagaagcaggagcaggagaccacccacaagaacatcgaggaggacaggaagctgctgatccaggccgccatcgtgcgcatcatgaagatgaggaaggtgctgaagcaccagcagctgctgggggaggtgctgacccagctgagcagccgcttcaagccccgggtgcctgtgatcaagaagtgcatcgacatcctgattgagaaggagtacctggagcgggtggatggagagaaggacacctacagctacctggcctag

SEQ ID NO: 19164 - DNA, 1824 bp, Artificial Sequence
  Description of Artificial Sequence: Synthetic coding sequence
atggagctgtacacccacgtgtacaactactgcacctctgtgcaccagagcaaccaggcccggggagctggggtgccccccagcaagagcaagaagggccagacccctgggggcgcccagtttgtgggcctggagctgtacaagaggctgaaggagttcctgaagaactacctgaccaacctgctgaaggatggagaggacctgatggatgagagcgtgctgaagttctacacccagcagtgggaggactaccgcttcagcagcaaggtgctgaatggcatctgtgcctacctgaacagacactgggtgcggcgggagtgtgatgagggcaggaagggcatctatgagatctacagcctggccctggtgacctggagggactgcctcttccggcccctgaacaagcaggtgaccaatgctgtgctgaagctgattgagaaggagagaaatggagagaccatcaacaccaggctcatcagcggcgtggtgcagagctatgtggagctgggcctgaatgaagatgatgcctttgccaagggccccaccctgactgtgtacaaggagagctttgagagccagttcctggccgacacagagcgcttctacacccgggagagcacagagttcctgcagcagaaccctgtgacagagtacatgaagaaggccgaggcccggctgctggaggagcagaggagagtgcaggtgtacctgcacgagagcacccaggatgagctggccaggaaatgtgagcaggtgctgattgagaagcacctggagatcttccacacagagttccagaacctgctggatgctgacaagaatgaagacctgggccgcatgtacaacctggtgagccgcatccaggacggcctgggggagctgaagaagctgctggagacccacatccacaaccagggcctggccgccatcgagaagtgtggggaggccgccctgaatgaccccaagatgtatgtgcagacagtgctggatgtgcacaagaagtacaatgccctggtgatgtctgccttcaacaatgatgctggctttgtggccgccctggacaaggcctgtggccgcttcatcaacaacaatgctgtgaccaagatggcccagagcagcagcaagagccctgagctgctggcccgctactgtgacagcctgctgaagaagagcagcaagaaccctgaggaggccgagctggaggacaccctgaaccaggtgatggtggtgttcaagtacatcgaggacaaggatgtgttccagaagttctacgccaagatgctggccaagaggctggtgcaccagaacagcgccagtgatgatgctgaggcctccatgatcagcaagctgaagcaggcctgtggctttgagtacaccagcaagctgcagaggatgttccaggacattggagtgtccaaggacctgaatgagcagttcaagaagcacctgaccaacagcgagcccctggacctggacttcagcatccaggtgctgagcagcggctcctggcccttccagcagagctgcacctttgccctgcccagcgagctggagaggagctaccagcgcttcaccgccttctacgccagccgccacagcggcaggaagctgacctggctgtaccagctgagcaaaggagagctggtgaccaactgcttcaagaaccgctacaccctgcaggccagcaccttccagatggccatcctgctgcagtacaacacagaagatgcctacacagtgcagcagctgacagacagcacccagatcaagatggacatcctggcccaggtgctgcagatcctgctgaagagcaagctgctgtag

SEQ ID NO: 19165 - DNA, 2121 bp, Artificial Sequence
  Description of Artificial Sequence: Synthetic coding sequence
atgagcctgaagccccgggtggtggactttgatgagacctggaacaagctgctgaccaccatcaaggctgtggtgatgctggagtatgtggagcgggccacctggaatgaccgcttcagtgacatctatgccctgtgtgtggcctacccagagcccctgggggagcggctgtacacagagaccaagatcttcctggagaaccacgtgcgccacctgcacaagagggtgctggagagcgaggagcaggtgctggtgatgtaccaccgctactgggaggagtacagcaaaggagctgactacatggactgcctgtaccgctacctgaacacccagttcatcaagaagaacaagctgacagaagctgacctgcagtatggctatggaggagtggacatgaatgagcccctgatggagattggagagctggccctggacatgtggaggaagctgatggtggagcccctgcaggccatcctgatccgcatgctgctgcgggagatcaagaatgaccggggcggggaggaccccaaccagaaggtgatccacggcgtcatcaacagctttgtgcacgtggagcagtacaagaagaagttccccctgaagttctaccaggagatctttgagagccccttcctgacagaaacaggagagtactacaagcaggaggccagcaacctgctgcaggagagcaactgcagccagtacatggagaaggtgctgggccgcctgaaggatgaggagatccgctgcaggaagtacctgcaccccagcagctacaccaaggtgattcatgagtgccagcagaggatggtggccgaccacctgcagttcctgcacgccgagtgccacaacatcatccggcaggagaagaagaatgacatggccaacatgtatgtgctgctgcgggctgtgtccacaggcctgccccacatgatccaggagctgcagaaccacatccatgatgagggcctgcgggccaccagcaacctgacccaggagaacatgcccaccctgtttgtggagagcgtgctggaggtgcacggcaagtttgtgcagctgatcaacacagtgctgaatggagaccagcacttcatgtctgccctggacaaggccctgacctctgtggtgaactaccgggagcccaagtctgtgtgcaaggcccctgagctgctggccaagtactgtgacaacctgctgaagaagagcgccaagggcatgacagaaaatgaggtggaggaccggctgaccagcttcatcaccgtcttcaagtacattgatgacaaggatgtgttccagaagttctacgccaggatgctggccaagaggctcatccacggcctgtccatgtccatggattctgaggaggccatgatcaacaagctgaagcaggcctgtggctatgagttcaccagcaagctgcacaggatgtacacagacatgtctgtgtctgctgacctgaacaacaagttcaacaacttcatcaagaaccaggacacagtgattgacctgggcatctccttccagatctacgtgctgcaggccggggcctggcccctgacccaggcccccagcagcacctttgccatcccccaggagctggagaagtctgtgcagatgtttgagctgttctacagccagcacttcagcggcaggaagctgacctggctgcactacctgtgcacaggagaggtgaagatgaactacctgggcaagccctacgtggccatggtgaccacctaccagatggctgtgctgctggccttcaacaacagcgagaccgtgtcctacaaggagctgcaggacagcacccagatgaatgagaaggagctgaccaagaccatcaagagcctgctggatgtgaagatgatcaaccatgattctgagaaggaggacattgatgctgagagcagcttcagcctgaacatgaacttcagcagcaagaggaccaagttcaagatcaccacctccatgcagaaggacaccccccaggtgatcagccagagccgggcccgcttcaaccccagcatctccatgatcaagaagtgcatcgaggtgctgattgacaagcagtacatcgagaggagccaggccagcgcagatgagtacagctatgtggcctag

SEQ ID NO: 19166 - DNA, 2121 bp, Artificial Sequence; identical to SEQ ID NO: 19165
  Description of Artificial Sequence: Synthetic coding sequence

SEQ ID NO: 19167 - DNA, 2238 bp, Artificial Sequence
  Description of Artificial Sequence: Synthetic coding sequence
atgagcctgaagccccgggtggtggactttgatgagacctggaacaagctgctgaccaccatcaaggctgtggtgatgctggagtatgtggagcgggccacctggaatgaccgcttcagtgacatctatgccctgtgtgtggcctacccagagcccctgggggagcggctgtacacagagaccaagatcttcctggagaaccacgtgcgccacctgcacaagagggtgctggagagcgaggagcaggtgctggtgatgtaccaccgctactgggaggagtacagcaaaggagctgactacatggactgcctgtaccgctacctgaacacccagttcatcaagaagaacaagctgacagaagctgacctgcagtatggctatggaggagtggacatgaatgagcccctgatggagattggagagctggccctggacatgtggaggaagctgatggtggagcccctgcaggccatcctgatccgcatgctgctgcgggagatcaagaatgaccggggcggggaggaccccaaccagaaggtgatccacggcgtcatcaacagctttgtgcacgtggagcagtacaagaagaagttccccctgaagttctaccaggagatctttgagagccccttcctgacagaaacaggagagtactacaagcaggaggccagcaacctgctgcaggagagcaactgcagccagtacatggagaaggtgctgggccgcctgaaggatgaggagatccgctgcaggaagtacctgcaccccagcagctacaccaaggtgattcatgagtgccagcagaggatggtggccgaccacctgcagttcctgcacgccgagtgccacaacatcatccggcaggagaagaagaatgacatggccaacatgtatgtgctgctgcgggctgtgtccacaggcctgccccacatgatccaggagctgcagaaccacatccatgatgagggcctgcgggccaccagcaacctgacccaggagaacatgcccaccctgtttgtggagagcgtgctggaggtgcacggcaagtttgtgcagctgatcaacacagtgctgaatggagaccagcacttcatgtctgccctggacaaggccctgacctctgtggtgaactaccgggagcccaagtctgtgtgcaaggcccctgagctgctggccaagtactgtgacaacctgctgaagaagagcgccaagggcatgacagaaaatgaggtggaggaccggctgaccagcttcatcaccgtcttcaagtacattgatgacaaggatgtgttccagaagttctacgccaggatgctggccaagaggctcatccacggcctgtccatgtccatggattctgaggaggccatgatcaacaagctgaagcaggcctgtggctatgagttcaccagcaagctgcacaggatgtacacagacatgtctgtgtctgctgacctgaacaacaagttcaacaacttcatcaagaaccaggacacagtgattgacctgggcatctccttccagatctacgtgctgcaggccggggcctggcccctgacccaggcccccagcagcacctttgccatcccccaggagctggagaagtctgtgcagatgtttgagctgttctacagccagcacttcagcggcaggaagctgacctggctgcactacctgtgcacaggagaggtgaagatgaactacctgggcaagccctacgtggccatggtgaccacctaccagatggctgtgctgctggccttcaacaacagcgagaccgtgtcctacaaggagctgcaggacagcacccagatgaatgagaaggagctgaccaagaccatcaagagcctgctggatgtgaagatgatcaaccatgattctgagaaggaggacattgatgctgagagcagcttcagcctgaacatgaacttcagcagcaagaggaccaagttcaagatcaccacctccatgcagaaggacaccccccaggagatggagcagaccaggtctgctgtggatgaggacaggaagatgtacctgcaggccgccatcgtgcgcatcatgaaggccaggaaggtgctgcggcacaatgccctgatccaggaggtgatcagccagagccgggcccgcttcaaccccagcatctccatgatcaagaagtgcatcgaggtgctgattgacaagcagtacatcgagaggagccaggccagcgcagatgagtacagctatgtggcctag

SEQ ID NO: 19168 - DNA, 2238 bp, Artificial Sequence; identical to SEQ ID NO: 19167
  Description of Artificial Sequence: Synthetic coding sequence

SEQ ID NO: 19169 - DNA, 2238 bp, Artificial Sequence; identical to SEQ ID NO: 19167
  Description of Artificial Sequence: Synthetic coding sequence

SEQ ID NO: 19170 - DNA, 2067 bp, Artificial Sequence
  Description of Artificial Sequence: Synthetic coding sequence
atgctgtatgtgtggcccatcctgaaccccctggagaaggacttcatccagaagctgcgcttcttctggaagatcatgtttggcatctgcatccgctactgggaggagtacagcaaaggagctgactacatggactgcctgtaccgctacctgaacacccagttcatcaagaagaacaagctgacagaggccgacctgcagtatggctacggcggcgtggacatgaatgagcccctgatggagatcggggagctggccctggacatgtggaggaagctgatggtggagcccctgcaggccatcctgatccgcatgctgctgcgggagatcaagaatgacagaggaggagaggaccccaaccagaaggtgattcatggagtcatcaacagctttgtgcacgtggagcagtacaagaagaagttccccctgaagttctaccaggagatctttgagagccccttcctgacagagaccggggagtactacaagcaggaggccagcaacctgctgcaggagagcaactgcagccagtacatggagaaggtgctgggccgcctgaaggatgaggagatccgctgcaggaagtacctgcaccccagcagctacaccaaggtgattcatgagtgccagcagaggatggtggccgaccacctgcagttcctgcatgctgagtgccacaacatcatccggcaggagaagaagaatgacatggccaacatgtatgtgctgctgcgggctgtgtccacaggcctgccccacatgatccaggagctgcagaaccacatccatgatgagggcctgcgggccaccagcaacctgacccaggagaacatgcccaccctgtttgtggagagcgtgctggaggtgcacggcaagtttgtgcagctgatcaacacagtgctgaatggagaccagcacttcatgtctgccctggacaaggccctgacctctgtggtgaactaccgggagcccaagtctgtgtgcaaggcccctgagctgctggccaagtactgtgacaacctgctgaagaagagcgccaagggcatgacagaaaatgaggtggaggaccggctgaccagcttcatcaccgtcttcaagtacattgatgacaaggatgtgttccagaagttctacgccaggatgctggccaagaggctcatccacggcctgtccatgtccatggacagcgaggaggccatgatcaacaagctgaagcaggcctgtggctatgagttcaccagcaagctgcacaggatgtacacagacatgtctgtgtctgctgacctgaacaacaagttcaacaacttcatcaagaaccaggacaccgtcatcgacctgggcatctccttccagatctacgtgctgcaggccggggcctggcccctgacccaggcccccagcagcacctttgccatcccccaggagctggagaagtctgtgcagatgtttgagctgttctacagccagcacttcagcggcaggaagctgacctggctgcactacctgtgcaccggggaggtgaagatgaactacctgggcaagccctacgtggccatggtgaccacctaccagatggctgtgctgctggccttcaacaacagcgagaccgtgtcctacaaggagctgcaggacagcacccagatgaatgagaaggagctgaccaagaccatcaagagcctgctggatgtgaagatgatcaaccacgacagcgagaaggaggacattgatgctgagagcagcttcagcctgaacatgaacttcagcagcaagaggaccaagttcaagatcaccacctccatgcagaaggacaccccccaggagatggagcagaccaggtctgctgtggatgaggacaggaagatgtacctgcaggccgccatcgtgcgcatcatgaaggccaggaaggtgctgcggcacaatgccctgatccaggaggtgatcagccagagccgggcccgcttcaaccccagcatctccatgatcaagaagtgcatcgaggtgctgattgacaagcagtacatcgagaggagccaggccagcgcagatgagtacagctatgtggcctag

SEQ ID NO: 19171 - DNA, 651 bp, Artificial Sequence
  Description of Artificial Sequence: Synthetic coding sequence
atgagcctgaagccccgggtggtggactttgatgagacctggaacaagctgctgaccaccatcaaggctgtggtgatgctggagtatgtggagcgggccacctggaatgaccgcttcagtgacatctatgccctgtgtgtggcctacccagagcccctgggggagcggctgtacacagagaccaagatcttcctggagaaccacgtgcgccacctgcacaagagggtgctggagagcgaggagcaggtgctggtgatgtaccaccgctactgggaggagtacagcaaaggagctgactacatggactgcctgtaccgctacctgaacacccagttcatcaagaagaacaagctgacagaagctgacctgcagtatggctatggaggagtggacatgaatgagcccctgatggagattggagagctggccctggacatgtggaggaagctgatggtggagcccctgcaggccatcctgatccgcatgctgctgcgggagatcaagaatgaccggggcggggaggaccccaaccagaaggtgatccacggcgtcatcaacagctttgtgcacgtggagcagtacaagaagaagttccccctgaagttctaccaggagatctttgagagccccttcctgacagaaacaggatag

SEQ ID NO: 19172 - DNA, 2295 bp, Artificial Sequence
  Description of Artificial Sequence: Synthetic coding sequence
atgtacagagtgacctggagcaccttctggctgcgcttccagcactacacctgcaccatgagcctgaagccccgggtggtggactttgatgagacctggaacaagctgctgaccaccatcaaggctgtggtgatgctggagtatgtggagcgggccacctggaatgaccgcttcagtgacatctatgccctgtgtgtggcctacccagagcccctgggggagcggctgtacacagagaccaagatcttcctggagaaccacgtgcgccacctgcacaagagggtgctggagagcgaggagcaggtgctggtgatgtaccaccgctactgggaggagtacagcaaaggagctgactacatggactgcctgtaccgctacctgaacacccagttcatcaagaagaacaagctgacagaggccgacctgcagtatggctacggcggcgtggacatgaatgagcccctgatggagatcggggagctggccctggacatgtggaggaagctgatggtggagcccctgcaggccatcctgatccgcatgctgctgcgggagatcaagaatgacagaggaggagaggaccccaaccagaaggtgattcatggagtcatcaacagctttgtgcacgtggagcagtacaagaagaagttccccctgaagttctaccaggagatctttgagagccccttcctgacagagaccggggagtactacaagcaggaggccagcaacctgctgcaggagagcaactgcagccagtacatggagaaggtgctgggccgcctgaaggatgaggagatccgctgcaggaagtacctgcaccccagcagctacaccaaggtgattcatgagtgccagcagaggatggtggccgaccacctgcagttcctgcatgctgagtgccacaacatcatccggcaggagaagaagaatgacatggccaacatgtatgtgctgctgcgggctgtgtccacaggcctgccccacatgatccaggagctgcagaaccacatccatgatgagggcctgcgggccaccagcaacctgacccaggagaacatgcccaccctgtttgtggagagcgtgctggaggtgcacggcaagtttgtgcagctgatcaacacagtgctgaatggagaccagcacttcatgtctgccctggacaaggccctgacctctgtggtgaactaccgggagcccaagtctgtgtgcaaggcccctgagctgctggccaagtactgtgacaacctgctgaagaagagcgccaagggcatgacagaaaatgaggtggaggaccggctgaccagcttcatcaccgtcttcaagtacattgatgacaaggatgtgttccagaagttctacgccaggatgctggccaagaggctcatccacggcctgtccatgtccatggacagcgaggaggccatgatcaacaagctgaagcaggcctgtggctatgagttcaccagcaagctgcacaggatgtacacagacatgtctgtgtctgctgacctgaacaacaagttcaacaacttcatcaagaaccaggacaccgtcatcgacctgggcatctccttccagatctacgtgctgcaggccggggcctggcccctgacccaggcccccagcagcacctttgccatcccccaggagctggagaagtctgtgcagatgtttgagctgttctacagccagcacttcagcggcaggaagctgacctggctgcactacctgtgcaccggggaggtgaagatgaactacctgggcaagccctacgtggccatggtgaccacctaccagatggctgtgctgctggccttcaacaacagcgagaccgtgtcctacaaggagctgcaggacagcacccagatgaatgagaaggagctgaccaagaccatcaagagcctgctggatgtgaagatgatcaaccacgacagcgagaaggaggacattgatgctgagagcagcttcagcctgaacatgaacttcagcagcaagaggaccaagttcaagatcaccacctccatgcagaaggacaccccccaggagatggagcagaccaggtctgctgtggatgaggacaggaagatgtacctgcaggccgccatcgtgcgcatcatgaaggccaggaaggtgctgcggcacaatgccctgatccaggaggtgatcagccagagccgggcccgcttcaaccccagcatctccatgatcaagaagtgcatcgaggtgctgattgacaagcagtacatcgagaggagccaggccagcgcagatgagtacagctatgtggcctag

SEQ ID NO: 19173 - DNA, 2307 bp, Artificial Sequence
  Description of Artificial Sequence: Synthetic coding sequence
atgagcaacctgagcaagggcaccggcagcaggaaggacaccaagatgaggatccgggccttccccatgaccatggatgagaagtatgtgaacagcatctgggacctgctgaagaatgccatccaggagatccagaggaagaacaacagcggcctgagctttgaggagctgtacagaaatgcctacaccatggtgctgcacaagcatggagagaagctgtacacaggcctgcgggaggtggtgacagagcacctgatcaacaaggtgagagaagatgtgctgaacagcctgaacaacaacttcctgcagaccctgaaccaggcctggaatgaccaccagacagccatggtgatgatccgggacatcctgatgtacatggacagagtgtatgtgcagcagaacaacgtggagaatgtgtacaacctgggcctcatcatcttccgggaccaggtggtgcgctatggctgcatccgggaccacctgcggcagaccctgctggacatgattgcccgggagaggaagggggaggtggtggacagaggagccatcagaaatgcctgccagatgctgatgatcctgggcctggagggccgctctgtgtatgaagaagattttgaggcccccttcctggagatgtctgctgagttcttccagatggagagccagaagttcctggctgaaaattctgcctctgtgtacatcaagaaggtggaggcccgcatcaatgaggagattgagcgggtgatgcactgcctggacaagagcacagaggagcccatcgtgaaggtggtggagcgggagctgatcagcaagcacatgaagaccatcgtggagatggagaacagcggcctggtgcacatgctgaagaatggcaagacagaggacctgggctgcatgtacaagctgttcagccgggtgcccaacggcctgaagaccatgtgtgagtgcatgagcagctacctgcgggagcagggcaaggccctggtgtctgaggagggggagggcaagaaccctgtggactacatccagggcctgctggacctgaagagcagatttgaccgcttcctgctggagagcttcaacaatgacaggctcttcaagcagaccatcgccggggactttgagtacttcctgaacctgaacagccgcagccctgagtacctgagcctcttcattgatgacaagctgaagaagggcgtgaagggcctgacagagcaggaggtggagaccatcctggacaaggccatggtgctcttccgcttcatgcaggagaaggatgtgtttgagcgctactacaagcagcacctggcccggcggctgctgaccaacaagtctgtgtctgatgacagcgagaagaacatgatcagcaagctgaagacagaatgtggctgccagttcaccagcaagctggagggcatgttccgggacatgagcatcagcaacaccaccatggatgagttccggcagcacctgcaggccaccggggtgtccctgggcggcgtggacctgactgtgcgggtgctgaccaccggctactggcccacccagagcgccacccccaagtgcaacatccccccagcccccaggcatgcctttgagatcttccgccgcttctacctggccaagcacagcggccggcagctgaccctgcagcaccacatgggcagcgctgacctgaatgccaccttctacggccctgtgaagaaggaggatggcagcgaggtgggcgtgggcggggcccaggtgacaggcagcaacaccaggaagcacatcctgcaggtgtccaccttccagatgaccatcctgatgctgttcaacaaccgggagaagtacacctttgaggagatccagcaggagacagacatccctgagcgggagctggtgcgggccctgcagagcctggcctgtgggaagcccacccagagggtgctgaccaaggagcccaagagcaaggagattgaaaatggccacatcttcaccgtgaatgaccagttcaccagcaagctgcaccgggtgaagatccagacagtggccgccaagcagggcgagagtgaccctgagaggaaggagacccggcagaaggtggatgatgacaggaagcatgaaattgaagctgccatcgtgcgcatcatgaagagcaggaagaagatgcagcacaacgtgctggtggccgaggtgacccagcagctgaaggcccgcttcctgcccagccctgtggtgatcaagaagagaattgagggcctgattgagcgggagtacctggcccggaccccagaggacaggaaggtgtacacctacgtggcctag

SEQ ID NO: 19174 - DNA, 2109 bp, Artificial Sequence
  Description of Artificial Sequence: Synthetic coding sequence
atgagcaacctgagcaagggcaccggcagcaggaaggacaccaagatgaggatccgggccttccctgtgagagaagatgtgctgaacagcctgaacaacaacttcctgcagaccctgaaccaggcctggaatgaccaccagacagccatggtgatgatccgggacatcctgatgtacatggacagagtgtatgtgcagcagaacaacgtggagaatgtgtacaacctgggcctcatcatcttccgggaccaggtggtgcgctatggctgcatccgggaccacctgcggcagaccctgctggacatgattgcccgggagaggaagggggaggtggtggacagaggagccatcagaaatgcctgccagatgctgatgatcctgggcctggagggccgctctgtgtatgaagaagattttgaggcccccttcctggagatgtctgctgagttcttccagatggagagccagaagttcctggctgaaaattctgcctctgtgtacatcaagaaggtggaggcccgcatcaatgaggagattgagcgggtgatgcactgcctggacaagagcacagaggagcccatcgtgaaggtggtggagcgggagctgatcagcaagcacatgaagaccatcgtggagatggagaacagcggcctggtgcacatgctgaagaatggcaagacagaggacctgggctgcatgtacaagctgttcagccgggtgcccaacggcctgaagaccatgtgtgagtgcatgagcagctacctgcgggagcagggcaaggccctggtgtctgaggagggggagggcaagaaccctgtggactacatccagggcctgctggacctgaagagcagatttgaccgcttcctgctggagagcttcaacaatgacaggctcttcaagcagaccatcgccggggactttgagtacttcctgaacctgaacagccgcagccctgagtacctgagcctcttcattgatgacaagctgaagaagggcgtgaagggcctgacagagcaggaggtggagaccatcctggacaaggccatggtgctcttccgcttcatgcaggagaaggatgtgtttgagcgctactacaagcagcacctggcccggcggctgctgaccaacaagtctgtgtctgatgacagcgagaagaacatgatcagcaagctgaagacagaatgtggctgccagttcaccagcaagctggagggcatgttccgggacatgagcatcagcaacaccaccatggatgagttccggcagcacctgcaggccaccggggtgtccctgggcggcgtggacctgactgtgcgggtgctgaccaccggctactggcccacccagagcgccacccccaagtgcaacatccccccagcccccaggcatgcctttgagatcttccgccgcttctacctggccaagcacagcggccggcagctgaccctgcagcaccacatgggcagcgctgacctgaatgccaccttctacggccctgtgaagaaggaggatggcagcgaggtgggcgtgggcggggcccaggtgacaggcagcaacaccaggaagcacatcctgcaggtgtccaccttccagatgaccatcctgatgctgttcaacaaccgggagaagtacacctttgaggagatccagcaggagacagacatccctgagcgggagctggtgcgggccctgcagagcctggcctgtgggaagcccacccagagggtgctgaccaaggagcccaagagcaaggagattgaaaatggccacatcttcaccgtgaatgaccagttcaccagcaagctgcaccgggtgaagatccagacagtggccgccaagcagggcgagagtgaccctgagaggaaggagacccggcagaaggtggatgatgacaggaagcatgaaattgaagctgccatcgtgcgcatcatgaagagcaggaagaagatgcagcacaacgtgctggtggccgaggtgacccagcagctgaaggcccgcttcctgcccagccctgtggtgatcaagaagagaattgagggcctgattgagcgggagtacctggcccggaccccagaggacaggaaggtgtacacctacgtggcctag

SEQ ID NO: 19175 - DNA, 2235 bp, Artificial Sequence
  Description of Artificial Sequence: Synthetic coding sequence
atggatgagaagtatgtgaacagcatctgggacctgctgaagaatgccatccaggagatccagaggaagaacaacagcggcctgagctttgaggagctgtacagaaatgcctacaccatggtgctgcacaagcatggagagaagctgtacacaggcctgcgggaggtggtgacagagcacctgatcaacaaggtgagagaagatgtgctgaacagcctgaacaacaacttcctgcagaccctgaaccaggcctggaatgaccaccagacagccatggtgatgatccgggacatcctgatgtacatggacagagtgtatgtgcagcagaacaacgtggagaatgtgtacaacctgggcctcatcatcttccgggaccaggtggtgcgctatggctgcatccgggaccacctgcggcagaccctgctggacatgattgcccgggagaggaagggggaggtggtggacagaggagccatcagaaatgcctgccagatgctgatgatcctgggcctggagggccgctctgtgtatgaagaagattttgaggcccccttcctggagatgtctgctgagttcttccagatggagagccagaagttcctggctgaaaattctgcctctgtgtacatcaagaaggtggaggcccgcatcaatgaggagattgagcgggtgatgcactgcctggacaagagcacagaggagcccatcgtgaaggtggtggagcgggagctgatcagcaagcacatgaagaccatcgtggagatggagaacagcggcctggtgcacatgctgaagaatggcaagacagaggacctgggctgcatgtacaagctgttcagccgggtgcccaacggcctgaagaccatgtgtgagtgcatgagcagctacctgcgggagcagggcaaggccctggtgtctgaggagggggagggcaagaaccctgtggactacatccagggcctgctggacctgaagagcagatttgaccgcttcctgctggagagcttcaacaatgacaggctcttcaagcagaccatcgccggggactttgagtacttcctgaacctgaacagccgcagccctgagtacctgagcctcttcattgatgacaagctgaagaagggcgtgaagggcctgacagagcaggaggtggagaccatcctggacaaggccatggtgctcttccgcttcatgcaggagaaggatgtgtttgagcgctactacaagcagcacctggcccggcggctgctgaccaacaagtctgtgtctgatgacagcgagaagaacatgatcagcaagctgaagacagaatgtggctgccagttcaccagcaagctggagggcatgttccgggacatgagcatcagcaacaccaccatggatgagttccggcagcacctgcaggccaccggggtgtccctgggcggcgtggacctgactgtgcgggtgctgaccaccggctactggcccacccagagcgccacccccaagtgcaacatccccccagcccccaggcatgcctttgagatcttccgccgcttctacctggccaagcacagcggccggcagctgaccctgcagcaccacatgggcagcgctgacctgaatgccaccttctacggccctgtgaagaaggaggatggcagcgaggtgggcgtgggcggggcccaggtgacaggcagcaacaccaggaagcacatcctgcaggtgtccaccttccagatgaccatcctgatgctgttcaacaaccgggagaagtacacctttgaggagatccagcaggagacagacatccctgagcgggagctggtgcgggccctgcagagcctggcctgtgggaagcccacccagagggtgctgaccaaggagcccaagagcaaggagattgaaaatggccacatcttcaccgtgaatgaccagttcaccagcaagctgcaccgggtgaagatccagacagtggccgccaagcagggcgagagtgaccctgagaggaaggagacccggcagaaggtggatgatgacaggaagcatgaaattgaagctgccatcgtgcgcatcatgaagagcaggaagaagatgcagcacaacgtgctggtggccgaggtgacccagcagctgaaggcccgcttcctgcccagccctgtggtgatcaagaagagaattgagggcctgattgagcgggagtacctggcccggaccccagaggacaggaaggtgtacacctacgtggcctag

SEQ ID NO: 19176 - DNA, 2235 bp, Artificial Sequence; identical to SEQ ID NO: 19175
  Description of Artificial Sequence: Synthetic coding sequence

SEQ ID NO: 19177 - DNA, 1398 bp, Artificial Sequence
  Description of Artificial Sequence: Synthetic coding sequence
atggagaccggcttccctgccatcatgtacccaggcagcttcatcggcggctggggcgaggagtacctgtcctgggagggccctggcctgcctgactttgtgttccagcagcagcctgtggagagcgaggccatgcactgcagcaaccccaagagcggcgtggtgctggccaccgtggcccggggcccagatgcctgccagatcctgacccgggcccccctgggccaggaccccccccagaggacagtgctgggcctgctgacagccaacggccagtacagaaggacctgtggccagggcatcacccgcatccgctgctacagcggctctgaaaatgccttccccccagctgggaagaaggccctgcctgactgtggggtgcaggagccccccaagcagggctttgacatctacatggatgagctggagcagggcgaccgggacagctgcagcgtgcgggagggcatggcctttgaagatgtgtatgaggtggacaccggcaccctgaagagtgacctgcacttcctgctggacttcaacacagtgagccccatgctggtggacagcagcctgctgagccagagcgaggacatcagcagcctgggcacagatgtgatcaacgtgacagaatatgcagaggagatctaccagtacctgcgggaggccgagatccgccaccggcccaaggcccactacatgaagaagcagcctgacatcacagagggcatgaggaccatcctggtggactggctggtggaggtgggggaggagtacaagctgcgggcagagaccctgtacctggccgtgaacttcctggaccgcttcctgagctgcatgtctgtgctgcggggcaagctgcagctggtgggcacagctgccatgctgctggccagcaaatatgaggagatctacccacctgaggtggatgaatttgtgtacatcacagatgacacctacaccaagaggcagctgctgaagatggagcacctgctgctgaaggtgctggcctttgacctgactgtgcccaccaccaaccagttcctgctgcagtacctgcggcggcagggcgtgtgtgtgaggacagagaacctggccaagtatgtggccgagctgagcctgctggaggccgaccccttcctgaagtacctgcccagcctgattgctgctgctgccttctgcctggccaactacacagtgaacaagcacttctggccagagaccctggccgccttcaccggctacagcctgtctgaaattgtgccctgcctgtctgagctgcacaaggcctacctggacatcccccaccggccccagcaggccatccgggagaagtacaaggccagcaagtacctgtgtgtgtccctgatggagcccccagctgtgctgctgctgcagtag

SEQ ID NO: 19178 - DNA, 1395 bp, Artificial Sequence
  Description of Artificial Sequence: Synthetic coding sequence
atggagaccggcttccctgccatcatgtacccaggcagcttcatcggcggctggggcgaggagtacctgtcctgggagggccctggcctgcctgactttgtgttccagcagcctgtggagagcgaggccatgcactgcagcaaccccaagtctggagtggtgctggccaccgtggcccggggcccagatgcctgccagatcctgacccgggcccccctgggccaggaccccccccagaggacagtgctgggcctgctgacagccaacggccagtacagaaggacctgtggccagggcatcacccgcatccgctgctacagcggctctgaaaatgccttccccccagctgggaagaaggccctgcctgactgtggggtgcaggagccccccaagcagggctttgacatctacatggatgagctggagcagggcgaccgggacagctgcagcgtgcgggagggcatggcctttgaagatgtgtatgaggtggacaccggcaccctgaagagtgacctgcacttcctgctggacttcaacacagtgagccccatgctggtggacagcagcctgctgagccagagcgaggacatcagcagcctgggcacagatgtgatcaacgtgacagaatatgcagaggagatctaccagtacctgcgggaggccgagatccgccaccggcccaaggcccactacatgaagaagcagcctgacatcacagagggcatgaggaccatcctggtggactggctggtggaggtgggggaggagtacaagctgcgggcagagaccctgtacctggccgtgaacttcctggaccgcttcctgagctgcatgtctgtgctgcggggcaagctgcagctggtgggcacagctgccatgctgctggccagcaaatatgaggagatctacccacctgaggtggatgaatttgtgtacatcacagatgacacctacaccaagaggcagctgctgaagatggagcacctgctgctgaaggtgctggcctttgacctgactgtgcccaccaccaaccagttcctgctgcagtacctgcggcggcagggcgtgtgtgtgaggacagagaacctggccaagtatgtggccgagctgagcctgctggaggccgaccccttcctgaagtacctgcccagcctgattgctgctgctgccttctgcctggccaactacacagtgaacaagcacttctggccagagaccctggccgccttcaccggctacagcctgtctgagatcgtgccctgcctgtctgagctgcacaaggcctacctggacatcccccaccggccccagcaggccatccgggagaagtacaaggccagcaagtacctgtgtgtgtccctgatggagcccccagctgtgctgctgctgcagtag

SEQ ID NO: 19179 - DNA, 1266 bp, Artificial Sequence
  Description of Artificial Sequence: Synthetic coding sequence
atgcactgcagcaaccccaagagcggcgtggtgctggccaccgtggcccggggcccagatgcctgccagatcctgacccgggcccccctgggccaggaccccccccagaggacagtgctgggcctgctgacagccaacggccagtacagaaggacctgtggccagggcatcacccgcatccgctgctacagcggctctgaaaatgccttccccccagctgggaagaaggccctgcctgactgtggggtgcaggagccccccaagcagggctttgacatctacatggatgagctggagcagggcgaccgggacagctgcagcgtgcgggagggcatggcctttgaagatgtgtatgaggtggacaccggcaccctgaagagtgacctgcacttcctgctggacttcaacacagtgagccccatgctggtggacagcagcctgctgagccagagcgaggacatcagcagcctgggcacagatgtgatcaacgtgacagaatatgcagaggagatctaccagtacctgcgggaggccgagatccgccaccggcccaaggcccactacatgaagaagcagcctgacatcacagagggcatgaggaccatcctggtggactggctggtggaggtgggggaggagtacaagctgcgggcagagaccctgtacctggccgtgaacttcctggaccgcttcctgagctgcatgtctgtgctgcggggcaagctgcagctggtgggcacagctgccatgctgctggccagcaaatatgaggagatctacccacctgaggtggatgaatttgtgtacatcacagatgacacctacaccaagaggcagctgctgaagatggagcacctgctgctgaaggtgctggcctttgacctgactgtgcccaccaccaaccagttcctgctgcagtacctgcggcggcagggcgtgtgtgtgaggacagagaacctggccaagtatgtggccgagctgagcctgctggaggccgaccccttcctgaagtacctgcccagcctgattgctgctgctgccttctgcctggccaactacacagtgaacaagcacttctggccagagaccctggccgccttcaccggctacagcctgtctgaaattgtgccctgcctgtctgagctgcacaaggcctacctggacatcccccaccggccccagcaggccatccgggagaagtacaaggccagcaagtacctgtgtgtgtccctgatggagcccccagctgtgctgctgctgcagtag

SEQ ID NO: 19180 - DNA, 1266 bp, Artificial Sequence; identical to SEQ ID NO: 19179
  Description of Artificial Sequence: Synthetic coding sequence

SEQ ID NO: 19181 - DNA, 1299 bp, Artificial Sequence
  Description of Artificial Sequence: Synthetic coding sequence
atgctgggcaacagcgcccctggccctgccacccgggaggccggcagcgccctgctggccctgcagcagacagccctgcaggaggaccaggagaacatcaaccctgagaaggccgcccctgtgcagcagcccaggacccgggccgccctggccgtgctgaagagcggcaacccccggggcctggcccagcagcagaggcccaagacccggcgggtggcccccctgaaggacctgcctgtgaatgatgagcacgtgacagtgcccccctggaaggccaacagcaagcagcctgccttcaccatccacgtggatgaggccgagaaggaggcccagaagaagccagctgagagccagaagattgaaagagaagatgccctggccttcaacagcgccatcagcctgcccggccccaggaagcccctggtgcccctggactaccccatggatggcagctttgagagcccccacaccatggacatgagcatcatcctggaggatgagaagcctgtgtctgtgaatgaggtgcctgactaccacgaggacatccacacctacctgcgggagatggaggtgaagtgcaagcccaaggtgggctacatgaagaagcagcctgacatcaccaacagcatgagggccatcctggtggactggctggtggaggtgggggaggagtacaagctgcagaatgagaccctgcacctggccgtgaactacatcgaccgcttcctgagctccatgtctgtgctgcggggcaagctgcagctggtgggcacagctgccatgctgctggccagcaagtttgaggagatctacccacctgaggtggccgagtttgtgtacatcacagatgacacctacaccaagaagcaggtgctgaggatggagcacctggtgctgaaggtgctgacctttgacctggccgcccccaccgtgaaccagttcctgacccagtacttcctgcaccagcagcctgccaactgcaaggtggagagcctggccatgttcctgggggagctgagcctgattgatgctgacccctacctgaagtacctgcccagcgtgattgctggggccgccttccacctggccctgtacacagtgacaggccagagctggccagagagcctcatcaggaagacaggctacaccctggagagcctgaagccctgcctgatggacctgcaccagacctacctgaaggccccccagcacgcccagcagagcatccgggagaagtacaagaacagcaagtaccatggagtgtccctgctgaaccccccagagaccctgaacctgtag

SEQ ID NO: 19182 - DNA, 1302 bp, Artificial Sequence
  Description of Artificial Sequence: Synthetic coding sequence
atggccctgcgggtgaccaggaacagcaagatcaatgctgagaacaaggccaagatcaacatggccggggccaagagggtgcccacagccccagctgccaccagcaagccaggcctgcggcccaggacagccctgggggacatcggcaacaaggtgtctgagcagctgcaggccaagatgcccatgaagaaggaggccaagcccagcgccaccgggaaggtgattgacaagaagctgcccaagcccctggagaaggtgcccatgctggtgcctgtgcctgtgtctgagcctgtgcctgagcctgagcctgagcctgagcctgagcctgtgaaggaggagaagctgagccctgagcccatcctggtggacacagccagccccagccccatggagaccagcggctgtgccccagctgaggaggacctgtgccaggccttcagtgatgtgatcctggccgtgaatgatgtggatgctgaagatggagctgaccccaacctgtgcagtgaatatgtgaaggacatctatgcctacctgcggcagctggaggaggagcaggccgtgcggcccaagtacctgctgggccgggaggtgacaggcaacatgagggccatcctgattgactggctggtgcaggtgcagatgaagttccggctgctgcaggagaccatgtacatgacagtgtccatcatcgaccgcttcatgcagaacaactgtgtgcccaagaagatgctgcagctggtgggcgtgacagccatgttcatcgccagcaaatatgaggagatgtacccacctgagatcggggactttgcctttgtgacagacaacacctacaccaagcaccagatccggcagatggagatgaagatcctgcgggccctgaactttggcctgggccggcccctgcccctgcacttcctgcggcgggccagcaagatcggggaggtggatgtggagcagcacaccctggccaagtacctgatggagctgaccatgctggactatgacatggtgcacttcccccccagccagattgctgctggggccttctgcctggccctgaagatcctggacaacggggagtggacccccaccctgcagcactacctgagctacacagaggagagcctgctgcctgtgatgcagcacctggccaagaatgtggtgatggtgaaccagggcctgaccaagcacatgacagtgaagaacaagtatgccaccagcaagcacgccaagatcagcaccctgccccagctgaacagcgccctggtgcaggacctggccaaggctgtggccaaggtgtag

SEQ ID NO: 19183 - DNA, 1191 bp, Artificial Sequence
  Description of Artificial Sequence: Synthetic coding sequence
atggccctgcgggtgaccaggaacagcaagatcaatgctgagaacaaggccaagatcaacatggccggggccaagagggtgcccacagccccagctgccaccagcaagccaggcctgcggcccaggacagccctgggggacatcggcaacaaggtgtctgagcagctgcaggccaagatgcccatgaagaaggaggccaagcccagcgccaccgggaaggtgattgacaagaagctgcccaagcccctggagaaggtgcccatgctggtgcctgtgcctgtgtctgagcctgtgcctgagcctgagcctgagcctgagcctgagcctgtgaaggaggagaagctgagccctgagcccatcctggtggacacagccagccccagccccatggagaccagcggctgtgccccagctgaggaggacctgtgccaggccttcagtgatgtgatcctggccgtgaatgatgtggatgctgaagatggagctgaccccaacctgtgcagtgaatatgtgaaggacatctatgcctacctgcggcagctggaggaggagcaggccgtgcggcccaagtacctgctgggccgggaggtgacaggcaacatgagggccatcctgattgactggctggtgcaggtgcagatgaagttccggctgctgcaggagaccatgtacatgacagtgtccatcatcgaccgcttcatgcagaacaactgtgtgcccaagaagatgctgcagctggtgggcgtgacagccatgttcatcgccagcaaatatgaggagatgtacccacctgagatcggggactttgcctttgtgacagacaacacctacaccaagcaccagatccggcagatggagatgaagatcctgcgggccctgaactttggcctgggccggcccctgcccctgcacttcctgcggcgggccagcaagatcggggaggtggatgtggagcagcacaccctggccaagtacctgatggagctgaccatgctggactatgacatggtgcacttcccccccagccagattgctgctggggccttctgcctggccctgaagatcctggacaacggggagtggacagtgaagaacaagtatgccaccagcaagcacgccaagatcagcaccctgccccagctgaacagcgccctggtgcaggacctggccaaggctgtggccaaggtgtag

SEQ ID NO: 19184 - DNA, 1206 bp, Artificial Sequence
  Description of Artificial Sequence: Synthetic coding sequence
atggccctgcgggtgaccaggaacagcaagatcaatgctgagaacaaggccaagatcaacatggccggggccaagagggtgcccacagccccagctgccaccagcaagccaggcctgcggcccaggacagccctgggggacatcggcaacaaggtgtctgagcagctgcaggccaagatgcccatgaagaaggaggccaagcccagcgccaccgggaaggtgattgacaagaagctgcccaagcccctggagaaggtgcccatgctggtgcctgtgcctgtgtctgagcctgtgcctgagcctgagcctgagcctgagcctgagcctgtgaaggaggagaagctgagccctgagcccatcctggtggacacagccagccccagccccatggagaccagcggctgtgccccagctgaggaggacctgtgccaggccttcagtgatgtgatcctggccgtgaatgatgtggatgctgaagatggagctgaccccaacctgtgcagtgaatatgtgaaggacatctatgcctacctgcggcagctggaggaggagcaggccgtgcggcccaagtacctgctgggccgggaggtgacaggcaacatgagggccatcctgattgactggctggtgcaggtgcagatgaagttccggctgctgcaggagaccatgtacatgacagtgtccatcatcgaccgcttcatgcagaacaactgtgtgcccaagaagatgctgcagctggtgggcgtgacagccatgttcatcgccagcaaatatgaggagatgtacccacctgagatcggggactttgcctttgtgacagacaacacctacaccaagcaccagatccggcagatggagatgaagatcctgcgggccctgaactttggcctgggccggcccctgcccctgcacttcctgcggcgggccagcaagatcggggaggtggatgtggagcagcacaccctggccaagtacctgatggagctgaccatgctggactatgacatggtgcacttcccccccagccagattgctgctggggccttctgcctggccctgaagatcctggacaacggggagtggacccccaccctgcagcactacctgagctacacagaggagagcctgctgcctgtgatgcagcacctggccaagaatgtggtgatggtgaaccagggcctgaccaagcacatggtgtcccagtag

SEQ ID NO: 19185 - DNA, 1197 bp, Artificial Sequence
  Description of Artificial Sequence: Synthetic coding sequence
atggccctgctgcggcggcccaccgtgtccagtgacctggagaacatcgacaccggggtgaacagcaaggtgaagagccacgtgaccatcagaagaacagtgctggaggagatcggcaacagagtgaccacccgggccgcccaggtggccaagaaggcccagaacaccaaggtgcctgtgcagcccaccaagaccaccaacgtgaacaagcagctgaagcccacagcctctgtgaagcctgtgcagatggagaagctggcccccaagggccccagccccaccccagaagatgtgtccatgaaggaggagaacctgtgccaggccttcagtgatgccctgctgtgcaagattgaggacatcgacaatgaagactgggagaacccccagctgtgcagcgactatgtgaaggacatctaccagtacctgcggcagctggaggtgctgcagagcatcaacccccacttcctggatggccgggacatcaatggccgcatgagggccatcctggtggactggctggtgcaggtgcacagcaagttccggctgctgcaggagaccctgtacatgtgtgtgggcatcatggaccgcttcctgcaggtgcagcctgtgtccaggaagaagctgcagctggtgggcatcacagccctgctgctggccagcaaatatgaggagatgttcagccccaacattgaagattttgtgtacatcacagacaatgcctacaccagcagccagatccgggagatggagaccctcatcctgaaggagctgaagtttgagctgggccggcccctgcccctgcacttcctgcggcgggccagcaaggccggggaggtggatgtggagcagcacaccctggccaagtacctgatggagctgaccctgattgattatgacatggtgcactaccaccccagcaaggtggccgctgctgccagctgcctgagccagaaggtgctgggccagggcaagtggaacctgaagcagcagtactacacaggctacacagaaaatgaggtgctggaggtgatgcagcacatggccaagaatgtggtgaaggtgaatgaaaacctgaccaagttcatcgccatcaagaacaagtatgccagcagcaagctgctgaagatctccatgatcccccagctgaacagcaaggctgtgaaggacctggccagccccctgattggccgctcctag

SEQ ID NO: 19186 - DNA, 432 bp, Artificial Sequence
  Description of Artificial Sequence: Synthetic coding sequence
atggccggcaacttctggcagagcagccactacctgcagtggatcctggacaagcaggacctgctgaaggagcggcagaaggacctgaagttcctgtctgaggaggagtactggaagctgcagatcttcttcaccaacgtcatccaggccctgggggagcacctgaagctgcggcagcaggtgattgccacagccaccgtgtacttcaagcgcttctacgcccgctacagcctgaagagcattgatcctgtgctgatggcccccacctgtgtgttcctggccagcaaggtggaggagtttggagtggtgagcaacacccggctgattgctgctgccacctctgtgtgcaagtgcaagaagtacatctgcttcaaggatgtgatcctgaagaaggcccctgagtacatcgacttcttcttcttcagcctgtag

SEQ ID NO: 19187 - DNA, 852 bp, Artificial Sequence
  Description of Artificial Sequence: Synthetic coding sequence
atggccggcaacttctggcagagcagccactacctgcagtggatcctggacaagcaggacctgctgaaggagcggcagaaggacctgaagttcctgtctgaggaggagtactggaagctgcagatcttcttcaccaacgtcatccaggccctgggggagcacctgaagctgcggcagcaggtgattgccacagccaccgtgtacttcaagcgcttctacgcccgctacagcctgaagagcattgatcctgtgctgatggcccccacctgtgtgttcctggccagcaaggtggaggagtttggagtggtgagcaacacccggctgattgctgctgccacctctgtgctgaagacccgcttctcctatgccttccccaaggagttcccctacaggatgaaccacatcctggagtgtgagttctacctgctggagctgatggactgctgcctgattgtgtaccacccctaccggcccctgctgcagtatgtgcaggacatgggccaggaggacatgctgctgcccctggcctggagaattgtgaatgacacctacagaacagacctgtgcctgctgtacccacccttcatgattgccctggcctgcctgcacgtggcctgtgtggtgcagcagaaggatgcccggcagtggtttgctgagctgtctgtggacatggagaagatcctggagatcatccgggtcatcctgaagctgtatgagcagtggaagaactttgatgagaggaaggagatggccaccatcctgagcaagatgcccaagcccaagcccccacccaacagcgagggggagcagggccccaacggcagccagaacagcagctacagccagagctag

SEQ ID NO: 19188 - DNA, 597 bp, Artificial Sequence
  Description of Artificial Sequence: Synthetic coding sequence
atggcccccacctgtgtgttcctggccagcaaggtggaggagtttggagtggtgagcaacacccggctgattgctgctgccacctctgtgctgaagacccgcttctcctatgccttccccaaggagttcccctacaggatgaaccacatcctggagtgtgagttctacctgctggagctgatggactgctgcctgattgtgtaccacccctaccggcccctgctgcagtatgtgcaggacatgggccaggaggacatgctgctgcccctggcctggagaattgtgaatgacacctacagaacagacctgtgcctgctgtacccacccttcatgattgccctggcctgcctgcacgtggcctgtgtggtgcagcagaaggatgcccggcagtggtttgctgagctgtctgtggacatggagaagatcctggagatcatccgggtcatcctgaagctgtatgagcagtggaagaactttgatgagaggaaggagatggccaccatcctgagcaagatgcccaagcccaagcccccacccaacagcgagggggagcagggccccaacggcagccagaacagcagctacagccagagctag

SEQ ID NO: 19189 - DNA, 597 bp, Artificial Sequence; identical to SEQ ID NO: 19188
  Description of Artificial Sequence: Synthetic coding sequence

SEQ ID NO: 19190 - DNA, 489 bp, Artificial Sequence
  Description of Artificial Sequence: Synthetic coding sequence
atggcccccacctgtgtgttcctggccagcaaggtggaggagtttggagtggtgagcaacacccggctgattgctgctgccacctctgtgctgaagacccgcttctcctatgccttccccaaggagttcccctacaggatgaaccacatcctggagtgtgagttctacctgctggagctgatggactgctgcctgattgtgtaccacccctaccggcccctgctgcagtatgtgcaggacatgggccaggaggacatgctgctgcccctggcctggagaattgtgaatgacacctacagaacagacctgtgcctgctgtacccacccttcatgattgccctggcctgcctgcacgtggcctgtgtggtgcagcagaaggatgcccggcagtggtttgctgagctgtctgtggacatggagaagatcctggagatcatccgggtcatcctgaagctgtatgagcagtggaagaactttgatgagaggtag

SEQ ID NO: 19191 - DNA, 2283 bp, Artificial Sequence
  Description of Artificial Sequence: Synthetic coding sequence
atgagcacagtggaggaggacagcgacacagtgacagtggagaccgtgaacagcgtgaccctgacccaggacacagagggcaacctgatcctgcactgcccccagaatgaagcagatgaaattgattctgaggacagcattgagcccccccacaagaggctgtgcctgagcagtgaagatgaccagagcattgatgacagcaccccctgcatctctgtggtggccctgcccctgtctgaaaatgaccagagctttgaggtgaccatgacagccaccacagaggtggctgatgatgaggtgacagagggcaccgtgacccagatccagatcctgcagaatgagcagctggatgagatcagccccctgggcaatgaggaggtgtctgctgtgtcccaggcctggttcaccaccaaggaggacaaggacagcctgaccaacaagggccacaagtggaagcagggcatgtggagcaaggaggagattgacatcctgatgaacaacatcgagcgctacctgaaggcccggggcatcaaggatgccacagagatcatctttgagatgagcaaggatgagaggaaggacttctaccgcaccatcgcctggggcctgaaccggcccctgtttgctgtgtaccgccgggtgctgaggatgtatgatgacagaaatcatgtgggcaagtacaccccagaggagattgagaagctgaaggagctgcgcatcaagcacggcaatgactgggccaccatcggggccgccctgggccgcagcgccagctctgtgaaggaccgctgccgcctgatgaaggacacctgcaacacaggcaagtggacagaggaggaggagaagaggctggccgaggtggtgcatgagctgaccagcacagagcccggggacatcgtgacccagggcgtgtcctgggccgctgtggccgagcgggtgggcaccaggtctgagaagcagtgccgcagcaagtggctgaactacctgaactggaagcagagcggcggcacagagtggaccaaggaggatgagatcaacctgatcctgagaattgctgagctggatgtggctgatgaaaatgacatcaactgggacctgctggccgagggctggagctctgtgcgcagcccccagtggctgcggagcaagtggtggaccatcaagaggcagatcgccaaccacaaggatgtgtccttccctgtgctgatcaagggcctgaagcagctgcacgagaaccagaagaacaaccccaccctgctggagaacaagagcggcagcggcgtgcccaacagcaacaccaacagctctgtgcagcacgtgcagatccgggtggcccggctggaggacaacacagccatcagcagcagccccatggccgccctgcagatccctgtgcagatcacccacgtgagcagcgctgacagccctgccaccgtggacagcgagaccatcaccctgaacagcggcaccctgcagacctttgagatcctgcccagcttccacctgcagcccaccggcaccccaggcacctacctgctgcagaccagcagcagccagggcctgcccctgaccctgacagccagccccaccgtgaccctgacagctgctgccccagccagccctgagcagatcatcgtgcacgccctgagccctgagcacctgctgaacaccagtgacaacgtgacagtgcagtgccacacccccagggtcatcatccagacagtggccacagaggacatcaccagcagcatcagccaggccgagctgactgtggacagcgacatccagagcagtgacttccctgagcccccagatgccctggaggccgacaccttcccagatgagatccaccaccccaagatgacagtggagcccagcttcaatgatgcccacgtgtccaagttcagtgaccagaacagcacagagctgatgaacagcgtgatggtgaggacagaggaggagatcagtgacacagacctgaagcaggaggagagccccagcgacctggccagcgcctacgtgacagagggcctggagagccccaccatcgaggagcaggtggaccagaccattgatgatgagaccatcctgattgtgcccagcccccacggcttcatccaggccagtgatgtgattgacacagagagcgtgctgcccctgaccaccctgacagaccccatcctgcagcaccaccaggaggagagcaacatcatcggcagcagcctgggcagccctgtgtctgaggacagcaaggatgtggaggacctggtgaactgccactag

SEQ ID NO: 19192 - DNA, 858 bp, Artificial Sequence
  Description of Artificial Sequence: Synthetic coding sequence
atgagcacagtggaggaggacagcgacacagtgacagtggagaccgtgaacagcgtgaccctgacccaggacacagagggcaacctgatcctgcactgcccccagaatgaagcagatgaaattgattctgaggacagcattgagcccccccacaagaggctgtgcctgagcagtgaagatgaccagagcattgatgacagcaccccctgcatctctgtggtggccctgcccctgtctgaaaatgaccagagctttgaggtgaccatgacagccaccacagaggtggctgatgatgaggtgacagagggcaccgtgacccagatccagatcctgcagaatgagcagctggatgagatcagccccctgggcaatgaggaggtgtctgctgtgtcccaggcctggttcaccaccaaggaggacaaggacagcctgaccaacaagggccacaagtggaagcagggcatgtggagcaaggaggagattgacatcctgatgaacaacatcgagcgctacctgaaggcccggggcatcaaggatgccacagagatcatctttgagatgagcaaggatgagaggaaggacttctaccgcaccatcgcctggggcctgaaccggcccctgtttgctgtgtaccgccgggtgctgaggatgtatgatgacagaaatcatgtgggcaagtacaccccagaggagattgagaagctgaaggagaagaaggccatcgccgcctgcttcttcttcacccaccggcagctgtggacccccaagaagggccacaccttcaagctgtggctgagcaagtactgctgcccccagctgcccaaccagagcaatggcaagaagaagaatgaggagtag

SEQ ID NO: 19193 - DNA, 2283 bp, Artificial Sequence; identical to SEQ ID NO: 19191
  Description of Artificial Sequence: Synthetic coding sequence

SEQ ID NO: 19194 - DNA, 735 bp, Artificial Sequence
  Description of Artificial Sequence: Synthetic coding sequence
atgagcacagtggaggaggacagcgacacagtgacagtggagaccgtgaacagcgtgaccctgacccaggacacagagggcaacctgatcctgcactgcccccagaatgtgtctgaaaatgaccagagctttgaggtgaccatgacagccaccacagaggtggctgatgatgaggtgacagagggcaccgtgacccagatccagatcctgcagaatgagcagctggatgagatcagccccctgggcaatgaggaggtgtctgctgtgtcccaggcctggttcaccaccaaggaggacaaggacagcctgaccaacaagggccacaagtggaagcagggcatgtggagcaaggaggagattgacatcctgatgaacaacatcgagcgctacctgaaggcccggggcatcaaggatgccacagagatcatctttgagatgagcaaggatgagaggaaggacttctaccgcaccatcgcctggggcctgaaccggcccctgtttgctgtgtacagaagagtgctgaggatgtatgatgacaggaaccacgtgggcaagtacaccccagaggagattgagaagctgaaggagaagaaggccatcgccgcctgcttcttcttcacccaccggcagctgtggacccccaagaagggccacaccttcaagctgtggctgagcaagtactgctgcccccagctgcccaaccagagcaatggcaagaagaagaatgaggagtag

SEQ ID NO: 19195 - DNA, 819 bp, Artificial Sequence
  Description of Artificial Sequence: Synthetic coding sequence
atgagcacagtggaggaggacagcgacacagtgacagtggagaccgtgaacagcgtgaccctgacccaggacacagagggcaacctgatcctgcactgcccccagaatgaagcagatgaaattgattctgaggacagcattgagcccccccacaagaggctgtgcctgagcagtgaagatgaccagagcattgatgacagcaccccctgcatctctgtggtggccctgcccctgtctgaaaatgaccagagctttgaggtgaccatgacagccaccacagaggtggctgatgatgaggtgacagagggcaccgtgacccagatccagatcctgcagaatgagcagctggatgagatcagccccctgggcaatgaggaggtgtctgctgtgtcccaggcctggttcaccaccaaggaggacaaggacagcctgaccaacaagggccacaagtggaagcagggcatgtggagcaaggaggagattgacatcctgatgaacaacatcgagcgctacctgaaggcccggggcatcaaggatgccacagagatcatctttgagatgagcaaggatgagaggaaggacttctaccgcaccatcgcctggggcctgaaccggcccctgtttgctgtgtaccgccgggtgctgaggatgtatgatgacagaaatcatgtgggcaagtacaccccagaggagattgagaagctgaaggagcagctgtggacccccaagaagggccacaccttcaagctgtggctgagcaagtactgctgcccccagctgcccaaccagagcaatggcaagaagaagaatgaggagtag

SEQ ID NO: 19196 - DNA, 2073 bp, Artificial Sequence
  Description of Artificial Sequence: Synthetic coding sequence
atgagcacagtggaggaggacagcgacacagtgacagtggagaccgtgaacagcgtgaccctgacccaggacacagagggcaacctgatcctgcactgcccccagaatgaagcagatgaaattgattctgaggacagcattgagcccccccacaagaggctgtgcctgagcagtgaagatgaccagagcattgatgacagcaccccctgcatctctgtggtggccctgcccctgtctgaaaatgaccagagctttgaggtgaccatgacagccaccacagaggtggctgatgatgaggtgacagagggcaccgtgacccagatccagatcctgcagaatgagcagctggatgagatcagccccctgggcaatgaggaggtgtctgctgtgtcccaggcctggttcaccaccaaggaggacaaggacagcctgaccaacaagggccacaagtggaagcagggcatgtggagcaaggaggagattgacatcctgatgaacaacatcgagcgctacctgaaggcccggggcatcaaggatgccacagagatcatctttgagatgagcaaggatgagaggaaggacttctaccgcaccatcgcctggggcctgaaccggcccctgtttgctgtgtaccgccgggtgctgaggatgtatgatgacagaaatcatgtgggcaagtacaccccagaggagattgagaagctgaaggagctgcgcatcaagcacggcaatgactgggccaccatcggggccgccctgggccgcagcgccagctctgtgaaggaccgctgccgcctgatgaaggacacctgcaacacaggcaagtggacagaggaggaggagaagaggctggccgaggtggtgcatgagctgaccagcacagagcccggggacatcgtgacccagggcgtgtcctgggccgctgtggccgagcgggtgggcaccaggtctgagaagcagtgccgcagcaagtggctgaactacctgaactggaagcagagcggcggcacagagtggaccaaggaggatgagatcaacctgatcctgagaattgctgagctggatgtggctgatgaaaatgacatcaactgggacctgctggccgagggctggagctctgtgcgcagcccccagtggctgcggagcaagtggtggaccatcaagaggcagatcgccaaccacaaggatgtgtccttccctgccagcgctgacagccctgccaccgtggacagcgagaccatcaccctgaacagcggcaccctgcagacctttgagatcctgcccagcttccacctgcagcccaccggcaccccaggcacctacctgctgcagaccagcagcagccagggcctgcccctgaccctgacagccagccccaccgtgaccctgacagctgctgccccagccagccctgagcagatcatcgtgcacgccctgagccctgagcacctgctgaacaccagtgacaacgtgacagtgcagtgccacacccccagggtcatcatccagacagtggccacagaggacatcaccagcagcatcagccaggccgagctgactgtggacagcgacatccagagcagtgacttccctgagcccccagatgccctggaggccgacaccttcccagatgagatccaccaccccaagatgacagtggagcccagcttcaatgatgcccacgtgtccaagttcagtgaccagaacagcacagagctgatgaacagcgtgatggtgaggacagaggaggagatcagtgacacagacctgaagcaggaggagagccccagcgacctggccagcgcctacgtgacagagggcctggagagccccaccatcgaggagcaggtggaccagaccattgatgatgagaccatcctgattgtgcccagcccccacggcttcatccaggccagtgatgtgattgacacagagagcgtgctgcccctgaccaccctgacagaccccatcctgcagcaccaccaggaggagagcaacatcatcggcagcagcctgggcagccctgtgtctgaggacagcaaggatgtggaggacctggtgaactgccactag

SEQ ID NO: 19197 - DNA, 1485 bp, Artificial Sequence
  Description of Artificial Sequence: Synthetic coding sequence
atgaaggacacctgcaacacaggcaagtggacagaggaggaggagaagaggctggccgaggtggtgcatgagctgaccagcacagagcccggggacatcgtgacccagggcgtgtcctgggccgctgtggccgagcgggtgggcaccaggtctgagaagcagtgccgcagcaagtggctgaactacctgaactggaagcagagcggcggcacagagtggaccaaggaggatgagatcaacctgatcctgagaattgctgagctggatgtggctgatgaaaatgacatcaactgggacctgctggccgagggctggagctctgtgcgcagcccccagtggctgcggagcaagtggtggaccatcaagaggcagatcgccaaccacaaggatgtgtccttccctgtgctgatcaagggcctgaagcagctgcacgagaaccagaagaacaaccccaccctgctggagaacaagagcggcagcggcgtgcccaacagcaacaccaacagctctgtgcagcacgtgcagatccgggtggcccggctggaggacaacacagccatcagcagcagccccatggccgccctgcagatccctgtgcagatcacccacgtgagcagcgctgacagccctgccaccgtggacagcgagaccatcaccctgaacagcggcaccctgcagacctttgagatcctgcccagcttccacctgcagcccaccggcaccccaggcacctacctgctgcagaccagcagcagccagggcctgcccctgaccctgacagccagccccaccgtgaccctgacagctgctgccccagccagccctgagcagatcatcgtgcacgccctgagccctgagcacctgctgaacaccagtgacaacgtgacagtgcagtgccacacccccagggtcatcatccagacagtggccacagaggacatcaccagcagcatcagccaggccgagctgactgtggacagcgacatccagagcagtgacttccctgagcccccagatgccctggaggccgacaccttcccagatgagatccaccaccccaagatgacagtggagcccagcttcaatgatgcccacgtgtccaagttcagtgaccagaacagcacagagctgatgaacagcgtgatggtgaggacagaggaggagatcagtgacacagacctgaagcaggaggagagccccagcgacctggccagcgcctacgtgacagagggcctggagagccccaccatcgaggagcaggtggaccagaccattgatgatgagaccatcctgattgtgcccagcccccacggcttcatccaggccagtgatgtgattgacacagagagcgtgctgcccctgaccaccctgacagaccccatcctgcagcaccaccaggaggagagcaacatcatcggcagcagcctgggcagccctgtgtctgaggacagcaaggatgtggaggacctggtgaactgccactag

SEQ ID NO: 19198 - DNA, 111 bp, Artificial Sequence
  Description of Artificial Sequence: Synthetic coding sequence
atgagcacagtggaggaggacagcgacacagtgacagtggagaccgtgaacagcgtgaccctgacccaggacacagagggcaacctgatcctgcactgcccccagaactag

SEQ ID NO: 19199 - DNA, 33 bp, Artificial Sequence
  Description of Artificial Sequence: Synthetic coding sequence
atgacagccaccacagaggtggctgatgactag

SEQ ID NO: 19200 - DNA, 111 bp, Artificial Sequence; identical to SEQ ID NO: 19198
  Description of Artificial Sequence: Synthetic coding sequence

SEQ ID NO: 19201 - DNA, 735 bp, Artificial Sequence; identical to SEQ ID NO: 19194
  Description of Artificial Sequence: Synthetic coding sequence

SEQ ID NO: 19202 - DNA, 582 bp, Artificial Sequence
  Description of Artificial Sequence: Synthetic coding sequence
atgagcacagtggaggaggacagcgacacagtgacagtggagaccgtgaacagcgtgaccctgacccaggacacagagggcaacctgatcctgcactgcccccagaatgaagcagatgaaattgattctgaggacagcattgagcccccccacaagaggctgtgcctgagcagtgaagatgaccagagcattgatgacagcaccccctgcatctctgtggtggccctgcccctgtctgaaaatgaccagagctttgaggtgaccatgacagccaccacagaggtggctgatgatgaggtgacagagggcaccgtgacccagatccagatcctgcagaatgagcagctggatgagatcagccccctgggcaatgaggaggtgtctgctgtgtcccaggcctggttcaccaccaaggaggacaaggacagcctgaccaacaagggccacaagtggaagcagggcatgtggagcaaggaggagattgacatcctgatgaacaacatcgagcgctacctgaaggcccggggcatcaaggatgccacagagatcatctttgagatgagcaaggatgagaggaagtag

SEQ ID NO: 19203 - DNA, 84 bp, Artificial Sequence
  Description of Artificial Sequence: Synthetic coding sequence
atgagcacagtggaggaggacagcgacacagtgacagtggagaccgtgaacagcgtgaccctgacccaggacacagagggctag

SEQ ID NO: 19204 - DNA, 444 bp, Artificial Sequence
  Description of Artificial Sequence: Synthetic coding sequence
atgagcacagtggaggaggacagcgacacagtgacagtggagaccgtgaacagcgtgaccctgacccaggacacagagggcaacctgatcctgcactgcccccagaatgaagcagatgaaattgattctgaggacagcattgagcccccccacaagaggctgtgcctgagcagtgaagatgaccagagcattgatgacagcaccccctgcatctctgtggtggccctgcccctgtctgaaaatgaccagagctttgaggtgaccatgacagccaccacagaggtggctgatgatgaggtgacagagggcaccgtgacccagatccagatcctgcagaatgagcagctggatgagatcagccccctgggcaatgaggaggtgtctgctgtgtcccaggcctggttcaccaccaaggaggacaaggacagcctgaccaacaagtag

SEQ ID NO: 19205 - DNA, 222 bp, Artificial Sequence
  Description of Artificial Sequence: Synthetic coding sequence
atgagcacagtggaggaggacagcgacacagtgacagtggagaccgtgaacagcgtgaccctgacccaggacacagagggcaacctgatcctgcactgcccccagaatgaagcagatgaaattgattctgaggacagcattgagcccccccacaagaggctgtgcctgagcagtgaagatgaccagagcattgatgacagcaccccctgcatctctgtgtag

SEQ ID NO: 19206 - DNA, 2019 bp, Artificial Sequence
  Description of Artificial Sequence: Synthetic coding sequence
atgacagccaccacagaggtggctgatgatgaggtgacagagggcaccgtgacccagatccagatcctgcagaatgagcagctggatgagatcagccccctgggcaatgaggaggtgtctgctgtgtcccaggcctggttcaccaccaaggaggacaaggacagcctgaccaacaagggccacaagtggaagcagggcatgtggagcaaggaggagattgacatcctgatgaacaacatcgagcgctacctgaaggcccggggcatcaaggatgccacagagatcatctttgagatgagcaaggatgagaggaaggacttctaccgcaccatcgcctggggcctgaaccggcccctgtttgctgtgtaccgccgggtgctgaggatgtatgatgacagaaatcatgtgggcaagtacaccccagaggagattgagaagctgaaggagctgcgcatcaagcacggcaatgactgggccaccatcggggccgccctgggccgcagcgccagctctgtgaaggaccgctgccgcctgatgaaggacacctgcaacacaggcaagtggacagaggaggaggagaagaggctggccgaggtggtgcatgagctgaccagcacagagcccggggacatcgtgacccagggcgtgtcctgggccgctgtggccgagcgggtgggcaccaggtctgagaagcagtgccgcagcaagtggctgaactacctgaactggaagcagagcggcggcacagagtggaccaaggaggatgagatcaacctgatcctgagaattgctgagctggatgtggctgatgaaaatgacatcaactgggacctgctggccgagggctggagctctgtgcgcagcccccagtggctgcggagcaagtggtggaccatcaagaggcagatcgccaaccacaaggatgtgtccttccctgtgctgatcaagggcctgaagcagctgcacgagaaccagaagaacaaccccaccctgctggagaacaagagcggcagcggcgtgcccaacagcaacaccaacagctctgtgcagcacgtgcagatccgggtggcccggctggaggacaacacagccatcagcagcagccccatggccgccctgcagatccctgtgcagatcacccacgtgagcagcgctgacagccctgccaccgtggacagcgagaccatcaccctgaacagcggcaccctgcagacctttgagatcctgcccagcttccacctgcagcccaccggcaccccaggcacctacctgctgcagaccagcagcagccagggcctgcccctgaccctgacagccagccccaccgtgaccctgacagctgctgccccagccagccctgagcagatcatcgtgcacgccctgagccctgagcacctgctgaacaccagtgacaacgtgacagtgcagtgccacacccccagggtcatcatccagacagtggccacagaggacatcaccagcagcatcagccaggccgagctgactgtggacagcgacatccagagcagtgacttccctgagcccccagatgccctggaggccgacaccttcccagatgagatccaccaccccaagatgacagtggagcccagcttcaatgatgcccacgtgtccaagttcagtgaccagaacagcacagagctgatgaacagcgtgatggtgaggacagaggaggagatcagtgacacagacctgaagcaggaggagagccccagcgacctggccagcgcctacgtgacagagggcctggagagccccaccatcgaggagcaggtggaccagaccattgatgatgagaccatcctgattgtgcccagcccccacggcttcatccaggccagtgatgtgattgacacagagagcgtgctgcccctgaccaccctgacagaccccatcctgcagcaccaccaggaggagagcaacatcatcggcagcagcctgggcagccctgtgtctgaggacagcaaggatgtggaggacctggtgaactgccactag

SEQ ID NO: 19207 - DNA, 291 bp, Artificial Sequence
  Description of Artificial Sequence: Synthetic coding sequence
atgagcacagtggaggaggacagcgacacagtgacagtggagaccgtgaacagcgtgaccctgacccaggacacagagggcaacctgatcctgcactgcccccagaatgaagcagatgaaattgattctgaggacagcattgagcccccccacaagaggctgtgcctgagcagtgaagatgaccagagcattgatgacagcaccccctgcatctctgtggtggccctgcccctgtctgaaaatgaccagagctttgaggtgaccatgacagccaccacagaggtggcctag

SEQ ID NO: 19208 - DNA, 171 bp, Artificial Sequence
  Description of Artificial Sequence: Synthetic coding sequence
atgagcacagtggaggaggacagcgacacagtgacagtggagaccgtgaacagcgtgaccctgacccaggacacagagggcaacctgatcctgcactgcccccagaatgaagcagatgaaattgattctgaggacagcattgagcccccccacaagaggctgtgcctgtag

SEQ ID NO: 19209 - DNA, 858 bp, Artificial Sequence; identical to SEQ ID NO: 19192
  Description of Artificial Sequence: Synthetic coding sequence

SEQ ID NO: 19210 - DNA, 150 bp, Artificial Sequence
  Description of Artificial Sequence: Synthetic coding sequence
atgagcacagtggaggaggacagcgacacagtgacagtggagaccgtgaacagcgtgaccctgacccaggacacagagggcaacctgatcctgcactgcccccagaatgaagcagatgaaattgattctgaggacagcattgagccctag

SEQ ID NO: 19211 - DNA, 330 bp, Artificial Sequence
  Description of Artificial Sequence: Synthetic coding sequence
atgagcacagtggaggaggacagcgacacagtgacagtggagaccgtgaacagcgtgaccctgacccaggacacagagggcaacctgatcctgcactgcccccagaatgaagcagatgaaattgattctgaggacagcattgagcccccccacaagaggctgtgcctgagcagtgaagatgaccagagcattgatgacagcaccccctgcatctctgtggtggccctgcccctgtctgaaaatgaccagagctttgaggtgaccatgacagccaccacagaggtggctgatgatgaggtgacagagggcaccgtgacccagatccagtag

SEQ ID NO: 19212 - DNA, 276 bp, Artificial Sequence
  Description of Artificial Sequence: Synthetic coding sequence
atgagcacagtggaggaggacagcgacacagtgacagtggagaccgtgaacagcgtgaccctgacccaggacacagagggcaacctgatcctgcactgcccccagaatgaagcagatgaaattgattctgaggacagcattgagcccccccacaagaggctgtgcctgagcagtgaagatgaccagagcattgatgacagcaccccctgcatctctgtggtggccctgcccctgtctgaaaatgaccagagctttgaggtgaccatgacagcctag

SEQ ID NO: 19213 - DNA, 1647 bp, Artificial Sequence
  Description of Artificial Sequence: Synthetic coding sequence
atggccactggagccaatgccacccccctggacttccccagcaagaagaggaagaggagccgctggaaccaggacaccatggagcagaagacagtcatccctggcatgcccaccgtcatccccccaggcctgacccgggagcaggagcgggcctacatcgtgcagctgcagatcgaggacctgaccaggaagctgaggactggagacctgggcatcccccccaacccagaagatagaagccccagccctgagcccatctacaacagcgagggcaagaggctgaacacccgggagttccgcaccaggaagaagctggaggaggagcggcacaacctgatcacagagatggtggccctgaacccagacttcaagcccccagctgactacaagcccccagccaccagggtgtctgacaaggtgatgatcccccaggatgagtacccagagatcaactttgtgggcctgctgattggcccccggggcaacaccctgaagaacatcgagaaggagtgcaatgccaagatcatgatccggggcaagggctctgtgaaggagggcaaggtgggcaggaaggatggccagatgctgcctggagaagatgagcccctgcacgccctggtgacagccaacaccatggagaatgtgaagaaggctgtggagcagatccggaacatcctgaagcagggcatcgagaccccagaggaccagaatgacctgaggaagatgcagctgcgggagctggcccggctgaatggcaccctgcgggaggatgacaaccgcatcctgcggccctggcagagcagcgagaccaggagcatcaccaacaccaccgtgtgcaccaagtgtggcggggccggccacatcgccagtgactgcaagttccagaggcctggggacccccagagcgcccaggacaaggccaggatggacaaggagtacctgagcctgatggccgagctgggggaggcccctgtgcctgcctctgtgggcagcaccagcggccctgccaccacccccctggccagcgcccccaggcctgctgccccagccaacaaccccccaccacccagcctgatgagcaccacccagagccggcccccctggatgaacagcggccccagcgagagccggccctaccacggcatgcatggaggcggccctgggggccctgggggcggcccccacagcttcccccaccccctgcccagcctgactggaggccacggcggccaccccatgcagcacaaccccaacggccccccaccaccctggatgcagcccccacctccacccatgaaccagggcccccaccccccaggccaccacggccccccacccatggaccagtacctgggcagcacccctgtgggcagcggcgtgtaccgcctgcaccagggcaagggcatgatgcctcctccacccatgggcatgatgcctcctcctcctcctccacccagcggccagcccccacctccacccagcggccccctgcccccctggcagcagcagcagcagcagcccccacctcctcctccacccagcagctccatggccagcagcacccccctgccctggcagcagaggagcctgcctgctgctgccatggcccgggccatgagggtgaggaccttccgggcccactggtag

SEQ ID NO: 19214 - DNA, 486 bp, Artificial Sequence
  Description of Artificial Sequence: Synthetic coding sequence
atggagcaccagctgctgtgctgtgaggtggagaccatccggcgggcctacccagatgccaacctgctgaatgacagagtgctgcgggccatgctgaaggccgaggagacctgtgcccccagcgtgtcctacttcaagtgtgtgcagacctttgtggccctgtgtgccacagatgtgaagttcatcagcaaccccccatccatggtggccgccggctctgtggtggccgctgtgcagggcctgaacctgcggagccccaacaacttcctgagctactaccgcctgacccgcttcctgagcagggtcatcaagtgtgaccctgactgcctgcgggcctgccaggagcagatcgaggccctgctggagagcagcctgcggcaggcccagcagaacatggaccccaaggctgctgaggaggaggaggaggaggaggaggaggtggacctggcctgcacccccacagatgtgagagatgtggacatctag

SEQ ID NO: 19215 - DNA, 870 bp, Artificial Sequence
  Description of Artificial Sequence: Synthetic coding sequence
atggagctgctgtgccacgaggtggaccctgtgcggcgggctgtgcgggacaggaacctgctgagagatgacagagtgctgcagaacctgctgaccatcgaggagcgctacctgccccagtgcagctacttcaagtgtgtgcagaaggacatccagccctacatgaggaggatggtggccacctggatgctggaggtgtgtgaggagcagaagtgtgaggaggaggtgttccccctggccatgaactacctggaccgcttcctggccggcgtgcccacccccaagagccacctgcagctgctgggcgctgtgtgcatgttcctggccagcaagctgaaggagaccagccccctgacagctgagaagctgtgcatctacacagacaacagcatcaagccccaggagctgctggagtgggagctggtggtgctgggcaagctgaagtggaacctggccgctgtgacccctcatgacttcatcgagcacatcctgaggaagctgccccagcagcgggagaagctgagcctcatcaggaagcacgcccagaccttcatcgccctgtgtgccacagacttcaagtttgccatgtacccacccagcatgattgccaccggctctgtgggcgccgccatctgtggcctgcagcaggatgaggaggtgagcagcctgacctgtgatgccctgacagagctgctggccaagatcaccaacacagatgtggactgcctgaaggcctgccaggagcagatcgaggccgtgctgctgaacagcctgcagcagtaccggcaggaccagagagatggcagcaagtcagaagatgagctggaccaggccagcacccccacagatgtgcgggacatcgacctgtag

SEQ ID NO: 19216 - DNA, 729 bp, Artificial Sequence
  Description of Artificial Sequence: Synthetic coding sequence
atgaagtctgctgggggcagcggccgcagcctgctgcccagcccccgggtgtgtgaggagcagagatgtgaggaggaggtgttccccctggccatgaactacctggaccgctacctgagctgtgtgcccaccaggaaggcccagctgcagctgctgggcgctgtgtgcatgctgctggccagcaagctgcgggagaccacccccctgaccatcgagaagctgtgcatctacacagaccatgctgtgagcccccggcagctgcgggactgggaggtgctggtgctgggcaagctgaagtgggacctggccgccgtcatcgcccatgacttcctggccttcatcctgcaccggctgagcctgccccgggaccggcaggccctggtgaagaagcacgcccagaccttcctggccctgtgtgccacagactacacctttgccatgtacccacccagcatgattgccaccggcagcatcggggctgctgtgcagggcctgggcgcctgcagcatgtctggagatgagctgacagagctgctggccggcatcactggaacagaggtggactgcctgcgggcctgccaggagcagattgaagctgccctgcgggagagcctgcgggaggccagccagaccagcagcagccctgcccccaaggccccccggggcagcagcagccagggccccagccagaccagcacccccacagatgtgacagccatccacctgtag

SEQ ID NO: 19217 - DNA, 636 bp, Artificial Sequence
  Description of Artificial Sequence: Synthetic coding sequence
atgaactacctggaccgctacctgagctgtgtgcccaccaggaaggcccagctgcagctgctgggcgctgtgtgcatgctgctggccagcaagctgcgggagaccacccccctgaccatcgagaagctgtgcatctacacagaccatgctgtgagcccccggcagctgcgggactgggaggtgctggtgctgggcaagctgaagtgggacctggccgctgtgattgcccatgacttcctggccttcatcctgcaccggctgagcctgccccgggaccggcaggccctggtgaagaagcacgcccagaccttcctggccctgtgtgccacagactacacctttgccatgtacccacccagcatgattgccaccggcagcattggagctgctgtgcagggcctgggcgcctgcagcatgtctggagatgagctgacagagctgctggccggcatcaccggcacagaggtggactgcctgcgggcctgccaggagcagatcgaggccgccctgcgggagagcctgcgggaggccagccagaccagcagcagccctgcccccaaggccccccggggcagcagcagccagggccccagccagaccagcacccccacagatgtgacagccatccacctgtag

SEQ ID NO: 19218 - DNA, 879 bp, Artificial Sequence
  Description of Artificial Sequence: Synthetic coding sequence
atggagctgctgtgctgtgagggcaccaggcatgcccccagggctggccctgacccccggctgctgggggaccagagggtgctgcagagcctgctgcggctggaggagcgctacgtgccccgggccagctacttccagtgtgtgcagcgggagatcaagccccacatgaggaagatgctggcctactggatgctggaggtgtgtgaggagcagagatgtgaggaggaggtgttccccctggccatgaactacctggaccgctacctgagctgtgtgcccaccaggaaggcccagctgcagctgctgggcgctgtgtgcatgctgctggccagcaagctgcgggagaccacccccctgaccatcgagaagctgtgcatctacacagaccatgctgtgagcccccggcagctgcgggactgggaggtgctggtgctgggcaagctgaagtgggacctggccgccgtcatcgcccatgacttcctggccttcatcctgcaccggctgagcctgccccgggaccggcaggccctggtgaagaagcacgcccagaccttcctggccctgtgtgccacagactacacctttgccatgtacccacccagcatgattgccaccggcagcatcggggctgctgtgcagggcctgggcgcctgcagcatgtctggagatgagctgacagagctgctggccggcatcactggaacagaggtggactgcctgcgggcctgccaggagcagattgaagctgccctgcgggagagcctgcgggaggccagccagaccagcagcagccctgcccccaaggccccccggggcagcagcagccagggccccagccagaccagcacccccacagatgtgacagccatccacctgtag

SEQ ID NO: 19219 - DNA, 663 bp, Artificial Sequence
  Description of Artificial Sequence: Synthetic coding sequence
atggagctgctgtgctgtgagggcaccaggcatgcccccagggctggccctgacccccggctgctgggggaccagagggtgctgcagagcctgctgcggctggaggagcgctacgtgccccgggccagctacttccagtgtgtgcagcgggagatcaagccccacatgaggaagatgctggcctactggatgctggaggactgggaggtgctggtgctgggcaagctgaagtgggacctggccgccgtcatcgcccatgacttcctggccttcatcctgcaccggctgagcctgccccgggaccggcaggccctggtgaagaagcacgcccagaccttcctggccctgtgtgccacagactacacctttgccatgtacccacccagcatgattgccaccggcagcatcggggctgctgtgcagggcctgggcgcctgcagcatgtctggagatgagctgacagagctgctggccggcatcactggaacagaggtggactgcctgcgggcctgccaggagcagattgaagctgccctgcgggagagcctgcgggaggccagccagaccagcagcagccctgcccccaaggccccccggggcagcagcagccagggccccagccagaccagcacccccacagatgtgacagccatccacctgtag

SEQ ID NO: 19220 - DNA, 291 bp, Artificial Sequence
  Description of Artificial Sequence: Synthetic coding sequence
atgtacccacccagcatgattgccaccggcagcatcggggctgctgtgcagggcctgggcgcctgcagcatgtctggagatgagctgacagagctgctggccggcatcactggaacagaggtggactgcctgcgggcctgccaggagcagattgaagctgccctgcgggagagcctgcgggaggccagccagaccagcagcagccctgcccccaaggccccccggggcagcagcagccagggccccagccagaccagcacccccacagatgtgacagccatccacctgtag

SEQ ID NO: 19221 - DNA, 132 bp, Artificial Sequence
  Description of Artificial Sequence: Synthetic coding sequence
atgaactacctggaccgctacctgagctgtgtgcccaccaggaaggcccagctgcagctgctgggcgctgtgtgcatgctgctggccagcaagctgcgggagaccacccccctgaccatcgagaagctgtag

SEQ ID NO: 19222 - DNA, 357 bp, Artificial Sequence
  Description of Artificial Sequence: Synthetic coding sequence
atgaactacctggaccgctacctgagctgtgtgcccaccaggaaggcccagctgcagctgctgggcgctgtgtgcatgctgctggccagcaagctgcgggagaccacccccctgaccatcgagaagctgtgcatctacacagaccatgctgtgagcccccggcagctgcgggactgggaggtgctggtgctgggcaagctgaagtgggacctggccgctgtgattgcccatgacttcctggccttcatcctgcaccggctgagcctgccccgggaccggcaggccctggtgaagaagcacgcccagaccttcctggccctgtgtgccacagactacacctttgccatgtacccctag

SEQ ID NO: 19223 - DNA, 33 bp, Artificial Sequence
  Description of Artificial Sequence: Synthetic coding sequence
atgtacccacccagcatgattgccactggatag

SEQ ID NO: 19224 - DNA, 636 bp, Artificial Sequence; identical to SEQ ID NO: 19217
  Description of Artificial Sequence: Synthetic coding sequence

SEQ ID NO: 19225 - DNA, 1233 bp, Artificial Sequence
  Description of Artificial Sequence: Synthetic coding sequence
atgccccgggagcggcgggagagagatgccaaggagcgggacaccatgaaggaggatggaggagctgagttcagcgcccggagcaggaagaggaaggccaacgtgaccgtcttcctgcaggaccctgatgaggagatggccaagattgacagaacagcccgggaccagtgtggcagccagccctgggacaacaatgctgtgtgtgccgacccctgcagcctcatccccaccccagacaaggaggatgatgacagagtgtaccccaacagcacctgcaagccccgcatcatcgcccccagccggggcagccccctgcctgtgctgtcctgggccaaccgggaggaggtgtggaagatcatgctgaacaaggagaagacctacctgcgggaccagcacttcctggagcagcaccccctgctgcagcccaagatgagggccatcctgctggactggctgatggaggtgtgtgaggtgtacaagctgcaccgggagaccttctacctggcccaggacttctttgaccgctacatggccacccaggagaatgtggtgaagaccctgctgcagctgattggcatcagcagcctcttcatcgccgccaagctggaggagatctacccacccaagctgcaccagtttgcctacgtgacagatggagcctgcagcggagatgagatcctgaccatggagctgatgatcatgaaggccctgaagtggaggctgagccccctgaccatcgtgtcctggctgaatgtgtacatgcaggtggcctacctgaatgacctgcacgaggtgctgctgccccagtacccccagcagatcttcatccagattgctgagctgctggacctgtgtgtgctggatgtggactgcctggagttcccctacggcatcctggccgccagcgccctgtaccacttcagcagcagcgagctgatgcagaaggtgtctggctaccagtggtgtgacatcgagaactgtgtgaagtggatggtgccctttgccatggtgatccgggagaccggcagcagcaagctgaagcacttccggggcgtggctgatgaagatgcccacaacatccagacccaccgggacagcctggacctgctggacaaggcccgggccaagaaggccatgctgtctgagcagaacagagccagccccctgcccagcggcctgctgaccccaccccagagcggcaagaagcagagcagcggccctgagatggcctag

SEQ ID NO: 19226 - DNA, 1104 bp, Artificial Sequence
  Description of Artificial Sequence: Synthetic coding sequence
atgccccgggagcggcgggagagagatgccaaggagcgggacaccatgaaggaggatggaggagctgagttcagcgcccggagcaggaagaggaaggccaacgtgaccgtcttcctgcaggaccctgatgaggagatggccaagattgacagaacagcccgggaccagtgtggcagccagccctgggacaacaatgctgtgtgtgccgacccctgcagcctcatccccaccccagacaaggaggatgatgacagagtgtaccccaacagcacctgcaagccccgcatcatcgcccccagccggggcagccccctgcctgtgctgtcctgggccaaccgggaggaggtgtggaagatcatgctgaacaaggagaagacctacctgcgggaccagcacttcctggagcagcaccccctgctgcagcccaagatgagggccatcctgctggactggctgatggaggtgtccctgagcctgcctgagatctacccacccaagctgcaccagtttgcctacgtgacagatggagcctgcagcggagatgagatcctgaccatggagctgatgatcatgaaggccctgaagtggaggctgagccccctgaccatcgtgtcctggctgaatgtgtacatgcaggtggcctacctgaatgacctgcacgaggtgctgctgccccagtacccccagcagatcttcatccagattgctgagctgctggacctgtgtgtgctggatgtggactgcctggagttcccctacggcatcctggccgccagcgccctgtaccacttcagcagcagcgagctgatgcagaaggtgtctggctaccagtggtgtgacatcgagaactgtgtgaagtggatggtgccctttgccatggtgatccgggagaccggcagcagcaagctgaagcacttccggggcgtggctgatgaagatgcccacaacatccagacccaccgggacagcctggacctgctggacaaggcccgggccaagaaggccatgctgtctgagcagaacagagccagccccctgcccagcggcctgctgaccccaccccagagcggcaagaagcagagcagcggccctgagatggcctag

SEQ ID NO: 19227 - DNA, 1188 bp, Artificial Sequence
  Description of Artificial Sequence: Synthetic coding sequence
atgaaggaggatggcggcgctgagttcagcgcccggagcaggaagaggaaggccaacgtgacagtgttcctgcaggaccctgatgaggagatggccaagattgacagaacagcccgggaccagtgtggcagccagccctgggacaacaatgctgtgtgtgccgacccctgcagcctcatccccaccccagacaaggaggatgatgacagagtgtaccccaacagcacctgcaagccccgcatcatcgcccccagccggggcagccccctgcctgtgctgtcctgggccaaccgggaggaggtgtggaagatcatgctgaacaaggagaagacctacctgcgggaccagcacttcctggagcagcaccccctgctgcagcccaagatgagggccatcctgctggactggctgatggaggtgtgtgaggtgtacaagctgcaccgggagaccttctacctggcccaggacttctttgaccgctacatggccacccaggagaatgtggtgaagaccctgctgcagctgattggcatcagcagcctcttcatcgccgccaagctggaggagatctacccacccaagctgcaccagtttgcctacgtgacagatggagcctgcagcggagatgagatcctgaccatggagctgatgatcatgaaggccctgaagtggaggctgagccccctgaccatcgtgtcctggctgaatgtgtacatgcaggtggcctacctgaatgacctgcacgaggtgctgctgccccagtacccccagcagatcttcatccagattgctgagctgctggacctgtgtgtgctggatgtggactgcctggagttcccctacggcatcctggccgccagcgccctgtaccacttcagcagcagcgagctgatgcagaaggtgtctggctaccagtggtgtgacatcgagaactgtgtgaagtggatggtgccctttgccatggtgatccgggagaccggcagcagcaagctgaagcacttccggggcgtggctgatgaagatgcccacaacatccagacccaccgggacagcctggacctgctggacaaggcccgggccaagaaggccatgctgtctgagcagaacagagccagccccctgcccagcggcctgctgaccccaccccagagcggcaagaagcagagcagcggccctgagatggcctag

SEQ ID NO: 19228 - DNA, 2106 bp, Artificial Sequence
  Description of Artificial Sequence: Synthetic coding sequence
aggacctcctggcccagcgagctggccgctgagaagggcaactttgaagctgctgtgaagctgggcatcgcctacctgtacaatgaaggcctgtctgtgtctgatgaggcccgggcagaggtgaatggcctgaaggccagccgcttcttcagcctggccgagcggctgaatgtgggcgccgcccccttcatctggctgttcatccggcccccctggagcgtgtctggcagctgctgcaaggctgtggtgcatgagagcctgcgggcagagtgccagctgcagaggacccacaaggccagcatcctgcactgcctgggccgggtgctgagcctgtttgaagatgaggagaagcagcagcaggcccatgacctgtttgaggaggccgcccaccagggctgcctgaccagcagctacctgctgtgggagagtgacagaagaacagatgtgtctgaccccggccgctgcctgcacagcttcaggaagctgcgggactatgctgccaagggctgctgggaggcccagctgagcctggccaaggcctgtgccaatgccaaccagctgggcctggaggtgcgggccagcagcgagatcgtgtgccagctgttccaggccagccaggccgtgtccaagcagcaggtgttttctgtgcagaagggcctgaatgacaccatgagatacatcctgattgactggctggtggaggtggccaccatgaaggacttcaccagcctgtgcctgcacctgactgtggagtgtgtggaccgctacctgcggcggcggctggtgccccgctaccgcctgcagctgctgggcatcgcctgcatggtgatctgcacccgcttcatcagcaaggagatcctgaccatccgggaggccgtgtggctgacagacaacacctacaagtatgaggacctggtgaggatgatgggagagatcgtgtctgccctggagggcaagatccgggtgcccaccgtggtggactacaaggaggtgctgctgaccctggtgcctgtggagctgcggacccagcacctgtgcagcttcctgtgtgagctgagcctgctgcacaccagcctgagcgcctatgccccagcccggctggccgccgccgccctgctgctggcccggctgacccacggccagacccagccctggaccacccagctgtgggacctgaccggcttctcctatgaggacctgatcccctgtgtgctgagcctgcacaagaagtgcttccatgatgatgcccccaaggactaccggcaggtgtccctgacagctgtgaagcagagatttgaggacaagagatatggagagatcagccaggaggaggtgctgagctacagccagctgtgtgccgccctgggcgtgacccaggacagcccagacccccccaccttcctgagcactggagagatccacgccttcctgagcagccccagcggccgccgcaccaagaggaagcgggagaacagcctgcaggaggaccggggcagctttgtgaccacccccacagctgagctgagcagccaggaggagaccctgctgggcagcttcctggactggagcctggactgctgcagcggctatgaaggagaccaggagagcgagggggagaaggagggagatgtgacagcccccagcggcatcctggatgtgacagtggtgtacctgaaccctgagcagcactgctgccaggagagcagtgatgaggaggcctgcccagaggacaagggcccccaggacccccaggccctggccctggacacccagatcccagccaccccaggccccaagcccctggtgaggaccagccgggagcccgggaaggatgtgaccaccagcggctacagctctgtgtccacagccagccccaccagctctgtggatggcggcctgggcgccctgccccagcccacctctgtgctgagcctggacagcgacagccacacccagccctgccaccaccaggccaggaagagctgcctgcagtgcaggcctcccagccccccagagagctctgtgccccagcagcaggtgaagaggatcaacctgtgcatccacagcgaggaggaggacatgaacctgggcctggtgcggctgtag

SEQ ID NO: 19229 - DNA, 2361 bp, Artificial Sequence
  Description of Artificial Sequence: Synthetic coding sequence
atgggcagcggaggagtggtgcactgccgctgtgccaagtgcttctgctaccccaccaagaggcgcatcagaagaagacccaggaacctgaccatcctgagcctgcctgaagatgtgctcttccacatcctgaagtggctgtctgtggaggacatcctggccgtgcgggctgtgcacagccagctgaaggacctggtggacaaccacgcctctgtgtgggcctgtgccagcttccaggagctgtggcccagccctggcaacctgaagctgtttgaaagagctgctgagaagggcaactttgaggccgctgtgaagctgggcatcgcctacctgtacaatgaaggcctgtctgtgtctgatgaggcccgggcagaggtgaatggcctgaaggccagccgcttcttcagcctggccgagcggctgaatgtgggcgccgcccccttcatctggctgttcatccggcccccctggagcgtgtctggcagctgctgcaaggctgtggtgcatgagagcctgcgggcagagtgccagctgcagaggacccacaaggccagcatcctgcactgcctgggccgggtgctgagcctgtttgaagatgaggagaagcagcagcaggcccatgacctgtttgaggaggccgcccaccagggctgcctgaccagcagctacctgctgtgggagagtgacagaagaacagatgtgtctgaccccggccgctgcctgcacagcttcaggaagctgcgggactatgctgccaagggctgctgggaggcccagctgagcctggccaaggcctgtgccaatgccaaccagctgggcctggaggtgcgggccagcagcgagatcgtgtgccagctgttccaggccagccaggccgtgtccaagcagcaggtgttttctgtgcagaagggcctgaatgacaccatgagatacatcctgattgactggctggtggaggtggccaccatgaaggacttcaccagcctgtgcctgcacctgactgtggagtgtgtggaccgctacctgcggcggcggctggtgccccgctaccgcctgcagctgctgggcatcgcctgcatggtgatctgcacccgcttcatcagcaaggagatcctgaccatccgggaggccgtgtggctgacagacaacacctacaagtatgaggacctggtgaggatgatgggagaaattgtgtctgccctggagggcaagatccgggtgcccaccgtggtggactacaaggaggtgctgctgaccctggtgcctgtggagctgcggacccagcacctgtgcagcttcctgtgtgagctgagcctgctgcacaccagcctgagcgcctatgccccagcccggctggccgctgctgccctgctgctggcccggctgacccacggccagacccagccctggaccacccagctgtgggacctgaccggcttctcctatgaagatctcatcccctgtgtgctgagcctgcacaagaagtgcttccatgatgatgcccccaaggactaccggcaggtgtccctgacagctgtgaagcagagatttgaggacaagcgctacggggagatcagccaggaggaggtgctgagctacagccagctgtgtgccgccctgggcgtgacccaggacagcccagacccccccaccttcctgagcactggagagatccacgccttcctgagcagccccagcggccgccgcaccaagaggaagcgggagaacagcctgcaggaggaccggggcagctttgtgaccacccccacagctgagctgagcagccaggaggagaccctgctgggcagcttcctggactggagcctggactgctgcagcggctatgaaggagaccaggagagcgagggggagaaggagggagatgtgacagcccccagcggcatcctggatgtgacagtggtgtacctgaaccctgagcagcactgctgccaggagagcagtgatgaggaggcctgcccagaagataaaggcccccaggacccccaggccctggccctggacacccagatcccagccaccccaggccccaagcccctggtgaggaccagccgggagcccgggaaggatgtgaccaccagcggctacagctctgtgtccacagccagccccaccagctctgtggatggcggcctgggcgccctgccccagcccacctctgtgctgagcctggacagcgacagccacacccagccctgccaccaccaggccaggaagagctgcctgcagtgccggccccccagccccccagagagctctgtgccccagcagcaggtgaagaggatcaacctgtgcatccacagcgaggaggaggacatgaacctgggcctggtgcggctgtag

SEQ ID NO: 19230 - DNA, 888 bp, Artificial Sequence
  Description of Artificial Sequence: Synthetic coding sequence
atgattgaggtgctgaccaccacagacagccagaagctgctgcaccagctgaatgccctgctggagcaggagagccgctgccagcccaaggtgtgtggcctgcggctgattgaaagtgcccatgacaatggcctgaggatgacagcccggctgcgggactttgaggtgaaggacctgctgagcctgacccagttcttcggctttgacacagagaccttcagcctggccgtgaacctgctggaccgcttcctgagcaagatgaaggtgcagcccaagcacctgggctgtgtgggcctgagctgcttctacctggccgtgaagagcattgaggaggagagaaatgtgcccctggccacagacctgatccgcatcagccagtaccgcttcaccgtgtctgacctgatgaggatggagaagatcgtgctggagaaggtgtgctggaaggtgaaggccaccacagccttccagttcctgcagctgtactacagcctgctgcaggagaacctgcccctggagaggaggaacagcatcaactttgagcggctggaggcccagctgaaggcctgccactgccgcatcatcttcagcaaggccaagcccagcgtgctggccctgagcatcatcgccctggagatccaggcccagaagtgtgtggagctgacagagggcattgaatgtctgcagaagcacagcaagatcaatggccgggacctgaccttctggcaggagctggtgtccaagtgcctgacagagtacagcagcaacaagtgcagcaagcccaacgtgcagaagctgaagtggatcgtgtctggccgcacagcccggcagctgaagcacagctactaccgcatcacccacctgcccaccatccctgagatggtgccctag

SEQ ID NO: 19231 - DNA, 888 bp, Artificial Sequence; identical to SEQ ID NO: 19230
  Description of Artificial Sequence: Synthetic coding sequence

SEQ ID NO: 19232 - DNA, 411 bp, Artificial Sequence
  Description of Artificial Sequence: Synthetic coding sequence
atgattgaggtgctgaccaccacagacagccagaagctgctgcaccagctgaatgccctgctggagcaggagagccgctgccagcccaaggtgtgtggcctgcggctgattgaaagtgcccatgacaatggcctgaggatgacagcccggctgcgggactttgaggtgaaggacctgctgagcctgacccagttcttcggctttgacacagagaccttcagcctggccgtgaacctgctggaccgcttcctgagcaagatgaaggtgcagcccaagcacctgggctgtgtgggcctgagctgcttctacctggccgtgaagagcattgaggaggagagaaatgtgcccctggccacagacctgatccgcatcagccagtaccgcttcaccgtgtctgacctgatgaggtag

SEQ ID NO: 19233 - DNA, 411 bp, Artificial Sequence; identical to SEQ ID NO: 19232
  Description of Artificial Sequence: Synthetic coding sequence

SEQ ID NO: 19234 - DNA, 504 bp, Artificial Sequence
  Description of Artificial Sequence: Synthetic coding sequence
atgtctgccaaggacctgatgaggatggagaagatcgtgctggagaaggtgtgctggaaggtgaaggccaccacagccttccagttcctgcagctgtactacagcctgctgcaggagaacctgcccctggagaggaggaacagcatcaactttgagcggctggaggcccagctgaaggcctgccactgccgcatcatcttcagcaaggccaagcccagcgtgctggccctgagcatcatcgccctggagatccaggcccagaagtgtgtggagctgacagagggcattgaatgtctgcagaagcacagcaagatcaatggccgggacctgaccttctggcaggagctggtgtccaagtgcctgacagagtacagcagcaacaagtgcagcaagcccaacgtgcagaagctgaagtggatcgtgtctggccgcacagcccggcagctgaagcacagctactaccgcatcacccacctgcccaccatccctgagatggtgccctag

SEQ ID NO: 19235 - DNA, 348 bp, Artificial Sequence
  Description of Artificial Sequence: Synthetic coding sequence
atgattgaggtgctgaccaccacagacagccagaagctgctgcaccagctgaatgccctgctggagcaggagagccgctgccagcccaaggtgtgtggcctgcggctgattgaaagtgcccatgacaatggcctgaggatgacagcccggctgcgggactttgaggtgaaggacctgctgagcctgacccagttcttcggctttgacacagagaccttcagcctggccgtgaacctgctggaccgcttcctgagcaagatgaaggtgcagcccaagcacctgggctgtgtgggcctgagctgcttctacctggccgtgaagagcattgaggaggagagaaatgtgtag

SEQ ID NO: 19236 - DNA, 486 bp, Artificial Sequence
  Description of Artificial Sequence: Synthetic coding sequence
atgaggatggagaagatcgtgctggagaaggtgtgctggaaggtgaaggccaccacagccttccagttcctgcagctgtactacagcctgctgcaggagaacctgcccctggagaggaggaacagcatcaactttgagcggctggaggcccagctgaaggcctgccactgccgcatcatcttcagcaaggccaagcccagcgtgctggccctgagcatcatcgccctggagatccaggcccagaagtgtgtggagctgacagagggcattgaatgtctgcagaagcacagcaagatcaatggccgggacctgaccttctggcaggagctggtgtccaagtgcctgacagagtacagcagcaacaagtgcagcaagcccaacgtgcagaagctgaagtggatcgtgtctggccgcacagcccggcagctgaagcacagctactaccgcatcacccacctgcccaccatccctgagatggtgccctag

SEQ ID NO: 19237 - DNA, 486 bp, Artificial Sequence; identical to SEQ ID NO: 19236
  Description of Artificial Sequence: Synthetic coding sequence

SEQ ID NO: 19238 - DNA, 105 bp, Artificial Sequence
  Description of Artificial Sequence: Synthetic coding sequence
atgattgaggtgctgaccaccacagacagccagaagctgctgcaccagctgaatgccctgctggagcaggagagccgctgccagcccaagaggcacttcctgtag

SEQ ID NO: 19239 - DNA, 1035 bp, Artificial Sequence
  Description of Artificial Sequence: Synthetic coding sequence
atgaaggacctgggcgctgagcacctggccggccacgagggcgtgcagctgctgggcctgctgaatgtgtacctggagcaggaggagcgcttccagccccgggagaagggcctgagcctgattgaggccaccccagaaaatgacaacaccctgtgccccggcctgagaaatgccaaggtggaggacctgcggagcctggccaacttcttcggcagctgcacagagacctttgtgctggccgtgaacatcctggaccgcttcctggccctgatgaaggtgaagcccaagcacctgagctgcattggagtgtgcagcttcctgctggccgcccgcatcgtggaggaggactgcaacatccccagcacccatgatgtgatccgcatcagccagtgcaagtgcacagccagtgacatcaagaggatggagaagatcatcagcgagaagctgcactatgagctggaggccaccacagccctgaacttcctgcacctgtaccacaccatcatcctgtgccacaccagcgagaggaaggagatcctgagcctggacaagctggaggcccagctgaaggcctgcaactgccgcctcatcttcagcaaggccaagcccagcgtgctggccctgtgcctgctgaacctggaggtggagaccctgaagtctgtggagctgctggagatcctgctgctggtgaagaagcacagcaagatcaatgacacagagttcttctactggagggagctggtgtccaagtgcctggccgagtacagcagccctgagtgctgcaagccagacctgaagaagctggtgtggatcgtgtccagaagaacagcccagaacctgcacaacagctactacagcgtgcctgagctgcccaccatccctgagggcggctgctttgatgagagcgagagcgaggacagctgtgaggacatgagctgtggggaggagagcctgagcagcagcccccccagcgaccaggagtgcaccttcttcttcaacttcaaggtggcccagaccctgtgcttccccagctag

SEQ ID NO: 19240 - DNA, 1035 bp, Artificial Sequence
  Description of Artificial Sequence: Synthetic coding sequence
atgaaggacctgggcgctgagcacctggccggccacgagggcgtgcagctgctgggcctgctgaatgtgtacctggagcaggaggagcgcttccagccccgggagaagggcctgagcctgattgaggccaccccagaaaatgacaacaccctgtgccccggcctgagaaatgccaaggtggaggacctgcggagcctggccaacttcttcggcagctgcacagagacctttgtgctggccgtgaacatcctggaccgcttcctggccctgatgaaggtgaagcccaagcacctgagctgcattggagtgtgcagcttcctgctggccgcccgcatcgtggaggaggactgcaacatccccagcacccatgatgtgatccgcatcagccagtgcaagtgcacagccagtgacatcaagaggatggagaagatcatcagcgagaagctgcactatgagctggaggccaccacagccctgaacttcctgcacctgtaccacaccatcatcctgtgccacaccagcgagaggaaggagatcctgagcctggacaagctggaggcccagctgaaggcctgcaactgccgcctcatcttcagcaaggccaagcccagcgtgctggccctgtgcctgctgaacctggaggtggagaccctgaagtctgtggagctgctggagatcctgctgctggtgaagaagcacagcaagatcaatgacacagagttcttctactggagggagctggtgtccaagtgcctggccgagtacagcagccctgagtgctgcaagccagacctgaagaagctggtgtggatcgtgtccagaagaacagcccagaacctgcacaacagctactacagcgtgcctgagctgcccaccatccctgagggcggctgctttgatgagagcgagagctctgtggcccaggccggcgtgcagtggccagacctgagcagcttccagcccccacccacccgcttcaagcgcttcagctgcctgagcctgcggagctcctgggactacagctcctggacctag

SEQ ID NO: 19241 - DNA, 1035 bp, Artificial Sequence; identical to SEQ ID NO: 19239
  Description of Artificial Sequence: Synthetic coding sequence

SEQ ID NO: 19242 - DNA, 1035 bp, Artificial Sequence; identical to SEQ ID NO: 19239
  Description of Artificial Sequence: Synthetic coding sequence

SEQ ID NO: 19243 - DNA, 483 bp, Artificial Sequence
  Description of Artificial Sequence: Synthetic coding sequence
atgaaggacctgggcgctgagcacctggccggccacgagggcgtgcagctgctgggcctgctgaatgtgtacctggagcaggaggagcgcttccagccccgggagaagggcctgagcctgattgaggccaccccagaaaatgacaacaccctgtgccccggcctgagaaatgccaaggtggaggacctgcggagcctggccaacttcttcggcagctgcacagagacctttgtgctggccgtgaacatcctggaccgcttcctggccctgatgaaggtgaagcccaagcacctgagctgcattggagtgtgcagcttcctgctggccgcccgcatcgtggaggaggactgcaacatccccagcacccatgatgtgatccgcatcagccagtgcaagtgcacagccagtgacatcaagaggatggagaagatcatcagcgagaagctgcactatgagctggaggccaccacagccctgaactag

SEQ ID NO: 19244 - DNA, 972 bp, Artificial Sequence
  Description of Artificial Sequence: Synthetic coding sequence
atgtaccacaacagcagccagaagaggcactggaccttcagcagcgaggagcagctggcccggctgcgggcagatgccaacaggaagttccgctgcaaggctgtggccaacgggaaggtgctgcccaatgaccctgtgttcctggagccccatgaggagatgaccctgtgcaagtactatgagaagaggctgctggagttctgcagcgtcttcaagccagccatgcccaggtctgtggtgggcacagcctgcatgtacttcaagcgcttctacctgaacaacagcgtgatggagtaccacccccgcatcatcatgctgacctgtgccttcctggcctgcaaggtggatgagttcaacgtgagcagcccccagtttgtgggcaacctgcgggagagccccctgggccaggagaaggccctggagcagatcctggagtatgagctgctgctgatccagcagctgaacttccacctgattgtgcacaacccctaccggccctttgagggcttcctgattgacctgaagacccgctaccccatcctggagaaccctgagatcctgaggaagacagcagatgacttcctgaaccgcatcgccctgacagatgcctacctgctgtacacccccagccagatcgccctgacagccatcctgagcagcgccagccgggccggcatcaccatggagagctacctgtctgagagcctgatgctgaaggagaacagaacctgcctgagccagctgctggacatcatgaagtccatgaggaacctggtgaagaagtatgagccccccaggtctgaggaggtggccgtgctgaagcagaagctggagcgctgccacagcgctgagctggccctgaatgtcatcaccaagaagaggaagggctatgaagatgatgattatgtgtccaagaagagcaagcatgaggaggaggagtggacagatgatgacctggtggagagcctgtag

SEQ ID NO: 19245 - DNA, 768 bp, Artificial Sequence
  Description of Artificial Sequence: Synthetic coding sequence
atgcccaggtctgtggtgggcacagcctgcatgtacttcaagcgcttctacctgaacaacagcgtgatggagtaccacccccgcatcatcatgctgacctgtgccttcctggcctgcaaggtggatgagttcaacgtgagcagcccccagtttgtgggcaacctgcgggagagccccctgggccaggagaaggccctggagcagatcctggagtatgagctgctgctgatccagcagctgaacttccacctgattgtgcacaacccctaccggccctttgagggcttcctgattgacctgaagacccgctaccccatcctggagaaccctgagatcctgaggaagacagcagatgacttcctgaaccgcatcgccctgacagatgcctacctgctgtacacccccagccagatcgccctgacagccatcctgagcagcgccagccgggccggcatcaccatggagagctacctgtctgagagcctgatgctgaaggagaacagaacctgcctgagccagctgctggacatcatgaagtccatgaggaacctggtgaagaagtatgagccccccaggtctgaggaggtggccgtgctgaagcagaagctggagcgctgccacagcgctgagctggccctgaatgtcatcaccaagaagaggaagggctatgaagatgatgattatgtgtccaagaagagcaagcatgaggaggtgtgcttcacccccaagatgaacagcaagctgttcctgctgtacatcctggtgtag

SEQ ID NO: 19246 - DNA, 750 bp, Artificial Sequence
  Description of Artificial Sequence: Synthetic coding sequence
atgcccaggtctgtggtgggcacagcctgcatgtacttcaagcgcttctacctgaacaacagcgtgatggagtaccacccccgcatcatcatgctgacctgtgccttcctggcctgcaaggtggatgagttcaacgtgagcagcccccagtttgtgggcaacctgcgggagagccccctgggccaggagaaggccctggagcagatcctggagtatgagctgctgctgatccagcagctgaacttccacctgattgtgcacaacccctaccggccctttgagggcttcctgattgacctgaagacccgctaccccatcctggagaaccctgagatcctgaggaagacagcagatgacttcctgaaccgcatcgccctgacagatgcctacctgctgtacacccccagccagatcgccctgacagccatcctgagcagcgccagccgggccggcatcaccatggagagctacctgtctgagagcctgatgctgaaggagaacagaacctgcctgagccagctgctggacatcatgaagtccatgaggaacctggtgaagaagtatgagccccccaggtctgaggaggtggccgtgctgaagcagaagctggagcgctgccacagcgctgagctggccctgaatgtcatcaccaagaagaggaagggctatgaagatgatgattatgtgtccaagaagagcaagcatgaggaggaggagtggacagatgatgacctggtggagagcctgtag

SEQ ID NO: 19247 - DNA, 1053 bp, Artificial Sequence
  Description of Artificial Sequence: Synthetic coding sequence
atggtgaccccctgccccaccagccccagcagccctgctgcccgggccggccggcgggacaatgaccagaacctgcgggcccctgtgaagaagagcagaagaccccggctgcggaggaagcagcccctgcaccccctgaacccctgccccctgcccggggacagcggcatctgtgacctgtttgagagccccagcagcggcagtgatggagctgagagccccagcgctgcccggggcggcagccccctgcccggccctgcccagcctgtggcccagctggacctgcagaccttccgggactatggccagagctgctacgccttcaggaaggcccaggagagccacttccacccccgggaggccctggcccggcagccccaggtgacagctgagagccgctgcaagctgctgtcctggctgatccctgtgcaccggcagtttggcctgagctttgagagcctgtgcctgactgtgaacaccctggaccgcttcctgaccaccacccctgtggccgctgactgcttccagctgctgggcgtgaccagcctgctgattgcctgcaagcaggtggaggtgcaccccccccgggtgaagcagctgctggccctgtgctgcggggccttcagccggcagcagctgtgcaacctggagtgcatcgtgctgcacaagctgcacttcaccctgggcgcccccaccatctccttcttcctggagcacttcacccacgcccgggtggaggccggccaggccgaggccagcgaggccctggaggcccaggccctggcccggggcgtggccgagctgagcctggccgactatgccttcaccagctacagccccagcctgctggccatctgctgcctggccctggccgacaggatgctgcgggtgtccaggcctgtggacctgcggctgggggaccaccctgaggccgccctggaggactgcatgggcaagctgcagctgctggtggccatcaacagcaccagcctgacccacatgctgcctgtgcagatctgtgagaagtgcagcctgccccccagcagcaagtag

SEQ ID NO: 19248 - DNA, 2181 bp, Artificial Sequence
  Description of Artificial Sequence: Synthetic coding sequence
atggagggggagaggaagaacaacaacaagcgctggtacttcacccgggagcagctggagaacagccccagcagaagatttggagtggaccctgacaaggagctgagctaccggcagcaggccgccaacctgctgcaggacatgggccagaggctgaatgtgtcccagctgaccatcaacacagccatcgtgtacatgcaccgcttctacatgatccagagcttcacccagtttcctggcaacagcgtggccccagctgccctcttcctggccgccaaggtggaggagcagcccaagaagctggagcacgtgatcaaggtggcccacacctgcctgcacccccaggagagcctgcctgacaccaggtctgaggcctacctgcagcaggtgcaggacctggtgatcctggagagcatcatcctgcagaccctgggctttgagctgaccatcgaccacccccacacccacgtggtgaagtgcacccagctggtgcgggccagcaaggacctggcccagaccagctacttcatggccaccaacagcctgcacctgaccaccttcagcctgcagtacaccccacctgtggtggcctgtgtgtgcatccacctggcctgcaagtggagcaactgggagatccctgtgtccacagatggcaagcactggtgggagtatgtggatgccaccgtgaccctggagctgctggatgagctgacccatgagttcctgcagatcctggagaagacccccaaccggctgaagaggatctggaactggagggcctgtgaggccgccaagaagaccaaggcagatgaccggggcacagatgagaagaccagcgagcagaccatcctgaacatgatcagccagagcagcagtgacaccaccatcgccggcctgatgtccatgagcaccagcaccaccagcgctgtgcccagcctgcctgtgtctgaggagagcagcagcaacctgacctctgtggagatgctgcccgggaagcgctggctgagcagccagcccagcttcaagctggagcccacccagggccacaggaccagcgagaacctggccctgactggagtggaccacagcctgccccaggacggcagcaatgccttcatcagccagaagcagaacagcaagtctgtgcccagcgccaaggtgtccctgaaggagtaccgggccaagcatgctgaggagctggccgcccagaagaggcagctggagaacatggaggccaacgtgaagagccagtatgcctatgctgcccagaacctgctgagccaccacgacagccacagcagcgtcatcctgaagatgcccatcgagggctctgaaaatcctgagcggcccttcctggagaaggctgacaagacagccctgaagatgagaattcctgtggccggcggggacaaggccgccagcagcaagccagaggagatcaagatgaggatcaaggtgcacgccgctgctgacaagcacaacagcgtggaggacagcgtgaccaagagccgggagcacaaggagaagcacaagacccaccccagcaaccaccaccaccaccacaaccaccacagccacaagcacagccacagccagctgcctgtgggcactggaaacaagaggcctggggaccccaagcacagcagccagaccagcaacctggcccacaagacctacagcctgagcagcagcttcagcagcagcagcagcaccaggaagaggggccccagcgaggagaccggcggcgctgtgtttgaccacccagccaagatcgccaagagcaccaagagcagcagcctgaacttctccttccccagcctgcccaccatgggccagatgcctggccacagcagtgacaccagcggcctgtccttcagccagcccagctgcaagaccagggtgccccacagcaagctggacaagggccccaccggggccaacggccacaacaccacccagaccatcgactaccaggacacagtgaacatgctgcacagcctgctgagcgcccagggcgtgcagcccacccagcccacagcctttgaatttgtgcggccctacagcgactacctgaaccccaggtctgggggcatcagcagccgcagcggcaacacagacaagccccggcccccacccctgcccagcgagcccccaccacccctgccccccctgcccaagtag

SEQ ID NO: 19249 - DNA, 723 bp, Artificial Sequence
  Description of Artificial Sequence: Synthetic coding sequence
atggaggactacaccaagattgagaagatcggggagggcacctatggagtggtgtacaagggccgccacaagaccaccggccaggtggtggccatgaagaagatccggctggagagcgaggaggagggcgtgcccagcacagccatccgggagatcagcctgctgaaggagctgcggcaccccaacatcgtgtccctgcaggatgtgctgatgcaggacagccggctgtacctgatctttgagttcctgtccatggacctgaagaagtacctggacagcatccccccaggccagtacatggacagcagcctggtgaaggtggtgaccctgtggtaccgcagccctgaggtgctgctgggcagcgcccgctacagcacccctgtggacatctggagcatcggcaccatctttgctgagctggccaccaagaagcccctcttccacggggacagcgagattgaccagctgttccgcatcttccgggccctgggcacccccaacaatgaggtgtggccagaggtggagagcctgcaggactacaagaacaccttccccaagtggaagccaggcagcctggccagccacgtgaagaacctggatgaaaatggcctggacctgctgagcaagatgctgatctatgaccctgccaagaggatcagcggcaagatggccctgaaccacccctacttcaatgacctggacaaccagatcaagaagatgtag

SEQ ID NO: 19250 - DNA, 723 bp, Artificial Sequence; identical to SEQ ID NO: 19249
  Description of Artificial Sequence: Synthetic coding sequence

SEQ ID NO: 19251 - DNA, 894 bp, Artificial Sequence
  Description of Artificial Sequence: Synthetic coding sequence
atggaggactacaccaagattgagaagatcggggagggcacctatggagtggtgtacaagggccgccacaagaccaccggccaggtggtggccatgaagaagatccggctggagagcgaggaggagggcgtgcccagcacagccatccgggagatcagcctgctgaaggagctgcggcaccccaacatcgtgtccctgcaggatgtgctgatgcaggacagccggctgtacctgatctttgagttcctgtccatggacctgaagaagtacctggacagcatccccccaggccagtacatggacagcagcctggtgaagagctacctgtaccagatcctgcagggcatcgtgttctgccacagccggcgggtgctgcaccgggacctgaagccccagaacctgctgattgatgacaagggcaccatcaagctggccgactttggcctggcccgggccttcggcatccccatccgggtgtacacccatgaggtggtgaccctgtggtaccgcagccctgaggtgctgctgggcagcgcccgctacagcacccctgtggacatctggagcatcggcaccatctttgctgagctggccaccaagaagcccctcttccatggagacagcgagattgaccagctgttccgcatcttccgggccctgggcacccccaacaatgaggtgtggccagaggtggagagcctgcaggactacaagaacaccttccccaagtggaagccaggcagcctggccagccacgtgaagaacctggatgaaaatggcctggacctgctgagcaagatgctgatctatgaccctgccaagaggatcagcggcaagatggccctgaaccacccctacttcaatgacctggacaaccagatcaagaagatgtag

SEQ ID NO: 19252 - DNA, 894 bp, Artificial Sequence
  Description of Artificial Sequence: Synthetic coding sequence
atggaggactacaccaagattgagaagatcggggagggcacctatggagtggtgtacaagggccgccacaagaccaccggccaggtggtggccatgaagaagatccggctggagagcgaggaggagggcgtgcccagcacagccatccgggagatcagcctgctgaaggagctgcggcaccccaacatcgtgtccctgcaggatgtgctgatgcaggacagccggctgtacctgatctttgagttcctgtccatggacctgaagaagtacctggacagcatccccccaggccagtacatggacagcagcctggtgaagagctacctgtaccagatcctgcagggcatcgtgttctgccacagccggcgggtgctgcaccgggacctgaagccccagaacctgctgattgatgacaagggcaccatcaagctggccgactttggcctggcccgggccttcggcatccccatccgggtgtacacccatgaggccatcaccctgtggtaccgcagccctgaggtgctgctgggcagcgcccgctacagcacccctgtggacatctggagcatcggcaccatctttgctgagctggccaccaagaagcccctcttccatggagacagcgagattgaccagctgttccgcatcttccgggccctgggcacccccaacaatgaggtgtggccagaggtggagagcctgcaggactacaagaacaccttccccaagtggaagccaggcagcctggccagccacgtgaagaacctggatgaaaatggcctggacctgctgagcaagatgctgatctatgaccctgccaagaggatcagcggcaagatggccctgaaccacccctacttcaatgacctggacaaccagatcaagaagatgtag

SEQ ID NO: 19253 - DNA, 570 bp, Artificial Sequence
  Description of Artificial Sequence: Synthetic coding sequence
atggaggactacaccaagattgagaagatcggggagggcacctatggagtggtgtacaagggccgccacaagaccaccggccaggtggtggccatgaagaagatccggctggagagcgaggaggagggcgtgcccagcacagccatccgggagatcagcctgctgaaggagctgcggcaccccaacatcgtgtccctgcaggatgtgctgatgcaggacagccggctgtacctgatctttgagttcctgtccatggacctgaagaagtacctggacagcatccccccaggccagtacatggacagcagcctggtgaagagctacctgtaccagatcctgcagggcatcgtgttctgccacagccggcgggtgctgcaccgggacctgaagccccagaacctgctgattgatgacaagggcaccatcaagctggccgactttggcctggcccgggccttcggcatccccatccgggtgtacacccatgaggccatcaccctgtggtaccgcagccctgaggtgctgctgggcagcgcccgctacagcacccctgtggacatctggagctag

SEQ ID NO: 19254 - DNA, 897 bp, Artificial Sequence
  Description of Artificial Sequence: Synthetic coding sequence
atggagaacttccagaaggtggagaagatcggggagggcacctatggagtggtgtacaaggccaggaacaagctgaccggggaggtggtggccctgaagaagatccggctggacacagaaacagaaggagtgcccagcacagccatccgggagatcagcctgctgaaggagctgaaccaccccaacatcgtgaagctgctggatgtgatccacacagagaacaagctgtacctggtgtttgagttcctgcaccaggacctgaagaagttcatggatgccagcgccctgaccggcatccccctgcccctcatcaagagctacctgttccagctgctgcagggcctggccttctgccacagccaccgggtgctgcaccgggacctgaagccccagaacctgctgatcaacacagaaggagccatcaagctggccgactttggcctggcccgggccttcggcgtgcctgtgaggacctacacccatgaggtggtgaccctgtggtaccgggcccctgagatcctgctgggctgcaagtactacagcacagctgtggacatctggagcctgggctgcatctttgctgagatggtgacccggcgggccctcttccctggggacagcgagattgaccagctgttccgcatcttccgcaccctgggcaccccagatgaggtggtgtggccaggagtgacctccatgccagactacaagcccagcttccccaagtgggcccggcaggacttcagcaaggtggtgccccccctggatgaagatggccgcagcctgctgagccagatgctgcactatgaccccaacaagaggatcagcgccaaggccgccctggcccaccccttcttccaggatgtgaccaagcctgtgccccacctgcggctgtag

SEQ ID NO: 19255 - DNA, 795 bp, Artificial Sequence
  Description of Artificial Sequence: Synthetic coding sequence
atggagaacttccagaaggtggagaagatcggggagggcacctatggagtggtgtacaaggccaggaacaagctgaccggggaggtggtggccctgaagaagatccggctggacacagaaacagaaggagtgcccagcacagccatccgggagatcagcctgctgaaggagctgaaccaccccaacatcgtgaagctgctggatgtgatccacacagagaacaagctgtacctggtgtttgagttcctgcaccaggacctgaagaagttcatggatgccagcgccctgaccggcatccccctgcccctcatcaagagctacctgttccagctgctgcagggcctggccttctgccacagccaccgggtgctgcaccgggacctgaagccccagaacctgctgatcaacacagaaggagccatcaagctggccgactttggcctggcccgggccttcggcgtgcctgtgaggacctacacccatgaggtgacccggcgggccctcttccctggggacagcgagattgaccagctgttccgcatcttccgcaccctgggcaccccagatgaggtggtgtggccaggagtgacctccatgccagactacaagcccagcttccccaagtgggcccggcaggacttcagcaaggtggtgccccccctggatgaagatggccgcagcctgctgagccagatgctgcactatgaccccaacaagaggatcagcgccaaggccgccctggcccaccccttcttccaggatgtgaccaagcctgtgccccacctgcggctgtag

SEQ ID NO: 19256 - DNA, 348 bp, Artificial Sequence
  Description of Artificial Sequence: Synthetic coding sequence
atgagctacaagcccaacctggccgcccacatgcctgctgctgccctgaatgctgctggctctgtgcacagccccagcacctccatggccaccagcagccagtaccggcagctgctgagtgactatggcccccccagcctgggctacacccagggcactggaaacagccaggtgccccagagcaaatatgcagagctgctggccatcatcgaggagctgggcaaggagatccggcccacctacgccggcagcaagagcgccatggagcggctgaagaggggcatcatccacgcccggggcctggtgcgggagtgcctggccgagacagaaagaaatgcccggagctag

SEQ ID NO: 19257 - DNA, 912 bp, Artificial Sequence
  Description of Artificial Sequence: Synthetic coding sequence
atggccaccagccgctatgagcctgtggccgagattggagtgggcgcctatggaacagtgtacaaggcccgggacccccacagcggccactttgtggccctgaagtctgtgcgggtgcccaatggaggcggcggcggcggcggcctgcccatcagcacagtgcgggaggtggccctgctgcggcggctggaggcctttgagcaccccaacgtggtgcggctgatggatgtgtgtgccaccagcaggacagaccgggagatcaaggtgaccctggtgtttgaacatgtggaccaggacctgcggacctacctggacaaggcccctcctcctggcctgcctgctgagaccatcaaggacctgatgaggcagttcctgcggggcctggacttcctgcacgccaactgcatcgtgcaccgggacctgaagccagagaacatcctggtgaccagcggcggcaccgtgaagctggccgactttggcctggcccgcatctacagctaccagatggccctgacccctgtggtggtgaccctgtggtaccgggcccctgaggtgctgctgcagagcacctacgccacccctgtggacatgtggagcgtgggctgcatctttgctgagatgttccggaggaagcccctcttctgtggcaacagcgaggccgaccagctgggcaagatctttgacctgattggcctgcccccagaagatgactggcccagagatgtgtccctgcccaggggggccttccccccccggggccccaggcctgtgcagagcgtggtgcctgagatggaggagagcggggcccagctgctgctggagatgctgaccttcaacccccacaagaggatcagcgccttccgggccctgcagcacagctacctgcacaaggatgagggcaaccctgagtag

SEQ ID NO: 19258 - DNA, 336 bp, Artificial Sequence
  Description of Artificial Sequence: Synthetic coding sequence
atggccaccagccgctatgagcctgtggccgagattggagtgggcgcctatggaacagtgtacaaggcccgggacccccacagcggccactttgtggccctgaagtctgtgcgggtgcccaatggaggcggcggcggcggcggcctgcccatcagcacagtgcgggaggtggccctgctgcggcggctggaggcctttgagcaccccaacgtggtgcggctgatggatgtgtgtgccaccagcaggacagaccgggagatcaagcgctgctttgtggagagcctgagctctgtggagaccctgaagcccacctcctgggccaagagcctgacctag

SEQ ID NO: 19259 - DNA, 552 bp, Artificial Sequence
  Description of Artificial Sequence: Synthetic coding sequence
atgaggcagttcctgcggggcctggacttcctgcacgccaactgcatcgtgcaccgggacctgaagccagagaacatcctggtgaccagcggcggcaccgtgaagctggccgactttggcctggcccgcatctacagctaccagatggccctgacccctgtggtggtgaccctgtggtaccgggcccctgaggtgctgctgcagagcacctacgccacccctgtggacatgtggagcgtgggctgcatctttgctgagatgttccggaggaagcccctcttctgtggcaacagcgaggccgaccagctgggcaagatctttgacctgattggcctgcccccagaagatgactggcccagagatgtgtccctgcccaggggggccttccccccccggggccccaggcctgtgcagagcgtggtgcctgagatggaggagagcggggcccagctgctgctggagatgctgaccttcaacccccacaagaggatcagcgccttccgggccctgcagcacagctacctgcacaaggatgagggcaaccctgagtag

SEQ ID NO: 19260 - DNA, 9 bp, Artificial Sequence
  Description of Artificial Sequence: Synthetic coding sequence
atggcctag

SEQ ID NO: 19261 - DNA, 612 bp, Artificial Sequence
  Description of Artificial Sequence: Synthetic coding sequence
atggccaccagccgctatgagcctgtggccgagattggagtgggcgcctatggaacagtgtacaaggcccgggacccccacagcggccactttgtggccctgaagtctgtgcgggtgcccaatggaggcggcggcggcggcggcctgcccatcagcacagtgcgggaggtggccctgctgcggcggctggaggcctttgagcaccccaacgtggtgcggctgatggatgtgtgtgccaccagcaggacagaccgggagatcaaggtgaccctggtgtttgaacatgtggaccaggacctgcggacctacctggacaaggcccctcctcctggcctgcctgctgagaccatcaaggacctgatgaggcagttcctgcggggcctggacttcctgcacgccaactgcatcgtgcaccgggacctgaagccagagaacatcctggtgaccagcggcggcaccgtgaagctggccgactttggcctggcccgcatctacagctaccagatggccctgacccctgtggtggtgaccctgtggtaccgggcccctgaggtgctgctgcagagcacctacgccacccctgtggacatgtggagcgtgggctgcatctag

SEQ ID NO: 19262 - DNA, 513 bp, Artificial Sequence
  Description of Artificial Sequence: Synthetic coding sequence
atggccaccagccgctatgagcctgtggccgagattggagtgggcgcctatggaacagtgtacaaggcccgggacccccacagcggccactttgtggccctgaagtctgtgcgggtgcccaatggaggcggcggcggcggcggcctgcccatcagcacagtgcgggaggtggccctgctgcggcggctggaggcctttgagcaccccaacgtggtgcggctgatggatgtgtgtgccaccagcaggacagaccgggagatcaaggtgaccctggtgtttgaacatgtggaccaggacctgcggacctacctggacaaggcccctcctcctggcctgcctgctgagaccatcaaggacctgatgaggcagttcctgcggggcctggacttcctgcacgccaactgcatcgtgcaccgggacctgaagccagagaacatcctggtgaccagcggcggcaccgtgaagctggccgactttggcctggcccgcatctacagctaccagatggcctag

SEQ ID NO: 19263 - DNA, 348 bp, Artificial Sequence
  Description of Artificial Sequence: Synthetic coding sequence
atggccaccagccgctatgagcctgtggccgagattggagtgggcgcctatggaacagtgtacaaggcccgggacccccacagcggccactttgtggccctgaagtctgtgcgggtgcccaatggaggcggcggcggcggcggcctgcccatcagcacagtgcgggaggtggccctgctgcggcggctggaggcctttgagcaccccaacgtggtgcggctgatggatgtgtgtgccaccagcaggacagaccgggagatcaaggtgaccctggtgtttgaacatgtggaccaggacctgcggacctacctggacaaggcccctcctcctggcctgcctgctgagtag

SEQ ID NO: 19264 - DNA, 924 bp, Artificial Sequence
  Description of Artificial Sequence: Synthetic coding sequence
atgggcaccgtgctgagcctgagccccagctacaggaaggccaccctgtttgaagatggagctgccaccgtgggccactacacagctgtgcagaacagcaagaatgccaaggacaagaacctgaagaggcacagcatcatctctgtgctgccctggaagagaattgtggccgtgtctgccaagaagaagaacagcaagaaggtgcagcccaacagcagctaccagaacaacatcacccacctgaacaatgaaaacctgaagaagagcctgagctgtgccaacctgagcacctttgcccagcccccaccagcccagcccccagcccccccagccagccagctgagcggcagccagacaggaggcagcagctctgtgaagaaggccccccaccctgctgtgaccagcgctggcacccccaagagggtgattgtgcaggccagcaccagcgagctgctgcgctgcctgggggagttcctgtgccgccgctgctaccgcctgaagcacctgagccccacagatcctgtgctgtggctgcggtctgtggacaggagcctgctgctgcagggctggcaggaccagggcttcatcaccccagccaacgtggtgttcctgtacatgctgtgcagagatgtgatcagcagcgaggtgggcagtgaccacgagctgcaggccgtgctgctgacctgcctgtacctgagctacagctacatgggaaatgagatctcctaccccctgaagcccttcctggtggagagctgcaaggaggccttctgggaccgctgcctgagcgtcatcaacctgatgagcagcaagatgctgcagatcaatgctgacccccactacttcacccaggtgttcagtgacctgaagaatgaaagtggccaggaggacaagaagaggctgctgctgggcctggacagatag

SEQ ID NO: 19265 - DNA, 981 bp, Artificial Sequence
  Description of Artificial Sequence: Synthetic coding sequence
atggagaaggatggcctgtgcagagctgaccagcagtatgaatgtgtggccgagattggagagggcgcctacggcaaggtgttcaaggcccgggacctgaagaatggaggccgctttgtggccctgaagagggtgcgggtgcagacaggagaggagggcatgcccctgagcaccatccgggaggtggccgtgctgcggcacctggagacctttgagcaccccaacgtggtgcggctgtttgatgtgtgcaccgtgtccaggacagaccgggagaccaagctgaccctggtgtttgagcacgtggaccaggacctgaccacctacctggacaaggtgcctgagcccggggtgcccacagagaccatcaaggacatgatgttccagctgctgcggggcctggacttcctgcacagccaccgggtggtgcaccgggacctgaagccccagaacatcctggtgaccagcagcggccagatcaagctggccgactttggcctggcccgcatctacagcttccagatggccctgacctctgtggtggtgaccctgtggtaccgggcccctgaggtgctgctgcagagcagctatgccacccctgtggacctgtggagcgtgggctgcatctttgctgagatgttccggaggaagcccctcttccggggcagcagtgatgtggaccagctgggcaagatcctggatgtgattggcctgcccggggaggaggactggcccagagatgtggccctgccccggcaggccttccacagcaagagcgcccagcccatcgagaagtttgtgacagacattgatgagctgggcaaggacctgctgctgaagtgcctgaccttcaacccagccaagaggatcagcgcctacagcgccctgagccacccctacttccaggacctggagcgctgcaaggagaacctggacagccacctgccccccagccagaacaccagcgagctgaacacagcctag

SEQ ID NO: 19266 - DNA, 981 bp, Artificial Sequence; identical to SEQ ID NO: 19265
  Description of Artificial Sequence: Synthetic coding sequence

SEQ ID NO: 19267 - DNA, 1041 bp, Artificial Sequence
  Description of Artificial Sequence: Synthetic coding sequence
atggccctggatgtgaagagccgggccaagagatatgagaagctggacttcctgggggagggccagtttgccaccgtgtacaaggcccgggacaagaacaccaaccagatcgtggccatcaagaagatcaagctgggccacaggtctgaggccaaggatggcatcaacagaacagccctgcgggagatcaagctgctgcaggagctgagccaccccaacatcatcggcctgctggatgccttcggccacaagagcaacatcagcctggtgtttgacttcatggagacagacctggaggtgatcatcaaggacaacagcctggtgctgacccccagccacatcaaggcctacatgctgatgaccctgcagggcctggagtacctgcaccagcactggatcctgcaccgggacctgaagcccaacaacctgctgctggatgaaaatggagtgctgaagctggccgactttggcctggccaagagctttggcagccccaacagagcctacacccaccaggtggtgacccgctggtaccgggcccctgagctgctgtttggagccaggatgtatggagtgggcgtggacatgtgggccgtgggctgcatcctggccgagctgctgctgcgggtgcccttcctgcccggggacagcgacctggaccagctgacccgcatctttgagaccctgggcacccccacagaggagcagtggccagacatgtgcagcctgcctgactatgtgaccttcaagagcttccctggcatccccctgcaccacatcttctctgctgctggagatgacctgctggacctgatccagggcctcttcctgttcaacccctgtgcccgcatcacagccacccaggccctgaagatgaagtacttcagcaacagacctggccccaccccaggctgccagctgccccggcccaactgccctgtggagaccctgaaggagcagagcaacccagccctggccatcaagaggaagaggacagaggccctggagcagggcggcctgcccaagaagctgatcttctag

SEQ ID NO: 19268 - DNA, 1395 bp, Artificial Sequence
  Description of Artificial Sequence: Synthetic coding sequence
atggactatgacttcaaggtgaagctgagcagcgagcgggagcgggtggaggacctgtttgaatatgagggctgcaaggtgggccggggcacctacggccacgtgtacaaggccaagaggaaggatggcaaggatgacaaggactatgccctgaagcagatcgagggcaccggcatctccatgtctgcctgccgggagatcgccctgctgcgggagctgaagcaccccaacgtcatcagcctgcagaaggtgttcctgagccatgctgacaggaaggtgtggctgctgtttgattatgcagagcatgacctgtggcacatcatcaagttccaccgggccagcaaggccaacaagaagcctgtgcagctgccccggggcatggtgaagagcctgctgtaccagatcctggatggcatccactacctgcacgccaactgggtgctgcaccgggacctgaagccagccaacatcctggtgatgggagagggccctgagcggggccgggtgaagattgctgacatgggctttgcccggctcttcaacagccccctgaagcccctggccgacctggaccctgtggtggtgaccttctggtaccgggcccctgagctgctgctgggcgcccggcactacaccaaggccatcgacatctgggccatcggctgcatctttgctgagctgctgaccagcgagcccatcttccactgccggcaggaggacatcaagaccagcaacccctaccaccacgaccagctggaccgcatcttcaacgtgatgggcttccctgctgacaaggactgggaggacatcaagaagatgcctgagcacagcaccctgatgaaggacttcagaagaaacacctacaccaactgcagcctcatcaagtacatggagaagcacaaggtgaagccagacagcaaggccttccacctgctgcagaagctgctgaccatggaccccatcaagaggatcaccagcgagcaggccatgcaggacccctacttcctggaggaccccctgcccaccagtgatgtgtttgctggctgccagatcccctaccccaagcgggagttcctgacagaggaggagccagatgacaagggggacaagaagaaccagcagcagcagcagggcaacaaccacaccaatggaacaggccaccctggcaaccaggacagcagccacacccagggcccccccctgaagaaggtgcgggtggtgccccccaccaccaccagcggcggcctcatcatgaccagtgactaccagaggagcaacccccatgctgcctaccccaaccctggccccagcaccagccagccccagagctccatgggctacagcgccaccagccagcagcccccccagtacagccaccagacccaccgctactag

SEQ ID NO: 19269 - DNA, 495 bp, Artificial Sequence
  Description of Artificial Sequence: Synthetic coding sequence
atggactatgacttcaaggtgaagctgagcagcgagcgggagcgggtggaggacctgtttgaatatgagggctgcaaggtgggccggggcacctacggccacgtgtacaaggccaagaggaaggatggcaaggatgacaaggactatgccctgaagcagatcgagggcaccggcatctccatgtctgcctgccgggagatcgccctgctgcgggagctgaagcaccccaacgtcatcagcctgcagaaggtgttcctgagccatgctgacaggaaggtgtggctgctgtttgattatgcagagcatgacctgtggcacatcatcaagttccaccgggccagcaaggccaacaagaagcctgtgcagctgccccggggcatggtgaagagcctgctgtaccagatcctggatggcatccactacctgcacgccaactgggtgctgcaccgggacctgctgacctgggccctgcctgactacctgatccacctgtag

SEQ ID NO: 19270 - DNA, 1119 bp, Artificial Sequence
  Description of Artificial Sequence: Synthetic coding sequence
atggccaagcagtatgattctgtggagtgccccttctgtgatgaggtgtccaaatatgagaagctggccaagattggccagggcaccttcggggaggtgttcaaggcccggcacaggaagacaggccagaaggtggccctgaagaaggtgctgatggagaatgagaaggagggcttccccatcacagccctgcgggagatcaagatcctgcagctgctgaagcatgaaaatgtggtgaacctgattgagatctgcaggaccaaggccagcccctacaaccgctgcaagggcagcatctacctggtgtttgacttctgtgaacatgacctggccggcctgctgagcaatgtgctggtgaagttcaccctgtctgagatcaagagggtgatgcagatgctgctgaatggcctgtactacatccacaggaacaagatcctgcaccgggacatgaaggccgccaacgtgctgatcaccagagatggagtgctgaagctggccgactttggcctggcccgggccttcagcctggccaagaacagccagcccaaccgctacaccaacagagtggtgaccctgtggtaccggcccccagagctgctgctgggggagcgggactatggcccccccatcgacctgtggggcgccggctgcatcatggccgagatgtggaccaggagccccatcatgcagggcaacacagagcagcaccagctggccctgatcagccagctgtgtggcagcatcaccccagaggtgtggcccaacgtggacaactatgagctgtatgagaagctggagctggtgaagggccagaagaggaaggtgaaggaccggctgaaggcctacgtgcgggacccctatgccctggacctgattgacaagctgctggtgctggaccctgcccagagaattgacagtgatgatgccctgaaccacgacttcttctggagcgaccccatgcccagcgacctgaagggcatgctgagcacccacctgacctccatgtttgagtacctggccccacccaggaggaagggcagccagatcacccagcagagcaccaaccagagcaggaacccagccaccaccaaccagacagaatttgagagggtcttctag

SEQ ID NO: 19271 - DNA, 1470 bp, Artificial Sequence
  Description of Artificial Sequence: Synthetic coding sequence
atgcagagagatgccccaccccgggccccagccccagccccccggctgcctgccccacccatcggggccgccgccagcagcggcggcggcggcggcggcggcagcggcggcggcggcggcggggccagcgctgccccagcccctcctggcctgagcggcaccaccagcccccggggccctgggggcggccggcgggcagaggaggccggcagcgccccccggggcaggaagtggccctggaggaggaagtggaggggccggggcggggcctggagcgctgctgctgctggccctggggccggggctgctgctgctgccactggaggcggcggcggggccctggaggccgccatggccaagcagtatgacagcgtggagtgccccttctgtgatgaggtgtccaaatatgagaagctggccaagattggccagggcacctttggagaggtgttcaaggcccggcacaggaagacaggccagaaggtggccctgaagaaggtgctgatggagaatgagaaggagggcttccccatcacagccctgcgggagatcaagatcctgcagctgctgaagcatgaaaatgtggtgaacctgattgagatctgcaggaccaaggccagcccctacaaccgctgcaagggcagcatctacctggtgtttgacttctgtgaacatgacctggccggcctgctgagcaatgtgctggtgaagttcaccctgtctgagatcaagagggtgatgcagatgctgctgaatggcctgtactacatccacaggaacaagatcctgcaccgggacatgaaggccgccaacgtgctgatcaccagagatggagtgctgaagctggccgactttggcctggcccgggccttcagcctggccaagaacagccagcccaaccgctacaccaacagagtggtgaccctgtggtacagacctcctgagctgctgctgggggagcgggactatggcccccccatcgacctgtggggcgccggctgcatcatggccgagatgtggaccaggagccccatcatgcagggcaacacagagcagcaccagctggccctgatcagccagctgtgtggcagcatcaccccagaggtgtggcccaacgtggacaactatgagctgtatgagaagctggagctggtgaagggccagaagaggaaggtgaaggaccggctgaaggcctacgtgcgggacccctatgccctggacctgattgacaagctgctggtgctggaccctgcccagagaattgacagtgatgatgccctgaaccacgacttcttctggagcgaccccatgcccagcgacctgaagggcatgctgagcacccacctgacctccatgtttgagtacctggccccacccaggaggaagggcagccagatcacccagcagagcaccaaccagagcagaaatcctgccaccaccaaccagacagaatttgagagggtcttctag

SEQ ID NO: 19272 - DNA, 585 bp, Artificial Sequence
  Description of Artificial Sequence: Synthetic coding sequence
atgcagagagatgccccaccccgggccccagccccagccccccggctgcctgccccacccatcggggccgccgccagcagcggcggcggcggcggcggcggcagcggcggcggcggcggcggggccagcgctgccccagcccctcctggcctgagcggcaccaccagcccccggggccctgggggcggccggcgggcagaggaggccggcagcgccccccggggcaggaagtggccctggaggaggaagtggaggggccggggcggggcctggagcgctgctgctgctggccctggggccggggctgctgctgctgccactggaggcggcggcggggccctggaggccgccatggccaagcagtatgacagcgtggagtgccccttctgtgatgaggtgtccaaatatgagaagctggccaagattggccagggcacctttggagaggtgttcaaggcccggcacaggaagacaggccagaaggtggccctgaagaaggtgctgatggagaatgagaaggagggcttccccatcacagccctgcgggagatcaagatcctgcagctgctgaagcatgaaaattag

SEQ ID NO: 19273 - DNA, 495 bp, Artificial Sequence
  Description of Artificial Sequence: Synthetic coding sequence
atgtctgagcctgctggagatgtgcggcagaacccctgtggcagcaaggcctgcagaagactctttggacctgtggacagcgagcagctgagccgggactgtgatgccctgatggccggctgcatccaggaggcccgggagcgctggaactttgattttgtgacagagacccccctggagggggactttgcctgggagcgggtgcggggcctgggcctgcccaagctgtacctgcccaccggcccccggcggggcagagatgagctgggcggcggcagaagacctggcaccagccctgccctgctgcagggcacagctgaggaggaccacgtggacctgagcctgagctgcaccctggtgcccaggtctggagagcaggccgagggcagccctgggggccctggggacagccagggcaggaagaggcggcagacctccatgacagacttctaccacagcaagagaagactcatcttcagcaagaggaagccctag

SEQ ID NO: 19274 - DNA, 495 bp, Artificial Sequence; identical to SEQ ID NO: 19273
  Description of Artificial Sequence: Synthetic coding sequence

SEQ ID NO: 19275 - DNA, 495 bp, Artificial Sequence; identical to SEQ ID NO: 19273
  Description of Artificial Sequence: Synthetic coding sequence

SEQ ID NO: 19276 - DNA, 597 bp, Artificial Sequence
  Description of Artificial Sequence: Synthetic coding sequence
atgtggggcgtcttccggcggcagaccacccacagcagcaacccccccctgcccggccagcagagctgctgcaaccaccgggacttcttctgcagcggggccatgtctgagcctgctggagatgtgcggcagaacccctgtggcagcaaggcctgcagaagactctttggacctgtggacagcgagcagctgagccgggactgtgatgccctgatggccggctgcatccaggaggcccgggagcgctggaactttgattttgtgacagagacccccctggagggggactttgcctgggagcgggtgcggggcctgggcctgcccaagctgtacctgcccaccggcccccggcggggcagagatgagctgggcggcggcagaagacctggcaccagccctgccctgctgcagggcacagctgaggaggaccacgtggacctgagcctgagctgcaccctggtgcccaggtctggagagcaggccgagggcagccctgggggccctggggacagccagggcaggaagaggcggcagacctccatgacagacttctaccacagcaagagaagactcatcttcagcaagaggaagccctag

SEQ ID NO: 19277 - DNA, 363 bp, Artificial Sequence
  Description of Artificial Sequence: Synthetic coding sequence
atggatgacagcaaggtggtgggcggcaaggtgaagaagccaggcaagaggggcaggaagccagccaagattgacctgaaggccaagctggagaggagccggcagagcgccagagaatgtcgggccaggaagaagctgcgctaccagtacctggaggagctggtgagcagccgggagcgggccatctgtgccctgcgggaggagctggagatgtacaagcagtggtgcatggccatggaccagggcaagatccccagcgagatcaaggccctgctgactggagaggagcagaacaagagccagcagaacagcagccgccacaccaaggccggcaagacagatgccaacagcaacagctggtag

SEQ ID NO: 19278 - DNA, 444 bp, Artificial Sequence
  Description of Artificial Sequence: Synthetic coding sequence
atggaggaggccagccagaggaagtggaactttgacttccagaaccacaagcccctggagggcaagtatgagtggcaggaggtggagaagggcagcctgcctgagttctactaccggccccccaggcctcccaagggggcctgcaaggtgcctgcccaggagagccaggatgtgtctggcagcaggcctgctgcccccctcatcggggccccagccaacagcgaggacacccacctggtggaccccaagacagaccccagcgacagccagacaggcctggccgagcagtgtgccggcatcaggaagaggcctgccacagatgacagcagcacccagaacaagagggccaacagaacagaagaaaatgtgtctgatggcagccccaatgccggctctgtggagcagacccccaagaagccaggcctgcggcggcggcagacctag

SEQ ID NO: 19279 - DNA, 918 bp, Artificial Sequence
  Description of Artificial Sequence: Synthetic coding sequence
atggagcggctggtggcccggggcaccttccctgtgctggtgaggaccagcgcctgccgcagcctgtttggacctgtggaccacgaggagctgagccgggagctgcaggcccggctggccgagctgaatgctgaggaccagaaccgctgggactatgacttccagcaggacatgcccctgcggggccctggccgcctgcagtggacagaggtggacagcgacagcgtgcctgccttctaccgggagaccgtgcaggtgggccgctgccgcctgctgctggcccccaggcctgtggccgtggccgtggccgtgagcccccccctggagcctgctgctgagagcctggatggcctggaggaggcccctgagcagctgcccagcgtgcctgtgcctgccccagccagcaccccacctcctgtgcctgtgctggccccagccccagccccagccccagcccctgtggccgcccctgtggccgcccctgtggccgtggccgtgctggccccagccccagccccagccccagccccagccccagccccagcccctgtggccgccccagccccagccccagccccagccccagccccagccccagccccagccccagccccagatgctgccccccaggagagcgctgagcagggcgccaaccagggccagaggggccaggagcccctggccgaccagctgcacagcggcatcagcggccggcctgctgctggaacagctgctgccagcgccaatggagctgccatcaagaagctgagcggccccctcatcagtgacttctttgccaagaggaagaggtctgcccctgagaagagcagtggagatgtgcctgccccctgccccagccccagcgctgcccctggggtgggctctgtggagcagacccccaggaagaggctgaggtag

SEQ ID NO: 19280 - DNA, 951 bp, Artificial Sequence
  Description of Artificial Sequence: Synthetic coding sequence
atgtctgatgccagcctgcggagcaccagcaccatggagcggctggtggcccggggcaccttccctgtgctggtgaggaccagcgcctgccgcagcctgtttggacctgtggaccacgaggagctgagccgggagctgcaggcccggctggccgagctgaatgctgaggaccagaaccgctgggactatgacttccagcaggacatgcccctgcggggccctggccgcctgcagtggacagaggtggacagcgacagcgtgcctgccttctaccgggagaccgtgcaggtgggccgctgccgcctgctgctggcccccaggcctgtggccgtggccgtggccgtgtccccacccctggagcctgctgctgagagcctggatggcctggaggaggcccctgagcagctgcccagcgtgcctgtgcctgccccagccagcaccccacctcctgtgcctgtgctggccccagccccagccccagccccagcccctgtggccgcccctgtggccgcccctgtggccgtggccgtgctggccccagccccagccccagccccagccccagccccagccccagcccctgtggccgccccagccccagccccagccccagccccagccccagccccagccccagccccagccccagatgctgccccccaggagagcgctgagcagggcgccaaccagggccagaggggccaggagcccctggccgaccagctgcacagcggcatcagcggccggcctgctgctggaacagctgctgccagcgccaacggggccgccatcaagaagctgagcggccccctcatcagtgacttctttgccaagaggaagaggtctgcccctgagaagagcagtggagatgtgcctgccccctgccccagccccagcgctgcccctggggtgggctctgtggagcagacccccaggaagaggctgaggtag

SEQ ID NO: 19281 - DNA, 951 bp, Artificial Sequence; identical to SEQ ID NO: 19280
  Description of Artificial Sequence: Synthetic coding sequence

SEQ ID NO: 19282 - DNA, 918 bp, Artificial Sequence; identical to SEQ ID NO: 19279
  Description of Artificial Sequence: Synthetic coding sequence

SEQ ID NO: 19283 - DNA, 504 bp, Artificial Sequence
  Description of Artificial Sequence: Synthetic coding sequence
atggagcctgctgctggcagctccatggagcccagcgctgactggctggccacagctgctgcccggggccgggtggaggaggtgcgggccctgctggaggccggggccctgcccaatgcccccaacagctatggccggcggcccatccaggtgatgatgatgggcagcgcccgggtggccgagctgctgctgctgcacggggctgagcccaactgtgccgaccctgccaccctgaccaggcctgtgcatgatgctgcccgggagggcttcctggacaccctggtggtgctgcaccgggccggggcccggctggatgtgagagatgcctggggccgcctgcctgtggacctggccgaggagctgggccacagagatgtggcccgctacctgcgggctgctgctgggggcacccggggcagcaaccacgccagaattgatgctgctgagggccccagcgagatgattggcaaccacctgtgggtgtgccgcagcagacatgcctag

SEQ ID NO: 19284 - DNA, 471 bp, Artificial Sequence
  Description of Artificial Sequence: Synthetic coding sequence
atggagcctgctgctggcagctccatggagcccagcgctgactggctggccacagctgctgcccggggccgggtggaggaggtgcgggccctgctggaggccggggccctgcccaatgcccccaacagctatggccggcggcccatccaggtgatgatgatgggcagcgcccgggtggccgagctgctgctgctgcacggggctgagcccaactgtgccgaccctgccaccctgaccaggcctgtgcatgatgctgcccgggagggcttcctggacaccctggtggtgctgcaccgggccggggcccggctggatgtgagagatgcctggggccgcctgcctgtggacctggccgaggagctgggccacagagatgtggcccgctacctgcgggctgctgctgggggcacccggggcagcaaccacgccagaattgatgctgctgagggccccagcgacatcccagactag

SEQ ID NO: 19285 - DNA, 522 bp, Artificial Sequence
  Description of Artificial Sequence: Synthetic coding sequence
atgggccggggccgctgtgtgggccccagcctgcagctgcggggccaggagtggcgctgcagccccctggtgcccaagggcggcgctgctgctgctgagctgggccctgggggcggggagaacatggtgcggcgcttcctggtgaccctgcgcatcagaagagcctgtggccccccccgggtgcgggtgtttgtggtgcacatcccccggctgaccggggagtgggccgcccctggggccccagctgctgtggccctggtgctgatgctgctgcggagccagaggctgggccagcagcccctgcccaggaggcctggccatgatgatggccagaggcccagcggcggcgctgctgctgccccccggcggggggcccagctgcggcggcccaggcacagccaccccacccgggcccggcgctgccctgggggcctgcccggccatgctggaggagctgcccctggccgcggggctgctggccgggcccgctgcctgggccccagcgcccggggccctggatag

SEQ ID NO: 19286 - DNA, 504 bp, Artificial Sequence; identical to SEQ ID NO: 19283
  Description of Artificial Sequence: Synthetic coding sequence

SEQ ID NO: 19287 - DNA, 399 bp, Artificial Sequence
  Description of Artificial Sequence: Synthetic coding sequence
atggtgcggcgcttcctggtgaccctgcgcatccggcgggcctgtggccccccccgggtgcgggtgtttgtggtgcacatcccccggctgactggagagtgggccgcccctggggccccagctgctgtggccctggtgctgatgctgctgcggagccagaggctgggccagcagcccctgccccggcggcccggccatgatgatggccagaggccttctggaggagctgctgctgcccccaggagaggagcccagctgcggcggcccaggcacagccaccccacccgggcccggcgctgccctgggggcctgcccggccacgccggcggggccgcccctggaagaggagctgctggccgggcccgctgcctgggccccagcgcccggggccctggatag

SEQ ID NO: 19288 - DNA, 417 bp, Artificial Sequence
  Description of Artificial Sequence: Synthetic coding sequence
atgagggaggagaacaagggcatgcccagcggcggcggcagtgatgagggcctggccagcgctgctgcccggggcctggtggagaaggtgcggcagctgctggaggccggggctgaccccaatggagtgaaccgcttcggccggcgggccatccaggtgatgatgatgggcagcgcccgggtggccgagctgctgctgctgcacggggctgagcccaactgtgccgaccctgccaccctgaccaggcctgtgcatgatgctgcccgggagggcttcctggacaccctggtggtgctgcaccgggccggggcccggctggatgtgagagatgcctggggccgcctgcctgtggacctggccgaggagcggggccacagagatgtggccggctacctgaggacagccaccggggactag

SEQ ID NO: 19289 - DNA, 237 bp, Artificial Sequence
  Description of Artificial Sequence: Synthetic coding sequence
atgagggaggagaacaagggcatgcccagcggcggcggcagtgatgagggcctggccagcgctgctgcccggggcctggtggagaaggtgcggcagctgctggaggccggggctgaccccaatggagtgaaccgcttcggccggcgggccatccaggtggccggggcccctggcccccggcggcagggcgcccgggagcggggggcccggccccggcgcatcggggccggcacctag

SEQ ID NO: 19290 - DNA, 237 bp, Artificial Sequence; identical to SEQ ID NO: 19289
  Description of Artificial Sequence: Synthetic coding sequence

SEQ ID NO: 19291 - DNA, 507 bp, Artificial Sequence
  Description of Artificial Sequence: Synthetic coding sequence
atggccgagccctggggcaatgagctggccagcgctgctgcccggggggacctggagcagctgaccagcctgctgcagaacaacgtgaatgtgaatgcccagaatggatttggaagaacagccctgcaggtgatgaagctgggcaaccctgagatcgcccggcggctgctgctgcggggggccaacccagacctgaaggacagaactggatttgctgtgattcatgatgctgcccgggccggcttcctggacaccctgcagaccctgctggagttccaggctgatgtgaacattgaagataatgaaggcaacctgcccctgcacctggccgccaaggagggccacctgcgggtggtggagttcctggtgaagcacacagccagcaatgtgggccacaggaaccacaagggggacacagcctgtgacctggcccggctgtatggaagaaatgaggtggtgtccctgatgcaggccaatggagctggaggagccaccaacctgcagtag

SEQ ID NO: 19292 - DNA, 507 bp, Artificial Sequence; identical to SEQ ID NO: 19291
  Description of Artificial Sequence: Synthetic coding sequence

SEQ ID NO: 19293 - DNA, 507 bp, Artificial Sequence; identical to SEQ ID NO: 19291
  Description of Artificial Sequence: Synthetic coding sequence

SEQ ID NO: 19294 - DNA, 501 bp, Artificial Sequence
  Description of Artificial Sequence: Synthetic coding sequence
atgctgctggaggaggtgcgggccggggaccggctgtctggagctgctgcccggggagatgtgcaggaggtgcggcggctgctgcaccgggagctggtgcacccagatgccctgaacagatttgggaagacagccctgcaggtgatgatgtttggcagcacagccatcgccctggagctgctgaagcagggcgccagccccaacgtgcaggacaccagcggcaccagccctgtgcatgatgctgccaggacaggcttcctggacaccctgaaggtgctggtggagcacggggctgatgtgaatgtgcctgatggcaccggggccctgcccatccacctggccgtgcaggagggccacacagctgtggtgtccttcctggccgctgagagtgacctgcacagaagagatgcccggggcctgacccccctggagctggccctgcagagaggagcccaggacctggtggacatcctgcagggccacatggtggcccccctgtag

SEQ ID NO: 19295 - DNA, 501 bp, Artificial Sequence; identical to SEQ ID NO: 19294
  Description of Artificial Sequence: Synthetic coding sequence

SEQ ID NO: 19296 - DNA, 639 bp, Artificial Sequence
  Description of Artificial Sequence: Synthetic coding sequence
atgaagccacccagcagcatccagaccagcgagtttgacagcagtgatgaggagcccattgaagatgagcagacccccatccacatctcctggctgagcctgagccgggtgaactgcagccagttcctgggcctgtgtgccctgcccggctgcaagttcaaggatgtgagaagaaatgtgcagaaggacacagaggagctgaagagctgtggcatccaggacatctttgtgttctgcaccagaggagagctgagcaagtacagagtgcccaacctgctggacctgtaccagcagtgtggcatcatcacccaccaccaccccatcgcagatggcggcaccccagacatcgccagctgctgtgagatcatggaggagctgaccacctgcctgaagaactacaggaagaccctcatccactgctatggaggcctgggccgcagctgcctggtggccgcctgcctgctgctgtacctgagtgacaccatcagccctgagcaggccatcgacagcctgcgggacctgcggggcagcggggccatccagaccatcaagcagtacaactacctgcacgagttccgggacaagctggccgcccacctgagcagccgggacagccagagccgctctgtgtccaggtag

SEQ ID NO: 19297 - DNA, 501 bp, Artificial Sequence
  Description of Artificial Sequence: Synthetic coding sequence
atgaacccctgctgcaagttcaaggatgtgagaagaaatgtgcagaaggacacagaggagctgaagagctgtggcatccaggacatctttgtgttctgcaccagaggagagctgagcaagtacagagtgcccaacctgctggacctgtaccagcagtgtggcatcatcacccaccaccaccccatcgcagatggcggcaccccagacatcgccagctgctgtgagatcatggaggagctgaccacctgcctgaagaactacaggaagaccctcatccactgctatggaggcctgggccgcagctgcctggtggccgcctgcctgctgctgtacctgagtgacaccatcagccctgagcaggccatcgacagcctgcgggacctgcggggcagcggggccatccagaccatcaagcagtacaactacctgcacgagttccgggacaagctggccgcccacctgagcagccgggacagccagagccgctctgtgtccaggtag

SEQ ID NO: 19298 - DNA, 210 bp, Artificial Sequence
  Description of Artificial Sequence: Synthetic coding sequence
atgaagccacccagcagcatccagaccagcgagtttgacagcagtgatgaggagcccattgaagatgagcagacccccatccacatctcctggctgagcctgagccgggtgaactgcagccagttcctgggcctgtgtgccctgcccggctgcaagttcaaggatgtgagaagaaatgtgcagaaggagaagaagaagaagaagaagtag

SEQ ID NO: 19299 - DNA, 624 bp, Artificial Sequence
  Description of Artificial Sequence: Synthetic coding sequence
atgaagccacccagcagcatccagaccagcgagtttgacagcagtgatgaggagcccattgaagatgagcagacccccatccacatctcctggctgagcctgagccgggtgaactgcagccagttcctgggcctgtgtgccctgcccggctgcaagttcaaggatgtgagaagaaatgtgcagaaggacacagaggagctgaagagctgtggcatccaggacatctttgtgttctgcaccagaggagagctgagcaagtacagagtgcccaacctgctggacctgtaccagcagtgtggcatcatcacccaccaccaccccatcgcagatggcggcaccccagacatcgccagctgctgtgagatcatggaggagctgaccacctgcctgaagaacctcttctgctacggcggcctgggccgcagctgcctggtggccgcctgcctgctgctgtacctgagtgacaccatcagccctgagcaggccatcgacagcctgcgggacctgcggggcagcggggccatccagaccatcaagcagtacaactacctgcacgagttccgggacaagctggccgcccacctgagcagccgggacagccagagccgctctgtgtccaggtag

SEQ ID NO: 19300 - DNA, 519 bp, Artificial Sequence
  Description of Artificial Sequence: Synthetic coding sequence
atgaagccacccagcagcatccagaccagctgcaagttcaaggatgtgagaagaaatgtgcagaaggacacagaggagctgaagagctgtggcatccaggacatctttgtgttctgcaccagaggagagctgagcaagtacagagtgcccaacctgctggacctgtaccagcagtgtggcatcatcacccaccaccaccccatcgcagatggcggcaccccagacatcgccagctgctgtgagatcatggaggagctgaccacctgcctgaagaactacaggaagaccctcatccactgctatggaggcctgggccgcagctgcctggtggccgcctgcctgctgctgtacctgagtgacaccatcagccctgagcaggccatcgacagcctgcgggacctgcggggcagcggggccatccagaccatcaagcagtacaactacctgcacgagttccgggacaagctggccgcccacctgagcagccgggacagccagagccgctctgtgtccaggtag

SEQ ID NO: 19301 - DNA, 2871 bp, Artificial Sequence
  Description of Artificial Sequence: Synthetic coding sequence
atgagcagcggcctgtggagccaggagaaggtgaccagcccctactgggaggagcgcatcttctacctgctgctgcaggagtgcagcgtgacagacaagcagacccagaagctgctgaaggtgcccaagggcagcatcggccagtacatccaggacagatctgtgggccacagccgcatccccagcgccaagggcaagaagaaccagatcggcctgaagatcctggagcagccccatgctgtgctgtttgtggatgagaaggatgtggtggagatcaatgagaagttcacagagctgctgctggccatcaccaactgtgaggagcgcttcagcctcttcaagaacagaaaccggctgagcaagggcctgcagattgatgtgggctgccctgtgaaggtgcagctgcggtctggagaggagaagtttcctggggtggtgcgcttccggggccccctgctggccgagaggacagtgtctggcatcttctttggagtggagctgctggaggagggccggggccagggcttcacagatggagtgtaccagggcaagcagctgttccagtgtgatgaggactgtggggtgtttgtggccctggacaagctggagctgattgaagatgatgacacagccctggagagtgactatgccggccctggggacaccatgcaggtggagctgccccccctggagatcaacagccgggtgtccctgaaggtgggggagaccatcgagagcggcaccgtcatcttctgtgatgtgctgcccgggaaggagagcctgggctactttgtgggcgtggacatggacaaccccatcggcaactgggatggccgctttgatggagtgcagctgtgcagctttgcctgtgtggagagcaccatcctgctgcacatcaatgacatcatcccagccctgtctgagagcgtgacccaggagcggcggccccccaagctggccttcatgagcagaggagtgggggacaagggcagcagcagccacaacaagcccaaggccaccggcagcaccagtgaccccggcaacagaaacagaagtgagctgttctacaccctgaatggcagctctgtggacagccagccccagagcaagagcaagaacacctggtacattgatgaggtggccgaggaccctgccaagagcctgacagagatcagcacagactttgacaggagcagcccccccctgcagcccccacctgtgaacagcctgaccacagaaaatcgcttccacagcctgcccttcagcctgaccaagatgcccaacaccaacggcagcatcggccacagccccctgagcctgagcgcccagagcgtgatggaggagctgaacacagcccctgtgcaggagagcccccccctggccatgcctcctggcaacagccacggcctggaggtgggcagcctggccgaggtgaaggagaacccccccttctatggagtcatccgctggattggccagcccccaggcctgaatgaggtgctggccggcctggagctggaggatgaatgtgccggctgcacagatggcaccttccggggcacccgctacttcacctgtgccctgaagaaggccctgtttgtgaagctgaagagctgcaggccagacagcagatttgccagcctgcagcctgtgagcaaccagatcgagcgctgcaacagcctggcctttggaggctacctgtctgaggtggtggaggagaacaccccacccaagatggagaaggagggcctggagatcatgattggcaagaagaagggcatccagggccactacaacagctgctacctggacagcaccctcttctgcctgtttgccttcagctctgtgctggacacagtgctgctgcggcccaaggagaagaatgatgtggagtactacagcgagacccaggagctgctgaggacagagatcgtgaaccccctgcgcatctacggctacgtgtgtgccaccaagatcatgaagctgaggaagatcctggagaaggtggaggccgccagcggcttcaccagcgaggagaaggaccctgaggagttcctgaacatcctcttccaccacatcctgcgggtggagcccctgctgaagatccgctctgctggccagaaggtgcaggactgctacttctaccagatcttcatggagaagaatgagaaggtgggcgtgcccaccatccagcagctgctggagtggagcttcatcaacagcaacctgaagtttgctgaggcccccagctgcctgatcatccagatgcccaggtttgggaaggacttcaagctgttcaagaagatcttccccagcctggagctgaacatcacagacctgctggaggacaccccccggcagtgccgcatctgtggcggcctggccatgtatgagtgcagagaatgttatgatgatcctgacatctctgctgggaagatcaagcagttctgcaagacctgcaacacccaggtgcacctgcaccccaagaggctgaaccacaagtacaaccctgtgtccctgcccaaggacctgcctgactgggactggaggcatggctgcatcccctgccagaacatggagctgtttgctgtgctgtgcatcgagaccagccactacgtggcctttgtgaagtatggcaaggatgattctgcctggctgttctttgacagcatggctgacagagatggcggccagaatggcttcaacatcccccaggtgaccccctgcccagaggtgggggagtacctgaagatgagcctggaggacctgcacagcctggacagccgccgcatccagggctgtgcccggcggctgctgtgtgatgcctacatgtgcatgtaccagagccccaccatgagcctgtacaagtag

SEQ ID NO: 19302 - DNA, 2862 bp, Artificial Sequence
  Description of Artificial Sequence: Synthetic coding sequence
atgagcagcggcctgtggagccaggagaaggtgaccagcccctactgggaggagcgcatcttctacctgctgctgcaggagtgcagcgtgacagacaagcagacccagaagctgctgaaggtgcccaagggcagcatcggccagtacatccaggacagatctgtgggccacagccgcatccccagcgccaagggcaagaagaaccagatcggcctgaagatcctggagcagccccatgctgtgctgtttgtggatgagaaggatgtggtggagatcaatgagaagttcacagagctgctgctggccatcaccaactgtgaggagcgcttcagcctcttcaagaacagaaaccggctgagcaagggcctgcagattgatgtgggctgccctgtgaaggtgcagctgcggtctggagaggagaagtttcctggggtggtgcgcttccggggccccctgctggccgagaggacagtgtctggcatcttctttggagtggagctgctggaggagggccggggccagggcttcacagatggagtgtaccagggcaagcagctgttccagtgtgatgaggactgtggggtgtttgtggccctggacaagctggagctgattgaagatgatgacacagccctggagagtgactatgccggccctggggacaccatgcaggtggagctgccccccctggagatcaacagccgggtgtccctgaaggtgggggagaccatcgagagcggcaccgtcatcttctgtgatgtgctgcccgggaaggagagcctgggctactttgtgggcgtggacatggacaaccccatcggcaactgggatggccgctttgatggagtgcagctgtgcagctttgcctgtgtggagagcaccatcctgctgcacatcaatgacatcatccctgagagcgtgacccaggagaggaggcctcccaagctggccttcatgagccggggcgtgggggacaagggcagcagcagccacaacaagcccaaggccaccggcagcaccagtgaccccggcaacagaaacagaagtgagctgttctacaccctgaatggcagctctgtggacagccagccccagagcaagagcaagaacacctggtacattgatgaggtggctgaagatcctgccaagagcctgacagagatcagcacagactttgacaggagcagcccccccctgcagcccccacctgtgaacagcctgaccacagagaaccgcttccacagcctgcccttcagcctgaccaagatgcccaacaccaacggcagcatcggccacagccccctgagcctgagcgcccagagcgtgatggaggagctgaacacagcccctgtgcaggagagcccccccctggccatgcctcctggcaacagccacggcctggaggtgggcagcctggccgaggtgaaggaaaatccacccttctacggcgtcatccgctggattggccagcccccaggcctgaatgaggtgctggccggcctggagctggaggatgaatgtgccggctgcacagatggcaccttccggggcacccgctacttcacctgtgccctgaagaaggccctgtttgtgaagctgaagagctgcaggccagacagcagatttgccagcctgcagcctgtgagcaaccagatcgagcgctgcaacagcctggccttcggcggctacctgtctgaggtggtggaggagaacaccccacccaagatggagaaggagggcctggagatcatgattggcaagaagaagggcatccagggccactacaacagctgctacctggacagcaccctcttctgcctgtttgccttcagctctgtgctggacacagtgctgctgcggcccaaggagaagaatgatgtggagtactacagcgagacccaggagctgctgaggacagaaattgtgaaccccctgcgcatctacggctacgtgtgtgccaccaagatcatgaagctgaggaagatcctggagaaggtggaggccgccagcggcttcaccagcgaggagaaggaccctgaggagttcctgaacatcctcttccaccacatcctgcgggtggagcccctgctgaagatccgctctgctggccagaaggtgcaggactgctacttctaccagatcttcatggagaagaatgagaaggtgggcgtgcccaccatccagcagctgctggagtggagcttcatcaacagcaacctgaagtttgctgaggcccccagctgcctgatcatccagatgcccaggtttgggaaggacttcaagctgttcaagaagatcttccccagcctggagctgaacatcacagacctgctggaggacaccccccggcagtgccgcatctgtggcggcctggccatgtatgaatgtcgggagtgctatgatgatcctgacatctctgctgggaagatcaagcagttctgcaagacctgcaacacccaggtgcacctgcaccccaagaggctgaaccacaagtacaaccctgtgtccctgcccaaggacctgcctgactgggactggaggcatggctgcatcccctgccagaacatggagctgtttgctgtgctgtgcatcgagaccagccactacgtggcctttgtgaagtatggcaaggatgacagcgcctggctgttctttgacagcatggctgacagagatggcggccagaatggcttcaacatcccccaggtgaccccctgcccagaggtgggggagtacctgaagatgagcctggaggacctgcacagcctggacagccgccgcatccagggctgtgcccggcggctgctgtgtgatgcctacatgtgcatgtaccagagccccaccatgagcctgtacaagtag

SEQ ID NO: 19303 - DNA, 2862 bp, Artificial Sequence; identical to SEQ ID NO: 19302
  Description of Artificial Sequence: Synthetic coding sequence

SEQ ID NO: 19304 - DNA, 2871 bp, Artificial Sequence
  Description of Artificial Sequence: Synthetic coding sequence
atgagcagcggcctgtggagccaggagaaggtgaccagcccctactgggaggagcgcatcttctacctgctgctgcaggagtgcagcgtgacagacaagcagacccagaagctgctgaaggtgcccaagggcagcatcggccagtacatccaggacagatctgtgggccacagccgcatccccagcgccaagggcaagaagaaccagatcggcctgaagatcctggagcagccccatgctgtgctgtttgtggatgagaaggatgtggtggagatcaatgagaagttcacagagctgctgctggccatcaccaactgtgaggagcgcttcagcctcttcaagaacagaaaccggctgagcaagggcctgcagattgatgtgggctgccctgtgaaggtgcagctgcggtctggagaggagaagtttcctggggtggtgcgcttccggggccccctgctggccgagaggacagtgtctggcatcttctttggagtggagctgctggaggagggccggggccagggcttcacagatggagtgtaccagggcaagcagctgttccagtgtgatgaggactgtggggtgtttgtggccctggacaagctggagctgattgaagatgatgacacagccctggagagtgactatgccggccctggggacaccatgcaggtggagctgccccccctggagatcaacagccgggtgtccctgaaggtgggggagaccatcgagagcggcaccgtcatcttctgtgatgtgctgcccgggaaggagagcctgggctactttgtgggcgtggacatggacaaccccatcggcaactgggatggccgctttgatggagtgcagctgtgcagctttgcctgtgtggagagcaccatcctgctgcacatcaatgacatcatcccagctgtgtctgagagcgtgacccaggagcggcggccccccaagctggccttcatgagcagaggagtgggggacaagggcagcagcagccacaacaagcccaaggccaccggcagcaccagtgaccccggcaacagaaacagaagtgagctgttctacaccctgaatggcagctctgtggacagccagccccagagcaagagcaagaacacctggtacattgatgaggtggccgaggaccctgccaagagcctgacagagatcagcacagactttgacaggagcagcccccccctgcagcccccacctgtgaacagcctgaccacagaaaatcgcttccacagcctgcccttcagcctgaccaagatgcccaacaccaacggcagcatcggccacagccccctgagcctgagcgcccagagcgtgatggaggagctgaacacagcccctgtgcaggagagcccccccctggccatgcctcctggcaacagccacggcctggaggtgggcagcctggccgaggtgaaggagaacccccccttctatggagtcatccgctggattggccagcccccaggcctgaatgaggtgctggccggcctggagctggaggatgaatgtgccggctgcacagatggcaccttccggggcacccgctacttcacctgtgccctgaagaaggccctgtttgtgaagctgaagagctgcaggccagacagcagatttgccagcctgcagcctgtgagcaaccagatcgagcgctgcaacagcctggcctttggaggctacctgtctgaggtggtggaggagaacaccccacccaagatggagaaggagggcctggagatcatgattggcaagaagaagggcatccagggccactacaacagctgctacctggacagcaccctcttctgcctgtttgccttcagctctgtgctggacacagtgctgctgcggcccaaggagaagaatgatgtggagtactacagcgagacccaggagctgctgaggacagagatcgtgaaccccctgcgcatctacggctacgtgtgtgccaccaagatcatgaagctgaggaagatcctggagaaggtggaggccgccagcggcttcaccagcgaggagaaggaccctgaggagttcctgaacatcctcttccaccacatcctgcgggtggagcccctgctgaagatccgctctgctggccagaaggtgcaggactgctacttctaccagatcttcatggagaagaatgagaaggtgggcgtgcccaccatccagcagctgctggagtggagcttcatcaacagcaacctgaagtttgctgaggcccccagctgcctgatcatccagatgcccaggtttgggaaggacttcaagctgttcaagaagatcttccccagcctggagctgaacatcacagacctgctggaggacaccccccggcagtgccgcatctgtggcggcctggccatgtatgagtgcagagaatgttatgatgatcctgacatctctgctgggaagatcaagcagttctgcaagacctgcaacacccaggtgcacctgcaccccaagaggctgaaccacaagtacaaccctgtgtccctgcccaaggacctgcctgactgggactggaggcatggctgcatcccctgccagaacatggagctgtttgctgtgctgtgcatcgagaccagccactacgtggcctttgtgaagtatggcaaggatgattctgcctggctgttctttgacagcatggctgacagagatggcggccagaatggcttcaacatcccccaggtgaccccctgcccagaggtgggggagtacctgaagatgagcctggaggacctgcacagcctggacagccgccgcatccagggctgtgcccggcggctgctgtgtgatgcctacatgtgcatgtaccagagccccaccatgagcctgtacaagtag

SEQ ID NO: 19305 - DNA, 450 bp, Artificial Sequence
  Description of Artificial Sequence: Synthetic coding sequence
atggcccggagcaacctgcccctggccctgggcctggccctggtggccttctgcctgctggccctgcccagagatgcccgggcccggccccaggagaggatggtgggggagctgcgggacctgagcccagatgacccccaggtgcagaaggccgcccaggccgctgtggccagctacaacatgggcagcaacagcatctactacttccgggacacccacatcatcaaggcccagagccagctggtggccggcatcaagtacttcctgaccatggagatgggcagcacagactgcaggaagaccagggtgactggagaccacgtggacctgaccacctgccccctggccgccggggcccagcaggagaagctgcgctgtgactttgaggtgctggtggtgccctggcagaacagcagccagctgctgaagcacaactgtgtgcagatgtag

SEQ ID NO: 19306 - DNA, 504 bp, Artificial Sequence
  Description of Artificial Sequence: Synthetic coding sequence
atgctgcctgagaaggccctgcacggccacccccagctgcccaggacagtgcccaccagggctgccatgagagctgctggcaccctgctggccttctgctgcctggtgctgagcaccaccggcggccccagcccagacacctgcagccaggacctgaacagccgggtgaagccaggcttccccaagaccatcaagaccaatgaccccggggtgctgcaggccgcccgctacagcgtggagaagttcaacaactgcaccaatgacatgttcctgttcaaggagagccgcatcacccgggccctggtgcagatcgtgaagggcctgaagtacatgctggaggtggagatcggccgcaccacctgcaagaagaaccagcacctgcggctggatgactgtgacttccagaccaaccacaccctgaagcagaccctgagctgctacagcgaggtgtgggtggtgccctggctgcagcactttgaggtgcctgtgctgcgctgccactag

SEQ ID NO: 19307 - DNA, 438 bp, Artificial Sequence
  Description of Artificial Sequence: Synthetic coding sequence
atgagagctgctggcaccctgctggccttctgctgcctggtgctgagcaccaccggcggccccagcccagacacctgcagccaggacctgaacagccgggtgaagccaggcttccccaagaccatcaagaccaatgaccccggggtgctgcaggccgcccgctacagcgtggagaagttcaacaactgcaccaatgacatgttcctgttcaaggagagccgcatcacccgggccctggtgcagatcgtgaagggcctgaagtacatgctggaggtggagatcggccgcaccacctgcaagaagaaccagcacctgcggctggatgactgtgacttccagaccaaccacaccctgaagcagaccctgagctgctacagcgaggtgtgggtggtgccctggctgcagcactttgaggtgcctgtgctgcgctgccactag

SEQ ID NO: 19308 - DNA, 453 bp, Artificial Sequence
  Description of Artificial Sequence: Synthetic coding sequence
atgctgggcgccgccctgcggcgctgtgctgtggccgccaccaccagggctgacccccggggcctgctgcacagcgcccggaccccaggccctgctgtggccatccagagcgtgcgctgctacagccacggcagccaggagacagatgaggagtttgatgcccgctgggtgacctacttcaacaagccagacattgatgcctgggagctgaggaagggcatcaacaccctggtgacctatgacatggtgcctgagcccaagatcattgatgctgccctgcgggcctgccggcggctgaatgactttgccagcacagtgcgcatcctggaggtggtgaaggacaaggccggcccccacaaggagatctacccctacgtgatccaggagctgcggcccaccctgaatgagctgggcatcagcaccccagaggagctgggcctggacaaggtgtag

SEQ ID NO: 19309 - DNA, 318 bp, Artificial Sequence
  Description of Artificial Sequence: Synthetic coding sequence
atgggagatgtggagaagggcaagaagatcttcatcatgaagtgcagccagtgccacacagtggagaagggcggcaagcacaagacaggccccaacctgcacggcctgtttggaaggaagacaggccaggcccctggctacagctacacagctgccaacaagaacaagggcatcatctggggcgaggacaccctgatggagtacctggagaaccccaagaagtacatccctggcaccaagatgatctttgtgggcatcaagaagaaggaggagagagctgacctgattgcctacctgaagaaggccaccaatgaatag

SEQ ID NO: 19310 - DNA, 318 bp, Artificial Sequence; identical to SEQ ID NO: 19309
  Description of Artificial Sequence: Synthetic coding sequence

SEQ ID NO: 19311 - DNA, 318 bp, Artificial Sequence; identical to SEQ ID NO: 19309
  Description of Artificial Sequence: Synthetic coding sequence

SEQ ID NO: 19312 - DNA, 306 bp, Artificial Sequence
  Description of Artificial Sequence: Synthetic coding sequence
atgggagatgtggagaagggcaagaagatcttcatcatgaagtgcagccagtgccacacagtggagaagggcggcaagcacaagacaggccccaacctgcacggcctgtttggaaggaagacaggccaggcccctggctacagctacacagctgccaacaagaacaagggcatcatctggggcgaggacaccctgatggagtacctggagaaccccaagaagtacatccctggcaccaagatgatctttgtgggcatcaagaagaaggaggagagagctgacctgattgcctacctgaagaagtag

SEQ ID NO: 19313 - DNA, 1632 bp, Artificial Sequence
  Description of Artificial Sequence: Synthetic coding sequence
atgggcaccagcctgagccccaatgacccctggcccctgaaccccctgagcatccagcagaccaccctgctgctgctgctgtctgtgctggccaccgtgcacgtgggccagaggctgctgcggcagaggcggcggcagctgcggagcgcccctcctggcccctttgcctggcccctgattggaaatgctgctgctgtgggccaggccgcccacctgagctttgcccggctggccaggagatatggagatgtgttccagatccggctgggcagctgccccatcgtggtgctgaatggagagcgggccatccaccaggccctggtgcagcagggcagcgcctttgctgacaggcctgcctttgccagcttccgggtggtgtctgggggccgctccatggccttcggccactacagcgagcactggaaggtgcagaggagagctgcccacagcatgatgaggaacttcttcacccggcagcccaggagccggcaggtgctggagggccacgtgctgtctgaggcccgggagctggtggccctgctggtgcggggcagcgcagatggagccttcctggacccccggcccctgactgtggtggccgtggccaacgtgatgtctgctgtgtgcttcggctgccgctacagccatgatgatcctgagttccgggagctgctgagccacaatgaggagtttggaagaacagtgggcgccggcagcctggtggatgtgatgccctggctgcagtacttccccaaccctgtgaggacagtgttccgggagtttgagcagctgaacagaaacttcagcaacttcatcctggacaagttcctgcggcactgtgagagcctgcggcctggagctgccccccgggacatgatggatgccttcatcctgtctgctgagaagaaggctgctggggacagccatggaggaggagcccggctggacctggagaatgtgcctgccaccatcacagacatctttggagccagccaggacaccctgagcacagccctgcagtggctgctgctgctcttcacccgctacccagatgtgcagaccagggtgcaggccgagctggaccaggtggtgggccgggaccggctgccctgcatgggagaccagcccaacctgccctacgtgctggccttcctgtatgaggccatgaggttcagcagctttgtgcctgtgaccatcccccacgccaccacagccaacacctctgtgctgggctaccacatccccaaggacacagtggtgtttgtgaaccagtggagcgtgaaccacgaccctgtgaagtggcccaaccctgagaactttgatcctgcccgcttcctggacaaggatggcctcatcaacaaggacctgaccagccgggtgatgatcttctctgtgggcaagaggcgctgcattggagaggagctgagcaagatgcagctgttcctgttcatcagcatcctggcccaccagtgtgacttccgggccaaccccaatgagcccgccaagatgaacttctcctatggcctgaccatcaagcccaagagcttcaaggtgaatgtgaccctgcgggagagcatggagctgctggacagcgctgtgcagaacctgcaggccaaggagacctgccagtag

SEQ ID NO: 19314 - DNA, 1632 bp, Artificial Sequence; identical to SEQ ID NO: 19313
  Description of Artificial Sequence: Synthetic coding sequence

SEQ ID NO: 19315 - DNA, 3399 bp, Artificial Sequence
  Description of Artificial Sequence: Synthetic coding sequence
atggagccagacagcctgctggaccaggatgacagctatgagagcccccaggagcggcccggcagcagaagaagcctgcccggcagcctgtctgagaagagccccagcatggagcccagcgctgccacccccttccgggtgacaggcttcctgagccggcggctgaagggcagcatcaagaggaccaagagccagcccaagctggacaggaaccacagcttccgccacatcctgcccggcttccgctctgctgctgctgctgctgctgacaatgaaagaagccacctgatgccccggctgaaggagagccgcagccatgagagcctgctgagccccagcagcgctgtggaggccctggacctgtccatggaggaggaggtggtgatcaagcctgtgcacagcagcatcctgggccaggactactgctttgaggtgaccaccagcagcggcagcaagtgcttcagctgccgctctgctgctgagcgggacaagtggatggagaacctgcggcgggctgtgcaccccaacaaggacaacagcagaagagtggagcacatcctgaagctgtgggtgattgaggccaaggacctgcctgccaagaagaagtacctgtgtgagctgtgcctggatgatgtgctgtatgcccggaccaccgggaagctgaagacagacaacgtgttctggggcgagcactttgagttccacaacctgccccccctgaggacagtgacagtgcacctgtaccgggagacagacaagaagaagaagaaggagagaaattcctacctgggcctggtgtccctgcctgctgcctctgtggccggccggcagtttgtggagaagtggtaccctgtggtgacccccaaccccaagggcggcaagggccctggccccatgatccgcatcaaggcccgctaccagaccatcaccatcctgcccatggagatgtacaaggagtttgctgagcacatcaccaaccactacctgggcctgtgtgccgccctggagcccatcctgagcgccaagaccaaggaggagatggccagcgccctggtgcacatcctgcagagcacaggcaaggtgaaggacttcctgacagacctgatgatgtctgaggtggacagatgtggggacaatgagcacctgatcttccgggagaacaccctggccaccaaggccatcgaggagtacctgaagctggtgggccagaagtacctgcaggatgccctgggggagttcatcaaggccctgtatgaaagtgatgagaactgtgaggtggaccccagcaagtgcagcgctgctgacctgcctgagcaccagggcaacctgaagatgtgctgtgagctggccttctgcaagatcatcaacagctactgtgtgttcccccgggagctgaaggaggtgtttgcctcctggaggcaggagtgcagcagccggggccgcccagacatcagcgagcggctcatcagcgccagcctcttcctgcgcttcctgtgcccagccatcatgagccccagcctcttcaacctgctgcaggagtacccagatgacagaacagcccggaccctgaccctcatcgccaaggtgacccagaacctggccaactttgccaagtttggcagcaaggaggagtacatgtccttcatgaaccagttcctggagcacgagtggaccaacatgcagcgcttcctgctggagatcagcaaccctgagaccctgagcaacacagctggctttgagggctacatcgacctgggccgggagctgagcagcctgcacagcctgctgtgggaggccgtgtcccagctggagcagagcatcgtgtccaagctgggccccctgccccgcatcctgagagatgtgcacacagccctgagcaccccaggcagcggccagctgcccggcaccaatgacctggccagcaccccaggcagcggcagcagcagcatctctgctggcctgcagaagatggtgattgaaaatgacctgagcggcctgattgacttcacccggctgcccagccccaccccagagaacaaggacctcttctttgtgaccaggagcagtggagtgcagcccagccctgcccggagcagcagctacagcgaggccaatgaaccagacctgcagatggccaatggaggcaagagcctgtccatggtggacctgcaggatgcccggaccctggatggagaggccggcagccctgctggcccagatgtgctgcccacagatggccaggccgccgccgcccagctggtggccggctggccagcccgggccacccctgtgaacctggccggcctggccaccgtgagaagagctggccagacccccaccaccccaggcaccagcgagggcgcccctggccggccccagctgctggcccccctgtccttccagaaccctgtgtaccagatggctgctggcctgcccctgagcccccggggcctgggggacagcggcagcgagggccacagcagcctgagcagccacagcaacagcgaggagctggccgctgctgccaagctgggcagcttcagcacagctgctgaggagctggcccggcggcctggagagctggcccggcggcagatgagcctgacagagaagggcggccagcccaccgtgccccggcagaacagcgctggcccccagaggagaattgaccagcccccacctcctcctcctcctcctcctccagccccccggggccgcaccccacccaacctgctgagcaccctgcagtacccccggcccagcagcggcaccctggccagcgccagcccagactgggtgggccccagcacccggctgcggcagcagagcagcagcagcaaaggagacagccctgagctgaagcccagggctgtgcacaagcagggccccagccctgtgagccccaatgccctggacagaacagctgcctggctgctgaccatgaatgcccagctgctggaggatgagggcctgggccctgaccccccccaccgggaccggctgcggagcaaggatgagctgagccaggccgagaaggacctggccgtgctgcaggacaagctgcgcatcagcaccaagaagctggaggagtatgagaccctcttcaagtgccaggaggagaccacccagaagctggtgctggagtaccaggcccggctggaggagggggaggagcggctgcggcggcagcaggaggacaaggacatccagatgaagggcatcatcagccggctgatgtctgtggaggaggagctgaagaaggaccacgccgagatgcaggccgctgtggacagcaagcagaagatcattgatgcccaggagaagagaattgccagcctggatgctgccaatgcccggctgatgtctgccctgacccagctgaaggagagcatgcactag

SEQ ID NO: 19316 - DNA, 3198 bp, Artificial Sequence
  Description of Artificial Sequence: Synthetic coding sequence
atgccccggctgaaggagagccgcagccatgagagcctgctgagccccagcagcgctgtggaggccctggacctgtccatggaggaggaggtggtgatcaagcctgtgcacagcagcatcctgggccaggactactgctttgaggtgaccaccagcagcggcagcaagtgcttcagctgccgctctgctgctgagcgggacaagtggatggagaacctgcggcgggctgtgcaccccaacaaggacaacagcagaagagtggagcacatcctgaagctgtgggtgattgaggccaaggacctgcctgccaagaagaagtacctgtgtgagctgtgcctggatgatgtgctgtatgcccggaccaccgggaagctgaagacagacaacgtgttctggggcgagcactttgagttccacaacctgccccccctgaggacagtgacagtgcacctgtaccgggagacagacaagaagaagaagaaggagagaaattcctacctgggcctggtgtccctgcctgctgcctctgtggccggccggcagtttgtggagaagtggtaccctgtggtgacccccaaccccaagggcggcaagggccctggccccatgatccgcatcaaggcccgctaccagaccatcaccatcctgcccatggagatgtacaaggagtttgctgagcacatcaccaaccactacctgggcctgtgtgccgccctggagcccatcctgagcgccaagaccaaggaggagatggccagcgccctggtgcacatcctgcagagcacaggcaaggtgaaggacttcctgacagacctgatgatgtctgaggtggacagatgtggggacaatgagcacctgatcttccgggagaacaccctggccaccaaggccatcgaggagtacctgaagctggtgggccagaagtacctgcaggatgccctgggggagttcatcaaggccctgtatgaaagtgatgagaactgtgaggtggaccccagcaagtgcagcgctgctgacctgcctgagcaccagggcaacctgaagatgtgctgtgagctggccttctgcaagatcatcaacagctactgtgtgttcccccgggagctgaaggaggtgtttgcctcctggaggcaggagtgcagcagccggggccgcccagacatcagcgagcggctcatcagcgccagcctcttcctgcgcttcctgtgcccagccatcatgagccccagcctcttcaacctgctgcaggagtacccagatgacagaacagcccggaccctgaccctcatcgccaaggtgacccagaacctggccaactttgccaagtttggcagcaaggaggagtacatgtccttcatgaaccagttcctggagcacgagtggaccaacatgcagcgcttcctgctggagatcagcaaccctgagaccctgagcaacacagctggctttgagggctacatcgacctgggccgggagctgagcagcctgcacagcctgctgtgggaggccgtgtcccagctggagcagagcatcgtgtccaagctgggccccctgccccgcatcctgagagatgtgcacacagccctgagcaccccaggcagcggccagctgcccggcaccaatgacctggccagcaccccaggcagcggcagcagcagcatctctgctggcctgcagaagatggtgattgaaaatgacctgagcggcctgattgacttcacccggctgcccagccccaccccagagaacaaggacctcttctttgtgaccaggagcagtggagtgcagcccagccctgcccggagcagcagctacagcgaggccaatgaaccagacctgcagatggccaatggaggcaagagcctgtccatggtggacctgcaggatgcccggaccctggatggagaggccggcagccctgctggcccagatgtgctgcccacagatggccaggccgccgccgcccagctggtggccggctggccagcccgggccacccctgtgaacctggccggcctggccaccgtgagaagagctggccagacccccaccaccccaggcaccagcgagggcgcccctggccggccccagctgctggcccccctgtccttccagaaccctgtgtaccagatggctgctggcctgcccctgagcccccggggcctgggggacagcggcagcgagggccacagcagcctgagcagccacagcaacagcgaggagctggccgctgctgccaagctgggcagcttcagcacagctgctgaggagctggcccggcggcctggagagctggcccggcggcagatgagcctgacagagaagggcggccagcccaccgtgccccggcagaacagcgctggcccccagaggagaattgaccagcccccacctcctcctcctcctcctcctccagccccccggggccgcaccccacccaacctgctgagcaccctgcagtacccccggcccagcagcggcaccctggccagcgccagcccagactgggtgggccccagcacccggctgcggcagcagagcagcagcagcaaaggagacagccctgagctgaagcccagggctgtgcacaagcagggccccagccctgtgagccccaatgccctggacagaacagctgcctggctgctgaccatgaatgcccagctgctggaggatgagggcctgggccctgaccccccccaccgggaccggctgcggagcaaggatgagctgagccaggccgagaaggacctggccgtgctgcaggacaagctgcgcatcagcaccaagaagctggaggagtatgagaccctcttcaagtgccaggaggagaccacccagaagctggtgctggagtaccaggcccggctggaggagggggaggagcggctgcggcggcagcaggaggacaaggacatccagatgaagggcatcatcagccggctgatgtctgtggaggaggagctgaagaaggaccacgccgagatgcaggccgctgtggacagcaagcagaagatcattgatgcccaggagaagagaattgccagcctggatgctgccaatgcccggctgatgtctgccctgacccagctgaaggagcgctacagcatgcaggccagaaatggcatcagccccaccaaccccaccaagctgcagatcacagaaaatggagagttcaggaacagcagcaactgctag

SEQ ID NO: 19317 - DNA, 3210 bp, Artificial Sequence
  Description of Artificial Sequence: Synthetic coding sequence
agccagcccaagctggacaggaaccacagcttccgccacatcctgcccggcttccgctctgctgctgctgctgctgctgacaatgaaagaagccacctgatgccccggctgaaggagagccgcagccatgagagcctgctgagccccagcagcgctgtggaggccctggacctgtccatggaggaggaggtggtgatcaagcctgtgcacagcagcatcctgggccaggactactgctttgaggtgaccaccagcagcggcagcaagtgcttcagctgccgctctgctgctgagcgggacaagtggatggagaacctgcggcgggctgtgcaccccaacaaggacaacagccggcgggtggagcacatcctgaagctgtgggtgattgaggccaaggacctgcctgccaagaagaagtacctgtgtgagctgtgcctggatgatgtgctgtatgcccggaccaccgggaagctgaagacagacaacgtgttctggggcgagcactttgagttccacaacctgccccccctgaggacagtgacagtgcacctgtaccgggagacagacaagaagaagaagaaggagaggaacagctacctgggcctggtgtccctgcctgctgcctctgtggccggccggcagtttgtggagaagtggtaccctgtggtgacccccaaccccaagggcggcaaaggacctggccccatgatccgcatcaaggcccgctaccagaccatcaccatcctgcccatggagatgtacaaggagtttgctgagcacatcaccaaccactacctgggcctgtgtgccgccctggagcccatcctgagcgccaagaccaaggaggagatggccagcgccctggtgcacatcctgcagagcacaggcaaggtgaaggacttcctgacagacctgatgatgtctgaggtggacagatgtggggacaatgagcacctgatcttccgggagaacaccctggccaccaaggccatcgaggagtacctgaagctggtgggccagaagtacctgcaggatgccctgggggagttcatcaaggccctgtatgaaagtgatgagaactgtgaggtggaccccagcaaatgttctgctgctgacctgcctgagcaccagggcaacctgaagatgtgctgtgagctggccttctgcaagatcatcaacagctactgtgtgttcccccgggagctgaaggaggtgtttgcctcctggaggcaggagtgcagcagccggggccgcccagacatcagcgagcggctcatcagcgccagcctcttcctgcgcttcctgtgcccagccatcatgagccccagcctcttcaacctgctgcaggagtacccagatgacagaacagcccggaccctgaccctgattgccaaggtgacccagaacctggccaactttgccaagtttggcagcaaggaggagtacatgtccttcatgaaccagttcctggagcacgagtggaccaacatgcagcgcttcctgctggagatcagcaaccctgagaccctgagcaacacagctggctttgagggctacatcgacctgggccgggagctgagcagcctgcacagcctgctgtgggaggccgtgtcccagctggagcagagcatcgtgtccaagctgggccccctgccccgcatcctgagagatgtgcacacagccctgagcaccccaggcagcggccagctgcccggcaccaatgacctggccagcaccccaggcagcggcagcagcagcatctctgctggcctgcagaagatggtgattgaaaatgacctgagcggcctgattgacttcacccggctgcccagccccaccccagagaacaaggacctcttctttgtgaccaggagcagcggcgtgcagcccagccctgcccggagcagcagctacagcgaggccaatgaaccagacctgcagatggccaacggcggcaagagcctgtccatggtggacctgcaggatgcccggaccctggatggagaggccggcagccctgctggcccagatgtgctgcccacagatggccaggccgctgctgcccagctggtggccggctggccagcccgggccacccctgtgaacctggccggcctggccaccgtgcggcgggccggccagacccccaccaccccaggcaccagcgagggcgcccctggccggccccagctgctggcccccctgtccttccagaaccctgtgtaccagatggccgccggcctgcccctgagcccccggggcctgggggacagcggcagcgagggccacagcagcctgagcagccacagcaacagcgaggagctggccgccgccgccaagctgggcagcttcagcacagctgctgaggagctggcccggcggcctggagagctggcccggcggcagatgagcctgacagagaagggcggccagcccaccgtgccccggcagaacagcgctggcccccagaggagaattgaccagcccccacctcctcctcctcctcctcctccagccccccggggccgcaccccacccaacctgctgagcaccctgcagtacccccggcccagcagcggcaccctggccagcgccagcccagactgggtgggccccagcacccggctgcggcagcagagcagcagcagcaagggggacagccctgagctgaagcccagggctgtgcacaagcagggccccagccctgtgagccccaatgccctggacagaacagctgcctggctgctgaccatgaatgcccagctgctggaggatgagggcctgggccctgaccccccccaccgggaccggctgcggagcaaggatgagctgagccaggccgagaaggacctggccgtgctgcaggacaagctgcgcatcagcaccaagaagctggaggagtatgagaccctcttcaagtgccaggaggagaccacccagaagctggtgctggagtaccaggcccggctggaggagggggaggagcggctgcggcggcagcaggaggacaaggacatccagatgaagggcatcatcagccggctgatgtctgtggaggaggagctgaagaaggaccatgctgagatgcaggccgctgtggacagcaagcagaagatcattgatgcccaggagaagagaattgccagcctggatgctgccaatgcccggctgatgtctgccctgacccagctgaaggagagcatgcactag

SEQ ID NO: 19318 - DNA, 876 bp, Artificial Sequence
  Description of Artificial Sequence: Synthetic coding sequence
atggagccagacagcctgctggaccaggatgacagctatgagagcccccaggagcggcccggcagcagaagaagcctgcccggcagcctgtctgagaagagccccagcatggagcccagcgctgccacccccttccgggtgacaggcttcctgagccggcggctgaagggcagcatcaagaggaccaagagccagcccaagctggacaggaaccacagcttccgccacatcctgcccggcttccgctctgctgctgctgctgctgctgacaatgaaagaagccacctgatgccccggctgaaggagagccgcagccatgagagcctgctgagccccagcagcgctgtggaggccctggacctgtccatggaggaggaggtggtgatcaagcctgtgcacagcagcatcctgggccaggactactgctttgaggtgaccaccagcagcggcagcaagtgcttcagctgccgctctgctgctgagcgggacaagtggatggagaacctgcggcgggctgtgcaccccaacaaggacaacagcagaagagtggagcacatcctgaagctgtgggtgattgaggccaaggacctgcctgccaagaagaagtacctgtgtgagctgtgcctggatgatgtgctgtatgcccggaccaccgggaagctgaagacagacaacgtgttctggggcgagcactttgagttccacaacctgccccccctgaggacagtgacagtgcacctgtaccgggagacagacaagaagaagaagaaggagagaaattcctacctgggcctggtgtccctgcctgctgcctctgtggccggccggcagtttgtggagaagtggtaccctgtggtgacccccaaccccaagtag

SEQ ID NO: 19319 - DNA, 3570 bp, Artificial Sequence
  Description of Artificial Sequence: Synthetic coding sequence
atgtctgctgggggcagcgccaggaagagcacaggccgcagcagctactactaccgcctgctgcggcggccccggctgcagaggcagaggagccgcagccgcagcaggaccaggcctgcccgggagagcccccaggagcggcccggcagcagaagaagcctgcccggcagcctgtctgagaagagccccagcatggagcccagcgctgccacccccttccgggtgacaggcttcctgagccggcggctgaagggcagcatcaagaggaccaagagccagcccaagctggacaggaaccacagcttccgccacatcctgcccggcttccgctctgctgctgctgctgctgctgacaatgaaagaagccacctgatgccccggctgaaggagagccgcagccatgagagcctgctgagccccagcagcgctgtggaggccctggacctgtccatggaggaggaggtggtgatcaagcctgtgcacagcagcatcctgggccaggactactgctttgaggtgaccaccagcagcggcagcaagtgcttcagctgccgctctgctgctgagcgggacaagtggatggagaacctgcggcgggctgtgcaccccaacaaggacaacagcagaagagtggagcacatcctgaagctgtgggtgattgaggccaaggacctgcctgccaagaagaagtacctgtgtgagctgtgcctggatgatgtgctgtatgcccggaccaccgggaagctgaagacagacaacgtgttctggggcgagcactttgagttccacaacctgccccccctgaggacagtgacagtgcacctgtaccgggagacagacaagaagaagaagaaggagagaaattcctacctgggcctggtgtccctgcctgctgcctctgtggccggccggcagtttgtggagaagtggtaccctgtggtgacccccaaccccaagggcggcaagggccctggccccatgatccgcatcaaggcccgctaccagaccatcaccatcctgcccatggagatgtacaaggagtttgctgagcacatcaccaaccactacctgggcctgtgtgccgccctggagcccatcctgagcgccaagaccaaggaggagatggccagcgccctggtgcacatcctgcagagcacaggcaaggtgaaggacttcctgacagacctgatgatgtctgaggtggacagatgtggggacaatgagcacctgatcttccgggagaacaccctggccaccaaggccatcgaggagtacctgaagctggtgggccagaagtacctgcaggatgccctgggggagttcatcaaggccctgtatgaaagtgatgagaactgtgaggtggaccccagcaagtgcagcgctgctgacctgcctgagcaccagggcaacctgaagatgtgctgtgagctggccttctgcaagatcatcaacagctactgtgtgttcccccgggagctgaaggaggtgtttgcctcctggaggcaggagtgcagcagccggggccgcccagacatcagcgagcggctcatcagcgccagcctcttcctgcgcttcctgtgcccagccatcatgagccccagcctcttcaacctgctgcaggagtacccagatgacagaacagcccggaccctgaccctcatcgccaaggtgacccagaacctggccaactttgccaagtttggcagcaaggaggagtacatgtccttcatgaaccagttcctggagcacgagtggaccaacatgcagcgcttcctgctggagatcagcaaccctgagaccctgagcaacacagctggctttgagggctacatcgacctgggccgggagctgagcagcctgcacagcctgctgtgggaggccgtgtcccagctggagcagagcatcgtgtccaagctgggccccctgccccgcatcctgagagatgtgcacacagccctgagcaccccaggcagcggccagctgcccggcaccaatgacctggccagcaccccaggcagcggcagcagcagcatctctgctggcctgcagaagatggtgattgaaaatgacctgagcggcctgattgacttcacccggctgcccagccccaccccagagaacaaggacctcttctttgtgaccaggagcagtggagtgcagcccagccctgcccggagcagcagctacagcgaggccaatgaaccagacctgcagatggccaatggaggcaagagcctgtccatggtggacctgcaggatgcccggaccctggatggagaggccggcagccctgctggcccagatgtgctgcccacagatggccaggccgccgccgcccagctggtggccggctggccagcccgggccacccctgtgaacctggccggcctggccaccgtgagaagagctggccagacccccaccaccccaggcaccagcgagggcgcccctggccggccccagctgctggcccccctgtccttccagaaccctgtgtaccagatggctgctggcctgcccctgagcccccggggcctgggggacagcggcagcgagggccacagcagcctgagcagccacagcaacagcgaggagctggccgctgctgccaagctgggcagcttcagcacagctgctgaggagctggcccggcggcctggagagctggcccggcggcagatgagcctgacagagaagggcggccagcccaccgtgccccggcagaacagcgctggcccccagaggagaattgaccagcccccacctcctcctcctcctcctcctccagccccccggggccgcaccccacccaacctgctgagcaccctgcagtacccccggcccagcagcggcaccctggccagcgccagcccagactgggtgggccccagcacccggctgcggcagcagagcagcagcagcaaaggagacagccctgagctgaagcccagggctgtgcacaagcagggccccagccctgtgagccccaatgccctggacagaacagctgcctggctgctgaccatgaatgcccagctgctggaggatgagggcctgggccctgaccccccccaccgggaccggctgcggagcaaggatgagctgagccaggccgagaaggacctggccgtgctgcaggacaagctgcgcatcagcaccaagaagctggaggagtatgagaccctcttcaagtgccaggaggagaccacccagaagctggtgctggagtaccaggcccggctggaggagggggaggagcggctgcggcggcagcaggaggacaaggacatccagatgaagggcatcatcagccggctgatgtctgtggaggaggagctgaagaaggaccacgccgagatgcaggccgctgtggacagcaagcagaagatcattgatgcccaggagaagagaattgccagcctggatgctgccaatgcccggctgatgtctgccctgacccagctgaaggagcgctacagcatgcaggccagaaatggcatcagccccaccaaccccaccaagctgcagatcacagaaaatggagagttcaggaacagcagcaactgctag

SEQ ID NO: 19320 - DNA, 690 bp, Artificial Sequence
  Description of Artificial Sequence: Synthetic coding sequence
atgccccggctgaaggagagccgcagccatgagagcctgctgagccccagcagcgctgtggaggccctggacctgtccatggaggaggaggtggtgatcaagcctgtgcacagcagcatcctgggccaggactactgctttgaggtgaccaccagcagcggcagcaagtgcttcagctgccgctctgctgctgagcgggacaagtggatggagaacctgcggcgggctgtgcaccccaacaaggacaacagcagaagagtggagcacatcctgaagctgtgggtgattgaggccaaggacctgcctgccaagaagaagtacctgtgtgagctgtgcctggatgatgtgctgtatgcccggaccaccgggaagctgaagacagacaacgtgttctggggcgagcactttgagttccacaacctgccccccctgaggacagtgacagtgcacctgtaccgggagacagacaagaagaagaagaaggagagaaattcctacctgggcctggtgtccctgcctgctgcctctgtggccggccggcagtttgtggagaagtggtaccctgtggtgacccccaaccccaagggcggcaagggccctggccccatgatccgcatcaaggcccgctaccagaccatcaccatcctgcccatggagatgtacaaggagtttgctgagcacatcacctag

SEQ ID NO: 19321 - DNA, 3423 bp, Artificial Sequence
  Description of Artificial Sequence: Synthetic coding sequence
atgagctacaactacgtggtgacagcccagaagcccacagctgtgaatggctgtgtgacaggccacttcaccagcgctgaggacctgaacctgctgattgccaagaacacccggctggagatctacgtggtgacagctgagggcctgcggcctgtgaaggaggtgggcatgtatggcaagattgctgtgatggagctgttccggcccaagggggagagcaaggacctgctcttcatcctgacagccaagtacaatgcctgcatcctggagtacaagcagagcggggagagcattgacatcatcacccgggcccatggaaatgtgcaggaccgcatcggccggcccagcgagaccggcatcatcggcatcatcgaccctgaatgtaggatgattggcctgcggctgtatgatggcctcttcaaggtgatccccctggaccgggacaacaaggagctgaaggccttcaacatccggctggaggagctgcacgtgattgatgtgaagttcctgtatggctgccaggcccccaccatctgctttgtgtaccaggacccccagggcagacatgtgaagacctatgaggtgtccctgcgggagaaggagttcaacaagggcccctggaagcaggagaatgtggaggccgaggcctccatggtgattgctgtgcctgagccctttggaggagccatcatcatcggccaggagagcatcacctaccacaatggagacaagtacctggccatcgccccacccatcatcaagcagagcaccatcgtgtgccacaacagagtggaccccaacggcagccgctacctgctgggggacatggagggccgcctcttcatgctgctgctggagaaggaggagcagatggatggcaccgtgaccctgaaggacctgcgggtggagctgctgggggagaccagcattgctgagtgcctgacctacctggacaatggagtggtgtttgtgggcagccggctgggggacagccagctggtgaagctgaatgtggacagcaatgagcagggcagctatgtggtggccatggagaccttcaccaacctgggccccatcgtggacatgtgtgtggtggacctggagcggcagggccagggccagctggtgacctgcagcggggccttcaaggagggcagcctgcgcatcatcagaaatggcatcggcatccatgaacatgccagcattgacctgcccggcatcaagggcctgtggcccctgcggagtgaccccaaccgggagacagatgacaccctggtgctgagctttgtgggccagaccagggtgctgatgctgaatggagaggaggtggaggagacagagctgatgggctttgtggatgaccagcagaccttcttctgtggaaatgtggcccaccagcagctgatccagatcaccagcgcctctgtgcggctggtgtcccaggagcccaaggccctggtgtctgagtggaaggagccccaggccaagaacatctctgtggccagctgcaacagcagccaggtggtggtggccgtgggccgggccctgtactacctgcagatccacccccaggagctgcggcagatcagccacacagagatggagcacgaggtggcctgcctggacatcacccccctgggggacagcaatggcctgagccccctgtgtgccatcggcctgtggacagacatcagcgcccgcatcctgaagctgcccagctttgagctgctgcacaaggagatgctgggcggggagatcatccccaggagcatcctgatgaccacctttgagagcagccactacctgctgtgtgccctgggagatggagccctcttctacttcggcctgaacatcgagaccggcctgctgagtgacaggaagaaggtgaccctgggcacccagcccaccgtgctgcggaccttccgcagcctgagcaccaccaacgtgtttgcctgcagcgaccggcccaccgtcatctacagcagcaaccacaagctggtgttcagcaatgtgaacctgaaggaggtgaactacatgtgccccctgaacagtgatggctacccagacagcctggccctggccaacaacagcaccctgaccatcggcaccattgatgagatccagaagctgcacatcagaacagtgcccctgtatgagagccccaggaagatctgctaccaggaggtgtcccagtgctttggagtgctgagcagccgcatcgaggtgcaggacaccagcggcggcaccacagccctgcggcccagcgccagcacccaggccctgagcagctctgtgagcagcagcaagctgttcagcagcagcacagcccctcatgagaccagctttggagaggaggtggaggtgcacaacctgctgatcatcgaccagcacacctttgaggtgctgcacgcccaccagttcctgcagaatgaatatgccctgagcctggtgtcctgcaagctgggcaaggaccccaacacctacttcatcgtgggcacagccatggtgtacccagaggaggccgagcccaagcagggccgcatcgtggtgttccagtacagtgatggcaagctgcagacagtggccgagaaggaggtgaagggagctgtgtacagcatggtggagttcaacgggaagctgctggccagcatcaacagcacagtgcggctgtatgagtggaccacagagaaggagctgaggacagagtgcaaccactacaacaacatcatggccctgtacctgaagaccaagggggacttcatcctggtgggggacctgatgaggtctgtgctgctgctggcctacaagcccatggagggcaactttgaggagatcgcccgggacttcaaccccaactggatgtctgctgtggagatcctggatgatgacaacttcctgggcgcagaaaatgccttcaacctgtttgtgtgccagaaggacagcgctgccaccacagatgaggagcggcagcacctgcaggaggtgggcctcttccacctgggggagtttgtgaatgtgttctgccacggcagcctggtgatgcagaacctgggggagaccagcacccccacccagggctctgtgctgtttggcaccgtgaatggcatgattggcctggtgaccagcctgtctgagagctggtacaacctgctgctggacatgcagaaccggctgaacaaggtgatcaagtctgtgggcaagattgagcacagcttctggaggagcttccacacagagaggaagacagagcccgccaccggcttcattgatggagacctgattgagagcttcctggacatcagccggcccaagatgcaggaggtggtggccaacctgcagtatgatgatggcagcggcatgaagcgggaggccacagcagatgacctgatcaaggtggtggaggagctgacccgcatccactag

SEQ ID NO: 19322 - DNA, 1356 bp, Artificial Sequence
  Description of Artificial Sequence: Synthetic coding sequence
atgagctacaactacgtggtgacagcccagaagcccacagctgtgaatggctgtgtgacaggccacttcaccagcgctgaggacctgaacctgctgattgccaagaacacccggctggagatctacgtggtgacagctgagggcctgcggcctgtgaaggaggtgggcatgtatggcaagattgctgtgatggagctgttccggcccaaggccctgagcagctctgtgagcagcagcaagctgttcagcagcagcacagcccctcatgagaccagctttggagaggaggtggaggtgcacaacctgctgatcatcgaccagcacacctttgaggtgctgcacgcccaccagttcctgcagaatgaatatgccctgagcctggtgtcctgcaagctgggcaaggaccccaacacctacttcatcgtgggcacagccatggtgtacccagaggaggccgagcccaagcagggcagaattgtggtgttccagtacagtgatggcaagctgcagacagtggccgagaaggaggtgaagggagctgtgtacagcatggtggagttcaacgggaagctgctggccagcatcaacagcacagtgcggctgtatgagtggaccacagagaaggagctgaggacagagtgcaaccactacaacaacatcatggccctgtacctgaagaccaagggggacttcatcctggtgggggacctgatgaggtctgtgctgctgctggcctacaagcccatggagggcaactttgaggagatcgcccgggacttcaaccccaactggatgtctgctgtggagatcctggatgatgacaacttcctgggcgcagaaaatgccttcaacctgtttgtgtgccagaaggacagcgctgccaccacagatgaggagcggcagcacctgcaggaggtgggcctcttccacctgggggagtttgtgaatgtgttctgccacggcagcctggtgatgcagaacctgggggagaccagcacccccacccagggctctgtgctgtttggaacagtgaatggcatgattggcctggtgaccagcctgtctgagagctggtacaacctgctgctggacatgcagaaccggctgaacaaggtgatcaagtctgtgggcaagattgagcacagcttctggaggagcttccacacagagaggaagacagagcccgccaccggcttcattgatggagacctgattgagagcttcctggacatcagccggcccaagatgcaggaggtggtggccaacctgcagtatgatgatggcagcggcatgaagcgggaggccacagcagatgacctgatcaaggtggtggaggagctgacccgcatccactag

SEQ ID NO: 19323 - DNA, 441 bp, Artificial Sequence
  Description of Artificial Sequence: Synthetic coding sequence
atgagctacaactacgtggtgacagcccagaagcccacagctgtgaatggctgtgtgacaggccacttcaccagcgctgaggacctgaacctgctgattgccaagaacacccggctggagatctacgtggtgacagctgagggcctgcggcctgtgaaggaggtgggcatgtatggcaagattgctgtgatggagctgttccggcccaagggggagagcaaggacctgctcttcatcctgacagccaagtacaatgcctgcatcctggagtacaagcagagcggggagagcattgacatcatcacccgggcccatggaaatgtgcaggaccgcatcggccggcccagcgagaccggcatcatcggcatcatcgaccctgaatgtaggatgattggcctgcggctgtatgatggcctcttcaaggtgatccccctggactag

SEQ ID NO: 19324 - DNA, 330 bp, Artificial Sequence
  Description of Artificial Sequence: Synthetic coding sequence
atgagctacaactacgtggtgacagcccagaagcccacagctgtgaatggctgtgtgacaggccacttcaccagcgctgaggacctgaacctgctgattgccaagaacacccggctggagatctacgtggtgacagctgagggcctgcggcctgtgaaggaggtgggcatgtatggcaagattgctgtgatggagctgttccggcccaagggggagagcaaggacctgctcttcatcctgacagccaagtacaatgcctgcatcctggagtacaagcagagcggggagagcattgacatcatcacccgggcccatggaaatgtgcagtag

SEQ ID NO: 19325 - DNA, 1284 bp, Artificial Sequence
  Description of Artificial Sequence: Synthetic coding sequence
atggcccccaagaagaggcctgagacccagaagaccagcgagatcgtgctgcggcccaggaacaagaggagccgcagccccctggagctggagcctgaggccaagaagctgtgtgccaagggcagcggccccagccgccgctgtgacagcgactgcctgtgggtgggcctggccggcccccagatcctgcccccctgccgcagcatcgtgaggaccctgcaccagcacaagctgggccgggcctcctggcccagcgtgcagcagggcctgcagcagagcttcctgcacaccctggacagctaccgcatcctgcagaaggccgccccctttgaccggcgggccaccagcctggcctggcaccccacccaccccagcacagtggccgtgggcagcaagggcggggacatcatgctgtggaactttggcatcaaggacaagcccaccttcatcaagggcattggagctgggggcagcatcaccggcctgaagttcaaccccctgaacaccaaccagttctacgccagctccatggagggcaccacccggctgcaggacttcaagggcaacatcctgcgggtgtttgccagcagtgacaccatcaacatctggttctgcagcctggatgtgtctgccagcagcaggatggtggtgactggagacaacgtgggcaatgtcatcctgctgaacatggatggcaaggagctgtggaacctgaggatgcacaagaagaaggtgacccacgtggccctgaacccctgctgtgactggttcctggccacagcctctgtggaccagacagtgaagatctgggacctgcggcaggtgcggggcaaggccagcttcctgtacagcctgccccaccgccaccctgtgaatgctgcctgcttctccccagatggagcccggctgctgaccacagaccagaagtctgagatccgggtgtacagcgccagccagtgggactgccccctgggcctcatcccccacccccaccgccacttccagcacctgacccccatcaaggccgcctggcacccccgctacaacctgattgtggtgggccgctacccagaccccaacttcaagagctgcaccccctatgagctgcggaccattgatgtgtttgatggcaacagcggcaagatgatgtgccagctgtatgaccctgagagcagcggcatcagcagcctgaatgagttcaaccccatgggagacaccctggccagcgccatgggctaccacatcctgatctggagccaggaggaggcccggaccaggaagtag

SEQ ID NO: 19326 - DNA, 717 bp, Artificial Sequence
  Description of Artificial Sequence: Synthetic coding sequence
atggcccccaagaagaggcctgagacccagaagaccagcgagatcgtgctgcggcccaggaacaagaggagccgcagccccctggagctggagcctgaggccaagaagctgtgtgccaagggcagcggccccagccgccgctgtgacagcgactgcctgtgggtgggcctggccggcccccagatcctgcccccctgccgcagcatcgtgaggaccctgcaccagcacaagctgggccgggcctcctggcccagcgtgcagcagggcctgcagcagagcttcctgcacaccctggacagctaccgcatcctgcagaaggccgccccctttgaccggcgggccaccagcctggcctggcaccccacccaccccagcacagtggccgtgggcagcaagggcggggacatcatgctgtggaactttggcatcaaggacaagcccaccttcatcaagggagctgcctggcacccccgctacaacctgattgtggtgggccgctacccagaccccaacttcaagagctgcaccccctatgagctgcggaccattgatgtgtttgatggcaacagcggcaagatgatgtgccagctgtatgaccctgagagcagcggcatcagcagcctgaatgagttcaaccccatgggagacaccctggccagcgccatgggctaccacatcctgatctggagccaggaggaggcccggaccaggaagtag

SEQ ID NO: 19327 - DNA, 735 bp, Artificial Sequence
  Description of Artificial Sequence: Synthetic coding sequence
atggcccccaagaagaggcctgagacccagaagaccagcgagatcgtgctgcggcccaggaacaagaggagccgcagccccctggagctggagcctgaggccaagaagctgtgtgccaagggcagcggccccagccgccgctgtgacagcgactgcctgtgggtgggcctggccggcccccagatcctgcccccctgccgcagcatcgtgaggaccctgcaccagcacaagctgggccgggcctcctggcccagcgtgcagcagggcctgcagcagagcttcctgcacaccctggacagctaccgcatcctgcagaaggccgccccctttgaccggcgggccaccagcctggcctggcaccccacccaccccagcacagtggccgtgggcagcaagggcggggacatcatgctgtggaactttggcatcaaggacaagcccaccttcatcaagggcattggagctgggggcagcatcaccggcctgaagttcaaccccctgaacaccaaccagttctacgccagctccatggagggcaccacccggctgcaggacttcaagggcaacatcctgcgggtgtttgccagcagtgacaccatcaacatctggttctgcagcctggatgtgtctgccagcagcaggatggtggtgactggagacaacgtgggcaatgtcatcctgctgaacatggatggcaaggagctggtgtctgtgcccatggagcccggcagctag

SEQ ID NO: 19328 - DNA, 1092 bp, Artificial Sequence
  Description of Artificial Sequence: Synthetic coding sequence
atggcccccaagaagaggcctgagacccagaagaccagcgagatcgtgctgcggcccaggaacaagaggagccgcagccccctggagctggagcctgaggccaagaagctgtgtgccaagggcagcggccccagccgccgctgtgacagcgactgcctgtgggtgggcctggccggcccccagatcctgcccccctgccgcagcatcgtgaggaccctgcaccagcacaagctgggccgggcctcctggcccagcgtgcagcagattggagctgggggcagcatcaccggcctgaagttcaaccccctgaacaccaaccagttctacgccagctccatggagggcaccacccggctgcaggacttcaagggcaacatcctgcgggtgtttgccagcagtgacaccatcaacatctggttctgcagcctggatgtgtctgccagcagcaggatggtggtgactggagacaacgtgggcaatgtcatcctgctgaacatggatggcaaggagctgtggaacctgaggatgcacaagaagaaggtgacccacgtggccctgaacccctgctgtgactggttcctggccacagcctctgtggaccagacagtgaagatctgggacctgcggcaggtgcggggcaaggccagcttcctgtacagcctgccccaccgccaccctgtgaatgctgcctgcttctccccagatggagcccggctgctgaccacagaccagaagtctgagatccgggtgtacagcgccagccagtgggactgccccctgggcctcatcccccacccccaccgccacttccagcacctgacccccatcaaggccgcctggcacccccgctacaacctgattgtggtgggccgctacccagaccccaacttcaagagctgcaccccctatgagctgcggaccattgatgtgtttgatggcaacagcggcaagatgatgtgccagctgtatgaccctgagagcagcggcatcagcagcctgaatgagttcaaccccatgggagacaccctggccagcgccatgggctaccacatcctgatctggagccaggaggaggcccggaccaggaagtag

SEQ ID NO: 19329 - DNA, 1119 bp, Artificial Sequence
  Description of Artificial Sequence: Synthetic coding sequence
atgtctgaggccggggaggccaccaccaccaccaccaccaccctgccccaggcccccacagaggccgctgctgctgccccccaggaccctgcccccaagagccctgtgggcagcggggccccccaggccgccgccccagccccagctgcccacgtggccggcaaccctggaggagatgctgccccagctgccactggaacagctgctgctgccagcctggccacagctgctggctctgaagatgctgagaagaaggtgctggccaccaaggtgctgggcaccgtgaagtggttcaacgtgagaaatggctacggcttcatcaacagaaatgacaccaaggaggatgtgtttgtgcaccagacagccatcaagaagaacaaccccaggaagtacctgcggtctgtgggagatggagagaccgtggagtttgatgtggtggagggggagaagggagctgaggccgccaacgtgacaggcccagatggagtgcctgtggagggcagccgctatgctgctgacagaagacgctaccgccggggctactacggcagaagaagaggcccccccaggaactatgctggggaggaggaggaggagggcagcggcagcagcgagggctttgatcctccagccacagaccggcagttcagcggggccaggaaccagctgcggcggccccagtaccggccccagtaccggcagaggcgcttccccccctaccacgtgggccagacctttgaccggcgcagccgggtgctgccccaccccaaccgcatccaggccggggagatcggggagatgaaggatggagtgcctgagggcgcccagctgcagggccctgtgcacaggaaccccacctaccggccccgctaccgcagccggggccccccccggcccaggcctgccccagctgtgggggaggccgaggacaaggagaaccagcaggccaccagcggccccaaccagcccagcgtgcggcggggctaccgccggccctacaactacagaagaagaccccggcccccaaatgcccccagccaggacggcaaggaggccaaggccggggaggcccccacagagaacccagccccacccacccagcagagcagcgctgagtag

SEQ ID NO: 19330 - DNA, 867 bp, Artificial Sequence
  Description of Artificial Sequence: Synthetic coding sequence
atggccaatgagacccagaaggtgggcgccatccacttccccttccccttcaccccctacagcatccaggaggacttcatggccgagctgtacagagtgctggaggccggcaagattggcatctttgagagccccaccggcaccgggaagagcctgagcctcatctgtggggccctgtcctggctgcgggactttgagcagaagaagcgggaggaggaggcccggctgctggagactggaacaggccccctgcatgatgagaaggatgagagcctgtgcctgagcagcagctgtgagggcgccgccggcacccccaggcctgctggggagcccgcctgggtgacccagtttgtgcagaagaaggaggagcgggacctggtggaccggctgaaggccgagcaggcccggaggaagcagcgggaggagcggctgcagcagctgcagcaccgggtgcagctgaagtatgctgccaagaggctgcggcaggaggaggaggagcgggagaacctgctgcggctgagccgggagatgctggagaccggccctgaggccgagcggctggagcagctggagagcggggaggaggagctggtgctggccgagtatgaaagtgatgaggagaagaaggtggccagccgggcccccagtgatgccaccagcagccgccaccccccagatgccagcttccctgctgccctgaacttcctgcagaggacccggcccagctctgtgctgtctgaggacctgctgatgcagagagctgtggccaagcacccagccctgctgccctggcagatgagcagcagccccctgcggcccggcagcgagtggatgaggatgaggatgacctggaggaagaacacctag

SEQ ID NO: 19331 - DNA, 2571 bp, Artificial Sequence
  Description of Artificial Sequence: Synthetic coding sequence
atggccaatgagacccagaaggtgggcgccatccacttccccttccccttcaccccctacagcatccaggaggacttcatggccgagctgtacagagtgctggaggccggcaagattggcatctttgagagccccaccggcaccgggaagagcctgagcctcatctgtggggccctgtcctggctgcgggactttgagcagaagaagcgggaggaggaggcccggctgctggagactggaacaggccccctgcatgatgagaaggatgagagcctgtgcctgagcagcagctgtgagggcgccgccggcacccccaggcctgctggggagcccgcctgggtgacccagtttgtgcagaagaaggaggagcgggacctggtggaccggctgaaggccgagcaggcccggaggaagcagcgggaggagcggctgcagcagctgcagcaccgggtgcagctgaagtatgctgccaagaggctgcggcaggaggaggaggagcgggagaacctgctgcggctgagccgggagatgctggagaccggccctgaggccgagcggctggagcagctggagagcggggaggaggagctggtgctggccgagtatgaaagtgatgaggagaagaaggtggccagccgggtggatgaagatgaagatgacctggaggaggagcacatcaccaagatctactactgcagcaggacccacagccagctggcccagtttgtgcatgaggtgaagaagagcccctttgggaaggatgtgcggctggtgtccctgggcagccggcagaacctgtgtgtgaatgaagatgtgaagagcctgggctctgtgcagctgatcaatgacagatgtgtggacatgcagaggagcagacatgagaagaagaagggagctgaggaggagaagcccaagagaagacggcaggagaagcaggccgcctgccccttctacaaccacgagcagatgggcctgctgagagatgaggccctggccgaggtgaaggacatggagcagctgctggccctgggcaaggaggcccgggcctgcccctactacggcagccggctggccatcccagctgcccagctggtggtgctgccctaccagatgctgctgcatgctgccacccggcaggccgccggcatccggctgcaggaccaggtggtgatcattgatgaggcccacaacctgattgacaccatcaccggcatgcacagcgtggaggtgtctggcagccagctgtgccaggcccacagccagctgctgcagtatgtggagagatatggcaagaggctgaaggccaagaacctgatgtacctgaagcagatcctgtacctgctggagaagtttgtggccgtgctgggcggcaacatcaagcagaaccccaacacccagagcctgagccagacaggaacagagctgaagaccatcaatgacttcctgttccagagccagattgacaacatcaacctcttcaaggtgcagcgctactgtgagaagtccatgatcagcaggaagctgtttggcttcacagaaagatatggagctgtgttcagcagccgggagcagcccaagctggccggcttccagcagttcctgcagagcctgcagcccaggaccacagaggccctggccgccccagcagatgagagccaggccagcaccctgcggcctgccagccccctgatgcacatccagggcttcctggccgccctgaccacagccaaccaggacggccgggtcatcctgagccggcagggcagcctgagccagagcaccctgaagttcctgctgctgaacccagctgtgcactttgcccaggtggtgaaggagtgcagagctgtggtgattgctgggggcaccatgcagcctgtgtctgacttccggcagcagctgctggcctgtgccggcgtggaggccgagcgggtggtggagttcagctgtggccacgtgatccccccagacaacatcctgcccctggtgatctgcagcggcatcagcaaccagcccctggagttcaccttccagaagcgggagctgccccagatgatcttccaggagcccaagagcgcccaccaggtggagcaggtgctgctggcctacagccgctgcatccaggcctgtggccaggagcggggccaggtgactggagccctgctgctgtctgtggtgggcggcaagatgtctgagggcatcaacttcagtgacaacctgggccgctgtgtggtgatggtgggcatgcccttccccaacatccgctctgctgagctgcaggagaagatggcctacctggaccagaccctgccccgggcccctggccaggcccctcctgggaaggccctggtggagaacctgtgcatgaaggctgtgaaccagagcatcggccgggccatccgccaccagaaggactttgcctctgtggtgctgctggaccagagatatgcccggccccctgtgctggccaagctgcctgcctggatccgggcccgggtggaggtgaaggccaccttcggccctgccatcgctgctgtgcagaagttccaccgggagaagagcgccagcagctag

SEQ ID NO: 19332 - DNA, 1671 bp, Artificial Sequence
  Description of Artificial Sequence: Synthetic coding sequence
gaggaggagcccctgtggcagggctgcagcgctggcctgccctggctgcctgctgagaagaagaagggagctgaggaggagaagcccaagagaagacggcaggagaagcaggccgcctgccccttctacaaccacgagcagatgggcctgctgagagatgaggccctggccgaggtgaaggacatggagcagctgctggccctgggcaaggaggcccgggcctgcccctactacggcagccggctggccatcccagctgcccagctggtggtgctgccctaccagatgctgctgcacgccgccacccggcaggccgccggcatccggctgcaggaccaggtggtgatcattgatgaggcccacaacctgattgacaccatcaccggcatgcacagcgtggaggtgtctggcagccagctgtgccaggcccacagccagctgctgcagtatgtggagagatatggcaagaggctgaaggccaagaacctgatgtacctgaagcagatcctgtacctgctggagaagtttgtggccgtgctgggcggcaacatcaagcagaaccccaacacccagagcctgagccagacaggaacagagctgaagaccatcaatgacttcctgttccagagccagattgacaacatcaacctcttcaaggtgcagcgctactgtgagaagtccatgatcagcaggaagctgtttggcttcacagagcgctacggggctgtgttcagcagccgggagcagcccaagctggccggcttccagcagttcctgcagagcctgcagcccaggaccacagaggccctggccgccccagcagatgagagccaggccagcaccctgcggcctgccagccccctgatgcacatccagggcttcctggccgccctgaccacagccaaccaggacggccgggtcatcctgagccggcagggcagcctgagccagagcaccctgaagttcctgctgctgaacccagctgtgcactttgcccaggtggtgaaggaatgtagagctgtggtgattgctgggggcaccatgcagcctgtgtctgacttccggcagcagctgctggcctgtgccggcgtggaggccgagcgggtggtggagttcagctgtggccacgtgattcctccagacaacatcctgcccctggtgatctgcagcggcatcagcaaccagcccctggagttcaccttccagaagcgggagctgccccagatgatggatgaggtgggccgcatcctgtgcaacctgtgtggggtggtgcctggaggagtggtgtgcttcttccccagctatgagtacctgcggcaggtgcacgcccactgggagaagggcggcctgctgggccgcctggccgccaggaagaagatcttccaggagcccaagagcgcccaccaggtggagcaggtgctgctggcctacagccgctgcatccaggcctgtggccaggagcggggccaggtgactggagccctgctgctgtctgtggtgggcggcaagatgtctgagggcatcaacttcagtgacaacctgggccgctgtgtggtgatggtgggcatgcccttccccaacatccgctctgctgagctgcaggagaagatggcctacctggaccagaccctggccggccccagcggcacccggcgcatcctgcctgcctag

SEQ ID NO: 19333 - DNA, 2913 bp, Artificial Sequence
  Description of Artificial Sequence: Synthetic coding sequence
atggccaatgagacccagaaggtgggcgccatccacttccccttccccttcaccccctacagcatccaggaggacttcatggccgagctgtacagagtgctggaggccggcaagattggcatctttgagagccccaccggcaccgggaagagcctgagcctcatctgtggggccctgtcctggctgcgggactttgagcagaagaagcgggaggaggaggcccggctgctggagactggaacaggccccctgcatgatgagaaggatgagagcctgtgcctgagcagcagctgtgagggcgccgccggcacccccaggcctgctggggagcccgcctgggtgacccagtttgtgcagaagaaggaggagcgggacctggtggaccggctgaaggccgagcaggcccggaggaagcagcgggaggagcggctgcagcagctgcagcaccgggtgcagctgaagtatgctgccaagaggctgcggcaggaggaggaggagcgggagaacctgctgcggctgagccgggagatgctggagaccggccctgaggccgagcggctggagcagctggagagcggggaggaggagctggtgctggccgagtatgaaagtgatgaggagaagaaggtggccagccgggtggatgaagatgaagatgacctggaggaggagcacatcaccaagatctactactgcagcaggacccacagccagctggcccagtttgtgcatgaggtgaagaagagcccctttgggaaggatgtgcggctggtgtccctgggcagccggcagaacctgtgtgtgaatgaagatgtgaagagcctgggctctgtgcagctgatcaatgacagatgtgtggacatgcagaggagcagacatgagaagaagaagggagctgaggaggagaagcccaagagaagacggcaggagaagcaggccgcctgccccttctacaaccacgagcagatgggcctgctgagagatgaggccctggccgaggtgaaggacatggagcagctgctggccctgggcaaggaggcccgggcctgcccctactacggcagccggctggccatcccagctgcccagctggtggtgctgccctaccagatgctgctgcatgctgccacccggcaggccgccggcatccggctgcaggaccaggtggtgatcattgatgaggcccacaacctgattgacaccatcaccggcatgcacagcgtggaggtgtctggcagccagctgtgccaggcccacagccagctgctgcagtatgtggagagatatggcaagaggctgaaggccaagaacctgatgtacctgaagcagatcctgtacctgctggagaagtttgtggccgtgctgggcggcaacatcaagcagaaccccaacacccagagcctgagccagacaggaacagagctgaagaccatcaatgacttcctgttccagagccagattgacaacatcaacctcttcaaggtgcagcgctactgtgagaagtccatgatcagcaggaagctgtttggcttcacagaaagatatggagctgtgttcagcagccgggagcagcccaagctggccggcttccagcagttcctgcagagcctgcagcccaggaccacagaggccctggccgccccagcagatgagagccaggccagcaccctgcggcctgccagccccctgatgcacatccagggcttcctggccgccctgaccacagccaaccaggacggccgggtcatcctgagccggcagggcagcctgagccagagcaccctgaagttcctgctgctgaacccagctgtgcactttgcccaggtggtgaaggagtgcagagctgtggtgattgctgggggcaccatgcagcctgtgtctgacttccggcagcagctgctggcctgtgccggcgtggaggccgagcgggtggtggagttcagctgtggccacgtgatccccccagacaacatcctgcccctggtgatctgcagcggcatcagcaaccagcccctggagttcaccttccagaagcgggagctgccccagatgatggatgaggtgggccgcatcctgtgcaacctgtgtggggtggtgcctgggggcgtggtgtgcttcttccccagctatgagtacctgcggcaggtgcacgcccactgggagaagggcggcctgctgggccgcctggccgccaggaagaagatcttccaggagcccaagagcgcccaccaggtggagcaggtgctgctggcctacagccgctgcatccaggcctgtggccaggagcggggccaggtgactggagccctgctgctgtctgtggtgggcggcaagatgtctgagggcatcaacttcagtgacaacctgggccgctgtgtggtgatggtgggcatgcccttccccaacatccgctctgctgagctgcaggagaagatggcctacctggaccagaccctgagccccaggcctggcaccccccgggagggcagcggcggggagcctgtgcatgagggccggcagcctgtgcaccggcagggccaccaggcccctgagggcttctgccagaggtctgcccctggccctgccatctgcccagccccctgccccggccaggccgccggcctggaccccagcccctgtggcggccagagctacctgtggcccaggcactgctgctgtgccgaggtgtccccaggagaggtgggcctcttcctgatgggcaaccacaccacagcctggaggcgggccctgcccctgagctgccccctggagaccgtgtttgtggtgggcgtggtgtgtggggaccctgtgaccaaggtgaagccccggcggcgggtgtggagccctgagtgctgccaggaccccggcactggagtgagcagcagaagaaggaagtggggcaaccctgagtag

SEQ ID NO: 19334 - DNA, 675 bp, Artificial Sequence
  Description of Artificial Sequence: Synthetic coding sequence
atggccgagctgtacagagtgctggaggccggcaagattggcatctttgagagccccaccggcaccgggaagagcctgagcctcatctgtggggccctgtcctggctgcgggactttgagcagaagaagcgggaggaggaggcccggctgctggagactggaacaggccccctgcatgatgagaaggatgagagcctgtgcctgagcagcagctgtgagggcgccgccggcacccccaggcctgctggggagcccgcctgggtgacccagtttgtgcagaagaaggaggagcgggacctggtggaccggctgaaggccgagcaggcccggaggaagcagcgggaggagcggctgcagcagctgcagcaccgggtgcagctgaagtatgctgccaagaggctgcggcaggaggaggaggagcgggagaacctgctgcggctgagccgggagatgctggagaccggccctgaggccgagcggctggagcagctggagagcggggaggaggagctggtgctggccgagtatgaaagtgatgaggagaagaaggtggccagccgggtggatgaagatgaagatgacctggaggaggagcacatcaccaagatctactactgcagcaggacccacagccagctggcccagtttgtgcatgaggtgaagaagagcccctag

SEQ ID NO: 19335 - DNA, 2721 bp, Artificial Sequence
  Description of Artificial Sequence: Synthetic coding sequence
atggccaatgagacccagaaggtgggcgccatccacttccccttccccttcaccccctacagcatccaggaggacttcatggccgagctgtacagagtgctggaggccggcaagattggcatctttgagagccccaccggcaccgggaagagcctgagcctcatctgtggggccctgtcctggctgcgggactttgagcagaagaagcgggaggaggaggcccggctgctggagactggaacaggccccctgcatgatgagaaggatgagagcctgtgcctgagcagcagctgtgagggcgccgccggcacccccaggcctgctggggagcccgcctgggtgacccagtttgtgcagaagaaggaggagcgggacctggtggaccggctgaaggccgagcaggcccggaggaagcagcgggaggagcggctgcagcagctgcagcaccgggtgcagctgaagtatgctgccaagaggctgcggcaggaggaggaggagcgggagaacctgctgcggctgagccgggagatgctggagaccggccctgaggccgagcggctggagcagctggagagcggggaggaggagctggtgctggccgagtatgaaagtgatgaggagaagaaggtggccagccgggtggatgaagatgaagatgacctggaggaggagcacatcaccaagatctactactgcagcaggacccacagccagctggcccagtttgtgcatgaggtgaagaagagcccctttgggaaggatgtgcggctggtgtccctgggcagccggcagaacctgtgtgtgaatgaagatgtgaagagcctgggctctgtgcagctgatcaatgacagatgtgtggacatgcagaggagcagacatgagaagaagaagggagctgaggaggagaagcccaagagaagacggcaggagaagcaggccgcctgccccttctacaaccacgagcagatgggcctgctgagagatgaggccctggccgaggtgaaggacatggagcagctgctggccctgggcaaggaggcccgggcctgcccctactacggcagccggctggccatcccagctgcccagctggtggtgctgccctaccagatgctgctgcatgctgccacccggcaggccgccggcatccggctgcaggaccaggtggtgatcattgatgaggcccacaacctgattgacaccatcaccggcatgcacagcgtggaggtgtctggcagccagctgtgccaggcccacagccagctgctgcagtatgtggagagatatggcaagaggctgaaggccaagaacctgatgtacctgaagcagatcctgtacctgctggagaagtttgtggccgtgctgggcggcaacatcaagcagaaccccaacacccagagcctgagccagacaggaacagagctgaagaccatcaatgacttcctgttccagagccagattgacaacatcaacctcttcaaggtgcagcgctactgtgagaagtccatgatcagcaggaagctgtttggcttcacagaaagatatggagctgtgttcagcagccgggagcagcccaagctggccggcttccagcagttcctgcagagcctgcagcccaggaccacagaggccctggccgccccagcagatgagagccaggccagcaccctgcggcctgccagccccctgatgcacatccagggcttcctggccgccctgaccacagccaaccaggacggccgggtcatcctgagccggcagggcagcctgagccagagcaccctgaagttcctgctgctgaacccagctgtgcactttgcccaggtggtgaaggagtgcagagctgtggtgattgctgggggcaccatgcagcctgtgtctgacttccggcagcagctgctggcctgtgccggcgtggaggccgagcgggtggtggagttcagctgtggccacgtgatccccccagacaacatcctgcccctggtgatctgcagcggcatcagcaaccagcccctggagttcaccttccagaagcgggagctgccccagatgatggatgaggtgggccgcatcctgtgcaacctgtgtggggtggtgcctgggggcgtggtgtgcttcttccccagctatgagtacctgcggcaggtgcacgcccactgggagaagggcggcctgctgggccgcctggccgccaggaagaagatcttccaggagcccaagagcgcccaccaggtggagcaggtgctgctggcctacagccgctgcatccaggcctgtggccaggagcggggccaggtgactggagccctgctgctgtctgtggtgggcggcaagatgtctgagggcatcaacttcagtgacaacctgggccgctgtgtggtgatggtgggcatgcccttccccaacatccgctctgctgagctgcaggagaagatggcctacctggaccagaccctgccccgggcccctggccaggcccctcctgggaaggccctggtggagaacctgtgcatgaaggctgtgaaccagagcatcggccgggccatccgccaccagaaggactttgcctctgtggtgctgctggaccagagatatgcccggccccctgtgctggccaagctgcctgcctggatccgggcccgggtggaggtgaaggccaccttcggccctgccatcgctgctgtgcagaagttccaccgggagaagagcgccagcagctag

SEQ ID NO: 19336 - DNA, 2913 bp, Artificial Sequence; identical to SEQ ID NO: 19333
  Description of Artificial Sequence: Synthetic coding sequence

SEQ ID NO: 19337 - DNA, 4293 bp, Artificial Sequence
  Description of Artificial Sequence: Synthetic coding sequence
atgaccgtcttccggcaggagaatgtggatgactactatgacacaggagaggagctgggcagcggccagtttgctgtggtgaagaagtgccgggagaagagcacaggcctgcagtatgctgccaagttcatcaagaagaggaggaccaagagcagcagaagaggagtgtccagagaagatattgagcgggaggtgtccatcctgaaggagatccagcaccccaacgtcatcaccctgcacgaggtgtatgagaacaagacagatgtgatcctgatcctggagctggtggccggcggggagctgtttgacttcctggccgagaaggagagcctgacagaggaggaggccacagagttcctgaagcagatcctgaatggagtgtactacctgcacagcctgcagatcgcccactttgacctgaagccagagaacatcatgctgctggacagaaatgtgcccaagccccgcatcaagatcatcgactttggcctggcccacaagattgactttggaaatgagttcaagaacatcttcggcaccccagagtttgtggcccctgagatcgtgaactatgagcccctgggcctggaggccgacatgtggagcattggagtcatcacctacatcctgctgagcggggccagccccttcctgggggacaccaagcaggagaccctggccaacgtgtctgctgtgaactatgaatttgaagatgagtacttcagcaacaccagcgccctggccaaggacttcatccggcggctgctggtgaaggaccccaagaagaggatgaccatccaggacagcctgcagcacccctggatcaagcccaaggacacccagcaggccctgagcaggaaggccagcgctgtgaacatggagaagttcaagaagtttgctgccaggaagaagtggaagcagagcgtgcggctcatcagcctgtgccagaggctgagccgctccttcctgagccgcagcaacatgtctgtggcccggagtgatgacaccctggatgaggaggacagctttgtgatgaaggccatcatccacgccatcaatgatgacaacgtgcccggcctgcagcacctgctgggcagcctgagcaactatgatgtgaaccagcccaacaagcacggcaccccacccctgctgattgctgctggctgcggcaacatccagatcctgcagctgctgatcaagaggggcagcagaattgatgtgcaggacaagggcggcagcaatgctgtgtactgggccgcccggcacggccacgtggacaccctgaagttcctgtctgaaaataaatgtcccctggatgtgaaggacaagagcggggagatggccctgcacgtggccgcccgctatggccacgcagatgtggcccagctgctgtgcagctttggcagcaaccccaacatccaggacaaggaggaggagacccccctgcactgtgccgcctggcacggctactacagcgtggccaaggccctgtgtgaggccggctgcaatgtgaacatcaagaaccgggagggggagacccccctgctgacagccagcgcccggggctaccatgacatcgtggagtgcctggccgagcacggggctgacctgaatgcctgtgacaaggatggccacatcgccctgcacctggccgtgcggcgctgccagatggaggtgatcaagaccctgctgagccagggctgctttgtggactaccaggacagacatggcaacacccccctgcacgtggcctgcaaggatggcaacatgcccatcgtggtggccctgtgtgaggccaactgcaacctggacatcagcaacaagtatggccgcacccccctgcacctggccgccaacaacggcatcctggatgtggtgcgctacctgtgcctgatgggcgcctctgtggaggccctgaccacagatggcaagacagctgaggacctggcccggtctgagcagcatgaacatgtggccggcctgctggcccggctgaggaaggacacccaccggggcctcttcatccagcagctgcggcccacccagaacctgcagccccgcatcaagctgaagctgtttggccacagcggcagcggcaagaccaccctggtggagagcctgaagtgtggcctgctgcggagcttcttcagaagaagaagaccccggctgagcagcaccaacagcagccgcttcccccccagccccctggccagcaagcccaccgtgtctgtgtccatcaacaacctgtacccaggctgtgaaaatgtgtctgtgcgcagccgctccatgatgtttgagcccggcctgaccaagggcatgctggaggtgtttgtggcccccacccaccacccccactgcagcgcagatgaccagagcaccaaggccatcgacatccagaatgcctacctgaatggagtgggggacttctctgtgtgggagttcagcggcaaccctgtgtacttctgctgctatgactactttgctgccaatgaccccaccagcatccacgtggtggtgttcagcctggaggagccctatgagatccagctgaaccaggtgatcttctggctgtccttcctgaagagcctggtgcctgtggaggagcccatcgccttcggcggcaagctgaagaaccccctgcaggtggtgctggtggccacccatgctgacatcatgaatgtgcccaggcctgctggaggagaatttggctatgacaaggacaccagcctgctgaaggagatccggaacagatttggaaatgacctgcacatcagcaacaagctgtttgtgctggatgctggggccagcggcagcaaggacatgaaggtgctgaggaaccacctgcaggagatccgcagccagatcgtgtctgtgtgcccccccatgacccacctgtgtgagaagatcatcagcaccctgcccagctggaggaagctgaatggccccaaccagctgatgagcctgcagcagtttgtgtatgatgtgcaggaccagctgaaccccctggccagcgaggaggacctgcggagaattgcccagcagctgcacagcactggagagatcaacatcatgcagagcgagaccgtgcaggatgtgctgctgctggacccccgctggctgtgcaccaacgtgctgggcaagctgctgtctgtggagaccccccgggccctgcaccactaccggggccgctacacagtggaggacatccagaggctggtgcctgacagtgatgtggaggagctgctgcagatcctggatgccatggacatctgtgcccgggacctgagcagcggcaccatggtggatgtgcctgccctgatcaagacagacaacctgcaccgctcctgggcagatgaggaggatgaggtgatggtgtatggaggagtgagaattgtgcctgtggagcacctgacccccttcccctgtggcatcttccacaaggtgcaggtgaacctgtgccgctggatccaccagcagagcacagaaggagatgctgacatccggctgtgggtgaatggctgcaagctggccaacagaggagctgagctgctggtgctgctggtgaaccacggccagggcatcgaggtgcaggtgcggggcctggagacagagaagatcaagtgctgcctgctgctggacagcgtgtgcagcaccattgaaaatgtgatggccaccaccctgcccggcctgctgactgtgaagcactacctgagcccccagcagctgcgggagcaccacgagcctgtgatgatctaccagccccgggacttcttccgggcccagaccctgaaggagaccagcctgaccaacaccatgggcggctacaaggagagcttcagcagcatcatgtgcttcggctgccatgatgtgtacagccaggccagcctgggcatggacatccacgccagtgacctgaacctgctgaccaggaggaagctgagccggctgctggaccccccagaccccctgggcaaggactggtgcctgctggccatgaacctgggcctgcctgacctggtggccaagtacaacaccagcaatggagcccccaaggacttcctgcccagccccctgcacgccctgctgcgggagtggaccacctacccagagagcacagtgggcaccctgatgagcaagctgcgggagctgggcagaagagatgctgctgacttcctgctgaaggccagctctgtgttcaagatcaacctggatggaaatggccaggaggcctatgccagcagctgcaacagcggcaccagctacaacagcatcagctctgtggtgtccaggtag

SEQ ID NO: 19338 - DNA, 4293 bp, Artificial Sequence; identical to SEQ ID NO: 19337
  Description of Artificial Sequence: Synthetic coding sequence

SEQ ID NO: 19339 - DNA, 4368 bp, Artificial Sequence
  Description of Artificial Sequence: Synthetic coding sequence
atgaccgtcttccggcaggagaatgtggatgactactatgacacaggagaggagctgggcagcggccagtttgctgtggtgaagaagtgccgggagaagagcacaggcctgcagtatgctgccaagttcatcaagaagaggaggaccaagagcagcagaagaggagtgtccagagaagatattgagcgggaggtgtccatcctgaaggagatccagcaccccaacgtcatcaccctgcacgaggtgtatgagaacaagacagatgtgatcctgatcctggagctggtggccggcggggagctgtttgacttcctggccgagaaggagagcctgacagaggaggaggccacagagttcctgaagcagatcctgaatggagtgtactacctgcacagcctgcagatcgcccactttgacctgaagccagagaacatcatgctgctggacagaaatgtgcccaagccccgcatcaagatcatcgactttggcctggcccacaagattgactttggaaatgagttcaagaacatcttcggcaccccagagtttgtggcccctgagatcgtgaactatgagcccctgggcctggaggccgacatgtggagcattggagtcatcacctacatcctgctgagcggggccagccccttcctgggggacaccaagcaggagaccctggccaacgtgtctgctgtgaactatgaatttgaagatgagtacttcagcaacaccagcgccctggccaaggacttcatccggcggctgctggtgaaggaccccaagaagaggatgaccatccaggacagcctgcagcacccctggatcaagcccaaggacacccagcaggccctgagcaggaaggccagcgctgtgaacatggagaagttcaagaagtttgctgccaggaagaagtggaagcagagcgtgcggctcatcagcctgtgccagaggctgagccgctccttcctgagccgcagcaacatgtctgtggcccggagtgatgacaccctggatgaggaggacagctttgtgatgaaggccatcatccacgccatcaatgatgacaacgtgcccggcctgcagcacctgctgggcagcctgagcaactatgatgtgaaccagcccaacaagcacggcaccccacccctgctgattgctgctggctgcggcaacatccagatcctgcagctgctgatcaagaggggcagcagaattgatgtgcaggacaagggcggcagcaatgctgtgtactgggccgcccggcacggccacgtggacaccctgaagttcctgtctgaaaataaatgtcccctggatgtgaaggacaagagcggggagatggccctgcacgtggccgcccgctatggccacgcagatgtggcccagctgctgtgcagctttggcagcaaccccaacatccaggacaaggaggaggagacccccctgcactgtgccgcctggcacggctactacagcgtggccaaggccctgtgtgaggccggctgcaatgtgaacatcaagaaccgggagggggagacccccctgctgacagccagcgcccggggctaccatgacatcgtggagtgcctggccgagcacggggctgacctgaatgcctgtgacaaggatggccacatcgccctgcacctggccgtgcggcgctgccagatggaggtgatcaagaccctgctgagccagggctgctttgtggactaccaggacagacatggcaacacccccctgcacgtggcctgcaaggatggcaacatgcccatcgtggtggccctgtgtgaggccaactgcaacctggacatcagcaacaagtatggccgcacccccctgcacctggccgccaacaacggcatcctggatgtggtgcgctacctgtgcctgatgggcgcctctgtggaggccctgaccacagatggcaagacagctgaggacctggcccggtctgagcagcatgaacatgtggccggcctgctggcccggctgaggaaggacacccaccggggcctcttcatccagcagctgcggcccacccagaacctgcagccccgcatcaagctgaagctgtttggccacagcggcagcggcaagaccaccctggtggagagcctgaagtgtggcctgctgcggagcttcttcagaagaagaagaccccggctgagcagcaccaacagcagccgcttcccccccagccccctggccagcaagcccaccgtgtctgtgtccatcaacaacctgtacccaggctgtgaaaatgtgtctgtgcgcagccgctccatgatgtttgagcccggcctgaccaagggcatgctggaggtgtttgtggcccccacccaccacccccactgcagcgcagatgaccagagcaccaaggccatcgacatccagaatgcctacctgaatggagtgggggacttctctgtgtgggagttcagcggcaaccctgtgtacttctgctgctatgactactttgctgccaatgaccccaccagcatccacgtggtggtgttcagcctggaggagccctatgagatccagctgaaccaggtgatcttctggctgtccttcctgaagagcctggtgcctgtggaggagcccatcgccttcggcggcaagctgaagaaccccctgcaggtggtgctggtggccacccatgctgacatcatgaatgtgcccaggcctgctggaggagaatttggctatgacaaggacaccagcctgctgaaggagatccggaacagatttggaaatgacctgcacatcagcaacaagctgtttgtgctggatgctggggccagcggcagcaaggacatgaaggtgctgaggaaccacctgcaggagatccgcagccagatcgtgtccaagaccctgcccttcaccccagacatcctggtgggcgtgcccctgtggcaccaccagaagattggaggcagccctgtgtgcccccccatgacccacctgtgtgagaagatcatcagcaccctgcccagctggaggaagctgaatggccccaaccagctgatgagcctgcagcagtttgtgtatgatgtgcaggaccagctgaaccccctggccagcgaggaggacctgcggcgcatcgcccagcagctgcacagcactggagagatcaacatcatgcagagcgagaccgtgcaggatgtgctgctgctggacccccgctggctgtgcaccaacgtgctgggcaagctgctgtctgtggagaccccccgggccctgcaccactaccggggccgctacacagtggaggacatccagaggctggtgcctgacagtgatgtggaggagctgctgcagatcctggatgccatggacatctgtgcccgggacctgagcagcggcaccatggtggatgtgcctgccctgatcaagacagacaacctgcaccgctcctgggcagatgaagaagatgaggtgatggtgtatggaggagtgcgcatcgtgcctgtggagcacctgacccccttcccctgtggcatcttccacaaggtgcaggtgaacctgtgccgctggatccaccagcagagcacagaaggagatgctgacatccggctgtgggtgaatggctgcaagctggccaacagaggagctgagctgctggtgctgctggtgaaccacggccagggcatcgaggtgcaggtgcggggcctggagacagagaagatcaagtgctgcctgctgctggacagcgtgtgcagcaccattgaaaatgtgatggccaccaccctgcccggcctgctgactgtgaagcactacctgagcccccagcagctgcgggagcaccacgagcctgtgatgatctaccagccccgggacttcttccgggcccagaccctgaaggagaccagcctgaccaacaccatgggcggctacaaggagagcttcagcagcatcatgtgcttcggctgccatgatgtgtacagccaggccagcctgggcatggacatccacgccagtgacctgaacctgctgaccaggaggaagctgagccggctgctggaccccccagaccccctgggcaaggactggtgcctgctggccatgaacctgggcctgcctgacctggtggccaagtacaacaccagcaatggagcccccaaggacttcctgcccagccccctgcacgccctgctgcgggagtggaccacctacccagagagcacagtgggcaccctgatgagcaagctgcgggagctgggcagaagagatgctgctgacttcctgctgaaggccagcagcgtcttcaagatcaacctggatggaaatggccaggaggcctatgccagcagctgcaacagcggcaccagctacaacagcatcagctctgtggtgtccaggtag

SEQ ID NO: 19340 - DNA, 4293 bp, Artificial Sequence; identical to SEQ ID NO: 19337
  Description of Artificial Sequence: Synthetic coding sequence

SEQ ID NO: 19341 - DNA, 4095 bp, Artificial Sequence
  Description of Artificial Sequence: Synthetic coding sequence
atgaccgtcttccggcaggagaatgtggatgactactatgacacaggagaggagctgggcagcggccagtttgctgtggtgaagaagtgccgggagaagagcacaggcctgcagtatgctgccaagttcatcaagaagaggaggaccaagagcagcagaagaggagtgtccagagaagatattgagcgggaggtgtccatcctgaaggagatccagcaccccaacgtcatcaccctgcacgaggtgtatgagaacaagacagatgtgatcctgatcctggagctggtggccggcggggagctgtttgacttcctggccgagaaggagagcctgacagaggaggaggccacagagttcctgaagcagatcctgaatggagtgtactacctgcacagcctgcagatcgcccactttgacctgaagccagagaacatcatgctgctggacagaaatgtgcccaagccccgcatcaagatcatcgactttggcctggcccacaagattgactttggaaatgagttcaagaacatcttcggcaccccagagtttgtggcccctgagatcgtgaactatgagcccctgggcctggaggccgacatgtggagcattggagtcatcacctacatcctgctgagcggggccagccccttcctgggggacaccaagcaggagaccctggccaacgtgtctgctgtgaactatgaatttgaagatgagtacttcagcaacaccagcgccctggccaaggacttcatccggcggctgctggtgaaggaccccaagaagaggatgaccatccaggacagcctgcagcacccctggatcaagcccaaggacacccagcaggccctgagcaggaaggccagcgctgtgaacatggagaagttcaagaagtttgctgccaggaagaagtggaagcagagcgtgcggctcatcagcctgtgccagaggctgagccgctccttcctgagccgcagcaacatgtctgtggcccggagtgatgacaccctggatgaggaggacagctttgtgatgaaggccatcatccacgccatcaatgatgacaacgtgcccggcctgcagcacctgctgggcagcctgagcaactatgatgtgaaccagcccaacaagcacggcaccccacccctgctgattgctgctggctgcggcaacatccagatcctgcagctgctgatcaagaggggcagcagaattgatgtgcaggacaagggcggcagcaatgctgtgtactgggccgcccggcacggccacgtggacaccctgaagttcctgtctgaaaataaatgtcccctggatgtgaaggacaagagcggggagatggccctgcacgtggccgcccgctatggccacgcagatgtggcccagctgctgtgcagctttggcagcaaccccaacatccaggacaaggaggaggagacccccctgcactgtgccgcctggcacggctactacagcgtggccaaggccctgtgtgaggccggctgcaatgtgaacatcaagaaccgggagggggagacccccctgctgacagccagcgcccggggctaccatgacatcgtggagtgcctggccgagcacggggctgacctgaatgcctgtgacaaggatggccacatcgccctgcacctggccgtgcggcgctgccagatggaggtgatcaagaccctgctgagccagggctgctttgtggactaccaggacagacatggcaacacccccctgcacgtggcctgcaaggatggcaacatgcccatcgtggtggccctgtgtgaggccaactgcaacctggacatcagcaacaagtatggccgcacccccctgcacctggccgccaacaacggcatcctggatgtggtgcgctacctgtgcctgatgggcgcctctgtggaggccctgaccacagatggcaagacagctgaggacctggcccggtctgagcagcatgaacatgtggccggcctgctggcccggctgaggaaggacacccaccggggcctcttcatccagcagctgcggcccacccagaacctgcagccccgcatcaagctgaagctgtttggccacagcggcagcggcaagaccaccctggtggagagcctgaagtgtggcctgctgcggagcttcttcagaagaagaagaccccggctgagcagcaccaacagcagccgcttcccccccagccccctggccagcaagcccaccgtgtctgtgtccatcaacaacctgtacccaggctgtgaaaatgtgtctgtgcgcagccgctccatgatgtttgagcccggcctgaccaagggcatgctggaggtgtttgtggcccccacccaccacccccactgcagcgcagatgaccagagcaccaaggccatcgacatccagaatgcctacctgaatgccttcggcggcaagctgaagaaccccctgcaggtggtgctggtggccacccatgctgacatcatgaatgtgcccaggcctgctggaggagaatttggctatgacaaggacaccagcctgctgaaggagatccggaacagatttggaaatgacctgcacatcagcaacaagctgtttgtgctggatgctggggccagcggcagcaaggacatgaaggtgctgaggaaccacctgcaggagatccgcagccagatcgtgtctgtgtgcccccccatgacccacctgtgtgagaagatcatcagcaccctgcccagctggaggaagctgaatggccccaaccagctgatgagcctgcagcagtttgtgtatgatgtgcaggaccagctgaaccccctggccagcgaggaggacctgcggagaattgcccagcagctgcacagcactggagagatcaacatcatgcagagcgagaccgtgcaggatgtgctgctgctggacccccgctggctgtgcaccaacgtgctgggcaagctgctgtctgtggagaccccccgggccctgcaccactaccggggccgctacacagtggaggacatccagaggctggtgcctgacagtgatgtggaggagctgctgcagatcctggatgccatggacatctgtgcccgggacctgagcagcggcaccatggtggatgtgcctgccctgatcaagacagacaacctgcaccgctcctgggcagatgaggaggatgaggtgatggtgtatggaggagtgagaattgtgcctgtggagcacctgacccccttcccctgtggcatcttccacaaggtgcaggtgaacctgtgccgctggatccaccagcagagcacagaaggagatgctgacatccggctgtgggtgaatggctgcaagctggccaacagaggagctgagctgctggtgctgctggtgaaccacggccagggcatcgaggtgcaggtgcggggcctggagacagagaagatcaagtgctgcctgctgctggacagcgtgtgcagcaccattgaaaatgtgatggccaccaccctgcccggcctgctgactgtgaagcactacctgagcccccagcagctgcgggagcaccacgagcctgtgatgatctaccagccccgggacttcttccgggcccagaccctgaaggagaccagcctgaccaacaccatgggcggctacaaggagagcttcagcagcatcatgtgcttcggctgccatgatgtgtacagccaggccagcctgggcatggacatccacgccagtgacctgaacctgctgaccaggaggaagctgagccggctgctggaccccccagaccccctgggcaaggactggtgcctgctggccatgaacctgggcctgcctgacctggtggccaagtacaacaccagcaatggagcccccaaggacttcctgcccagccccctgcacgccctgctgcgggagtggaccacctacccagagagcacagtgggcaccctgatgagcaagctgcgggagctgggcagaagagatgctgctgacttcctgctgaaggccagctctgtgttcaagatcaacctggatggaaatggccaggaggcctatgccagcagctgcaacagcggcaccagctacaacagcatcagctctgtggtgtccaggtag

SEQ ID NO: 19342 - DNA, 2223 bp, Artificial Sequence
  Description of Artificial Sequence: Synthetic coding sequence
atggccacagccaacagcatcatcgtgctggatgatgatgatgaagatgaggccgccgcccagcccggccccagccaccccctgcccaatgctgccagccctggagctgaggcccccagcagcagcgagccccatggagcccggggcagcagcagcagcggcggcaagaagtgctacaagctggagaatgagaagctgtttgaggagttcctggagctgtgcaagatgcagacagctgaccaccctgaggtggtgcccttcctgtacaaccggcagcagagggcccacagcctcttcctggccagcgctgagttctgcaacatcctgagccgggtgctgagccgggcccggagcaggcctgccaagctgtatgtgtacatcaatgagctgtgcaccgtgctgaaggcccacagcgccaagaagaagctgaacctggccccagctgccaccaccagcaatgagcccagcggcaacaacccccccacccacctgagcctggaccccaccaatgctgagaacacagccagccagagccccaggacccggggcagccggcggcagatccagaggctggagcagctgctggccctgtatgtggccgagatccggcggctgcaggagaaggagctggacctgtctgagctggatgatcctgacagcgcctacctgcaggaggcccggctgaagaggaagctgatccggctgtttggccgcctgtgtgagctgaaggactgcagcagcctgaccggccgggtgattgagcagaggatcccctaccggggcacccgctacccagaggtgaacagaagaattgagcggctcatcaacaagccaggccctgacaccttcccagactatggagatgtgctgcgggctgtggagaaggctgctgcccggcacagcctgggcctgccccggcagcagctgcagctgatggcccaggatgccttcagagatgtgggcatccggctgcaggagaggaggcacctggacctgatctacaactttggctgccacctgacagatgactacagacctggggtggaccctgccctgagtgaccctgtgctggcccggcggctgagagaaaatagaagcctggccatgagccggctggatgaagtcatcagcaaatatgccatgctgcaggacaagtctgaggagggggagaggaagaagaggcgggcccggctgcagggcaccagcagccacagcgctgacaccccagaggccagcctggacagcggggagggccccagcggcatggccagccagggctgccccagcgccagcagagctgagacagatgatgaagatgatgaggagagtgatgaggaggaggaggaggaggaggaggaggaggaggaggaggccacagattctgaggaggaggaggacctggagcagatgcaggagggccaggaggatgatgaggaggaggatgaggaggaggaggccgccgccggcaaggatggagacaagagccccatgagcagcctgcagatcagcaatgagaagaacctggagcccgggaagcagatcagccgcagcagcggggagcagcagaacaagggcagaattgtgagccccagcctgctgtctgaggagcccctggcccccagcagcattgatgctgagagcaatggagagcagcctgaggagctgaccctggaggaggagagccctgtgtcccagctgtttgagctggagattgaggccctgcccctggacacccccagctctgtggagacagacatcagcagcagcaggaagcagagcgaggagcccttcaccaccgtgctggagaatggagctggcatggtgagcagcaccagcttcaacggcggcgtgagcccccacaactggggagacagcggccccccctgcaagaagagcaggaaggagaagaagcagacaggcagcggccccctgggcaacagctatgtggagcggcagaggtctgtgcatgagaagaatggcaagaagatctgcaccctgcccagcccccccagccccctggccagcctggcccctgtggccgacagcagcaccagggtggacagccccagccacggcctggtgaccagcagcctgtgcatccccagccctgcccggctgagccagaccccccacagccagccccccaggcctggcacctgcaagacctctgtggccacccagtgtgaccctgaggagatcatcgtgctgagtgacagcgactag

SEQ ID NO: 19343 - DNA, 2223 bp, Artificial Sequence; identical to SEQ ID NO: 19342
  Description of Artificial Sequence: Synthetic coding sequence

SEQ ID NO: 19344 - DNA, 1998 bp, Artificial Sequence
  Description of Artificial Sequence: Synthetic coding sequence
atgcagacagctgaccaccctgaggtggtgcccttcctgtacaaccggcagcagagggcccacagcctcttcctggccagcgctgagttctgcaacatcctgagccgggtgctgagccgggcccggagcaggcctgccaagctgtatgtgtacatcaatgagctgtgcaccgtgctgaaggcccacagcgccaagaagaagctgaacctggccccagctgccaccaccagcaatgagcccagcggcaacaacccccccacccacctgagcctggaccccaccaatgcagaaaatacagccagccagagccccaggacccggggcagccggcggcagatccagaggctggagcagctgctggccctgtatgtggccgagatccggcggctgcaggagaaggagctggacctgtctgagctggatgatcctgattctgcctacctgcaggaggcccggctgaagaggaagctgatccggctgtttggccgcctgtgtgagctgaaggactgcagcagcctgaccggccgggtcatcgagcagaggatcccctaccggggcacccgctacccagaggtgaacagacgcatcgagcggctcatcaacaagccaggccctgacaccttcccagactatggagatgtgctgcgggctgtggagaaggccgccgcccggcacagcctgggcctgccccggcagcagctgcagctgatggcccaggatgccttcagagatgtgggcatccggctgcaggagcggcggcacctggacctgatctacaactttggctgccacctgacagatgactacagacctggggtggaccctgccctgagtgaccctgtgctggcccggcggctgcgggagaacagaagcctggccatgagccggctggatgaggtgatcagcaaatatgccatgctgcaggacaagtctgaggagggggagaggaagaagagaagagcccggctgcagggcaccagcagccacagcgctgacaccccagaggccagcctggacagcggggagggccccagcggcatggccagccagggctgccccagcgccagcagagctgagacagatgatgaagatgatgaggagagtgatgaggaggaggaggaggaggaggaggaggaggaggaggaggccacagacagcgaggaggaggaggacctggagcagatgcaggagggccaggaggatgatgaggaggaggatgaggaggaggaggccgctgctgggaaggatggagacaagagccccatgagcagcctgcagatcagcaatgagaagaacctggagcccgggaagcagatcagccgcagcagtggagagcagcagaacaagggccgcatcgtgagccccagcctgctgtctgaggagcccctggcccccagcagcattgatgctgagagcaatggagagcagcctgaggagctgaccctggaggaggagagccctgtgtcccagctgtttgagctggagattgaggccctgcccctggacacccccagctctgtggagacagacatcagcagcagcaggaagcagagcgaggagcccttcaccaccgtgctggagaatggagctggcatggtgagcagcaccagcttcaatggaggagtgagcccccacaactggggagacagcggccccccctgcaagaagagcaggaaggagaagaagcagacaggcagcggccccctgggcaacagctatgtggagcggcagaggtctgtgcatgagaagaatggcaagaagatctgcaccctgcccagcccccccagccccctggccagcctggcccctgtggccgacagcagcaccagggtggacagccccagccacggcctggtgaccagcagcctgtgcatccccagccctgcccggctgagccagaccccccacagccagcccccccggcccggcacctgcaagacctctgtggccacccagtgtgaccctgaggagatcatcgtgctgagtgacagcgactag

SEQ ID NO: 19345 - DNA, 537 bp, Artificial Sequence
  Description of Artificial Sequence: Synthetic coding sequence
atggccacagccaacagcatcatcgtgctggatgatgatgatgaagatgaggccgccgcccagcccggccccagccaccccctgcccaatgctgccagccctggagctgaggcccccagcagcagcgagccccatggagcccggggcagcagcagcagcggcggcaagaagtgctacaagctggagaatgagaagctgtttgaggagttcctggagctgtgcaagatgcagacagctgaccaccctgaggtggtgcccttcctgtacaaccggcagcagagggcccacagcctcttcctggccagcgctgagttctgcaacatcctgagccgggtgctgagccgggcccggagcaggcctgccaagctgtatgtgtacatcaatgagctgtgcaccgtgctgaaggcccacagcgccaagaagaagctgaacctggccccagctgccaccaccagcaatgagcccagcggcaacaacccccccacccacctgagcctggaccccaccaatgctgagaacacagccagccagagctag

SEQ ID NO: 19346 - DNA, 147 bp, Artificial Sequence
  Description of Artificial Sequence: Synthetic coding sequence
atggccacagccaacagcatcatcgtgctggatgatgatgatgaagatgaggccgccgcccagcccggccccagccaccccctgcccaatgctgccagccctggagctgaggcccccagcagcagcgagccccatggagccaggtag

SEQ ID NO: 19347 - DNA, 393 bp, Artificial Sequence
  Description of Artificial Sequence: Synthetic coding sequence
atggccacagccaacagcatcatcgtgctggatgatgatgatgaagatgaggccgccgcccagcccggccccagccaccccctgcccaatgctgccagccctggagctgaggcccccagcagcagcgagccccatggagcccggggcagcagcagcagcggcggcaagaagtgctacaagctggagaatgagaagctgtttgaggagttcctggagctgtgcaagatgcagacagctgaccaccctgaggtggtgcccttcctgtacaaccggcagcagagggcccacagcctcttcctggccagcgctgagttctgcaacatcctgagccgggtgctgagccgggcccggagcaggcctgccaagctgtatgtgtacatcaatgagctgtag

SEQ ID NO: 19348 - DNA, 2316 bp, Artificial Sequence
  Description of Artificial Sequence: Synthetic coding sequence
ggtgtgcctgtgatcaagtggaagaaggatggcatccacctggccctgggcatggatgagaggaagcagcagctgagcaatggcagcctgctgatccagaacatcctgcacagccgccaccacaagccagatgagggcctgtaccagtgtgaggccagcctgggggacagcggcagcatcatcagcaggacagccaaggtggccgtggccggccccctgcgcttcctgagccagacagaatctgtgacagccttcatgggagacacagtgctgctgaagtgtgaggtgattggagagcccatgcccaccatccactggcagaagaaccagcaggacctgacccccatccctggggacagccgggtggtggtgctgcccagcggggccctgcagatcagccggctgcagcccggggacatcggcatctaccgctgcagcgccaggaacccagccagcagcaggactggaaatgaagctgaggtgcgcatcctgagtgaccccggcctgcaccggcagctgtacttcctgcagaggcccagcaatgtggtggccatcgagggcaaggatgctgtgctggagtgctgcgtgtctggctacccacctccttccttcacctggctgcggggggaggaggtgatccagctgcggagcaagaagtacagcctgctgggcggcagcaacctgctgatcagcaatgtgacagatgatgacagcggcatgtacacctgtgtggtgacctacaagaatgaaaacatcagcgccagcgctgagctgactgtgctggtgcccccctggttcctgaaccaccccagcaacctgtatgcctatgagagcatggacattgaatttgagtgcaccgtgtctgggaagcctgtgcccaccgtgaactggatgaagaatggagatgtggtgatccccagcgactacttccagatcgtgggcggcagcaacctgcgcatcctgggcgtggtgaagagtgatgagggcttctaccagtgtgtggccgagaatgaagctggaaatgcccagaccagcgcccagctgattgtgcccaagccagccatccccagcagctctgtgctgcccagcgcccccagagatgtggtgcctgtgctggtgagcagcagatttgtgcggctgtcctggaggcccccagctgaggccaagggcaacatccagaccttcaccgtcttcttcagccgggagggggacaaccgggagcgggccctgaacaccacccagcccggcagcctgcagctgactgtgggcaacctgaagccagaggccatgtacaccttccgggtggtggcctacaatgagtggggccctggagagagcagccagcccatcaaggtggccacccagcctgagctgcaggtgcccggccctgtggagaacctgcaggccgtgtccaccagccccaccagcatcctgatcacctgggagcccccagcctatgccaacggccctgtgcagggctaccgcctcttctgcacagaggtgtccacaggcaaggagcagaacatcgaggtggatggcctgagctacaagctggagggcctgaagaagttcacagagtacagcctgcgcttcctggcctacaacagatatggccctggggtgtccacagatgacatcaccgtggtgaccctgagtgatgtgcccagcgccccaccccagaatgtgtccctggaggtggtgaacagccgcagcatcaaggtgtcctggctgcccccaccttctggcacccagaatggcttcatcaccggctacaagatccgccacaggaagaccacccggcggggggagatggagaccctggagcccaacaacctgtggtacctgttcaccggcctggagaagggcagccagtacagcttccaggtgtctgccatgacagtgaatggaactggaccacccagcaactggtacacagctgagaccccagaaaatgacctggatgagagccaggtgcctgaccagcccagcagcctgcacgtgcggccccagaccaactgcatcatcatgtcctggaccccacccctgaaccccaacatcgtggtgcggggctacatcatcggctatggagtgggcagcccctatgcagagaccgtgcgggtggacagcaagcagcgctactacagcattgaaaggctggagagcagcagccactacgtgatcagcctgaaggccttcaacaatgctggggagggcgtgcccctgtatgagagcgccaccaccaggagcatcaccgtgagaagacacaacatcagcaagctgcacagcaaccggccccagaccaagcacaacgtgtag

SEQ ID NO: 19349 - DNA, 2694 bp, Artificial Sequence
  Description of Artificial Sequence: Synthetic coding sequence
atgggagacacagtgctgctgaagtgtgaggtgattggagagcccatgcccaccatccactggcagaagaaccagcaggacctgacccccatccctggggacagccgggtggtggtgctgcccagcggggccctgcagatcagccggctgcagcccggggacatcggcatctaccgctgcagcgccagaaatcctgccagcagcaggactggaaatgaggccgaggtgcgcatcctgagtgaccccggcctgcaccggcagctgtacttcctgcagaggcccagcaatgtggtggccatcgagggcaaggatgctgtgctggagtgctgcgtgtctggctaccccccacccagcttcacctggctgcggggggaggaggtgatccagctgcggagcaagaagtacagcctgctgggcggcagcaacctgctgatcagcaatgtgacagatgatgattctggcatgtacacctgtgtggtgacctacaagaatgaaaacatcagcgccagcgctgagctgactgtgctggtgcccccctggttcctgaaccaccccagcaacctgtatgcctatgaatccatggacatcgagtttgaatgtactgtgtctgggaagcctgtgcccaccgtgaactggatgaagaatggagatgtggtgatccccagcgactacttccagatcgtgggcggcagcaacctgcgcatcctgggcgtggtgaagagtgatgagggcttctaccagtgtgtggctgaaaatgaggccggaaatgcccagaccagcgcccagctgattgtgcccaagccagccatccccagcagctctgtgctgcccagcgcccccagagatgtggtgcctgtgctggtgagcagcagatttgtgcggctgtcctggaggcctcctgctgaggccaagggcaacatccagaccttcaccgtcttcttcagccgggagggggacaaccgggagcgggccctgaacaccacccagcccggcagcctgcagctgactgtgggcaacctgaagccagaggccatgtacaccttccgggtggtggcctacaatgagtggggccctggagagagcagccagcccatcaaggtggccacccagcctgagctgcaggtgcccggccctgtggagaacctgcaggccgtgtccaccagccccaccagcatcctgatcacctgggagcccccagcctatgccaatggacctgtgcagggctaccgcctcttctgcacagaggtgtccacaggcaaggagcagaacatcgaggtggatggcctgagctacaagctggagggcctgaagaagttcacagagtacagcctgcgcttcctggcctacaacagatatggccctggggtgtccacagatgacatcaccgtggtgaccctgagtgatgtgcccagcgccccaccccagaatgtgtccctggaggtggtgaacagccgcagcatcaaggtgtcctggctgcccccacccagcggcacccagaatggcttcatcaccggctacaagatccgccacaggaagaccaccaggagaggagagatggagaccctggagcccaacaacctgtggtacctgttcaccggcctggagaagggcagccagtacagcttccaggtgtctgccatgacagtgaatggcaccggcccccccagcaactggtacacagctgagaccccagaaaatgacctggatgagagccaggtgcctgaccagcccagcagcctgcacgtgcggccccagaccaactgcatcatcatgtcctggaccccacccctgaaccccaacatcgtggtgcggggctacatcatcggctacggcgtgggcagcccctatgcagagaccgtgcgggtggacagcaagcagcgctactacagcattgagcggctggagagcagcagccactacgtgatcagcctgaaggccttcaacaatgctggggagggcgtgcccctgtatgaaagtgccaccaccaggagcatcacagacctgagcacccccatgctgccccctgtgggcgtgcaggccgtggccctgacccatgatgctgtgcgggtgtcctgggccgacaacagcgtgcccaagaaccagaagaccagcgaggtgcggctgtacacagtgcgctggaggaccagcttcagcgccagcgccaagtacaagtctgaggacaccaccagcctgagctacacagccaccggcctgaagcccaacaccatgtatgagttctctgtgatggtgaccaagaacagaagaagcagcacctggagcatgacagcccacgccaccacctatgaggccgcccccaccagcgcccccaaggacctgaccgtcatcacccgggagggcaagccccgggccgtcatcgtgtcctggcagccccccctggaggccaacgggaagatcacagcctacatcctcttctacaccctggacaagaacatccccattgatgactggatcatggagaccatcagcggggaccggctgacccaccagatcatggacctgaacctggacaccatgtactacttccgcatccaggccaggaacagcaagggcgtgggccccctgagtgaccccatcctcttccgcaccctgaaggtggagcacccagacaagatggccaatgaccaggacaccggggtgaccatcaacctggtgaatgaggtgctgctgggctag

SEQ ID NO: 19350 - DNA, 4344 bp, Artificial Sequence
  Description of Artificial Sequence: Synthetic coding sequence
atggagaacagcctgcgctgtgtgtgggtgcccaagctggcctttgtgctgtttggagccagcctcttcagcgcccacctgcaggtgacaggcttccagatcaaggccttcaccgccctgcgcttcctgtctgagcccagtgatgctgtgaccatgaggggcggcaatgtgctgctggactgcagcgctgagagtgaccggggcgtgcctgtgatcaagtggaagaaggatggcatccacctggccctgggcatggatgagaggaagcagcagctgagcaatggcagcctgctgatccagaacatcctgcacagccgccaccacaagccagatgagggcctgtaccagtgtgaggccagcctgggggacagcggcagcatcatcagcaggacagccaaggtggccgtggccggccccctgcgcttcctgagccagacagagagcgtgacagccttcatgggagacacagtgctgctgaagtgtgaggtgattggagagcccatgcccaccatccactggcagaagaaccagcaggacctgacccccatccctggggacagccgggtggtggtgctgcccagcggggccctgcagatcagccggctgcagcccggggacatcggcatctaccgctgcagcgccagaaatcctgccagcagcaggactggaaatgaggccgaggtgcgcatcctgagtgaccccggcctgcaccggcagctgtacttcctgcagaggcccagcaatgtggtggccatcgagggcaaggatgctgtgctggagtgctgcgtgtctggctaccccccacccagcttcacctggctgcggggggaggaggtgatccagctgcggagcaagaagtacagcctgctgggcggcagcaacctgctgatcagcaatgtgacagatgatgattctggcatgtacacctgtgtggtgacctacaagaatgaaaacatcagcgccagcgctgagctgactgtgctggtgcccccctggttcctgaaccaccccagcaacctgtatgcctatgaatccatggacatcgagtttgaatgtactgtgtctgggaagcctgtgcccaccgtgaactggatgaagaatggagatgtggtgatccccagcgactacttccagatcgtgggcggcagcaacctgcgcatcctgggcgtggtgaagagtgatgagggcttctaccagtgtgtggctgaaaatgaggccggaaatgcccagaccagcgcccagctgattgtgcccaagccagccatccccagcagctctgtgctgcccagcgcccccagagatgtggtgcctgtgctggtgagcagcagatttgtgcggctgtcctggaggcctcctgctgaggccaagggcaacatccagaccttcaccgtcttcttcagccgggagggggacaaccgggagcgggccctgaacaccacccagcccggcagcctgcagctgactgtgggcaacctgaagccagaggccatgtacaccttccgggtggtggcctacaatgagtggggccctggagagagcagccagcccatcaaggtggccacccagcctgagctgcaggtgcccggccctgtggagaacctgcaggccgtgtccaccagccccaccagcatcctgatcacctgggagcccccagcctatgccaatggacctgtgcagggctaccgcctcttctgcacagaggtgtccacaggcaaggagcagaacatcgaggtggatggcctgagctacaagctggagggcctgaagaagttcacagagtacagcctgcgcttcctggcctacaacagatatggccctggggtgtccacagatgacatcaccgtggtgaccctgagtgatgtgcccagcgccccaccccagaatgtgtccctggaggtggtgaacagccgcagcatcaaggtgtcctggctgcccccacccagcggcacccagaatggcttcatcaccggctacaagatccgccacaggaagaccaccaggagaggagagatggagaccctggagcccaacaacctgtggtacctgttcaccggcctggagaagggcagccagtacagcttccaggtgtctgccatgacagtgaatggcaccggcccccccagcaactggtacacagctgagaccccagaaaatgacctggatgagagccaggtgcctgaccagcccagcagcctgcacgtgcggccccagaccaactgcatcatcatgtcctggaccccacccctgaaccccaacatcgtggtgcggggctacatcatcggctacggcgtgggcagcccctatgcagagaccgtgcgggtggacagcaagcagcgctactacagcattgagcggctggagagcagcagccactacgtgatcagcctgaaggccttcaacaatgctggggagggcgtgcccctgtatgaaagtgccaccaccaggagcatcacagaccccacagatcctgtggactactaccccctgctggatgacttccccacctctgtgcctgacctgagcacccccatgctgccccctgtgggcgtgcaggccgtggccctgacccatgatgctgtgcgggtgtcctgggccgacaacagcgtgcccaagaaccagaagaccagcgaggtgcggctgtacacagtgcgctggaggaccagcttcagcgccagcgccaagtacaagtctgaggacaccaccagcctgagctacacagccaccggcctgaagcccaacaccatgtatgagttctctgtgatggtgaccaagaacagaagaagcagcacctggagcatgacagcccacgccaccacctatgaggccgcccccaccagcgcccccaaggacctgaccgtcatcacccgggagggcaagccccgggccgtcatcgtgtcctggcagccccccctggaggccaacgggaagatcacagcctacatcctcttctacaccctggacaagaacatccccattgatgactggatcatggagaccatcagcggggaccggctgacccaccagatcatggacctgaacctggacaccatgtactacttccgcatccaggccaggaacagcaagggcgtgggccccctgagtgaccccatcctcttccgcaccctgaaggtggagcacccagacaagatggccaatgaccagggcagacatggagatggcggctactggcctgtggacaccaacctgattgacaggagcaccctgaatgagccccccatcggccagatgcacccccctcatggctctgtgaccccccagaagaacagcaacctgctggtgatcatcgtggtgacagtgggcgtcatcaccgtgctggtggtggtgattgtggccgtcatctgcaccaggaggagcagcgcccagcagaggaagaagagggccacccacagcgctgggaagaggaagggcagccagaaggacctgcggcccccagacctgtggatccaccacgaggagatggagatgaagaacatcgagaagcccagcggcacagatcctgctggccgggacagccccatccagagctgccaggacctgacccctgtgagccacagccagagcgagacccagctgggcagcaagagcaccagccacagcggccaggacacagaggaggccggcagctccatgagcaccctggagaggagcctggccgcccggcgggccccccgggccaagctgatgatccccatggatgcccagagcaacaacccagctgtggtgtctgccatccctgtgcccaccctggagagcgcccagtacccaggcatcctgcccagccccacctgtggctacccccacccccagttcaccctgcggcctgtgcccttccccaccctgtctgtggaccggggctttggagctggccgcagccagagcgtgtctgagggccccaccacccagcagccccccatgctgccccccagccagcctgagcacagcagcagcgaggaggcccccagcaggaccatccccacagcctgtgtgcggcccacccaccccctgcggagctttgccaaccccctgctgcccccacccatgtctgccatcgagcccaaggtgccctacacccccctgctgagccagcccggccccaccctgcccaagacccacgtgaagacagccagcctgggcctggccggcaaggcccggagccccctgctgcctgtgtctgtgcccacagcccctgaggtgtctgaggagagccacaagcccacagaggacagcgccaacgtgtatgagcaggatgacctgtctgagcagatggccagcctggagggcctgatgaagcagctgaatgccatcactggaagtgccttctag

SEQ ID NO: 19351 - DNA, 213 bp, Artificial Sequence
  Description of Artificial Sequence: Synthetic coding sequence
atgaccatgaatgtgctggaggccggcaagtggaagagcatcgtgcctgcccctggagagggcctgctggccgtgctgcacatgatggtgttcacagatgccctgcaccgggagaggtctgtgaagtggcaggccggcgtgtgctacaacggcggcaaggactttgctgtgtccctggcccggcccaaggctgctgagggcattgctgactag

SEQ ID NO: 19352 - DNA, 1392 bp, Artificial Sequence
  Description of Artificial Sequence: Synthetic coding sequence
atgtctgtggccatcaggaagaggtcctgggaggagcacgtgacccactggatgggccagcccttcaacagtgatgacaggaacacagcctgccaccacggcctggtggccgacagcctgcaggcctccatggagaaggatgccaccctgaatgtggacaggaaggagaagtgtgtgtccctgcctgactgctgccacggcagcgagctgcgggacttccctggccggcccatgggccacctgagcaaggatgtggatgaaaatgacagccatgaaggagaggaccagttcctgagcctggaggccagcacagagaccctggtgcacgtgtctgatgaggacaacaatgctgacctgtgcctgacagatgacaagcaggtgctgaacacccagggccagaagaccagcggccagcacatgatccagggcgccggcagcctggagaaggccctgcccatcatccagagcaaccaggtgagcagcaacagctggggcattgctggggagacagagctggccctggtgaaggagagcggggagaggaaggtgacagacagcatcagcaagagcctggagctgtgcaatgagatcagcctgtctgagatcaaggatgcccccaaggtgaatgctgtggacaccctgaatgtgaaggacatcgcccctgagaagcagctgctgaacagcgctgtgattgcccagcagaggaggaagccagacccccccaaggatgaaaatgaaagaagcacctgcaatgtggtgcagaatgagttcctggacaccccctgcaccaacagaggcctgcccctgctgaagacagactttggcagctgcctgctgcagccccccagctgccccaacggcatgtctgcagaaaatggcctggagaagagcggcttcagccagcaccagaacaagagcccccccaaggtgaaggcagaagatggcatgcagtgcctgcagctgaaggagaccctggccacccaggagcccacagacaaccaggtgcggctgaggaagaggaaggagatcagagaagatcgggaccgggcccggctggacagcatggtgctgctgatcatgaagctggaccagctggaccaggacattgaaaatgccctgagcaccagcagcagccccagcggcacccccaccaacctgcggagacatgtgcctgacctggagagcggcagcgagagcggggctgacaccatctctgtgaaccagaccagggtgaacctgagcagtgacacagagagcacagacctgcccagcagcacccctgtggccaacagcggcaccaagcccaagaccacagccatccagggcatcagcgagaaggagaaggccggcaagctgaccttctggttctgcttcctggccaacctcttctag

SEQ ID NO: 19353 - DNA, 5268 bp, Artificial Sequence
  Description of Artificial Sequence: Synthetic coding sequence
atggagaccaggagcagcaagaccaggaggagcctggccagcaggaccaatgaatgccagggcaccatgtgggcccccaccagccccccagctggcagcagcagccccagccagcccacctggaagagcagcctgtacagcagcctggcctacagcgaggccttccactacagctttgctgcccggccccggcggctgacccagctggccctggcccagaggcctgagccccagctgctgcggctgcggcccagcagcctgcggacccaggacatcagccacctgctgactggagtcttcaggaacctgtacagcgctgaggtgattggagatgaggtgtctgccagcctcatcaaggcccggggctctgaaaatgaaagacatgaggagtttgtggaccagctgcagcagatccgggagctgtacaagcagaggctggatgaatttgagatgctggagcggcacatcacccaggcccaggcccgggccatcgccgagaatgaaagagtgatgagccaggccggcgtgcaggacctggagagcctggtgcggctgccccctgtgaagtctgtgagccgctggtgcatcgacagcgagctgctgaggaagcaccacctgatcagccctgaggactactacacagacacagtgcccttccacagcgcccccaagggcatcagcctgcccggctgcagcaagctgaccttcagctgtgagaagaggtctgtgcagaagaaggagctgaacaagaagctggaggacagctgcaggaagaagctggccgagtttgaagatgagctggaccacacagtggacagcctgacctggaacctgacccccaaggccaaggagaggacccgggagcccctgaagaaggccagccagcccaggaacaagaactggatgaaccacctgcgggtgccccagcgggagctggaccggctgctgctggccaggatggagagcaggaaccacttcctgaagaacccccgcttcttcccccccaacaccaggtatggaggcaagagcctggtgtttcctcccaagaagccagcccccatcggggagttccagagcacagagcctgagcagagctgtgccgacacccctgtgttcctggccaagccacccatcggcttcttcacagattatgagatcggccctgtgtatgagatggtgattgccctgcagaacaccaccaccaccagccgctacctgcgggtgctgccccccagcaccccctactttgccctgggcctgggcatgtttcctgggaagggcggcatggtggcccctggcatgacctgccagtacatcgtgcagttcttcccagactgcctgggggactttgatgacttcatcctggtggagacccagagcgcccacaccctgctgatccccctgcaggcccggcggcccccacctgtgctgaccctgagccctgtgctggactgtggctactgcctgattggaggagtgaagatgacccgcttcatctgcaagaatgtgggcttctctgtgggccgcttctgcatcatgcccaagacctcctggccacccctgtccttcaaggccatcgccaccgtgggctttgtggagcagcccccatttggcatcctgcccagcgtgtttgagctggcccctggccacgccatcctggtggaggtgctcttcagccccaagagcctgggcaaggccgagcagaccttcatcatcatgtgtgacaactgccagatcaaggagctggtgaccatcggcatcggccagctgattgccctggacctgatctacatctctggagagaagagccagcctgaccctggagagctgacagacctgacagcccagcacttcatccgctttgagcctgagaacctgcggagcacagccaggaagcagctgatcatcagaaatgccacccacgtggagctggccttctactggcagatcatgaagcccaacctgcagcccctgatgcctggagagaccttctccatggacagcatcaagtgctacccagacaaggagacagccttcagcatcatgcccaggaaaggagtgctgagcccccacacagaccacgagttcatcctgtccttcagcccccatgagctgcgggacttccacagcgtgctgcagatggtgctggaggaggtgcctgagcctgtgtcctctgaggccgagagcctgggccacagcagctacagcgtggatgatgtgattgtgctggagattgaggtgaagggctctgtggagcccttccaggtgctgctggagccctatgccctgatcatccctggagagaactacatcggcatcaacgtgaagaaggccttcaagatgtggaacaacagcaagagccccatccgctacctgtggggcaagatcagtgactgccacatcatcgaggtggagcccggcaccggggtgattgagcccagcgaggtgggggactttgagctgaacttcaccggcggcgtgcccggccccaccagccaggacctgctgtgtgaaattgaggacagccccagccctgtggtgctgcacatcgaggccgtgttcaagggccctgccctgatcatcaacgtgtctgccctgcagtttggcctgctgcggctgggccagaaggccaccaacagcatccagatcagaaatgtgtcccagctgcctgccacctggaggatgaaggagagccctgtgtccctgcaggagaggccagaagatgtgagcccctttgacatcgagcccagcagcggccagctgcacagcctgggggagtgccgggtggacatcaccctggaggccctgcactgccagcacctggagaccgtgctggagctggaggtggagaatggagcctggagctacctgcctgtgtatgcagaggtgcagaagccccacgtgtacctgcagagcagccaggtggaggtgaggaacctgtacctgggcgtgcccaccaagaccaccatcaccctcatcaatggcaccctgctgcccacccagttccactggggcaagctgctgggccaccaggccgagttctgcatggtgacagtgagccccaagcacggcctgctgggccccagcgaggagtgccagctgaagctggagctgacagcccacacccaggaggagctgacccacctggccctgccctgccacgtgtctggcatgaagaagcccctggtgctgggcatcagcggcaagccccagggcctgcaggtggccatcaccatcagcaaggagagcagtgactgcagcacagagcagtggccaggccaccccaaggagctgcggctggactttggcagcgctgtgcccctgcggaccagggtgacccggcagctgatcctgaccaacagaagccccatccgcacccgcttcagcctgaagtttgagtacttcggcagcccccagaacagcctgagcaagaagaccagcctgcccaacatgcccccagccctgctgaagacagtgaggatgcaggagcacctggccaagcgggagcagctggacttcatggagagcatgctgagccacggcaagggggccgccttcttcccccacttcagccagggcatgctgggcccctaccagcagctgtgcatcgacatcaccggctgtgccaacatgtggggcgagtactgggacaacctgatctgcaccgtgggggacctgctgcctgaggtgattcctgtgcacatggctgctgtgggctgccccatcagcagcctgcggaccaccagctacaccatcgaccaggcccagaaggagcccgccatgagatttggcacccaggtgtctggaggagacacagtgaccaggaccctgcggctgaacaacagcagcccctgtgacatccggctggactgggagacctacgtgcctgaggacaaggaggaccggctggtggagctgctggtgttctacggcccccccttccccctgcgggaccaggccggaaatgagctggtgtgcccagacaccccagagggcggctgcctgctgtggagccctggccccagcagcagcagcgagttcagccatgaaacagacagctctgtggagggcagcagcagcgccagcaacagagtggcccagaagctgatcagcgtcatcctgcaggcccatgaaggagtgcccagcggccacctgtactgcatcagccccaagcaggtggtggtgcctgctgggggcagcagcaccatctacatctccttcacccccatggtgctgagccctgagatcctgcacaaggtggagtgcaccggctacgccctgggcttcatgagcctggacagcaaggtggagcgggagatccctgggaagaggcaccggctgcaggactttgctgtgggccccctgaagctggacctgcacagctatgtgcggcctgcccagctgtctgtggagctggactatggaggctccatggagttccagtgccaggccagtgacctgatccctgagcagccctgcagcggcgtgctgtctgagctggtgaccacccaccacctgaagctgaccaacaccacagagatcccccactacttccggctgatggtgtcccggcccttctctgtgtcccaggatggagccagccaggaccaccgggcccctggccctggccagaagcaggagtgtgaggaggagacagccagcgctgacaagcagctggtgctgcaggcccaggagaacatgctggtgaatgtgtccttcagcctgagcctggagctgctgagctaccagaagctgcctgctgaccagaccctgcccggggtggacatccagcagagcgccagcggggagcgggagatggtgttcacccagaacctgctgctggagtacaccaaccagaccacccaggtggtgcccctgcgggctgtggtggccgtgcctgagctgcagctgagcacctcctgggtggactttggcacctgctttgtgtcccagcagagggtgcgggaggtgtacctgatgaacctgagcggctgccgcagctactggaccatgctgatgggccagcaggagcccgccaaggctgctgtggccttccgggtgagccccaacagcggcctgctggaggcccggagcgccaatgccccacccaccagcatcgccctgcaggtgttcttcaccgcccggagcagcgagctgtatgagagcaccatggtggtggagggcgtgctgggggagaagagctgcaccctgcggctgcggggccagggcagctatgatgagcgctacatgctgccccaccagccctag

SEQ ID NO: 19354 - DNA, 5337 bp, Artificial Sequence
  Description of Artificial Sequence: Synthetic coding sequence
atggagaccaggagcagcaagaccaggaggagcctggccagcaggaccaatgaatgccagggcaccatgtgggcccccaccagccccccagctggcagcagcagccccagccagcccacctggaagagcagcctgtacagcagcctggcctacagcgaggccttccactacagctttgctgcccggccccggcggctgacccagctggccctggcccagaggcctgagccccagctgctgcggctgcggcccagcagcctgcggacccaggacatcagccacctgctgactggagtcttcaggaacctgtacagcgctgaggtgattggagatgaggtgtctgccagcctcatcaaggcccggggctctgaaaatgaaagacatgaggagtttgtggaccagctgcagcagatccgggagctgtacaagcagaggctggatgaatttgagatgctggagcggcacatcacccaggcccaggcccgggccatcgccgagaatgaaagagtgatgagccaggccggcgtgcaggacctggagagcctggtgcggctgccccctgtgaagtctgtgagccgctggtgcatcgacagcgagctgctgaggaagcaccacctgatcagccctgaggactactacacagacacagtgcccttccacagcgcccccaagggcatcagcctgcccggctgcagcaagctgaccttcagctgtgagaagaggtctgtgcagaagaaggagctgaacaagaagctggaggacagctgcaggaagaagctggccgagtttgaagatgagctggaccacacagtggacagcctgacctggaacctgacccccaaggccaaggagaggacccgggagcccctgaagaaggccagccagcccaggaacaagaactggatgaaccacctgcgggtgccccagcgggagctggaccggctgctgctggccaggatggagagcaggaaccacttcctgaagaacccccgcttcttcccccccaacaccaggtatggaggcaagagcctggtgtttcctcccaagaagccagcccccatcggggagttccagagcacagagcctgagcagagctgtgccgacacccctgtgttcctggccaagccacccatcggcttcttcacagattatgagatcggccctgtgtatgagatggtgattgccctgcagaacaccaccaccaccagccgctacctgcgggtgctgccccccagcaccccctactttgccctgggcctgggcatgtttcctgggaagggcggcatggtggcccctggcatgacctgccagtacatcgtgcagttcttcccagactgcctgggggactttgatgacttcatcctggtggagacccagagcgcccacaccctgctgatccccctgcaggcccggcggcccccacctgtgctgaccctgagccctgtgctggactgtggctactgcctgattggaggagtgaagatgacccgcttcatctgcaagaatgtgggcttctctgtgggccgcttctgcatcatgcccaagacctcctggccacccctgtccttcaaggccatcgccaccgtgggctttgtggagcagcccccatttggcatcctgcccagcgtgtttgagctggcccctggccacgccatcctggtggaggtgctcttcagccccaagagcctgggcaaggccgagcagaccttcatcatcatgtgtgacaactgccagatcaaggagctggtgaccatcggcatcggccagctgattgccctggacctgatctacatctctggagagaagagccagcctgaccctggagagctgacagacctgacagcccagcacttcatccgctttgagcctgagaacctgcggagcacagccaggaagcagctgatcatcagaaatgccacccacgtggagctggccttctactggcagatcatgaagcccaacctgcagcccctgatgcctggagagaccttctccatggacagcatcaagtgctacccagacaaggagacagccttcagcatcatgcccaggaaaggagtgctgagcccccacacagaccacgagttcatcctgtccttcagcccccatgagctgcgggacttccacagcgtgctgcagatggtgctggaggaggtgcctgagcctgtgtcctctgaggccgagagcctgggccacagcagctacagcgtggatgatgtgattgtgctggagattgaggtgaagggctctgtggagcccttccaggtgctgctggagccctatgccctgatcatccctggagagaactacatcggcatcaacgtgaagaaggccttcaagatgtggaacaacagcaagagccccatccgctacctgtggggcaagatcagtgactgccacatcatcgaggtggagcccggcaccggggtgattgagcccagcgaggtgggggactttgagctgaacttcaccggcggcgtgcccggccccaccagccaggacctgctgtgtgaaattgaggacagccccagccctgtggtgctgcacatcgaggccgtgttcaagggccctgccctgatcatcaacgtgtctgccctgcagtttggcctgctgcggctgggccagaaggccaccaacagcatccagatcagaaatgtgtcccagctgcctgccacctggaggatgaaggagagccctgtgtccctgcaggagaggccagaagatgtgagcccctttgacatcgagcccagcagcggccagctgcacagcctgggggagtgccgggtggacatcaccctggaggccctgcactgccagcacctggagaccgtgctggagctggaggtggagaatggagcctggagctacctgcctgtgtatgcagaggtgcagaagccccacgtgtacctgcagagcagccaggtggaggtgaggaacctgtacctgggcgtgcccaccaagaccaccatcaccctcatcaatggcaccctgctgcccacccagttccactggggcaagctgctgggccaccaggccgagttctgcatggtgacagtgagccccaagcacggcctgctgggccccagcgaggagtgccagctgaagctggagctgacagcccacacccaggaggagctgacccacctggccctgccctgccacgtgtctggcatgaagaagcccctggtgctgggcatcagcggcaagccccagggcctgcaggtggccatcaccatcagcaaggagagcagtgactgcagcacagagcagtggccaggccaccccaaggagctgcggctggactttggcagcgctgtgcccctgcggaccagggtgacccggcagctgatcctgaccaacagaagccccatccgcacccgcttcagcctgaagtttgagtacttcggcagcccccagaacagcctgagcaagaagaccagcctgcccaacatgcccccagccctgctgaagacagtgaggatgcaggagcacctggccaagcgggagcagctggacttcatggagagcatgctgagccacggcaagggggccgccttcttcccccacttcagccagggcatgctgggcccctaccagcagctgtgcatcgacatcaccggctgtgccaacatgtggggcgagtactgggacaacctgatctgcaccgtgggggacctgctgcctgaggtgattcctgtgcacatggctgctgtgggctgccccatcagcagcctgcggaccaccagctacaccatcgaccaggcccagaaggagcccgccatgagatttggcacccaggtgtctggaggagacacagtgaccaggaccctgcggctgaacaacagcagcccctgtgacatccggctggactgggagacctacgtgcctgaggacaaggaggaccggctggtggagctgctggtgttctacggcccccccttccccctgcgggaccaggccggaaatgagctggtgtgcccagacaccccagagggcggctgcctgctgtggagccctggccccagcagcagcagcgagttcagccatgaaacagacagctctgtggagggcagcagcagcgccagcaacagagtggcccagaagctgatcagcgtcatcctgcaggcccatgaaggagtgcccagcggccacctgtactgcatcagccccaagcaggtggtggtgcctgctgggggcagcagcaccatctacatctccttcacccccatggtgctgagccctgagatcctgcacaaggtggagtgcaccggctacgccctgggcttcatgagcctggacagcaaggtggagcgggagatccctgggaagaggcaccggctgcaggactttgctgtgggccccctgaagctggacctgcacagctatgtgcggcctgcccagctgtctgtggagctggactatggaggctccatggagttccagtgccaggccagtgacctgatccctgagcagccctgcagcggcgtgctgtctgagctggtgaccacccaccacctgaagctgaccaacaccacagagatcccccactacttccggctgatggtgtcccggcccttctctgtgtcccaggatggagccagccaggaccaccgggcccctggccctggccagaagcaggagtgtgaggaggagacagccagcgctgacaagcagctggtgctgcaggcccaggagaacatgctggtgaatgtgtccttcagcctgagcctggagctgctgagctaccagaagctgcctgctgaccagaccctgcccggggtggacatccagcagagcgccagcggggagcgggagatggtgttcacccagaacctgctgctggagtacaccaaccagaccacccaggtggtgcccctgcgggctgtggtggccgtgcctgagctgcagctgagcacctcctgggtggactttggcacctgctttgtgtcccagcagagggtgcgggaggtgtacctgatgaacctgagcggctgccgcagctactggaccatgctgatgggcgtggtgtcctgcaccagcccccgctggtggtggaaggtgtgcagcgtgcgcagccctgccccctgtggcagcggggccaaggcccccatgatgagggacacctgctgcctgaccagccctgaggccccaccccagcccagcgcccctggccccagctggaggaagaacatcgcccagggcctgggcgccgccctgcagcacaaggacacagacctgggcacctggggccccctgggcagctcctggaatggaagaacacccttccacaacggcctgagcctgggcccccatgacatgagcagcgagctgacctag

SEQ ID NO: 19355 - DNA, 5277 bp, Artificial Sequence
  Description of Artificial Sequence: Synthetic coding sequence
atggagaccaggagcagcaagaccaggaggagcctggccagcaggaccaatgaatgccagggcaccatgtgggcccccaccagccccccagctggcagcagcagccccagccagcccacctggaagagcagcctgtacagcagcctggcctacagcgaggccttccactacagctttgctgcccggccccggcggctgacccagctggccctggcccagaggcctgagccccagctgctgcggctgcggcccagcagcctgcggacccaggacatcagccacctgctgactggagtcttcaggaacctgtacagcgctgaggtgattggagatgaggtgtctgccagcctcatcaaggcccggggctctgaaaatgaaagacatgaggagtttgtggaccagctgcagcagatccgggagctgtacaagcagaggctggatgaatttgagatgctggagcggcacatcacccaggcccaggcccgggccatcgccgagaatgaaagagtgatgagccaggccggcgtgcaggacctggagagcctggtgcggctgccccctgtgaagtctgtgagccgctggtgcatcgacagcgagctgctgaggaagcaccacctgatcagccctgaggactactacacagacacagtgcccttccacagcgcccccaagggcatcagcctgcccggctgcagcaagctgaccttcagctgtgagaagaggtctgtgcagaagaaggagctgaacaagaagctggaggacagctgcaggaagaagctggccgagtttgaagatgagctggaccacacagtggacagcctgacctggaacctgacccccaaggccaaggagaggacccgggagcccctgaagaaggccagccagcccaggaacaagaactggatgaaccacctgcgggtgccccagcgggagctggaccggctgctgctggccaggatggagagcaggaaccacttcctgaagaacccccgcttcttcccccccaacaccaggtatggaggcaagagcctggtgtttcctcccaagaagccagcccccatcggggagttccagagcacagagcctgagcagagctgtgccgacacccctgtgttcctggccaagccacccatcggcttcttcacagattatgagatcggccctgtgtatgagatggtgattgccctgcagaacaccaccaccaccagccgctacctgcgggtgctgccccccagcaccccctactttgccctgggcctgggcatgtttcctgggaagggcggcatggtggcccctggcatgacctgccagtacatcgtgcagttcttcccagactgcctgggggactttgatgacttcatcctggtggagacccagagcgcccacaccctgctgatccccctgcaggcccggcggcccccacctgtgctgaccctgagccctgtgctggactgtggctactgcctgattggaggagtgaagatgacccgcttcatctgcaagaatgtgggcttctctgtgggccgcttctgcatcatgcccaagacctcctggccacccctgtccttcaaggccatcgccaccgtgggctttgtggagcagcccccatttggcatcctgcccagcgtgtttgagctggcccctggccacgccatcctggtggaggtgctcttcagccccaagagcctgggcaaggccgagcagaccttcatcatcatgtgtgacaactgccagatcaaggagctggtgaccatcggcatcggccagctgattgccctggacctgatctacatctctggagagaagagccagcctgaccctggagagctgacagacctgacagcccagcacttcatccgctttgagcctgagaacctgcggagcacagccaggaagcagctgatcatcagaaatgccacccacgtggagctggccttctactggcagatcatgaagcccaacctgcagcccctgatgcctggagagaccttctccatggacagcatcaagtgctacccagacaaggagacagccttcagcatcatgcccaggaaaggagtgctgagcccccacacagaccacgagttcatcctgtccttcagcccccatgagctgcgggacttccacagcgtgctgcagatggtgctggaggaggtgcctgagcctgtgtcctctgaggccgagagcctgggccacagcagctacagcgtggatgatgtgattgtgctggagattgaggtgaagggctctgtggagcccttccaggtgctgctggagccctatgccctgatcatccctggagagaactacatcggcatcaacgtgaagaaggccttcaagatgtggaacaacagcaagagccccatccgctacctgtggggcaagatcagtgactgccacatcatcgaggtggagcccggcaccggggtgattgagcccagcgaggtgggggactttgagctgaacttcaccggcggcgtgcccggccccaccagccaggacctgctgtgtgaaattgaggacagccccagccctgtggtgctgcacatcgaggccgtgttcaagggccctgccctgatcatcaacgtgtctgccctgcagtttggcctgctgcggctgggccagaaggccaccaacagcatccagatcagaaatgtgtcccagctgcctgccacctggaggatgaaggagagccctgtgtccctgcaggagaggccagaagatgtgagcccctttgacatcgagcccagcagcggccagctgcacagcctgggggagtgccgggtggacatcaccctggaggccctgcactgccagcacctggagaccgtgctggagctggaggtggagaatggagcctggagctacctgcctgtgtatgcagaggtgcagaagccccacgtgtacctgcagagcagccaggtggaggtgaggaacctgtacctgggcgtgcccaccaagaccaccatcaccctcatcaatggcaccctgctgcccacccagttccactggggcaagctgctgggccaccaggccgagttctgcatggtgacagtgagccccaagcacggcctgctgggccccagcgaggagtgccagctgaagctggagctgacagcccacacccaggaggagctgacccacctggccctgccctgccacgtgtctggcatgaagaagcccctggtgctgggcatcagcggcaagccccagggcctgcaggtggccatcaccatcagcaaggagagcagtgactgcagcgtcttcagcacagagcagtggccaggccaccccaaggagctgcggctggactttggatctgctgtgcccctgcggaccagggtgacccggcagctgatcctgaccaacagaagccccatccgcacccgcttcagcctgaagtttgagtacttcggcagcccccagaacagcctgagcaagaagaccagcctgcccaacatgcccccagccctgctgaagacagtgaggatgcaggagcacctggccaagcgggagcagctggacttcatggagagcatgctgagccatggaaaaggagctgccttcttcccccacttcagccagggcatgctgggcccctaccagcagctgtgcatcgacatcaccggctgtgccaacatgtggggcgagtactgggacaacctgatctgcaccgtgggggacctgctgcctgaggtgattcctgtgcacatggctgctgtgggctgccccatcagcagcctgcggaccaccagctacaccatcgaccaggcccagaaggagcccgccatgagatttggcacccaggtgtctggaggagacacagtgaccaggaccctgcggctgaacaacagcagcccctgtgacatccggctggactgggagacctacgtgcctgaggacaaggaggaccggctggtggagctgctggtgttctacggcccccccttccccctgcgggaccaggccggaaatgagctggtgtgcccagacaccccagagggcggctgcctgctgtggagccctggccccagcagcagcagcgagttcagccatgaaacagacagctctgtggagggcagcagcagcgccagcaacagagtggcccagaagctgatcagcgtcatcctgcaggcccacgagggcgtgcccagcggccacctgtactgcatcagccccaagcaggtggtggtgcctgctgggggcagcagcaccatctacatctccttcacccccatggtgctgagccctgagatcctgcacaaggtggagtgcaccggctacgccctgggcttcatgagcctggacagcaaggtggagcgggagatccctgggaagaggcaccggctgcaggactttgctgtgggccccctgaagctggacctgcacagctatgtgcggcctgcccagctgtctgtggagctggactatggaggctccatggagttccagtgccaggccagtgacctgatccctgagcagccctgcagcggcgtgctgtctgagctggtgaccacccaccacctgaagctgaccaacaccacagagatcccccactacttccggctgatggtgtcccggcccttctctgtgtcccaggatggagccagccaggaccaccgggcccctggccctggccagaagcaggagtgtgaggaggagacagccagcgctgacaagcagctggtgctgcaggcccaggagaacatgctggtgaatgtgtccttcagcctgagcctggagctgctgagctaccagaagctgcctgctgaccagaccctgcccggggtggacatccagcagagcgccagcggggagcgggagatggtgttcacccagaacctgctgctggagtacaccaaccagaccacccaggtggtgcccctgcgggctgtggtggccgtgcctgagctgcagctgagcacctcctgggtggactttggcacctgctttgtgtcccagcagagggtgcgggaggtgtacctgatgaacctgagcggctgccgcagctactggaccatgctgatgggccagcaggagcccgccaaggctgctgtggccttccgggtgagccccaacagcggcctgctggaggcccggagcgccaatgccccacccaccagcatcgccctgcaggtgttcttcaccgcccggagcagcgagctgtatgagagcaccatggtggtggagggcgtgctgggggagaagagctgcaccctgcggctgcggggccagggcagctatgatgagcgctacatgctgccccaccagccctag

SEQ ID NO: 19356 - DNA, 237 bp, Artificial Sequence
  Description of Artificial Sequence: Synthetic coding sequence
atgaggccctgcatctggatccacgtgcacctgaagccaccctgccgcctggtggagctgctgcccttcagcagcgccctgcagggcctgagccacctgagcctgggcaccaccctgcccgtcatcctgcctgagagaaatgaggagcagaacctgcaggagctgagccacaatgctgacaagtaccagatgggagactgctgcaaggaggagattgatgacagcatcttctactag

SEQ ID NO: 19357 - DNA, 2940 bp, Artificial Sequence
  Description of Artificial Sequence: Synthetic coding sequence
atgaggggctaccatggagaccggggcagccaccccaggcctgccaggtttgctgaccagcagcacatggatgtgggccctgctgcccgggccccctacctgctgggcagccgggaggccttcagcacagagccccgcttctgtgccccccgggccggcctgggccacatcagccctgagggccccctgagcctgtctgagggccccagcgtgggccctgagggcggccctgctggggccggcgtgggcggcggcagcagcaccttccccaggatgtacccaggccagggcccctttgacacctgtgaggactgtgtgggccacccccagggcaagggggccccccggctgccccccaccctgctggaccagtttgagaagcagctgcctgtgcagcaggacggcttccacaccctgccctaccagaggggccctgctggggccggccctggccctgcccctggcaccggcacagcccctgagcccaggtctgagagccccagccgcatccgccacctggtgcacagcgtgcagaagctgtttgccaagagccacagcctggaggcccctgggaagagggactacaacggccccaaggccgagggccggggcggcagcggcggggacagctacccaggccctggcagcggcggcccccacaccagccaccaccaccaccaccaccaccaccaccaccaccaccagagccgccacggcaagaggagcaagagcaaggacagaaaaggagatggccgccaccaggccaagagcacaggctggtggagcagtgatgacaacctggacagcgacagcggcttcctggccggcggccggcccccaggagagcccggcggccccttctgcctggagggcccagatggcagctacagagacctgtccttcaagggccgcagcggcggcagcgagggccgctgcctggcctgcaccggcatgtccatgagcctggatggccagagcgtgaagaggtctgcctggcacaccatgatggtgtcccagggcagagatggctacccaggagctggccctgggaagggcctgctgggccctgagaccaaggccaaggcccggacctaccactacctgcaggtgccccaggatgactggggcggctaccccaccggcggcaaggatggagagatcccctgcaggaggatgaggagcggcagctacatcaaggccatgggagatgaggagagcggggacagtgatggcagccccaagaccagccccaaggctgtggcccggcgcttcaccaccaggaggagcagctctgtggaccaggcccgcatcaactgctgcgtgcccccacgcatccaccccaggagcagcatccctggctacagccgcagcctgaccaccggccagctgagtgatgagctgaaccagcagctggaggccgtgtgtggctctgtgtttggagagctggagagccaggccgtggatgccctggacctgcccggctgcttcaggatgaggagccacagctacctgcgggccatccaggccggctgcagccaggatgatgactgcctgcccctgctggccaccccagctgctgtgtctggccggcccggcagcagcttcaacttcaggaaggcccccccacccatccccccaggcagccaggccccaccccgcatcagcatcacagcccagagcagcacagacagcgcccacgagagcttcaccgctgctgagggccctgcccggcgctgcagcagcgcagatggcctggatggccctgccatgggcgcccggaccctggagctggcccctgtgcccccccgggccagccccaagccacccaccctcatcatcaagaccatccctggccgggaggagctgcggagcctggcccggcagaggaagtggaggcccagcattggagtgcaggtggagaccatcagtgacagcgacacagagaacagaagccggcgggagttccacagcattggagtgcaggtggaggaggacaagagaagagcccgcttcaagaggagcaacagcgtgacagctggggtgcaggccgacctggagctggagggcctggccggcctggccaccgtggccacagaggacaaggccctgcagtttggccgctccttccagagacatgccagcgagccccagcccggcccccgggcccccacctacagcgtcttcagaacagtgcacacccagggccagtgggcctaccgggagggctaccccctgccctatgagcccccagccacagatggcagccctggccctgccccagcccccaccccaggccctggggccggccggcgggacagctggattgagcggggcagccgcagcctgcctgattctggccgggccagcccctgccccagagatggagagtggttcatcaagatgctgcgggcagaggtggagaagctggagcactggtgccagcagatggagcgggaggctgaagattatgagctgcctgaggagatcctggagaagatccgctctgctgtgggcagcacccagctgctgctgagccagaaggtgcagcagttcttccggctgtgccagcagagcatggaccccacagccttccctgtgcccaccttccaggacctggccggcttctgggacctgctgcagctgagcattgaagatgtgaccctgaagttcctggagctgcagcagctgaaggccaacagctggaagctgctggagcccaaggaggagaagaaggtgcccccacccatccccaagaagcccctgcggggccggggcgtgcctgtgaaggagaggagcctggacagcgtggaccggcagaggcaggaggccaggaagaggctgctggccgccaagagagctgccagcttccgccacagcagcgccacagagagcgctgacagcattgagatctacatccctgaggcccagacccggctgtag

SEQ ID NO: 19358 - DNA, 5358 bp, Artificial Sequence
  Description of Artificial Sequence: Synthetic coding sequence
atgggcatcagcaccgtcatcctggagatgtgcctgctgtggggccaggtgctgagcactggaggctggatccccaggaccacagattatgccagcctcatccccagcgaggtgcccctggaccccaccgtggccgagggcagccccttccccagcgagagcaccctggagagcacagtggccgagggcagccccatcagcctggagagcaccctggagagcacagtggccgagggcagcctcatccccagcgagagcaccctggagagcacagtggccgagggcagtgacagcggcctggccctgcggctggtgaatggagatggccgctgccagggccgggtggagatcctgtaccggggctcctggggcaccgtgtgtgatgacagctgggacaccaatgatgccaacgtggtgtgccggcagctgggctgcggctgggccatgtctgcccctggaaatgcctggtttggccagggcagcggccccatcgccctggatgatgtgcgctgcagcggccacgagagctacctgtggagctgcccccacaacggctggctgagccacaactgtggccatggagaagatgctggggtcatctgcagcgctgcccagccccagagcaccctgcggcctgagagctggcctgtgcgcatcagcccccctgtgcccacagagggcagcgagagcagcctggccctgcggctggtgaatggaggagaccgctgccggggccgggtggaggtgctgtaccggggctcctggggcaccgtgtgtgatgactactgggacaccaatgatgccaacgtggtgtgccggcagctgggctgcggctgggccatgtctgcccctggaaatgcccagtttggccagggcagcggccccatcgtgctggatgatgtgcgctgcagcggccacgagagctacctgtggagctgcccccacaacggctggctgacccacaactgtggccacagtgaagatgctggggtcatctgcagcgccccccagagccggcccacccccagcccagacacctggcccaccagccacgccagcacagctggccctgagagcagcctggccctgcggctggtgaatggaggagaccgctgccagggccgggtggaggtgctgtaccggggctcctggggcaccgtgtgtgatgacagctgggacaccagtgatgccaacgtggtgtgccggcagctgggctgcggctgggccaccagcgcccctggaaatgcccgcttcggccagggcagcggccccatcgtgctggatgatgtgcgctgcagcggctatgagagctacctgtggagctgcccccacaacggctggctgagccacaactgccagcacagtgaagatgctggggtcatctgcagcgctgcccacagctggagcacccccagcccagacaccctgcccaccatcaccctgcctgccagcacagtgggcagcgagagcagcctggccctgcggctggtgaatggaggagaccgctgccagggccgggtggaggtgctgtaccagggctcctggggcaccgtgtgtgatgacagctgggacaccaatgatgccaacgtggtgtgccggcagctgggctgcggctgggccatgtctgcccctggaaatgccaggtttggccagggcagcggccccatcgtgctggatgatgtgcgctgcagcggccacgagagctacctgtggagctgcccccacaacggctggctgagccacaactgtggccacagtgaagatgctggggtcatctgcagcgccagccagagccggcccacccccagcccagacacctggcccaccagccacgccagcacagctggcagcgagagcagcctggccctgcggctggtgaatggaggagaccgctgccagggccgggtggaggtgctgtaccggggctcctggggcaccgtgtgtgatgactactgggacaccaatgatgccaacgtggtgtgccggcagctgggctgcggctgggccatgtctgcccctggaaatgcccgcttcggccagggcagcggccccatcgtgctggatgatgtgcgctgcagcggccacgagagctacctgtggagctgcccccacaacggctggctgagccacaactgtggccaccatgaagatgctggggtcatctgcagcgccagccagagccagcccacccccagcccagacacctggcccaccagccacgccagcacagctggcagcgagagcagcctggccctgcggctggtgaatggaggagaccgctgccagggccgggtggaggtgctgtaccggggctcctggggcaccgtgtgtgatgactactgggacaccaatgatgccaacgtggtgtgccggcagctgggctgcggctgggccaccagcgcccctggaaatgccaggtttggccagggcagcggccccatcgtgctggatgatgtgcgctgcagcggccacgagagctacctgtggagctgcccccacaacggctggctgagccacaactgtggccaccatgaagatgctggggtcatctgcagcgccagccagagccagcccacccccagcccagacacctggcccaccagccgggccagcacagctggcagcgagagcaccctggccctgcggctggtgaatggaggagaccgctgccggggccgggtggaggtgctgtaccagggctcctggggcaccgtgtgtgatgactactgggacaccaatgatgccaacgtggtgtgccggcagctgggctgcggctgggccatgtctgcccctggaaatgcccagtttggccagggcagcggccccatcgtgctggatgatgtgcgctgcagcggccacgagagctacctgtggagctgcccccacaacggctggctgagccacaactgtggccaccatgaagatgctggggtcatctgcagcgctgcccagagccagagcacccccaggccagacacctggctgaccaccaacctgcctgccctgactgtgggcagcgagagcagcctggccctgcggctggtgaatggaggagaccgctgccggggccgggtggaggtgctgtaccggggctcctggggcaccgtgtgtgatgacagctgggacaccaatgatgccaacgtggtgtgccggcagctgggctgcggctgggccatgtctgcccctggaaatgccaggtttggccagggcagcggccccatcgtgctggatgatgtgcgctgcagcggaaatgaaagctacctgtggagctgcccccacaagggctggctgacccacaactgtggccaccatgaagatgctggggtcatctgcagcgccacccagatcaacagcaccaccacagactggtggcaccccaccaccaccaccacagcccggcccagcagcaactgtggcggcttcctgttctacgccagcggcaccttcagcagccccagctacccagcctactaccccaacaatgccaagtgtgtgtgggagattgaggtgaacagcggctaccgcatcaacctgggcttcagcaacctgaagctggaggcccaccacaactgcagctttgattatgtggagatctttgatggcagcctgaacagcagcctgctgctgggcaagatctgcaatgacacccggcagatcttcaccagcagctacaacaggatgaccatccacttcagaagtgacatctccttccagaacacaggcttcctggcctggtacaacagcttccccagtgatgccaccctgcggctggtgaacctgaacagcagctatggcctgtgtgccggccgggtggagatctaccatggaggcacctggggcaccgtgtgtgatgacagctggaccatccaggaggccgaggtggtgtgccggcagctgggctgcggccgggctgtgtctgccctgggcaatgcctactttggaagtggcagcggccccatcaccctggatgatgtggagtgcagcggcacagagagcaccctgtggcagtgcaggaacagaggctggttcagccacaactgcaaccacagagaagatgctggggtcatctgcagcggcaaccacctgagcaccccagcccccttcctgaacatcacccggcccaacacagactacagctgtggcggcttcctgagccagcccagcggggacttcagcagccccttctacccaggcaactaccccaacaatgccaagtgtgtgtgggacatcgaggtgcagaacaactacagagtgaccgtcatcttcagagatgtgcagctggagggcggctgcaactatgactacatcgaggtgtttgatggcccctaccgcagcagccccctgattgcccgggtgtgtgatggagcccggggcagcttcaccagcagcagcaacttcatgagcatccgcttcatcagtgaccacagcatcacccggcggggcttccgggcagagtactacagcagccccagcaatgacagcaccaacctgctgtgcctgcccaaccacatgcaggcctctgtgagccgcagctacctgcagagcctgggcttcagcgccagtgacctggtgatcagcacctggaatggctactatgaatgtcggccccagatcacccccaacctggtgatcttcaccatcccctacagcggctgcggcaccttcaagcaggccgacaatgacaccatcgactacagcaacttcctgacagctgctgtgtctgggggcatcatcaagagaagaacagacctgcgcatccacgtgtcctgcaggatgctgcagaacacctgggtggacaccatgtacatcgccaatgacaccatccacgtggccaacaacaccatccaggtggaggaggtgcagtatggcaactttgatgtgaacatctccttctacaccagcagcagcttcctgtaccctgtgaccagccggccctactacgtggacctgaaccaggacctgtatgtgcaggccgagatcctgcacagtgatgctgtgctgaccctgtttgtggacacctgtgtggccagcccctacagcaatgacttcaccagcctgacctatgacctgatccgcagcggctgtgtgagagatgacacctacggcccctacagcagccccagcctgagaattgcccgcttccgcttccgggccttccacttcctgaaccgcttccccagcgtgtacctgcgctgcaagatggtggtgtgccgggcctatgaccccagcagccgctgctaccggggctgtgtgctgcggagcaagagagatgtgggcagctaccaggagaaggtggatgtggtgctgggccccatccagctgcagaccccaccaagaagagaggaggagcccaggtag

SEQ ID NO: 19359 - DNA, 5358 bp, Artificial Sequence; identical to SEQ ID NO: 19358
  Description of Artificial Sequence: Synthetic coding sequence

SEQ ID NO: 19360 - DNA, 7242 bp, Artificial Sequence
  Description of Artificial Sequence: Synthetic coding sequence
atgggcatcagcaccgtcatcctggagatgtgcctgctgtggggccaggtgctgagcactggaggctggatccccaggaccacagattatgccagcctcatccccagcgaggtgcccctggaccccaccgtggccgagggcagccccttccccagcgagagcaccctggagagcacagtggccgagggcagccccatcagcctggagagcaccctggagagcacagtggccgagggcagcctcatccccagcgagagcaccctggagagcacagtggccgagggcagtgacagcggcctggccctgcggctggtgaatggagatggccgctgccagggccgggtggagatcctgtaccggggctcctggggcaccgtgtgtgatgacagctgggacaccaatgatgccaacgtggtgtgccggcagctgggctgcggctgggccatgtctgcccctggaaatgcctggtttggccagggcagcggccccatcgccctggatgatgtgcgctgcagcggccacgagagctacctgtggagctgcccccacaacggctggctgagccacaactgtggccatggagaagatgctggggtcatctgcagcgctgcccagccccagagcaccctgcggcctgagagctggcctgtgcgcatcagcccccctgtgcccacagagggcagcgagagcagcctggccctgcggctggtgaatggaggagaccgctgccggggccgggtggaggtgctgtaccggggctcctggggcaccgtgtgtgatgactactgggacaccaatgatgccaacgtggtgtgccggcagctgggctgcggctgggccatgtctgcccctggaaatgcccagtttggccagggcagcggccccatcgtgctggatgatgtgcgctgcagcggccacgagagctacctgtggagctgcccccacaacggctggctgacccacaactgtggccacagtgaagatgctggggtcatctgcagcgccccccagagccggcccacccccagcccagacacctggcccaccagccacgccagcacagctggccctgagagcagcctggccctgcggctggtgaatggaggagaccgctgccagggccgggtggaggtgctgtaccggggctcctggggcaccgtgtgtgatgacagctgggacaccagtgatgccaacgtggtgtgccggcagctgggctgcggctgggccaccagcgcccctggaaatgcccgcttcggccagggcagcggccccatcgtgctggatgatgtgcgctgcagcggctatgagagctacctgtggagctgcccccacaacggctggctgagccacaactgccagcacagtgaagatgctggggtcatctgcagcgctgcccacagctggagcacccccagcccagacaccctgcccaccatcaccctgcctgccagcacagtgggcagcgagagcagcctggccctgcggctggtgaatggaggagaccgctgccagggccgggtggaggtgctgtaccggggctcctggggcaccgtgtgtgatgacagctgggacaccaatgatgccaacgtggtgtgccggcagctgggctgcggctgggccatgctggcccctggaaatgccaggtttggccagggcagcggccccatcgtgctggatgatgtgcgctgcagcggaaatgaaagctacctgtggagctgcccccacaacggctggctgagccacaactgtggccacagtgaagatgctggggtcatctgcagcggccctgagagcagcctggccctgcggctggtgaatggaggagaccgctgccagggccgggtggaggtgctgtaccggggctcctggggcaccgtgtgtgatgacagctgggacaccaatgatgccaacgtggtgtgccggcagctgggctgcggctgggccaccagcgcccctggaaatgccaggtttggccagggcagcggccccatcgtgctggatgatgtgcgctgcagcggccacgagagctacctgtggagctgccccaacaacggctggctgagccacaactgtggccaccatgaagatgctggggtcatctgcagcgctgcccagagccgcagcacccccaggccagacaccctgagcaccatcaccctgccccccagcacagtgggcagcgagagcagcctgaccctgcggctggtgaatggaagtgaccgctgccagggccgggtggaggtgctgtaccggggctcctggggcaccgtgtgtgatgacagctgggacaccaatgatgccaacgtggtgtgccggcagctgggctgcggctgggccaccagcgcccctggaaatgcccgcttcggccagggcagcggccccatcgtgctggatgatgtgcgctgcagcggccacgagagctacctgtggagctgcccccacaacggctggctgagccacaactgtggccaccatgaagatgctggggtcatctgcagcgtgtcccagagccggcccacccccagcccagacacctggcccaccagccacgccagcacagctggccctgagagcagcctggccctgcggctggtgaatggaggagaccgctgccagggccgggtggaggtgctgtaccggggctcctggggcaccgtgtgtgatgacagctgggacaccagtgatgccaacgtggtgtgccggcagctgggctgcggctgggccaccagcgcccctggaaatgccaggtttggccagggcagcggccccatcgtgctggatgatgtgcgctgcagcggctatgagagctacctgtggagctgcccccacaacggctggctgagccacaactgccagcacagtgaagatgctggggtcatctgcagcgctgcccacagctggagcacccccagcccagacaccctgcccaccatcaccctgcctgccagcacagtgggcagcgagagcagcctggccctgcggctggtgaatggaggagaccgctgccagggccgggtggaggtgctgtaccagggctcctggggcaccgtgtgtgatgacagctgggacaccaatgatgccaacgtggtgtgccggcagctgggctgcggctgggccatgtctgcccctggaaatgcccgcttcggccagggcagcggccccatcgtgctggatgatgtgcgctgcagcggccacgagagctacctgtggagctgcccccacaacggctggctgagccacaactgtggccacagtgaagatgctggggtcatctgcagcgccagccagagccggcccacccccagcccagacacctggcccaccagccacgccagcacagctggcagcgagagcagcctggccctgcggctggtgaatggaggagaccgctgccagggccgggtggaggtgctgtaccggggctcctggggcaccgtgtgtgatgactactgggacaccaatgatgccaacgtggtgtgccggcagctgggctgcggctgggccatgtctgcccctggaaatgccaggtttggccagggcagcggccccatcgtgctggatgatgtgcgctgcagcggccacgagagctacctgtggagctgcccccacaacggctggctgagccacaactgtggccaccatgaagatgctggggtcatctgcagcgccagccagagccagcccacccccagcccagacacctggcccaccagccacgccagcacagctggcagcgagagcagcctggccctgcggctggtgaatggaggagaccgctgccagggccgggtggaggtgctgtaccggggctcctggggcaccgtgtgtgatgactactgggacaccaatgatgccaacgtggtgtgccggcagctgggctgcggctgggccaccagcgcccctggaaatgcccgcttcggccagggcagcggccccatcgtgctggatgatgtgcgctgcagcggccacgagagctacctgtggagctgcccccacaacggctggctgagccacaactgtggccaccatgaagatgctggggtcatctgcagcgccagccagagccagcccacccccagcccagacacctggcccaccagccacgccagcacagctggcagcgagagcagcctggccctgcggctggtgaatggaggagaccgctgccagggccgggtggaggtgctgtaccggggctcctggggcaccgtgtgtgatgactactgggacaccaatgatgccaacgtggtgtgccggcagctgggctgcggctgggccaccagcgcccctggaaatgccaggtttggccagggcagcggccccatcgtgctggatgatgtgcgctgcagcggccacgagagctacctgtggagctgcccccacaacggctggctgagccacaactgtggccaccatgaagatgctggggtcatctgcagcgccagccagagccagcccacccccagcccagacacctggcccaccagccgggccagcacagctggcagcgagagcaccctggccctgcggctggtgaatggaggagaccgctgccggggccgggtggaggtgctgtaccagggctcctggggcaccgtgtgtgatgactactgggacaccaatgatgccaacgtggtgtgccggcagctgggctgcggctgggccatgtctgcccctggaaatgcccagtttggccagggcagcggccccatcgtgctggatgatgtgcgctgcagcggccacgagagctacctgtggagctgcccccacaacggctggctgagccacaactgtggccaccatgaagatgctggggtcatctgcagcgctgcccagagccagagcacccccaggccagacacctggctgaccaccaacctgcctgccctgactgtgggcagcgagagcagcctggccctgcggctggtgaatggaggagaccgctgccggggccgggtggaggtgctgtaccggggctcctggggcaccgtgtgtgatgacagctgggacaccaatgatgccaacgtggtgtgccggcagctgggctgcggctgggccatgtctgcccctggaaatgccaggtttggccagggcagcggccccatcgtgctggatgatgtgcgctgcagcggaaatgaaagctacctgtggagctgcccccacaagggctggctgacccacaactgtggccaccatgaagatgctggggtcatctgcagcgccacccagatcaacagcaccaccacagactggtggcaccccaccaccaccaccacagcccggcccagcagcaactgtggcggcttcctgttctacgccagcggcaccttcagcagccccagctacccagcctactaccccaacaatgccaagtgtgtgtgggagattgaggtgaacagcggctaccgcatcaacctgggcttcagcaacctgaagctggaggcccaccacaactgcagctttgattatgtggagatctttgatggcagcctgaacagcagcctgctgctgggcaagatctgcaatgacacccggcagatcttcaccagcagctacaacaggatgaccatccacttcagaagtgacatctccttccagaacacaggcttcctggcctggtacaacagcttccccagtgatgccaccctgcggctggtgaacctgaacagcagctatggcctgtgtgccggccgggtggagatctaccatggaggcacctggggcaccgtgtgtgatgacagctggaccatccaggaggccgaggtggtgtgccggcagctgggctgcggccgggctgtgtctgccctgggcaatgcctactttggaagtggcagcggccccatcaccctggatgatgtggagtgcagcggcacagagagcaccctgtggcagtgcaggaacagaggctggttcagccacaactgcaaccacagagaagatgctggggtcatctgcagcggcaaccacctgagcaccccagcccccttcctgaacatcacccggcccaacacagactacagctgtggcggcttcctgagccagcccagcggggacttcagcagccccttctacccaggcaactaccccaacaatgccaagtgtgtgtgggacatcgaggtgcagaacaactacagagtgaccgtcatcttcagagatgtgcagctggagggcggctgcaactatgactacatcgaggtgtttgatggcccctaccgcagcagccccctgattgcccgggtgtgtgatggagcccggggcagcttcaccagcagcagcaacttcatgagcatccgcttcatcagtgaccacagcatcacccggcggggcttccgggcagagtactacagcagccccagcaatgacagcaccaacctgctgtgcctgcccaaccacatgcaggcctctgtgagccgcagctacctgcagagcctgggcttcagcgccagtgacctggtgatcagcacctggaatggctactatgaatgtcggccccagatcacccccaacctggtgatcttcaccatcccctacagcggctgcggcaccttcaagcaggccgacaatgacaccatcgactacagcaacttcctgacagctgctgtgtctgggggcatcatcaagagaagaacagacctgcgcatccacgtgtcctgcaggatgctgcagaacacctgggtggacaccatgtacatcgccaatgacaccatccacgtggccaacaacaccatccaggtggaggaggtgcagtatggcaactttgatgtgaacatctccttctacaccagcagcagcttcctgtaccctgtgaccagccggccctactacgtggacctgaaccaggacctgtatgtgcaggccgagatcctgcacagtgatgctgtgctgaccctgtttgtggacacctgtgtggccagcccctacagcaatgacttcaccagcctgacctatgacctgatccgcagcggctgtgtgagagatgacacctacggcccctacagcagccccagcctgagaattgcccgcttccgcttccgggccttccacttcctgaaccgcttccccagcgtgtacctgcgctgcaagatggtggtgtgccgggcctatgaccccagcagccgctgctaccggggctgtgtgctgcggagcaagagagatgtgggcagctaccaggagaaggtggatgtggtgctgggccccatccagctgcagaccccaccaagaagagaggaggagcccaggtag

SEQ ID NO: 19361 - DNA, 5358 bp, Artificial Sequence; identical to SEQ ID NO: 19358
  Description of Artificial Sequence: Synthetic coding sequence

SEQ ID NO: 19362 - DNA, 7242 bp, Artificial Sequence; identical to SEQ ID NO: 19360
  Description of Artificial Sequence: Synthetic coding sequence

SEQ ID NO: 19363 - DNA, 7242 bp, Artificial Sequence; identical to SEQ ID NO: 19360
  Description of Artificial Sequence: Synthetic coding sequence

SEQ ID NO: 19364 - DNA, 7212 bp, Artificial Sequence
  Description of Artificial Sequence: Synthetic coding sequence
atgggcatcagcaccgtcatcctggagatgtgcctgctgtggggccaggtgctgagcactggaggctggatccccaggaccacagattatgccagcctcatccccagcgaggtgcccctggaccccaccgtggccgagggcagccccttccccagcgagagcaccctggagagcacagtggccgagggcagccccatcagcctggagagcaccctggagagcacagtggccgagggcagcctcatccccagcgagagcaccctggagagcacagtggccgagggcagtgacagcggcctggccctgcggctggtgaatggagatggccgctgccagggccgggtggagatcctgtaccggggctcctggggcaccgtgtgtgatgacagctgggacaccaatgatgccaacgtggtgtgccggcagctgggctgcggctgggccatgtctgcccctggaaatgcctggtttggccagggcagcggccccatcgccctggatgatgtgcgctgcagcggccacgagagctacctgtggagctgcccccacaacggctggctgagccacaactgtggccatggagaagatgctggggtcatctgcagcgctgcccagccccagagcaccctgcggcctgagagctggcctgtgcgcatcagcccccctgtgcccacagagggcagcgagagcagcctggccctgcggctggtgaatggaggagaccgctgccggggccgggtggaggtgctgtaccggggctcctggggcaccgtgtgtgatgactactgggacaccaatgatgccaacgtggtgtgccggcagctgggctgcggctgggccatgtctgcccctggaaatgcccagtttggccagggcagcggccccatcgtgctggatgatgtgcgctgcagcggccacgagagctacctgtggagctgcccccacaacggctggctgacccacaactgtggccacagtgaagatgctggggtcatctgcagcgccccccagagccggcccacccccagcccagacacctggcccaccagccacgccagcacagctggccctgagagcagcctggccctgcggctggtgaatggaggagaccgctgccagggccgggtggaggtgctgtaccggggctcctggggcaccgtgtgtgatgacagctgggacaccagtgatgccaacgtggtgtgccggcagctgggctgcggctgggccaccagcgcccctggaaatgcccgcttcggccagggcagcggccccatcgtgctggatgatgtgcgctgcagcggctatgagagctacctgtggagctgcccccacaacggctggctgagccacaactgccagcacagtgaagatgctggggtcatctgcagcgacaccctgcccaccatcaccctgcctgccagcacagtgggcagcgagagcagcctggccctgcggctggtgaatggaggagaccgctgccagggccgggtggaggtgctgtaccggggctcctggggcaccgtgtgtgatgacagctgggacaccaatgatgccaacgtggtgtgccggcagctgggctgcggctgggccatgctggcccctggaaatgccaggtttggccagggcagcggccccatcgtgctggatgatgtgcgctgcagcggaaatgaaagctacctgtggagctgcccccacaacggctggctgagccacaactgtggccacagtgaagatgctggggtcatctgcagcggccctgagagcagcctggccctgcggctggtgaatggaggagaccgctgccagggccgggtggaggtgctgtaccggggctcctggggcaccgtgtgtgatgacagctgggacaccaatgatgccaacgtggtgtgccggcagctgggctgcggctgggccaccagcgcccctggaaatgccaggtttggccagggcagcggccccatcgtgctggatgatgtgcgctgcagcggccacgagagctacctgtggagctgccccaacaacggctggctgagccacaactgtggccaccatgaagatgctggggtcatctgcagcgctgcccagagccgcagcacccccaggccagacaccctgagcaccatcaccctgccccccagcacagtgggcagcgagagcagcctgaccctgcggctggtgaatggaagtgaccgctgccagggccgggtggaggtgctgtaccggggctcctggggcaccgtgtgtgatgacagctgggacaccaatgatgccaacgtggtgtgccggcagctgggctgcggctgggccaccagcgcccctggaaatgcccgcttcggccagggcagcggccccatcgtgctggatgatgtgcgctgcagcggccacgagagctacctgtggagctgcccccacaacggctggctgagccacaactgtggccaccatgaagatgctggggtcatctgcagcgtgtcccagagccggcccacccccagcccagacacctggcccaccagccacgccagcacagctggccctgagagcagcctggccctgcggctggtgaatggaggagaccgctgccagggccgggtggaggtgctgtaccggggctcctggggcaccgtgtgtgatgacagctgggacaccagtgatgccaacgtggtgtgccggcagctgggctgcggctgggccaccagcgcccctggaaatgccaggtttggccagggcagcggccccatcgtgctggatgatgtgcgctgcagcggctatgagagctacctgtggagctgcccccacaacggctggctgagccacaactgccagcacagtgaagatgctggggtcatctgcagcgctgcccacagctggagcacccccagcccagacaccctgcccaccatcaccctgcctgccagcacagtgggcagcgagagcagcctggccctgcggctggtgaatggaggagaccgctgccagggccgggtggaggtgctgtaccagggctcctggggcaccgtgtgtgatgacagctgggacaccaatgatgccaacgtggtgtgccggcagctgggctgcggctgggccatgtctgcccctggaaatgcccgcttcggccagggcagcggccccatcgtgctggatgatgtgcgctgcagcggccacgagagctacctgtggagctgcccccacaacggctggctgagccacaactgtggccacagtgaagatgctggggtcatctgcagcgccagccagagccggcccacccccagcccagacacctggcccaccagccacgccagcacagctggcagcgagagcagcctggccctgcggctggtgaatggaggagaccgctgccagggccgggtggaggtgctgtaccggggctcctggggcaccgtgtgtgatgactactgggacaccaatgatgccaacgtggtgtgccggcagctgggctgcggctgggccatgtctgcccctggaaatgccaggtttggccagggcagcggccccatcgtgctggatgatgtgcgctgcagcggccacgagagctacctgtggagctgcccccacaacggctggctgagccacaactgtggccaccatgaagatgctggggtcatctgcagcgccagccagagccagcccacccccagcccagacacctggcccaccagccacgccagcacagctggcagcgagagcagcctggccctgcggctggtgaatggaggagaccgctgccagggccgggtggaggtgctgtaccggggctcctggggcaccgtgtgtgatgactactgggacaccaatgatgccaacgtggtgtgccggcagctgggctgcggctgggccaccagcgcccctggaaatgcccgcttcggccagggcagcggccccatcgtgctggatgatgtgcgctgcagcggccacgagagctacctgtggagctgcccccacaacggctggctgagccacaactgtggccaccatgaagatgctggggtcatctgcagcgccagccagagccagcccacccccagcccagacacctggcccaccagccacgccagcacagctggcagcgagagcagcctggccctgcggctggtgaatggaggagaccgctgccagggccgggtggaggtgctgtaccggggctcctggggcaccgtgtgtgatgactactgggacaccaatgatgccaacgtggtgtgccggcagctgggctgcggctgggccaccagcgcccctggaaatgccaggtttggccagggcagcggccccatcgtgctggatgatgtgcgctgcagcggccacgagagctacctgtggagctgcccccacaacggctggctgagccacaactgtggccaccatgaagatgctggggtcatctgcagcgccagccagagccagcccacccccagcccagacacctggcccaccagccgggccagcacagctggcagcgagagcaccctggccctgcggctggtgaatggaggagaccgctgccggggccgggtggaggtgctgtaccagggctcctggggcaccgtgtgtgatgactactgggacaccaatgatgccaacgtggtgtgccggcagctgggctgcggctgggccatgtctgcccctggaaatgcccagtttggccagggcagcggccccatcgtgctggatgatgtgcgctgcagcggccacgagagctacctgtggagctgcccccacaacggctggctgagccacaactgtggccaccatgaagatgctggggtcatctgcagcgctgcccagagccagagcacccccaggccagacacctggctgaccaccaacctgcctgccctgactgtgggcagcgagagcagcctggccctgcggctggtgaatggaggagaccgctgccggggccgggtggaggtgctgtaccggggctcctggggcaccgtgtgtgatgacagctgggacaccaatgatgccaacgtggtgtgccggcagctgggctgcggctgggccatgtctgcccctggaaatgccaggtttggccagggcagcggccccatcgtgctggatgatgtgcgctgcagcggaaatgaaagctacctgtggagctgcccccacaagggctggctgacccacaactgtggccaccatgaagatgctggggtcatctgcagcgccacccagatcaacagcaccaccacagactggtggcaccccaccaccaccaccacagcccggcccagcagcaactgtggcggcttcctgttctacgccagcggcaccttcagcagccccagctacccagcctactaccccaacaatgccaagtgtgtgtgggagattgaggtgaacagcggctaccgcatcaacctgggcttcagcaacctgaagctggaggcccaccacaactgcagctttgattatgtggagatctttgatggcagcctgaacagcagcctgctgctgggcaagatctgcaatgacacccggcagatcttcaccagcagctacaacaggatgaccatccacttcagaagtgacatctccttccagaacacaggcttcctggcctggtacaacagcttccccagtgatgccaccctgcggctggtgaacctgaacagcagctatggcctgtgtgccggccgggtggagatctaccatggaggcacctggggcaccgtgtgtgatgacagctggaccatccaggaggccgaggtggtgtgccggcagctgggctgcggccgggctgtgtctgccctgggcaatgcctactttggaagtggcagcggccccatcaccctggatgatgtggagtgcagcggcacagagagcaccctgtggcagtgcaggaacagaggctggttcagccacaactgcaaccacagagaagatgctggggtcatctgcagcggcaaccacctgagcaccccagcccccttcctgaacatcacccggcccaacacagactacagctgtggcggcttcctgagccagcccagcggggacttcagcagccccttctacccaggcaactaccccaacaatgccaagtgtgtgtgggacatcgaggtgcagaacaactacagagtgaccgtcatcttcagagatgtgcagctggagggcggctgcaactatgactacatcgaggtgtttgatggcccctaccgcagcagccccctgattgcccgggtgtgtgatggagcccggggcagcttcaccagcagcagcaacttcatgagcatccgcttcatcagtgaccacagcatcacccggcggggcttccgggcagagtactacagcagccccagcaatgacagcaccaacctgctgtgcctgcccaaccacatgcaggcctctgtgagccgcagctacctgcagagcctgggcttcagcgccagtgacctggtgatcagcacctggaatggctactatgaatgtcggccccagatcacccccaacctggtgatcttcaccatcccctacagcggctgcggcaccttcaagcaggccgacaatgacaccatcgactacagcaacttcctgacagctgctgtgtctgggggcatcatcaagagaagaacagacctgcgcatccacgtgtcctgcaggatgctgcagaacacctgggtggacaccatgtacatcgccaatgacaccatccacgtggccaacaacaccatccaggtggaggaggtgcagtatggcaactttgatgtgaacatctccttctacaccagcagcagcttcctgtaccctgtgaccagccggccctactacgtggacctgaaccaggacctgtatgtgcaggccgagatcctgcacagtgatgctgtgctgaccctgtttgtggacacctgtgtggccagcccctacagcaatgacttcaccagcctgacctatgacctgatccgcagcggctgtgtgagagatgacacctacggcccctacagcagccccagcctgagaattgcccgcttccgcttccgggccttccacttcctgaaccgcttccccagcgtgtacctgcgctgcaagatggtggtgtgccgggcctatgaccccagcagccgctgctaccggggctgtgtgctgcggagcaagagagatgtgggcagctaccaggagaaggtggatgtggtgctgggccccatccagctgcagaccccaccaagaagagaggaggagcccaggtag

SEQ ID NO: 19365 - DNA, 1680 bp, Artificial Sequence
  Description of Artificial Sequence: Synthetic coding sequence
atgaccatccacttcagaagtgacatctccttccagaacacaggcttcctggcctggtacaacagcttccccagtgatgccaccctgcggctggtgaacctgaacagcagctatggcctgtgtgccggccgggtggagatctaccatggaggcacctggggcaccgtgtgtgatgacagctggaccatccaggaggccgaggtggtgtgccggcagctgggctgcggccgggctgtgtctgccctgggcaatgcctactttggaagtggcagcggccccatcaccctggatgatgtggagtgcagcggcacagagagcaccctgtggcagtgcaggaacagaggctggttcagccacaactgcaaccacagagaagatgctggggtcatctgcagcggcaaccacctgagcaccccagcccccttcctgaacatcacccggcccaacacagactacagctgtggcggcttcctgagccagcccagcggggacttcagcagccccttctacccaggcaactaccccaacaatgccaagtgtgtgtgggacatcgaggtgcagaacaactacagagtgaccgtcatcttcagagatgtgcagctggagggcggctgcaactatgactacatcgaggtgtttgatggcccctaccgcagcagccccctgattgcccgggtgtgtgatggagcccggggcagcttcaccagcagcagcaacttcatgagcatccgcttcatcagtgaccacagcatcacccggcggggcttccgggcagagtactacagcagccccagcaatgacagcaccaacctgctgtgcctgcccaaccacatgcaggcctctgtgagccgcagctacctgcagagcctgggcttcagcgccagtgacctggtgatcagcacctggaatggctactatgaatgtcggccccagatcacccccaacctggtgatcttcaccatcccctacagcggctgcggcaccttcaagcaggccgacaatgacaccatcgactacagcaacttcctgacagctgctgtgtctgggggcatcatcaagagaagaacagacctgcgcatccacgtgtcctgcaggatgctgcagaacacctgggtggacaccatgtacatcgccaatgacaccatccacgtggccaacaacaccatccaggtggaggaggtgcagtatggcaactttgatgtgaacatctccttctacaccagcagcagcttcctgtaccctgtgaccagccggccctactacgtggacctgaaccaggacctgtatgtgcaggccgagatcctgcacagtgatgctgtgctgaccctgtttgtggacacctgtgtggccagcccctacagcaatgacttcaccagcctgacctatgacctgatccgcagcggctgtgtgagagatgacacctacggcccctacagcagccccagcctgagaattgcccgcttccgcttccgggccttccacttcctgaaccgcttccccagcgtgtacctgcgctgcaagatggtggtgtgccgggcctatgaccccagcagccgctgctaccggggctgtgtgctgcggagcaagagagatgtgggcagctaccaggagaaggtggatgtggtgctgggccccatccagctgcagaccccaccaagaagagaggaggagcccaggtag

SEQ ID NO: 19366 - DNA, 3402 bp, Artificial Sequence
  Description of Artificial Sequence: Synthetic coding sequence
atgggcatcagcaccgtcatcctggagatgtgcctgctgtggggccaggtgctgagcactggaggctggatccccaggaccacagattatgccagcctcatccccagcgaggtgcccctggaccccaccgtggccgagggcagccccttccccagcgagagcaccctggagagcacagtggccgagggcagccccatcagcctggagagcaccctggagagcacagtggccgagggcagcctcatccccagcgagagcaccctggagagcacagtggccgagggcagtgacagcggcctggccctgcggctggtgaatggagatggccgctgccagggccgggtggagatcctgtaccggggctcctggggcaccgtgtgtgatgacagctgggacaccaatgatgccaacgtggtgtgccggcagctgggctgcggctgggccatgtctgcccctggaaatgcctggtttggccagggcagcggccccatcgccctggatgatgtgcgctgcagcggccacgagagctacctgtggagctgcccccacaacggctggctgagccacaactgtggccatggagaagatgctggggtcatctgcagcgccccccagagccggcccacccccagcccagacacctggcccaccagccacgccagcacagctggcagcgagagcagcctggccctgcggctggtgaatggaggagaccgctgccagggccgggtggaggtgctgtaccggggctcctggggcaccgtgtgtgatgactactgggacaccaatgatgccaacgtggtgtgccggcagctgggctgcggctgggccaccagcgcccctggaaatgcccgcttcggccagggcagcggccccatcgtgctggatgatgtgcgctgcagcggccacgagagctacctgtggagctgcccccacaacggctggctgagccacaactgtggccaccatgaagatgctggggtcatctgcagcgccagccagagccagcccacccccagcccagacacctggcccaccagccgggccagcacagctggcagcgagagcaccctggccctgcggctggtgaatggaggagaccgctgccggggccgggtggaggtgctgtaccagggctcctggggcaccgtgtgtgatgactactgggacaccaatgatgccaacgtggtgtgccggcagctgggctgcggctgggccatgtctgcccctggaaatgcccagtttggccagggcagcggccccatcgtgctggatgatgtgcgctgcagcggccacgagagctacctgtggagctgcccccacaacggctggctgagccacaactgtggccaccatgaagatgctggggtcatctgcagcgccacccagatcaacagcaccaccacagactggtggcaccccaccaccaccaccacagcccggcccagcagcaactgtggcggcttcctgttctacgccagcggcaccttcagcagccccagctacccagcctactaccccaacaatgccaagtgtgtgtgggagattgaggtgaacagcggctaccgcatcaacctgggcttcagcaacctgaagctggaggcccaccacaactgcagctttgattatgtggagatctttgatggcagcctgaacagcagcctgctgctgggcaagatctgcaatgacacccggcagatcttcaccagcagctacaacaggatgaccatccacttcagaagtgacatctccttccagaacacaggcttcctggcctggtacaacagcttccccagtgatgccaccctgcggctggtgaacctgaacagcagctatggcctgtgtgccggccgggtggagatctaccatggaggcacctggggcaccgtgtgtgatgacagctggaccatccaggaggccgaggtggtgtgccggcagctgggctgcggccgggctgtgtctgccctgggcaatgcctactttggaagtggcagcggccccatcaccctggatgatgtggagtgcagcggcacagagagcaccctgtggcagtgcaggaacagaggctggttcagccacaactgcaaccacagagaagatgctggggtcatctgcagcggcaaccacctgagcaccccagcccccttcctgaacatcacccggcccaacacagactacagctgtggcggcttcctgagccagcccagcggggacttcagcagccccttctacccaggcaactaccccaacaatgccaagtgtgtgtgggacatcgaggtgcagaacaactacagagtgaccgtcatcttcagagatgtgcagctggagggcggctgcaactatgactacatcgaggtgtttgatggcccctaccgcagcagccccctgattgcccgggtgtgtgatggagcccggggcagcttcaccagcagcagcaacttcatgagcatccgcttcatcagtgaccacagcatcacccggcggggcttccgggcagagtactacagcagccccagcaatgacagcaccaacctgctgtgcctgcccaaccacatgcaggcctctgtgagccgcagctacctgcagagcctgggcttcagcgccagtgacctggtgatcagcacctggaatggctactatgaatgtcggccccagatcacccccaacctggtgatcttcaccatcccctacagcggctgcggcaccttcaagcaggccgacaatgacaccatcgactacagcaacttcctgacagctgctgtgtctgggggcatcatcaagagaagaacagacctgcgcatccacgtgtcctgcaggatgctgcagaacacctgggtggacaccatgtacatcgccaatgacaccatccacgtggccaacaacaccatccaggtggaggaggtgcagtatggcaactttgatgtgaacatctccttctacaccagcagcagcttcctgtaccctgtgaccagccggccctactacgtggacctgaaccaggacctgtatgtgcaggccgagatcctgcacagtgatgctgtgctgaccctgtttgtggacacctgtgtggccagcccctacagcaatgacttcaccagcctgacctatgacctgatccgcagcggctgtgtgagagatgacacctacggcccctacagcagccccagcctgagaattgcccgcttccgcttccgggccttccacttcctgaaccgcttccccagcgtgtacctgcgctgcaagatggtggtgtgccgggcctatgaccccagcagccgctgctaccggggctgtgtgctgcggagcaagagagatgtgggcagctaccaggagaaggtggatgtggtgctgggccccatccagctgcagaccccaccaagaagagaggaggagcccaggtag

SEQ ID NO: 19367 - DNA, 7242 bp, Artificial Sequence; identical to SEQ ID NO: 19360
  Description of Artificial Sequence: Synthetic coding sequence

SEQ ID NO: 19368 - DNA, 7629 bp, Artificial Sequence
  Description of Artificial Sequence: Synthetic coding sequence
atgggcatcagcaccgtcatcctggagatgtgcctgctgtggggccaggtgctgagcactggaggctggatccccaggaccacagattatgccagcctcatccccagcgaggtgcccctggaccccaccgtggccgagggcagccccttccccagcgagagcaccctggagagcacagtggccgagggcagccccatcagcctggagagcaccctggagagcacagtggccgagggcagcctcatccccagcgagagcaccctggagagcacagtggccgagggcagtgacagcggcctggccctgcggctggtgaatggagatggccgctgccagggccgggtggagatcctgtaccggggctcctggggcaccgtgtgtgatgacagctgggacaccaatgatgccaacgtggtgtgccggcagctgggctgcggctgggccatgtctgcccctggaaatgcctggtttggccagggcagcggccccatcgccctggatgatgtgcgctgcagcggccacgagagctacctgtggagctgcccccacaacggctggctgagccacaactgtggccatggagaagatgctggggtcatctgcagcgctgcccagccccagagcaccctgcggcctgagagctggcctgtgcgcatcagcccccctgtgcccacagagggcagcgagagcagcctggccctgcggctggtgaatggaggagaccgctgccggggccgggtggaggtgctgtaccggggctcctggggcaccgtgtgtgatgactactgggacaccaatgatgccaacgtggtgtgccggcagctgggctgcggctgggccatgtctgcccctggaaatgcccagtttggccagggcagcggccccatcgtgctggatgatgtgcgctgcagcggccacgagagctacctgtggagctgcccccacaacggctggctgacccacaactgtggccacagtgaagatgctggggtcatctgcagcgccccccagagccggcccacccccagcccagacacctggcccaccagccacgccagcacagctggccctgagagcagcctggccctgcggctggtgaatggaggagaccgctgccagggccgggtggaggtgctgtaccggggctcctggggcaccgtgtgtgatgacagctgggacaccagtgatgccaacgtggtgtgccggcagctgggctgcggctgggccaccagcgcccctggaaatgcccgcttcggccagggcagcggccccatcgtgctggatgatgtgcgctgcagcggctatgagagctacctgtggagctgcccccacaacggctggctgagccacaactgccagcacagtgaagatgctggggtcatctgcagcgctgcccacagctggagcacccccagcccagacaccctgcccaccatcaccctgcctgccagcacagtgggcagcgagagcagcctggccctgcggctggtgaatggaggagaccgctgccagggccgggtggaggtgctgtaccggggctcctggggcaccgtgtgtgatgacagctgggacaccaatgatgccaacgtggtgtgccggcagctgggctgcggctgggccatgctggcccctggaaatgccaggtttggccagggcagcggccccatcgtgctggatgatgtgcgctgcagcggaaatgaaagctacctgtggagctgcccccacaacggctggctgagccacaactgtggccacagtgaagatgctggggtcatctgcagcggccctgagagcagcctggccctgcggctggtgaatggaggagaccgctgccagggccgggtggaggtgctgtaccggggctcctggggcaccgtgtgtgatgacagctgggacaccaatgatgccaacgtggtgtgccggcagctgggctgcggctgggccaccagcgcccctggaaatgccaggtttggccagggcagcggccccatcgtgctggatgatgtgcgctgcagcggccacgagagctacctgtggagctgccccaacaacggctggctgagccacaactgtggccaccatgaagatgctggggtcatctgcagcgctgcccagagccgcagcacccccaggccagacaccctgagcaccatcaccctgccccccagcacagtgggcagcgagagcagcctgaccctgcggctggtgaatggaagtgaccgctgccagggccgggtggaggtgctgtaccggggctcctggggcaccgtgtgtgatgacagctgggacaccaatgatgccaacgtggtgtgccggcagctgggctgcggctgggccaccagcgcccctggaaatgcccgcttcggccagggcagcggccccatcgtgctggatgatgtgcgctgcagcggccacgagagctacctgtggagctgcccccacaacggctggctgagccacaactgtggccaccatgaagatgctggggtcatctgcagcgtgtcccagagccggcccacccccagcccagacacctggcccaccagccacgccagcacagctggccctgagagcagcctggccctgcggctggtgaatggaggagaccgctgccagggccgggtggaggtgctgtaccggggctcctggggcaccgtgtgtgatgacagctgggacaccagtgatgccaacgtggtgtgccggcagctgggctgcggctgggccaccagcgcccctggaaatgccaggtttggccagggcagcggccccatcgtgctggatgatgtgcgctgcagcggctatgagagctacctgtggagctgcccccacaacggctggctgagccacaactgccagcacagtgaagatgctggggtcatctgcagcgctgcccacagctggagcacccccagcccagacaccctgcccaccatcaccctgcctgccagcacagtgggcagcgagagcagcctggccctgcggctggtgaatggaggagaccgctgccagggccgggtggaggtgctgtaccagggctcctggggcaccgtgtgtgatgacagctgggacaccaatgatgccaacgtggtgtgccggcagctgggctgcggctgggccatgtctgcccctggaaatgcccgcttcggccagggcagcggccccatcgtgctggatgatgtgcgctgcagcggccacgagagctacctgtggagctgcccccacaacggctggctgagccacaactgtggccacagtgaagatgctggggtcatctgcagcgccagccagagccggcccacccccagcccagacacctggcccaccagccacgccagcacagctggcagcgagagcagcctggccctgcggctggtgaatggaggagaccgctgccagggccgggtggaggtgctgtaccggggctcctggggcaccgtgtgtgatgactactgggacaccaatgatgccaacgtggtgtgccggcagctgggctgcggctgggccatgtctgcccctggaaatgccaggtttggccagggcagcggccccatcgtgctggatgatgtgcgctgcagcggccacgagagctacctgtggagctgcccccacaacggctggctgagccacaactgtggccaccatgaagatgctggggtcatctgcagcgccagccagagccagcccacccccagcccagacacctggcccaccagccacgccagcacagctggcagcgagagcagcctggccctgcggctggtgaatggaggagaccgctgccagggccgggtggaggtgctgtaccggggctcctggggcaccgtgtgtgatgactactgggacaccaatgatgccaacgtggtgtgccggcagctgggctgcggctgggccaccagcgcccctggaaatgcccgcttcggccagggcagcggccccatcgtgctggatgatgtgcgctgcagcggccacgagagctacctgtggagctgcccccacaacggctggctgagccacaactgtggccaccatgaagatgctggggtcatctgcagcgccagccagagccagcccacccccagcccagacacctggcccaccagccacgccagcacagctggcagcgagagcagcctggccctgcggctggtgaatggaggagaccgctgccagggccgggtggaggtgctgtaccggggctcctggggcaccgtgtgtgatgactactgggacaccaatgatgccaacgtggtgtgccggcagctgggctgcggctgggccaccagcgcccctggaaatgccaggtttggccagggcagcggccccatcgtgctggatgatgtgcgctgcagcggccacgagagctacctgtggagctgcccccacaacggctggctgagccacaactgtggccaccatgaagatgctggggtcatctgcagcgccagccagagccagcccacccccagcccagacacctggcccaccagccacgccagcacagctggcagcgagagcagcctggccctgcggctggtgaatggaggagaccgctgccagggccgggtggaggtgctgtaccggggctcctggggcaccgtgtgtgatgactactgggacaccaatgatgccaacgtggtgtgccggcagctgggctgcggctgggccaccagcgcccctggaaatgcccgcttcggccagggcagcggccccatcgtgctggatgatgtgcgctgcagcggccacgagagctacctgtggagctgcccccacaacggctggctgagccacaactgtggccaccatgaagatgctggggtcatctgcagcgccagccagagccagcccacccccagcccagacacctggcccaccagccgggccagcacagctggcagcgagagcaccctggccctgcggctggtgaatggaggagaccgctgccggggccgggtggaggtgctgtaccagggctcctggggcaccgtgtgtgatgactactgggacaccaatgatgccaacgtggtgtgccggcagctgggctgcggctgggccatgtctgcccctggaaatgcccagtttggccagggcagcggccccatcgtgctggatgatgtgcgctgcagcggccacgagagctacctgtggagctgcccccacaacggctggctgagccacaactgtggccaccatgaagatgctggggtcatctgcagcgctgcccagagccagagcacccccaggccagacacctggctgaccaccaacctgcctgccctgactgtgggcagcgagagcagcctggccctgcggctggtgaatggaggagaccgctgccggggccgggtggaggtgctgtaccggggctcctggggcaccgtgtgtgatgacagctgggacaccaatgatgccaacgtggtgtgccggcagctgggctgcggctgggccatgtctgcccctggaaatgcccgcttcggccagggcagcggccccatcgtgctggatgatgtgcgctgcagcggaaatgaaagctacctgtggagctgcccccacaagggctggctgacccacaactgtggccaccatgaagatgctggggtcatctgcagcgccacccagatcaacagcaccaccacagactggtggcaccccaccaccaccaccacagcccggcccagcagcaactgtggcggcttcctgttctacgccagcggcaccttcagcagccccagctacccagcctactaccccaacaatgccaagtgtgtgtgggagattgaggtgaacagcggctaccgcatcaacctgggcttcagcaacctgaagctggaggcccaccacaactgcagctttgattatgtggagatctttgatggcagcctgaacagcagcctgctgctgggcaagatctgcaatgacacccggcagatcttcaccagcagctacaacaggatgaccatccacttcagaagtgacatctccttccagaacacaggcttcctggcctggtacaacagcttccccagtgatgccaccctgcggctggtgaacctgaacagcagctatggcctgtgtgccggccgggtggagatctaccacggcggcacctggggcaccgtgtgtgatgacagctggaccatccaggaggccgaggtggtgtgccggcagctgggctgcggccgggctgtgtctgccctgggcaatgcctacttcggcagcggcagcggccccatcaccctggatgatgtggagtgcagcggcacagagagcaccctgtggcagtgcaggaacagaggctggttcagccacaactgcaaccaccgggaggatgctggggtcatctgcagcggcaaccacctgagcaccccagcccccttcctgaacatcacccggcccaacacagactacagctgtggcggcttcctgagccagcccagcggggacttcagcagccccttctacccaggcaactaccccaacaatgccaagtgtgtgtgggacatcgaggtgcagaacaactacagagtgaccgtcatcttcagagatgtgcagctggagggcggctgcaactatgactacatcgaggtgtttgatggcccctaccgcagcagccccctcatcgcccgggtgtgtgatggagcccggggcagcttcaccagcagcagcaacttcatgagcatccgcttcatcagtgaccacagcatcacccggcggggcttccgggcagagtactacagcagccccagcaatgacagcaccaacctgctgtgcctgcccaaccacatgcaggcctctgtgagccgcagctacctgcagagcctgggcttcagcgccagtgacctggtgatcagcacctggaatggctactatgagtgccggccccagatcacccccaacctggtgatcttcaccatcccctacagcggctgcggcaccttcaagcaggccgacaatgacaccatcgactacagcaacttcctgacagctgctgtgtctgggggcatcatcaagagaagaacagacctgcgcatccacgtgtcctgcaggatgctgcagaacacctgggtggacaccatgtacatcgccaatgacaccatccacgtggccaacaacaccatccaggtggaggaggtgcagtatggcaactttgatgtgaacatctccttctacaccagcagcagcttcctgtaccctgtgaccagccggccctactacgtggacctgaaccaggacctgtatgtgcaggccgagatcctgcacagtgatgctgtgctgaccctgtttgtggacacctgtgtggccagcccctacagcaatgacttcaccagcctgacctatgacctgatccgcagcggctgtgtgagagatgacacctacggcccctacagcagccccagcctgcgcatcgcccgcttccgcttccgggccttccacttcctgaaccgcttccccagcgtgtacctgcgctgcaagatggtggtgtgccgggcctatgaccccagcagccgctgctaccggggctgtgtgctgcggagcaagagagatgtgggcagctaccaggagaaggtggatgtggtgctgggccccatccagctgcagaccccaccccggcgggaggaggagcccaggtag

SEQ ID NO: 19369 - DNA, 7239 bp, Artificial Sequence
  Description of Artificial Sequence: Synthetic coding sequence
atgggcatcagcaccgtcatcctggagatgtgcctgctgtggggccaggtgctgagcactggaggctggatccccaggaccacagattatgccagcctcatccccagcgaggtgcccctggaccccaccgtggccgagggcagccccttccccagcgagagcaccctggagagcacagtggccgagggcagccccatcagcctggagagcaccctggagagcacagtggccgagggcagcctcatccccagcgagagcaccctggagagcacagtggccgagggcagtgacagcggcctggccctgcggctggtgaatggagatggccgctgccagggccgggtggagatcctgtaccggggctcctggggcaccgtgtgtgatgacagctgggacaccaatgatgccaacgtggtgtgccggcagctgggctgcggctgggccatgtctgcccctggaaatgcctggtttggccagggcagcggccccatcgccctggatgatgtgcgctgcagcggccacgagagctacctgtggagctgcccccacaacggctggctgagccacaactgtggccatggagaagatgctggggtcatctgcagcgctgcccagccccagagcaccctgcggcctgagagctggcctgtgcgcatcagcccccctgtgcccacagagggcagcgagagcagcctggccctgcggctggtgaatggaggagaccgctgccggggccgggtggaggtgctgtaccggggctcctggggcaccgtgtgtgatgactactgggacaccaatgatgccaacgtggtgtgccggcagctgggctgcggctgggccatgtctgcccctggaaatgcccagtttggccagggcagcggccccatcgtgctggatgatgtgcgctgcagcggccacgagagctacctgtggagctgcccccacaacggctggctgacccacaactgtggccacagtgaagatgctggggtcatctgcagcgccccccagagccggcccacccccagcccagacacctggcccaccagccacgccagcacagctggccctgagagcagcctggccctgcggctggtgaatggaggagaccgctgccagggccgggtggaggtgctgtaccggggctcctggggcaccgtgtgtgatgacagctgggacaccagtgatgccaacgtggtgtgccggcagctgggctgcggctgggccaccagcgcccctggaaatgcccgcttcggccagggcagcggccccatcgtgctggatgatgtgcgctgcagcggctatgagagctacctgtggagctgcccccacaacggctggctgagccacaactgccagcacagtgaagatgctggggtcatctgcagcgctgcccacagctggagcacccccagcccagacaccctgcccaccatcaccctgcctgccagcacagtgggcagcgagagcagcctggccctgcggctggtgaatggaggagaccgctgccagggccgggtggaggtgctgtaccggggctcctggggcaccgtgtgtgatgacagctgggacaccaatgatgccaacgtggtgtgccggcagctgggctgcggctgggccatgctggcccctggaaatgccaggtttggccagggcagcggccccatcgtgctggatgatgtgcgctgcagcggaaatgaaagctacctgtggagctgcccccacaacggctggctgagccacaactgtggccacagtgaagatgctggggtcatctgcagcggccctgagagcagcctggccctgcggctggtgaatggaggagaccgctgccagggccgggtggaggtgctgtaccggggctcctggggcaccgtgtgtgatgacagctgggacaccaatgatgccaacgtggtgtgccggcagctgggctgcggctgggccaccagcgcccctggaaatgccaggtttggccagggcagcggccccatcgtgctggatgatgtgcgctgcagcggccacgagagctacctgtggagctgccccaacaacggctggctgagccacaactgtggccaccatgaagatgctggggtcatctgcagcgctgcccagagccgcagcacccccaggccagacaccctgagcaccatcaccctgccccccagcacagtgggcagcgagagcagcctgaccctgcggctggtgaatggaagtgaccgctgccagggccgggtggaggtgctgtaccggggctcctggggcaccgtgtgtgatgacagctgggacaccaatgatgccaacgtggtgtgccggcagctgggctgcggctgggccaccagcgcccctggaaatgcccgcttcggccagggcagcggccccatcgtgctggatgatgtgcgctgcagcggccacgagagctacctgtggagctgcccccacaacggctggctgagccacaactgtggccaccatgaagatgctggggtcatctgcagcgtgtcccagagccggcccacccccagcccagacacctggcccaccagccacgccagcacagctggccctgagagcagcctggccctgcggctggtgaatggaggagaccgctgccagggccgggtggaggtgctgtaccggggctcctggggcaccgtgtgtgatgacagctgggacaccagtgatgccaacgtggtgtgccggcagctgggctgcggctgggccaccagcgcccctggaaatgccaggtttggccagggcagcggccccatcgtgctggatgatgtgcgctgcagcggctatgagagctacctgtggagctgcccccacaacggctggctgagccacaactgccagcacagtgaagatgctggggtcatctgcagcgctgcccacagctggagcacccccagcccagacaccctgcccaccatcaccctgcctgccagcacagtgggcagcgagagcagcctggccctgcggctggtgaatggaggagaccgctgccagggccgggtggaggtgctgtaccagggctcctggggcaccgtgtgtgatgacagctgggacaccaatgatgccaacgtggtgtgccggcagctgggctgcggctgggccatgtctgcccctggaaatgcccgcttcggccagggcagcggccccatcgtgctggatgatgtgcgctgcagcggccacgagagctacctgtggagctgcccccacaacggctggctgagccacaactgtggccacagtgaagatgctggggtcatctgcagcgccagccagagccggcccacccccagcccagacacctggcccaccagccacgccagcacagctggcagcgagagcagcctggccctgcggctggtgaatggaggagaccgctgccagggccgggtggaggtgctgtaccggggctcctggggcaccgtgtgtgatgactactgggacaccaatgatgccaacgtggtgtgccggcagctgggctgcggctgggccatgtctgcccctggaaatgccaggtttggccagggcagcggccccatcgtgctggatgatgtgcgctgcagcggccacgagagctacctgtggagctgcccccacaacggctggctgagccacaactgtggccaccatgaagatgctggggtcatctgcagcgccagccagagccagcccacccccagcccagacacctggcccaccagccacgccagcacagctggcagcgagagcagcctggccctgcggctggtgaatggaggagaccgctgccagggccgggtggaggtgctgtaccggggctcctggggcaccgtgtgtgatgactactgggacaccaatgatgccaacgtggtgtgccggcagctgggctgcggctgggccaccagcgcccctggaaatgcccgcttcggccagggcagcggccccatcgtgctggatgatgtgcgctgcagcggccacgagagctacctgtggagctgcccccacaacggctggctgagccacaactgtggccaccatgaagatgctggggtcatctgcagcgccagccagagccagcccacccccagcccagacacctggcccaccagccacgccagcacagctggcagcgagagcagcctggccctgcggctggtgaatggaggagaccgctgccagggccgggtggaggtgctgtaccggggctcctggggcaccgtgtgtgatgactactgggacaccaatgatgccaacgtggtgtgccggcagctgggctgcggctgggccaccagcgcccctggaaatgccaggtttggccagggcagcggccccatcgtgctggatgatgtgcgctgcagcggccacgagagctacctgtggagctgcccccacaacggctggctgagccacaactgtggccaccatgaagatgctggggtcatctgcagcgccagccagagccagcccacccccagcccagacacctggcccaccagccgggccagcacagctggcagcgagagcaccctggccctgcggctggtgaatggaggagaccgctgccggggccgggtggaggtgctgtaccagggctcctggggcaccgtgtgtgatgactactgggacaccaatgatgccaacgtggtgtgccggcagctgggctgcggctgggccatgtctgcccctggaaatgcccagtttggccagggcagcggccccatcgtgctggatgatgtgcgctgcagcggccacgagagctacctgtggagctgcccccacaacggctggctgagccacaactgtggccaccatgaagatgctggggtcatctgcagcgctgcccagagccagagcacccccaggccagacacctggctgaccaccaacctgcctgccctgactgtgggcagcgagagcagcctggccctgcggctggtgaatggaggagaccgctgccggggccgggtggaggtgctgtaccggggctcctggggcaccgtgtgtgatgacagctgggacaccaatgatgccaacgtggtgtgccggcagctgggctgcggctgggccatgtctgcccctggaaatgccaggtttggccagggcagcggccccatcgtgctggatgatgtgcgctgcagcggaaatgaaagctacctgtggagctgcccccacaagggctggctgacccacaactgtggccaccatgaagatgctggggtcatctgcagcgccacccagatcaacagcaccaccacagactggtggcaccccaccaccaccaccacagcccggcccagcagcaactgtggcggcttcctgttctacgccagcggcaccttcagcagccccagctacccagcctactaccccaacaatgccaagtgtgtgtgggagattgaggtgaacagcggctaccgcatcaacctgggcttcagcaacctgaagctggaggcccaccacaactgcagctttgattatgtggagatctttgatggcagcctgaacagcagcctgctgctgggcaagatctgcaatgacacccggcagatcttcaccagcagctacaacaggatgaccatccacttcagaagtgacatctccttccagaacacaggcttcctggcctggtacaacagcttccccagtgatgccaccctgcggctggtgaacctgaacagcagctatggcctgtgtgccggccgggtggagatctaccatggaggcacctggggcaccgtgtgtgatgacagctggaccatccaggaggccgaggtggtgtgccggcagctgggctgcggccgggctgtgtctgccctgggcaatgcctactttggaagtggcagcggccccatcaccctggatgatgtggagtgcagcggcacagagagcaccctgtggcagtgcaggaacagaggctggttcagccacaactgcaaccacagagaagatgctggggtcatctgcagcggcaaccacctgagcaccccagcccccttcctgaacatcacccggcccaacaactacagctgtggcggcttcctgagccagcccagcggggacttcagcagccccttctacccaggcaactaccccaacaatgccaagtgtgtgtgggacatcgaggtgcagaacaactacagagtgaccgtcatcttcagagatgtgcagctggagggcggctgcaactatgactacatcgaggtgtttgatggcccctaccgcagcagccccctcatcgcccgggtgtgtgatggagcccggggcagcttcaccagcagcagcaacttcatgagcatccgcttcatcagtgaccacagcatcacccggcggggcttccgggcagagtactacagcagccccagcaatgacagcaccaacctgctgtgcctgcccaaccacatgcaggcctctgtgagccgcagctacctgcagagcctgggcttcagcgccagtgacctggtgatcagcacctggaatggctactatgagtgccggccccagatcacccccaacctggtgatcttcaccatcccctacagcggctgcggcaccttcaagcaggccgacaatgacaccatcgactacagcaacttcctgacagctgctgtgtctgggggcatcatcaagagaagaacagacctgcgcatccacgtgtcctgcaggatgctgcagaacacctgggtggacaccatgtacatcgccaatgacaccatccacgtggccaacaacaccatccaggtggaggaggtgcagtatggcaactttgatgtgaacatctccttctacaccagcagcagcttcctgtaccctgtgaccagccggccctactacgtggacctgaaccaggacctgtatgtgcaggccgagatcctgcacagtgatgctgtgctgaccctgtttgtggacacctgtgtggccagcccctacagcaatgacttcaccagcctgacctatgacctgatccgcagcggctgtgtgagagatgacacctacggcccctacagcagccccagcctgcgcatcgcccgcttccgcttccgggccttccacttcctgaaccgcttccccagcgtgtacctgcgctgcaagatggtggtgtgccgggcctatgaccccagcagccgctgctaccggggctgtgtgctgcggagcaagagagatgtgggcagctaccaggagaaggtggatgtggtgctgggccccatccagctgcagaccccaccccggcgggaggaggagcccaggtag

SEQ ID NO: 19370 - DNA, 7242 bp, Artificial Sequence; identical to SEQ ID NO: 19360
  Description of Artificial Sequence: Synthetic coding sequence

SEQ ID NO: 19371 - DNA, 7212 bp, Artificial Sequence; identical to SEQ ID NO: 19364
  Description of Artificial Sequence: Synthetic coding sequence

SEQ ID NO: 19372 - DNA, 5358 bp, Artificial Sequence; identical to SEQ ID NO: 19358
  Description of Artificial Sequence: Synthetic coding sequence

SEQ ID NO: 19373 - DNA, 597 bp, Artificial Sequence
  Description of Artificial Sequence: Synthetic coding sequence
atggctgctgacatcagcgagagcagtggagctgactgcaagggggaccccaggaacagcgccaagctggatgctgactaccccctgcgggtgctgtactgcggcgtgtgcagcctgcccacagagtactgtgagtacatgccagatgtggccaagtgccggcagtggctggagaagaacttccccaatgaatttgccaagctgactgtggagaacagccccaagcaggaggccggcatcagcgagggccagggcacagctggggaggaggaggagaagaagaagcagaagagaggaggccggggccagatcaagcagaagaagaagacagtgccccagaaggtgaccatcgccaagatcccccgggccaagaagaagtatgtgaccagggtgtgtggcctggccacctttgaaattgacctgaaggaggcccagcgcttctttgcccagaagttcagctgtggggcctctgtgactggagaagatgagatcatcatccagggcgacttcacagatgacatcattgatgtgatccaggagaagtggccagaggtggatgatgacagcattgaggacctgggggaggtgaagaagtag

SEQ ID NO: 19374 - DNA, 1530 bp, Artificial Sequence
  Description of Artificial Sequence: Synthetic coding sequence
atggaccccccccgggccagccacctgagccccaggaagaagaggccccggcagacaggagccctgatggccagcagcccccaggacatcaagttccaggacctggtggtgttcatcctggagaagaagatgggcaccacccggcgggccttcctgatggagctggcccggaggaagggcttccgggtggagaatgagctgagtgacagcgtgacccacatcgtggccgagaacaacagcggcagtgatgtgctggagtggctgcaggcccagaaggtgcaggtgagcagccagcctgagctgctggatgtgtcctggctgattgagtgcatccgggccggcaagcctgtggagatgaccgggaagcaccagctggtggtgcggcgggactacagcgacagcaccaaccctggcccccccaagaccccacccatcgctgtgcagaagatcagccagtatgcctgccagaggaggaccaccctgaacaactgcaaccagatcttcacagatgcctttgacatcctggccgagaactgtgagttcagagaaaatgaagacagctgtgtgaccttcatgagagctgcctctgtgctgaagagcctgcccttcaccatcatctccatgaaggacacagagggcatcccctgcctgggcagcaaggtgaagggcatcatcgaggagatcattgaagatggagagagcagcgaggtgaaggctgtgctgaatgatgagcgctaccagagcttcaagctgttcacctctgtgtttggagtgggcctgaagaccagcgagaagtggttcaggatgggcttccgcaccctgagcaaggtgcggagtgacaagagcctgaagttcaccaggatgcagaaggccggcttcctgtactatgaggacctggtgtcctgtgtgaccagggctgaggccgaggccgtgtctgtgctggtgaaggaggccgtgtgggccttcctgcctgatgcctttgtgaccatgactggaggcttcagaagaggcaagaagatgggccatgatgtggacttcctgatcaccagccctggcagcacagaagatgaggagcagctgctgcagaaggtgatgaacctgtgggagaagaagggcctgctgctgtactatgacctggtggagagcacctttgagaagctgcggctgcccagcaggaaggtggatgccctggaccacttccagaagtgcttcctgatcttcaagctgccccggcagagggtggacagcgaccagagctcctggcaggagggcaagacctggaaggccatccgggtggacctggtgctgtgcccctatgaaagaagagcctttgccctgctgggctggacaggcagccggcagtttgagcgggacctgcggcgctatgccacccatgagaggaagatgatcctggacaaccacgccctgtatgacaagaccaagaggatcttcctgaaggccgagagcgaggaggagatctttgcccacctgggcctggactacatcgagccctgggagagaaatgcctag

SEQ ID NO: 19375 - DNA, 1527 bp, Artificial Sequence
  Description of Artificial Sequence: Synthetic coding sequence
atggaccccccccgggccagccacctgagccccaggaagaagaggccccggcagacaggagccctgatggccagcagcccccaggacatcaagttccaggacctggtggtgttcatcctggagaagaagatgggcaccacccggcgggccttcctgatggagctggcccggaggaagggcttccgggtggagaatgagctgagtgacagcgtgacccacatcgtggccgagaacaacagcggcagtgatgtgctggagtggctgcaggcccagaaggtgcaggtgagcagccagcctgagctgctggatgtgtcctggctgattgagtgcatccgggccggcaagcctgtggagatgaccgggaagcaccagctggtggtgcggcgggactacagcgacagcaccaaccctggcccccccaagaccccacccatcgctgtgcagaagatcagccagtatgcctgccagaggaggaccaccctgaacaactgcaaccagatcttcacagatgcctttgacatcctggccgagaactgtgagttcagagaaaatgaagacagctgtgtgaccttcatgagagctgcctctgtgctgaagagcctgcccttcaccatcatctccatgaaggacacagagggcatcccctgcctgggcagcaaggtgaagggcatcatcgaggagatcattgaagatggagagagcagcgaggtgaaggctgtgctgaatgatgagcgctaccagagcttcaagctgttcacctctgtgtttggagtgggcctgaagaccagcgagaagtggttcaggatgggcttccgcaccctgagcaaggtgcggagtgacaagagcctgaagttcaccaggatgcagaaggccggcttcctgtactatgaggacctggtgtcctgtgtgaccagggctgaggccgaggccgtgtctgtgctggtgaaggaggccgtgtgggccttcctgcctgatgcctttgtgaccatgactggaggcttcagaagaggcaagaagatgggccatgatgtggacttcctgatcaccagccctggcagcacagaagatgaggagcagctgctgcagaaggtgatgaacctgtgggagaagaagggcctgctgctgtactatgacctggtggagagcacctttgagaagctgcggctgcccagcaggaaggtggatgccctggaccacttccagaagtgcttcctgatcttcaagctgccccggcagagggtggacagcgaccagagctcctggcaggagggcaagacctggaaggccatccgggtggacctggtgctgtgcccctatgaaagaagagcctttgccctgctgggctggacaggcagcagatttgagcgggacctgcggcgctatgccacccatgagaggaagatgatcctggacaaccacgccctgtatgacaagaccaagaggatcttcctgaaggccgagagcgaggaggagatctttgcccacctgggcctggactacatcgagccctgggagagaaatgcctag

SEQ ID NO: 19376 - DNA, 2544 bp, Artificial Sequence
  Description of Artificial Sequence: Synthetic coding sequence
atggaggccgcccggcccagcggctcctggaatggagccctgtgccgcctgctgctgctgaccctggccatcctgatctttgccagtgatgcctgcaagaatgtgaccctgcacgtgcccagcaagctggatgctgagaagctggtgggccgggtgaacctgaaggagtgcttcaccgctgccaacctgatccacagcagtgaccctgacttccagatcctggaggatggctctgtgtacaccaccaacaccatcctgctgagcagcgagaagaggagcttcaccatcctgctgagcaacacagagaaccaggagaagaagaagatctttgtgttcctggagcaccagaccaaggtgctgaagaagaggcacaccaaggagaaggtgctgcggcgggccaagaggcgctgggcccccatcccctgcagcatgctggagaacagcctgggccccttccccctcttcctgcagcaggtgcagagcgacacagcccagaactacaccatctactacagcatccggggccctggggtggaccaggagcccaggaacctcttctacgtggagcgggacaccggcaacctgtactgcaccaggcctgtggaccgggagcagtatgagagctttgagatcatcgcctttgccaccaccccagatggctacaccccagagctgcccctgcccctcatcatcaagattgaagatgaaaatgacaactaccccatcttcacagaggagacctacaccttcaccatctttgagaactgccgggtgggcaccaccgtgggccaggtgtgtgccacagacaaggatgagccagacaccatgcacacccggctgaagtacagcatcatcggccaggtgccccccagccccaccctcttctccatgcaccccaccactggagtcatcaccaccaccagcagccagctggaccgggagctgattgacaagtaccagctgaagatcaaggtgcaggacatggatggccagtacttcggcctgcagaccaccagcacctgcatcatcaacattgatgatgtgaatgaccacctgcccaccttcaccaggaccagctatgtgacctctgtggaggagaacacagtggatgtggagatcctgcgggtgacagtggaggacaaggacctggtgaacacagccaactggagggccaactacaccatcctgaagggaaatgaaaatggaaacttcaagatcgtgacagatgccaagaccaatgaaggagtgctgtgtgtggtgaagcccctgaactatgaggagaagcagcagatgatcctgcagattggagtggtgaatgaggcccccttcagccgggaggccagccccaggtctgccatgagcacagccaccgtgacagtgaatgtggaggaccaggatgagggccctgagtgcaacccccccatccagacagtgaggatgaaggaaaatgctgaggtgggcaccaccagcaatggctacaaggcctatgaccctgagaccaggagcagcagcggcatccgctacaagaagctgacagaccccaccggctgggtgaccattgatgagaacacaggcagcatcaaggtgttccgcagcctggaccgggaggccgagaccatcaagaatggcatctacaacatcaccgtgctggccagtgaccagggcggccgcacctgcaccggcaccctgggcatcatcctgcaggatgtgaatgacaacagccccttcatccccaagaagacagtcatcatctgcaagcccaccatgagcagcgctgagatcgtggccgtggaccctgatgagcccatccacggccccccatttgacttcagcctggagagcagcaccagcgaggtgcagaggatgtggaggctgaaggccatcaatgacacagctgcccggctgagctaccagaatgaccccccatttggcagctatgtggtgcccatcaccgtgcgggaccggctgggcatgagctctgtgaccagcctggatgtgaccctgtgtgactgcatcacagaaaatgactgcacccaccgggtggaccccagaattggaggcggcggcgtgcagctgggcaagtgggccatcctggccatcctgctgggcatcgccctgctcttctgcatcctcttcaccctggtgtgtggggccagcggcaccagcaagcagcccaaggtgatcccagatgacctggcccagcagaacctgattgtgagcaacacagaggcccctggagatgacaaggtgtacagcgccaacggcttcaccacccagacagtgggcgccagcgcccagggcgtgtgtggcaccgtgggcagcggcatcaagaatggaggccaggagaccatcgagatggtgaagggcggccaccagaccagcgagagctgccgcggggccggccaccaccacaccctggacagctgccggggcggccacacagaggtggacaactgccgctacacctacagcgagtggcacagcttcacccagccccggctgggggaggagagcatccggggccacaccctcatcaagaactag

SEQ ID NO: 19377 - DNA, 2706 bp, Artificial Sequence
  Description of Artificial Sequence: Synthetic coding sequence
atggaggccgcccggcccagcggctcctggaatggagccctgtgccgcctgctgctgctgaccctggccatcctgatctttgccagtgatgcctgcaagaatgtgaccctgcacgtgcccagcaagctggatgctgagaagctggtgggccgggtgaacctgaaggagtgcttcaccgctgccaacctgatccacagcagtgaccctgacttccagatcctggaggatggctctgtgtacaccaccaacaccatcctgctgagcagcgagaagaggagcttcaccatcctgctgagcaacacagagaaccaggagaagaagaagatctttgtgttcctggagcaccagaccaaggtgctgaagaagaggcacaccaaggagaaggtgctgcggcgggccaagaggcgctgggcccccatcccctgcagcatgctggagaacagcctgggccccttccccctcttcctgcagcaggtgcagagcgacacagcccagaactacaccatctactacagcatccggggccctggggtggaccaggagcccaggaacctcttctacgtggagcgggacaccggcaacctgtactgcaccaggcctgtggaccgggagcagtatgagagctttgagatcatcgcctttgccaccaccccagatggctacaccccagagctgcccctgcccctcatcatcaagattgaagatgaaaatgacaactaccccatcttcacagaggagacctacaccttcaccatctttgagaactgccgggtgggcaccaccgtgggccaggtgtgtgccacagacaaggatgagccagacaccatgcacacccggctgaagtacagcatcatcggccaggtgccccccagccccaccctcttctccatgcaccccaccactggagtcatcaccaccaccagcagccagctggaccgggagctgattgacaagtaccagctgaagatcaaggtgcaggacatggatggccagtacttcggcctgcagaccaccagcacctgcatcatcaacattgatgatgtgaatgaccacctgcccaccttcaccaggaccagctatgtgacctctgtggaggagaacacagtggatgtggagatcctgcgggtgacagtggaggacaaggacctggtgaacacagccaactggagggccaactacaccatcctgaagggaaatgaaaatggaaacttcaagatcgtgacagatgccaagaccaatgaaggagtgctgtgtgtggtgaagcccctgaactatgaggagaagcagcagatgatcctgcagattggagtggtgaatgaggcccccttcagccgggaggccagccccaggtctgccatgagcacagccaccgtgacagtgaatgtggaggaccaggatgagggccctgagtgcaacccccccatccagacagtgaggatgaaggaaaatgctgaggtgggcaccaccagcaatggctacaaggcctatgaccctgagaccaggagcagcagcggcatccgctacaagaagctgacagaccccaccggctgggtgaccattgatgagaacacaggcagcatcaaggtgttccgcagcctggaccgggaggccgagaccatcaagaatggcatctacaacatcaccgtgctggccagtgaccagggcggccgcacctgcaccggcaccctgggcatcatcctgcaggatgtgaatgacaacagccccttcatccccaagaagacagtcatcatctgcaagcccaccatgagcagcgctgagatcgtggccgtggaccctgatgagcccatccacggccccccatttgacttcagcctggagagcagcaccagcgaggtgcagaggatgtggaggctgaaggccatcaatgacacagctgcccggctgagctaccagaatgaccccccatttggcagctatgtggtgcccatcaccgtgcgggaccggctgggcatgagctctgtgaccagcctggatgtgaccctgtgtgactgcatcacagaaaatgactgcacccaccgggtggaccccagaattggaggcggcggcgtgcagctgggcaagtgggccatcctggccatcctgctgggcatcgccctgctcttctgcatcctcttcaccctggtgtgtggggccagcggcaccagcaagcagcccaaggtgatcccagatgacctggcccagcagaacctgattgtgagcaacacagaggcccctggagatgacaaggtgtacagcgccaacggcttcaccacccagacagtgggcgccagcgcccagggcgtgtgtggcaccgtgggcagcggcatcaagaatggaggccaggagaccatcgagatggtgaagggcggccaccagaccagcgagagctgccgcggggccggccaccaccacaccctggacagctgccggggcggccacacagaggtggacaactgccgctacacctacagcgagtggcacagcttcacccagccccggctgggggagaaggtgtacctgtgcaaccaggatgagaaccacaagcacgcccaggactatgtgctgacctacaactatgagggccggggctctgtggccggctctgtgggctgctgcagcgagcggcaggaggaggatggcctggagttcctggacaacctggagcccaagttccgcaccctggccgaggcctgcatgaagaggtag

SEQ ID NO: 19378 - DNA, 2745 bp, Artificial Sequence
  Description of Artificial Sequence: Synthetic coding sequence
atggaggccgcccggcccagcggctcctggaatggagccctgtgccgcctgctgctgctgaccctggccatcctgatctttgccagtgatgcctgcaagaatgtgaccctgcacgtgcccagcaagctggatgctgagaagctggtgggccgggtgaacctgaaggagtgcttcaccgctgccaacctgatccacagcagtgaccctgacttccagatcctggaggatggctctgtgtacaccaccaacaccatcctgctgagcagcgagaagaggagcttcaccatcctgctgagcaacacagagaaccaggagaagaagaagatctttgtgttcctggagcaccagaccaagatcagcctgctggtgccctggctgtgcctggtggccgaggtgctgaagaagaggcacaccaaggagaaggtgctgcggcgggccaagaggcgctgggcccccatcccctgcagcatgctggagaacagcctgggccccttccccctcttcctgcagcaggtgcagagcgacacagcccagaactacaccatctactacagcatccggggccctggggtggaccaggagcccaggaacctcttctacgtggagcgggacaccggcaacctgtactgcaccaggcctgtggaccgggagcagtatgagagctttgagatcatcgcctttgccaccaccccagatggctacaccccagagctgcccctgcccctcatcatcaagattgaagatgaaaatgacaactaccccatcttcacagaggagacctacaccttcaccatctttgagaactgccgggtgggcaccaccgtgggccaggtgtgtgccacagacaaggatgagccagacaccatgcacacccggctgaagtacagcatcatcggccaggtgccccccagccccaccctcttctccatgcaccccaccaccggggtcatcaccaccaccagcagccagctggaccgggagctgattgacaagtaccagctgaagatcaaggtgcaggacatggatggccagtacttcggcctgcagaccaccagcacctgcatcatcaacattgatgatgtgaatgaccacctgcccaccttcaccaggaccagctatgtgacctctgtggaggagaacacagtggatgtggagatcctgcgggtgacagtggaggacaaggacctggtgaacacagccaactggagggccaactacaccatcctgaagggaaatgaaaatggaaacttcaagatcgtgacagatgccaagaccaatgaaggagtgctgtgtgtggtgaagcccctgaactatgaggagaagcagcagatgatcctgcagatcggcgtggtgaatgaggcccccttcagccgggaggccagccccaggtctgccatgagcacagccaccgtgacagtgaatgtggaggaccaggatgagggccctgagtgcaacccccccatccagacagtgaggatgaaggaaaatgctgaggtgggcaccaccagcaatggctacaaggcctatgaccctgagaccaggagcagcagcggcatccgctacaagaagctgacagaccccaccggctgggtgaccattgatgaaaatacaggcagcatcaaggtgttccgcagcctggaccgggaggccgagaccatcaagaatggcatctacaacatcaccgtgctggccagtgaccagggcggccgcacctgcaccggcaccctgggcatcatcctgcaggatgtgaatgacaacagccccttcatccccaagaagacagtcatcatctgcaagcccaccatgagcagcgctgagatcgtggccgtggaccctgatgagcccatccacggccccccatttgacttcagcctggagagcagcaccagcgaggtgcagaggatgtggaggctgaaggccatcaatgacacagctgcccggctgagctaccagaatgacccccccttcggcagctatgtggtgcccatcaccgtgcgggaccggctgggcatgagctctgtgaccagcctggatgtgaccctgtgtgactgcatcacagaaaatgactgcacccaccgggtggacccccgcatcggcggcggcggcgtgcagctgggcaagtgggccatcctggccatcctgctgggcatcgccctgctcttctgcatcctcttcaccctggtgtgtggggccagcggcaccagcaagcagcccaaggtgatcccagatgacctggcccagcagaacctgattgtgagcaacacagaggcccctggagatgacaaggtgtacagcgccaacggcttcaccacccagacagtgggcgccagcgcccagggcgtgtgtggcaccgtgggcagcggcatcaagaatggaggccaggagaccatcgagatggtgaagggcggccaccagaccagcgagagctgcagaggagctggccaccaccacaccctggacagctgccggggcggccacacagaggtggacaactgccgctacacctacagcgagtggcacagcttcacccagccccggctgggggagaaggtgtacctgtgcaaccaggatgagaaccacaagcacgcccaggactatgtgctgacctacaactatgagggccggggctctgtggccggctctgtgggctgctgcagcgagcggcaggaggaggatggcctggagttcctggacaacctggagcccaagttccgcaccctggccgaggcctgcatgaagaggtag

SEQ ID NO: 19379 - DNA, 2004 bp, Artificial Sequence
  Description of Artificial Sequence: Synthetic coding sequence
atgaagatgatcaccacccagttcctgcagaagaagctgatcctgctgcagttcctgaagattgctgagtggggcaccaccgtgggccaggtgtgtgccacagacaaggatgagccagacaccatgcacacccggctgaagtacagcatcatcggccaggtgccccccagccccaccctcttctccatgcaccccaccactggagtcatcaccaccaccagcagccagctggaccgggagctgattgacaagtaccagctgaagatcaaggtgcaggacatggatggccagtacttcggcctgcagaccaccagcacctgcatcatcaacattgatgatgtgaatgaccacctgcccaccttcaccaggaccagctatgtgacctctgtggaggagaacacagtggatgtggagatcctgcgggtgacagtggaggacaaggacctggtgaacacagccaactggagggccaactacaccatcctgaagggaaatgaaaatggaaacttcaagatcgtgacagatgccaagaccaatgaaggagtgctgtgtgtggtgaagcccctgaactatgaggagaagcagcagatgatcctgcagattggagtggtgaatgaggcccccttcagccgggaggccagccccaggtctgccatgagcacagccaccgtgacagtgaatgtggaggaccaggatgagggccctgagtgcaacccccccatccagacagtgaggatgaaggaaaatgctgaggtgggcaccaccagcaatggctacaaggcctatgaccctgagaccaggagcagcagcggcatccgctacaagaagctgacagaccccaccggctgggtgaccattgatgagaacacaggcagcatcaaggtgttccgcagcctggaccgggaggccgagaccatcaagaatggcatctacaacatcaccgtgctggccagtgaccagggcggccgcacctgcaccggcaccctgggcatcatcctgcaggatgtgaatgacaacagccccttcatccccaagaagacagtcatcatctgcaagcccaccatgagcagcgctgagatcgtggccgtggaccctgatgagcccatccacggccccccatttgacttcagcctggagagcagcaccagcgaggtgcagaggatgtggaggctgaaggccatcaatgacacagctgcccggctgagctaccagaatgaccccccatttggcagctatgtggtgcccatcaccgtgcgggaccggctgggcatgagctctgtgaccagcctggatgtgaccctgtgtgactgcatcacagaaaatgactgcacccaccgggtggaccccagaattggaggcggcggcgtgcagctgggcaagtgggccatcctggccatcctgctgggcatcgccctgctcttctgcatcctcttcaccctggtgtgtggggccagcggcaccagcaagcagcccaaggtgatcccagatgacctggcccagcagaacctgattgtgagcaacacagaggcccctggagatgacaaggtgtacagcgccaacggcttcaccacccagacagtgggcgccagcgcccagggcgtgtgtggcaccgtgggcagcggcatcaagaatggaggccaggagaccatcgagatggtgaagggcggccaccagaccagcgagagctgccgcggggccggccaccaccacaccctggacagctgccggggcggccacacagaggtggacaactgccgctacacctacagcgagtggcacagcttcacccagccccggctgggggagaaggtgtacctgtgcaaccaggatgagaaccacaagcacgcccaggactatgtgctgacctacaactatgagggccggggctctgtggccggctctgtgggctgctgcagcgagcggcaggaggaggatggcctggagttcctggacaacctggagcccaagttccgcaccctggccgaggcctgcatgaagaggtag

SEQ ID NO: 19380 - DNA, 3000 bp, Artificial Sequence
  Description of Artificial Sequence: Synthetic coding sequence
atgatgggcctcttccccaggaccactggagccctggccatctttgtggtggtgatcctggtgcacggggagctgagaattgagaccaagggccagtatgatgaggaggagatgaccatgcagcaggccaagaggcggcagaagcgggagtgggtgaagtttgccaagccctgccgggagggggaggacaacagcaagaggaaccccatcgccaagatcaccagtgactaccaggccacccagaagatcacctaccgcatcagcggcgtgggcatcgaccagcccccatttggcatctttgtggtggacaagaacacaggagacatcaacatcacagccatcgtggaccgggaggagacccccagcttcctgatcacctgccgggccctgaatgcccagggcctggatgtggagaagcccctcatcctgactgtgaagatcctggacatcaatgacaacccccctgtgttcagccagcagatcttcatgggagaaattgaggagaacagcgccagcaacagcctggtgatgatcctgaatgccacagatgctgatgagcccaaccacctgaacagcaagatcgccttcaagatcgtgtcccaggagcccgccggcacccccatgttcctgctgagcagaaatactggagaggtgaggaccctgaccaacagcctggaccgggagcaggccagcagctaccgcctggtggtgtctggagctgacaaggatggagagggcctgagcacccagtgtgagtgcaacatcaaggtgaaggatgtgaatgacaacttccccatgttccgggacagccagtacagcgcccgcatcgaggagaacatcctgagcagcgagctgctgcgcttccaggtgacagacctggatgaggagtacacagacaactggctggccgtgtacttcttcaccagcggaaatgaaggcaactggtttgagatccagacagaccccaggaccaatgaaggcatcctgaaggtggtgaaggccctggactatgagcagctgcagagcgtgaagctgagcattgctgtgaagaacaaggccgagttccaccagagcgtcatcagccgctacagagtgcagagcacccctgtgaccatccaggtgatcaacgtgcgggagggcatcgccttccggcctgccagcaagaccttcaccgtgcagaagggcatcagcagcaagaagctggtggactacatcctgggcacctaccaggccattgatgaggacaccaacaaggccgccagcaatgtgaagtatgtgatgggcagaaatgatggcggctacctgatgattgacagcaagacagctgagatcaagtttgtgaagaacatgaacagagacagcaccttcatcgtgaacaagaccatcacagctgaggtgctggccattgatgagtacacaggcaagaccagcacaggcaccgtgtatgtgcgggtgcctgacttcaatgacaactgccccacagctgtgctggagaaggatgctgtgtgcagcagcagccccagcgtggtggtgtctgcccggaccctgaacaaccgctacacaggcccctacacctttgccctggaggaccagcctgtgaagctgcctgctgtgtggagcatcaccaccctgaatgccaccagcgccctgctgcgggcccaggagcagatccccccaggagtgtaccacatcagcctggtgctgacagacagccagaacaacagatgtgagatgcccaggagcctgaccctggaggtgtgccagtgtgacaacagaggcatctgtggcaccagctaccccaccaccagccctggcaccaggtatggccggccccacagcggccgcctgggccctgctgccatcggcctgctgctgctgggcctgctgctgctgctgctggcccccctgctgctgctgacctgtgactgtggggccggcagcactggaggagtgactggaggcttcatccctgtgcctgatggcagcgagggcaccatccaccagtggggcattgaaggagcccaccctgaggacaaggagatcaccaacatctgtgtgccccctgtgacagccaacggggctgacttcatggagagcagcgaggtgtgcaccaacacctacgcccggggcacagctgtggagggcaccagcggcatggagatgaccaccaagctgggcgccgccacagaaagtggaggagctgctggctttgccactggaacagtgtctggagctgccagcggctttggagctgccactggagtgggcatctgcagcagcggccagagcggcaccatgaggaccaggcacagcactggaggcaccaacaaggactatgcagatggagccatctccatgaacttcctggacagctacttcagccagaaggcctttgcctgtgccgaggaggatgatggccaggaggccaatgactgcctgctgatctatgacaatgaaggagcagatgccaccggcagccctgtgggctctgtgggctgctgcagcttcatcgcagatgacctggatgacagcttcctggacagcctgggccccaagttcaagaagctggccgagatcagcctgggcgtggatggagagggcaaggaggtgcagccccccagcaaggacagcggctatggaattgagagctgtggccaccccatcgaggtgcagcagacaggctttgtgaagtgccagaccctgagcggcagccagggcgccagcgccctgagcaccagcggctctgtgcagcctgctgtgtccatcccagaccccctgcagcacggcaactacctggtgacagagacctacagcgccagcggcagcctggtgcagcccagcacagctggctttgaccccctgctgacccagaatgtcatcgtgacagagagggtcatctgccccatcagctctgtgcccggcaacctggccggccccacccagctgcggggcagccacaccatgctgtgcacagaggacccctgcagccgcctcatctag

SEQ ID NO: 19381 - DNA, 8616 bp, Artificial Sequence
  Description of Artificial Sequence: Synthetic coding sequence
atgagctgcaatggaggcagccacccccgcatcaacaccctgggccgcatgatccgggcagagagcggccctgacctgcgctatgaggtgaccagcggcggcggcggcaccagcaggatgtactacagccggcggggcgtcatcacagaccagaacagtgatggctactgccagacaggcaccatgagccgccaccagaaccagaacaccatccaggagctgctgcagaactgcagcgactgcctgatgagagctgagctgattgtgcagcctgagctgaagtatggagatggcatccagctgaccaggagccgggagctggatgaatgttttgcccaggccaatgaccagatggagatcctggacagcctcatccgggagatgaggcagatgggccagccctgtgatgcctaccagaagaggctgctgcagctgcaggagcagatgagggccctgtacaaggccatctctgtgccccgggtgcggcgggccagcagcaaaggaggcggcggctacacctgccagagcggcagcggctgggatgagttcaccaagcacgtgaccagcgagtgcctgggctggatgaggcagcagagagctgagatggacatggtggcctggggcgtggacctggcctctgtggagcagcacatcaacagccaccggggcatccacaacagcatcggggactaccgctggcagctggacaagatcaaggctgacctgcgggagaagagcgccatctaccagctggaggaggagtatgagaacctgctgaaggccagctttgagaggatggaccacctgcggcagctgcagaacatcatccaggccaccagccgggagatcatgtggatcaatgactgtgaggaggaggagctgctgtatgactggagcgacaagaacaccaacatcgcccagaagcaggaggccttcagcatccgcatgagccagctggaggtgaaggagaaggagctgaacaagctgaagcaggagagtgaccagctggtgctgaaccagcacccagccagtgacaagattgaggcctacatggacaccctgcagacccagtggagctggatcctgcagatcaccaagtgcattgatgtgcacctgaaggaaaatgctgcctacttccagttctttgaggaggcccagagcacagaggcctacctgaagggcctgcaggacagcatcaggaagaagtacccctgtgacaagaacatgcccctgcagcacctgctggagcagatcaaggagctggagaaggagcgggagaagatcctggagtacaagaggcaggtgcagaacctggtgaacaagagcaagaagatcgtgcagctgaagcccagaaatccagactaccgcagcaacaagcccatcatcctgcgggccctgtgtgactacaagcaggaccagaagatcgtgcacaagggagatgagtgcatcctgaaggacaacaatgaaagaagcaagtggtacgtgacaggccctgggggcgtggacatgctggtgcccagcgtgggcctcatcatccccccacccaaccccctggccgtggacctgagctgcaagattgagcagtactatgaggccatcctggccctgtggaaccagctgtacatcaacatgaagagcctggtgtcctggcactactgcatgattgatattgagaagatccgggccatgaccatcgccaagctgaagaccatgaggcaggaggactacatgaagaccatcgctgacctggagctgcactaccaggagttcatccggaacagccagggcagcgagatgtttggagatgatgacaagaggaagatccagagccagttcacagatgcccagaagcactaccagaccctggtgatccagctgcccggctacccccagcaccagacagtgaccaccacagagatcacccaccacggcacctgccaggatgtgaaccacaacaaggtgattgagaccaaccgggagaatgacaagcaggagacctggatgctgatggagctgcagaagatccggcggcagatcgagcactgtgagggccgcatgaccctgaagaacctgcccctggccgaccagggcagcagccaccacatcaccgtgaagatcaatgagctgaagtctgtgcagaatgacagccaggccatcgccgaggtgctgaaccagctgaaggacatgctggccaacttccggggcagcgagaagtactgctacctgcagaatgaggtgtttggcctcttccagaagctggagaacatcaatggagtgacagatggctacctgaacagcctgtgcaccgtgcgggccctgctgcaggccatcctgcagacagaggacatgctgaaggtgtatgaggcccggctgacagaggaggagaccgtgtgcctggacctggacaaggtggaggcctaccgctgtggcctgaagaagatcaagaatgacctgaacctgaagaagagcctgctggccaccatgaagacagagctgcagaaggcccagcagatccacagccagaccagccagcagtaccccctgtatgacctggacctgggcaagtttggagagaaggtgacccagctgacagaccgctggcagagaattgacaagcagattgacttccggctgtgggacctggagaagcagatcaagcagctgaggaactacagagacaactaccaggccttctgcaagtggctgtatgatgccaagaggcggcaggacagcctggagagcatgaagtttggagacagcaacacagtgatgaggttcctgaatgagcagaagaacctgcacagcgagatcagcggcaagagggacaagtctgaggaggtgcagaagattgctgagctgtgtgccaacagcatcaaggactatgagctgcagctggccagctacaccagcggcctggagaccctgctgaacatccccatcaagaggaccatgatccagagccccagcggggtcatcctgcaggaggccgcagatgtgcacgcccgctacatcgagctgctgaccaggtctggggactactaccgcttcctgtctgagatgctgaagagcctggaggacctgaagctgaagaacaccaagattgaggtgctggaggaggagctgcggctggccagagatgccaacagcgagaactgcaacaagaacaagttcctggaccagaacctgcagaagtaccaggccgagtgcagccagttcaaggccaagctggccagcctggaggagctgaagaggcaggccgagctggatggcaagagcgccaagcagaacctggacaagtgctacggccagatcaaggagctgaatgagaagatcacccggctgacctatgaaattgaagatgagaagagaagaaggaagtctgtggaggacagatttgaccagcagaagaatgactatgaccagctgcagaaggcccggcagtgtgagaaggagaacctgggctggcagaagctggagagcgagaaggccatcaaggagaaggagtatgaaattgagcggctgcgggtgctgctgcaggaggagggcaccaggaagcgggagtatgaaaatgagctggccaaggtgaggaaccactacaatgaggagatgagcaacctgaggaacaagtatgaaacagagatcaacatcaccaagaccaccatcaaggagatctccatgcagaaggaggatgacagcaagaacctgaggaaccagctggaccggctgagcagagaaaatagagacctgaaggatgaaattgtgcggctgaatgacagcatcctgcaggccacagagcagaggcggcgggcagaggagaatgccctgcagcagaaggcctgtggcagcgagatcatgcagaagaagcagcacctggagattgagctgaagcaggtgatgcagcagaggtctgaggacaatgcccggcacaagcagagcctggaggaggccgccaagaccatccaggacaagaacaaggagattgagcggctgaaggccgagttccaggaggaggccaagaggcgctgggagtatgaaaatgagctgagcaaggtgaggaacaactatgatgaggagatcatcagcctgaagaaccagtttgaaacagagatcaacatcaccaagaccaccatccaccagctgaccatgcagaaggaggaggacaccagcggctaccgggcccagattgacaacctgaccagagaaaatagaagcctgtctgaggagatcaagaggctgaagaacaccctgacccagaccacagagaacctgcggcgggtggaggaggacatccagcagcagaaggccaccggcagcgaggtgtcccagaggaagcagcagctggaggtggagctgcggcaggtgacccagatgaggacagaggagagcgtgcgctacaagcagagcctggatgatgctgccaagaccatccaggacaagaacaaggagattgagcggctgaagcagctgattgacaaggagaccaatgacaggaagtgcctggaggatgaaaatgcccggctgcagagggtgcagtatgacctgcagaaggccaacagcagcgccacagagaccatcaacaagctgaaggtgcaggagcaggagctgacccggctgagaattgattatgaaagagtgtcccaggagaggacagtgaaggaccaggacatcacccgcttccagaacagcctgaaggagctgcagctgcagaagcagaaggtggaggaggagctgaaccggctgaagaggacagccagcgaggacagctgcaagaggaagaagctggaggaggagctggagggcatgaggaggagcctgaaggagcaggccatcaagatcaccaacctgacccagcagctggagcaggccagcatcgtgaagaagagaagtgaagatgacctgcggcagcagagagatgtgctggatggccacctgcgggagaagcagaggacccaggaggagctgcggcggctgagcagcgaggtggaggccctgcggcggcagctgctgcaggagcaggagagcgtgaagcaggcccacctgagaaatgagcacttccagaaggccatcgaggacaagagccgcagcctgaatgaaagcaagattgaaattgagcggctgcagagcctgacagagaacctgaccaaggagcacctgatgctggaggaggagctgaggaacctgcggctggagtatgatgacctgcggcggggccgctctgaggccgacagcgacaagaatgccaccatcctggagctgcggagccagctgcagatcagcaacaacagaaccctggagctgcagggcctcatcaatgacctgcagcgggagcgggagaacctgcggcaggagattgagaagttccagaagcaggccctggaggccagcaaccgcatccaggagagcaagaaccagtgcacccaggtggtgcaggagcgggagagcctgctggtgaagatcaaggtgctggagcaggacaaggcccggctgcagaggctggaggatgagctgaacagagccaagagcaccctggaggccgagaccagggtgaagcagaggctggagtgtgagaagcagcagatccagaatgacctgaaccagtggaagacccagtacagcaggaaggaggaggccatcaggaagattgaaagtgagcgggagaagtctgagcgggagaagaacagcctgcggagtgaaattgagcggctgcaggccgagatcaagagaattgaggagcgctgcaggaggaagctggaggacagcacccgggagacccagagccagctggagacagagaggagccgctaccagcgggagattgacaagctgcggcagaggccctacggcagccaccgggagacccagacagaatgtgagtggacagtggacaccagcaagctggtgtttgatggcctgaggaagaaggtgacagccatgcagctgtatgagtgccagctgattgacaagaccaccctggacaagctgctgaagggcaagaagtctgtggaggaggtggccagcgagatccagcccttcctgcggggagctggcagcattgctggggccagcgccagccccaaggagaagtacagcctggtggaggccaagaggaagaagctgatcagccctgagagcacagtgatgctgctggaggcccaggccgccactggaggcatcatcgacccccacagaaatgagaagctgactgtggacagcgccatcgcccgggacctgattgactttgatgaccggcagcagatctatgctgctgagaaggccatcaccggctttgatgaccccttcagcggcaagacagtgtctgtgtctgaggccatcaagaagaacctgattgaccgggagaccggcatgaggctgctggaggcccagatcgccagcggaggagtggtggaccctgtgaacagcgtcttcctgcccaaggatgtggccctggcccggggcctgattgaccgggacctgtaccgcagcctgaatgacccccgggacagccagaagaactttgtggaccctgtgaccaagaagaaggtgtcctatgtgcagctgaaggagcgctgccgcatcgagccccacacaggcctgctgctgctgtctgtgcagaagaggtccatgtccttccagggcatccggcagcctgtgacagtgacagagctggtggacagcggcatcctgcggcccagcacagtgaatgagctggagagcggccagatctcctatgatgaggtgggggagcgcatcaaggacttcctgcagggcagcagctgcatcgccggcatctacaatgagaccaccaagcagaagctgggcatctatgaggccatgaagattggcctggtgcggcctggaacagccctggagctgctggaggcccaggccgccaccggcttcatcgtggaccctgtgagcaacctgcggctgcctgtggaggaggcctacaagaggggcctggtgggcatcgagttcaaggagaagctgctgtctgctgagagagctgtgacaggctacaatgaccctgagaccggcaacatcatcagcctcttccaggccatgaacaaggagctgattgaaaaaggacatggcatccggctgctggaggcccagatcgccaccggcggcatcatcgaccccaaggagagccaccggctgcctgtggacatcgcctacaagaggggctacttcaatgaggagctgtctgagatcctgagtgaccccagtgatgacaccaagggcttctttgaccccaacacagaggagaacctgacctacctgcagctgaaggagcgctgcatcaaggatgaggagaccggcctgtgcctgctgcccctgaaggagaagaagaagcaggtgcagaccagccagaagaacaccctgaggaagagaagagtggtgattgtggaccctgagaccaacaaggagatgtctgtgcaggaggcctacaagaagggcctgattgattatgagaccttcaaggagctgtgtgagcaggagtgtgagtgggaggagatcaccatcactggaagtgatggcagcaccagggtggtgctggtggacaggaagacaggcagccagtatgacatccaggatgccatcgacaagggcctggtggacaggaagttctttgaccagtacagaagtggcagcctgagcctgacccagtttgctgacatgatcagcctgaagaatggagtgggcaccagcagctccatgggcagcggcgtgtctgatgatgtgttcagcagcagcagacatgaatctgtgtccaagatcagcaccatcagctctgtgaggaacctgaccatccgcagcagcagcttcagtgacaccctggaggagagcagccccatcgccgccatctttgacacagagaacctggagaagatcagcatcacagagggcatcgagcggggcatcgtggacagcatcaccggccagaggctgctggaggcccaggcctgcacaggaggcatcatccaccccaccaccggccagaagctgagcctgcaggatgctgtgtcccagggcgtcatcgaccaggacatggccacccggctgaagccagcccagaaggccttcatcggctttgagggcgtgaagggcaagaagaagatgtctgctgctgaggccgtgaaggagaagtggctgccctatgaggccggccagcgcttcctggagttccagtacctgactggaggcctggtggaccctgaggtgcacggccgcatcagcacagaggaggccatcaggaagggcttcattgatggccgggccgcccagaggctgcaggacaccagcagctatgccaagatcctgacctgccccaagaccaagctgaagatctcctacaaggatgccatcaacagatccatggtggaggacatcaccggcctgcggctgctggaggccgcctctgtgagcagcaagggcctgcccagcccctacaacatgagcagcgcccctggcagccgcagcggcagccgcagcggcagccgcagcggcagccgcagcggcagccgcagcggcagccggcggggcagctttgatgccactggaaacagcagctacagctacagctacagcttcagcagcagcagcatcggccactag

SEQ ID NO: 19382 - DNA, 2862 bp, Artificial Sequence
  Description of Artificial Sequence: Synthetic coding sequence
cagcagcagagagctgagatggacatggtggcctggggcgtggacctggcctctgtggagcagcacatcaacagccaccggggcatccacaacagcattggagactaccgctggcagctggacaagatcaaggctgacctgcgggagaagagcgccatctaccagctggaggaggagtatgagaacctgctgaaggccagctttgagaggatggaccacctgcggcagctgcagaacatcatccaggccaccagccgggagatcatgtggatcaatgactgtgaggaggaggagctgctgtatgactggagcgacaagaacaccaacatcgcccagaagcaggaggccttcagcatccgcatgagccagctggaggtgaaggagaaggagctgaacaagctgaagcaggagagtgaccagctggtgctgaaccagcacccagccagtgacaagattgaggcctacatggacaccctgcagacccagtggagctggatcctgcagatcaccaagtgcattgatgtgcacctgaaggaaaatgctgcctacttccagttctttgaggaggcccagagcacagaggcctacctgaagggcctgcaggacagcatcaggaagaagtacccctgtgacaagaacatgcccctgcagcacctgctggagcagatcaaggagctggagaaggagcgggagaagatcctggagtacaagaggcaggtgcagaacctggtgaacaagagcaagaagatcgtgcagctgaagcccaggaacccagactaccgcagcaacaagcccatcatcctgcgggccctgtgtgactacaagcaggaccagaagatcgtgcacaagggagatgagtgcatcctgaaggacaacaatgaaagaagcaagtggtacgtgactggacctggaggagtggacatgctggtgcccagcgtgggcctcatcatccccccacccaaccccctggccgtggacctgagctgcaagattgagcagtactatgaggccatcctggccctgtggaaccagctgtacatcaacatgaagagcctggtgtcctggcactactgcatgattgacatcgagaagatccgggccatgaccatcgccaagctgaagaccatgaggcaggaggactacatgaagaccatcgctgacctggagctgcactaccaggagttcatccggaacagccagggcagcgagatgtttggagatgatgacaagaggaagatccagagccagttcacagatgcccagaagcactaccagaccctggtgatccagctgcccggctacccccagcaccagacagtgaccaccacagagatcacccaccacggcacctgccaggatgtgaaccacaacaaggtgattgagaccaacagagaaaatgacaagcaggagacctggatgctgatggagctgcagaagatccggcggcagatcgagcactgtgagggccgcatgaccctgaagaacctgcccctggccgaccagggcagcagccaccacatcaccgtgaagatcaatgagctgaagtctgtgcagaatgacagccaggccatcgccgaggtgctgaaccagctgaaggacatgctggccaacttccggggcagcgagaagtactgctacctgcagaatgaggtgtttggcctcttccagaagctggagaacatcaacggggtgacagatggctacctgaacagcctgtgcaccgtgcgggccctgctgcaggccatcctgcagacagaggacatgctgaaggtgtatgaggcccggctgacagaggaggagaccgtgtgcctggacctggacaaggtggaggcctaccgctgtggcctgaagaagatcaagaatgacctgaacctgaagaagagcctgctggccaccatgaagacagagctgcagaaggcccagcagatccacagccagaccagccagcagtaccccctgtatgacctggacctgggcaagtttggagagaaggtgacccagctgacagaccgctggcagagaattgacaagcagattgacttccggctgtgggacctggagaagcagatcaagcagctgaggaactacagagacaactaccaggccttctgcaagtggctgtatgatgccaagaggcggcaggacagcctggagagcatgaagtttggagacagcaacacagtgatgaggttcctgaatgagcagaagaacctgcacagcgagatcagcggcaagagggacaagtctgaggaggtgcagaagattgctgagctgtgtgccaacagcatcaaggactatgagctgcagctggccagctacaccagcggcctggagaccctgctgaacatccccatcaagaggaccatgatccagagccccagcggggtcatcctgcaggaggccgcagatgtgcacgcccgctacatcgagctgctgaccaggtctggggactactaccgcttcctgtctgagatgctgaagagcctggaggacctgaagctgaagaacaccaagattgaggtgctggaggaggagctgcggctggccagagatgccaacagcgagaactgcaacaagaacaagttcctggaccagaacctgcagaagtaccaggctgaatgttcccagttcaaggccaagctggccagcctggaggagctgaagaggcaggccgagctggatggcaagagcgccaagcagaacctggacaagtgctacggccagatcaaggagctgaatgagaagatcacccggctgacctatgaaattgaagatgagaagagaagaaggaagtctgtggaggacagatttgaccagcagaagaatgactatgaccagctgcagaaggcccggcagtgctag

SEQ ID NO: 19383 - DNA, 6819 bp, Artificial Sequence
  Description of Artificial Sequence: Synthetic coding sequence
atgagctgcaatggaggcagccacccccgcatcaacaccctgggccgcatgatccgggcagagagcggccctgacctgcgctatgaggtgaccagcggcggcggcggcaccagcaggatgtactacagccggcggggcgtcatcacagaccagaacagtgatggctactgccagacaggcaccatgagccgccaccagaaccagaacaccatccaggagctgctgcagaactgcagcgactgcctgatgagagctgagctgattgtgcagcctgagctgaagtatggagatggcatccagctgaccaggagccgggagctggatgaatgttttgcccaggccaatgaccagatggagatcctggacagcctcatccgggagatgaggcagatgggccagccctgtgatgcctaccagaagaggctgctgcagctgcaggagcagatgagggccctgtacaaggccatctctgtgccccgggtgcggcgggccagcagcaaaggaggcggcggctacacctgccagagcggcagcggctgggatgagttcaccaagcacgtgaccagcgagtgcctgggctggatgaggcagcagagagctgagatggacatggtggcctggggcgtggacctggcctctgtggagcagcacatcaacagccaccggggcatccacaacagcatcggggactaccgctggcagctggacaagatcaaggctgacctgcgggagaagagcgccatctaccagctggaggaggagtatgagaacctgctgaaggccagctttgagaggatggaccacctgcggcagctgcagaacatcatccaggccaccagccgggagatcatgtggatcaatgactgtgaggaggaggagctgctgtatgactggagcgacaagaacaccaacatcgcccagaagcaggaggccttcagcatccgcatgagccagctggaggtgaaggagaaggagctgaacaagctgaagcaggagagtgaccagctggtgctgaaccagcacccagccagtgacaagattgaggcctacatggacaccctgcagacccagtggagctggatcctgcagatcaccaagtgcattgatgtgcacctgaaggaaaatgctgcctacttccagttctttgaggaggcccagagcacagaggcctacctgaagggcctgcaggacagcatcaggaagaagtacccctgtgacaagaacatgcccctgcagcacctgctggagcagatcaaggagctggagaaggagcgggagaagatcctggagtacaagaggcaggtgcagaacctggtgaacaagagcaagaagatcgtgcagctgaagcccagaaatccagactaccgcagcaacaagcccatcatcctgcgggccctgtgtgactacaagcaggaccagaagatcgtgcacaagggagatgagtgcatcctgaaggacaacaatgaaagaagcaagtggtacgtgacaggccctgggggcgtggacatgctggtgcccagcgtgggcctcatcatccccccacccaaccccctggccgtggacctgagctgcaagattgagcagtactatgaggccatcctggccctgtggaaccagctgtacatcaacatgaagagcctggtgtcctggcactactgcatgattgatattgagaagatccgggccatgaccatcgccaagctgaagaccatgaggcaggaggactacatgaagaccatcgctgacctggagctgcactaccaggagttcatccggaacagccagggcagcgagatgtttggagatgatgacaagaggaagatccagagccagttcacagatgcccagaagcactaccagaccctggtgatccagctgcccggctacccccagcaccagacagtgaccaccacagagatcacccaccacggcacctgccaggatgtgaaccacaacaaggtgattgagaccaaccgggagaatgacaagcaggagacctggatgctgatggagctgcagaagatccggcggcagatcgagcactgtgagggccgcatgaccctgaagaacctgcccctggccgaccagggcagcagccaccacatcaccgtgaagatcaatgagctgaagtctgtgcagaatgacagccaggccatcgccgaggtgctgaaccagctgaaggacatgctggccaacttccggggcagcgagaagtactgctacctgcagaatgaggtgtttggcctcttccagaagctggagaacatcaatggagtgacagatggctacctgaacagcctgtgcaccgtgcgggccctgctgcaggccatcctgcagacagaggacatgctgaaggtgtatgaggcccggctgacagaggaggagaccgtgtgcctggacctggacaaggtggaggcctaccgctgtggcctgaagaagatcaagaatgacctgaacctgaagaagagcctgctggccaccatgaagacagagctgcagaaggcccagcagatccacagccagaccagccagcagtaccccctgtatgacctggacctgggcaagtttggagagaaggtgacccagctgacagaccgctggcagagaattgacaagcagattgacttccggctgtgggacctggagaagcagatcaagcagctgaggaactacagagacaactaccaggccttctgcaagtggctgtatgatgccaagaggcggcaggacagcctggagagcatgaagtttggagacagcaacacagtgatgaggttcctgaatgagcagaagaacctgcacagcgagatcagcggcaagagggacaagtctgaggaggtgcagaagattgctgagctgtgtgccaacagcatcaaggactatgagctgcagctggccagctacaccagcggcctggagaccctgctgaacatccccatcaagaggaccatgatccagagccccagcggggtcatcctgcaggaggccgcagatgtgcacgcccgctacatcgagctgctgaccaggtctggggactactaccgcttcctgtctgagatgctgaagagcctggaggacctgaagctgaagaacaccaagattgaggtgctggaggaggagctgcggctggccagagatgccaacagcgagaactgcaacaagaacaagttcctggaccagaacctgcagaagtaccaggccgagtgcagccagttcaaggccaagctggccagcctggaggagctgaagaggcaggccgagctggatggcaagagcgccaagcagaacctggacaagtgctacggccagatcaaggagctgaatgagaagatcacccggctgacctatgaaattgaagatgagaagagaagaaggaagtctgtggaggacagatttgaccagcagaagaatgactatgaccagctgcagaaggcccggcagtgtgagaaggagaacctgggctggcagaagctggagagcgagaaggccatcaaggagaaggagtatgaaattgagcggctgcgggtgctgctgcaggaggagggcaccaggaagcgggagtatgaaaatgagctggccaaggccagcaaccgcatccaggagagcaagaaccagtgcacccaggtggtgcaggagcgggagagcctgctggtgaagatcaaggtgctggagcaggacaaggcccggctgcagaggctggaggatgagctgaacagagccaagagcaccctggaggccgagaccagggtgaagcagaggctggagtgtgagaagcagcagatccagaatgacctgaaccagtggaagacccagtacagcaggaaggaggaggccatcaggaagattgagagcgagcgggagaagtctgagcgggagaagaacagcctgcggagtgaaattgaaaggctgcaggccgagatcaagagaattgaggagcgctgcaggaggaagctggaggacagcacccgggagacccagagccagctggagacagagaggagccgctaccagcgggagattgacaagctgcggcagaggccctacggcagccaccgggagacccagacagaatgtgagtggacagtggacaccagcaagctggtgtttgatggcctgaggaagaaggtgacagccatgcagctgtatgagtgccagctgattgacaagaccaccctggacaagctgctgaagggcaagaagtctgtggaggaggtggccagcgagatccagcccttcctgcggggggccggcagcattgctggggccagcgccagccccaaggagaagtacagcctggtggaggccaagaggaagaagctgatcagccctgagagcacagtgatgctgctggaggcccaggccgccaccggcggcatcatcgacccccacagaaatgagaagctgactgtggacagcgccatcgcccgggacctgattgactttgatgaccggcagcagatctatgctgctgagaaggccatcactggatttgatgaccccttcagcggcaagacagtgtctgtgtctgaggccatcaagaagaacctgattgaccgggagaccggcatgaggctgctggaggcccagatcgccagcggcggcgtggtggaccctgtgaacagcgtcttcctgcccaaggatgtggccctggcccggggcctgattgaccgggacctgtaccgcagcctgaatgacccccgggacagccagaagaactttgtggaccctgtgaccaagaagaaggtgtcctatgtgcagctgaaggagcgctgcagaattgagccccacacaggcctgctgctgctgtctgtgcagaagaggtccatgtccttccagggcatccggcagcctgtgacagtgacagagctggtggacagcggcatcctgcggcccagcacagtgaatgagctggagagcggccagatctcctatgatgaggtgggggagcgcatcaaggacttcctgcagggcagcagctgcatcgccggcatctacaatgagaccaccaagcagaagctgggcatctatgaggccatgaagattggcctggtgcggcccggcacagccctggagctgctggaggcccaggccgccaccggcttcatcgtggaccctgtgagcaacctgcggctgcctgtggaggaggcctacaagaggggcctggtgggcatcgagttcaaggagaagctgctgtctgctgagagagctgtgacaggctacaatgaccctgagactggaaacatcatcagcctcttccaggccatgaacaaggagctgattgagaagggccacggcatccggctgctggaggcccagatcgccactggaggcatcatcgaccccaaggagagccaccggctgcctgtggacatcgcctacaagaggggctacttcaatgaggagctgtctgagatcctgagtgaccccagtgatgacaccaagggcttctttgaccccaacacagaggagaacctgacctacctgcagctgaaggagcgctgcatcaaggatgaggagaccggcctgtgcctgctgcccctgaaggagaagaagaagcaggtgcagaccagccagaagaacaccctgaggaagagaagagtggtgattgtggaccctgagaccaacaaggagatgtctgtgcaggaggcctacaagaagggcctgattgattatgagaccttcaaggagctgtgtgagcaggagtgtgagtgggaggagatcaccatcaccggcagtgatggcagcaccagggtggtgctggtggacaggaagacaggcagccagtatgacatccaggatgccatcgacaagggcctggtggacaggaagttctttgaccagtaccgcagcggcagcctgagcctgacccagtttgctgacatgatcagcctgaagaatggagtgggcaccagcagctccatgggcagcggcgtgtctgatgatgtgttcagcagcagcagacatgagagcgtgtccaagatcagcaccatcagctctgtgaggaacctgaccatccgcagcagcagcttcagtgacaccctggaggagagcagccccatcgccgccatctttgacacagagaacctggagaagatcagcatcacagagggcatcgagcggggcatcgtggacagcatcaccggccagaggctgctggaggcccaggcctgcaccggcggcatcatccaccccaccaccggccagaagctgagcctgcaggatgctgtgtcccagggcgtgattgaccaggacatggccacccggctgaagccagcccagaaggccttcatcggctttgaaggagtgaagggcaagaagaagatgtctgctgctgaggccgtgaaggagaagtggctgccctatgaagctggccagcgcttcctggagttccagtacctgaccggcggcctggtggaccctgaggtgcacggccgcatcagcacagaggaggccatcaggaagggcttcattgatggccgggccgcccagaggctgcaggacaccagcagctatgccaagatcctgacctgccccaagaccaagctgaagatctcctacaaggatgccatcaacagatccatggtggaggacatcaccggcctgcggctgctggaggccgcctctgtgagcagcaagggcctgcccagcccctacaacatgagcagcgcccctggcagccgcagcggcagccgcagcggcagccgcagcggcagccgcagcggcagccgcagcggcagcagaagaggcagctttgatgccaccggcaacagcagctacagctacagctacagcttcagcagcagcagcatcggccactag

SEQ ID NO: 19384 - DNA, 507 bp, Artificial Sequence
  Description of Artificial Sequence: Synthetic coding sequence
atggagccccccaacctgtaccctgtgaagctgtatgtgtatgacctgagcaagggcctggcccggcggctgagccccatcatgctgggcaagcagctggagggcatctggcacaccagcatcgtggtgcacaaggatgagttcttcttcggcagcggcggcatcagcagctgccccccaggcggcaccctgctgggccccccagacagcgtggtggatgtgggcagcacagaggtgacagaggagatcttcctggagtacctgagcagcctgggggagagcctcttccggggggaggcctacaacctgtttgagcacaactgcaacaccttcagcaatgaggtggcccagttcctgaccggcaggaagatccccagctacatcacagacctgcccagcgaggtgctgagcacccccttcggccaggccctgcggcccctgctggacagcatccagatccagcccccaggcggcagctctgtgggccggcccaacggccagagctag

SEQ ID NO: 19385 - DNA, 561 bp, Artificial Sequence
  Description of Artificial Sequence: Synthetic coding sequence
atgaagagtgacttctacttccagaagtctgagccccacagcctgagcagcgaggccctgatgagaagagctgtgtccctggtgacagacagcaccagcaccttcctgagccagaccacctacgccctgattgaggccatcacagagtacaccaaggctgtgtacaccctgaccagcctgtaccggcagtacaccagcctgctgggcaagatgaacagcgaggaggaggatgaggtgtggcaggtgatcatcggggcccgggcagagatgaccagcaagcaccaggagtacctgaagctggagaccacctggatgacagctgtgggcctgtctgagatggctgctgaggccgcctaccagacaggagctgaccaggccagcatcacagccaggaaccacatccagctggtgaagctgcaggtggaggaggtgcaccagctgagcaggaaggccgagaccaagctggccgaggcccagatcgaggagctgcggcagaagacccaggaggagggggaggagagagctgagagcgagcaggaggcctacctgagagaagattag

SEQ ID NO: 19386 - DNA, 588 bp, Artificial Sequence
  Description of Artificial Sequence: Synthetic coding sequence
atggccgccctgaagtcctggctgagccgctctgtgaccagcttcttccgctaccggcagtgcctgtgtgtgcctgtggtggccaacttcaagaagcgctgcttcagcgagctgatccggccctggcacaagacagtgaccatcggcttcggcgtgaccctgtgtgctgtgcccatcgcccaggccgtgtacaccctgaccagcctgtaccggcagtacaccagcctgctgggcaagatgaacagcgaggaggaggatgaggtgtggcaggtgatcattggagcccgggcagagatgaccagcaagcaccaggagtacctgaagctggagaccacctggatgacagctgtgggcctgtctgagatggctgctgaggccgcctaccagacaggagctgaccaggccagcatcacagccaggaaccacatccagctggtgaagctgcaggtggaggaggtgcaccagctgagcaggaaggccgagaccaagctggccgaggcccagatcgaggagctgcggcagaagacccaggaggagggggaggagcgggcagagagcgagcaggaggcctacctgcgggaggactag

SEQ ID NO: 19387 - DNA, 588 bp, Artificial Sequence; identical to SEQ ID NO: 19386
  Description of Artificial Sequence: Synthetic coding sequence

SEQ ID NO: 19388 - DNA, 720 bp, Artificial Sequence
  Description of Artificial Sequence: Synthetic coding sequence
atggccgccctgaagtcctggctgagccgctctgtgaccagcttcttccgctaccggcagtgcctgtgtgtgcctgtggtggccaacttcaagaagcgctgcttcagcgagctgatccggccctggcacaagacagtgaccatcggcttcggcgtgaccctgtgtgctgtgcccatcgcccagaagtctgagccccacagcctgagcagcgaggccctgatgagaagagctgtgtccctggtgacagacagcaccagcaccttcctgagccagaccacctacgccctgattgaggccatcacagagtacaccaaggctgtgtacaccctgaccagcctgtaccggcagtacaccagcctgctgggcaagatgaacagcgaggaggaggatgaggtgtggcaggtgatcattggagcccgggcagagatgaccagcaagcaccaggagtacctgaagctggagaccacctggatgacagctgtgggcctgtctgagatggctgctgaggccgcctaccagacaggagctgaccaggccagcatcacagccaggaaccacatccagctggtgaagctgcaggtggaggaggtgcaccagctgagcaggaaggccgagaccaagctggccgaggcccagatcgaggagctgcggcagaagacccaggaggagggggaggagcgggcagagagcgagcaggaggcctacctgcgggaggactag

SEQ ID NO: 19389 - DNA, 561 bp, Artificial Sequence; identical to SEQ ID NO: 19385
  Description of Artificial Sequence: Synthetic coding sequence

SEQ ID NO: 19390 - DNA, 3822 bp, Artificial Sequence
  Description of Artificial Sequence: Synthetic coding sequence
atggagcccccaggcggcagcctgggccctggccggggcacccgggacaagaagaagggccgcagcccagatgagctgcccagcgctggaggagatggcggcaagagcaagaagttcaccctgaagaggctgatggctgatgagctggagcgcttcacctccatgaggatcaagaaggagaaggagaagcccaacagcgcccacaggaacagcagcgccagctatggagatgaccccacagcccagagcctgcaggatgtgtctgatgagcaggtgctggtgctgtttgagcagatgctgctggacatgaacctgaatgaggagaagcagcagcccctgcgggagaaggacatcatcatcaagcgggagatggtgtcccagtacctgtacaccagcaaggccggcatgagccagaaggagagcagcaagagcgccatgatgtacatccaggagctgcggagcggcctgcgggacatgcccctgctgagctgcctggagagcctgcgggtgtccctgaacaacaaccctgtgtcctgggtgcagacctttggagctgagggcctggccagcctgctggacatcctgaagaggctgcatgatgagaaggaggagacagctggcagctatgacagcaggaacaagcatgagatcatccgctgcctgaaggccttcatgaacaacaagtttggcatcaagaccatgctggagacagaggagggcatcctgctgctggtgcgggccatggaccctgctgtgcccaacatgatgattgatgctgccaagctgctgagcgccctgtgcatcctgccccagcctgaggacatgaatgaaagagtgctggaggccatgacagaaagagctgagatggatgaggtggagcgcttccagcccctgctggatggcctgaagagcggcaccaccatcgccctgaaggtgggctgcctgcagctgatcaatgccctgatcaccccagctgaggagctggacttccgggtgcacatccgctctgagctgatgaggctgggcctgcaccaggtgctgcaggacctgcgggagattgaaaatgaagacatgagggtgcagctgaatgtgtttgatgagcagggcgaggaggacagctatgacctgaagggccgcctggatgacatccgcatggagatggatgacttcaatgaggtgttccagatcctgctgaacacagtgaaggacagcaaggccgagccccacttcctgagcatcctgcagcacctgctgctggtgagaaatgactatgaggcccggccccagtactacaagctgattgaggagtgcatcagccagatcgtgctgcacaagaatggagctgaccctgacttcaagtgccgccacctgcagattgaaattgagggcctgattgaccagatgattgacaagaccaaggtggagaagtctgaggccaaggctgctgagctggagaagaagctggacagcgagctgacagcccggcatgagctgcaggtggagatgaagaagatggagagtgactttgagcagaagctgcaggacctgcagggcgagaaggatgccctgcacagcgagaagcagcagatcgccacagagaagcaggacctggaggccgaggtgtcccagctgactggagaggtggccaagctgaccaaggagctggaggatgccaagaaggagatggccagcctgtctgctgctgccatcaccgtgcccccatctgtgcccagccgggcccctgtgcccccagccccacccctgcccggggacagcggcaccatcatccccccacctccagcccctggggacagcaccaccccacctcctcctcctcctcctcctcctcctcctccacccctgcccggcggcgtgtgcatcagcagcccccccagcctgcccggcggcacagccatcagccccccaccacccctgtctggagatgccaccatccccccacctccacccctgcctgagggcgtgggcatccccagccccagcagcctgcccggcggcacagccatccccccacctccacccctgcccggcagcgcccgcatccccccacctcctccacccctgcccggcagcgctggcatccccccacctcctccacccctgcccggggaggccggcatgcctcctcctcctccacccctgcccggcggccctggcatccccccacctccacccttccctgggggccctggcatccccccacctcctcctggcatgggcatgcctcctcctcctccatttggatttggagtgcctgctgcccctgtgctgcccttcggcctgacccccaagaagctgtacaagccagaggtgcagctgcggcggcccaactggagcaagctggtggccgaggacctgagccaggactgcttctggaccaaggtgaaggaggacagatttgaaaataatgagctgtttgccaagctgaccctgaccttcagcgcccagaccaagaggaccaagaaggccaagaaggaccaggagggcggggaggagaagaagtctgtgcagaagaagaaggtgaaggagctgaaggtgctggacagcaagacagcccagaacctgagcatcttcctgggcagcttcaggatgccctaccaggagatcaagaatgtcatcctggaggtgaatgaagctgtgctgacagagagcatgatccagaacctgatcaagcagatgcctgagcctgagcagctgaagatgctgtctgagctgaaggatgaatatgatgacctggccgagagcgagcagtttggagtggtgatgggcaccgtgccccggctgcggccccggctgaatgccatcctcttcaagctgcagttcagcgagcaggtggagaacatcaagccagagatcgtgtctgtgacagctgcctgtgaggagctgaggaagtctgagagcttcagcaacctgctggagatcaccctgctggtgggcaactacatgaatgccggcagcagaaatgctggggccttcggcttcaacatctccttcctgtgcaagctgcgggacaccaagagcacagaccagaagatgaccctgctgcacttcctggccgagctgtgtgaaaatgactacccagatgtgctgaagttcccagatgagctggcccacgtggagaaggccagccgggtgtctgctgagaacctgcagaagaacctggaccagatgaagaagcagatcagtgatgtggagagagatgtgcagaacttccctgctgccacagatgagaaggacaagtttgtggagaagatgaccatctttgtgaaggatgcccaggagcagtacaacaagctgaggatgatgcacagcaacatggagaccctgtacaaggagctgggggagtacttcctgtttgaccccaagaagctgtctgtggaggagttcttcatggacctgcacaacttcaggaacatgttcctgcaggccgtgaaggagaaccagaagaggcgggagacagaggagaagatgaggcgggccaagctggccaaggagaaggccgagaaggagcggctggagaagcagcagaagcgggagcagctgattgacatgaatgcagaaggagatgaaacaggagtgatggacagcctgctggaggccctgcagagcggggccgccttccggaggaagaggggcccccggcaggccaacaggaaggccggctgtgctgtgaccagcctgctggccagcgagctgaccaaggatgatgccatggctgctgtgcctgccaaggtgtccaagaacagcgagaccttccccaccatcctggaggaggccaaggagctggtgggccgggccagctag

SEQ ID NO: 19391 - DNA, 3810 bp, Artificial Sequence
  Description of Artificial Sequence: Synthetic coding sequence
atggagcccccaggcggcagcctgggccctggccggggcacccgggacaagaagaagggccgcagcccagatgagctgcccagcgctggaggagatggcggcaagagcaagaagttcaccctgaagaggctgatggctgatgagctggagcgcttcacctccatgaggatcaagaaggagaaggagaagcccaacagcgcccacaggaacagcagcgccagctatggagatgaccccacagcccagagcctgcaggatgtgtctgatgagcaggtgctggtgctgtttgagcagatgctgctggacatgaacctgaatgaggagaagcagcagcccctgcgggagaaggacatcatcatcaagcgggagatggtgtcccagtacctgtacaccagcaaggccggcatgagccagaaggagagcagcaagagcgccatgatgtacatccaggagctgcggagcggcctgcgggacatgcccctgctgagctgcctggagagcctgcgggtgtccctgaacaacaaccctgtgtcctgggtgcagacctttggagctgagggcctggccagcctgctggacatcctgaagaggctgcatgatgagaaggaggagacagctggcagctatgacagcaggaacaagcatgagatcatccgctgcctgaaggccttcatgaacaacaagtttggcatcaagaccatgctggagacagaggagggcatcctgctgctggtgcgggccatggaccctgctgtgcccaacatgatgattgatgctgccaagctgctgagcgccctgtgcatcctgccccagcctgaggacatgaatgaaagagtgctggaggccatgacagaaagagctgagatggatgaggtggagcgcttccagcccctgctggatggcctgaagagcggcaccaccatcgccctgaaggtgggctgcctgcagctgatcaatgccctgatcaccccagctgaggagctggacttccgggtgcacatccgctctgagctgatgaggctgggcctgcaccaggtgctgcaggacctgcgggagattgaaaatgaagacatgagggtgcagctgaatgtgtttgatgagcagggcgaggaggacagctatgacctgaagggccgcctggatgacatccgcatggagatggatgacttcaatgaggtgttccagatcctgctgaacacagtgaaggacagcaaggccgagccccacttcctgagcatcctgcagcacctgctgctggtgagaaatgactatgaggcccggccccagtactacaagctgattgaggagtgcatcagccagatcgtgctgcacaagaatggagctgaccctgacttcaagtgccgccacctgcagattgaaattgagggcctgattgaccagatgattgacaagaccaaggtggagaagtctgaggccaaggctgctgagctggagaagaagctggacagcgagctgacagcccggcatgagctgcaggtggagatgaagaagatggagagtgactttgagcagaagctgcaggacctgcagggcgagaaggatgccctgcacagcgagaagcagcagatcgccacagagaagcaggacctggaggccgaggtgtcccagctgactggagaggtggccaagctgaccaaggagctggaggatgccaagaaggagatggccagcctgtctgctgctgccatcaccgtgcccccatctgtgcccagccgggcccctgtgcccccagccccacccctgcccggggacagcggcaccatcatccccccacctccagcccctggggacagcaccaccccacctcctcctcctcctcctcctcctcctcctccacccctgcccggcggcgtgtgcatcagcagcccccccagcctgcccggcggcacagccatcagccccccaccacccctgtctggagatgccaccatccccccacctccacccctgcctgagggcgtgggcatccccagccccagcagcctgcccggcggcacagccatccccccacctccacccctgcccggcagcgcccgcatccccccacctcctccacccctgcccggcagcgctggcatccccccacctcctccacccctgcccggggaggccggcatgcctcctcctcctccacccctgcccggcggccctggcatccccccacctccacccttccctgggggccctggcatccccccacctcctcctggcatgggcatgcctcctcctcctccatttggatttggagtgcctgctgcccctgtgctgcccttcggcctgacccccaagaagctgtacaagccagaggtgcagctgcggcggcccaactggagcaagctggtggccgaggacctgagccaggactgcttctggaccaaggtgaaggaggacagatttgaaaataatgagctgtttgccaagctgaccctgaccttcagcgcccagaccaagaccaagaaggaccaggagggcggggaggagaagaagtctgtgcagaagaagaaggtgaaggagctgaaggtgctggacagcaagacagcccagaacctgagcatcttcctgggcagcttcaggatgccctaccaggagatcaagaatgtcatcctggaggtgaatgaagctgtgctgacagagagcatgatccagaacctgatcaagcagatgcctgagcctgagcagctgaagatgctgtctgagctgaaggatgaatatgatgacctggccgagagcgagcagtttggagtggtgatgggcaccgtgccccggctgcggccccggctgaatgccatcctcttcaagctgcagttcagcgagcaggtggagaacatcaagccagagatcgtgtctgtgacagctgcctgtgaggagctgaggaagtctgagagcttcagcaacctgctggagatcaccctgctggtgggcaactacatgaatgccggcagcagaaatgctggggccttcggcttcaacatctccttcctgtgcaagctgcgggacaccaagagcacagaccagaagatgaccctgctgcacttcctggccgagctgtgtgaaaatgactacccagatgtgctgaagttcccagatgagctggcccacgtggagaaggccagccgggtgtctgctgagaacctgcagaagaacctggaccagatgaagaagcagatcagtgatgtggagagagatgtgcagaacttccctgctgccacagatgagaaggacaagtttgtggagaagatgaccagctttgtgaaggatgcccaggagcagtacaacaagctgaggatgatgcacagcaacatggagaccctgtacaaggagctgggggagtacttcctgtttgaccccaagaagctgtctgtggaggagttcttcatggacctgcacaacttcaggaacatgttcctgcaggccgtgaaggagaaccagaagaggcgggagacagaggagaagatgaggcgggccaagctggccaaggagaaggccgagaaggagcggctggagaagcagcagaagcgggagcagctgattgacatgaatgcagaaggagatgaaacaggagtgatggacagcctgctggaggccctgcagagcggggccgccttccggaggaagaggggcccccggcaggccaacaggaaggccggctgtgctgtgaccagcctgctggccagcgagctgaccaaggatgatgccatggctgctgtgcctgccaaggtgtccaagaacagcgagaccttccccaccatcctggaggaggccaaggagctggtgggccgggccagctag

SEQ ID NO: 19392 - DNA, 3792 bp, Artificial Sequence
  Description of Artificial Sequence: Synthetic coding sequence
atggagcccccaggcggcagcctgggccctggccggggcacccgggacaagaagaagggccgcagcccagatgagctgcccagcgctggaggagatggcggcaagagcaagaagttcctggagcgcttcacctccatgaggatcaagaaggagaaggagaagcccaacagcgcccacaggaacagcagcgccagctatggagatgaccccacagcccagagcctgcaggatgtgtctgatgagcaggtgctggtgctgtttgagcagatgctgctggacatgaacctgaatgaggagaagcagcagcccctgcgggagaaggacatcatcatcaagcgggagatggtgtcccagtacctgtacaccagcaaggccggcatgagccagaaggagagcagcaagagcgccatgatgtacatccaggagctgcggagcggcctgcgggacatgcccctgctgagctgcctggagagcctgcgggtgtccctgaacaacaaccctgtgtcctgggtgcagaccttcggggctgagggcctggccagcctgctggacatcctgaagaggctgcatgatgagaaggaggagacagctggcagctatgacagcaggaacaagcatgagatcatccgctgcctgaaggccttcatgaacaacaagtttggcatcaagaccatgctggagacagaggagggcatcctgctgctggtgcgggccatggaccctgctgtgcccaacatgatgattgatgctgccaagctgctgagcgccctgtgcatcctgccccagcctgaggacatgaatgaaagagtgctggaggccatgacagagcgggcagagatggatgaggtggagcgcttccagcccctgctggatggcctgaagagcggcaccaccatcgccctgaaggtgggctgcctgcagctgatcaatgccctgatcaccccagctgaggagctggacttccgggtgcacatccgctctgagctgatgaggctgggcctgcaccaggtgctgcaggacctgcgggagattgaaaatgaagacatgagggtgcagctgaatgtgtttgatgagcagggcgaggaggacagctatgacctgaagggccgcctggatgacatccgcatggagatggatgacttcaatgaggtgttccagatcctgctgaacacagtgaaggacagcaaggccgagccccacttcctgagcatcctgcagcacctgctgctggtgagaaatgactatgaggcccggccccagtactacaagctgattgaggagtgcatcagccagatcgtgctgcacaagaatggagctgaccctgacttcaagtgccgccacctgcagatcgagattgagggcctgattgaccagatgattgacaagaccaaggtggagaagtctgaggccaaggctgctgagctggagaagaagctggacagcgagctgacagcccggcatgagctgcaggtggagatgaagaagatggagagtgactttgagcagaagctgcaggacctgcagggcgagaaggatgccctgcacagcgagaagcagcagatcgccacagagaagcaggacctggaggccgaggtgtcccagctgaccggggaggtggccaagctgaccaaggagctggaggatgccaagaaggagatggccagcctgtctgctgctgccatcaccgtgccccccagcgtgcccagccgggcccctgtgcccccagccccacccctgcccggggacagcggcaccatcatccccccacctccagcccctggggacagcaccaccccacctcctcctcctcctcctcctcctcctcctccacccctgcctggaggagtgtgcatcagcagcccccccagcctgcccggcggcacagccatcagccccccaccacccctgtctggagatgccaccatccccccacctccacccctgcctgagggcgtgggcatccccagccccagcagcctgcccggcggcacagccatccccccacctccacccctgcccggcagcgcccgcatccccccacctcctccacccctgcccggcagcgctggcatccccccacctcctccacccctgcctggagaggccggcatgcctcctcctcctccacccctgcccggcggccctggcatccccccacctccacccttccctgggggccctggcatccccccacctcctcctggcatgggcatgcctcctcctccacccttcggcttcggcgtgcctgctgcccctgtgctgcccttcggcctgacccccaagaagctgtacaagccagaggtgcagctgcggcggcccaactggagcaagctggtggccgaggacctgagccaggactgcttctggaccaaggtgaaggaggacagatttgagaacaatgagctgtttgccaagctgaccctgaccttcagcgcccagaccaagaccagcaaggccaagaaggaccaggagggcggggaggagaagaagtctgtgcagaagaagaaggtgaaggagctgaaggtgctggacagcaagacagcccagaacctgagcatcttcctgggcagcttcaggatgccctaccaggagatcaagaatgtcatcctggaggtgaatgaagctgtgctgacagagagcatgatccagaacctgatcaagcagatgcctgagcctgagcagctgaagatgctgtctgagctgaaggatgaatatgatgacctggccgagagcgagcagtttggagtggtgatgggcaccgtgccccggctgcggccccggctgaatgccatcctcttcaagctgcagttcagcgagcaggtggagaacatcaagccagagatcgtgtctgtgacagctgcctgtgaggagctgaggaagtctgagagcttcagcaacctgctggagatcaccctgctggtgggcaactacatgaatgccggcagcagaaatgctggggccttcggcttcaacatctccttcctgtgcaagctgcgggacaccaagagcacagaccagaagatgaccctgctgcacttcctggccgagctgtgtgaaaatgactacccagatgtgctgaagttcccagatgagctggcccacgtggagaaggccagccgggtgtctgctgagaacctgcagaagaacctggaccagatgaagaagcagatcagtgatgtggagagagatgtgcagaacttccctgctgccacagatgagaaggacaagtttgtggagaagatgaccagctttgtgaaggatgcccaggagcagtacaacaagctgaggatgatgcacagcaacatggagaccctgtacaaggagctgggggagtacttcctgtttgaccccaagaagctgtctgtggaggagttcttcatggacctgcacaacttcaggaacatgttcctgcaggccgtgaaggagaaccagaagaggcgggagacagaggagaagatgaggcgggccaagctggccaaggagaaggccgagaaggagcggctggagaagcagcagaagcgggagcagctgattgacatgaatgcagaaggagatgaaacaggagtgatggacagcctgctggaggccctgcagagcggggccgccttccggaggaagaggggcccccggcaggccaacaggaaggccggctgtgctgtgaccagcctgctggccagcgagctgaccaaggatgatgccatggctgctgtgcctgccaaggtgtccaagaacagcgagaccttccccaccatcctggaggaggccaaggagctggtgggccgggccagctag

SEQ ID NO: 19393 - DNA, 3819 bp, Artificial Sequence
  Description of Artificial Sequence: Synthetic coding sequence
atggagcccccaggcggcagcctgggccctggccggggcacccgggacaagaagaagggccgcagcccagatgagctgcccagcgctggaggagatggcggcaagagcaagaagttcaccctgaagaggctgatggctgatgagctggagcgcttcacctccatgaggatcaagaaggagaaggagaagcccaacagcgcccacaggaacagcagcgccagctatggagatgaccccacagcccagagcctgcaggatgtgtctgatgagcaggtgctggtgctgtttgagcagatgctgctggacatgaacctgaatgaggagaagcagcagcccctgcgggagaaggacatcatcatcaagcgggagatggtgtcccagtacctgtacaccagcaaggccggcatgagccagaaggagagcagcaagagcgccatgatgtacatccaggagctgcggagcggcctgcgggacatgcccctgctgagctgcctggagagcctgcgggtgtccctgaacaacaaccctgtgtcctgggtgcagacctttggagctgagggcctggccagcctgctggacatcctgaagaggctgcatgatgagaaggaggagacagctggcagctatgacagcaggaacaagcatgagatcatccgctgcctgaaggccttcatgaacaacaagtttggcatcaagaccatgctggagacagaggagggcatcctgctgctggtgcgggccatggaccctgctgtgcccaacatgatgattgatgctgccaagctgctgagcgccctgtgcatcctgccccagcctgaggacatgaatgaaagagtgctggaggccatgacagaaagagctgagatggatgaggtggagcgcttccagcccctgctggatggcctgaagagcggcaccaccatcgccctgaaggtgggctgcctgcagctgatcaatgccctgatcaccccagctgaggagctggacttccgggtgcacatccgctctgagctgatgaggctgggcctgcaccaggtgctgcaggacctgcgggagattgaaaatgaagacatgagggtgcagctgaatgtgtttgatgagcagggcgaggaggacagctatgacctgaagggccgcctggatgacatccgcatggagatggatgacttcaatgaggtgttccagatcctgctgaacacagtgaaggacagcaaggccgagccccacttcctgagcatcctgcagcacctgctgctggtgagaaatgactatgaggcccggccccagtactacaagctgattgaggagtgcatcagccagatcgtgctgcacaagaatggagctgaccctgacttcaagtgccgccacctgcagattgaaattgagggcctgattgaccagatgattgacaagaccaaggtggagaagtctgaggccaaggctgctgagctggagaagaagctggacagcgagctgacagcccggcatgagctgcaggtggagatgaagaagatggagagtgactttgagcagaagctgcaggacctgcagggcgagaaggatgccctgcacagcgagaagcagcagatcgccacagagaagcaggacctggaggccgaggtgtcccagctgactggagaggtggccaagctgaccaaggagctggaggatgccaagaaggagatggccagcctgtctgctgctgccatcaccgtgcccccatctgtgcccagccgggcccctgtgcccccagccccacccctgcccggggacagcggcaccatcatccccccacctccagcccctggggacagcaccaccccacctcctcctcctcctcctcctcctcctcctccacccctgcccggcggcgtgtgcatcagcagcccccccagcctgcccggcggcacagccatcagccccccaccacccctgtctggagatgccaccatccccccacctccacccctgcctgagggcgtgggcatccccagccccagcagcctgcccggcggcacagccatccccccacctccacccctgcccggcagcgcccgcatccccccacctcctccacccctgcccggcagcgctggcatccccccacctcctccacccctgcccggggaggccggcatgcctcctcctcctccacccctgcccggcggccctggcatccccccacctccacccttccctgggggccctggcatccccccacctcctcctggcatgggcatgcctcctcctcctccatttggatttggagtgcctgctgcccctgtgctgcccttcggcctgacccccaagaagctgtacaagccagaggtgcagctgcggcggcccaactggagcaagctggtggccgaggacctgagccaggactgcttctggaccaaggtgaaggaggacagatttgaaaataatgagctgtttgccaagctgaccctgaccttcagcgcccagaccaagaccagcaaggccaagaaggaccaggagggcggggaggagaagaagtctgtgcagaagaagaaggtgaaggagctgaaggtgctggacagcaagacagcccagaacctgagcatcttcctgggcagcttcaggatgccctaccaggagatcaagaatgtcatcctggaggtgaatgaggccgtgctgacagagagcatgatccagaacctgatcaagcagatgcctgagcctgagcagctgaagatgctgtctgagctgaaggatgaatatgatgacctggccgagagcgagcagtttggagtggtgatgggcaccgtgccccggctgcggccccggctgaatgccatcctcttcaagctgcagttcagcgagcaggtggagaacatcaagccagaaattgtgtctgtgacagctgcctgtgaggagctgaggaagtctgagagcttcagcaacctgctggagatcaccctgctggtgggcaactacatgaatgccggcagcagaaatgctggggccttcggcttcaacatctccttcctgtgcaagctgcgggacaccaagagcacagaccagaagatgaccctgctgcacttcctggccgagctgtgtgaaaatgactacccagatgtgctgaagttcccagatgagctggcccacgtggagaaggccagccgggtgtctgctgagaacctgcagaagaacctggaccagatgaagaagcagatcagtgatgtggagagagatgtgcagaacttccctgctgccacagatgagaaggacaagtttgtggagaagatgaccagctttgtgaaggatgcccaggagcagtacaacaagctgaggatgatgcacagcaacatggagaccctgtacaaggagctgggggagtacttcctgtttgaccccaagaagctgtctgtggaggagttcttcatggacctgcacaacttcaggaacatgttcctgcaggccgtgaaggagaaccagaagagaagagaaacagaggagaagatgagaagagccaagctggccaaggagaaggccgagaaggagcggctggagaagcagcagaagcgggagcagctgattgacatgaatgcagaaggagatgagaccggggtgatggacagcctgctggaggccctgcagagcggggccgccttccggaggaagaggggcccccggcaggccaacaggaaggccggctgtgctgtgaccagcctgctggccagcgagctgaccaaggatgatgccatggctgctgtgcctgccaaggtgtccaagaacagcgagaccttccccaccatcctggaggaggccaaggagctggtgggccgggccagctag

SEQ ID NO: 19394 - DNA, 3747 bp, Artificial Sequence
  Description of Artificial Sequence: Synthetic coding sequence
atggagcccccaggcggcagcctgggccctggccggggcacccgggacaagaagaagggccgcagcccagatgagctgcccagcgctggaggagatggcggcaagagcaagaagttcctggagcgcttcacctccatgaggatcaagaaggagaaggagaagcccaacagcgcccacaggaacagcagcgccagctatggagatgaccccacagcccagagcctgcaggatgtgtctgatgagcaggtgctggtgctgtttgagcagatgctgctggacatgaacctgaatgaggagaagcagcagcccctgcgggagaaggacatcatcatcaagcgggagatggtgtcccagtacctgtacaccagcaaggccggcatgagccagaaggagagcagcaagagcgccatgatgtacatccaggagctgcggagcggcctgcgggacatgcccctgctgagctgcctggagagcctgcgggtgtccctgaacaacaaccctgtgtcctgggtgcagaccttcggggctgagggcctggccagcctgctggacatcctgaagaggctgcatgatgagaaggaggagacagctggcagctatgacagcaggaacaagcatgagatcatccgctgcctgaaggccttcatgaacaacaagtttggcatcaagaccatgctggagacagaggagggcatcctgctgctggtgcgggccatggaccctgctgtgcccaacatgatgattgatgctgccaagctgctgagcgccctgtgcatcctgccccagcctgaggacatgaatgaaagagtgctggaggccatgacagagcgggcagagatggatgaggtggagcgcttccagcccctgctggatggcctgaagagcggcaccaccatcgccctgaaggtgggctgcctgcagctgatcaatgccctgatcaccccagctgaggagctggacttccgggtgcacatccgctctgagctgatgaggctgggcctgcaccaggtgctgcaggacctgcgggagattgaaaatgaagacatgagggtgcagctgaatgtgtttgatgagcagggcgaggaggacagctatgacctgaagggccgcctggatgacatccgcatggagatggatgacttcaatgaggtgttccagatcctgctgaacacagtgaaggacagcaaggccgagccccacttcctgagcatcctgcagcacctgctgctggtgagaaatgactatgaggcccggccccagtactacaagctgattgaggagtgcatcagccagatcgtgctgcacaagaatggagctgaccctgacttcaagtgccgccacctgcagatcgagattgagggcctgattgaccagatgattgacaagaccaaggtggagaagtctgaggccaaggctgctgagctggagaagaagctggacagcgagctgacagcccggcatgagctgcaggtggagatgaagaagatggagagtgactttgagcagaagctgcaggacctgcagggcgagaaggatgccctgcacagcgagaagcagcagatcgccacagagaagcaggacctggaggccgaggtgtcccagctgaccggggaggtggccaagctgaccaaggagctggaggatgccaagaaggagatggccagcctgtctgctgctgccatcaccgtgccccccagcgtgcccagccgggcccctgtgcccccagccccacccctgcccggggacagcggcaccatcatccccccacctccagcccctggggacagcaccaccccacctcctcctcctcctcctcctcctcctcctccacccctgcccggcggcacagccatcagccccccaccacccctgtctggagatgccaccatccccccacctccacccctgcctgagggcgtgggcatccccagccccagcagcctgcccggcggcacagccatccccccacctccacccctgcccggcagcgcccgcatccccccacctcctccacccctgcccggcagcgctggcatccccccacctcctccacccctgcctggagaggccggcatgcctcctcctcctccacccctgcccggcggccctggcatccccccacctccacccttccctgggggccctggcatccccccacctcctcctggcatgggcatgcctcctcctccacccttcggcttcggcgtgcctgctgcccctgtgctgcccttcggcctgacccccaagaagctgtacaagccagaggtgcagctgcggcggcccaactggagcaagctggtggccgaggacctgagccaggactgcttctggaccaaggtgaaggaggacagatttgagaacaatgagctgtttgccaagctgaccctgaccttcagcgcccagaccaagaccaagaaggaccaggagggcggggaggagaagaagtctgtgcagaagaagaaggtgaaggagctgaaggtgctggacagcaagacagcccagaacctgagcatcttcctgggcagcttcaggatgccctaccaggagatcaagaatgtcatcctggaggtgaatgaggccgtgctgacagagagcatgatccagaacctgatcaagcagatgcctgagcctgagcagctgaagatgctgtctgagctgaaggatgaatatgatgacctggccgagagcgagcagtttggagtggtgatgggcaccgtgccccggctgcggccccggctgaatgccatcctcttcaagctgcagttcagcgagcaggtggagaacatcaagccagaaattgtgtctgtgacagctgcctgtgaggagctgaggaagtctgagagcttcagcaacctgctggagatcaccctgctggtgggcaactacatgaatgccggcagcagaaatgctggggccttcggcttcaacatctccttcctgtgcaagctgcgggacaccaagagcacagaccagaagatgaccctgctgcacttcctggccgagctgtgtgaaaatgactacccagatgtgctgaagttcccagatgagctggcccacgtggagaaggccagccgggtgtctgctgagaacctgcagaagaacctggaccagatgaagaagcagatcagtgatgtggagagagatgtgcagaacttccctgctgccacagatgagaaggacaagtttgtggagaagatgaccatctttgtgaaggatgcccaggagcagtacaacaagctgaggatgatgcacagcaacatggagaccctgtacaaggagctgggggagtacttcctgtttgaccccaagaagctgtctgtggaggagttcttcatggacctgcacaacttcaggaacatgttcctgcaggccgtgaaggagaaccagaagagaagagaaacagaggagaagatgagaagagccaagctggccaaggagaaggccgagaaggagcggctggagaagcagcagaagcgggagcagctgattgacatgaatgcagaaggagatgagaccggggtgatggacagcctgctggaggccctgcagagcggggccgccttccggaggaagaggggcccccggcaggccaacaggaaggccggctgtgctgtgaccagcctgctggccagcgagctgaccaaggatgatgccatggctgctgtgcctgccaaggtgtccaagaacagcgagaccttccccaccatcctggaggaggccaaggagctggtgggccgggccagctag

SEQ ID NO: 19395 - DNA, 3795 bp, Artificial Sequence
  Description of Artificial Sequence: Synthetic coding sequence
atggagcccccaggcggcagcctgggccctggccggggcacccgggacaagaagaagggccgcagcccagatgagctgcccagcgctggaggagatggcggcaagagcaagaagttcctggagcgcttcacctccatgaggatcaagaaggagaaggagaagcccaacagcgcccacaggaacagcagcgccagctatggagatgaccccacagcccagagcctgcaggatgtgtctgatgagcaggtgctggtgctgtttgagcagatgctgctggacatgaacctgaatgaggagaagcagcagcccctgcgggagaaggacatcatcatcaagcgggagatggtgtcccagtacctgtacaccagcaaggccggcatgagccagaaggagagcagcaagagcgccatgatgtacatccaggagctgcggagcggcctgcgggacatgcccctgctgagctgcctggagagcctgcgggtgtccctgaacaacaaccctgtgtcctgggtgcagaccttcggggctgagggcctggccagcctgctggacatcctgaagaggctgcatgatgagaaggaggagacagctggcagctatgacagcaggaacaagcatgagatcatccgctgcctgaaggccttcatgaacaacaagtttggcatcaagaccatgctggagacagaggagggcatcctgctgctggtgcgggccatggaccctgctgtgcccaacatgatgattgatgctgccaagctgctgagcgccctgtgcatcctgccccagcctgaggacatgaatgaaagagtgctggaggccatgacagagcgggcagagatggatgaggtggagcgcttccagcccctgctggatggcctgaagagcggcaccaccatcgccctgaaggtgggctgcctgcagctgatcaatgccctgatcaccccagctgaggagctggacttccgggtgcacatccgctctgagctgatgaggctgggcctgcaccaggtgctgcaggacctgcgggagattgaaaatgaagacatgagggtgcagctgaatgtgtttgatgagcagggcgaggaggacagctatgacctgaagggccgcctggatgacatccgcatggagatggatgacttcaatgaggtgttccagatcctgctgaacacagtgaaggacagcaaggccgagccccacttcctgagcatcctgcagcacctgctgctggtgagaaatgactatgaggcccggccccagtactacaagctgattgaggagtgcatcagccagatcgtgctgcacaagaatggagctgaccctgacttcaagtgccgccacctgcagatcgagattgagggcctgattgaccagatgattgacaagaccaaggtggagaagtctgaggccaaggctgctgagctggagaagaagctggacagcgagctgacagcccggcatgagctgcaggtggagatgaagaagatggagagtgactttgagcagaagctgcaggacctgcagggcgagaaggatgccctgcacagcgagaagcagcagatcgccacagagaagcaggacctggaggccgaggtgtcccagctgaccggggaggtggccaagctgaccaaggagctggaggatgccaagaaggagatggccagcctgtctgctgctgccatcaccgtgccccccagcgtgcccagccgggcccctgtgcccccagccccacccctgcccggggacagcggcaccatcatccccccacctccagcccctggggacagcaccaccccacctcctcctcctcctcctcctcctcctcctccacccctgcctggaggagtgtgcatcagcagcccccccagcctgcccggcggcacagccatcagccccccaccacccctgtctggagatgccaccatccccccacctccacccctgcctgagggcgtgggcatccccagccccagcagcctgcccggcggcacagccatccccccacctccacccctgcccggcagcgcccgcatccccccacctcctccacccctgcccggcagcgctggcatccccccacctcctccacccctgcctggagaggccggcatgcctcctcctcctccacccctgcccggcggccctggcatccccccacctccacccttccctgggggccctggcatccccccacctcctcctggcatgggcatgcctcctcctccacccttcggcttcggcgtgcctgctgcccctgtgctgcccttcggcctgacccccaagaagctgtacaagccagaggtgcagctgcggcggcccaactggagcaagctggtggccgaggacctgagccaggactgcttctggaccaaggtgaaggaggacagatttgagaacaatgagctgtttgccaagctgaccctgaccttcagcgcccagaccaagaggaccaagaaggccaagaaggaccaggagggcggggaggagaagaagtctgtgcagaagaagaaggtgaaggagctgaaggtgctggacagcaagacagcccagaacctgagcatcttcctgggcagcttcaggatgccctaccaggagatcaagaatgtcatcctggaggtgaatgaggccgtgctgacagagagcatgatccagaacctgatcaagcagatgcctgagcctgagcagctgaagatgctgtctgagctgaaggatgaatatgatgacctggccgagagcgagcagtttggagtggtgatgggcaccgtgccccggctgcggccccggctgaatgccatcctcttcaagctgcagttcagcgagcaggtggagaacatcaagccagaaattgtgtctgtgacagctgcctgtgaggagctgaggaagtctgagagcttcagcaacctgctggagatcaccctgctggtgggcaactacatgaatgccggcagcagaaatgctggggccttcggcttcaacatctccttcctgtgcaagctgcgggacaccaagagcacagaccagaagatgaccctgctgcacttcctggccgagctgtgtgaaaatgactacccagatgtgctgaagttcccagatgagctggcccacgtggagaaggccagccgggtgtctgctgagaacctgcagaagaacctggaccagatgaagaagcagatcagtgatgtggagagagatgtgcagaacttccctgctgccacagatgagaaggacaagtttgtggagaagatgaccatctttgtgaaggatgcccaggagcagtacaacaagctgaggatgatgcacagcaacatggagaccctgtacaaggagctgggggagtacttcctgtttgaccccaagaagctgtctgtggaggagttcttcatggacctgcacaacttcaggaacatgttcctgcaggccgtgaaggagaaccagaagagaagagaaacagaggagaagatgagaagagccaagctggccaaggagaaggccgagaaggagcggctggagaagcagcagaagcgggagcagctgattgacatgaatgcagaaggagatgagaccggggtgatggacagcctgctggaggccctgcagagcggggccgccttccggaggaagaggggcccccggcaggccaacaggaaggccggctgtgctgtgaccagcctgctggccagcgagctgaccaaggatgatgccatggctgctgtgcctgccaaggtgtccaagaacagcgagaccttccccaccatcctggaggaggccaaggagctggtgggccgggccagctag

SEQ ID NO: 19396 - DNA, 855 bp, Artificial Sequence
  Description of Artificial Sequence: Synthetic coding sequence
atggccagcctgtctgctgctgccatcaccgtgccccccagcgtgcccagccgggcccctgtgcccccagccccacccctgcccggggacagcggcaccatcatccccccacctccagcccctggggacagcaccaccccacctcctcctcctcctcctcctcctcctcctccacccctgcctggaggagtgtgcatcagcagcccccccagcctgcccggcggcacagccatcagccccccaccacccctgtctggagatgccaccatccccccacctccacccctgcctgagggcgtgggcatccccagccccagcagcctgcccggcggcacagccatccccccacctccacccctgcccggcagcgcccgcatccccccacctcctccacccctgcccggcagcgctggcatccccccacctcctccacccctgcctggagaggccggcatgcctcctcctcctccacccctgcccggcggccctggcatccccccacctccacccttccctgggggccctggcatccccccacctcctcctggcatgggcatgcctcctcctccacccttcggcttcggcgtgcctgctgcccctgtgctgcccttcggcctgacccccaagaagctgtacaagccagaggtgcagctgcggcggcccaactggagcaagctggtggccgaggacctgagccaggactgcttctggaccaaggtgaaggaggacagatttgagaacaatgagctgtttgccaagctgaccctgaccttcagcgcccagaccaagtctgagaaggccaagaaggaccaggagggcggggaggagaagaagtctgtgcagaagaagaagtag

SEQ ID NO: 19397 - DNA, 513 bp, Artificial Sequence
  Description of Artificial Sequence: Synthetic coding sequence
atgtactgccagtttgccagcttccagtacacctgccagccctgccggggccagaggatgctgtgcacccgggacagcgagtgctgcggggaccagctgtgtgtgtggggccactgcaccaagatggccacccggggcagcaatggcaccatctgtgacaaccagagggactgccagcccggcctgtgctgtgccttccagaggggcctgctcttccctgtgtgcacccccctgcctgtggagggggagctgtgccacgaccctgccagccggctgctggacctgatcacctgggagctggagccagatggagccctggaccgctgcccctgtgccagcggcctgctgtgccagccccacagccacagcctggtgtatgtgtgcaagcccacctttgtgggcagccgggaccaggatggagagatcctgctgccccgggaggtgcctgatgagtacctggccgcctcctggaggcgctgtgcccgctcctggaggacctggaggggggcctag

SEQ ID NO: 19398 - DNA, 1053 bp, Artificial Sequence
  Description of Artificial Sequence: Synthetic coding sequence
atgcagaggctgggcgccaccctgctgtgcctgctgctggccgctgctgtgcccacagccccagccccagcccccacagccaccagcgcccctgtgaagccaggccctgccctgagctacccccaggaggaggccaccctgaatgagatgttccgggaggtggaggagctgatggaggacacccagcacaagctgcggtctgctgtggaggagatggaggccgaggaggccgccgccaaggccagcagcgaggtgaacctggccaacctgcccccatcctaccacaatgagaccaacacagacaccaaggtgggcaacaacaccatccacgtgcaccgggagatccacaagatcaccaacaaccagacaggccagatggtgttttctgaaacagtcatcacctctgtgggagatgaggagggccgccgcagccatgagtgcatcattgatgaggactgtggccccagcatgtactgccagtttgccagcttccagtacacctgccagccctgccggggccagaggatgctgtgcacccgggacagcgagtgctgcggggaccagctgtgtgtgtggggccactgcaccaagatggccacccggggcagcaatggcaccatctgtgacaaccagagggactgccagcccggcctgtgctgtgccttccagaggggcctgctcttccctgtgtgcacccccctgcctgtggagggggagctgtgccacgaccctgccagccggctgctggacctgatcacctgggagctggagccagatggagccctggaccgctgcccctgtgccagcggcctgctgtgccagccccacagccacagcctggtgtatgtgtgcaagcccacctttgtgggcagccgggaccaggatggagagatcctgctgccccgggaggtgcctgatgaatatgaggtgggcagcttcatggaggaggtgcggcaggagctggaggacctggagaggagcctgacagaggagatggccctgcgggagcctgctgctgctgctgctgccctgctgggcggggaggagatctag

SEQ ID NO: 19399 - DNA, 882 bp, Artificial Sequence
  Description of Artificial Sequence: Synthetic coding sequence
atggaggacacccagcacaagctgcggtctgctgtggaggagatggaggccgaggaggccgccgccaaggccagcagcgaggtgaacctggccaacctgccccccagctaccacaatgagaccaacacagacaccaaggtgggcaacaacaccatccacgtgcaccgggagatccacaagatcaccaacaaccagacaggccagatggtgttcagcgagaccgtcatcacctctgtgggagatgaggagggcagaagaagccatgagtgcatcattgatgaggactgtggccccagcatgtactgccagtttgccagcttccagtacacctgccagccctgccggggccagaggatgctgtgcacccgggacagcgagtgctgcggggaccagctgtgtgtgtggggccactgcaccaagatggccacccggggcagcaatggcaccatctgtgacaaccagagggactgccagcccggcctgtgctgtgccttccagaggggcctgctcttccctgtgtgcacccccctgcctgtggagggggagctgtgccacgaccctgccagccggctgctggacctgatcacctgggagctggagccagatggagccctggaccgctgcccctgtgccagcggcctgctgtgccagccccacagccacagcctggtgtatgtgtgcaagcccacctttgtgggcagccgggaccaggatggagagatcctgctgccccgggaggtgcctgatgaatatgaggtgggcagcttcatggaggaggtgcggcaggagctggaggacctggagaggagcctgacagaggagatggccctgcgggagcctgctgctgctgctgctgccctgctgggcggggaggagatctag

SEQ ID NO: 19400 - DNA, 1053 bp, Artificial Sequence; identical to SEQ ID NO: 19398
  Description of Artificial Sequence: Synthetic coding sequence

SEQ ID NO: 19401 - DNA, 969 bp, Artificial Sequence
  Description of Artificial Sequence: Synthetic coding sequence
atgcagaggctgggcgccaccctgctgtgcctgctgctggccgctgctgtgcccacagccccagccccagcccccacagccaccagcgcccctgtgaagccaggccctgccctgagctacccccaggaggaggccaccctgaatgagatgttccgggaggtggaggagctgatggaggacacccagcacaagctgcggtctgctgtggaggagatggaggccgaggaggccgccgccaaggccagcagcgaggtgaacctggccaacctgcccccatcctaccacaatgagaccaacacagacaccaaggtgggcaacaacaccatccacgtgcaccgggagatccacaaggagtgcatcattgatgaggactgtggccccagcatgtactgccagtttgccagcttccagtacacctgccagccctgccggggccagaggatgctgtgcacccgggacagcgagtgctgcggggaccagctgtgtgtgtggggccactgcaccaagatggccacccggggcagcaatggcaccatctgtgacaaccagagggactgccagcccggcctgtgctgtgccttccagaggggcctgctcttccctgtgtgcacccccctgcctgtggagggggagctgtgccacgaccctgccagccggctgctggacctgatcacctgggagctggagccagatggagccctggaccgctgcccctgtgccagcggcctgctgtgccagccccacagccacagcctggtgtatgtgtgcaagcccacctttgtgggcagccgggaccaggatggagagatcctgctgccccgggaggtgcctgatgaatatgaggtgggcagcttcatggaggaggtgcggcaggagctggaggacctggagaggagcctgacagaggagatggccctgcgggagcctgctgctgctgctgctgccctgctgggcggggaggagatctag

SEQ ID NO: 19402 - DNA, 708 bp, Artificial Sequence
  Description of Artificial Sequence: Synthetic coding sequence
atgcagaggctgggcgccaccctgctgtgcctgctgctggccgctgctgtgcccacagccccagccccagcccccacagccaccagcgcccctgtgaagccaggccctgccctgagctacccccaggaggaggccaccctgaatgagatgttccgggaggtggaggagctgatggaggacacccagcacaagctgcggtctgctgtggaggagatggaggccgaggaggccgccgccaaggccagcagcgaggtgaacctggccaacctgcccccatcctaccacaatgagaccaacacagacaccaaggtgggcaacaacaccatccacgtgcaccgggagatccacaagatcaccaacaaccagacaggccagatggtgttttctgaaacagtcatcacctctgtgggagatgaggagggccgccgcagccatgagtgcatcattgatgaggactgtggccccagcatgtactgccagtttgccagcttccagtacacctgccagccctgccggggccagaggatgctgtgcacccgggacagcgagtgctgcggggaccagctgtgtgtgtggggccactgcaccaagatggccacccggggcagcaatggcaccatctgtgacaaccagagggactgccagcccggcctgtgctgtgccttccagaggggcctgctcttccctgtgtgcacccccctgccctag

SEQ ID NO: 19403 - DNA, 2301 bp, Artificial Sequence
  Description of Artificial Sequence: Synthetic coding sequence
atgaagaccccctggaaggtgctgctgggcctgctgggcgctgctgccctggtgaccatcatcaccgtgcctgtggtgctgctgaacaagggcacagatgatgccacagctgacagcaggaagacctacaccctgacagactacctgaagaacacctaccgcctgaagctgtacagcctgcgctggatcagtgaccacgagtacctgtacaagcaggagaacaacatcctggtgttcaatgcagaatatggcaacagctctgtgttcctggagaacagcacctttgatgaatttggccacagcatcaatgactacagcatcagcccagatggccagttcatcctgctggagtacaactacgtgaagcagtggaggcacagctacacagccagctatgacatctatgacctgaacaagaggcagctgatcacagaggagcgcatccccaacaacacccagtgggtgacctggagccctgtgggccacaagctggcctacgtgtggaacaatgacatctacgtgaagattgagcccaacctgcccagctaccgcatcacctggacaggcaaggaggacatcatctacaacggcatcacagactgggtgtatgaggaggaggtgttttctgcctacagcgccctgtggtggagccccaacggcaccttcctggcctatgcccagttcaatgacacagaggtgcccctcatcgagtacagcttctacagtgatgagagcctgcagtaccccaagacagtgcgggtgccctaccccaaggccggggctgtgaaccccaccgtgaagttctttgtggtgaacacagacagcctgagctctgtgaccaatgccaccagcatccagatcacagccccagcctccatgctgattggagaccactacctgtgtgatgtgacctgggccacccaggagcgcatcagcctgcagtggctgcggcgcatccagaactacagcgtgatggacatctgtgactatgatgagagcagcggccgctggaactgcctggtggcccggcagcacatcgagatgagcaccaccggctgggtgggccgcttccggcccagcgagccccacttcaccctggatggcaacagcttctacaagatcatcagcaatgaggagggctaccgccacatctgctacttccagattgacaagaaggactgcaccttcatcaccaagggcacctgggaggtgattggaattgaggccctgaccagtgactacctgtactacatcagcaatgagtacaagggcatgcctgggggcaggaacctgtacaagatccagctgagtgactacaccaaggtgacctgcctgagctgtgagctgaaccctgagcgctgccagtactacagcgtgtccttcagcaaggaggccaagtactaccagctgcgctgcagcggccctggcctgcccctgtacaccctgcacagctctgtgaatgacaagggcctgcgggtgctggaggacaacagcgccctggacaagatgctgcagaatgtgcagatgcccagcaagaagctggacttcatcatcctgaatgagaccaagttctggtaccagatgatcctgcccccccactttgacaagagcaagaagtaccccctgctgctggatgtgtatgccggcccctgcagccagaaggctgacacagtgttccggctgaactgggccacctacctggccagcacagagaacatcatcgtggccagctttgatggccggggcagcggctaccagggcgacaagatcatgcacgccatcaacagaaggctgggcacctttgaggtggaggaccagattgaagctgcccggcagttcagcaagatgggctttgtggacaacaagagaattgccatctggggctggagctatggaggctacgtgacctccatggtgctgggcagcggcagcggggtcttcaagtgtggcattgctgtggcccctgtgagccgctgggagtactatgacagcgtgtacacagagcgctacatgggcctgcccaccccagaggacaacctggaccactacagaaacagcacagtgatgagcagagctgagaacttcaagcaggtggagtacctgctgatccacggcacagcagatgacaacgtgcacttccagcagagcgcccagatcagcaaggccctggtggatgtgggcgtggacttccaggccatgtggtacacagatgaggaccacggcatcgccagcagcacagcccaccagcacatctacacccacatgagccacttcatcaagcagtgcttcagcctgccctag

SEQ ID NO: 19404 - DNA, 645 bp, Artificial Sequence
  Description of Artificial Sequence: Synthetic coding sequence
atgaatgtgttccgcatcctgggggacctgagccacctgctggccatgatcctgctgctgggcaagatctggaggagcaagtgctgcaagggcatcagcggcaagagccagatcctgtttgccctggtgttcaccacccgctacctggacctcttcaccaacttcatcagcatctacaacacagtgatgaaggtggtgttcctgctgtgtgcctacgtgacagtgtacatgatctacggcaagttcaggaagacctttgacagtgaaaatgacaccttccggctggagttcctgctggtgcctgtgattggcctgtccttcctggagaactacagcttcaccctgctggagatcctgtggaccttcagcatctacctggagagcgtggccatcctgccccagctgttcatgatcagcaagacaggagaggccgagaccatcaccacccactacctgttcttcctgggcctgtaccgggccctgtacctggccaactggatccgccgctaccagacagagaacttctatgaccagattgctgtggtgtctggagtggtgcagaccatcttctactgtgacttcttctacctgtatgtgaccaaggtgctgaagggcaagaagctgagcctgcccatgcccatctag

SEQ ID NO: 19405 - DNA, 498 bp, Artificial Sequence
  Description of Artificial Sequence: Synthetic coding sequence
atgaaggaggaccaggtggtggccgaggagcccggcttccaggatgaggaggagagcctcttccaggacatcgacctgctgcagaagcacggcatcaacgtggccgacatcaagaagctgaagtctgtgggcatctgcaccatcaagggcatccagatgaccacccggcgggccctgtgcaatgtgaagggcctgtctgaggccaaggtggacaagatcaaggaggccgccaacaagctgattgagcccggcttcctgacagcctttgagtacagcgagaagaggaagatggtgttccacatcaccaccggcagccaggagtttgacaagctgctgggcggcggcatcgagagcatggccatcacagaggcctttggagagttcagaacaggcaagacccagctgagccacaccctgtgtgtgacagcccagctgcccggggccggcggctacccaggcggcaagatcatcttcatcgacacagagaacaccctgtag

SEQ ID NO: 19406 - DNA, 420 bp, Artificial Sequence
  Description of Artificial Sequence: Synthetic coding sequence
atgaaggaggaccaggtggtggccgaggagcccggcttccaggatgaggaggagagcctcttccaggacatcgacctgctgcagaagcacggcatcaacgtggccgacatcaagaagctgaagtctgtgggcatctgcaccatcaagggcatccagatgaccacccggcgggccctgtgcaatgtgaagggcctgtctgaggccaaggtggacaagatcaaggaggccgccaacaagctgattgagcccggcttcctgacagcctttgagtacagcgagaagaggaagatggtgttccacatcaccaccggcagccaggagtttgacaagctgctgggcggcggcatcgagagcatggccatcacagaggcctttggagagttcagaacaggcaagacccagctgagccacaccctgtag

SEQ ID NO: 19407 - DNA, 858 bp, Artificial Sequence
  Description of Artificial Sequence: Synthetic coding sequence
atgaaggaggaccaggtggtggccgaggagcccggcttccaggatgaggaggagagcctcttccaggacatcgacctgctgcagaagcacggcatcaacgtggccgacatcaagaagctgaagtctgtgggcatctgcaccatcaagggcatccagatgaccacccggcgggccctgtgcaatgtgaagggcctgtctgaggccaaggtggacaagatcaaggaggccgccaacaagctgattgagcccggcttcctgacagcctttgagtacagcgagaagaggaagatggtgttccacatcaccaccggcagccaggagtttgacaagctgctgggcggcggcatcgagagcatggccatcacagaggcctttggagagttcagaacaggcaagacccagctgagccacaccctgtgtggggagcaccagatggagctgctggactatgtggccgccaagttccacgaggaggccggcatcttcaagctgctgatcatcgacagcatcatggccctcttccgggtggacttcagcggccgcggggagctggccgagcggcagcagaagctggcccagatgctgagccggctgcagaagatcagcgaggagtacaacgtggccgtgtttgtgaccaaccagatgacagctgaccccggggccaccatgaccttccaggccgaccccaagaagcccatcggcggccacatcctggcccacgccagcaccacccgcatcagcctgaggaagggccgcggggagctgagaattgccaagatctatgacagccctgagatgccagaaaatgaggccacctttgccatcacagctgggggcattggagatgccaaggagtag

SEQ ID NO: 19408 - DNA, 612 bp, Artificial Sequence
  Description of Artificial Sequence: Synthetic coding sequence
atgaaggaggaccaggtggtggccgaggagcccggcttccaggatgaggaggagagcctcttccaggacatcgacctgctgcagaagcacggcatcaacgtggccgacatcaagaagctgaagtctgtgggcatctgcaccatcaagggcatccagatgaccacccggcgggccctgtgcaatgtgaagggcctgtctgaggccaaggtggacaagatcaaggaggccgccaacaagctgattgagcccggcttcctgacagcctttgagtacagcgagaagaggaagatggtgttccacatcaccaccggcagccaggagtttgacaagctgctgggcggcggcatcgagagcatggccatcacagaggcctttggagagttcagaacaggcaagacccagctgagccacaccctgtgtggggagcaccagatggagctgctggactatgtggccgccaagttccacgaggaggccggcatcttcaagctgctgatcatcgacagcatcatggccctcttccgggtggacttcagcggccgcggggagctggccgagcggcagcagaagctggcccagatgctgagccggctgcagaagatcagcgagtag

SEQ ID NO: 19409 - DNA, 1599 bp, Artificial Sequence
  Description of Artificial Sequence: Synthetic coding sequence
atgaatggagtgctgatcccccacacccccatcgctgtggacttctggagcctgcggcgggccggcacagcccggctcttcttcctgagccacatgcacagcgaccacacagtgggcctgagcagcacctgggcccggcccctgtactgcagccccatcacagcccacctgctgcaccgccacctgcaggtgtccaagcagtggatccaggccctggaggtgggggagagccacgtgctgcccctggatgaaattggccaggagaccatgacagtgaccctgctggatgccaaccactgccccggctctgtgatgttcctgtttgagggctacttcggcaccatcctgtacaccggggacttccgctacacccccagcatgctgaaggagcccgccctgaccctgggcaagcagatccacaccctgtacctggacaacaccaactgcaacccagccctggtgctgcccagccggcaggaggccgcccaccagatcgtgcagctgatcaggaagcacccccagcacaacatcaagattggcctgtacagcctgggcaaggagagcctgctggagcagctggccctggagttccagacctgggtggtgctgagcccccggcggctggagctggtgcagctgctgggcctggctgatgtgttcaccgtggaggagaaggccggccgcatccatgctgtggaccacatggagatctgccacagcaacatgctgcgctggaaccagacccaccccaccatcgccatcctgcccaccagcaggaagatccacagcagccacccagacatccacgtgatcccctacagcgaccacagcagctacagcgagctgcgggcctttgtggccgccctgaagccctgccaggtggtgcccatcgtgtcccggcggccctgtggcggcttccaggacagcctgagcccccgcatctctgtgcccctcatcccagacagcgtgcagcagtacatgagcagcagcagcaggaagcccagcctgctgtggctgctggagcggcggctgaagaggcccaggacccagggcgtggtgtttgagagccctgaggagagcgctgaccagagccaggccgaccgggacagcaagaaggccaagaaggagaagctgagcccctggccagctgacctggagaagcagcccagccaccaccccctgcgcatcaagaagcagctgttcccagacctgtacagcaaggagtggaacaaggctgtgcccttctgtgagagccagaagagggtgaccatgctgacagcccccctgggcttctctgtgcacctgcggagcacagatgaggagttcatcagccagaagacccgggaggagatcggcctgggcagccccctggtgcccatgggagatgatgatggcggccctgaggccaccggcaaccagagcgcctggatgggccacggcagccccctgagccacagcagcaagggcacccccctgctggccacagagttccggggcctggccctgaagtacctgctgacccctgtgaacttcttccaggccggctacagcagcagaagatttgaccagcaggtggagaagtaccacaagccctgctag

SEQ ID NO: 19410 - DNA, 1734 bp, Artificial Sequence
  Description of Artificial Sequence: Synthetic coding sequence
atgaagcaccaggagcgcttcctgttccagggcaacaatggaacagtgctgtacacaggagacttccggctggcccagggcgaggccgccaggatggagctgctgcacagcggcggccgggtgaaggacatccagagcgtgtacctggacaccaccttctgtgacccccgcttctaccagatccccagccgggaggagtgcctgtctggagtgctggagctggtgcgctcctggatcaccaggagcccctaccacgtggtgtggctgaactgcaaggccgcctacggctatgagtacctgttcaccaacctgtctgaggagctgggcgtgcaggtgcacgtgaacaagctggacatgttcaggaacatgcctgagatcctgcaccacctgaccacagacaggaacacccagatccacgcctgccgccaccccaaggccgaggagtacttccagtggagcaagctgccctgtggcatcaccagcaggaaccgcatccccctgcacatcatcagcatcaagcccagcaccatgtggtttggagagaggagcaggaagaccaacgtgattgtgaggactggagagagcagctaccgggcctgcttctccttccacagcagctacagcgagatcaaggacttcctgagctacctgtgccctgtgaatgcctacccaaatgtcatccctgtgggcaccaccatggacaaggtggtggagatcctgaagcccctgtgccgcagcagccagagcacagagcccaagtacaagcccctgggcaagctgaagagggccaggacagtgcaccgggacagcgaggaggaggatgactacctgtttgatgaccccctgcccatccccctgcggcacaaggtgccctacccagagaccttccaccctgaggtgttctccatgacagctgtgtctgagaagcagcctgagaagctgcggcagaccccaggctgctgcagagctgagtgcatgcagagcagccgcttcaccaactttgtggactgtgaggagagcaacagcgagagcgaggaggaggtgggcatcccagccagcctgcagggcgacctgggctctgtgctgcacctgcagaaggcagatggagatgtgccccagtgggaggtgttcttcaagagaaatgatgagatcacagatgagagcctggagaacttccccagcagcacagtggccggcggcagccagagccccaagctgttcagtgacagtgatggagagagcacccacatcagcagccagaacagcagccagagcacccacatcacagagcagggcagccagggctgggacagccagagcgacacagtgctgctgagcagccaggagaggaacagcggggacatcaccagcctggacaaggctgactaccggcccaccatcaaggagaacatcccagccagcctgatggagcagaatgtcatctgccccaaggacacctacagcgacctgaagagccgggacaaggatgtgaccatcgtgcccagcactggagagcccaccaccctgagcagcgagacccacatccctgaggagaagagcctgctgaacctgagcaccaatgctgacagccagagcagcagtgactttgaggtgcccagcaccccagaggccgagctgcccaagcgggagcacctgcagtacctgtatgagaagctggccactggagagagcattgctgtgaagaagaggaagtgcagcctgctggacacctag

SEQ ID NO: 19411 - DNA, 255 bp, Artificial Sequence
  Description of Artificial Sequence: Synthetic coding sequence
atgttcctgttccagggcaacaacggcaccgtgctgtacaccggggacttccggctggcccagggcgaggccgccaggatggagctgctgcacagcggcggccgggtgaaggacatccagagcgtgtacctggacaccaccttctgtgacccccgcttctaccagatccccagccgggaggagtgcctgagcggcgtgctggagctggtgcgctcctggatcaccaggagcccctaccacgtggtgtggctgtag

SEQ ID NO: 19412 - DNA, 1038 bp, Artificial Sequence
  Description of Artificial Sequence: Synthetic coding sequence
atggacaaggtggtggagatcctgaagcccctgtgccgcagcagccagagcacagagcccaagtacaagcccctgggcaagctgaagagggccaggacagtgcaccgggacagcgaggaggaggatgactacctgtttgatgaccccctgcccatccccctgcggcacaaggtgccctacccagagaccttccaccctgaggtgttctccatgacagctgtgtctgagaagcagcctgagaagctgcggcagaccccaggctgctgcagagctgagtgcatgcagagcagccgcttcaccaactttgtggactgtgaggagagcaacagcgagagcgaggaggaggtgggcatcccagccagcctgcagggcgacctgggctctgtgctgcacctgcagaaggcagatggagatgtgccccagtgggaggtgttcttcaagagaaatgatgagatcacagatgagagcctggagaacttccccagcagcacagtggccggcggcagccagagccccaagctgttcagtgacagtgatggagagagcacccacatcagcagccagaacagcagccagagcacccacatcacagagcagggcagccagggctgggacagccagagcgacacagtgctgctgagcagccaggagaggaacagcggggacatcaccagcctggacaaggctgactaccggcccaccatcaaggagaacatcccagccagcctgatggagcagaatgtcatctgccccaaggacacctacagcgacctgaagagccgggacaaggatgtgaccatcgtgcccagcactggagagcccaccaccctgagcagcgagacccacatccctgaggagaagagcctgctgaacctgagcaccaatgctgacagccagagcagcagtgactttgaggtgcccagcaccccagaggccgagctgcccaagcgggagcacctgcagtacctgtatgagaagctggccactggagagagcattgctgtgaagaagaggaagtgcagcctgctggacacctag

SEQ ID NO: 19413 - DNA, 1734 bp, Artificial Sequence; identical to SEQ ID NO: 19410
  Description of Artificial Sequence: Synthetic coding sequence

SEQ ID NO: 19414 - DNA, 1734 bp, Artificial Sequence; identical to SEQ ID NO: 19410
  Description of Artificial Sequence: Synthetic coding sequence

SEQ ID NO: 19415 - DNA, 1719 bp, Artificial Sequence
  Description of Artificial Sequence: Synthetic coding sequence
atgttcctgttccagggcaacaacggcaccgtgctgtacaccggggacttccggctggcccagggcgaggccgccaggatggagctgctgcacagcggcggccgggtgaaggacatccagagcgtgtacctggacaccaccttctgtgacccccgcttctaccagatccccagccgggaggagtgcctgagcggcgtgctggagctggtgcgctcctggatcaccaggagcccctaccacgtggtgtggctgaactgcaaggccgcctacggctatgagtacctgttcaccaacctgtctgaggagctgggcgtgcaggtgcacgtgaacaagctggacatgttcaggaacatgcctgagatcctgcaccacctgaccacagacaggaacacccagatccacgcctgccgccaccccaaggccgaggagtacttccagtggagcaagctgccctgtggcatcaccagcaggaaccgcatccccctgcacatcatcagcatcaagcccagcaccatgtggtttggagagaggagcaggaagaccaacgtcatcgtgaggactggagagagcagctaccgggcctgcttctccttccacagcagctacagcgagatcaaggacttcctgagctacctgtgccctgtgaatgcctaccccaacgtcatccctgtgggcaccaccatggacaaggtggtggagatcctgaagcccctgtgccgcagcagccagagcacagagcccaagtacaagcccctgggcaagctgaagagggccaggacagtgcaccgggacagcgaggaggaggatgactacctgtttgatgaccccctgcccatccccctgcggcacaaggtgccctacccagagaccttccaccctgaggtgttctccatgacagctgtgtctgagaagcagcctgagaagctgcggcagaccccaggctgctgcagagctgagtgcatgcagagcagccgcttcaccaactttgtggactgtgaggagagcaacagcgagagcgaggaggaggtgggcatcccagccagcctgcagggcgacctgggctctgtgctgcacctgcagaaggcagatggagatgtgccccagtgggaggtgttcttcaagagaaatgatgagatcacagatgagagcctggagaacttccccagcagcacagtggccggcggcagccagagccccaagctgttcagtgacagtgatggagagagcacccacatcagcagccagaacagcagccagagcacccacatcacagagcagggcagccagggctgggacagccagagcgacacagtgctgctgagcagccaggagagaaattctggggacatcaccagcctggacaaggctgactaccggcccaccatcaaggagaacatcccagccagcctgatggagcagaatgtcatctgccccaaggacacctacagcgacctgaagagccgggacaaggatgtgaccatcgtgcccagcactggagagcccaccaccctgagcagcgagacccacatccctgaggagaagagcctgctgaacctgagcaccaatgctgacagccagagcagcagtgactttgaggtgcccagcaccccagaggccgagctgcccaagcgggagcacctgcagtacctgtatgagaagctggccaccggggagagcattgctgtgaagaagaggaagtgcagcctgctggacacctag

SEQ ID NO: 19416 - DNA, 1719 bp, Artificial Sequence; identical to SEQ ID NO: 19415
  Description of Artificial Sequence: Synthetic coding sequence

SEQ ID NO: 19417 - DNA, 1719 bp, Artificial Sequence; identical to SEQ ID NO: 19415
  Description of Artificial Sequence: Synthetic coding sequence

SEQ ID NO: 19418 - DNA, 2079 bp, Artificial Sequence
  Description of Artificial Sequence: Synthetic coding sequence
atgagcagctttgagggccagatggccgagtaccccaccatcagcattgacagatttgaccgggagaacctgcgggcccgggcctacttcctgagccactgccacaaggaccacatgaagggcctgcgggcccccaccctgaagaggcggctggagtgcagcctgaaggtgtacctgtactgcagccctgtgaccaaggagctgctgctgaccagccccaagtaccgcttctggaagaagaggatcatcagcattgaaattgagacccccacccagatcagcctggtggatgaggccagcggggagaaggaggagatcgtggtgaccctgctgcctgctggccactgccccggctctgtgatgttcctgttccagggcaacaacggcaccgtgctgtacaccggggacttccggctggcccagggcgaggccgccaggatggagctgctgcacagcggcggccgggtgaaggacatccagagcgtgtacctggacaccaccttctgtgacccccgcttctaccagatccccagccgggaggagtgcctgagcggcgtgctggagctggtgcgctcctggatcaccaggagcccctaccacgtggtgtggctgaactgcaaggccgcctacggctatgagtacctgttcaccaacctgtctgaggagctgggcgtgcaggtgcacgtgaacaagctggacatgttcaggaacatgcctgagatcctgcaccacctgaccacagacaggaacacccagatccacgcctgccgccaccccaaggccgaggagtacttccagtggagcaagctgccctgtggcatcaccagcaggaaccgcatccccctgcacatcatcagcatcaagcccagcaccatgtggtttggagagaggagcaggaagaccaacgtcatcgtgaggactggagagagcagctaccgggcctgcttctccttccacagcagctacagcgagatcaaggacttcctgagctacctgtgccctgtgaatgcctaccccaacgtcatccctgtgggcaccaccatggacaaggtggtggagatcctgaagcccctgtgccgcagcagccagagcacagagcccaagtacaagcccctgggcaagctgaagagggccaggacagtgcaccgggacagcgaggaggaggatgactacctgtttgatgaccccctgcccatccccctgcggcacaaggtgccctacccagagaccttccaccctgaggtgttctccatgacagctgtgtctgagaagcagcctgagaagctgcggcagaccccaggctgctgcagagctgagtgcatgcagagcagccgcttcaccaactttgtggactgtgaggagagcaacagcgagagcgaggaggaggtgggcatcccagccagcctgcagggcgacctgggctctgtgctgcacctgcagaaggcagatggagatgtgccccagtgggaggtgttcttcaagagaaatgatgagatcacagatgagagcctggagaacttccccagcagcacagtggccggcggcagccagagccccaagctgttcagtgacagtgatggagagagcacccacatcagcagccagaacagcagccagagcacccacatcacagagcagggcagccagggctgggacagccagagcgacacagtgctgctgagcagccaggagagaaattctggggacatcaccagcctggacaaggctgactaccggcccaccatcaaggagaacatcccagccagcctgatggagcagaatgtcatctgccccaaggacacctacagcgacctgaagagccgggacaaggatgtgaccatcgtgcccagcactggagagcccaccaccctgagcagcgagacccacatccctgaggagaagagcctgctgaacctgagcaccaatgctgacagccagagcagcagtgactttgaggtgcccagcaccccagaggccgagctgcccaagcgggagcacctgcagtacctgtatgagaagctggccaccggggagagcattgctgtgaagaagaggaagtgcagcctgctggacacctag

SEQ ID NO: 19419 - DNA, 1305 bp, Artificial Sequence
  Description of Artificial Sequence: Synthetic coding sequence
atgagcagctttgagggccagatggccgagtaccccaccatcagcattgacagatttgaccgggagaacctgcgggcccgggcctacttcctgagccactgccacaaggaccacatgaagggcctgcgggcccccaccctgaagaggcggctggagtgcagcctgaaggtgtacctgtactgcagccctgtgaccaaggagctgctgctgaccagccccaagtaccgcttctggaagaagaggatcatcagcattgaaattgagacccccacccagatcagcctggtggatgaggccagcggggagaaggaggagatcgtggtgaccctgctgcctgctggccactgccccggctctgtgatgttcctgttccagggcaacaacggcaccgtgctgtacaccggggacttccggctggcccagggcgaggccgccaggatggagctgctgcacagcggcggccgggtgaaggacatccagagcgtgtacctggacaccaccttctgtgacccccgcttctaccagatccccagccgggaggagtgcctgagcggcgtgctggagctggtgcgctcctggatcaccaggagcccctaccacgtggtgtggctgaactgcaaggccgcctacggctatgagtacctgttcaccaacctgtctgaggagctgggcgtgcaggtgcacgtgaacaagctggacatgttcaggaacatgcctgagatcctgcaccacctgaccacagacaggaacacccagatccacgcctgccgccaccccaaggccgaggagtacttccagtggagcaagctgccctgtggcatcaccagcaggaaccgcatccccctgcacatcatcagcatcaagcccagcaccatgtggtttggagagaggagcaggaagaccaacgtcatcgtgaggactggagagagcagctaccgggcctgcttctccttccacagcagctacagcgagatcaaggacttcctgagctacctgtgccctgtgaatgcctaccccaacgtcatccctgtgggcaccaccatggacaaggtggtggagatcctgaagcccctgtgccgcagcagccagagcacagagcccaagtacaagcccctgggcaagctgaagagggccaggacagtgcaccgggacagcggcagccacagcgtgacccaggccaggatgcgctggtgccaccacgacagcctgtaccccctgaccccaggcatcaagaggagcagctgcctgagcctgctgacctcctggatcaccggggcctacagacatgcccagctgatgatctag

SEQ ID NO: 19420 - DNA, 1719 bp, Artificial Sequence; identical to SEQ ID NO: 19415
  Description of Artificial Sequence: Synthetic coding sequence

SEQ ID NO: 19421 - DNA, 354 bp, Artificial Sequence
  Description of Artificial Sequence: Synthetic coding sequence
atggagctgctgcacagcggcggccgggtgaaggacatccagagcgtgtacctggacaccaccttctgtgacccccgcttctaccagatccccagccgggaggagtgcctgagcggcgtgctggagctggtgcgctcctggatcaccaggagcccctaccacgtggtgtggctgaactgcaaggccgcctacggctatgagtacctgttcaccaacctgtctgaggagctgggcgtgcaggtgcacgtgaacaagctggacatgttcaggaacatgcctgagatcctgcaccacctgaccacagacaggaacacccagatccacgcctgccgccaccccaaggccgaggagtag

SEQ ID NO: 19422 - DNA, 1719 bp, Artificial Sequence; identical to SEQ ID NO: 19415
  Description of Artificial Sequence: Synthetic coding sequence

SEQ ID NO: 19423 - DNA, 174 bp, Artificial Sequence
  Description of Artificial Sequence: Synthetic coding sequence
atgaagcaccaggagcgcttcctgttccagggcaacaatggaacagtgctgtacacaggagacttccggctggcccagggcgaggccgccaggatggagctgctgcacagcggcggccgggtgaaggacatccagagcgtgtacctggacaccaccttctgtgaccccaggtag

SEQ ID NO: 19424 - DNA, 807 bp, Artificial Sequence
  Description of Artificial Sequence: Synthetic coding sequence
atggaggtgactggagatgctggggtgcctgagagcggggagatccgcaccctgaagccctgcctgctgcggaggaactacagccgggagcagcacggcgtggccgccagctgcctggaggacctgcggagcaaggcctgtgacatcctggccatcgacaagagcctgacccctgtgaccctggtgctggctgaagatggcaccatcgtggatgatgatgactacttcctgtgcctgcccagcaacaccaagtttgtggccctggccagcaatgagaagtgggcctacaacaacagtgatggcggcacagcctggatcagccaggagagctttgatgtggatgaaacagacagcggggccggcctgaagtggaagaatgtggcccggcagctgaaggaggacctgagcagcatcatcctgctgtctgaggaggacctgcagatgctggtggatgccccctgcagcgacctggcccaggagctgcggcagagctgtgccaccgtgcagaggctgcagcacaccctgcagcaggtgctggaccagcgggaggaggtgcggcagagcaagcagctgctgcagctgtacctgcaggccctggagaaggagggcagcctgctgagcaagcaggaggagagcaaggccgccttcggggaggaggtggatgctgtggacaccggcatcagccgggagaccagcagtgatgtggccctggccagccacatcctgacagccctgcgggagaagcaggcccctgagctgagcctgagcagccaggacctggaggtgggcggcaaccagggccactag

SEQ ID NO: 19425 - DNA, 996 bp, Artificial Sequence
  Description of Artificial Sequence: Synthetic coding sequence
atggaggtgactggagatgctggggtgcctgagagcggggagatccgcaccctgaagccctgcctgctgcggaggaactacagccgggagcagcacggcgtggccgccagctgcctggaggacctgcggagcaaggcctgtgacatcctggccatcgacaagagcctgacccctgtgaccctggtgctggctgaagatggcaccatcgtggatgatgatgactacttcctgtgcctgcccagcaacaccaagtttgtggccctggccagcaatgagaagtgggcctacaacaacagtgatggcggcacagcctggatcagccaggagagctttgatgtggatgaaacagacagcggggccggcctgaagtggaagaatgtggcccggcagctgaaggaggacctgagcagcatcatcctgctgtctgaggaggacctgcagatgctggtggatgccccctgcagcgacctggcccaggagctgcggcagagctgtgccaccgtgcagaggctgcagcacaccctgcagcaggtgctggaccagcgggaggaggtgcggcagagcaagcagctgctgcagctgtacctgcaggccctggagaaggagggcagcctgctgagcaagcaggaggagagcaaggccgccttcggggaggaggtggatgctgtggacaccggcatcagccgggagaccagcagtgatgtggccctggccagccacatcctgacagccctgcgggagaagcaggcccctgagctgagcctgagcagccaggacctggagctggtgaccaaggaggaccccaaggccctggccgtggccctgaactgggacatcaagaagacagagaccgtgcaggaggcctgtgagcgggagctggccctgcggctgcagcagacccagagcctgcacagcctgcggagcatcagcgccagcaaggccagccccccaggggacctgcagaaccccaagagggcccggcaggaccccacctag

SEQ ID NO: 19426 - DNA, 510 bp, Artificial Sequence
  Description of Artificial Sequence: Synthetic coding sequence
atggctgctgagagcctgcccttctcctttggcaccctgagctcctgggagctggaggcctggtatgaggacctgcaggaggtgctgagcagtgatgaaaatggaggcacctacgtgtccccacctggaaatgaggaggaggagagcaagatcttcaccaccctggaccctgccagcctggcctggctgacagaggaggagcctgagcctgctgaggtgaccagcaccagccagagcccccacagcccagacagcagccagagcagcctggcccaggaggaggaggaggaggaccagggccgcaccaggaagaggaagcagagcggccacagccctgcccgggccggcaagcagaggatgaaggagaaggagcaggagaatgaaaggaaggtggcccagctggccgaggagaatgaaaggctgaagcaggagattgagcggctgacccgggaggtggaggccacccggcgggccctgattgacaggatggtgaacctgcaccaggcctag

SEQ ID NO: 19427 - DNA, 510 bp, Artificial Sequence; identical to SEQ ID NO: 19426
  Description of Artificial Sequence: Synthetic coding sequence

SEQ ID NO: 19428 - DNA, 438 bp, Artificial Sequence
  Description of Artificial Sequence: Synthetic coding sequence
atggagctggtgcctgccaccccccactacccagcagatgtgctcttccagacagaccccacagctgagatggctgctgagagcctgcccttctcctttggcaccctgagctcctgggagctggaggcctggtatgaggacctgcaggaggtgctgagcagtgatgaaaatggaggcacctacgtgagccccccaggaaatgaggaggaggagagcaagatcttcaccaccctggaccctgccagcctggcctggctgacagaggaggagcctgagcctgctgaggtgaccagcaccagccagagcccccacagcccagacagcagccagagcagcctggcccaggaggaggaggaggaggaccagggccgcaccaggaagaggaagcagagcggccacagccctgcccgggccggcaagcagaggatgaaggagtag

SEQ ID NO: 19429 - DNA, 579 bp, Artificial Sequence
  Description of Artificial Sequence: Synthetic coding sequence
atggagctggtgcctgccaccccccactacccagcagatgtgctcttccagacagaccccacagctgagatggctgctgagagcctgcccttctcctttggcaccctgagctcctgggagctggaggcctggtatgaggacctgcaggaggtgctgagcagtgatgaaaatggaggcacctacgtgagccccccaggaaatgaggaggaggagagcaagatcttcaccaccctggaccctgccagcctggcctggctgacagaggaggagcctgagcctgctgaggtgaccagcaccagccagagcccccacagcccagacagcagccagagcagcctggcccaggaggaggaggaggaggaccagggccgcaccaggaagaggaagcagagcggccacagccctgcccgggccggcaagcagaggatgaaggagaaggagcaggagaatgaaaggaaggtggcccagctggccgaggagaatgaaaggctgaagcaggagattgaaaggctgacccgggaggtggaggccacccggcgggccctgattgacaggatggtgaacctgcaccaggcctag

SEQ ID NO: 19430 - DNA, 579 bp, Artificial Sequence; identical to SEQ ID NO: 19429
  Description of Artificial Sequence: Synthetic coding sequence

SEQ ID NO: 19431 - DNA, 864 bp, Artificial Sequence
  Description of Artificial Sequence: Synthetic coding sequence
atggccagcctggaggtgagccgcagccccaggaggagccggcgggagctggaggtgcgcagcccccggcagaacaagtacagcgtgctgctgcccacctacaatgaaagagagaacctgcccctgattgtgtggctgctggtgaagagcttcagcgagagcggcatcaactatgagatcatcatcattgatgatggcagcccagatggcaccagagatgtggccgagcagctggagaagatctacggcagtgaccgcatcctgctgcggccccgggagaagaagctgggcctgggcacagcctacatccacggcatgaagcacgccaccggcaactacatcatcatcatggatgctgacctgagccaccaccccaagttcatccctgagttcatcaggaagcagaaggagggcaactttgacatcgtgtctggcacccgctacaagggaaatggaggagtgtatggctgggacctgaagaggaagatcatcagtgatggagtgctgccctgctgccccggctggagcctgctgggcagcagtgaccctgccatcctggcctcctgggactacagcagaggagccaacttcctgacccagatcctgctgcggcctggggccagtgacctgaccggcagcttccggctgtacaggaaggaggtgctggagaagctgattgagaagtgtgtgtccaagggctacgtgttccagatggagatgattgtgcgggcccggcagctgaactacaccatcggggaggtgcccatcagctttgtggacagagtgtatggagagagcaagctgggcggcaatgaaattgtgtccttcctgaagggcctgctgaccctgtttgccaccacctag

SEQ ID NO: 19432 - DNA, 768 bp, Artificial Sequence
  Description of Artificial Sequence: Synthetic coding sequence
atggccagcctggaggtgagccgcagccccaggaggagccggcgggagctggaggtgcgcagcccccggcagaacaagtacagcgtgctgctgcccacctacaatgaaagagagaacctgcccctgattgtgtggctgctggtgaagagcttcagcgagagcggcatcaactatgagatcatcatcattgatgatggcagcccagatggcaccagagatgtggccgagcagctggagaagatctacggcagtgaccgcatcctgctgcggccccgggagaagaagctgggcctgggcacagcctacatccacggcatgaagcacgccaccggcaactacatcatcatcatggatgctgacctgagccaccaccccaagttcatccctgagttcatcagtgatggagtgctgccctgctgccccggctggagcctgctgggcagcagtgaccctgccatcctggcctcctgggactacagcagaggagccaacttcctgacccagatcctgctgcggcctggggccagtgacctgaccggcagcttccggctgtacaggaaggaggtgctggagaagctgattgagaagtgtgtgtccaagggctacgtgttccagatggagatgattgtgcgggcccggcagctgaactacaccatcggggaggtgcccatcagctttgtggacagagtgtatggagagagcaagctgggcggcaatgaaattgtgtccttcctgaagggcctgctgaccctgtttgccaccacctag

SEQ ID NO: 19433 - DNA, 888 bp, Artificial Sequence
  Description of Artificial Sequence: Synthetic coding sequence
tgagccagcctggaggtgagccgcagccccaggaggagccggcgggagctggaggtgcgcagcccccggcagaacaagtacagcgtgctgctgcccacctacaatgaaagagagaacctgcccctgattgtgtggctgctggtgaagagcttcagcgagagcggcatcaactatgagatcatcatcattgatgatggcagcccagatggcaccagagatgtggccgagcagctggagaagatctacggcagtgaccgcatcctgctgcggccccgggagaagaagctgggcctgggcacagcctacatccacggcatgaagcacgccaccggcaactacatcatcatcatggatgctgacctgagccaccaccccaagttcatccctgagttcatcaggaagcagaaggagggcaactttgacatcgtgtctggcacccgctacaagggaaatggaggagtgtatggctgggacctgaagaggaagatcatcagtgatggagtgctgccctgctgccccggctggagcctgctgggcagcagtgaccctgccatcctggcctcctgggactaccgctgtgagcccccccggctggccagcagaggagccaacttcctgacccagatcctgctgcggcctggggccagtgacctgaccggcagcttccggctgtacaggaaggaggtgctggagaagctgattgagaagtgtgtgtccaagggctacgtgttccagatggagatgattgtgcgggcccggcagctgaactacaccatcggggaggtgcccatcagctttgtggacagagtgtatggagagagcaagctgggcggcaatgaaattgtgtccttcctgaagggcctgctgaccctgtttgccaccacctag

SEQ ID NO: 19434 - DNA, 783 bp, Artificial Sequence
  Description of Artificial Sequence: Synthetic coding sequence
atggccagcctggaggtgagccgcagccccaggaggagccggcgggagctggaggtgcgcagcccccggcagaacaagtacagcgtgctgctgcccacctacaatgaaagagagaacctgcccctgattgtgtggctgctggtgaagagcttcagcgagagcggcatcaactatgagatcatcatcattgatgatggcagcccagatggcaccagagatgtggccgagcagctggagaagatctacggcagtgaccgcatcctgctgcggccccgggagaagaagctgggcctgggcacagcctacatccacggcatgaagcacgccaccggcaactacatcatcatcatggatgctgacctgagccaccaccccaagttcatccctgagttcatcaggaagcagaaggagggcaactttgacatcgtgtctggcacccgctacaagggaaatggaggagtgtatggctgggacctgaagaggaagatcatcagcagaggagccaacttcctgacccagatcctgctgcggcctggggccagtgacctgaccggcagcttccggctgtacaggaaggaggtgctggagaagctgattgaaaaatgtgtgtccaagggctacgtgttccagatggagatgattgtgcgggcccggcagctgaactacaccatcggggaggtgcccatcagctttgtggacagagtgtatggagagagcaagctgggcggcaatgagatcgtgtccttcctgaagggcctgctgaccctgtttgccaccacctag

SEQ ID NO: 19435 - DNA, 666 bp, Artificial Sequence
  Description of Artificial Sequence: Synthetic coding sequence
atggccagcctggaggtgagccgcagccccaggaggagccggcgggagctggaggtgcgcagcccccggcagaacaagtacagcgtgctgctgcccacctacaatgaaagagagaacctgcccctgattgtgtggctgctggtgaagagcttcagcgagagcggcatcaactatgagatcatcatcattgatgatggcagcccagatggcaccagagatgtggccgagcagctggagaagatctacggcagtgaccgcatcctgctgcggccccgggagaagaagctgggcctgggcacagcctacatccacggcatgaagcacgccaccggcaactacatcatcatcatggatgctgacctgagccaccaccccaagttcatccctgagttcatcagtgatggagtgctgccctgctgccccggctggagcctgctgggcagcagtgaccctgccatcctggcctcctgggactacagcagaggagccaacttcctgacccagatcctgctgcggcctggggccagtgacctgaccggcagcttccggctgtacaggaaggaggtgctggagaagctgattgagaagtgtgtgtccaagggctacgtgttccagatggagatgattgtgcgggcccggcagctgaactacaccatcggggagtag

SEQ ID NO: 19436 - DNA, 888 bp, Artificial Sequence
  Description of Artificial Sequence: Synthetic coding sequence
atggccagcctggaggtgagccgcagccccaggaggagccggcgggagctggaggtgcgcagcccccggcagaacaagtacagcgtgctgctgcccacctacaatgaaagagagaacctgcccctgattgtgtggctgctggtgaagagcttcagcgagagcggcatcaactatgagatcatcatcattgatgatggcagcccagatggcaccagagatgtggccgagcagctggagaagatctacggcagtgaccgcatcctgctgcggccccgggagaagaagctgggcctgggcacagcctacatccacggcatgaagcacgccaccggcaactacatcatcatcatggatgctgacctgagccaccaccccaagttcatccctgagttcatcaggaagcagaaggagggcaactttgacatcgtgtctggcacccgctacaagggaaatggaggagtgtatggctgggacctgaagaggaagatcatcagtgatggagtgctgccctgctgccccggctggagcctgctgggcagcagtgaccctgccatcctggcctcctgggactaccgctgtgagcccccccggctggccagcagaggagccaacttcctgacccagatcctgctgcggcctggggccagtgacctgaccggcagcttccggctgtacaggaaggaggtgctggagaagctgattgagaagtgtgtgtccaagggctacgtgttccagatggagatgattgtgcgggcccggcagctgaactacaccatcggggaggtgcccatcagctttgtggacagagtgtatggagagagcaagctgggcggcaatgaaattgtgtccttcctgaagggcctgctgaccctgtttgccaccacctag

SEQ ID NO: 19437 - DNA, 1332 bp, Artificial Sequence
  Description of Artificial Sequence: Synthetic coding sequence
atgaggcggcaggtgatggccgccctggtggtgtctggagctgctgagcagggcggcagagatggccctggccggggccgggccccccggggccgggtggccaaccagatccccccagagatcctgaagaacccccagctgcaggccgccatccgggtgctgcccagcaactacaactttgagatccccaagaccatctggaggatccagcaggcccaggccaagaaggtggccctgcagatgcctgagggcctgctgctgtttgcctgcaccatcgtggacatcctggagcgcttcacagaggccgaggtgatggtgatgggagatgtgacctacggggcctgctgcgtggatgacttcaccgcccgggccctgggcgctgacttcctggtgcactacggccacagctgcctgatccccatggacaccagcgcccaggacttccgggtgctgtatgtgtttgtggacatcagaattgacaccacccacctgctggacagcctgcggctgaccttccccccagccacagccctggccctggtgtccaccatccagtttgtgtccaccctgcaggccgccgcccaggagctgaaggccgagtacagagtgtctgtgccccagtgcaagcccctgagccctggagagatcctgggctgcaccagcccccggctgagcaaggaggtggaggccgtggtgtacctgggagatggccgcttccacctggagagcgtgatgattgccaaccccaacgtgcctgcctaccgctatgacccctacagcaaggtgctgagccgggagcactatgaccaccagaggatgcaggccgcccggcaggaggccatcgccacagcccggagcgccaagtcctggggcctcatcctgggcaccctgggccggcagggcagccccaagatcctggagcacctggagagccggctgcgggccctgggcctgagctttgtgcggctgctgctgtctgagatcttccccagcaagctgagcctgctgcctgaggtggatgtgtgggtgcaggtggcctgcccccggctgagcattgactggggcacagccttccccaagcccctgctgaccccctatgaggccgctgtggccctgcgggacatctcctggcagcagccctaccccatggacttctacgccggcagcagcctgggcccctggacagtgaaccacggccaggaccggcggccccacgcccctggccggcctgcccggggcaaggtgcaggagggcagcgcccggccccccagcgctgtggcctgtgaggactgcagctgcagagatgagaaggtggcccccctggccccctag

SEQ ID NO: 19438 - DNA, 1146 bp, Artificial Sequence
  Description of Artificial Sequence: Synthetic coding sequence
atgattgacaccctgcggcctgtgccctttgccagcgagatggccatcagcaagacagtggcctggctgaatgagcagctggagctgggcaatgaaaggctgctgctgatggactgccggccccaggagctgtatgagagcagccacatcgagagcgccatcaacgtggccatccctggcatcatgctgcggcggctgcagaagggcaacctgcctgtgcgggccctcttcaccagaggagaagatcgggaccgcttcacccggcgctgtggcacagacacagtggtgctgtatgatgagagcagcagtgactggaatgaaaatactggaggagagagcgtgctgggcctgctgctgaagaagctgaaggatgagggctgccgggccttctacctggagggcggcttcagcaagttccaggccgagttcagcctgcactgtgagaccaacctggatggcagctgcagcagcagcagcccccccctgcctgtgctgggcctgggcggcctgcgcatcagcagtgacagcagcagtgacatcgagagtgacctggaccgggaccccaacagcgccacagacagtgatggcagccccctgagcaacagccagcccagcttccctgtggagatcctgcccttcctgtacctgggctgtgccaaggacagcaccaacctggatgtgctggaggagtttggcatcaagtacatcctgaatgtgacccccaacctgcccaacctgtttgaaaatgctggggagttcaagtacaagcagatccccatcagtgaccactggagccagaacctgagccagttcttccctgaggccatctccttcattgatgaggcccggggcaagaactgtggggtgctggtgcactgcctggccggcatcagccgctctgtgacagtgacagtggcctacctgatgcagaagctgaacctgtccatgaatgatgcctatgacatcgtgaagatgaagaagagcaacatcagccccaacttcaacttcatgggccagctgctggactttgagaggaccctgggcctgagcagcccctgtgacaacagagtgcctgcccagcagctgtacttcaccacccccagcaaccagaatgtgtaccaggtggacagcctgcagagcacctag

SEQ ID NO: 19439 - DNA, 708 bp, Artificial Sequence
  Description of Artificial Sequence: Synthetic coding sequence
atgattgacaccctgcggcctgtgccctttgccagcgagatggccatcagcaagacagtggcctggctgaatgagcagctggagctgggcaatgaaaggctgctgctgatggactgccggccccaggagctgtatgagagcagccacatcgagagcgccatcaacgtggccatccctggcatcatgctgcggcggctgcagaagggcaacctgcctgtgcgggccctcttcaccagaggagaagatcgggaccgcttcacccggcgctgtggcacagacacagtggtgctgtatgatgagagcagcagtgactggaatgaaaatactggaggagagagcgtgctgggcctgctgctgaagaagctgaaggatgagggctgccgggccttctacctggaggatgaggcccggggcaagaactgtggggtgctggtgcactgcctggccggcatcagccgctctgtgacagtgacagtggcctacctgatgcagaagctgaacctgtccatgaatgatgcctatgacatcgtgaagatgaagaagagcaacatcagccccaacttcaacttcatgggccagctgctggactttgagaggaccctgggcctgagcagcccctgtgacaacagagtgcctgcccagcagctgtacttcaccacccccagcaaccagaatgtgtaccaggtggacagcctgcagagcacctag

SEQ ID NO: 19440 - DNA, 354 bp, Artificial Sequence
  Description of Artificial Sequence: Synthetic coding sequence
atgattgacaccctgcggcctgtgccctttgccagcgagatggccatcagcaagacagtggcctggctgaatgagcagctggagctgggcaatgaaaggctgctgctgatggactgccggccccaggagctgtatgagagcagccacatcgagagcgccatcaacgtggccatccctggcatcatgctgcggcggctgcagaagggcaacctgcctgtgcgggccctcttcaccagaggagaagatcgggaccgcttcacccggcgctgtggcacagacacagtggtgctgtatgatgagagcagcagtgactggaatgaaaatactggaggagagagcgtgctgggcctgtag

SEQ ID NO: 19441 - DNA, 1545 bp, Artificial Sequence
  Description of Artificial Sequence: Synthetic coding sequence
atggctgatgctgaggtgatcatcctgcccaagaagcacaagaagaagaaggagaggaagagcctgcctgaagaagatgtggccgagatccagcacgccgaggagttcctgatcaagccagagagcaaggtggccaagctggacaccagccagtggcccctgctgctgaagaactttgacaagctgaatgtgaggaccacccactacacccccctggcctgtggcagcaaccccctgaagcgggagattggagactacatcagaacaggcttcatcaacctggacaagcccagcaaccccagcagccatgaggtggtggcctggatccgccgcatcctgcgggtggagaagacaggccacagcggcaccctggaccccaaggtgacaggctgcctgattgtgtgcatcgagcgggccacccggctggtgaagagccagcagagcgctgggaaggagtatgtgggcatcgtgcggctgcacaatgccattgaaggaggcacccagctgagccgggccctggagaccctgactggagccctcttccagaggcctcccctgattgctgctgtgaagaggcagctgcgggtgaggaccatctatgagagcaagatgattgaatatgaccctgagcggcggctgggcatcttctgggtgtcctgtgaggccggcacctacatccgcaccctgtgtgtgcacctgggcctgctgctgggcgtgggcggccagatgcaggagctgcggcgggtgcgctctggagtgatgtctgagaaggaccacatggtgaccatgcatgatgtgctggatgcccagtggctgtatgacaaccacaaggatgagagctacctgcggcgggtggtgtaccccctggagaagctgctgaccagccacaagaggctggtgatgaaggacagcgctgtgaatgccatctgctatggagccaagatcatgctgcccggggtgctgcgctatgaagatggcatcgaggtgaaccaggagatcgtggtgatcaccaccaagggggaggccatctgcatggccatcgccctgatgaccacagctgtgatcagcacctgtgaccacggcatcgtggccaagatcaagagggtcatcatggagcgggacacctaccccaggaagtggggcctgggccccaaggccagccagaagaagctgatgatcaagcagggcctgctggacaagcacggcaagcccacagacagcaccccagccacctggaagcaggagtatgtggactacagcgagagcgccaagaaggaggtggtggccgaggtggtgaaggccccccaggtggtggccgaggccgccaagacagccaagaggaagcgggagagcgagagcgagagtgatgagaccccacctgctgccccccagctgatcaagaaggagaagaagaagagcaagaaggacaagaaggccaaggccggcctggagagcggggctgagcctggagatggagacagcgacaccaccaagaagaagaagaagaagaagaaggccaaggaggtggagctggtgtctgagtag

SEQ ID NO: 19442 - DNA, 7245 bp, Artificial Sequence
  Description of Artificial Sequence: Synthetic coding sequence
atggctgaaaatgtggtggagcccggcccccccagcgccaagaggcccaagctgagcagccctgccctgagcgccagcgccagtgatggaacagactttggcagcctgtttgacctggagcatgacctgcctgatgagctgatcaacagcacagagctgggcctgaccaatggaggagacatcaaccagctgcagaccagcctgggcatggtgcaggatgctgccagcaagcacaagcagctgtctgagctgctgcggagcggcagcagccccaacctgaacatgggcgtgggcggccctggccaggtgatggccagccaggcccagcagagcagccctggcctgggcctcatcaacagcatggtgaagagccccatgacccaggccggcctgaccagccccaacatgggcatgggcaccagcggccccaaccagggccccacccagagcacaggcatgatgaacagccctgtgaaccagcctgccatgggcatgaacacaggcatgaatgccggcatgaaccctggcatgctggccgctggaaatggccagggcatcatgcccaaccaggtgatgaatggcagcatcggggccggccggggccggcagaacatgcagtaccccaaccctggcatgggcagcgctggcaacctgctgacagagcccctgcagcagggcagcccccagatgggcggccagacaggcctgcggggcccccagcccctgaagatgggcatgatgaacaaccccaacccctacggcagcccctacacccagaaccctggccagcagattggagccagcggcctgggcctgcagatccagaccaagacagtgctgagcaacaacctgagcccctttgccatggacaagaaggctgtgcctgggggcggcatgcccaacatgggccagcagcctgccccccaggtgcagcagcccggcctggtgacccctgtggcccagggcatgggcagcggggcccacacagctgaccctgagaagaggaagctgatccagcagcagctggtgctgctgctgcacgcccacaagtgccagaggcgggagcaggccaacggggaggtgcggcagtgcaacctgccccactgcaggaccatgaagaatgtgctgaaccacatgacccactgccagagcggcaagagctgccaggtggcccactgtgccagcagccggcagatcatcagccactggaagaactgcaccaggcatgactgccctgtgtgcctgcccctgaagaatgctggggacaagaggaaccagcagcccatcctgactggagcccctgtgggcctgggcaaccccagcagcctgggcgtgggccagcagagcgcccccaacctgagcacagtgtcccagattgaccccagcagcattgaaagagcctatgctgccctgggcctgccctaccaggtgaaccagatgcccacccagccccaggtgcaggccaagaaccagcagaaccagcagcccggccagagcccccagggcatgaggcccatgagcaacatgtctgccagccccatgggcgtgaatggaggagtgggcgtgcagacccccagcctgctgagtgacagcatgctgcacagcgccatcaacagccagaaccccatgatgtctgaaaatgcctctgtgcccagcctgggccccatgcccacagctgcccagcccagcaccaccggcatcaggaagcagtggcatgaggacatcacccaggacctgaggaaccacctggtgcacaagctggtgcaggccatcttccccaccccagaccctgctgccctgaaggacaggaggatggagaacctggtggcctatgccaggaaggtggagggggacatgtatgagagcgccaacaacagagctgagtactaccacctgctggccgagaagatctacaagatccagaaggagctggaggagaagaggaggacccggctgcagaagcagaacatgctgcccaatgctgctggcatggtgcctgtgtccatgaaccctggccccaacatgggccagccccagcccggcatgaccagcaatggccccctgcctgaccccagcatgatccggggctctgtgcccaaccagatgatgccccgcatcaccccccagagcggcctgaaccagtttggccagatgtccatggcccagccccccatcgtgccccggcagaccccacccctgcagcaccacggccagctggcccagcccggggccctgaacccccccatgggctacggccccaggatgcagcagcccagcaaccagggccagttcctgccccagacccagttccccagccagggcatgaatgtgaccaacatccccctggcccccagcagcggccaggcccctgtgtcccaggcccagatgagcagcagcagctgccctgtgaacagccccatcatgcctcctggcagccagggcagccacatccactgcccccagctgccccagcctgccctgcaccagaacagccccagccctgtgcccagcaggacccccaccccccaccacaccccacccagcattggagcccagcagcccccagccaccaccatcccagcccctgtgcccaccccaccagccatgcctcctggcccccagagccaggccctgcaccccccaccccggcagacccccaccccacccaccacccagctgccccagcaggtgcagcccagcctgcctgctgcccccagcgctgaccagccccagcagcagcccaggagccagcagagcacagctgcctctgtgcccacccccacagcccccctgctgcccccccagcctgccacccccctgagccagcctgctgtgtccattgagggccaggtgagcaacccccccagcaccagcagcacagaggtgaacagccaggccatcgccgagaagcagcccagccaggaggtgaagatggaggccaagatggaggtggaccagcctgagcctgctgacacccagcctgaggacatcagcgagagcaaggtggaggactgcaagatggagagcacagaaacagaggagaggagcacagagctgaagacagagatcaaggaggaggaggaccagcccagcaccagcgccacccagagcagccctgcccctggccagagcaagaagaagatcttcaagccagaggagctgcggcaggccctgatgcccaccctggaggccctgtaccggcaggaccctgagagcctgcccttccggcagcctgtggacccccagctgctgggcatcccagactactttgacatcgtgaagagccccatggacctgagcaccatcaagaggaagctggacaccggccagtaccaggagccctggcagtatgtggatgacatctggctgatgttcaacaatgcctggctgtacaacaggaagaccagccgggtgtacaagtactgcagcaagctgtctgaggtgtttgagcaggagattgatcctgtgatgcagagcctgggctactgctgcggcaggaagctggagttcagcccccagaccctgtgctgctacggcaagcagctgtgcaccatccccagagatgccacctactacagctaccagaaccgctaccacttctgtgagaagtgcttcaatgagatccagggcgagagcgtgtccctgggagatgaccccagccagccccagaccaccatcaacaaggagcagttcagcaagaggaagaatgacaccctggaccctgagctgtttgtggagtgcacagaatgtggcaggaagatgcaccagatctgtgtgctgcaccacgagatcatctggccagctggctttgtgtgtgatggctgcctgaagaagagcgcccggaccaggaaagaaaacaagttcagcgccaagaggctgcccagcacccggctgggcaccttcctggagaacagagtgaatgacttcctgcggcggcagaaccaccctgagagcggggaggtgacagtgcgggtggtgcacgccagtgacaagacagtggaggtgaagccaggcatgaaggccaggtttgtggacagcggggagatggccgagagcttcccctaccgcaccaaggccctgtttgcctttgaggagattgatggagtggacctgtgcttcttcggcatgcacgtgcaggagtatggcagtgactgccccccacccaaccagaggagagtgtacatctcctacctggacagcgtgcacttcttccggcccaagtgcctgaggacagctgtgtaccacgagatcctgattggctacctggagtatgtgaagaagctgggctacaccaccggccacatctgggcctgccccccatctgaaggagatgactacatcttccactgccaccccccagaccagaagatccccaagcccaagaggctgcaggagtggtacaagaagatgctggacaaggctgtgtctgaaagaattgtgcatgactacaaggacatcttcaagcaggccacagaggaccggctgaccagcgccaaggagctgccctactttgaaggagacttctggcccaacgtgctggaggagagcatcaaggagctggagcaggaggaggaggagaggaagcgggaggagaacaccagcaatgaaagcacagatgtgaccaagggggacagcaagaatgccaagaagaagaacaacaagaagaccagcaagaacaagagcagcctgagccggggcaacaagaagaagccaggcatgcccaacgtgtccaatgacctgagccagaagctgtatgccaccatggagaagcacaaggaggtgttcttcgtcatccggctgattgctggccctgctgccaacagcctgccccccatcgtggaccctgaccccctcatcccctgtgacctgatggatggaagagatgccttcctgaccctggcccgggacaagcacctggagttcagcagcctgcggcgggcccagtggagcaccatgtgcatgctggtggagctgcacacccagagccaggacagatttgtgtacacctgcaatgaatgcaagcaccacgtggagacccgctggcactgcaccgtgtgtgaagattatgacctgtgcatcacctgctacaacaccaagaaccacgaccacaagatggagaagctgggcctgggcctggatgatgagagcaacaaccagcaggccgccgccacccagagccctggggacagccggcggctgagcatccagcgctgcatccagagcctggtgcacgcctgccagtgcagaaatgccaactgcagcctgcccagctgccagaagatgaagagggtggtgcagcacaccaagggctgcaagaggaagaccaacggcggctgccccatctgcaagcagctgattgccctgtgctgctaccacgccaagcactgccaggagaacaagtgccctgtgcccttctgcctgaacatcaagcagaagctgcggcagcagcagctgcagcaccggctgcagcaggcccagatgctgcggcggaggatggcctccatgcagaggactggagtggtgggccagcagcagggcctgcccagccccaccccagccacccccaccacccccaccggccagcagcccaccaccccccagaccccccagcccaccagccagccccagcccaccccacccaacagcatgccaccctacctgcccaggacccaggccgccggccctgtgtcccagggcaaggccgccggccaggtgaccccacccaccccaccccagacagcccagccccccctgcccggccccccacctgctgctgtggagatggccatgcagatccagagagctgctgagacccagaggcagatggcccacgtgcagatcttccagaggcccatccagcaccagatgccacccatgacccccatggcccccatgggcatgaaccccccacccatgacccggggccccagcggccacctggagcccggcatgggccccaccggcatgcagcagcagcccccctggagccagggcggcctgccccagccccagcagctgcagagcggcatgcccaggcctgccatgatgtctgtggcccagcacggccagcccctgaacatggccccccagcccggcctgggccaggtgggcatcagccccctgaagccaggcaccgtgtcccagcaggccctgcagaacctgctgcggaccctgcggagccccagcagccccctgcagcagcagcaggtgctgagcatcctgcacgccaacccccagctgctggccgccttcatcaagcagagagctgccaagtatgccaacagcaacccccagcccatccctggccagcccggcatgccccagggccagcccggcctgcagccccccaccatgcctggccagcagggcgtgcacagcaacccagccatgcagaacatgaaccccatgcaggccggcgtgcagagagctggcctgccccagcagcagccccagcagcagctgcagccccccatgggcggcatgagcccccaggcccagcagatgaacatgaaccacaacaccatgcccagccagttccgggacatcctgcggcggcagcagatgatgcagcagcagcagcagcagggcgccggccctggcatcggccctggcatggccaaccacaaccagttccagcagccccagggcgtgggctacccaccccagcagcagcagaggatgcagcaccacatgcagcagatgcagcagggcaacatgggccagatcggccagctgccccaggccctgggcgctgaggccggggccagcctgcaggcctaccagcagaggctgctgcagcagcagatgggcagccctgtgcagcccaaccccatgagcccccagcagcacatgctgcccaaccaggcccagagcccccacctgcagggccagcagatccccaacagcctgagcaaccaggtgcgcagcccccagcctgtgcccagcccccggccccagagccagcccccccacagcagccccagccccaggatgcagccccagcccagcccccaccacgtgagcccccagaccagcagcccccaccctggcctggtggccgcccaggccaaccccatggagcagggccactttgccagcccagaccagaacagcatgctgagccagctggccagcaaccctggcatggccaacctgcacggggccagcgccacagacctgggcctgagcacagacaacagcgacctgaacagcaacctgagccagagcaccctggacatccactag

SEQ ID NO: 19443 - DNA, 1314 bp, Artificial Sequence
  Description of Artificial Sequence: Synthetic coding sequence
atggccctggccggggccccagctgggggcccctgtgccccagccctggaggccctgctgggcgctggggccctgcggctgctggacagcagccagatcgtcatcatctctgctgcccaggatgccagcgcccccccagcccccactggacctgctgccccagctgctggcccctgtgaccctgacctgctgctgtttgccaccccccaggccccccggcccaccccatctgcccccaggcctgccctgggccggccccctgtgaagaggcggctggacctggagacagaccaccagtacctggccgagagcagcggccctgcccggggccggggccgccaccctggaaaaggagtgaagagccctggagagaagagccgctatgagaccagcctgaacctgaccaccaagcgcttcctggagctgctgagccacagcgcagatggagtggtggacctgaactgggccgctgaggtgctgaaggtgcagaagaggcgcatctatgacatcaccaacgtgctggagggcatccagctgattgccaagaagagcaagaaccacatccagtggctgggcagccacaccaccgtgggcgtgggcggccgcctggagggcctgacccaggacctgcggcagctgcaggagagcgagcagcagctggaccacctgatgaacatctgcaccacccagctgcggctgctgtctgaggacacagacagccagaggctggcctacgtgacctgccaggacctgcggagcattgctgaccctgctgagcagatggtgatggtgatcaaggcccctcctgagacccagctgcaggccgtggacagcagcgagaacttccagatcagcctgaagagcaagcagggccccattgatgtgttcctgtgcccagaggagaccgtgggcggcatcagccctgggaagacccccagccaggaggtgaccagcgaggaggagaacagagccacagattctgccaccatcgtgtccccaccacccagcagcccccccagcagcctgaccacagaccccagccagagcctgctgagcctggagcaggagcccctgctgagcaggatgggcagcctgcgggcccctgtggatgaagatcggctgagccccctggtggccgctgacagcctgctggagcacgtgcgggaggacttcagcggcctgctgcctgaggagttcatcagcctgagcccccctcatgaggccctggactaccacttcggcctggaggagggggagggcatccgggacctgtttgactgtgactttggagacctgacccccctggacttctag

SEQ ID NO: 19444 - DNA, 1242 bp, Artificial Sequence
  Description of Artificial Sequence: Synthetic coding sequence
atggccgaggccggcccccaggcccctcctcctcctggcacccccagcagacatgagaagagcctgggcctgctgaccaccaagtttgtgtccctgctgcaggaggccaaggatggagtgctggacctgaagctggccgctgacaccctggccgtgcggcagaagaggcgcatctatgacatcaccaacgtgctggagggcatcggcctgattgagaagaagagcaagaacagcatccagtggaagggcgtgggccctggctgcaacacccgggagattgctgacaagctgattgagctgaaggccgagattgaggagctgcagcagcgggagcaggagctggaccagcacaaggtgtgggtgcagcagagcatcagaaatgtgacagaagatgtgcagaacagctgcctggcctacgtgacccatgaggacatctgccgctgctttgctggggacaccctgctggccatccgggcccccagcggcaccagcctggaggtgcccatccctgagggcctgaatggccagaagaagtaccagatccacctgaagtctgtgtctggccccatcgaggtgctgctggtgaacaaggaggcctggagcagcccccctgtggccgtgcctgtgcccccacctgaggacctgctgcagagccccagcgctgtgtccaccccaccacccctgcccaagccagccctggcccagagccaggaggccagccggcccaacagcccccagctgacccccacagctgtgcccggcagcgctgaggtgcagggcatggccggccctgctgctgagatcaccgtgtctgggggccctggaacagacagcaaggacagcggggagctgagcagcctgcccctgggccccaccaccctggacacccggcccctgcagagcagcgccctgctggacagcagcagcagcagcagcagcagcagcagcagcagcagcaacagcaacagcagcagcagcagcggccccaaccccagcaccagctttgagcccatcaaggctgaccccactggagtgctggagctgcccaaggagctgtctgagatctttgaccccacccgggagtgcatgagcagcgagctgctggaggagctgatgagcagcgaggtgtttgcccccctgctgcggctgagccccccacctggggaccatgactacatctacaacctggatgaaagtgaaggagtgtgtgacctgtttgatgtgcctgtgctgaacctgtag

SEQ ID NO: 19445 - DNA, 1164 bp, Artificial Sequence
  Description of Artificial Sequence: Synthetic coding sequence
atgaccgggaagctggccgagaagctgcctgtgaccatgagcagcctgctgaaccagctgcctgacaacctgtacccagaggagatccccagcgccctgaacctcttcagcggcagcagtgacagcgtggtgcactacaaccagatggccacagaaaatgtgatggacatcggcctgaccaatgagaagcccaaccctgagctgagctacagcggcagcttccagcctgcccctggcaacaagacagtgacctacctgggcaagtttgcctttgacagccccagcaactggtgccaggacaacatcatcagcctgatgtctgctggcatcctgggcgtgcccccagccagcggggccctgagcacccagaccagcacagcctccatggtgcagcccccccagggagatgtggaggccatgtacccagccctgcccccctacagcaactgtggggacctgtacagcgagcctgtgtccttccatgacccccagggcaaccctggcctggcctacagcccccaggactaccagagcgccaagccagccctggacagcaacctcttccccatgatcccagactacaacctgtaccaccaccccaatgacatgggcagcatccctgagcacaagcccttccagggcatggaccccatccgggtgaaccccccacccatcacccccctggagaccatcaaggccttcaaggacaagcagatccaccctggcttcggcagcctgccccagccccccctgaccctgaagcccatccggcccaggaagtaccccaaccggcccagcaagacccccctgcacgagcggccccacgcctgcccagctgagggctgtgaccggcgcttcagcagaagtgatgagctgaccaggcacctgcgcatccacacaggccacaagcccttccagtgccgcatctgcatgaggagcttcagcagaagtgaccacctgaccacccacatccgcacccacactggagagaagccctttgcctgtgagttctgtggcaggaagtttgcccggagtgatgagaggaagagacatgccaagatccacctgaagcagaaggagaagaaggccgagaagggcggggcccccagcgccagcagcgcccctcctgtgtccctggcccctgtggtgaccacctgtgcctag

SEQ ID NO: 19446 - DNA, 687 bp, Artificial Sequence
  Description of Artificial Sequence: Synthetic coding sequence
atggacatcggcctgaccaatgagaagcccaaccctgagctgagctacagcggcagcttccagcctgcccctggcaacaagacagtgaccatgatcccagactacaacctgtaccaccaccccaatgacatgggcagcatccctgagcacaagcccttccagggcatggaccccatccgggtgaaccccccacccatcacccccctggagaccatcaaggccttcaaggacaagcagatccaccctggcttcggcagcctgccccagccccccctgaccctgaagcccatccggcccaggaagtaccccaaccggcccagcaagacccccctgcacgagcggccccacgcctgcccagctgagggctgtgaccggcgcttcagcagaagtgatgagctgaccaggcacctgcgcatccacacaggccacaagcccttccagtgccgcatctgcatgaggagcttcagcagaagtgaccacctgaccacccacatccgcacccacactggagagaagccctttgcctgtgagttctgtggcaggaagtttgcccggagtgatgagaggaagagacatgccaagatccacctgaagcagaaggagaagaaggccgagaagggcggggcccccagcgccagcagcgcccctcctgtgtccctggcccctgtggtgaccacctgtgcctag

SEQ ID NO: 19447 - DNA, 1050 bp, Artificial Sequence
  Description of Artificial Sequence: Synthetic coding sequence
atggagccctgtgccgcctggagcccccggggcggccgggagaatgtgatggacatcggcctgaccaatgagaagcccaaccctgagctgagctacagcggcagcttccagcctgcccctggcaacaagacagtgacctacctgggcaagtttgcctttgacagccccagcaactggtgccaggacaacatcatcagcctgatgtctgctggcatcctgggcgtgcccccagccagcggggccctgagcacccagaccagcacagcctccatggtgcagcccccccagggagatgtggaggccatgtacccagccctgcccccctacagcaactgtggggacctgtacagcgagcctgtgtccttccatgacccccagggcaaccctggcctggcctacagcccccaggactaccagagcgccaagccagccctggacagcaacctcttccccatgatcccagactacaacctgtaccaccaccccaatgacatgggcagcatccctgagcacaagcccttccagggcatggaccccatccgggtgaaccccccacccatcacccccctggagaccatcaaggccttcaaggacaagcagatccaccctggcttcggcagcctgccccagccccccctgaccctgaagcccatccggcccaggaagtaccccaaccggcccagcaagacccccctgcacgagcggccccacgcctgcccagctgagggctgtgaccggcgcttcagcagaagtgatgagctgaccaggcacctgcgcatccacacaggccacaagcccttccagtgccgcatctgcatgaggagcttcagcagaagtgaccacctgaccacccacatccgcacccacactggagagaagccctttgcctgtgagttctgtggcaggaagtttgcccggagtgatgagaggaagagacatgccaagatccacctgaagcagaaggagaagaaggccgagaagggcggggcccccagcgccagcagcgcccctcctgtgtccctggcccctgtggtgaccacctgtgcctag

SEQ ID NO: 19448 - DNA, 3696 bp, Artificial Sequence
  Description of Artificial Sequence: Synthetic coding sequence
atggcctctgtgtggaagaggctgcagagggtgggcaagcacgccagcaagttccagtttgtggccagctaccaggagctgatggtggagtgcaccaagaagtggcagcctgacaagctggtggtggtgtggacccggcgcagcaggaggaagagcagcaaggcccacagctggcagcccggcatcaagaacccctaccggggcgtggtggtgtggcctgtgcctgagaacatcgagatcaccgtgaccctcttcaaggacccccacgccgaggagtttgaggacaaggagtggacctttgtgattgaaaatgaaagccccagcggccgcaggaaggccctggccaccagcagcatcaacatgaagcagtatgccagccccatgcccacccagacagatgtgaagctgaagttcaagcccctgagcaagaaggtggtgtctgctgccctgcagttcagcctgagctgcatcttcctgcgggagggcaaggccacagatgaggacatgcagagcctggccagcctgatgtccatgaagcaggccgacatcggcaacctggatgactttgaagaagataatgaagatgatgatgagaacagagtgaaccaggaggagaaggccgccaagatcacagaaattgtgaaccagctgaatgccctgagcagcctggatgaggaccaggatgactgcatcaagcaggccaacatgaggtctgccaagagcgccagcagcagcgaggagctgatcaacaagctgaacttcctggatgaggccgagaaggacctggccaccgtgaacagcaacccctttgatgatcctgatgctgctgagctgaacccctttggagaccctgacagcgaggagcccatcacagaaacagccagccccaggaagacagaggacagcttctacaacaacagctacaaccccttcaaggaggtgcagaccccccagtacctgaacccctttgatgagcctgaggcctttgtgaccatcaaggacagccccccccagagcaccaagaggaagaacatccggcctgtggacatgagcaagtacctgtatgctgacagcagcaagacagaggaggaggagctggatgagagcaaccccttctatgagcccaagagcaccccaccacccaacaacctggtgaaccctgtgcaggagctggagacagaaagaagagtgaagaggaaggccccagcccctcctgtgctgagccccaagacaggagtgctgaatgaaaatacagtgtctgctgggaaggacctgagcaccagccccaagcccagccccatccccagccctgtgctgggcaggaagcccaatgccagccagagcctgctggtgtggtgcaaggaggtgaccaagaactaccggggcgtgaagatcaccaacttcaccacctcctggagaaatggcctgtccttctgtgccatcctgcaccacttccggccagacctgattgactacaagagcctgaacccccaggacatcaaggagaacaacaagaaggcctatgatggctttgccagcatcggcatcagccggctgctggagcccagcgacatggtgctgctggccatcccagacaagctgactgtgatgacctacctgtaccagatccgggcccacttcagcggccaggagctgaatgtggtgcagatcgaggagaacagcagcaagagcacctacaaggtgggcaactatgaaacagacaccaacagctctgtggaccaggagaagttctacgccgagctgagtgacctgaagcgggagcctgagctgcagcagcccatcagcggggctgtggacttcctgagccaggatgattctgtgtttgtgaatgattctggagtgggggagagcgagagcgagcaccagaccccagatgaccacctgagccccagcacagccagcccctactgcaggaggaccaagagtgacacagagccccagaagagccagcagagcagcggccgcaccagcggcagtgatgatcctggcatctgcagcaacacagacagcacccaggcccaggtgctgctgggcaagaagaggctgctgaaggccgagaccctggagctgagtgacctgtatgtgtctgacaagaagaaggacatgagcccccccttcatctgtgaggagacagatgagcagaagctgcagaccctggacatcggcagcaacctggagaaggagaagctggagaacagccgcagcctggagtgccgcagtgaccctgagagccccatcaagaagaccagcctgagccccaccagcaagctgggctacagctacagccgggacctggacctggccaagaagaagcacgccagcctgcggcagacagaaagtgaccctgatgctgacaggaccaccctgaaccacgccgaccacagcagcaagatcgtgcagcaccggctgctgagccggcaggaggagctgaaggagcgggcccgggtgctgctggagcaggccaggagagatgctgccctgaaggccggcaacaagcacaacaccaacacagccacccccttctgcaaccggcagctgagtgaccagcaggatgaggagcggcggcggcagctgcgggagcgggcccggcagctgattgctgaggcccggtctggagtgaagatgtctgagctgcccagctatggagagatggctgctgagaagctgaaggagaggagcaaggccagcggagatgaaaatgacaacatcgagattgacaccaatgaggagatccctgagggctttgtggtgggcggcggagatgagctgaccaacctggagaatgacctggacaccccagagcagaacagcaagctggtggacctgaagctgaagaagctgctggaggtgcagccccaggtggccaacagccccagcagcgctgcccagaaggctgtgacagagagcagcgagcaggacatgaagtctggaacagaggacctgaggacagagcggctgcagaagaccacagagcgcttcagaaatcctgtggtgttcagcaaggacagcacagtgaggaagacccagctgcagagcttcagccagtacattgaaaatagacctgagatgaagaggcagaggagcatccaggaggacaccaagaagggaaatgaggagaaggccgccatcacagagacccagaggaagcccagtgaagatgaggtgctgaacaagggcttcaaggacaccagccagtatgtggtgggggagctggccgccctggagaatgagcagaagcagattgacacccgggccgccctggtggagaagaggctgcgctacctgatggacacaggaagaaacacagaggaggaggaggccatgatgcaggagtggttcatgctggtgaacaagaagaatgccctgatccggaggatgaaccagctgagcctgctggagaaggagcatgacctggagaggagatatgagctgctgaaccgggagctgcgggccatgctggccatcgaggactggcagaagacagaggcccagaagagaagagagcagctgctgctggatgagctggtggccctggtgaacaagagagatgccctggtgcgggacctggatgcccaggagaagcaggccgaggaggaggatgagcacctggagaggaccctggagcagaacaagggcaagatggccaagaaggaggagaagtgtgtgctgcagtag

SEQ ID NO: 19449 - DNA, 3591 bp, Artificial Sequence
  Description of Artificial Sequence: Synthetic coding sequence
atggcctctgtgtggaagaggctgcagagggtgggcaagcacgccagcaagttccagtttgtggccagctaccaggagctgatggtggagtgcaccaagaagtggcagcctgacaagctggtggtggtgtggacccggcgcagcaggaggaagagcagcaaggcccacagctggcagcccggcatcaagaacccctaccggggcgtggtggtgtggcctgtgcctgagaacatcgagatcaccgtgaccctcttcaaggacccccacgccgaggagtttgaggacaaggagtggacctttgtgattgaaaatgaaagccccagcggccgcaggaaggccctggccaccagcagcatcaacatgaagcagtatgccagccccatgcccacccagacagatgtgaagctgaagttcaagcccctgagcaagaaggtggtgtctgctgccctgcagttcagcctgagctgcatcttcctgcgggagggcaaggccacagatgaggacatgcagagcctggccagcctgatgtccatgaagcaggccgacatcggcaacctggatgactttgaagaagataatgaagatgatgatgagaacagagtgaaccaggaggagaaggccgccaagatcacagagctgatcaacaagctgaacttcctggatgaagctgagaaggacctggccaccgtgaacagcaacccctttgatgatcctgatgctgctgagctgaacccctttggagaccctgattctgaggagcccatcacagaaacagccagccccaggaagacagaagattccttctacaacaacagctacaaccccttcaaggaggtgcagaccccccagtacctgaacccctttgatgagcctgaggcctttgtgaccatcaaggacagccccccccagagcaccaagaggaagaacatccggcctgtggacatgagcaagtacctgtatgctgacagcagcaagacagaggaggaggagctggatgagagcaaccccttctatgagcccaagagcaccccaccacccaacaacctggtgaaccctgtgcaggagctggagacagagcggcgggtgaagaggaaggccccagcccctcctgtgctgagccccaagacaggagtgctgaatgaaaatacagtgtctgctgggaaggacctgagcaccagccccaagcccagccccatccccagccctgtgctgggcaggaagcccaatgccagccagagcctgctggtgtggtgcaaggaggtgaccaagaactacagaggagtgaagatcaccaacttcaccacctcctggagaaatggcctgtccttctgtgccatcctgcaccacttccggccagacctgattgactacaagagcctgaacccccaggacatcaaggagaacaacaagaaggcctatgatggctttgccagcatcggcatcagccggctgctggagcccagcgacatggtgctgctggccatcccagacaagctgactgtgatgacctacctgtaccagatccgggcccacttcagcggccaggagctgaatgtggtgcagatcgaggagaacagcagcaagagcacctacaaggtgggcaactatgaaacagacaccaacagctctgtggaccaggagaagttctatgcagagctgagtgacctgaagcgggagcctgagctgcagcagcccatctctggagctgtggacttcctgagccaggatgacagcgtgtttgtgaatgacagcggcgtgggggagagcgagagcgagcaccagaccccagatgaccacctgagccccagcacagccagcccctactgcaggaggaccaagagtgacacagagccccagaagagccagcagagcagcggccgcaccagcggcagtgatgaccccggcatctgcagcaacacagacagcacccaggcccaggtgctgctgggcaagaagaggctgctgaaggccgagaccctggagctgagtgacctgtatgtgtctgacaagaagaaggacatgagcccccccttcatctgtgaggagacagatgagcagaagctgcagaccctggacatcggcagcaacctggagaaggagaagctggagaacagccgcagcctggagtgccgcagtgaccctgagagccccatcaagaagaccagcctgagccccaccagcaagctgggctacagctacagccgggacctggacctggccaagaagaagcacgccagcctgcggcagacagaaagtgaccctgatgctgacaggaccaccctgaaccacgccgaccacagcagcaagatcgtgcagcaccggctgctgagccggcaggaggagctgaaggagcgggcccgggtgctgctggagcaggccaggagagatgctgccctgaaggccggcaacaagcacaacaccaacacagccacccccttctgcaaccggcagctgagtgaccagcaggatgaggagcggcggcggcagctgcgggagcgggcccggcagctgattgctgaggcccggtctggagtgaagatgtctgagctgcccagctatggagagatggctgctgagaagctgaaggagaggagcaaggccagcggagatgaaaatgacaacattgaaattgacaccaatgaggagatccctgagggctttgtggtgggcggcggagatgagctgaccaacctggagaatgacctggacaccccagagcagaacagcaagctggtggacctgaagctgaagaagctgctggaggtgcagccccaggtggccaacagccccagcagcgctgcccagaaggctgtgacagagagcagcgagcaggacatgaagagcggcacagaggacctgaggacagagcggctgcagaagaccacagagcgcttcaggaaccctgtggtgttcagcaaggacagcacagtgaggaagacccagctgcagagcttcagccagtacatcgagaacagacctgagatgaagaggcagaggagcatccaggaggacaccaagaagggaaatgaggagaaggccgccatcacagagacccagaggaagcccagtgaagatgaggtgctgaacaagggcttcaaggacaccagccagtatgtggtgggggagctggccgccctggagaatgagcagaagcagattgacaccagggctgccctggtggagaagaggctgcgctacctgatggacaccggcaggaacacagaggaggaggaggccatgatgcaggagtggttcatgctggtgaacaagaagaatgccctgatccggaggatgaaccagctgagcctgctggagaaggagcatgacctggagcggcgctatgagctgctgaaccgggagctgcgggccatgctggccatcgaggactggcagaagacagaggcccagaagaggcgggagcagctgctgctggatgagctggtggccctggtgaacaagagagatgccctggtgcgggacctggatgcccaggagaagcaggccgaggaggaggatgagcacctggagaggaccctggagcagaacaagggcaagatggccaagaaggaggagaagtgtgtgctgcagtag

SEQ ID NO: 19450 - DNA, 3483 bp, Artificial Sequence
  Description of Artificial Sequence: Synthetic coding sequence
atggcctctgtgtggaagaggctgcagagggtgggcaagcacgccagcaagttccagtttgtggccagctaccaggagctgatggtggagtgcaccaagaagtggcagcctgacaagctggtggtggtgtggacccggcgcagcaggaggaagagcagcaaggcccacagctggcagcccggcatcaagaacccctaccggggcgtggtggtgtggcctgtgcctgagaacatcgagatcaccgtgaccctcttcaaggacccccacgccgaggagtttgaggacaaggagtggacctttgtgattgaaaatgaaagccccagcggccgcaggaaggccctggccaccagcagcatcaacatgaagcagtatgccagccccatgcccacccagacagatgtgaagctgaagttcaagcccctgagcaagaaggtggtgtctgctgccctgcagttcagcctgagctgcatcttcctgcgggagggcaaggccacagatgaggacatgcagagcctggccagcctgatgtccatgaagcaggccgacatcggcaacctggatgactttgaagaagataatgaagatgatgatgagaacagagtgaaccaggaggagaaggccgccaagatcacagagctgatcaacaagctgaacttcctggatgaagctgagaaggacctggccaccgtgaacagcaacccctttgatgatcctgatgctgctgagctgaacccctttggagaccctgattctgaggagcccatcacagaaacagccagccccaggaagacagaagattccttctacaacaacagctacaaccccttcaaggaggtgcagaccccccagtacctgaacccctttgatgagcctgaggcctttgtgaccatcaaggacagccccccccagagcaccaagaggaagaacatccggcctgtggacatgagcaagtacctgtatgctgacagcagcaagacagaggaggaggagctggatgagagcaaccccttctatgagcccaagagcaccccaccacccaacaacctggtgaaccctgtgcaggagctggagacagagcggcgggtgaagaggaaggccccagcccctcctgtgctgagccccaagacaggagtgctgaatgaaaatacagtgtctgctgggaaggacctgagcaccagccccaagcccagccccatccccagccctgtgctgggcaggaagcccaatgccagccagagcctgctggtgtggtgcaaggaggtgaccaagaactacagaggagtgaagatcaccaacttcaccacctcctggagaaatggcctgtccttctgtgccatcctgcaccacttccggccagacctgattgactacaagagcctgaacccccaggacatcaaggagaacaacaagaaggcctatgatggctttgccagcatcggcatcagccggctgctggagcccagcgacatggtgctgctggccatcccagacaagctgactgtgatgacctacctgtaccagatccgggcccacttcagcggccaggagctgaatgtggtgcagatcgaggagaacagcagcaagagcacctacaaggtgggcaactatgaaacagacaccaacagctctgtggaccaggagaagttctatgcagagctgagtgacctgaagcgggagcctgagctgcagcagcccatctctggagctgtggacttcctgagccaggatgacagcgtgtttgtgaatgacagcggcgtgggggagagcgagagcgagcaccagaccccagatgaccacctgagccccagcacagccagcccctactgcaggaggaccaagagtgacacagagccccagaagagccagcagagcagcggccgcaccagcggcagtgatgaccccggcatctgcagcaacacagacagcacccaggcccaggtgctgctgggcaagaagaggctgctgaaggccgagaccctggagctgagtgacctgtatgtgtctgacaagaagaaggacatgagcccccccttcatctgtgaggagacagatgagcagaagctgcagaccctggacatcggcagcaacctggagaaggagaagctggagaacagccgcagcctggagtgccgcagtgaccctgagagccccatcaagaagaccagcctgagccccaccagcaagctgggctacagctacagccgggacctggacctggccaagaagaagcacgccagcctgcggcagacagaaagtgaccctgatgctgacaggaccaccctgaaccacgccgaccacagcagcaagatcgtgcagcaccggctgctgagccggcaggaggagctgaaggagcgggcccgggtgctgctggagcaggccaggagagatgctgccctgaaggccggcaacaagcacaacaccaacacagccacccccttctgcaaccggcagctgagtgaccagcaggatgaggagcggcggcggcagctgcgggagcgggcccggcagctgattgctgaggcccggtctggagtgaagatgtctgagctgcccagctatggagagatggctgctgagaagctgaaggagaggagcaaggccagcggggagcagaacagcaagctggtggacctgaagctgaagaagctgctggaggtgcagccccaggtggccaacagccccagcagcgctgcccagaaggctgtgacagagagcagcgagcaggacatgaagagcggcacagaggacctgaggacagagcggctgcagaagaccacagagcgcttcaggaaccctgtggtgttcagcaaggacagcacagtgaggaagacccagctgcagagcttcagccagtacatcgagaacagacctgagatgaagaggcagaggagcatccaggaggacaccaagaagggaaatgaggagaaggccgccatcacagagacccagaggaagcccagtgaagatgaggtgctgaacaagggcttcaaggacaccagccagtatgtggtgggggagctggccgccctggagaatgagcagaagcagattgacaccagggctgccctggtggagaagaggctgcgctacctgatggacaccggcaggaacacagaggaggaggaggccatgatgcaggagtggttcatgctggtgaacaagaagaatgccctgatccggaggatgaaccagctgagcctgctggagaaggagcatgacctggagcggcgctatgagctgctgaaccgggagctgcgggccatgctggccatcgaggactggcagaagacagaggcccagaagaggcgggagcagctgctgctggatgagctggtggccctggtgaacaagagagatgccctggtgcgggacctggatgcccaggagaagcaggccgaggaggaggatgagcacctggagaggaccctggagcagaacaagggcaagatggccaagaaggaggagaagtgtgtgctgcagtag

SEQ ID NO: 19451 - DNA, 3591 bp, Artificial Sequence; identical to SEQ ID NO: 19449
  Description of Artificial Sequence: Synthetic coding sequence

SEQ ID NO: 19452 - DNA, 933 bp, Artificial Sequence
  Description of Artificial Sequence: Synthetic coding sequence
atggcctctgtgtggaagaggctgcagagggtgggcaagcacgccagcaagttccagtttgtggccagctaccaggagctgatggtggagtgcaccaagaagtggcagcctgacaagctggtggtggtgtggacccggcgcagcaggaggaagagcagcaaggcccacagctggcagcccggcatcaagaacccctaccggggcgtggtggtgtggcctgtgcctgagaacatcgagatcaccgtgaccctcttcaaggacccccacgccgaggagtttgaggacaaggagtggacctttgtgattgaaaatgaaagccccagcggccgcaggaaggccctggccaccagcagcatcaacatgaagcagtatgccagccccatgcccacccagacagatgtgaagctgaagttcaagcccctgagcaagaaggtggtgtctgctgccctgcagttcagcctgagctgcatcttcctgcgggagggcaaggccacagatgaggacatgcagagcctggccagcctgatgtccatgaagcaggccgacatcggcaacctggatgactttgaagaagataatgaagatgatgatgagaacagagtgaaccaggaggagaaggccgccaagatcacagagctgatcaacaagctgaacttcctggatgaagctgagaaggacctggccaccgtgaacagcaacccctttgatgatcctgatgctgctgagctgaacccctttggagaccctgattctgaggagcccatcacagaaacagccagccccaggaagacagaagattccttctacaacaacagctacaaccccttcaaggaggtgcagaccccccagtacctgaacccctttgatgagcctgaggcctttgtgaccatcaaggacagccccccccagagcaccaagaggaagaacatctag

SEQ ID NO: 19453 - DNA, 234 bp, Artificial Sequence
  Description of Artificial Sequence: Synthetic coding sequence
atggcctctgtgtggaagaggctgcagagggtgggcaagcacgccagcaagttccagtttgtggccagctaccaggagctgatggtggagtgcaccaagaagtggcagcctgacaagctggtggtggtgtggacccggcgcagcaggaggaagagcagcaaggcccacagctggcagcccggcatcaagaacccctaccggggcgtggtggtgtggcctgtgcctgagaactag

SEQ ID NO: 19454 - DNA, 3483 bp, Artificial Sequence; identical to SEQ ID NO: 19450
  Description of Artificial Sequence: Synthetic coding sequence

SEQ ID NO: 19455 - DNA, 609 bp, Artificial Sequence
  Description of Artificial Sequence: Synthetic coding sequence
atgaagaggcagaggagcatccaggaggacaccaagaagggaaatgaggagaaggccgccatcacagagacccagaggaagcccagtgaagatgaggtgctgaacaagggcttcaaggacaccagccagtatgtggtgggggagctggccgccctggagaatgagcagaagcagattgacaccagggctgccctggtggagaagaggctgcgctacctgatggacaccggcaggaacacagaggaggaggaggccatgatgcaggagtggttcatgctggtgaacaagaagaatgccctgatccggaggatgaaccagctgagcctgctggagaaggagcatgacctggagcggcgctatgagctgctgaaccgggagctgcgggccatgctggccatcgaggactggcagaagacagaggcccagaagaggcgggagcagctgctgctggatgagctggtggccctggtgaacaagagagatgccctggtgcgggacctggatgcccaggagaagcaggccgaggaggaggatgagcacctggagaggaccctggagcagaacaagggcaagatggccaagaaggaggagaagtgtgtgctgcagtag

SEQ ID NO: 19456 - DNA, 1287 bp, Artificial Sequence
  Description of Artificial Sequence: Synthetic coding sequence
atggaccccagcgtgaccctgtggcagttcctgctgcagctgctgcgggagcagggcaatggccacatcatctcctggaccagcagagatggaggagagttcaagctggtggatgctgaggaggtggcccggctgtggggcctgaggaagaacaagaccaacatgaactatgacaagctgagccgggccctgcgctactactatgacaagaacatcatcaggaaggtgtctggccagaagtttgtgtacaagtttgtgtcctacccagaggtggccggctgcagcacagaggactgccccccccagcctgaggtgtctgtgaccagcaccatgcccaacgtggccccagctgccatccatgctgcccctggggacacagtgtctgggaagccaggcacccccaagggagctggcatggccggccctgggggcctggcccggagcagcagaaatgagtacatgaggagcggcctgtacagcaccttcaccatccagagcctgcagccccagcccccaccccaccccaggcctgctgtggtgctgcccagcgctgccccagctggagctgctgccccacccagcggcagccgcagcaccagccccagccccctggaggcctgcctggaggccgaggaggccggcctgcccctgcaggtgatcctgaccccacctgaggcccccaacctgaagtctgaggagctgaatgtggagcccggcctgggccgggccctgcccccagaggtgaaggtggagggccccaaggaggagctggaggtggccggggagcggggctttgtgcctgagaccaccaaggccgagcctgaggtgcccccccaggagggcgtgcctgcccggctgcctgctgtggtgatggacacagctggccaggccggcggccatgctgccagcagccctgagatcagccagccccagaagggcaggaagccccgggacctggagctgcccctgagccccagcctgctgggcggccctggccctgagaggaccccaggcagcggcagcggcagcggcctgcaggcccctggccctgccctgacccccagcctgctgcccacccacaccctgacccctgtgctgctgacccccagcagcctgcccccatccatccacttctggagcaccctgagccccatcgcccccaggagccctgccaagctgtccttccagttccccagcagcggcagcgcccaggtgcacatccccagcatctctgtggatggcctgagcacccctgtggtgctgagccctggcccccagaagccctag

SEQ ID NO: 19457 - DNA, 288 bp, Artificial Sequence
  Description of Artificial Sequence: Synthetic coding sequence
atggaccccagcgtgaccctgtggcagttcctgctgcagctgctgcgggagcagggcaatggccacatcatctcctggaccagcagagatggaggagagttcaagctggtggatgctgaggaggtggcccggctgtggggcctgaggaagaacaagaccaacatgaactatgacaagctgagccgggccctgcgctactactatgacaagaacatcatcaggaaggtgtctggccagaagtttgtgtacaagtttgtgtcctacccagagagccactgtgccccctag

SEQ ID NO: 19458 - DNA, 1287 bp, Artificial Sequence; identical to SEQ ID NO: 19456
  Description of Artificial Sequence: Synthetic coding sequence

SEQ ID NO: 19459 - DNA, 366 bp, Artificial Sequence
  Description of Artificial Sequence: Synthetic coding sequence
atggacacagctggccaggccggcggccatgctgccagcagccctgagatcagccagccccagaagggcaggaagccccgggacctggagctgcccctgagccccagcctgctgggcggccctggccctgagaggaccccagccctgctgcccacccacaccctgacccctgtgctgctgacccccagcagcctgccccccagcatccacttctggagcaccctgagccccatcgcccccaggagccctgccaagctgtccttccagttccccagcagcggcagcgcccaggtgcacatccccagcatctctgtggatggcctgagcacccctgtggtgctgagccctggcccccagaagccctag

SEQ ID NO: 19460 - DNA, 1713 bp, Artificial Sequence
  Description of Artificial Sequence: Synthetic coding sequence
atgtctgagcagagcatctgccaggcccgggctgctgtgatggtgtatgatgatgccaacaagaagtgggtgcctgctgggggcagcacaggcttcagccgggtgcacatctaccaccacactggaaacaacaccttccgggtggtgggcaggaagatccaggaccaccaggtggtgatcaactgtgccatccccaagggcctgaagtacaaccaggccacccagaccttccaccagtggagagatgcccggcaggtgtatggcctgaactttggcagcaaagaagatgccaacgtgtttgccagcgccatgatgcacgccctggaggtgctgaacagccaggagaccggccccaccctgccccggcagaacagccagctgcctgcccaggtgcagaatggccccagccaggaggagctggagatccagaggcggcagctgcaggagcagcagaggcagaaggagctggagcgggagcggctggagcgggagaggatggagcgggagcggctggagcgggagcggctggagcgggagcggctggagcgggagcggctggagcaggagcagctggagcgggagcggcaggagcgggagcggcaggagcggctggagcggcaggagcggctggagcggcaggagcggctggagcggcaggagcggctggaccgggagcggcaggagcggcaggagcgggagcggctggagcggctggagcgggagcggcaggagcgggagcggcaggagcagctggagcgggagcagctggagtgggagcgggagcggcgcatcagcagcgctgctgccccagcctctgtggagacccccctgaacagcgtgctgggggacagcagcgccagcgagcccggcctgcaggccgccagccagcctgctgagacccccagccagcagggcatcgtgctgggccccctggcccctcctcctcctccacccctgcccccaggccctgcccaggcctctgtggccctgcccccacctcctggccccccacctcctccacccctgcccagcactggacctcctcctcctcctcctcctccacccctgcccaaccaggtgcccccacctcctcctcctcctccagccccacccctgcctgccagcggcttcttcctggcctccatgtctgaggacaaccggcccctgaccggcctggccgccgccatcgccggggccaagctgaggaaggtgtccaggatggaggacaccagcttccccagcggcggcaatgccatcggcgtgaacagcgccagcagcaagacagacaccggcagaggaaatggccccctgcccctgggcggcagcggcctgatggaggagatgtctgccctgctggccaggagaagaagaattgctgagaagggcagcaccattgaaacagagcagaaggaggacaagggagaagattctgagcctgtgaccagcaaggccagcagcaccagcaccccagagcccaccaggaagccctgggagaggaccaacaccatgaatggcagcaagagccctgtgatcagccggcccaagagcacccccctgagccagcccagcgccaatggagtgcagacagagggcctggactatgaccggctgaagcaggacatcctggatgagatgaggaaggagctgaccaagctgaaggaggagctgattgatgccatccggcaggagctgagcaagagcaacacagcctag

SEQ ID NO: 19461 - DNA, 1776 bp, Artificial Sequence
  Description of Artificial Sequence: Synthetic coding sequence
atgtctgagcagagcatctgccaggcccgggctgctgtgatggtgtatgatgatgccaacaagaagtgggtgcctgctgggggcagcacaggcttcagccgggtgcacatctaccaccacactggaaacaacaccttccgggtggtgggcaggaagatccaggaccaccaggtggtgatcaactgtgccatccccaagggcctgaagtacaaccaggccacccagaccttccaccagtggagagatgcccggcaggtgtatggcctgaactttggcagcaaagaagatgccaacgtgtttgccagcgccatgatgcacgccctggaggtgctgaacagccaggagaccggccccaccctgccccggcagaacagccagctgcctgcccaggtgcagaatggccccagccaggaggagctggagatccagaggcggcagctgcaggagcagcagaggcagaaggagctggagcgggagcggctggagcgggagaggatggagcgggagcggctggagcgggagcggctggagcgggagcggctggagcgggagcggctggagcaggagcagctggagcgggagcggcaggagcgggagcggcaggagcggctggagcggcaggagcggctggagcggcaggagcggctggagcggcaggagcggctggaccgggagcggcaggagcggcaggagcgggagcggctggagcggctggagcgggagcggcaggagcgggagcggcaggagcagctggagcgggagcagctggagtgggagcgggagcggcgcatcagcagcgctgctgccccagcctctgtggagacccccctgaacagcgtgctgggggacagcagcgccagcgagcccggcctgcaggccgccagccagcctgctgagacccccagccagcagggcatcgtgctgggccccctggcccctcctcctcctccacccctgcccccaggccctgcccaggcctctgtggccctgcccccacctcctggccccccacctcctccacccctgcccagcactggacctcctcctcctcctcctcctccacccctgcccaaccaggtgcccccacctcctcctcctcctccagccccacccctgcctgccagcggcttcttcctggcctccatgtctgaggacaaccggcccctgaccggcctggccgccgccatcgccggggccaagctgaggaaggtgtccaggatggaggacaccagcttccccagcggcggcaatgccatcggcgtgaacagcgccagcagcaagacagacaccggcagaggaaatggccccctgcccctgggcggcagcggcctgatggaggagatgtctgccctgctggccaggagaagaagaattgctgagaagggcagcaccattgaaacagagcagaaggaggacaagggagaagattctgagcctgtgaccagcaaggccagcagcaccagcaccccagagcccaccaggaagccctgggagaggaccaacaccatgaatggcagcaagagccctgtgatcagcagaagagacagccccaggaagaaccagatcgtgtttgacaacagaagctatgacagcctgcaccggcccaagagcacccccctgagccagcccagcgccaacggggtgcagacagagggcctggactatgaccggctgaagcaggacatcctggatgagatgaggaaggagctgaccaagctgaaggaggagctgattgatgccatccggcaggagctgagcaagagcaacacagcctag

SEQ ID NO: 19462 - DNA, 1599 bp, Artificial Sequence
  Description of Artificial Sequence: Synthetic coding sequence
tctgagcagagcatctgccaggcccgggctgctgtgatggtgtatgatgatgccaacaagaagtgggtgcctgctgggggcagcacaggcttcagccgggtgcacatctaccaccacacaggcaacaacaccttccgggtggtgggcaggaagatccaggaccaccaggtggtgatcaactgtgccatccccaagggcctgaagtacaaccaggccacccagaccttccaccagtggagagatgcccggcaggtgtatggcctgaactttggcagcaaggaggatgccaacgtgtttgccagcgccatgatgcacgccctggaggtgctgaacagccaggagaccggccccaccctgccccggcagaacagccagctgcctgcccaggtgcagaatggccccagccaggaggagctggagatccagaggcggcagctgcaggagcagcagaggcagaaggagctggagcgggagcggctggagcgggagaggatggagcgggagcggctggagcgggagcggctggagcgggagcggctggagcgggagcggctggagcaggagcagctggagcgggagcggcaggagcgggagcggcaggagcggctggagcggcaggagcggctggagcggcaggagcggctggagcggcaggagcggctggaccgggagcggcaggagcggcaggagcgggagcggctggagcggctggagcgggagcggcaggagcgggagcggcaggagcagctggagcgggagcagctggagtgggagcgggagcggcgcatcagcagcgctggcatcgtgctgggccccctggcccctcctcctcctccacccctgcccccaggccctgcccaggcctctgtggccctgcccccacctcctggccccccacctcctccacccctgcccagcactggacctcctcctcctcctcctcctccacccctgcccaaccaggtgcccccacctcctcctcctcctccagccccacccctgcctgccagcggcttcttcctggcctccatgtctgaggacaaccggcccctgaccggcctggccgccgccatcgccggggccaagctgaggaaggtgtccaggatggaggacaccagcttccccagcggcggcaatgccatcggcgtgaacagcgccagcagcaagacagacaccggcagaggaaatggccccctgcccctgggcggcagcggcctgatggaggagatgtctgccctgctggccaggagaagaagaattgctgagaagggcagcaccattgaaacagagcagaaggaggacaagggagaagattctgagcctgtgaccagcaaggccagcagcaccagcaccccagagcccaccaggaagccctgggagaggaccaacaccatgaatggcagcaagagccctgtgatcagccggcccaagagcacccccctgagccagcccagcgccaatggagtgcagacagagggcctggactatgaccggctgaagcaggacatcctggatgagatgaggaaggagctgaccaagctgaaggaggagctgattgatgccatccggcaggagctgagcaagagcaacacagcctag

SEQ ID NO: 19463 - DNA, 1878 bp, Artificial Sequence
  Description of Artificial Sequence: Synthetic coding sequence
atggaccggggcaccctgcccctggccgtggccctgctgctggccagctgcagcctgagccccaccagcctggccgagaccgtgcactgtgacctgcagcctgtgggccctgagcggggggaggtgacctacaccaccagccaggtgtccaagggctgtgtggcccaggccccaaatgccatcctggaggtgcacgtgctcttcctggagttccccaccggccccagccagctggagctgaccctgcaggccagcaagcagaatggcacctggccccgggaggtgctgctggtgctgtctgtgaacagcagcgtcttcctgcacctgcaggccctgggcatccccctgcacctggcctacaacagcagcctggtgaccttccaggagcccccaggagtgaacaccacagagctgcccagcttccccaagacccagatcctggagtgggccgctgagcggggccccatcaccagcgctgctgagctgaatgacccccagagcatcctgctgcggctgggccaggcccagggcagcctgtccttctgcatgctggaggccagccaggacatgggccgcaccctggagtggaggcccaggaccccagccctggtgcggggctgccacctggagggcgtggccggccacaaggaggcccacatcctgcgggtgctgcccggccacagcgctggccccaggacagtgacagtgaaggtggagctgagctgtgcccctggggacctggatgctgtgctgatcctgcagggccccccctacgtgtcctggctgattgatgccaaccacaacatgcagatctggaccaccggggagtacagcttcaagatcttccctgagaagaacatccggggcttcaagctgcctgacaccccccagggcctgctgggggaggccaggatgctgaatgccagcatcgtggccagctttgtggagctgcccctggccagcatcgtgtccctgcacgccagcagctgtggcggccgcctgcagaccagccctgcccccatccagaccaccccacccaaggacacctgcagccctgagctgctgatgagcctcatccagaccaagtgtgctgatgatgccatgaccctggtgctgaagaaggagctggtggcccacctgaagtgcaccatcaccggcctgaccttctgggaccccagctgtgaggctgaagatagaggagacaagtttgtgctgcggagcgcctacagcagctgtggcatgcaggtgtctgcctccatgatcagcaatgaagctgtggtgaacatcctgagcagcagcagcccccagaggaagaaggtgcactgcctgaacatggacagcctgtccttccagctgggcctgtacctgagcccccacttcctgcaggccagcaacaccatcgagcccggccagcagagctttgtgcaggtgcgggtgagccccagcgtgtctgagttcctgctgcagctggacagctgccacctggacctgggccctgagggcggcaccgtggagctgatccagggccgggccgccaagggcaactgtgtgtccctgctgagccccagccctgagggggacccccgcttctccttcctgctgcacttctacacagtgcccatccccaagacaggcaccctgagctgcaccgtggccctgcggcccaagacaggcagccaggaccaggaggtgcacaggacagtgttcatgaggctgaacatcatcagcccagacctgagcggctgcaccagcaagggcctggtgctgcctgctgtgctgggcatcacctttggagccttcctgattggagccctgctgacagctgccctgtggtacatctacagccacacccgggagtaccccaggcctccccagtag

SEQ ID NO: 19464 - DNA, 1977 bp, Artificial Sequence
  Description of Artificial Sequence: Synthetic coding sequence
atggaccggggcaccctgcccctggccgtggccctgctgctggccagctgcagcctgagccccaccagcctggccgagaccgtgcactgtgacctgcagcctgtgggccctgagcggggggaggtgacctacaccaccagccaggtgtccaagggctgtgtggcccaggccccaaatgccatcctggaggtgcacgtgctcttcctggagttccccaccggccccagccagctggagctgaccctgcaggccagcaagcagaatggcacctggccccgggaggtgctgctggtgctgtctgtgaacagcagcgtcttcctgcacctgcaggccctgggcatccccctgcacctggcctacaacagcagcctggtgaccttccaggagcccccaggagtgaacaccacagagctgcccagcttccccaagacccagatcctggagtgggccgctgagcggggccccatcaccagcgctgctgagctgaatgacccccagagcatcctgctgcggctgggccaggcccagggcagcctgtccttctgcatgctggaggccagccaggacatgggccgcaccctggagtggaggcccaggaccccagccctggtgcggggctgccacctggagggcgtggccggccacaaggaggcccacatcctgcgggtgctgcccggccacagcgctggccccaggacagtgacagtgaaggtggagctgagctgtgcccctggggacctggatgctgtgctgatcctgcagggccccccctacgtgtcctggctgattgatgccaaccacaacatgcagatctggaccaccggggagtacagcttcaagatcttccctgagaagaacatccggggcttcaagctgcctgacaccccccagggcctgctgggggaggccaggatgctgaatgccagcatcgtggccagctttgtggagctgcccctggccagcatcgtgtccctgcacgccagcagctgtggcggccgcctgcagaccagccctgcccccatccagaccaccccacccaaggacacctgcagccctgagctgctgatgagcctcatccagaccaagtgtgctgatgatgccatgaccctggtgctgaagaaggagctggtggcccacctgaagtgcaccatcaccggcctgaccttctgggaccccagctgtgaggctgaagatagaggagacaagtttgtgctgcggagcgcctacagcagctgtggcatgcaggtgtctgcctccatgatcagcaatgaagctgtggtgaacatcctgagcagcagcagcccccagaggaagaaggtgcactgcctgaacatggacagcctgtccttccagctgggcctgtacctgagcccccacttcctgcaggccagcaacaccatcgagcccggccagcagagctttgtgcaggtgcgggtgagccccagcgtgtctgagttcctgctgcagctggacagctgccacctggacctgggccctgagggcggcaccgtggagctgatccagggccgggccgccaagggcaactgtgtgtccctgctgagccccagccctgagggggacccccgcttctccttcctgctgcacttctacacagtgcccatccccaagacaggcaccctgagctgcaccgtggccctgcggcccaagacaggcagccaggaccaggaggtgcacaggacagtgttcatgaggctgaacatcatcagcccagacctgagcggctgcaccagcaagggcctggtgctgcctgctgtgctgggcatcacctttggagccttcctgattggagccctgctgacagctgccctgtggtacatctacagccacaccaggagccccagcaagcgggagcctgtggtggccgtggccgccccagccagcagcgagagcagcagcaccaaccacagcatcggcagcacccagagcaccccctgcagcaccagctccatggcctag

SEQ ID NO: 19465 - DNA, 1977 bp, Artificial Sequence; identical to SEQ ID NO: 19464
  Description of Artificial Sequence: Synthetic coding sequence

SEQ ID NO: 19466 - DNA, 1431 bp, Artificial Sequence
  Description of Artificial Sequence: Synthetic coding sequence
atgctggaggccagccaggacatgggccgcaccctggagtggaggcccaggaccccagccctggtgcggggctgccacctggagggcgtggccggccacaaggaggcccacatcctgcgggtgctgcccggccacagcgctggccccaggacagtgacagtgaaggtggagctgagctgtgcccctggggacctggatgctgtgctgatcctgcagggccccccctacgtgtcctggctgattgatgccaaccacaacatgcagatctggaccaccggggagtacagcttcaagatcttccctgagaagaacatccggggcttcaagctgcctgacaccccccagggcctgctgggggaggccaggatgctgaatgccagcatcgtggccagctttgtggagctgcccctggccagcatcgtgtccctgcacgccagcagctgtggcggccgcctgcagaccagccctgcccccatccagaccaccccacccaaggacacctgcagccctgagctgctgatgagcctcatccagaccaagtgtgctgatgatgccatgaccctggtgctgaagaaggagctggtggcccacctgaagtgcaccatcaccggcctgaccttctgggaccccagctgtgaggctgaagatagaggagacaagtttgtgctgcggagcgcctacagcagctgtggcatgcaggtgtctgcctccatgatcagcaatgaagctgtggtgaacatcctgagcagcagcagcccccagaggaagaaggtgcactgcctgaacatggacagcctgtccttccagctgggcctgtacctgagcccccacttcctgcaggccagcaacaccatcgagcccggccagcagagctttgtgcaggtgcgggtgagccccagcgtgtctgagttcctgctgcagctggacagctgccacctggacctgggccctgagggcggcaccgtggagctgatccagggccgggccgccaagggcaactgtgtgtccctgctgagccccagccctgagggggacccccgcttctccttcctgctgcacttctacacagtgcccatccccaagacaggcaccctgagctgcaccgtggccctgcggcccaagacaggcagccaggaccaggaggtgcacaggacagtgttcatgaggctgaacatcatcagcccagacctgagcggctgcaccagcaagggcctggtgctgcctgctgtgctgggcatcacctttggagccttcctgattggagccctgctgacagctgccctgtggtacatctacagccacaccaggagccccagcaagcgggagcctgtggtggccgtggccgccccagccagcagcgagagcagcagcaccaaccacagcatcggcagcacccagagcaccccctgcagcaccagctccatggcctag

SEQ ID NO: 19467 - DNA, 639 bp, Artificial Sequence
  Description of Artificial Sequence: Synthetic coding sequence
atggactacctgctgatgatcttcagcctgctgtttgtggcctgccagggcgcccctgagacagctgtgctgggcgctgagctgtctgctgtgggagaaaatggaggagagaagcccacccccagccccccctggaggctgcggcgcagcaagcgctgcagctgcagcagcctgatggacaaggaatgtgtgtacttctgccacctggacatcatctgggtgaacaccccagagcacgtggtgccctacggcctgggcagccccaggagcaagagggccctggagaacctgctgcccaccaaggccacagaccgggagaaccgctgccagtgtgccagccagaaggacaagaagtgctggaacttctgccaggccggcaaggagctgcgggcagaggacatcatggagaaggactggaacaaccacaagaagggcaaggactgcagcaagctgggcaagaagtgcatctaccagcagctggtgcggggcaggaagatcagaagaagcagcgaggagcacctgcggcagaccaggtctgagaccatgagaaattctgtgaagagcagcttccatgaccccaagctgaagggcaagcccagccgggagcgctacgtgacccacaacagagcccactggtag

SEQ ID NO: 19468 - DNA, 1329 bp, Artificial Sequence
  Description of Artificial Sequence: Synthetic coding sequence
atgcagcccccacccagcctgtgtggccgggccctggtggccctggtgctggcctgtggcctgagccgcatctggggcgaggagcggggcttccccccagaccgggccacccccctgctgcagacagctgagatcatgaccccacccaccaagaccctgtggcccaagggcagcaatgccagcctggcccggagcctggccccagctgaggtgcccaagggggacagaacagctggcagcccccccaggaccatcagccccccaccctgccagggccccatcgagatcaaggagaccttcaagtacatcaacacagtggtgtcctgcctggtgtttgtgctgggcatcatcggcaacagcaccctgctgcgcatcatctacaagaacaagtgcatgagaaatggccccaacatcctgattgccagcctggccctgggggacctgctgcacatcgtgattgacatccccatcaacgtgtacaagctgctggccgaggactggccctttggagctgagatgtgcaagctggtgcccttcatccagaaggcctctgtgggcatcaccgtgctgagcctgtgtgccctgagcattgaccgctacagagctgtggcctcctggagccgcatcaagggcatcggcgtgcccaagtggacagctgtggagatcgtgctgatctgggtggtgtctgtggtgctggccgtgcctgaggccatcggctttgacatcatcaccatggactacaagggcagctacctgcgcatctgcctgctgcaccctgtgcagaagacagccttcatgcagttctacaagacagccaaggactggtggctgttctccttctacttctgcctgcccctggccatcacagccttcttctacaccctgatgacctgtgagatgctgaggaagaagagcggcatgcagatcgccctgaatgaccacctgaagcagaggcgggaggtggccaagacagtgttctgcctggtgctggtgtttgccctgtgctggctgcccctgcacctgagccgcatcctgaagctgaccctgtacaaccagaatgaccccaacagatgtgagctgctgtccttcctgctggtgctggactacatcggcatcaacatggccagcctgaacagctgcatcaaccccatcgccctgtacctggtgtccaagcgcttcaagaactgcttcaagagctgcctgtgctgctggtgccagagctttgaggagaagcagagcctggaggagaagcagagctgcctgaagttcaaggccaatgaccacggctatgacaacttccgcagcagcaacaagtacagcagcagctag

SEQ ID NO: 19469 - DNA, 1599 bp, Artificial Sequence
  Description of Artificial Sequence: Synthetic coding sequence
atgaacaagagcacctgcctgatggctgctgagacccccagcaagcgctggaggctgcactgcctggccttcagccagagatttgtgcgggccggccctgcctgcagcagccgggaggcctgcagcagcccccgggccggctggaacccagctggcttccggctgcccggccgctggagcccctttgtggccctgcacctggtgtgccagatccgggaggccctgaagctgcggagcggccacaggaccccatctggagctggcagctccatgcagcccccacccagcctgtgtggccgggccctggtggccctggtgctggcctgtggcctgagccgcatctggggcgaggagcggggcttccccccagaccgggccacccccctgctgcagacagctgagatcatgaccccacccaccaagaccctgtggcccaagggcagcaatgccagcctggcccggagcctggccccagctgaggtgcccaagggggacagaacagctggcagcccccccaggaccatcagccccccaccctgccagggccccatcgagatcaaggagaccttcaagtacatcaacacagtggtgtcctgcctggtgtttgtgctgggcatcatcggcaacagcaccctgctgcgcatcatctacaagaacaagtgcatgagaaatggccccaacatcctgattgccagcctggccctgggggacctgctgcacatcgtgattgacatccccatcaacgtgtacaagctgctggccgaggactggccctttggagctgagatgtgcaagctggtgcccttcatccagaaggcctctgtgggcatcaccgtgctgagcctgtgtgccctgagcattgaccgctacagagctgtggcctcctggagccgcatcaagggcatcggcgtgcccaagtggacagctgtggagatcgtgctgatctgggtggtgtctgtggtgctggccgtgcctgaggccatcggctttgacatcatcaccatggactacaagggcagctacctgcgcatctgcctgctgcaccctgtgcagaagacagccttcatgcagttctacaagacagccaaggactggtggctgttctccttctacttctgcctgcccctggccatcacagccttcttctacaccctgatgacctgtgagatgctgaggaagaagagcggcatgcagatcgccctgaatgaccacctgaagcagaggcgggaggtggccaagacagtgttctgcctggtgctggtgtttgccctgtgctggctgcccctgcacctgagccgcatcctgaagctgaccctgtacaaccagaatgaccccaacagatgtgagctgctgtccttcctgctggtgctggactacatcggcatcaacatggccagcctgaacagctgcatcaaccccatcgccctgtacctggtgtccaagcgcttcaagaactgcttcaagagctgcctgtgctgctggtgccagagctttgaggagaagcagagcctggaggagaagcagagctgcctgaagttcaaggccaatgaccacggctatgacaacttccgcagcagcaacaagtacagcagcagctag

SEQ ID NO: 19470 - DNA, 1311 bp, Artificial Sequence
  Description of Artificial Sequence: Synthetic coding sequence
atgcagcccccacccagcctgtgtggccgggccctggtggccctggtgctggcctgtggcctgagccgcatctggggcgaggagcggggcttccccccagaccgggccacccccctgctgcagacagctgagatcatgaccccacccaccaagaccctgtggcccaagggcagcaatgccagcctggcccggagcctggccccagctgaggtgcccaagggggacagaacagctggcagcccccccaggaccatcagccccccaccctgccagggccccatcgagatcaaggagaccttcaagtacatcaacacagtggtgtcctgcctggtgtttgtgctgggcatcatcggcaacagcaccctgctgcgcatcatctacaagaacaagtgcatgagaaatggccccaacatcctgattgccagcctggccctgggggacctgctgcacatcgtgattgacatccccatcaacgtgtacaagctgctggccgaggactggccctttggagctgagatgtgcaagctggtgcccttcatccagaaggcctctgtgggcatcaccgtgctgagcctgtgtgccctgagcattgaccgctacagagctgtggcctcctggagccgcatcaagggcatcggcgtgcccaagtggacagctgtggagatcgtgctgatctgggtggtgtctgtggtgctggccgtgcctgaggccatcggctttgacatcatcaccatggactacaagggcagctacctgcgcatctgcctgctgcaccctgtgcagaagacagccttcatgcagttctacaagacagccaaggactggtggctgttctccttctacttctgcctgcccctggccatcacagccttcttctacaccctgatgacctgtgagatgctgaggaagaagagcggcatgcagatcgccctgaatgaccacctgaagcagaggcgggaggtggccaagacagtgttctgcctggtgctggtgtttgccctgtgctggctgcccctgcacctgagccgcatcctgaagctgaccctgtacaaccagaatgaccccaacagatgtgagctgctgtccttcctgctggtgctggactacatcggcatcaacatggccagcctgaacagctgcatcaaccccatcgccctgtacctggtgtccaagcgcttcaagaactgcttcaaggccggcccccacgtgggcaacaagctggtgatgctgttctctgtgaacattgaatgtgatggcaccgtgaaccagaaccccaccatgtggccagagaggaagagcaacaacaactag

SEQ ID NO: 19471 - DNA, 2787 bp, Artificial Sequence
  Description of Artificial Sequence: Synthetic coding sequence
atggccctgcggcggctgggcgccgccctgctgctgctgcccctgctggccgctgtggaggagaccctgatggacagcaccacagccacagctgagctgggctggatggtgcaccccccatctggctgggaggaggtgtctggctatgatgagaacatgaacaccatccgcacctaccaggtgtgcaatgtgtttgagagcagccagaacaactggctgcggaccaagttcatcagaagaagaggagcccaccgcatccacgtggagatgaagttctctgtgcgggactgcagcagcatccccagcgtgcccggcagctgcaaggagaccttcaacctgtactactatgaggccgactttgacagcgccaccaagaccttccccaactggatggagaacccctgggtgaaggtggacaccatcgctgctgatgagagcttcagccaggtggacctgggcggccgggtgatgaagatcaacacagaggtgcgcagctttggacctgtgagccgcagcggcttctacctggccttccaggactatggaggctgcatgagcctgattgctgtgcgggtcttctacaggaagtgcccccgcatcatccagaatggagccatcttccaggagaccctgagcggggctgagagcaccagcctggtggccgcccggggcagctgcatcgccaatgctgaggaggtggatgtgcccatcaagctgtactgcaatggagatggagagtggctggtgcccatcggccgctgcatgtgcaaggccggctttgaggccgtggagaatggaacagtgtgccggggctgccccagcggcaccttcaaggccaaccagggagatgaggcctgcacccactgccccatcaacagcaggaccaccagcgagggcgccaccaactgtgtgtgcagaaatggctactacagagctgacctggaccccctggacatgccctgcaccaccatccccagcgccccccaggccgtcatcagctctgtgaatgagaccagcctgatgctggagtggaccccaccccgggacagcggcggccgggaggacctggtgtacaacatcatctgcaagagctgtggcagcggccgcggggcctgcacccgctgtggggacaacgtgcagtatgccccccggcagctgggcctgacagagccccgcatctacatcagtgacctgctggcccacacccagtacacctttgagatccaggccgtgaatggagtgacagaccagagccccttcagcccccagtttgcctctgtgaacatcaccaccaaccaggccgcccccagcgctgtgtccatcatgcaccaggtgtccaggacagtggacagcatcaccctgtcctggagccagcctgaccagcccaatggagtcatcctggactatgagctgcagtactatgagaaggagctgtctgagtacaatgccacagccatcaagagccccaccaacacagtgacagtgcagggcctgaaggccggggccatctacgtgttccaggtgcgggccaggacagtggccggctacggccgctacagcggcaagatgtacttccagaccatgacagaggtgaccccaggcatgaagatctacatcgaccccttcacctatgaggaccccaatgaggccgtgcgggagtttgccaaggagattgacatcagctgtgtgaagattgagcaggtgattggagctggggagtttggagaggtgtgcagcggccacctgaagctgcccgggaagcgggagatctttgtggccatcaagaccctgaagagcggctacacagagaagcagaggcgggacttcctgtctgaggccagcatcatgggccagtttgaccaccccaacgtcatccacctggagggcgtggtgaccaagagcacccctgtgatgatcatcacagagttcatggagaatggcagcctggacagcttcctgcggcagaatgatggccagttcaccgtcatccagctggtgggcatgctgcggggcattgctgctggcatgaagtacctggccgacatgaactacgtgcaccgggacctggccgccaggaacatcctggtgaacagcaacctggtgtgcaaggtgtctgactttggcctgagccgcttcctggaggatgacaccagtgaccccacctacaccagcgccctgggcggcaagatccccatccgctggacagcccctgaggccatccagtacaggaagttcaccagcgccagtgatgtgtggagctatggcatcgtgatgtgggaggtgatgtcctatggagagcggccctactgggacatgaccaaccaggacgtcatcaatgccatcgagcaggactaccgcctgcccccacccatggactgccccagcgccctgcaccagctgatgctggactgctggcagaaggacaggaaccaccggcccaagtttggccagatcgtgaacaccctggacaagatgatccggaaccccaacagcctgaaggccatggcccccctgagcagcggcatcaacctgcccctgctggacaggaccatcccagactacaccagcttcaacacagtggatgagtggctggaggccatcaagatgggccagtacaaggagagctttgccaatgccggcttcaccagctttgatgtggtgtcccagatgatgatggaggacatcctgcgggtgggcgtgaccctggccggccaccagaagaagatcctgaacagcatccaggtgatgagggcccagatgaaccagatccagagcgtggaggtgtag
